United States Patent 12,624,385 (RIBOREGULATORS AND METHODS OF USE THEREOF) - sequence listing, part 13

SEQ ID NO: 205430 - DNA, 103 bp, Artificial Sequence
  Synthetic Polynucleotide
taatacgactcactatagggtcagcaggctgaatgctcatgtacggttctaacagaggagaagaaccatgcatgagcataacctggcggcagcgcaaaagatg

SEQ ID NO: 205431 - DNA, 103 bp, Artificial Sequence
  Synthetic Polynucleotide
taatacgactcactatagggatctggatcttcagcaggctgaatgctcataacagaggagaatgagcatgcagcctgctaacctggcggcagcgcaaaagatg

SEQ ID NO: 205432 - DNA, 103 bp, Artificial Sequence
  Synthetic Polynucleotide
taatacgactcactatagggcatcataatcatctggatcttcagcaggctaacagaggagaagcctgatgaagatccagaacctggcggcagcgcaaaagatg

SEQ ID NO: 205433 - DNA, 103 bp, Artificial Sequence
  Synthetic Polynucleotide
taatacgactcactataggggaaaagccatcatcataatcatctggatctaacagaggagaagatccatgtgattatgaaacctggcggcagcgcaaaagatg

SEQ ID NO: 205434 - DNA, 103 bp, Artificial Sequence
  Synthetic Polynucleotide
taatacgactcactatagggatgcttcattgaaaagccatcatcataatcaacagaggagagattatatggatggctttaacctggcggcagcgcaaaagatg

SEQ ID NO: 205435 - DNA, 103 bp, Artificial Sequence
  Synthetic Polynucleotide
taatacgactcactatagggcggtggctgtatgcttcattgaaaagccataacagaggagaatggctatgcaatgaagcaacctggcggcagcgcaaaagatg

SEQ ID NO: 205436 - DNA, 103 bp, Artificial Sequence
  Synthetic Polynucleotide
taatacgactcactatagggtggaaacgggcggtggctgtatgcttcattaacagaggagaaatgaaatgtacagccacaacctggcggcagcgcaaaagatg

SEQ ID NO: 205437 - DNA, 103 bp, Artificial Sequence
  Synthetic Polynucleotide
taatacgactcactataggggtggtttctctggaaacgggcggtggctgtaacagaggagaacagccatggcccgtttcaacctggcggcagcgcaaaagatg

SEQ ID NO: 205438 - DNA, 103 bp, Artificial Sequence
  Synthetic Polynucleotide
taatacgactcactatagggtgatgaggcggtggtttctctggaaacgggaacagaggagacccgttatgagagaaaccaacctggcggcagcgcaaaagatg

SEQ ID NO: 205439 - DNA, 103 bp, Artificial Sequence
  Synthetic Polynucleotide
taatacgactcactatagggcccacaaaccctggtgtgctgggcatttgtaacagaggagaacaaatatgcagcacaccaacctggcggcagcgcaaaagatg

SEQ ID NO: 205440 - DNA, 103 bp, Artificial Sequence
  Synthetic Polynucleotide
taatacgactcactatagggagaatttcactgatgaggcggtggtttctcaacagaggagagagaaaatgccgcctcataacctggcggcagcgcaaaagatg

SEQ ID NO: 205441 - DNA, 103 bp, Artificial Sequence
  Synthetic Polynucleotide
taatacgactcactatagggactctcactaagaatttcactgatgaggcgaacagaggagacgcctcatgagtgaaattaacctggcggcagcgcaaaagatg

SEQ ID NO: 205442 - DNA, 103 bp, Artificial Sequence
  Synthetic Polynucleotide
taatacgactcactatagggctggcaccacactctcactaagaatttcacaacagaggagagtgaaaatgttagtgagaaacctggcggcagcgcaaaagatg

SEQ ID NO: 205443 - DNA, 103 bp, Artificial Sequence
  Synthetic Polynucleotide
taatacgactcactataggggaccgaacgtctggcaccacactctcactaaacagaggagatagtgaatgtgtggtgccaacctggcggcagcgcaaaagatg

SEQ ID NO: 205444 - DNA, 103 bp, Artificial Sequence
  Synthetic Polynucleotide
taatacgactcactatagggtgtgacaactgaccgaacgtctggcaccacaacagaggagagtggtgatggacgttcggaacctggcggcagcgcaaaagatg

SEQ ID NO: 205445 - DNA, 103 bp, Artificial Sequence
  Synthetic Polynucleotide
taatacgactcactatagggttctagctgttgtgacaactgaccgaacgtaacagaggagaacgttcatgcagttgtcaaacctggcggcagcgcaaaagatg

SEQ ID NO: 205446 - DNA, 103 bp, Artificial Sequence
  Synthetic Polynucleotide
taatacgactcactatagggaggacctgcattctagctgttgtgacaactaacagaggagaagttgtatgaacagctagaacctggcggcagcgcaaaagatg

SEQ ID NO: 205447 - DNA, 103 bp, Artificial Sequence
  Synthetic Polynucleotide
taatacgactcactatagggctgccgtttgaggacctgcattctagctgtaacagaggagaacagctatgatgcaggtcaacctggcggcagcgcaaaagatg

SEQ ID NO: 205448 - DNA, 103 bp, Artificial Sequence
  Synthetic Polynucleotide
taatacgactcactatagggaggactggacctgccgtttgaggacctgcaaacagaggagatgcaggatgtcaaacggcaacctggcggcagcgcaaaagatg

SEQ ID NO: 205449 - DNA, 103 bp, Artificial Sequence
  Synthetic Polynucleotide
taatacgactcactatagggtgaaccattaaggactggacctgccgtttgaacagaggagacaaacgatgggtccagtcaacctggcggcagcgcaaaagatg

SEQ ID NO: 205450 - DNA, 103 bp, Artificial Sequence
  Synthetic Polynucleotide
taatacgactcactatagggtggattgtatcccacaaaccctggtgtgctaacagaggagaagcacaatggggtttgtgaacctggcggcagcgcaaaagatg

SEQ ID NO: 205451 - DNA, 103 bp, Artificial Sequence
  Synthetic Polynucleotide
taatacgactcactatagggttttcgctgatgaaccattaaggactggacaacagaggagagtccagatgttaatggttaacctggcggcagcgcaaaagatg

SEQ ID NO: 205452 - DNA, 103 bp, Artificial Sequence
  Synthetic Polynucleotide
taatacgactcactatagggcagcttctagttttcgctgatgaaccattaaacagaggagataatggatgatcagcgaaaacctggcggcagcgcaaaagatg

SEQ ID NO: 205453 - DNA, 103 bp, Artificial Sequence
  Synthetic Polynucleotide
taatacgactcactatagggtgaagaagttcagcttctagttttcgctgaaacagaggagatcagcgatgactagaagcaacctggcggcagcgcaaaagatg

SEQ ID NO: 205454 - DNA, 103 bp, Artificial Sequence
  Synthetic Polynucleotide
taatacgactcactatagggttcctctatttgaagaagttcagcttctagaacagaggagactagaaatggaacttcttaacctggcggcagcgcaaaagatg

SEQ ID NO: 205455 - DNA, 103 bp, Artificial Sequence
  Synthetic Polynucleotide
taatacgactcactatagggcctggtgtcgttcctctatttgaagaagttaacagaggagaaacttcatgaaatagaggaacctggcggcagcgcaaaagatg

SEQ ID NO: 205456 - DNA, 103 bp, Artificial Sequence
  Synthetic Polynucleotide
taatacgactcactatagggctcttcttctcctggtgtcgttcctctattaacagaggagaaatagaatgacgacaccaaacctggcggcagcgcaaaagatg

SEQ ID NO: 205457 - DNA, 103 bp, Artificial Sequence
  Synthetic Polynucleotide
taatacgactcactatagggcaggaatttcctcttcttctcctggtgtcgaacagaggagacgacacatggagaagaagaacctggcggcagcgcaaaagatg

SEQ ID NO: 205458 - DNA, 103 bp, Artificial Sequence
  Synthetic Polynucleotide
taatacgactcactatagggctgtgctttccaggaatttcctcttcttctaacagaggagaagaagaatgggaaattccaacctggcggcagcgcaaaagatg

SEQ ID NO: 205459 - DNA, 103 bp, Artificial Sequence
  Synthetic Polynucleotide
taatacgactcactatagggttaaatgaatctgtgctttccaggaatttcaacagaggagagaaattatgggaaagcacaacctggcggcagcgcaaaagatg

SEQ ID NO: 205460 - DNA, 103 bp, Artificial Sequence
  Synthetic Polynucleotide
taatacgactcactatagggaagttcattgttaaatgaatctgtgctttcaacagaggagagaaagcatggattcatttaacctggcggcagcgcaaaagatg

SEQ ID NO: 205461 - DNA, 103 bp, Artificial Sequence
  Synthetic Polynucleotide
taatacgactcactataggggatgactgtatggattgtatcccacaaaccaacagaggagaggtttgatggatacaatcaacctggcggcagcgcaaaagatg

SEQ ID NO: 205462 - DNA, 103 bp, Artificial Sequence
  Synthetic Polynucleotide
taatacgactcactatagggacaaccttttaagttcattgttaaatgaataacagaggagaattcatatgacaatgaacaacctggcggcagcgcaaaagatg

SEQ ID NO: 205463 - DNA, 103 bp, Artificial Sequence
  Synthetic Polynucleotide
taatacgactcactatagggttcagaccgcacaaccttttaagttcattgaacagaggagacaatgaatgtaaaaggttaacctggcggcagcgcaaaagatg

SEQ ID NO: 205464 - DNA, 103 bp, Artificial Sequence
  Synthetic Polynucleotide
taatacgactcactatagggcacttctactttcagaccgcacaaccttttaacagaggagaaaaaggatgtgcggtctgaacctggcggcagcgcaaaagatg

SEQ ID NO: 205465 - DNA, 103 bp, Artificial Sequence
  Synthetic Polynucleotide
taatacgactcactatagggtctccatatccacttctactttcagaccgcaacagaggagagcggtcatgaagtagaagaacctggcggcagcgcaaaagatg

SEQ ID NO: 205466 - DNA, 103 bp, Artificial Sequence
  Synthetic Polynucleotide
taatacgactcactataggggctgcaattttctccatatccacttctactaacagaggagaagtagaatgggatatggaaacctggcggcagcgcaaaagatg

SEQ ID NO: 205467 - DNA, 103 bp, Artificial Sequence
  Synthetic Polynucleotide
taatacgactcactatagggtgcaatctcagctgcaattttctccatatcaacagaggagagatatgatgaaaattgcaaacctggcggcagcgcaaaagatg

SEQ ID NO: 205468 - DNA, 103 bp, Artificial Sequence
  Synthetic Polynucleotide
taatacgactcactatagggcctctgcctgtgcaatctcagctgcaatttaacagaggagaaaattgatgctgagattgaacctggcggcagcgcaaaagatg

SEQ ID NO: 205469 - DNA, 103 bp, Artificial Sequence
  Synthetic Polynucleotide
taatacgactcactatagggcgggcctgttcctctgcctgtgcaatctcaaacagaggagatgagatatgacaggcagaaacctggcggcagcgcaaaagatg

SEQ ID NO: 205470 - DNA, 103 bp, Artificial Sequence
  Synthetic Polynucleotide
taatacgactcactatagggctgccttttgcgggcctgttcctctgcctgaacagaggagacaggcaatggaacaggccaacctggcggcagcgcaaaagatg

SEQ ID NO: 205471 - DNA, 103 bp, Artificial Sequence
  Synthetic Polynucleotide
taatacgactcactatagggccctttcctcctgccttttgcgggcctgttaacagaggagaaacaggatggcaaaaggcaacctggcggcagcgcaaaagatg

SEQ ID NO: 205472 - DNA, 103 bp, Artificial Sequence
  Synthetic Polynucleotide
taatacgactcactatagggttgtaggcgagatgactgtatggattgtataacagaggagaatacaaatgatacagtcaaacctggcggcagcgcaaaagatg

SEQ ID NO: 205473 - DNA, 103 bp, Artificial Sequence
  Synthetic Polynucleotide
taatacgactcactataggggcctccttctccctttcctcctgccttttgaacagaggagacaaaagatgggaggaaagaacctggcggcagcgcaaaagatg

SEQ ID NO: 205474 - DNA, 103 bp, Artificial Sequence
  Synthetic Polynucleotide
taatacgactcactatagggttgctctgcggcctccttctccctttcctcaacagaggagagaggaaatggagaaggagaacctggcggcagcgcaaaagatg

SEQ ID NO: 205475 - DNA, 103 bp, Artificial Sequence
  Synthetic Polynucleotide
taatacgactcactatagggtgcgctcagcttgctctgcggcctccttctaacagaggagaagaaggatgccgcagagcaacctggcggcagcgcaaaagatg

SEQ ID NO: 205476 - DNA, 103 bp, Artificial Sequence
  Synthetic Polynucleotide
taatacgactcactatagggctgctctgactgcgctcagcttgctctgcgaacagaggagacgcagaatgagctgagcgaacctggcggcagcgcaaaagatg

SEQ ID NO: 205477 - DNA, 103 bp, Artificial Sequence
  Synthetic Polynucleotide
taatacgactcactatagggaggaacgatgctgctctgactgcgctcagcaacagaggagagctgagatgagtcagagcaacctggcggcagcgcaaaagatg

SEQ ID NO: 205478 - DNA, 103 bp, Artificial Sequence
  Synthetic Polynucleotide
taatacgactcactataggggttcttcctcaggaacgatgctgctctgacaacagaggagagtcagaatggcatcgttcaacctggcggcagcgcaaaagatg

SEQ ID NO: 205479 - DNA, 103 bp, Artificial Sequence
  Synthetic Polynucleotide
taatacgactcactatagggttagctgcttgttcttcctcaggaacgatgaacagaggagacatcgtatgtgaggaagaaacctggcggcagcgcaaaagatg

SEQ ID NO: 205480 - DNA, 103 bp, Artificial Sequence
  Synthetic Polynucleotide
taatacgactcactatagggctcgcctttgttagctgcttgttcttcctcaacagaggagagaggaaatgcaagcagctaacctggcggcagcgcaaaagatg

SEQ ID NO: 205481 - DNA, 103 bp, Artificial Sequence
  Synthetic Polynucleotide
taatacgactcactatagggctttcttctcctcgcctttgttagctgcttaacagaggagaaagcagatgacaaaggcgaacctggcggcagcgcaaaagatg

SEQ ID NO: 205482 - DNA, 103 bp, Artificial Sequence
  Synthetic Polynucleotide
taatacgactcactatagggttctcgtcgtctttcttctcctcgcctttgaacagaggagacaaaggatgggagaagaaaacctggcggcagcgcaaaagatg

SEQ ID NO: 205483 - DNA, 103 bp, Artificial Sequence
  Synthetic Polynucleotide
taatacgactcactatagggtgcgaacttttccaccttcagcggctccataacagaggagaatggagatgctgaaggtgaacctggcggcagcgcaaaagatg

SEQ ID NO: 205484 - DNA, 103 bp, Artificial Sequence
  Synthetic Polynucleotide
taatacgactcactatagggcaccgtgtacgccaagggatccgagcggaaaacagaggagattccgcatggatcccttgaacctggcggcagcgcaaaagatg

SEQ ID NO: 205485 - DNA, 103 bp, Artificial Sequence
  Synthetic Polynucleotide
taatacgactcactataggggttgatgcaggcatccatggcgcagtcgagaacagaggagactcgacatggccatggataacctggcggcagcgcaaaagatg

SEQ ID NO: 205486 - DNA, 103 bp, Artificial Sequence
  Synthetic Polynucleotide
taatacgactcactatagggacaggccgaggttgatgcaggcatccatggaacagaggagaccatggatgcctgcatcaaacctggcggcagcgcaaaagatg

SEQ ID NO: 205487 - DNA, 103 bp, Artificial Sequence
  Synthetic Polynucleotide
taatacgactcactataggggcttcctccaacaggccgaggttgatgcagaacagaggagactgcatatgcctcggcctaacctggcggcagcgcaaaagatg

SEQ ID NO: 205488 - DNA, 103 bp, Artificial Sequence
  Synthetic Polynucleotide
taatacgactcactatagggatagaacaaggcttcctccaacaggccgagaacagaggagactcggcatgttggaggaaaacctggcggcagcgcaaaagatg

SEQ ID NO: 205489 - DNA, 103 bp, Artificial Sequence
  Synthetic Polynucleotide
taatacgactcactatagggtccgagtaccatagaacaaggcttcctccaaacagaggagatggaggatgccttgttctaacctggcggcagcgcaaaagatg

SEQ ID NO: 205490 - DNA, 103 bp, Artificial Sequence
  Synthetic Polynucleotide
taatacgactcactatagggggctccatggtccgagtaccatagaacaagaacagaggagacttgttatgtggtactcgaacctggcggcagcgcaaaagatg

SEQ ID NO: 205491 - DNA, 103 bp, Artificial Sequence
  Synthetic Polynucleotide
taatacgactcactatagggaatcctgtatggctccatggtccgagtaccaacagaggagaggtactatgaccatggagaacctggcggcagcgcaaaagatg

SEQ ID NO: 205492 - DNA, 103 bp, Artificial Sequence
  Synthetic Polynucleotide
taatacgactcactatagggctgggaaaaaaatcctgtatggctccatggaacagaggagaccatggatgcatacaggaaacctggcggcagcgcaaaagatg

SEQ ID NO: 205493 - DNA, 103 bp, Artificial Sequence
  Synthetic Polynucleotide
taatacgactcactatagggggatggcttcctgggaaaaaaatcctgtataacagaggagaatacagatgttttttcccaacctggcggcagcgcaaaagatg

SEQ ID NO: 205494 - DNA, 103 bp, Artificial Sequence
  Synthetic Polynucleotide
taatacgactcactatagggccctctgacgggatggcttcctgggaaaaaaacagaggagatttttcatgggaagccataacctggcggcagcgcaaaagatg

SEQ ID NO: 205495 - DNA, 103 bp, Artificial Sequence
  Synthetic Polynucleotide
taatacgactcactatagggtccccttgcacaccgtgtacgccaagggataacagaggagaatccctatgcgtacacggaacctggcggcagcgcaaaagatg

SEQ ID NO: 205496 - DNA, 103 bp, Artificial Sequence
  Synthetic Polynucleotide
taatacgactcactatagggtcacttgaacccctctgacgggatggcttcaacagaggagagaagccatgccgtcagagaacctggcggcagcgcaaaagatg

SEQ ID NO: 205497 - DNA, 103 bp, Artificial Sequence
  Synthetic Polynucleotide
taatacgactcactatagggccaactttcatcacttgaacccctctgacgaacagaggagacgtcagatgggttcaagtaacctggcggcagcgcaaaagatg

SEQ ID NO: 205498 - DNA, 103 bp, Artificial Sequence
  Synthetic Polynucleotide
taatacgactcactatagggctgcagtttgccaactttcatcacttgaacaacagaggagagttcaaatgatgaaagttaacctggcggcagcgcaaaagatg

SEQ ID NO: 205499 - DNA, 103 bp, Artificial Sequence
  Synthetic Polynucleotide
taatacgactcactatagggcttgatgtagctgcagtttgccaactttcaaacagaggagatgaaagatggcaaactgcaacctggcggcagcgcaaaagatg

SEQ ID NO: 205500 - DNA, 103 bp, Artificial Sequence
  Synthetic Polynucleotide
taatacgactcactatagggggaaacatgccttgatgtagctgcagtttgaacagaggagacaaactatggctacatcaaacctggcggcagcgcaaaagatg

SEQ ID NO: 205501 - DNA, 103 bp, Artificial Sequence
  Synthetic Polynucleotide
taatacgactcactatagggcattgcttggggaaacatgccttgatgtagaacagaggagactacatatgggcatgtttaacctggcggcagcgcaaaagatg

SEQ ID NO: 205502 - DNA, 103 bp, Artificial Sequence
  Synthetic Polynucleotide
taatacgactcactatagggtcagattcttcattgcttggggaaacatgcaacagaggagagcatgtatgcccaagcaaaacctggcggcagcgcaaaagatg

SEQ ID NO: 205503 - DNA, 103 bp, Artificial Sequence
  Synthetic Polynucleotide
taatacgactcactatagggaaagccagtctcagattcttcattgcttggaacagaggagaccaagcatggaagaatctaacctggcggcagcgcaaaagatg

SEQ ID NO: 205504 - DNA, 103 bp, Artificial Sequence
  Synthetic Polynucleotide
taatacgactcactatagggcataatatcaaaagccagtctcagattcttaacagaggagaaagaatatgagactggctaacctggcggcagcgcaaaagatg

SEQ ID NO: 205505 - DNA, 103 bp, Artificial Sequence
  Synthetic Polynucleotide
taatacgactcactataggggtgtcactctcataatatcaaaagccagtcaacagaggagagactggatgttgatattaaacctggcggcagcgcaaaagatg

SEQ ID NO: 205506 - DNA, 103 bp, Artificial Sequence
  Synthetic Polynucleotide
taatacgactcactatagggacgccacgactccccttgcacaccgtgtacaacagaggagagtacacatggtgcaagggaacctggcggcagcgcaaaagatg

SEQ ID NO: 205507 - DNA, 103 bp, Artificial Sequence
  Synthetic Polynucleotide
taatacgactcactatagggtctctgccatgtgtcactctcataatatcaaacagaggagatgatatatggagagtgacaacctggcggcagcgcaaaagatg

SEQ ID NO: 205508 - DNA, 103 bp, Artificial Sequence
  Synthetic Polynucleotide
taatacgactcactatagggcaggctgtgttctctgccatgtgtcactctaacagaggagaagagtgatgcatggcagaaacctggcggcagcgcaaaagatg

SEQ ID NO: 205509 - DNA, 103 bp, Artificial Sequence
  Synthetic Polynucleotide
taatacgactcactatagggaatcttcaatcaggctgtgttctctgccataacagaggagaatggcaatgaacacagccaacctggcggcagcgcaaaagatg

SEQ ID NO: 205510 - DNA, 103 bp, Artificial Sequence
  Synthetic Polynucleotide
taatacgactcactatagggagtagaatcaaatcttcaatcaggctgtgtaacagaggagaacacagatggattgaagaaacctggcggcagcgcaaaagatg

SEQ ID NO: 205511 - DNA, 103 bp, Artificial Sequence
  Synthetic Polynucleotide
taatacgactcactatagggttcttctaaaagtagaatcaaatcttcaataacagaggagaattgaaatgttgattctaaacctggcggcagcgcaaaagatg

SEQ ID NO: 205512 - DNA, 103 bp, Artificial Sequence
  Synthetic Polynucleotide
taatacgactcactatagggtggcgtcgcattcttctaaaagtagaatcaaacagaggagatgattcatgttttagaagaacctggcggcagcgcaaaagatg

SEQ ID NO: 205513 - DNA, 103 bp, Artificial Sequence
  Synthetic Polynucleotide
taatacgactcactataggggctctgatgttggcgtcgcattcttctaaaaacagaggagatttagaatgatgcgacgcaacctggcggcagcgcaaaagatg

SEQ ID NO: 205514 - DNA, 103 bp, Artificial Sequence
  Synthetic Polynucleotide
taatacgactcactataggggtcgcagacgacgccacgactccccttgcaaacagaggagatgcaagatgagtcgtggcaacctggcggcagcgcaaaagatg

SEQ ID NO: 205515 - DNA, 103 bp, Artificial Sequence
  Synthetic Polynucleotide
taatacgactcactataggggaaggcagcggtcgcagacgacgccacgacaacagaggagagtcgtgatgtcgtctgcgaacctggcggcagcgcaaaagatg

SEQ ID NO: 205516 - DNA, 103 bp, Artificial Sequence
  Synthetic Polynucleotide
taatacgactcactatagggtccttcccgagaaggcagcggtcgcagacgaacagaggagacgtctgatgccgctgcctaacctggcggcagcgcaaaagatg

SEQ ID NO: 205517 - DNA, 103 bp, Artificial Sequence
  Synthetic Polynucleotide
taatacgactcactatagggcatcagcttttccttcccgagaaggcagcgaacagaggagacgctgcatgctcgggaagaacctggcggcagcgcaaaagatg

SEQ ID NO: 205518 - DNA, 103 bp, Artificial Sequence
  Synthetic Polynucleotide
taatacgactcactataggggagagcatcgcatcagcttttccttcccgaaacagaggagatcgggaatgaaaagctgaaacctggcggcagcgcaaaagatg

SEQ ID NO: 205519 - DNA, 103 bp, Artificial Sequence
  Synthetic Polynucleotide
taatacgactcactatagggacgcggcactgagagcatcgcatcagctttaacagaggagaaaagctatggcgatgctcaacctggcggcagcgcaaaagatg

SEQ ID NO: 205520 - DNA, 103 bp, Artificial Sequence
  Synthetic Polynucleotide
taatacgactcactataggggtatttggcgacgcggcactgagagcatcgaacagaggagacgatgcatgcagtgccgcaacctggcggcagcgcaaaagatg

SEQ ID NO: 205521 - DNA, 103 bp, Artificial Sequence
  Synthetic Polynucleotide
taatacgactcactatagggtcttggcggttgcgaacttttccaccttcaaacagaggagatgaaggatgaaaagttcgaacctggcggcagcgcaaaagatg

SEQ ID NO: 205522 - DNA, 103 bp, Artificial Sequence
  Synthetic Polynucleotide
taatacgactcactatagggtagcactacagtatttggcgacgcggcactaacagaggagaagtgccatgtcgccaaataacctggcggcagcgcaaaagatg

SEQ ID NO: 205523 - DNA, 103 bp, Artificial Sequence
  Synthetic Polynucleotide
taatacgactcactatagggttctgacacttagcactacagtatttggcgaacagaggagacgccaaatgctgtagtgcaacctggcggcagcgcaaaagatg

SEQ ID NO: 205524 - DNA, 103 bp, Artificial Sequence
  Synthetic Polynucleotide
taatacgactcactatagggccaagcttttttctgacacttagcactacaaacagaggagatgtagtatgaagtgtcagaacctggcggcagcgcaaaagatg

SEQ ID NO: 205525 - DNA, 103 bp, Artificial Sequence
  Synthetic Polynucleotide
taatacgactcactatagggtgtggtctggccaagcttttttctgacactaacagaggagaagtgtcatgaaaaagcttaacctggcggcagcgcaaaagatg

SEQ ID NO: 205526 - DNA, 103 bp, Artificial Sequence
  Synthetic Polynucleotide
taatacgactcactatagggcattcccgcttgtggtctggccaagcttttaacagaggagaaaaagcatggccagaccaaacctggcggcagcgcaaaagatg

SEQ ID NO: 205527 - DNA, 103 bp, Artificial Sequence
  Synthetic Polynucleotide
taatacgactcactatagggaaggcatttgcattcccgcttgtggtctggaacagaggagaccagacatgaagcgggaaaacctggcggcagcgcaaaagatg

SEQ ID NO: 205528 - DNA, 103 bp, Artificial Sequence
  Synthetic Polynucleotide
taatacgactcactatagggtgcagcttttaaggcatttgcattcccgctaacagaggagaagcgggatggcaaatgccaacctggcggcagcgcaaaagatg

SEQ ID NO: 205529 - DNA, 103 bp, Artificial Sequence
  Synthetic Polynucleotide
taatacgactcactatagggtatctgggtttgcagcttttaaggcatttgaacagaggagacaaatgatgtaaaagctgaacctggcggcagcgcaaaagatg

SEQ ID NO: 205530 - DNA, 103 bp, Artificial Sequence
  Synthetic Polynucleotide
taatacgactcactataggggtctggaggatatctgggtttgcagcttttaacagaggagaaaaagcatgaaacccagaaacctggcggcagcgcaaaagatg

SEQ ID NO: 205531 - DNA, 103 bp, Artificial Sequence
  Synthetic Polynucleotide
taatacgactcactataggggtcgaacggagtctggaggatatctgggttaacagaggagaaacccaatgatcctccagaacctggcggcagcgcaaaagatg

SEQ ID NO: 205532 - DNA, 103 bp, Artificial Sequence
  Synthetic Polynucleotide
taatacgactcactatagggccgtttcccctcttggcggttgcgaactttaacagaggagaaaagttatgaaccgccaaaacctggcggcagcgcaaaagatg

SEQ ID NO: 205533 - DNA, 103 bp, Artificial Sequence
  Synthetic Polynucleotide
taatacgactcactatagggctgccaagaagtcgaacggagtctggaggaaacagaggagatcctccatgctccgttcgaacctggcggcagcgcaaaagatg

SEQ ID NO: 205534 - DNA, 103 bp, Artificial Sequence
  Synthetic Polynucleotide
taatacgactcactataggggaagacaactctgccaagaagtcgaacggaaacagaggagatccgttatgcttcttggcaacctggcggcagcgcaaaagatg

SEQ ID NO: 205535 - DNA, 103 bp, Artificial Sequence
  Synthetic Polynucleotide
taatacgactcactatagggccataagtttgaagacaactctgccaagaaaacagaggagattcttgatggagttgtctaacctggcggcagcgcaaaagatg

SEQ ID NO: 205536 - DNA, 103 bp, Artificial Sequence
  Synthetic Polynucleotide
taatacgactcactatagggggtgctccatccataagtttgaagacaactaacagaggagaagttgtatgcaaacttataacctggcggcagcgcaaaagatg

SEQ ID NO: 205537 - DNA, 103 bp, Artificial Sequence
  Synthetic Polynucleotide
taatacgactcactatagggtgattctgaaggtgctccatccataagtttaacagaggagaaaacttatggatggagcaaacctggcggcagcgcaaaagatg

SEQ ID NO: 205538 - DNA, 103 bp, Artificial Sequence
  Synthetic Polynucleotide
taatacgactcactatagggaaagcttctctgattctgaaggtgctccataacagaggagaatggagatgcttcagaataacctggcggcagcgcaaaagatg

SEQ ID NO: 205539 - DNA, 103 bp, Artificial Sequence
  Synthetic Polynucleotide
taatacgactcactatagggtaaaatgagtaaagcttctctgattctgaaaacagaggagattcagaatgagagaagctaacctggcggcagcgcaaaagatg

SEQ ID NO: 205540 - DNA, 103 bp, Artificial Sequence
  Synthetic Polynucleotide
taatacgactcactatagggctccagatcataaaatgagtaaagcttctcaacagaggagagagaagatgtactcatttaacctggcggcagcgcaaaagatg

SEQ ID NO: 205541 - DNA, 103 bp, Artificial Sequence
  Synthetic Polynucleotide
taatacgactcactatagggtaatatttgactccagatcataaaatgagtaacagaggagaactcatatgatgatctggaacctggcggcagcgcaaaagatg

SEQ ID NO: 205542 - DNA, 103 bp, Artificial Sequence
  Synthetic Polynucleotide
taatacgactcactataggggtcagtttgttaatatttgactccagatcaaacagaggagatgatctatggtcaaatataacctggcggcagcgcaaaagatg

SEQ ID NO: 205543 - DNA, 103 bp, Artificial Sequence
  Synthetic Polynucleotide
taatacgactcactatagggggcgcgcagcccgtttcccctcttggcggtaacagaggagaaccgccatgaggggaaacaacctggcggcagcgcaaaagatg

SEQ ID NO: 205544 - DNA, 103 bp, Artificial Sequence
  Synthetic Polynucleotide
taatacgactcactatagggcttatcttcagtcagtttgttaatatttgaaacagaggagatcaaatatgaacaaactgaacctggcggcagcgcaaaagatg

SEQ ID NO: 205545 - DNA, 103 bp, Artificial Sequence
  Synthetic Polynucleotide
taatacgactcactatagggggccctctttcttatcttcagtcagtttgtaacagaggagaacaaacatgctgaagataaacctggcggcagcgcaaaagatg

SEQ ID NO: 205546 - DNA, 103 bp, Artificial Sequence
  Synthetic Polynucleotide
taatacgactcactatagggagttgcctgaggccctctttcttatcttcaaacagaggagatgaagaatggaaagagggaacctggcggcagcgcaaaagatg

SEQ ID NO: 205547 - DNA, 103 bp, Artificial Sequence
  Synthetic Polynucleotide
taatacgactcactatagggtgtcattacgagttgcctgaggccctctttaacagaggagaaaagagatgctcaggcaaaacctggcggcagcgcaaaagatg

SEQ ID NO: 205548 - DNA, 103 bp, Artificial Sequence
  Synthetic Polynucleotide
taatacgactcactatagggaatgttgaaatgtcattacgagttgcctgaaacagaggagatcaggcatgtcgtaatgaaacctggcggcagcgcaaaagatg

SEQ ID NO: 205549 - DNA, 103 bp, Artificial Sequence
  Synthetic Polynucleotide
taatacgactcactatagggtctctcatgaaatgttgaaatgtcattacgaacagaggagacgtaatatgatttcaacaaacctggcggcagcgcaaaagatg

SEQ ID NO: 205550 - DNA, 103 bp, Artificial Sequence
  Synthetic Polynucleotide
taatacgactcactatagggctgtatttcttctctcatgaaatgttgaaaaacagaggagatttcaaatgttcatgagaaacctggcggcagcgcaaaagatg

SEQ ID NO: 205551 - DNA, 103 bp, Artificial Sequence
  Synthetic Polynucleotide
taatacgactcactataggggagaggcatcctgtatttcttctctcatgaaacagaggagatcatgaatgaagaaatacaacctggcggcagcgcaaaagatg

SEQ ID NO: 205552 - DNA, 103 bp, Artificial Sequence
  Synthetic Polynucleotide
taatacgactcactatagggggtggcagctgagaggcatcctgtatttctaacagaggagaagaaatatgggatgcctcaacctggcggcagcgcaaaagatg

SEQ ID NO: 205553 - DNA, 103 bp, Artificial Sequence
  Synthetic Polynucleotide
taatacgactcactataggggtcaaaggcaggtggcagctgagaggcatcaacagaggagagatgccatgcagctgccaaacctggcggcagcgcaaaagatg

SEQ ID NO: 205554 - DNA, 103 bp, Artificial Sequence
  Synthetic Polynucleotide
taatacgactcactataggggcggggtcacggcgcgcagcccgtttccccaacagaggagaggggaaatgggctgcgcgaacctggcggcagcgcaaaagatg

SEQ ID NO: 205555 - DNA, 103 bp, Artificial Sequence
  Synthetic Polynucleotide
taatacgactcactatagggcttcaaaaaggtcaaaggcaggtggcagctaacagaggagaagctgcatgctgcctttgaacctggcggcagcgcaaaagatg

SEQ ID NO: 205556 - DNA, 103 bp, Artificial Sequence
  Synthetic Polynucleotide
taatacgactcactatagggtttgcaaaggcttcaaaaaggtcaaaggcaaacagaggagatgccttatgcctttttgaaacctggcggcagcgcaaaagatg

SEQ ID NO: 205557 - DNA, 103 bp, Artificial Sequence
  Synthetic Polynucleotide
taatacgactcactataggggcagatcacttttgcaaaggcttcaaaaagaacagaggagactttttatggcctttgcaaacctggcggcagcgcaaaagatg

SEQ ID NO: 205558 - DNA, 103 bp, Artificial Sequence
  Synthetic Polynucleotide
taatacgactcactatagggtgaaagagttgcagatcacttttgcaaaggaacagaggagacctttgatgaagtgatctaacctggcggcagcgcaaaagatg

SEQ ID NO: 205559 - DNA, 103 bp, Artificial Sequence
  Synthetic Polynucleotide
taatacgactcactatagggttacagatggtgaaagagttgcagatcactaacagaggagaagtgatatgcaactctttaacctggcggcagcgcaaaagatg

SEQ ID NO: 205560 - DNA, 103 bp, Artificial Sequence
  Synthetic Polynucleotide
taatacgactcactatagggcatctccgcattacagatggtgaaagagttaacagaggagaaactctatgaccatctgtaacctggcggcagcgcaaaagatg

SEQ ID NO: 205561 - DNA, 103 bp, Artificial Sequence
  Synthetic Polynucleotide
taatacgactcactatagggcaacttcctgcatctccgcattacagatggaacagaggagaccatctatgatgcggagaaacctggcggcagcgcaaaagatg

SEQ ID NO: 205562 - DNA, 103 bp, Artificial Sequence
  Synthetic Polynucleotide
taatacgactcactatagggaggccaacaccaacttcctgcatctccgcaaacagaggagatgcggaatggcaggaagtaacctggcggcagcgcaaaagatg

SEQ ID NO: 205563 - DNA, 103 bp, Artificial Sequence
  Synthetic Polynucleotide
taatacgactcactatagggactgggatataggccaacaccaacttcctgaacagaggagacaggaaatgggtgttggcaacctggcggcagcgcaaaagatg

SEQ ID NO: 205564 - DNA, 103 bp, Artificial Sequence
  Synthetic Polynucleotide
taatacgactcactataggggcaaagagatactgggatataggccaacacaacagaggagagtgttgatgtatatcccaaacctggcggcagcgcaaaagatg

SEQ ID NO: 205565 - DNA, 103 bp, Artificial Sequence
  Synthetic Polynucleotide
taatacgactcactatagggccggggcgcagcggggtcacggcgcgcagcaacagaggagagctgcgatgcgtgaccccaacctggcggcagcgcaaaagatg

SEQ ID NO: 205566 - DNA, 103 bp, Artificial Sequence
  Synthetic Polynucleotide
taatacgactcactatagggctgtgattgagcaaagagatactgggatataacagaggagaatatccatgtatctctttaacctggcggcagcgcaaaagatg

SEQ ID NO: 205567 - DNA, 103 bp, Artificial Sequence
  Synthetic Polynucleotide
taatacgactcactatagggggggtcacagctgtgattgagcaaagagataacagaggagaatctctatgctcaatcacaacctggcggcagcgcaaaagatg

SEQ ID NO: 205568 - DNA, 103 bp, Artificial Sequence
  Synthetic Polynucleotide
taatacgactcactatagggtcgaacagttggggtcacagctgtgattgaaacagaggagatcaatcatggctgtgaccaacctggcggcagcgcaaaagatg

SEQ ID NO: 205569 - DNA, 103 bp, Artificial Sequence
  Synthetic Polynucleotide
taatacgactcactatagggttgaacacaatcgaacagttggggtcacagaacagaggagactgtgaatgcaactgttcaacctggcggcagcgcaaaagatg

SEQ ID NO: 205570 - DNA, 103 bp, Artificial Sequence
  Synthetic Polynucleotide
taatacgactcactataggggtggggcccattgaacacaatcgaacagttaacagaggagaaactgtatgattgtgttcaacctggcggcagcgcaaaagatg

SEQ ID NO: 205571 - DNA, 103 bp, Artificial Sequence
  Synthetic Polynucleotide
taatacgactcactataggggcagtaagaggtggggcccattgaacacaaaacagaggagattgtgtatgatgggccccaacctggcggcagcgcaaaagatg

SEQ ID NO: 205572 - DNA, 103 bp, Artificial Sequence
  Synthetic Polynucleotide
taatacgactcactatagggcggactgctcgcagtaagaggtggggcccaaacagaggagatgggccatgcctcttactaacctggcggcagcgcaaaagatg

SEQ ID NO: 205573 - DNA, 103 bp, Artificial Sequence
  Synthetic Polynucleotide
taatacgactcactatagggctcgatgtctcggactgctcgcagtaagagaacagaggagactcttaatgcgagcagtcaacctggcggcagcgcaaaagatg

SEQ ID NO: 205574 - DNA, 103 bp, Artificial Sequence
  Synthetic Polynucleotide
taatacgactcactatagggcctctcccacctcgatgtctcggactgctcaacagaggagagagcagatggagacatcgaacctggcggcagcgcaaaagatg

SEQ ID NO: 205575 - DNA, 103 bp, Artificial Sequence
  Synthetic Polynucleotide
taatacgactcactatagggatggtgagctcctctcccacctcgatgtctaacagaggagaagacatatgggtgggagaaacctggcggcagcgcaaaagatg

SEQ ID NO: 205576 - DNA, 103 bp, Artificial Sequence
  Synthetic Polynucleotide
taatacgactcactataggggagtagctctccggggcgcagcggggtcacaacagaggagagtgaccatgctgcgccccaacctggcggcagcgcaaaagatg

SEQ ID NO: 205577 - DNA, 103 bp, Artificial Sequence
  Synthetic Polynucleotide
taatacgactcactatagggcaggtagcagatggtgagctcctctcccacaacagaggagagtgggaatggagctcaccaacctggcggcagcgcaaaagatg

SEQ ID NO: 205578 - DNA, 103 bp, Artificial Sequence
  Synthetic Polynucleotide
taatacgactcactatagggtcagcatatccaggtagcagatggtgagctaacagaggagaagctcaatgtctgctaccaacctggcggcagcgcaaaagatg

SEQ ID NO: 205579 - DNA, 103 bp, Artificial Sequence
  Synthetic Polynucleotide
taatacgactcactatagggtcactggtcatcagcatatccaggtagcagaacagaggagactgctaatgggatatgctaacctggcggcagcgcaaaagatg

SEQ ID NO: 205580 - DNA, 103 bp, Artificial Sequence
  Synthetic Polynucleotide
taatacgactcactatagggccggcgctcctcactggtcatcagcatatcaacagaggagagatatgatgatgaccagtaacctggcggcagcgcaaaagatg

SEQ ID NO: 205581 - DNA, 103 bp, Artificial Sequence
  Synthetic Polynucleotide
taatacgactcactatagggtcagctgcttccggcgctcctcactggtcaaacagaggagatgaccaatgaggagcgccaacctggcggcagcgcaaaagatg

SEQ ID NO: 205582 - DNA, 103 bp, Artificial Sequence
  Synthetic Polynucleotide
taatacgactcactatagggtactggtccctcagctgcttccggcgctccaacagaggagaggagcgatggaagcagctaacctggcggcagcgcaaaagatg

SEQ ID NO: 205583 - DNA, 103 bp, Artificial Sequence
  Synthetic Polynucleotide
taatacgactcactatagggttcaaagcagtactggtccctcagctgcttaacagaggagaaagcagatgagggaccagaacctggcggcagcgcaaaagatg

SEQ ID NO: 205584 - DNA, 103 bp, Artificial Sequence
  Synthetic Polynucleotide
taatacgactcactatagggaacagtcacattcaaagcagtactggtcccaacagaggagagggaccatgactgctttgaacctggcggcagcgcaaaagatg

SEQ ID NO: 205585 - DNA, 103 bp, Artificial Sequence
  Synthetic Polynucleotide
taatacgactcactatagggtggcaacggaaacagtcacattcaaagcagaacagaggagactgcttatgatgtgactgaacctggcggcagcgcaaaagatg

SEQ ID NO: 205586 - DNA, 103 bp, Artificial Sequence
  Synthetic Polynucleotide
taatacgactcactataggggtcctgggtttggcaacggaaacagtcacaaacagaggagatgtgacatgttccgttgcaacctggcggcagcgcaaaagatg

SEQ ID NO: 205587 - DNA, 103 bp, Artificial Sequence
  Synthetic Polynucleotide
taatacgactcactatagggccgagcggaagagtagctctccggggcgcaaacagaggagatgcgccatggagagctacaacctggcggcagcgcaaaagatg

SEQ ID NO: 205588 - DNA, 103 bp, Artificial Sequence
  Synthetic Polynucleotide
taatacgactcactatagggcagcatccttgtcctgggtttggcaacggaaacagaggagatccgttatgaaacccaggaacctggcggcagcgcaaaagatg

SEQ ID NO: 205589 - DNA, 103 bp, Artificial Sequence
  Synthetic Polynucleotide
taatacgactcactataggggttagcatatcagcatccttgtcctgggttaacagaggagaaacccaatgcaaggatgcaacctggcggcagcgcaaaagatg

SEQ ID NO: 205590 - DNA, 103 bp, Artificial Sequence
  Synthetic Polynucleotide
taatacgactcactatagggctcatcaccagttagcatatcagcatccttaacagaggagaaaggatatggatatgctaaacctggcggcagcgcaaaagatg

SEQ ID NO: 205591 - DNA, 103 bp, Artificial Sequence
  Synthetic Polynucleotide
taatacgactcactatagggtccatacttgctcatcaccagttagcatataacagaggagaatatgcatgctggtgatgaacctggcggcagcgcaaaagatg

SEQ ID NO: 205592 - DNA, 103 bp, Artificial Sequence
  Synthetic Polynucleotide
taatacgactcactatagggtgaacttccttccatacttgctcatcaccaaacagaggagatggtgaatggcaagtatgaacctggcggcagcgcaaaagatg

SEQ ID NO: 205593 - DNA, 103 bp, Artificial Sequence
  Synthetic Polynucleotide
taatacgactcactatagggcagggattcttgaacttccttccatacttgaacagaggagacaagtaatgaaggaagttaacctggcggcagcgcaaaagatg

SEQ ID NO: 205594 - DNA, 103 bp, Artificial Sequence
  Synthetic Polynucleotide
taatacgactcactatagggcaatttttttcagggattcttgaacttcctaacagaggagaaggaagatgaagaatcccaacctggcggcagcgcaaaagatg

SEQ ID NO: 205595 - DNA, 103 bp, Artificial Sequence
  Synthetic Polynucleotide
taatacgactcactatagggttcagttcttcaatttttttcagggattctaacagaggagaagaatcatggaaaaaaataacctggcggcagcgcaaaagatg

SEQ ID NO: 205596 - DNA, 103 bp, Artificial Sequence
  Synthetic Polynucleotide
taatacgactcactatagggccagtgtgccttcagttcttcaatttttttaacagaggagaaaaaaaatggaagaactgaacctggcggcagcgcaaaagatg

SEQ ID NO: 205597 - DNA, 103 bp, Artificial Sequence
  Synthetic Polynucleotide
taatacgactcactataggggctcccacttccagtgtgccttcagttcttaacagaggagaaagaacatgaggcacactaacctggcggcagcgcaaaagatg

SEQ ID NO: 205598 - DNA, 103 bp, Artificial Sequence
  Synthetic Polynucleotide
taatacgactcactataggggccaagggatccgagcggaagagtagctctaacagaggagaagagctatgcttccgctcaacctggcggcagcgcaaaagatg

SEQ ID NO: 205599 - DNA, 103 bp, Artificial Sequence
  Synthetic Polynucleotide
taatacgactcactataggggccagaacctgctcccacttccagtgtgccaacagaggagaggcacaatggaagtgggaaacctggcggcagcgcaaaagatg

SEQ ID NO: 205600 - DNA, 103 bp, Artificial Sequence
  Synthetic Polynucleotide
taatacgactcactatagggctggcacatggccagaacctgctcccacttaacagaggagaaagtggatgcaggttctgaacctggcggcagcgcaaaagatg

SEQ ID NO: 205601 - DNA, 103 bp, Artificial Sequence
  Synthetic Polynucleotide
taatacgactcactatagggttatgattgcctggcacatggccagaacctaacagaggagaaggttcatgccatgtgccaacctggcggcagcgcaaaagatg

SEQ ID NO: 205602 - DNA, 103 bp, Artificial Sequence
  Synthetic Polynucleotide
taatacgactcactataggggaattgctgcttatgattgcctggcacatgaacagaggagacatgtgatgggcaatcataacctggcggcagcgcaaaagatg

SEQ ID NO: 205603 - DNA, 103 bp, Artificial Sequence
  Synthetic Polynucleotide
taatacgactcactatagggaagccgttcagaattgctgcttatgattgcaacagaggagagcaatcatgagcagcaataacctggcggcagcgcaaaagatg

SEQ ID NO: 205604 - DNA, 103 bp, Artificial Sequence
  Synthetic Polynucleotide
taatacgactcactatagggtgatatcgggaagccgttcagaattgctgcaacagaggagagcagcaatgctgaacggcaacctggcggcagcgcaaaagatg

SEQ ID NO: 205605 - DNA, 103 bp, Artificial Sequence
  Synthetic Polynucleotide
taatacgactcactatagggtggtagatgttgatatcgggaagccgttcaaacagaggagatgaacgatgtcccgatataacctggcggcagcgcaaaagatg

SEQ ID NO: 205606 - DNA, 103 bp, Artificial Sequence
  Synthetic Polynucleotide
taatacgactcactatagggcaccttcagctggtagatgttgatatcgggaacagaggagacccgatatgaacatctacaacctggcggcagcgcaaaagatg

SEQ ID NO: 205607 - DNA, 103 bp, Artificial Sequence
  Synthetic Polynucleotide
taatacgactcactatagggcgcagtcgagcaccttcagctggtagatgtaacagaggagaacatctatgagctgaaggaacctggcggcagcgcaaaagatg

SEQ ID NO: 205608 - DNA, 103 bp, Artificial Sequence
  Synthetic Polynucleotide
taatacgactcactataggggcatccatggcgcagtcgagcaccttcagcaacagaggagagctgaaatggctcgactgaacctggcggcagcgcaaaagatg

SEQ ID NO: 205609 - DNA, 103 bp, Artificial Sequence
  Synthetic Polynucleotide
taatacgactcactataggggggcttcctgacgaggaaagagcgcggcataacagaggagaatgccgatgtctttcctcaacctggcggcagcgcaaaagatg

SEQ ID NO: 205610 - DNA, 103 bp, Artificial Sequence
  Synthetic Polynucleotide
taatacgactcactatagggcaggtgggcctggtcgtagggctgctggaaaacagaggagattccagatgccctacgacaacctggcggcagcgcaaaagatg

SEQ ID NO: 205611 - DNA, 103 bp, Artificial Sequence
  Synthetic Polynucleotide
taatacgactcactatagggtggctgccagcaggtgggcctggtcgtaggaacagaggagacctacgatgaggcccaccaacctggcggcagcgcaaaagatg

SEQ ID NO: 205612 - DNA, 103 bp, Artificial Sequence
  Synthetic Polynucleotide
taatacgactcactatagggggaggtgggatggctgccagcaggtgggccaacagaggagaggcccaatggctggcagcaacctggcggcagcgcaaaagatg

SEQ ID NO: 205613 - DNA, 103 bp, Artificial Sequence
  Synthetic Polynucleotide
taatacgactcactataggggaggatctccggaggtgggatggctgccagaacagaggagactggcaatgatcccacctaacctggcggcagcgcaaaagatg

SEQ ID NO: 205614 - DNA, 103 bp, Artificial Sequence
  Synthetic Polynucleotide
taatacgactcactatagggcggtggggttgaggatctccggaggtgggaaacagaggagatcccacatgcggagatccaacctggcggcagcgcaaaagatg

SEQ ID NO: 205615 - DNA, 103 bp, Artificial Sequence
  Synthetic Polynucleotide
taatacgactcactatagggggcagcgaggcggtggggttgaggatctccaacagaggagaggagatatgcaaccccacaacctggcggcagcgcaaaagatg

SEQ ID NO: 205616 - DNA, 103 bp, Artificial Sequence
  Synthetic Polynucleotide
taatacgactcactataggggatgagcattggcagcgaggcggtggggttaacagaggagaaaccccatggcctcgctgaacctggcggcagcgcaaaagatg

SEQ ID NO: 205617 - DNA, 103 bp, Artificial Sequence
  Synthetic Polynucleotide
taatacgactcactatagggcagagtcccagatgagcattggcagcgaggaacagaggagacctcgcatgcaatgctcaaacctggcggcagcgcaaaagatg

SEQ ID NO: 205618 - DNA, 103 bp, Artificial Sequence
  Synthetic Polynucleotide
taatacgactcactatagggggcgccaggacagagtcccagatgagcattaacagaggagaaatgctatgctgggactcaacctggcggcagcgcaaaagatg

SEQ ID NO: 205619 - DNA, 103 bp, Artificial Sequence
  Synthetic Polynucleotide
taatacgactcactatagggctgggcttggggcgccaggacagagtcccaaacagaggagatgggacatggtcctggcgaacctggcggcagcgcaaaagatg

SEQ ID NO: 205620 - DNA, 103 bp, Artificial Sequence
  Synthetic Polynucleotide
taatacgactcactatagggtggggtcggagggcttcctgacgaggaaagaacagaggagactttccatgtcaggaagcaacctggcggcagcgcaaaagatg

SEQ ID NO: 205621 - DNA, 103 bp, Artificial Sequence
  Synthetic Polynucleotide
taatacgactcactatagggaggcaattggctgggcttggggcgccaggaaacagaggagatcctggatgcccaagcccaacctggcggcagcgcaaaagatg

SEQ ID NO: 205622 - DNA, 103 bp, Artificial Sequence
  Synthetic Polynucleotide
taatacgactcactatagggagggaggcccaggcaattggctgggcttggaacagaggagaccaagcatggccaattgcaacctggcggcagcgcaaaagatg

SEQ ID NO: 205623 - DNA, 103 bp, Artificial Sequence
  Synthetic Polynucleotide
taatacgactcactatagggctggagccgaagggaggcccaggcaattggaacagaggagaccaattatgtgggcctccaacctggcggcagcgcaaaagatg

SEQ ID NO: 205624 - DNA, 103 bp, Artificial Sequence
  Synthetic Polynucleotide
taatacgactcactatagggtgggactctcctggagccgaagggaggcccaacagaggagagggcctatgttcggctccaacctggcggcagcgcaaaagatg

SEQ ID NO: 205625 - DNA, 103 bp, Artificial Sequence
  Synthetic Polynucleotide
taatacgactcactatagggtctgccaccctgggactctcctggagccgaaacagaggagatcggctatgggagagtccaacctggcggcagcgcaaaagatg

SEQ ID NO: 205626 - DNA, 103 bp, Artificial Sequence
  Synthetic Polynucleotide
taatacgactcactatagggggaggtcagctctgccaccctgggactctcaacagaggagagagagtatgagggtggcaaacctggcggcagcgcaaaagatg

SEQ ID NO: 205627 - DNA, 103 bp, Artificial Sequence
  Synthetic Polynucleotide
taatacgactcactatagggcatctgacagggaggtcagctctgccacccaacagaggagagggtggatgagctgacctaacctggcggcagcgcaaaagatg

SEQ ID NO: 205628 - DNA, 103 bp, Artificial Sequence
  Synthetic Polynucleotide
taatacgactcactatagggccactgtcctcatctgacagggaggtcagcaacagaggagagctgacatgcctgtcagaaacctggcggcagcgcaaaagatg

SEQ ID NO: 205629 - DNA, 103 bp, Artificial Sequence
  Synthetic Polynucleotide
taatacgactcactatagggggagcctttcccactgtcctcatctgacagaacagaggagactgtcaatggaggacagtaacctggcggcagcgcaaaagatg

SEQ ID NO: 205630 - DNA, 103 bp, Artificial Sequence
  Synthetic Polynucleotide
taatacgactcactatagggtggggggctgggagcctttcccactgtcctaacagaggagaaggacaatgggaaaggctaacctggcggcagcgcaaaagatg

SEQ ID NO: 205631 - DNA, 103 bp, Artificial Sequence
  Synthetic Polynucleotide
taatacgactcactatagggggcttccgattggggtcggagggcttcctgaacagaggagacaggaaatgctccgacccaacctggcggcagcgcaaaagatg

SEQ ID NO: 205632 - DNA, 103 bp, Artificial Sequence
  Synthetic Polynucleotide
taatacgactcactataggggagggtgggctggggggctgggagcctttcaacagaggagagaaaggatgccagcccccaacctggcggcagcgcaaaagatg

SEQ ID NO: 205633 - DNA, 103 bp, Artificial Sequence
  Synthetic Polynucleotide
taatacgactcactatagggaggagccggtgagggtgggctggggggctgaacagaggagacagcccatgagcccacccaacctggcggcagcgcaaaagatg

SEQ ID NO: 205634 - DNA, 103 bp, Artificial Sequence
  Synthetic Polynucleotide
taatacgactcactatagggagaaggacgaaggagccggtgagggtgggcaacagaggagagcccacatgcaccggctcaacctggcggcagcgcaaaagatg

SEQ ID NO: 205635 - DNA, 103 bp, Artificial Sequence
  Synthetic Polynucleotide
taatacgactcactataggggaagtagaggagaaggacgaaggagccggtaacagaggagaaccggcatgttcgtccttaacctggcggcagcgcaaaagatg

SEQ ID NO: 205636 - DNA, 103 bp, Artificial Sequence
  Synthetic Polynucleotide
taatacgactcactatagggggaagagactgaagtagaggagaaggacgaaacagaggagatcgtccatgtcctctactaacctggcggcagcgcaaaagatg

SEQ ID NO: 205637 - DNA, 103 bp, Artificial Sequence
  Synthetic Polynucleotide
taatacgactcactatagggcggcctccaaggaagagactgaagtagaggaacagaggagacctctaatgcagtctcttaacctggcggcagcgcaaaagatg

SEQ ID NO: 205638 - DNA, 103 bp, Artificial Sequence
  Synthetic Polynucleotide
taatacgactcactataggggcataggcctcggcctccaaggaagagactaacagaggagaagtctcatgcttggaggcaacctggcggcagcgcaaaagatg

SEQ ID NO: 205639 - DNA, 103 bp, Artificial Sequence
  Synthetic Polynucleotide
taatacgactcactatagggtgggaaggcagcataggcctcggcctccaaaacagaggagattggagatggaggcctataacctggcggcagcgcaaaagatg

SEQ ID NO: 205640 - DNA, 103 bp, Artificial Sequence
  Synthetic Polynucleotide
taatacgactcactatagggggcccaagcctgggaaggcagcataggcctaacagaggagaaggcctatgctgccttccaacctggcggcagcgcaaaagatg

SEQ ID NO: 205641 - DNA, 103 bp, Artificial Sequence
  Synthetic Polynucleotide
taatacgactcactatagggttgggcacttggcccaagcctgggaaggcaaacagaggagatgccttatgaggcttgggaacctggcggcagcgcaaaagatg

SEQ ID NO: 205642 - DNA, 103 bp, Artificial Sequence
  Synthetic Polynucleotide
taatacgactcactataggggctgtagttaggcttccgattggggtcggaaacagaggagatccgacatgaatcggaagaacctggcggcagcgcaaaagatg

SEQ ID NO: 205643 - DNA, 103 bp, Artificial Sequence
  Synthetic Polynucleotide
taatacgactcactatagggggccagctgcttgggcacttggcccaagccaacagaggagaggcttgatgcaagtgcccaacctggcggcagcgcaaaagatg

SEQ ID NO: 205644 - DNA, 103 bp, Artificial Sequence
  Synthetic Polynucleotide
taatacgactcactatagggcagagagctgggccagctgcttgggcacttaacagaggagaaagtgcatgagcagctggaacctggcggcagcgcaaaagatg

SEQ ID NO: 205645 - DNA, 103 bp, Artificial Sequence
  Synthetic Polynucleotide
taatacgactcactatagggtccttggcctcagagagctgggccagctgcaacagaggagagcagctatgccagctctcaacctggcggcagcgcaaaagatg

SEQ ID NO: 205646 - DNA, 103 bp, Artificial Sequence
  Synthetic Polynucleotide
taatacgactcactatagggagcctggagatccttggcctcagagagctgaacagaggagacagctcatggaggccaagaacctggcggcagcgcaaaagatg

SEQ ID NO: 205647 - DNA, 103 bp, Artificial Sequence
  Synthetic Polynucleotide
taatacgactcactatagggaggcctttcgagcctggagatccttggcctaacagaggagaaggccaatgatctccaggaacctggcggcagcgcaaaagatg

SEQ ID NO: 205648 - DNA, 103 bp, Artificial Sequence
  Synthetic Polynucleotide
taatacgactcactatagggttgcagttgaaggcctttcgagcctggagaaacagaggagatctccaatgtcgaaaggcaacctggcggcagcgcaaaagatg

SEQ ID NO: 205649 - DNA, 103 bp, Artificial Sequence
  Synthetic Polynucleotide
taatacgactcactataggggttgcagtatttgcagttgaaggcctttcgaacagaggagacgaaagatgttcaactgcaacctggcggcagcgcaaaagatg

SEQ ID NO: 205650 - DNA, 103 bp, Artificial Sequence
  Synthetic Polynucleotide
taatacgactcactatagggggtattccttgttgcagtatttgcagttgaaacagaggagatcaactatgaatactgcaaacctggcggcagcgcaaaagatg

SEQ ID NO: 205651 - DNA, 103 bp, Artificial Sequence
  Synthetic Polynucleotide
taatacgactcactatagggcccaggctgaggtattccttgttgcagtataacagaggagaatactgatgcaaggaataaacctggcggcagcgcaaaagatg

SEQ ID NO: 205652 - DNA, 103 bp, Artificial Sequence
  Synthetic Polynucleotide
taatacgactcactatagggcttgagggcacccaggctgaggtattccttaacagaggagaaaggaaatgctcagcctgaacctggcggcagcgcaaaagatg

SEQ ID NO: 205653 - DNA, 103 bp, Artificial Sequence
  Synthetic Polynucleotide
taatacgactcactatagggcctgcagctcgctgtagttaggcttccgataacagaggagaatcggaatgctaactacaaacctggcggcagcgcaaaagatg

SEQ ID NO: 205654 - DNA, 103 bp, Artificial Sequence
  Synthetic Polynucleotide
taatacgactcactatagggggatgtgcatcttgagggcacccaggctgaaacagaggagatcagccatggtgccctcaaacctggcggcagcgcaaaagatg

SEQ ID NO: 205655 - DNA, 103 bp, Artificial Sequence
  Synthetic Polynucleotide
taatacgactcactataggggtgtggcttcggatgtgcatcttgagggcaaacagaggagatgccctatggatgcacataacctggcggcagcgcaaaagatg

SEQ ID NO: 205656 - DNA, 103 bp, Artificial Sequence
  Synthetic Polynucleotide
taatacgactcactataggggcagggcagcgtgtggcttcggatgtgcataacagaggagaatgcacatgcgaagccacaacctggcggcagcgcaaaagatg

SEQ ID NO: 205657 - DNA, 103 bp, Artificial Sequence
  Synthetic Polynucleotide
taatacgactcactatagggttccgcagacgcagggcagcgtgtggcttcaacagaggagagaagccatgcgctgccctaacctggcggcagcgcaaaagatg

SEQ ID NO: 205658 - DNA, 103 bp, Artificial Sequence
  Synthetic Polynucleotide
taatacgactcactatagggttcccgcaggttccgcagacgcagggcagcaacagaggagagctgccatgcgtctgcggaacctggcggcagcgcaaaagatg

SEQ ID NO: 205659 - DNA, 103 bp, Artificial Sequence
  Synthetic Polynucleotide
taatacgactcactatagggagagaaggccttcccgcaggttccgcagacaacagaggagagtctgcatgacctgcgggaacctggcggcagcgcaaaagatg

SEQ ID NO: 205660 - DNA, 103 bp, Artificial Sequence
  Synthetic Polynucleotide
taatacgactcactataggggccagggcctagagaaggccttcccgcaggaacagaggagacctgcgatgaggccttctaacctggcggcagcgcaaaagatg

SEQ ID NO: 205661 - DNA, 103 bp, Artificial Sequence
  Synthetic Polynucleotide
taatacgactcactatagggccttgtagcagccagggcctagagaaggccaacagaggagaggccttatgtaggccctgaacctggcggcagcgcaaaagatg

SEQ ID NO: 205662 - DNA, 103 bp, Artificial Sequence
  Synthetic Polynucleotide
taatacgactcactatagggccggacatggccttgtagcagccagggcctaacagaggagaaggcccatgctgctacaaaacctggcggcagcgcaaaagatg

SEQ ID NO: 205663 - DNA, 103 bp, Artificial Sequence
  Synthetic Polynucleotide
taatacgactcactatagggcagtgtgggtccggacatggccttgtagcaaacagaggagatgctacatggccatgtccaacctggcggcagcgcaaaagatg

SEQ ID NO: 205664 - DNA, 103 bp, Artificial Sequence
  Synthetic Polynucleotide
taatacgactcactatagggggattagagtcctgcagctcgctgtagttaaacagaggagataactaatgcgagctgcaaacctggcggcagcgcaaaagatg

SEQ ID NO: 205665 - DNA, 103 bp, Artificial Sequence
  Synthetic Polynucleotide
taatacgactcactatagggggcttctcgccagtgtgggtccggacatggaacagaggagaccatgtatggacccacacaacctggcggcagcgcaaaagatg

SEQ ID NO: 205666 - DNA, 103 bp, Artificial Sequence
  Synthetic Polynucleotide
taatacgactcactatagggacaggagaagggcttctcgccagtgtgggtaacagaggagaacccacatgggcgagaagaacctggcggcagcgcaaaagatg

SEQ ID NO: 205667 - DNA, 103 bp, Artificial Sequence
  Synthetic Polynucleotide
taatacgactcactatagggtgcagtggggacaggagaagggcttctcgcaacagaggagagcgagaatgccttctcctaacctggcggcagcgcaaaagatg

SEQ ID NO: 205668 - DNA, 103 bp, Artificial Sequence
  Synthetic Polynucleotide
taatacgactcactatagggaaggcacggctgcagtggggacaggagaagaacagaggagacttctcatgtccccactgaacctggcggcagcgcaaaagatg

SEQ ID NO: 205669 - DNA, 103 bp, Artificial Sequence
  Synthetic Polynucleotide
taatacgactcactataggggcggtcagcgaaggcacggctgcagtggggaacagaggagaccccacatgagccgtgccaacctggcggcagcgcaaaagatg

SEQ ID NO: 205670 - DNA, 103 bp, Artificial Sequence
  Synthetic Polynucleotide
taatacgactcactataggggcaggttggagcggtcagcgaaggcacggcaacagaggagagccgtgatgtcgctgaccaacctggcggcagcgcaaaagatg

SEQ ID NO: 205671 - DNA, 103 bp, Artificial Sequence
  Synthetic Polynucleotide
taatacgactcactatagggaggtgggcccgcaggttggagcggtcagcgaacagaggagacgctgaatgctccaacctaacctggcggcagcgcaaaagatg

SEQ ID NO: 205672 - DNA, 103 bp, Artificial Sequence
  Synthetic Polynucleotide
taatacgactcactataggggtgggtctggaggtgggcccgcaggttggaaacagaggagatccaacatgcgggcccacaacctggcggcagcgcaaaagatg

SEQ ID NO: 205673 - DNA, 103 bp, Artificial Sequence
  Synthetic Polynucleotide
taatacgactcactatagggtgacatctgagtgggtctggaggtgggcccaacagaggagagggcccatgtccagacccaacctggcggcagcgcaaaagatg

SEQ ID NO: 205674 - DNA, 103 bp, Artificial Sequence
  Synthetic Polynucleotide
taatacgactcactatagggtggtacttcttgacatctgagtgggtctggaacagaggagaccagacatgctcagatgtaacctggcggcagcgcaaaagatg

SEQ ID NO: 205675 - DNA, 103 bp, Artificial Sequence
  Synthetic Polynucleotide
taatacgactcactatagggggtaaactctggattagagtcctgcagctcaacagaggagagagctgatggactctaataacctggcggcagcgcaaaagatg

SEQ ID NO: 205676 - DNA, 103 bp, Artificial Sequence
  Synthetic Polynucleotide
taatacgactcactatagggcgcctggcactggtacttcttgacatctgaaacagaggagatcagatatgaagaagtacaacctggcggcagcgcaaaagatg

SEQ ID NO: 205677 - DNA, 103 bp, Artificial Sequence
  Synthetic Polynucleotide
taatacgactcactatagggtccgagcacacgcctggcactggtacttctaacagaggagaagaagtatgagtgccaggaacctggcggcagcgcaaaagatg

SEQ ID NO: 205678 - DNA, 103 bp, Artificial Sequence
  Synthetic Polynucleotide
taatacgactcactatagggcgggagaaggtccgagcacacgcctggcacaacagaggagagtgccaatggtgtgctcgaacctggcggcagcgcaaaagatg

SEQ ID NO: 205679 - DNA, 103 bp, Artificial Sequence
  Synthetic Polynucleotide
taatacgactcactatagggcagggacattcgggagaaggtccgagcacaaacagaggagatgtgctatgaccttctccaacctggcggcagcgcaaaagatg

SEQ ID NO: 205680 - DNA, 103 bp, Artificial Sequence
  Synthetic Polynucleotide
taatacgactcactataggggcttgtggagcagggacattcgggagaaggaacagaggagaccttctatggaatgtcccaacctggcggcagcgcaaaagatg

SEQ ID NO: 205681 - DNA, 103 bp, Artificial Sequence
  Synthetic Polynucleotide
taatacgactcactataggggactcttggtgcttgtggagcagggacattaacagaggagaaatgtcatggctccacaaaacctggcggcagcgcaaaagatg

SEQ ID NO: 205682 - DNA, 103 bp, Artificial Sequence
  Synthetic Polynucleotide
taatacgactcactatagggtgagcagccggactcttggtgcttgtggagaacagaggagactccacatgcaccaagagaacctggcggcagcgcaaaagatg

SEQ ID NO: 205683 - DNA, 103 bp, Artificial Sequence
  Synthetic Polynucleotide
taatacgactcactatagggggggacatcctgagcagccggactcttggtaacagaggagaaccaagatgccggctgctaacctggcggcagcgcaaaagatg

SEQ ID NO: 205684 - DNA, 103 bp, Artificial Sequence
  Synthetic Polynucleotide
taatacgactcactataggggctgctggaaggtaaactctggattagagtaacagaggagaactctaatgcagagtttaaacctggcggcagcgcaaaagatg

SEQ ID NO: 205685 - DNA, 103 bp, Artificial Sequence
  Synthetic Polynucleotide
taatacgactcactatagggtggtcgtagggctgctggaaggtaaactctaacagaggagaagagttatgcttccagcaaacctggcggcagcgcaaaagatg

SEQ ID NO: 205686 - DNA, 103 bp, Artificial Sequence
  Synthetic Polynucleotide
taatacgactcactatagggatgcttcttgaccaggaaggagcgcggcataacagaggagaatgccgatgtccttcctgaacctggcggcagcgcaaaagatg

SEQ ID NO: 205687 - DNA, 103 bp, Artificial Sequence
  Synthetic Polynucleotide
taatacgactcactatagggaggcatggagtaactctcatagagatacggaacagaggagaccgtatatgtatgagagtaacctggcggcagcgcaaaagatg

SEQ ID NO: 205688 - DNA, 103 bp, Artificial Sequence
  Synthetic Polynucleotide
taatacgactcactataggggtggtatgacaggcatggagtaactctcataacagaggagaatgagaatgactccatgcaacctggcggcagcgcaaaagatg

SEQ ID NO: 205689 - DNA, 103 bp, Artificial Sequence
  Synthetic Polynucleotide
taatacgactcactatagggatctctggttgtggtatgacaggcatggagaacagaggagactccatatgtgtcataccaacctggcggcagcgcaaaagatg

SEQ ID NO: 205690 - DNA, 103 bp, Artificial Sequence
  Synthetic Polynucleotide
taatacgactcactatagggtgagctgaggatctctggttgtggtatgacaacagaggagagtcataatgcaaccagagaacctggcggcagcgcaaaagatg

SEQ ID NO: 205691 - DNA, 103 bp, Artificial Sequence
  Synthetic Polynucleotide
taatacgactcactatagggtgtatgctcctgagctgaggatctctggttaacagaggagaaaccagatgtcctcagctaacctggcggcagcgcaaaagatg

SEQ ID NO: 205692 - DNA, 103 bp, Artificial Sequence
  Synthetic Polynucleotide
taatacgactcactataggggtgatggggctgtatgctcctgagctgaggaacagaggagacctcagatgaggagcataaacctggcggcagcgcaaaagatg

SEQ ID NO: 205693 - DNA, 103 bp, Artificial Sequence
  Synthetic Polynucleotide
taatacgactcactatagggagtccacacagtgatggggctgtatgctccaacagaggagaggagcaatgagccccatcaacctggcggcagcgcaaaagatg

SEQ ID NO: 205694 - DNA, 103 bp, Artificial Sequence
  Synthetic Polynucleotide
taatacgactcactataggggagcagcggtagtccacacagtgatggggcaacagaggagagccccaatgctgtgtggaaacctggcggcagcgcaaaagatg

SEQ ID NO: 205695 - DNA, 103 bp, Artificial Sequence
  Synthetic Polynucleotide
taatacgactcactataggggcgtggaatggagcagcggtagtccacacaaacagaggagatgtgtgatgtaccgctgcaacctggcggcagcgcaaaagatg

SEQ ID NO: 205696 - DNA, 103 bp, Artificial Sequence
  Synthetic Polynucleotide
taatacgactcactataggggggtagctgggcgtggaatggagcagcggtaacagaggagaaccgctatgccattccacaacctggcggcagcgcaaaagatg

SEQ ID NO: 205697 - DNA, 103 bp, Artificial Sequence
  Synthetic Polynucleotide
taatacgactcactatagggaggcgttgaaatgcttcttgaccaggaaggaacagaggagaccttccatgtcaagaagcaacctggcggcagcgcaaaagatg

SEQ ID NO: 205698 - DNA, 103 bp, Artificial Sequence
  Synthetic Polynucleotide
taatacgactcactatagggagaggccattgggtagctgggcgtggaatgaacagaggagacattccatgcccagctacaacctggcggcagcgcaaaagatg

SEQ ID NO: 205699 - DNA, 103 bp, Artificial Sequence
  Synthetic Polynucleotide
taatacgactcactataggggaaagaggagagaggccattgggtagctggaacagaggagaccagctatgcaatggcctaacctggcggcagcgcaaaagatg

SEQ ID NO: 205700 - DNA, 103 bp, Artificial Sequence
  Synthetic Polynucleotide
taatacgactcactatagggggagtatccggaaagaggagagaggccattaacagaggagaaatggcatgtctcctcttaacctggcggcagcgcaaaagatg

SEQ ID NO: 205701 - DNA, 103 bp, Artificial Sequence
  Synthetic Polynucleotide
taatacgactcactatagggccaaagatgaggagtatccggaaagaggagaacagaggagactcctcatgccggatactaacctggcggcagcgcaaaagatg

SEQ ID NO: 205702 - DNA, 103 bp, Artificial Sequence
  Synthetic Polynucleotide
taatacgactcactatagggctcactcgccccaaagatgaggagtatccgaacagaggagacggataatgctcatctttaacctggcggcagcgcaaaagatg

SEQ ID NO: 205703 - DNA, 103 bp, Artificial Sequence
  Synthetic Polynucleotide
taatacgactcactatagggaggagggggactcactcgccccaaagatgaaacagaggagatcatctatggggcgagtgaacctggcggcagcgcaaaagatg

SEQ ID NO: 205704 - DNA, 103 bp, Artificial Sequence
  Synthetic Polynucleotide
taatacgactcactatagggtgtcagatggaggagggggactcactcgccaacagaggagaggcgagatggtccccctcaacctggcggcagcgcaaaagatg

SEQ ID NO: 205705 - DNA, 103 bp, Artificial Sequence
  Synthetic Polynucleotide
taatacgactcactatagggttggaggaggtgtcagatggaggagggggaaacagaggagatcccccatgtccatctgaaacctggcggcagcgcaaaagatg

SEQ ID NO: 205706 - DNA, 103 bp, Artificial Sequence
  Synthetic Polynucleotide
taatacgactcactatagggactgtggtccttggaggaggtgtcagatggaacagaggagaccatctatgacctcctccaacctggcggcagcgcaaaagatg

SEQ ID NO: 205707 - DNA, 103 bp, Artificial Sequence
  Synthetic Polynucleotide
taatacgactcactatagggtttctgagccactgtggtccttggaggaggaacagaggagacctcctatgaggaccacaaacctggcggcagcgcaaaagatg

SEQ ID NO: 205708 - DNA, 103 bp, Artificial Sequence
  Synthetic Polynucleotide
taatacgactcactatagggggctttttggaggcgttgaaatgcttcttgaacagaggagacaagaaatgtttcaacgcaacctggcggcagcgcaaaagatg

SEQ ID NO: 205709 - DNA, 103 bp, Artificial Sequence
  Synthetic Polynucleotide
taatacgactcactatagggctaatggggctttctgagccactgtggtccaacagaggagaggaccaatgtggctcagaaacctggcggcagcgcaaaagatg

SEQ ID NO: 205710 - DNA, 103 bp, Artificial Sequence
  Synthetic Polynucleotide
taatacgactcactatagggctcttcatcactaatggggctttctgagccaacagaggagaggctcaatgagccccattaacctggcggcagcgcaaaagatg

SEQ ID NO: 205711 - DNA, 103 bp, Artificial Sequence
  Synthetic Polynucleotide
taatacgactcactataggggtagtctttcctcttcatcactaatggggcaacagaggagagccccaatggtgatgaagaacctggcggcagcgcaaaagatg

SEQ ID NO: 205712 - DNA, 103 bp, Artificial Sequence
  Synthetic Polynucleotide
taatacgactcactatagggagcttggactgtagtctttcctcttcatcaaacagaggagatgatgaatgggaaagactaacctggcggcagcgcaaaagatg

SEQ ID NO: 205713 - DNA, 103 bp, Artificial Sequence
  Synthetic Polynucleotide
taatacgactcactatagggggggtctgaaagcttggactgtagtctttcaacagaggagagaaagaatgcagtccaagaacctggcggcagcgcaaaagatg

SEQ ID NO: 205714 - DNA, 103 bp, Artificial Sequence
  Synthetic Polynucleotide
taatacgactcactatagggcaatggcatgggggtctgaaagcttggactaacagaggagaagtccaatgtttcagaccaacctggcggcagcgcaaaagatg

SEQ ID NO: 205715 - DNA, 103 bp, Artificial Sequence
  Synthetic Polynucleotide
taatacgactcactatagggttttcagcttcaatggcatgggggtctgaaaacagaggagattcagaatgccatgccataacctggcggcagcgcaaaagatg

SEQ ID NO: 205716 - DNA, 103 bp, Artificial Sequence
  Synthetic Polynucleotide
taatacgactcactataggggcactgaaacttttcagcttcaatggcatgaacagaggagacatgccatggaagctgaaaacctggcggcagcgcaaaagatg

SEQ ID NO: 205717 - DNA, 103 bp, Artificial Sequence
  Synthetic Polynucleotide
taatacgactcactatagggtgcataaattgcactgaaacttttcagcttaacagaggagaaagctgatgagtttcagtaacctggcggcagcgcaaaagatg

SEQ ID NO: 205718 - DNA, 103 bp, Artificial Sequence
  Synthetic Polynucleotide
taatacgactcactatagggtaggtcttattgcataaattgcactgaaacaacagaggagagtttcaatgcaatttatgaacctggcggcagcgcaaaagatg

SEQ ID NO: 205719 - DNA, 103 bp, Artificial Sequence
  Synthetic Polynucleotide
taatacgactcactataggggctgtagtttggctttttggaggcgttgaaaacagaggagattcaacatgtccaaaaagaacctggcggcagcgcaaaagatg

SEQ ID NO: 205720 - DNA, 103 bp, Artificial Sequence
  Synthetic Polynucleotide
taatacgactcactatagggaaaagttgaataggtcttattgcataaattaacagaggagaaatttaatgaataagaccaacctggcggcagcgcaaaagatg

SEQ ID NO: 205721 - DNA, 103 bp, Artificial Sequence
  Synthetic Polynucleotide
taatacgactcactatagggccagcccagaaaaagttgaataggtcttataacagaggagaataagaatgattcaacttaacctggcggcagcgcaaaagatg

SEQ ID NO: 205722 - DNA, 103 bp, Artificial Sequence
  Synthetic Polynucleotide
taatacgactcactatagggttatgtttggccagcccagaaaaagttgaaaacagaggagattcaacatgttctgggctaacctggcggcagcgcaaaagatg

SEQ ID NO: 205723 - DNA, 103 bp, Artificial Sequence
  Synthetic Polynucleotide
taatacgactcactataggggtgcagctgcttatgtttggccagcccagaaacagaggagatctgggatggccaaacataacctggcggcagcgcaaaagatg

SEQ ID NO: 205724 - DNA, 103 bp, Artificial Sequence
  Synthetic Polynucleotide
taatacgactcactataggggggcatcgcagtgcagctgcttatgtttggaacagaggagaccaaacatgagcagctgcaacctggcggcagcgcaaaagatg

SEQ ID NO: 205725 - DNA, 103 bp, Artificial Sequence
  Synthetic Polynucleotide
taatacgactcactatagggtttctagactgggcatcgcagtgcagctgcaacagaggagagcagctatgctgcgatgcaacctggcggcagcgcaaaagatg

SEQ ID NO: 205726 - DNA, 103 bp, Artificial Sequence
  Synthetic Polynucleotide
taatacgactcactataggggctgaaagattttctagactgggcatcgcaaacagaggagatgcgatatgcagtctagaaacctggcggcagcgcaaaagatg

SEQ ID NO: 205727 - DNA, 103 bp, Artificial Sequence
  Synthetic Polynucleotide
taatacgactcactatagggagtatttacagctgaaagattttctagactaacagaggagaagtctaatgaatctttcaaacctggcggcagcgcaaaagatg

SEQ ID NO: 205728 - DNA, 103 bp, Artificial Sequence
  Synthetic Polynucleotide
taatacgactcactatagggtccttgtcacagtatttacagctgaaagataacagaggagaatctttatgctgtaaataaacctggcggcagcgcaaaagatg

SEQ ID NO: 205729 - DNA, 103 bp, Artificial Sequence
  Synthetic Polynucleotide
taatacgactcactataggggctcacatattccttgtcacagtatttacaaacagaggagatgtaaaatgtgtgacaagaacctggcggcagcgcaaaagatg

SEQ ID NO: 205730 - DNA, 103 bp, Artificial Sequence
  Synthetic Polynucleotide
taatacgactcactatagggtgtccagttcgctgtagtttggctttttggaacagaggagaccaaaaatgcaaactacaaacctggcggcagcgcaaaagatg

SEQ ID NO: 205731 - DNA, 103 bp, Artificial Sequence
  Synthetic Polynucleotide
taatacgactcactataggggggcgcccaggctcacatattccttgtcacaacagaggagagtgacaatgaatatgtgaaacctggcggcagcgcaaaagatg

SEQ ID NO: 205732 - DNA, 103 bp, Artificial Sequence
  Synthetic Polynucleotide
taatacgactcactatagggtgcatcttcagggcgcccaggctcacatataacagaggagaatatgtatgcctgggcgcaacctggcggcagcgcaaaagatg

SEQ ID NO: 205733 - DNA, 103 bp, Artificial Sequence
  Synthetic Polynucleotide
taatacgactcactatagggggtccgaatatgcatcttcagggcgcccagaacagaggagactgggcatgctgaagatgaacctggcggcagcgcaaaagatg

SEQ ID NO: 205734 - DNA, 103 bp, Artificial Sequence
  Synthetic Polynucleotide
taatacgactcactataggggtaatgtgtgggtccgaatatgcatcttcaaacagaggagatgaagaatgatattcggaaacctggcggcagcgcaaaagatg

SEQ ID NO: 205735 - DNA, 103 bp, Artificial Sequence
  Synthetic Polynucleotide
taatacgactcactatagggcaaacacaaggtaatgtgtgggtccgaataaacagaggagatattcgatgccacacattaacctggcggcagcgcaaaagatg

SEQ ID NO: 205736 - DNA, 103 bp, Artificial Sequence
  Synthetic Polynucleotide
taatacgactcactataggggcagatcttgcaaacacaaggtaatgtgtgaacagaggagacacacaatgccttgtgttaacctggcggcagcgcaaaagatg

SEQ ID NO: 205737 - DNA, 103 bp, Artificial Sequence
  Synthetic Polynucleotide
taatacgactcactatagggacgccttgccgcagatcttgcaaacacaagaacagaggagacttgtgatggcaagatctaacctggcggcagcgcaaaagatg

SEQ ID NO: 205738 - DNA, 103 bp, Artificial Sequence
  Synthetic Polynucleotide
taatacgactcactatagggggtctggaaaacgccttgccgcagatcttgaacagaggagacaagatatgcggcaaggcaacctggcggcagcgcaaaagatg

SEQ ID NO: 205739 - DNA, 103 bp, Artificial Sequence
  Synthetic Polynucleotide
taatacgactcactatagggaagcaaccagggtctggaaaacgccttgccaacagaggagaggcaagatgttttccagaaacctggcggcagcgcaaaagatg

SEQ ID NO: 205740 - DNA, 103 bp, Artificial Sequence
  Synthetic Polynucleotide
taatacgactcactatagggtgtgtccttgaagcaaccagggtctggaaaaacagaggagatttccaatgcctggttgcaacctggcggcagcgcaaaagatg

SEQ ID NO: 205741 - DNA, 103 bp, Artificial Sequence
  Synthetic Polynucleotide
taatacgactcactatagggactgtatgtgtgtccagttcgctgtagtttaacagaggagaaaactaatgcgaactggaaacctggcggcagcgcaaaagatg

SEQ ID NO: 205742 - DNA, 103 bp, Artificial Sequence
  Synthetic Polynucleotide
taatacgactcactatagggtgagttctaatgtgtccttgaagcaaccagaacagaggagactggttatgtcaaggacaaacctggcggcagcgcaaaagatg

SEQ ID NO: 205743 - DNA, 103 bp, Artificial Sequence
  Synthetic Polynucleotide
taatacgactcactatagggctcccccgtgtgagttctaatgtgtccttgaacagaggagacaaggaatgattagaactaacctggcggcagcgcaaaagatg

SEQ ID NO: 205744 - DNA, 103 bp, Artificial Sequence
  Synthetic Polynucleotide
taatacgactcactatagggaaaaaggcttctcccccgtgtgagttctaaaacagaggagattagaaatgacacgggggaacctggcggcagcgcaaaagatg

SEQ ID NO: 205745 - DNA, 103 bp, Artificial Sequence
  Synthetic Polynucleotide
taatacgactcactatagggtgagggcaagaaaaaggcttctcccccgtgaacagaggagacacgggatggaagcctttaacctggcggcagcgcaaaagatg

SEQ ID NO: 205746 - DNA, 103 bp, Artificial Sequence
  Synthetic Polynucleotide
taatacgactcactatagggtctgttgcagtgagggcaagaaaaaggcttaacagaggagaaagcctatgtcttgccctaacctggcggcagcgcaaaagatg

SEQ ID NO: 205747 - DNA, 103 bp, Artificial Sequence
  Synthetic Polynucleotide
taatacgactcactatagggctgcaaatgctctgttgcagtgagggcaagaacagaggagacttgccatgactgcaacaaacctggcggcagcgcaaaagatg

SEQ ID NO: 205748 - DNA, 103 bp, Artificial Sequence
  Synthetic Polynucleotide
taatacgactcactatagggtttgacctgtctgcaaatgctctgttgcagaacagaggagactgcaaatgagcatttgcaacctggcggcagcgcaaaagatg

SEQ ID NO: 205749 - DNA, 103 bp, Artificial Sequence
  Synthetic Polynucleotide
taatacgactcactatagggagccctcagatttgacctgtctgcaaatgcaacagaggagagcatttatggacaggtcaaacctggcggcagcgcaaaagatg

SEQ ID NO: 205750 - DNA, 103 bp, Artificial Sequence
  Synthetic Polynucleotide
taatacgactcactatagggtctgcagatgagccctcagatttgacctgtaacagaggagaacaggtatgatctgagggaacctggcggcagcgcaaaagatg

SEQ ID NO: 205751 - DNA, 103 bp, Artificial Sequence
  Synthetic Polynucleotide
taatacgactcactatagggtcagaatgggtctgcagatgagccctcagaaacagaggagatctgagatgtcatctgcaaacctggcggcagcgcaaaagatg

SEQ ID NO: 205752 - DNA, 103 bp, Artificial Sequence
  Synthetic Polynucleotide
taatacgactcactatagggggaaataatcactgtatgtgtgtccagttcaacagaggagagaactgatgacacatacaaacctggcggcagcgcaaaagatg

SEQ ID NO: 205753 - DNA, 103 bp, Artificial Sequence
  Synthetic Polynucleotide
taatacgactcactatagggtttctttacatcagaatgggtctgcagatgaacagaggagacatctgatgacccattctaacctggcggcagcgcaaaagatg

SEQ ID NO: 205754 - DNA, 103 bp, Artificial Sequence
  Synthetic Polynucleotide
taatacgactcactatagggtgcactggtatttctttacatcagaatgggaacagaggagacccattatgatgtaaagaaacctggcggcagcgcaaaagatg

SEQ ID NO: 205755 - DNA, 103 bp, Artificial Sequence
  Synthetic Polynucleotide
taatacgactcactataggggagcagtttttgcactggtatttctttacaaacagaggagatgtaaaatgataccagtgaacctggcggcagcgcaaaagatg

SEQ ID NO: 205756 - DNA, 103 bp, Artificial Sequence
  Synthetic Polynucleotide
taatacgactcactataggggaaggttttggagcagtttttgcactggtaaacagaggagataccagatgaaaaactgcaacctggcggcagcgcaaaagatg

SEQ ID NO: 205757 - DNA, 103 bp, Artificial Sequence
  Synthetic Polynucleotide
taatacgactcactatagggacattctggagaaggttttggagcagttttaacagaggagaaaaactatgccaaaacctaacctggcggcagcgcaaaagatg

SEQ ID NO: 205758 - DNA, 103 bp, Artificial Sequence
  Synthetic Polynucleotide
taatacgactcactatagggtgcaggagagacattctggagaaggttttgaacagaggagacaaaacatgctccagaataacctggcggcagcgcaaaagatg

SEQ ID NO: 205759 - DNA, 103 bp, Artificial Sequence
  Synthetic Polynucleotide
taatacgactcactatagggctcatgtttgtgcaggagagacattctggaaacagaggagatccagaatgtctctcctgaacctggcggcagcgcaaaagatg

SEQ ID NO: 205760 - DNA, 103 bp, Artificial Sequence
  Synthetic Polynucleotide
taatacgactcactatagggagccagattcctcatgtttgtgcaggagagaacagaggagactctccatgacaaacatgaacctggcggcagcgcaaaagatg

SEQ ID NO: 205761 - DNA, 103 bp, Artificial Sequence
  Synthetic Polynucleotide
taatacgactcactataggggctacacagcagccagattcctcatgtttgaacagaggagacaaacaatgggaatctggaacctggcggcagcgcaaaagatg

SEQ ID NO: 205762 - DNA, 103 bp, Artificial Sequence
  Synthetic Polynucleotide
taatacgactcactatagggagagatacggggaaataatcactgtatgtgaacagaggagacacataatgtgattatttaacctggcggcagcgcaaaagatg

SEQ ID NO: 205763 - DNA, 103 bp, Artificial Sequence
  Synthetic Polynucleotide
taatacgactcactatagggtaactctcatagagatacggggaaataatcaacagaggagagattatatgcccgtatctaacctggcggcagcgcaaaagatg

SEQ ID NO: 205764 - DNA, 103 bp, Artificial Sequence
  Synthetic Polynucleotide
taatacgactcactataggggtgcgttttcaccaggaaggagcgcggcataacagaggagaatgccgatgtccttcctgaacctggcggcagcgcaaaagatg

SEQ ID NO: 205765 - DNA, 103 bp, Artificial Sequence
  Synthetic Polynucleotide
taatacgactcactataggggggcaccaccagccccccacaggcagagcaaacagaggagatgctctatgtgtggggggaacctggcggcagcgcaaaagatg

SEQ ID NO: 205766 - DNA, 103 bp, Artificial Sequence
  Synthetic Polynucleotide
taatacgactcactataggggggggaggaggggcaccaccagccccccacaacagaggagagtggggatgtggtggtgcaacctggcggcagcgcaaaagatg

SEQ ID NO: 205767 - DNA, 103 bp, Artificial Sequence
  Synthetic Polynucleotide
taatacgactcactatagggtccttgtctcgggggaggaggggcaccaccaacagaggagaggtggtatgcctcctcccaacctggcggcagcgcaaaagatg

SEQ ID NO: 205768 - DNA, 103 bp, Artificial Sequence
  Synthetic Polynucleotide
taatacgactcactatagggagaaggggcctccttgtctcgggggaggagaacagaggagactcctcatgcgagacaagaacctggcggcagcgcaaaagatg

SEQ ID NO: 205769 - DNA, 103 bp, Artificial Sequence
  Synthetic Polynucleotide
taatacgactcactatagggcaccgggcacagaaggggcctccttgtctcaacagaggagagagacaatgaggccccttaacctggcggcagcgcaaaagatg

SEQ ID NO: 205770 - DNA, 103 bp, Artificial Sequence
  Synthetic Polynucleotide
taatacgactcactatagggtggggaaggtcaccgggcacagaaggggccaacagaggagaggccccatgtgtgcccggaacctggcggcagcgcaaaagatg

SEQ ID NO: 205771 - DNA, 103 bp, Artificial Sequence
  Synthetic Polynucleotide
taatacgactcactataggggtcccagggctggggaaggtcaccgggcacaacagaggagagtgcccatggaccttcccaacctggcggcagcgcaaaagatg

SEQ ID NO: 205772 - DNA, 103 bp, Artificial Sequence
  Synthetic Polynucleotide
taatacgactcactatagggccgaggagcggtcccagggctggggaaggtaacagaggagaaccttcatgagccctgggaacctggcggcagcgcaaaagatg

SEQ ID NO: 205773 - DNA, 103 bp, Artificial Sequence
  Synthetic Polynucleotide
taatacgactcactatagggcaggcgacggccgaggagcggtcccagggcaacagaggagagccctgatgccgctcctcaacctggcggcagcgcaaaagatg

SEQ ID NO: 205774 - DNA, 103 bp, Artificial Sequence
  Synthetic Polynucleotide
taatacgactcactatagggcagggagatgcaggcgacggccgaggagcgaacagaggagacgctccatggccgtcgccaacctggcggcagcgcaaaagatg

SEQ ID NO: 205775 - DNA, 103 bp, Artificial Sequence
  Synthetic Polynucleotide
taatacgactcactatagggtgtggctggagtgcgttttcaccaggaaggaacagaggagaccttccatgtgaaaacgcaacctggcggcagcgcaaaagatg

SEQ ID NO: 205776 - DNA, 103 bp, Artificial Sequence
  Synthetic Polynucleotide
taatacgactcactataggggcaggaggggcagggagatgcaggcgacggaacagaggagaccgtcgatggcatctcccaacctggcggcagcgcaaaagatg

SEQ ID NO: 205777 - DNA, 103 bp, Artificial Sequence
  Synthetic Polynucleotide
taatacgactcactatagggtcgatccgtggcaggaggggcagggagatgaacagaggagacatctcatggcccctcctaacctggcggcagcgcaaaagatg

SEQ ID NO: 205778 - DNA, 103 bp, Artificial Sequence
  Synthetic Polynucleotide
taatacgactcactatagggcagagcttcctcgatccgtggcaggaggggaacagaggagacccctcatgccacggatcaacctggcggcagcgcaaaagatg

SEQ ID NO: 205779 - DNA, 103 bp, Artificial Sequence
  Synthetic Polynucleotide
taatacgactcactatagggcagaggcccccagagcttcctcgatccgtgaacagaggagacacggaatgaggaagctcaacctggcggcagcgcaaaagatg

SEQ ID NO: 205780 - DNA, 103 bp, Artificial Sequence
  Synthetic Polynucleotide
taatacgactcactataggggcgtccagcccagaggcccccagagcttccaacagaggagaggaagcatggggggcctcaacctggcggcagcgcaaaagatg

SEQ ID NO: 205781 - DNA, 103 bp, Artificial Sequence
  Synthetic Polynucleotide
taatacgactcactataggggacttccaaggcgtccagcccagaggccccaacagaggagaggggccatggggctggacaacctggcggcagcgcaaaagatg

SEQ ID NO: 205782 - DNA, 103 bp, Artificial Sequence
  Synthetic Polynucleotide
taatacgactcactatagggcgacctcgctgacttccaaggcgtccagccaacagaggagaggctggatgccttggaagaacctggcggcagcgcaaaagatg

SEQ ID NO: 205783 - DNA, 103 bp, Artificial Sequence
  Synthetic Polynucleotide
taatacgactcactataggggcccgagggtcgacctcgctgacttccaagaacagaggagacttggaatgcagcgaggtaacctggcggcagcgcaaaagatg

SEQ ID NO: 205784 - DNA, 103 bp, Artificial Sequence
  Synthetic Polynucleotide
taatacgactcactatagggggcccggctggcccgagggtcgacctcgctaacagaggagaagcgagatggaccctcggaacctggcggcagcgcaaaagatg

SEQ ID NO: 205785 - DNA, 103 bp, Artificial Sequence
  Synthetic Polynucleotide
taatacgactcactataggggtacaatggcggcccggctggcccgagggtaacagaggagaaccctcatgccagccgggaacctggcggcagcgcaaaagatg

SEQ ID NO: 205786 - DNA, 103 bp, Artificial Sequence
  Synthetic Polynucleotide
taatacgactcactatagggttggggaccctgtggctggagtgcgttttcaacagaggagagaaaacatgctccagccaaacctggcggcagcgcaaaagatg

SEQ ID NO: 205787 - DNA, 103 bp, Artificial Sequence
  Synthetic Polynucleotide
taatacgactcactatagggtctttgaggggtacaatggcggcccggctgaacagaggagacagccgatgcgccattgtaacctggcggcagcgcaaaagatg

SEQ ID NO: 205788 - DNA, 103 bp, Artificial Sequence
  Synthetic Polynucleotide
taatacgactcactataggggttcaggctgtctttgaggggtacaatggcaacagaggagagccattatgcccctcaaaaacctggcggcagcgcaaaagatg

SEQ ID NO: 205789 - DNA, 103 bp, Artificial Sequence
  Synthetic Polynucleotide
taatacgactcactatagggggttgaggtggttcaggctgtctttgagggaacagaggagaccctcaatgacagcctgaaacctggcggcagcgcaaaagatg

SEQ ID NO: 205790 - DNA, 103 bp, Artificial Sequence
  Synthetic Polynucleotide
taatacgactcactatagggagtgggggcaggttgaggtggttcaggctgaacagaggagacagcctatgccacctcaaaacctggcggcagcgcaaaagatg

SEQ ID NO: 205791 - DNA, 103 bp, Artificial Sequence
  Synthetic Polynucleotide
taatacgactcactatagggcagcaccagcagtgggggcaggttgaggtgaacagaggagacacctcatgctgcccccaaacctggcggcagcgcaaaagatg

SEQ ID NO: 205792 - DNA, 103 bp, Artificial Sequence
  Synthetic Polynucleotide
taatacgactcactatagggaccgtgtgggcagcaccagcagtgggggcaaacagaggagatgccccatgtgctggtgcaacctggcggcagcgcaaaagatg

SEQ ID NO: 205793 - DNA, 103 bp, Artificial Sequence
  Synthetic Polynucleotide
taatacgactcactataggggtcggggaccaccgtgtgggcagcaccagcaacagaggagagctggtatggcccacacgaacctggcggcagcgcaaaagatg

SEQ ID NO: 205794 - DNA, 103 bp, Artificial Sequence
  Synthetic Polynucleotide
taatacgactcactatagggtgggcccaaggtcggggaccaccgtgtgggaacagaggagacccacaatgtggtccccgaacctggcggcagcgcaaaagatg

SEQ ID NO: 205795 - DNA, 103 bp, Artificial Sequence
  Synthetic Polynucleotide
taatacgactcactatagggcgtgccggtctgggcccaaggtcggggaccaacagaggagaggtcccatgccttgggccaacctggcggcagcgcaaaagatg

SEQ ID NO: 205796 - DNA, 103 bp, Artificial Sequence
  Synthetic Polynucleotide
taatacgactcactatagggtccggagccccgtgccggtctgggcccaagaacagaggagacttgggatgagaccggcaaacctggcggcagcgcaaaagatg

SEQ ID NO: 205797 - DNA, 103 bp, Artificial Sequence
  Synthetic Polynucleotide
taatacgactcactatagggccgccggtagttggggaccctgtggctggaaacagaggagatccagcatgagggtccccaacctggcggcagcgcaaaagatg

SEQ ID NO: 205798 - DNA, 103 bp, Artificial Sequence
  Synthetic Polynucleotide
taatacgactcactatagggaagcagtttttccggagccccgtgccggtcaacagaggagagaccggatgggggctccgaacctggcggcagcgcaaaagatg

SEQ ID NO: 205799 - DNA, 103 bp, Artificial Sequence
  Synthetic Polynucleotide
taatacgactcactataggggctcagccccaagcagtttttccggagcccaacagaggagagggctcatgaaaaactgcaacctggcggcagcgcaaaagatg

SEQ ID NO: 205800 - DNA, 103 bp, Artificial Sequence
  Synthetic Polynucleotide
taatacgactcactatagggcggggcatccgctcagccccaagcagttttaacagaggagaaaaactatgtggggctgaaacctggcggcagcgcaaaagatg

SEQ ID NO: 205801 - DNA, 103 bp, Artificial Sequence
  Synthetic Polynucleotide
taatacgactcactataggggcccggggctcggggcatccgctcagccccaacagaggagaggggctatgcggatgcccaacctggcggcagcgcaaaagatg

SEQ ID NO: 205802 - DNA, 103 bp, Artificial Sequence
  Synthetic Polynucleotide
taatacgactcactatagggactcaaagccgcccggggctcggggcatccaacagaggagaggatgcatggagccccggaacctggcggcagcgcaaaagatg

SEQ ID NO: 205803 - DNA, 103 bp, Artificial Sequence
  Synthetic Polynucleotide
taatacgactcactatagggcagtggaagcactcaaagccgcccggggctaacagaggagaagccccatgcggctttgaaacctggcggcagcgcaaaagatg

SEQ ID NO: 205804 - DNA, 103 bp, Artificial Sequence
  Synthetic Polynucleotide
taatacgactcactataggggggtttgtggcagtggaagcactcaaagccaacagaggagaggctttatgtgcttccacaacctggcggcagcgcaaaagatg

SEQ ID NO: 205805 - DNA, 103 bp, Artificial Sequence
  Synthetic Polynucleotide
taatacgactcactataggggcgtgtggtagggtttgtggcagtggaagcaacagaggagagcttccatggccacaaacaacctggcggcagcgcaaaagatg

SEQ ID NO: 205806 - DNA, 103 bp, Artificial Sequence
  Synthetic Polynucleotide
taatacgactcactatagggagcccggccagcgtgtggtagggtttgtggaacagaggagaccacaaatgctaccacacaacctggcggcagcgcaaaagatg

SEQ ID NO: 205807 - DNA, 103 bp, Artificial Sequence
  Synthetic Polynucleotide
taatacgactcactataggggtgcctggccagcccggccagcgtgtggtaaacagaggagataccacatgctggccgggaacctggcggcagcgcaaaagatg

SEQ ID NO: 205808 - DNA, 103 bp, Artificial Sequence
  Synthetic Polynucleotide
taatacgactcactataggggcgtctccagccgccggtagttggggacccaacagaggagagggtccatgactaccggcaacctggcggcagcgcaaaagatg

SEQ ID NO: 205809 - DNA, 103 bp, Artificial Sequence
  Synthetic Polynucleotide
taatacgactcactataggggcagctgccggtgcctggccagcccggccaaacagaggagatggccgatgtggccaggcaacctggcggcagcgcaaaagatg

SEQ ID NO: 205810 - DNA, 103 bp, Artificial Sequence
  Synthetic Polynucleotide
taatacgactcactatagggaggtggcagtgcagctgccggtgcctggccaacagaggagaggccagatgccggcagctaacctggcggcagcgcaaaagatg

SEQ ID NO: 205811 - DNA, 103 bp, Artificial Sequence
  Synthetic Polynucleotide
taatacgactcactatagggccccacctgcaggtggcagtgcagctgccgaacagaggagacggcagatgcactgccacaacctggcggcagcgcaaaagatg

SEQ ID NO: 205812 - DNA, 103 bp, Artificial Sequence
  Synthetic Polynucleotide
taatacgactcactatagggtgaagacacgccccacctgcaggtggcagtaacagaggagaactgccatgtgcaggtggaacctggcggcagcgcaaaagatg

SEQ ID NO: 205813 - DNA, 103 bp, Artificial Sequence
  Synthetic Polynucleotide
taatacgactcactatagggtacttgcaggtgaagacacgccccacctgcaacagaggagagcaggtatggcgtgtcttaacctggcggcagcgcaaaagatg

SEQ ID NO: 205814 - DNA, 103 bp, Artificial Sequence
  Synthetic Polynucleotide
taatacgactcactatagggcttgtcgcagtacttgcaggtgaagacacgaacagaggagacgtgtcatgacctgcaagaacctggcggcagcgcaaaagatg

SEQ ID NO: 205815 - DNA, 103 bp, Artificial Sequence
  Synthetic Polynucleotide
taatacgactcactatagggtggtgtactccttgtcgcagtacttgcaggaacagaggagacctgcaatgactgcgacaaacctggcggcagcgcaaaagatg

SEQ ID NO: 205816 - DNA, 103 bp, Artificial Sequence
  Synthetic Polynucleotide
taatacgactcactataggggcacccaggctggtgtactccttgtcgcagaacagaggagactgcgaatgggagtacacaacctggcggcagcgcaaaagatg

SEQ ID NO: 205817 - DNA, 103 bp, Artificial Sequence
  Synthetic Polynucleotide
taatacgactcactatagggcatcttgagggcacccaggctggtgtactcaacagaggagagagtacatgagcctgggtaacctggcggcagcgcaaaagatg

SEQ ID NO: 205818 - DNA, 103 bp, Artificial Sequence
  Synthetic Polynucleotide
taatacgactcactatagggtgcggatgtgcatcttgagggcacccaggcaacagaggagagcctggatgccctcaagaaacctggcggcagcgcaaaagatg

SEQ ID NO: 205819 - DNA, 103 bp, Artificial Sequence
  Synthetic Polynucleotide
taatacgactcactatagggatttctctctgcgtctccagccgccggtagaacagaggagactaccgatggctggagacaacctggcggcagcgcaaaagatg

SEQ ID NO: 205820 - DNA, 103 bp, Artificial Sequence
  Synthetic Polynucleotide
taatacgactcactatagggagcgtgtgagtgcggatgtgcatcttgaggaacagaggagacctcaaatggcacatccgaacctggcggcagcgcaaaagatg

SEQ ID NO: 205821 - DNA, 103 bp, Artificial Sequence
  Synthetic Polynucleotide
taatacgactcactatagggggtgcagggcagcgtgtgagtgcggatgtgaacagaggagacacatcatgactcacacgaacctggcggcagcgcaaaagatg

SEQ ID NO: 205822 - DNA, 103 bp, Artificial Sequence
  Synthetic Polynucleotide
taatacgactcactatagggagatcttgcaggtgcagggcagcgtgtgagaacagaggagactcacaatgtgccctgcaaacctggcggcagcgcaaaagatg

SEQ ID NO: 205823 - DNA, 103 bp, Artificial Sequence
  Synthetic Polynucleotide
taatacgactcactataggggccttgccacagatcttgcaggtgcagggcaacagaggagagccctgatgctgcaagataacctggcggcagcgcaaaagatg

SEQ ID NO: 205824 - DNA, 103 bp, Artificial Sequence
  Synthetic Polynucleotide
taatacgactcactatagggcctggagaaggccttgccacagatcttgcaaacagaggagatgcaagatgtgtggcaagaacctggcggcagcgcaaaagatg

SEQ ID NO: 205825 - DNA, 103 bp, Artificial Sequence
  Synthetic Polynucleotide
taatacgactcactataggggtaaccagggcctggagaaggccttgccacaacagaggagagtggcaatgccttctccaaacctggcggcagcgcaaaagatg

SEQ ID NO: 205826 - DNA, 103 bp, Artificial Sequence
  Synthetic Polynucleotide
taatacgactcactatagggtggccctgcagtaaccagggcctggagaagaacagaggagacttctcatggccctggttaacctggcggcagcgcaaaagatg

SEQ ID NO: 205827 - DNA, 103 bp, Artificial Sequence
  Synthetic Polynucleotide
taatacgactcactatagggggtgcggacatggccctgcagtaaccagggaacagaggagaccctggatgctgcagggcaacctggcggcagcgcaaaagatg

SEQ ID NO: 205828 - DNA, 103 bp, Artificial Sequence
  Synthetic Polynucleotide
taatacgactcactatagggcccctgtgtgggtgcggacatggccctgcaaacagaggagatgcaggatgatgtccgcaaacctggcggcagcgcaaaagatg

SEQ ID NO: 205829 - DNA, 103 bp, Artificial Sequence
  Synthetic Polynucleotide
taatacgactcactatagggtagggcttctcccctgtgtgggtgcggacaaacagaggagatgtccgatgccacacaggaacctggcggcagcgcaaaagatg

SEQ ID NO: 205830 - DNA, 103 bp, Artificial Sequence
  Synthetic Polynucleotide
taatacgactcactatagggggcaccattgatttctctctgcgtctccagaacagaggagactggagatgcagagagaaaacctggcggcagcgcaaaagatg

SEQ ID NO: 205831 - DNA, 103 bp, Artificial Sequence
  Synthetic Polynucleotide
taatacgactcactatagggcgagcaggcatagggcttctcccctgtgtgaacagaggagacacacaatggagaagcccaacctggcggcagcgcaaaagatg

SEQ ID NO: 205832 - DNA, 103 bp, Artificial Sequence
  Synthetic Polynucleotide
taatacgactcactatagggtgctgcagtgcgagcaggcatagggcttctaacagaggagaagaagcatgatgcctgctaacctggcggcagcgcaaaagatg

SEQ ID NO: 205833 - DNA, 103 bp, Artificial Sequence
  Synthetic Polynucleotide
taatacgactcactataggggcaaaggccctgctgcagtgcgagcaggcaaacagaggagatgcctgatggcactgcagaacctggcggcagcgcaaaagatg

SEQ ID NO: 205834 - DNA, 103 bp, Artificial Sequence
  Synthetic Polynucleotide
taatacgactcactatagggggagcggtcggcaaaggccctgctgcagtgaacagaggagacactgcatgagggcctttaacctggcggcagcgcaaaagatg

SEQ ID NO: 205835 - DNA, 103 bp, Artificial Sequence
  Synthetic Polynucleotide
taatacgactcactatagggcccgaaggttggagcggtcggcaaaggcccaacagaggagagggcctatgccgaccgctaacctggcggcagcgcaaaagatg

SEQ ID NO: 205836 - DNA, 103 bp, Artificial Sequence
  Synthetic Polynucleotide
taatacgactcactatagggtgcagatgggcccgaaggttggagcggtcgaacagaggagacgaccgatgcaaccttcgaacctggcggcagcgcaaaagatg

SEQ ID NO: 205837 - DNA, 103 bp, Artificial Sequence
  Synthetic Polynucleotide
taatacgactcactatagggtgagtgcgtttgcagatgggcccgaaggttaacagaggagaaaccttatggcccatctgaacctggcggcagcgcaaaagatg

SEQ ID NO: 205838 - DNA, 103 bp, Artificial Sequence
  Synthetic Polynucleotide
taatacgactcactatagggtcttggcgtctgagtgcgtttgcagatgggaacagaggagacccatcatgaaacgcactaacctggcggcagcgcaaaagatg

SEQ ID NO: 205839 - DNA, 103 bp, Artificial Sequence
  Synthetic Polynucleotide
taatacgactcactatagggcaccggtacttcttggcgtctgagtgcgttaacagaggagaaacgcaatgagacgccaaaacctggcggcagcgcaaaagatg

SEQ ID NO: 205840 - DNA, 103 bp, Artificial Sequence
  Synthetic Polynucleotide
taatacgactcactataggggcagcgccggcaccggtacttcttggcgtcaacagaggagagacgccatgaagtaccggaacctggcggcagcgcaaaagatg

SEQ ID NO: 205841 - DNA, 103 bp, Artificial Sequence
  Synthetic Polynucleotide
taatacgactcactatagggaggcagagcaggcaccattgatttctctctaacagaggagaagagagatgtcaatggtgaacctggcggcagcgcaaaagatg

SEQ ID NO: 205842 - DNA, 103 bp, Artificial Sequence
  Synthetic Polynucleotide
taatacgactcactatagggaggtcttggtgcagcgccggcaccggtactaacagaggagaagtaccatggccggcgctaacctggcggcagcgcaaaagatg

SEQ ID NO: 205843 - DNA, 103 bp, Artificial Sequence
  Synthetic Polynucleotide
taatacgactcactatagggatgcgggagaaggtcttggtgcagcgccggaacagaggagaccggcgatgcaccaagacaacctggcggcagcgcaaaagatg

SEQ ID NO: 205844 - DNA, 103 bp, Artificial Sequence
  Synthetic Polynucleotide
taatacgactcactatagggcaggagggacatgcgggagaaggtcttggtaacagaggagaaccaagatgttctcccgcaacctggcggcagcgcaaaagatg

SEQ ID NO: 205845 - DNA, 103 bp, Artificial Sequence
  Synthetic Polynucleotide
taatacgactcactatagggcatgccgcgccaggagggacatgcgggagaaacagaggagatctcccatgtgtccctccaacctggcggcagcgcaaaagatg

SEQ ID NO: 205846 - DNA, 103 bp, Artificial Sequence
  Synthetic Polynucleotide
taatacgactcactatagggccagactcctcatgccgcgccaggagggacaacagaggagagtccctatgggcgcggcaaacctggcggcagcgcaaaagatg

SEQ ID NO: 205847 - DNA, 103 bp, Artificial Sequence
  Synthetic Polynucleotide
taatacgactcactatagggcgggcagcagccagactcctcatgccgcgcaacagaggagagcgcggatggaggagtctaacctggcggcagcgcaaaagatg

SEQ ID NO: 205848 - DNA, 103 bp, Artificial Sequence
  Synthetic Polynucleotide
taatacgactcactatagggagccccccacaggcagagcaggcaccattgaacagaggagacaatggatgctgctctgcaacctggcggcagcgcaaaagatg

SEQ ID NO: 205849 - DNA, 103 bp, Artificial Sequence
  Synthetic Polynucleotide
taatacgactcactatagggctttgaaagtcctttcatgaatacatccataacagaggagaatggatatgttcatgaaaaacctggcggcagcgcaaaagatg

SEQ ID NO: 205850 - DNA, 103 bp, Artificial Sequence
  Synthetic Polynucleotide
taatacgactcactatagggtacatagagaacaccctcttttgtctttccaacagaggagaggaaagatgaaagagggtaacctggcggcagcgcaaaagatg

SEQ ID NO: 205851 - DNA, 103 bp, Artificial Sequence
  Synthetic Polynucleotide
taatacgactcactatagggttttggagcctacatagagaacaccctcttaacagaggagaaagaggatgttctctatgaacctggcggcagcgcaaaagatg

SEQ ID NO: 205852 - DNA, 103 bp, Artificial Sequence
  Synthetic Polynucleotide
taatacgactcactatagggccctccttggttttggagcctacatagagaaacagaggagatctctaatgaggctccaaaacctggcggcagcgcaaaagatg

SEQ ID NO: 205853 - DNA, 103 bp, Artificial Sequence
  Synthetic Polynucleotide
taatacgactcactatagggatgcaccactccctccttggttttggagccaacagaggagaggctccatgaccaaggagaacctggcggcagcgcaaaagatg

SEQ ID NO: 205854 - DNA, 103 bp, Artificial Sequence
  Synthetic Polynucleotide
taatacgactcactatagggttgccacaccatgcaccactccctccttggaacagaggagaccaaggatggagtggtgcaacctggcggcagcgcaaaagatg

SEQ ID NO: 205855 - DNA, 103 bp, Artificial Sequence
  Synthetic Polynucleotide
taatacgactcactatagggtcagccactgttgccacaccatgcaccactaacagaggagaagtggtatgtggtgtggcaacctggcggcagcgcaaaagatg

SEQ ID NO: 205856 - DNA, 103 bp, Artificial Sequence
  Synthetic Polynucleotide
taatacgactcactatagggtttggtcttctcagccactgttgccacaccaacagaggagaggtgtgatgacagtggctaacctggcggcagcgcaaaagatg

SEQ ID NO: 205857 - DNA, 103 bp, Artificial Sequence
  Synthetic Polynucleotide
taatacgactcactatagggtcacttgctctttggtcttctcagccactgaacagaggagacagtggatgagaagaccaaacctggcggcagcgcaaaagatg

SEQ ID NO: 205858 - DNA, 103 bp, Artificial Sequence
  Synthetic Polynucleotide
taatacgactcactatagggccaacatttgtcacttgctctttggtcttcaacagaggagagaagacatgagagcaagtaacctggcggcagcgcaaaagatg

SEQ ID NO: 205859 - DNA, 103 bp, Artificial Sequence
  Synthetic Polynucleotide
taatacgactcactatagggcactgctcctccaacatttgtcacttgctcaacagaggagagagcaaatgacaaatgttaacctggcggcagcgcaaaagatg

SEQ ID NO: 205860 - DNA, 103 bp, Artificial Sequence
  Synthetic Polynucleotide
taatacgactcactatagggcctccttggcctttgaaagtcctttcatgaaacagaggagatcatgaatggactttcaaaacctggcggcagcgcaaaagatg

SEQ ID NO: 205861 - DNA, 103 bp, Artificial Sequence
  Synthetic Polynucleotide
taatacgactcactatagggcacccgtcaccactgctcctccaacatttgaacagaggagacaaatgatggaggagcagaacctggcggcagcgcaaaagatg

SEQ ID NO: 205862 - DNA, 103 bp, Artificial Sequence
  Synthetic Polynucleotide
taatacgactcactatagggactgctgtcacacccgtcaccactgctcctaacagaggagaaggagcatgggtgacgggaacctggcggcagcgcaaaagatg

SEQ ID NO: 205863 - DNA, 103 bp, Artificial Sequence
  Synthetic Polynucleotide
taatacgactcactatagggcttctgggctactgctgtcacacccgtcacaacagaggagagtgacgatggtgacagcaaacctggcggcagcgcaaaagatg

SEQ ID NO: 205864 - DNA, 103 bp, Artificial Sequence
  Synthetic Polynucleotide
taatacgactcactatagggcctccactgtcttctgggctactgctgtcaaacagaggagatgacagatgtagcccagaaacctggcggcagcgcaaaagatg

SEQ ID NO: 205865 - DNA, 103 bp, Artificial Sequence
  Synthetic Polynucleotide
taatacgactcactatagggctccctgctccctccactgtcttctgggctaacagaggagaagcccaatggacagtggaaacctggcggcagcgcaaaagatg

SEQ ID NO: 205866 - DNA, 103 bp, Artificial Sequence
  Synthetic Polynucleotide
taatacgactcactatagggtgctgcaatgctccctgctccctccactgtaacagaggagaacagtgatgggagcagggaacctggcggcagcgcaaaagatg

SEQ ID NO: 205867 - DNA, 103 bp, Artificial Sequence
  Synthetic Polynucleotide
taatacgactcactatagggagccagtggctgctgcaatgctccctgctcaacagaggagagagcagatggcattgcagaacctggcggcagcgcaaaagatg

SEQ ID NO: 205868 - DNA, 103 bp, Artificial Sequence
  Synthetic Polynucleotide
taatacgactcactatagggtttttgacaaagccagtggctgctgcaatgaacagaggagacattgcatgagccactggaacctggcggcagcgcaaaagatg

SEQ ID NO: 205869 - DNA, 103 bp, Artificial Sequence
  Synthetic Polynucleotide
taatacgactcactatagggcaactggtcctttttgacaaagccagtggcaacagaggagagccactatgtttgtcaaaaacctggcggcagcgcaaaagatg

SEQ ID NO: 205870 - DNA, 103 bp, Artificial Sequence
  Synthetic Polynucleotide
taatacgactcactatagggcttccttgcccaactggtcctttttgacaaaacagaggagattgtcaatgaggaccagtaacctggcggcagcgcaaaagatg

SEQ ID NO: 205871 - DNA, 103 bp, Artificial Sequence
  Synthetic Polynucleotide
taatacgactcactataggggccacaactccctccttggcctttgaaagtaacagaggagaactttcatgggccaaggaaacctggcggcagcgcaaaagatg

SEQ ID NO: 205872 - DNA, 103 bp, Artificial Sequence
  Synthetic Polynucleotide
taatacgactcactatagggtcttgatacccttccttgcccaactggtccaacagaggagaggaccaatggggcaaggaaacctggcggcagcgcaaaagatg

SEQ ID NO: 205873 - DNA, 103 bp, Artificial Sequence
  Synthetic Polynucleotide
taatacgactcactatagggaggttcgtagtcttgatacccttccttgccaacagaggagaggcaagatggggtatcaaaacctggcggcagcgcaaaagatg

SEQ ID NO: 205874 - DNA, 103 bp, Artificial Sequence
  Synthetic Polynucleotide
taatacgactcactatagggctcagcagcagccacaactccctccttggcaacagaggagagccaagatgggagttgtgaacctggcggcagcgcaaaagatg

SEQ ID NO: 205875 - DNA, 103 bp, Artificial Sequence
  Synthetic Polynucleotide
taatacgactcactataggggtttggttttctcagcagcagccacaactcaacagaggagagagttgatgctgctgctgaacctggcggcagcgcaaaagatg

SEQ ID NO: 205876 - DNA, 103 bp, Artificial Sequence
  Synthetic Polynucleotide
taatacgactcactataggggccacaccctgtttggttttctcagcagcaaacagaggagatgctgcatggaaaaccaaaacctggcggcagcgcaaaagatg

SEQ ID NO: 205877 - DNA, 103 bp, Artificial Sequence
  Synthetic Polynucleotide
taatacgactcactatagggtgctgcttctgccacaccctgtttggttttaacagaggagaaaaaccatgcagggtgtgaacctggcggcagcgcaaaagatg

SEQ ID NO: 205878 - DNA, 103 bp, Artificial Sequence
  Synthetic Polynucleotide
taatacgactcactatagggttgtctttcctgctgcttctgccacaccctaacagaggagaagggtgatgcagaagcagaacctggcggcagcgcaaaagatg

SEQ ID NO: 205879 - DNA, 103 bp, Artificial Sequence
  Synthetic Polynucleotide
taatacgactcactatagggacaccctcttttgtctttcctgctgcttctaacagaggagaagaagcatgaggaaagacaacctggcggcagcgcaaaagatg

SEQ ID NO: 205880 - DNA, 103 bp, Artificial Sequence
  Synthetic Polynucleotide
taatacgactcactatagggcaggtcggtctccatcatcatgctgtacataacagaggagaatgtacatgatgatgatgaacctggcggcagcgcaaaagatg

SEQ ID NO: 205881 - DNA, 103 bp, Artificial Sequence
  Synthetic Polynucleotide
taatacgactcactataggggccgccgccgcccccgcctccgcccccgccaacagaggagaggcgggatgggaggcgggaacctggcggcagcgcaaaagatg

SEQ ID NO: 205882 - DNA, 103 bp, Artificial Sequence
  Synthetic Polynucleotide
taatacgactcactatagggcaggtccccggggcacggcgcccgcgagtgaacagaggagacactcgatggcgccgtgcaacctggcggcagcgcaaaagatg

SEQ ID NO: 205883 - DNA, 103 bp, Artificial Sequence
  Synthetic Polynucleotide
taatacgactcactatagggtcatctcgcgcaggtccccggggcacggcgaacagaggagacgccgtatgccggggaccaacctggcggcagcgcaaaagatg

SEQ ID NO: 205884 - DNA, 103 bp, Artificial Sequence
  Synthetic Polynucleotide
taatacgactcactatagggtacatgctgatcatctcgcgcaggtccccgaacagaggagacggggaatggcgcgagataacctggcggcagcgcaaaagatg

SEQ ID NO: 205885 - DNA, 103 bp, Artificial Sequence
  Synthetic Polynucleotide
taatacgactcactatagggggcgggcaagtacatgctgatcatctcgcgaacagaggagacgcgagatgatcagcatgaacctggcggcagcgcaaaagatg

SEQ ID NO: 205886 - DNA, 103 bp, Artificial Sequence
  Synthetic Polynucleotide
taatacgactcactatagggccccctcgccggcgggcaagtacatgctgaaacagaggagatcagcaatgacttgcccgaacctggcggcagcgcaaaagatg

SEQ ID NO: 205887 - DNA, 103 bp, Artificial Sequence
  Synthetic Polynucleotide
taatacgactcactataggggccgggtcgcccccctcgccggcgggcaagaacagaggagacttgccatgcggcgagggaacctggcggcagcgcaaaagatg

SEQ ID NO: 205888 - DNA, 103 bp, Artificial Sequence
  Synthetic Polynucleotide
taatacgactcactatagggtgctgccgccgccgggtcgcccccctcgccaacagaggagaggcgagatgggcgacccgaacctggcggcagcgcaaaagatg

SEQ ID NO: 205889 - DNA, 103 bp, Artificial Sequence
  Synthetic Polynucleotide
taatacgactcactatagggccgcggccgctgctgccgccgccgggtcgcaacagaggagagcgaccatgcggcggcagaacctggcggcagcgcaaaagatg

SEQ ID NO: 205890 - DNA, 103 bp, Artificial Sequence
  Synthetic Polynucleotide
taatacgactcactatagggcggctctgcgccgcggccgctgctgccgccaacagaggagaggcggcatgagcggccgcaacctggcggcagcgcaaaagatg

SEQ ID NO: 205891 - DNA, 103 bp, Artificial Sequence
  Synthetic Polynucleotide
taatacgactcactatagggcgagtgcagccggctctgcgccgcggccgcaacagaggagagcggccatggcgcagagcaacctggcggcagcgcaaaagatg

SEQ ID NO: 205892 - DNA, 103 bp, Artificial Sequence
  Synthetic Polynucleotide
taatacgactcactatagggcgcccccgccgccgccgccgcccccgcctcaacagaggagagaggcgatggcggcggcgaacctggcggcagcgcaaaagatg

SEQ ID NO: 205893 - DNA, 103 bp, Artificial Sequence
  Synthetic Polynucleotide
taatacgactcactataggggctgcggcagcgagtgcagccggctctgcgaacagaggagacgcagaatgggctgcactaacctggcggcagcgcaaaagatg

SEQ ID NO: 205894 - DNA, 103 bp, Artificial Sequence
  Synthetic Polynucleotide
taatacgactcactatagggccctggtagtgctgcggcagcgagtgcagcaacagaggagagctgcaatggctgccgcaaacctggcggcagcgcaaaagatg

SEQ ID NO: 205895 - DNA, 103 bp, Artificial Sequence
  Synthetic Polynucleotide
taatacgactcactatagggcgcgcccgcgccctggtagtgctgcggcagaacagaggagactgccgatgcactaccagaacctggcggcagcgcaaaagatg

SEQ ID NO: 205896 - DNA, 103 bp, Artificial Sequence
  Synthetic Polynucleotide
taatacgactcactatagggcgttcacgcccgcgcccgcgccctggtagtaacagaggagaactaccatggcgcgggcgaacctggcggcagcgcaaaagatg

SEQ ID NO: 205897 - DNA, 103 bp, Artificial Sequence
  Synthetic Polynucleotide
taatacgactcactatagggggcaccgtgccgttcacgcccgcgcccgcgaacagaggagacgcgggatggggcgtgaaaacctggcggcagcgcaaaagatg

SEQ ID NO: 205898 - DNA, 103 bp, Artificial Sequence
  Synthetic Polynucleotide
taatacgactcactataggggtgcgtcaggggcaccgtgccgttcacgccaacagaggagaggcgtgatgggcacggtgaacctggcggcagcgcaaaagatg

SEQ ID NO: 205899 - DNA, 103 bp, Artificial Sequence
  Synthetic Polynucleotide
taatacgactcactatagggttggccttggcgcccccgccgccgccgccgaacagaggagacggcggatgcggcgggggaacctggcggcagcgcaaaagatg

SEQ ID NO: 205900 - DNA, 103 bp, Artificial Sequence
  Synthetic Polynucleotide
taatacgactcactatagggccggtcctggttggccttggcgcccccgccaacagaggagaggcgggatggccaaggccaacctggcggcagcgcaaaagatg

SEQ ID NO: 205901 - DNA, 103 bp, Artificial Sequence
  Synthetic Polynucleotide
taatacgactcactataggggccgtttgacccggtcctggttggccttggaacagaggagaccaaggatgaccaggaccaacctggcggcagcgcaaaagatg

SEQ ID NO: 205902 - DNA, 103 bp, Artificial Sequence
  Synthetic Polynucleotide
taatacgactcactataggggcgttcatgggccgtttgacccggtcctggaacagaggagaccaggaatgggtcaaacgaacctggcggcagcgcaaaagatg

SEQ ID NO: 205903 - DNA, 103 bp, Artificial Sequence
  Synthetic Polynucleotide
taatacgactcactatagggcaccatgaaggcgttcatgggccgtttgacaacagaggagagtcaaaatgcccatgaacaacctggcggcagcgcaaaagatg

SEQ ID NO: 205904 - DNA, 103 bp, Artificial Sequence
  Synthetic Polynucleotide
taatacgactcactatagggcgcgggaccacaccatgaaggcgttcatggaacagaggagaccatgaatgccttcatggaacctggcggcagcgcaaaagatg

SEQ ID NO: 205905 - DNA, 103 bp, Artificial Sequence
  Synthetic Polynucleotide
taatacgactcactatagggcgccgctgcccgcgggaccacaccatgaagaacagaggagacttcatatggtggtcccgaacctggcggcagcgcaaaagatg

SEQ ID NO: 205906 - DNA, 103 bp, Artificial Sequence
  Synthetic Polynucleotide
taatacgactcactatagggggccatcttgcgccgctgcccgcgggaccaaacagaggagatggtccatggggcagcggaacctggcggcagcgcaaaagatg

SEQ ID NO: 205907 - DNA, 103 bp, Artificial Sequence
  Synthetic Polynucleotide
taatacgactcactatagggcgggcgagtgcaggtcggtctccatcatcaaacagaggagatgatgaatgagaccgaccaacctggcggcagcgcaaaagatg

SEQ ID NO: 205908 - DNA, 103 bp, Artificial Sequence
  Synthetic Polynucleotide
taatacgactcactatagggggttctcctgggccatcttgcgccgctgccaacagaggagaggcagcatggcaagatggaacctggcggcagcgcaaaagatg

SEQ ID NO: 205909 - DNA, 103 bp, Artificial Sequence
  Synthetic Polynucleotide
taatacgactcactatagggtgcatcttggggttctcctgggccatcttgaacagaggagacaagatatgccaggagaaaacctggcggcagcgcaaaagatg

SEQ ID NO: 205910 - DNA, 103 bp, Artificial Sequence
  Synthetic Polynucleotide
taatacgactcactatagggctccgagttgtgcatcttggggttctcctgaacagaggagacaggagatgcccaagatgaacctggcggcagcgcaaaagatg

SEQ ID NO: 205911 - DNA, 103 bp, Artificial Sequence
  Synthetic Polynucleotide
taatacgactcactataggggcttgctgatctccgagttgtgcatcttggaacagaggagaccaagaatgacaactcggaacctggcggcagcgcaaaagatg

SEQ ID NO: 205912 - DNA, 103 bp, Artificial Sequence
  Synthetic Polynucleotide
taatacgactcactataggggcccccaggcgcttgctgatctccgagttgaacagaggagacaactcatggatcagcaaaacctggcggcagcgcaaaagatg

SEQ ID NO: 205913 - DNA, 103 bp, Artificial Sequence
  Synthetic Polynucleotide
taatacgactcactatagggcttccactcggcccccaggcgcttgctgataacagaggagaatcagcatgcgcctggggaacctggcggcagcgcaaaagatg

SEQ ID NO: 205914 - DNA, 103 bp, Artificial Sequence
  Synthetic Polynucleotide
taatacgactcactatagggcggacatgaccttccactcggcccccaggcaacagaggagagcctggatgccgagtggaaacctggcggcagcgcaaaagatg

SEQ ID NO: 205915 - DNA, 103 bp, Artificial Sequence
  Synthetic Polynucleotide
taatacgactcactatagggttctcggcctcggacatgaccttccactcgaacagaggagacgagtgatgggtcatgtcaacctggcggcagcgcaaaagatg

SEQ ID NO: 205916 - DNA, 103 bp, Artificial Sequence
  Synthetic Polynucleotide
taatacgactcactataggggaacggccgcttctcggcctcggacatgacaacagaggagagtcatgatggaggccgagaacctggcggcagcgcaaaagatg

SEQ ID NO: 205917 - DNA, 103 bp, Artificial Sequence
  Synthetic Polynucleotide
taatacgactcactatagggcctcgtcgatgaacggccgcttctcggcctaacagaggagaaggccgatgagcggccgtaacctggcggcagcgcaaaagatg

SEQ ID NO: 205918 - DNA, 103 bp, Artificial Sequence
  Synthetic Polynucleotide
taatacgactcactatagggtgggcgccgccgggcgagtgcaggtcggtcaacagaggagagaccgaatggcactcgccaacctggcggcagcgcaaaagatg

SEQ ID NO: 205919 - DNA, 103 bp, Artificial Sequence
  Synthetic Polynucleotide
taatacgactcactatagggagccgcttggcctcgtcgatgaacggccgcaacagaggagagcggccatgcatcgacgaaacctggcggcagcgcaaaagatg

SEQ ID NO: 205920 - DNA, 103 bp, Artificial Sequence
  Synthetic Polynucleotide
taatacgactcactatagggcagcgcgcgcagccgcttggcctcgtcgataacagaggagaatcgacatggccaagcggaacctggcggcagcgcaaaagatg

SEQ ID NO: 205921 - DNA, 103 bp, Artificial Sequence
  Synthetic Polynucleotide
taatacgactcactatagggccttcatgtgcagcgcgcgcagccgcttggaacagaggagaccaagcatgtgcgcgcgcaacctggcggcagcgcaaaagatg

SEQ ID NO: 205922 - DNA, 103 bp, Artificial Sequence
  Synthetic Polynucleotide
taatacgactcactatagggtccgggtgctccttcatgtgcagcgcgcgcaacagaggagagcgcgcatggcacatgaaaacctggcggcagcgcaaaagatg

SEQ ID NO: 205923 - DNA, 103 bp, Artificial Sequence
  Synthetic Polynucleotide
taatacgactcactataggggtacttgtaatccgggtgctccttcatgtgaacagaggagacacatgatggagcacccgaacctggcggcagcgcaaaagatg

SEQ ID NO: 205924 - DNA, 103 bp, Artificial Sequence
  Synthetic Polynucleotide
taatacgactcactatagggggcgcggccggtacttgtaatccgggtgctaacagaggagaagcaccatgattacaagtaacctggcggcagcgcaaaagatg

SEQ ID NO: 205925 - DNA, 103 bp, Artificial Sequence
  Synthetic Polynucleotide
taatacgactcactatagggttggtcttgcggcgcggccggtacttgtaaaacagaggagattacaaatgccggccgcgaacctggcggcagcgcaaaagatg

SEQ ID NO: 205926 - DNA, 103 bp, Artificial Sequence
  Synthetic Polynucleotide
taatacgactcactataggggagcagcgtcttggtcttgcggcgcggccgaacagaggagacggccgatgcgcaagaccaacctggcggcagcgcaaaagatg

SEQ ID NO: 205927 - DNA, 103 bp, Artificial Sequence
  Synthetic Polynucleotide
taatacgactcactatagggtgtccttcttgagcagcgtcttggtcttgcaacagaggagagcaagaatgagacgctgcaacctggcggcagcgcaaaagatg

SEQ ID NO: 205928 - DNA, 103 bp, Artificial Sequence
  Synthetic Polynucleotide
taatacgactcactatagggagcgagtacttgtccttcttgagcagcgtcaacagaggagagacgctatgcaagaaggaaacctggcggcagcgcaaaagatg

SEQ ID NO: 205929 - DNA, 103 bp, Artificial Sequence
  Synthetic Polynucleotide
taatacgactcactatagggcgtgggggcctgggcgccgccgggcgagtgaacagaggagacactcgatgggcggcgccaacctggcggcagcgcaaaagatg

SEQ ID NO: 205930 - DNA, 103 bp, Artificial Sequence
  Synthetic Polynucleotide
taatacgactcactatagggcccgccggccagcgagtacttgtccttcttaacagaggagaaagaagatgaagtactcgaacctggcggcagcgcaaaagatg

SEQ ID NO: 205931 - DNA, 103 bp, Artificial Sequence
  Synthetic Polynucleotide
taatacgactcactatagggccgccaggagcccgccggccagcgagtactaacagaggagaagtactatgtggccggcgaacctggcggcagcgcaaaagatg

SEQ ID NO: 205932 - DNA, 103 bp, Artificial Sequence
  Synthetic Polynucleotide
taatacgactcactatagggcccgcgccggccgccaggagcccgccggccaacagaggagaggccggatggctcctggcaacctggcggcagcgcaaaagatg

SEQ ID NO: 205933 - DNA, 103 bp, Artificial Sequence
  Synthetic Polynucleotide
taatacgactcactataggggccgccgccacccgcgccggccgccaggagaacagaggagactcctgatggccggcgcgaacctggcggcagcgcaaaagatg

SEQ ID NO: 205934 - DNA, 103 bp, Artificial Sequence
  Synthetic Polynucleotide
taatacgactcactatagggccacagccgcgccgccgccacccgcgccggaacagaggagaccggcgatggtggcggcgaacctggcggcagcgcaaaagatg

SEQ ID NO: 205935 - DNA, 103 bp, Artificial Sequence
  Synthetic Polynucleotide
taatacgactcactatagggacgcccatggccacagccgcgccgccgccaaacagaggagatggcggatgcgcggctgtaacctggcggcagcgcaaaagatg

SEQ ID NO: 205936 - DNA, 103 bp, Artificial Sequence
  Synthetic Polynucleotide
taatacgactcactataggggcccacgcccacgcccatggccacagccgcaacagaggagagcggctatggccatgggcaacctggcggcagcgcaaaagatg

SEQ ID NO: 205937 - DNA, 103 bp, Artificial Sequence
  Synthetic Polynucleotide
taatacgactcactatagggccgcgcccacgcccacgcccacgcccatggaacagaggagaccatggatgtgggcgtggaacctggcggcagcgcaaaagatg

SEQ ID NO: 205938 - DNA, 103 bp, Artificial Sequence
  Synthetic Polynucleotide
taatacgactcactatagggcccacggccgccgcgcccacgcccacgcccaacagaggagagggcgtatgcgtgggcgcaacctggcggcagcgcaaaagatg

SEQ ID NO: 205939 - DNA, 103 bp, Artificial Sequence
  Synthetic Polynucleotide
taatacgactcactatagggcaggcgctggcccacggccgccgcgcccacaacagaggagagtgggcatggcggccgtgaacctggcggcagcgcaaaagatg

SEQ ID NO: 205940 - DNA, 103 bp, Artificial Sequence
  Synthetic Polynucleotide
taatacgactcactatagggccgagaggttcgtgggggcctgggcgccgcaacagaggagagcggcgatgaggcccccaaacctggcggcagcgcaaaagatg

SEQ ID NO: 205941 - DNA, 103 bp, Artificial Sequence
  Synthetic Polynucleotide
taatacgactcactatagggctgggctctccaggcgctggcccacggccgaacagaggagacggccgatggccagcgccaacctggcggcagcgcaaaagatg

SEQ ID NO: 205942 - DNA, 103 bp, Artificial Sequence
  Synthetic Polynucleotide
taatacgactcactataggggccgcgccgcctgggctctccaggcgctggaacagaggagaccagcgatgggagagcccaacctggcggcagcgcaaaagatg

SEQ ID NO: 205943 - DNA, 103 bp, Artificial Sequence
  Synthetic Polynucleotide
taatacgactcactataggggccgccgcccgccgcgccgcctgggctctcaacagaggagagagagcatgggcggcgcgaacctggcggcagcgcaaaagatg

SEQ ID NO: 205944 - DNA, 103 bp, Artificial Sequence
  Synthetic Polynucleotide
taatacgactcactatagggcgtgcgcgtagccgccgcccgccgcgccgcaacagaggagagcggcgatgcgggcggcgaacctggcggcagcgcaaaagatg

SEQ ID NO: 205945 - DNA, 103 bp, Artificial Sequence
  Synthetic Polynucleotide
taatacgactcactatagggcagccgttgacgtgcgcgtagccgccgcccaacagaggagagggcggatgctacgcgcaaacctggcggcagcgcaaaagatg

SEQ ID NO: 205946 - DNA, 103 bp, Artificial Sequence
  Synthetic Polynucleotide
taatacgactcactataggggccgttggcccagccgttgacgtgcgcgtaaacagaggagatacgcgatggtcaacggcaacctggcggcagcgcaaaagatg

SEQ ID NO: 205947 - DNA, 103 bp, Artificial Sequence
  Synthetic Polynucleotide
taatacgactcactatagggcggggtaggcgccgttggcccagccgttgaaacagaggagatcaacgatggggccaacgaacctggcggcagcgcaaaagatg

SEQ ID NO: 205948 - DNA, 103 bp, Artificial Sequence
  Synthetic Polynucleotide
taatacgactcactataggggccaccgagccggggtaggcgccgttggccaacagaggagaggccaaatgcgcctacccaacctggcggcagcgcaaaagatg

SEQ ID NO: 205949 - DNA, 103 bp, Artificial Sequence
  Synthetic Polynucleotide
taatacgactcactatagggcgccgccgccgccaccgagccggggtaggcaacagaggagagcctacatgggctcggtgaacctggcggcagcgcaaaagatg

SEQ ID NO: 205950 - DNA, 103 bp, Artificial Sequence
  Synthetic Polynucleotide
taatacgactcactatagggccgcggccgccgccgccgccgccaccgagcaacagaggagagctcggatgcggcggcggaacctggcggcagcgcaaaagatg

SEQ ID NO: 205951 - DNA, 103 bp, Artificial Sequence
  Synthetic Polynucleotide
taatacgactcactatagggccggcggggcccgagaggttcgtgggggccaacagaggagaggccccatggaacctctcaacctggcggcagcgcaaaagatg

SEQ ID NO: 205952 - DNA, 103 bp, Artificial Sequence
  Synthetic Polynucleotide
taatacgactcactatagggtgcatcatggccgcggccgccgccgccgccaacagaggagaggcggcatgggcggccgcaacctggcggcagcgcaaaagatg

SEQ ID NO: 205953 - DNA, 103 bp, Artificial Sequence
  Synthetic Polynucleotide
taatacgactcactatagggctgcgcctcctgcatcatggccgcggccgcaacagaggagagcggccatggccatgatgaacctggcggcagcgcaaaagatg

SEQ ID NO: 205954 - DNA, 103 bp, Artificial Sequence
  Synthetic Polynucleotide
taatacgactcactatagggcgtaggccagctgcgcctcctgcatcatggaacagaggagaccatgaatgaggaggcgcaacctggcggcagcgcaaaagatg

SEQ ID NO: 205955 - DNA, 103 bp, Artificial Sequence
  Synthetic Polynucleotide
taatacgactcactataggggggtgctgcccgtaggccagctgcgcctccaacagaggagaggaggcatggctggcctaaacctggcggcagcgcaaaagatg

SEQ ID NO: 205956 - DNA, 103 bp, Artificial Sequence
  Synthetic Polynucleotide
taatacgactcactataggggcccgcgcccgggtgctgcccgtaggccagaacagaggagactggccatggggcagcacaacctggcggcagcgcaaaagatg

SEQ ID NO: 205957 - DNA, 103 bp, Artificial Sequence
  Synthetic Polynucleotide
taatacgactcactatagggggtgcgcgccgcccgcgcccgggtgctgccaacagaggagaggcagcatgcgggcgcggaacctggcggcagcgcaaaagatg

SEQ ID NO: 205958 - DNA, 103 bp, Artificial Sequence
  Synthetic Polynucleotide
taatacgactcactatagggtgcgcgtgcgggtgcgcgccgcccgcgcccaacagaggagagggcgcatgcggcgcgcaaacctggcggcagcgcaaaagatg

SEQ ID NO: 205959 - DNA, 103 bp, Artificial Sequence
  Synthetic Polynucleotide
taatacgactcactataggggtgcgcggggtgcgcgtgcgggtgcgcgccaacagaggagaggcgcgatgccgcacgcgaacctggcggcagcgcaaaagatg

SEQ ID NO: 205960 - DNA, 103 bp, Artificial Sequence
  Synthetic Polynucleotide
taatacgactcactataggggcgggtgcgggtgcgcggggtgcgcgtgcgaacagaggagacgcacgatgaccccgcgcaacctggcggcagcgcaaaagatg

SEQ ID NO: 205961 - DNA, 103 bp, Artificial Sequence
  Synthetic Polynucleotide
taatacgactcactatagggtgcgggtggtgcgggtgcgggtgcgcggggaacagaggagaccccgcatgcccgcacccaacctggcggcagcgcaaaagatg

SEQ ID NO: 205962 - DNA, 103 bp, Artificial Sequence
  Synthetic Polynucleotide
taatacgactcactataggggccgcccgccccggcggggcccgagaggttaacagaggagaaacctcatgggccccgccaacctggcggcagcgcaaaagatg

SEQ ID NO: 205963 - DNA, 103 bp, Artificial Sequence
  Synthetic Polynucleotide
taatacgactcactatagggcgggtgcgcgtgcgggtggtgcgggtgcggaacagaggagaccgcacatgcaccacccgaacctggcggcagcgcaaaagatg

SEQ ID NO: 205964 - DNA, 103 bp, Artificial Sequence
  Synthetic Polynucleotide
taatacgactcactataggggcgggttgtgcgggtgcgcgtgcgggtggtaacagaggagaaccaccatgacgcgcaccaacctggcggcagcgcaaaagatg

SEQ ID NO: 205965 - DNA, 103 bp, Artificial Sequence
  Synthetic Polynucleotide
taatacgactcactatagggtgcatgggctgcgggttgtgcgggtgcgcgaacagaggagacgcgcaatggcacaacccaacctggcggcagcgcaaaagatg

SEQ ID NO: 205966 - DNA, 103 bp, Artificial Sequence
  Synthetic Polynucleotide
taatacgactcactataggggtcgtagcggtgcatgggctgcgggttgtgaacagaggagacacaacatgcagcccatgaacctggcggcagcgcaaaagatg

SEQ ID NO: 205967 - DNA, 103 bp, Artificial Sequence
  Synthetic Polynucleotide
taatacgactcactataggggcgcgcccatgtcgtagcggtgcatgggctaacagaggagaagcccaatgaccgctacgaacctggcggcagcgcaaaagatg

SEQ ID NO: 205968 - DNA, 103 bp, Artificial Sequence
  Synthetic Polynucleotide
taatacgactcactatagggctgtactgcagcgcgcccatgtcgtagcggaacagaggagaccgctaatgcatgggcgcaacctggcggcagcgcaaaagatg

SEQ ID NO: 205969 - DNA, 103 bp, Artificial Sequence
  Synthetic Polynucleotide
taatacgactcactatagggggagatggggctgtactgcagcgcgcccataacagaggagaatgggcatgctgcagtacaacctggcggcagcgcaaaagatg

SEQ ID NO: 205970 - DNA, 103 bp, Artificial Sequence
  Synthetic Polynucleotide
taatacgactcactatagggcctgcgagttggagatggggctgtactgcaaacagaggagatgcagtatggccccatctaacctggcggcagcgcaaaagatg

SEQ ID NO: 205971 - DNA, 103 bp, Artificial Sequence
  Synthetic Polynucleotide
taatacgactcactatagggctcatgtagccctgcgagttggagatggggaacagaggagaccccatatgcaactcgcaaacctggcggcagcgcaaaagatg

SEQ ID NO: 205972 - DNA, 103 bp, Artificial Sequence
  Synthetic Polynucleotide
taatacgactcactataggggggcgacgcgctcatgtagccctgcgagttaacagaggagaaactcgatgggctacatgaacctggcggcagcgcaaaagatg

SEQ ID NO: 205973 - DNA, 103 bp, Artificial Sequence
  Synthetic Polynucleotide
taatacgactcactatagggcgcccccgccgccgcccgccccggcggggcaacagaggagagccccgatggggcgggcgaacctggcggcagcgcaaaagatg

SEQ ID NO: 205974 - DNA, 103 bp, Artificial Sequence
  Synthetic Polynucleotide
taatacgactcactatagggcgtagcccgagggcgacgcgctcatgtagcaacagaggagagctacaatggcgcgtcgcaacctggcggcagcgcaaaagatg

SEQ ID NO: 205975 - DNA, 103 bp, Artificial Sequence
  Synthetic Polynucleotide
taatacgactcactataggggggaggccgccgtagcccgagggcgacgcgaacagaggagacgcgtcatgctcgggctaaacctggcggcagcgcaaaagatg

SEQ ID NO: 205976 - DNA, 103 bp, Artificial Sequence
  Synthetic Polynucleotide
taatacgactcactatagggggcgccgtaggggaggccgccgtagcccgaaacagaggagatcgggcatgggcggcctcaacctggcggcagcgcaaaagatg

SEQ ID NO: 205977 - DNA, 103 bp, Artificial Sequence
  Synthetic Polynucleotide
taatacgactcactatagggcggcggccgcggcgccgtaggggaggccgcaacagaggagagcggccatgcctacggcgaacctggcggcagcgcaaaagatg

SEQ ID NO: 205978 - DNA, 103 bp, Artificial Sequence
  Synthetic Polynucleotide
taatacgactcactataggggcggcggcggcggcggccgcggcgccgtagaacagaggagactacggatgcgcggccgcaacctggcggcagcgcaaaagatg

SEQ ID NO: 205979 - DNA, 103 bp, Artificial Sequence
  Synthetic Polynucleotide
taatacgactcactataggggccgcccgcagcggcggcggcggcggccgcaacagaggagagcggccatggccgccgccaacctggcggcagcgcaaaagatg

SEQ ID NO: 205980 - DNA, 103 bp, Artificial Sequence
  Synthetic Polynucleotide
taatacgactcactatagggtctggtgcgcgccgcccgcagcggcggcggaacagaggagaccgccgatgctgcgggcgaacctggcggcagcgcaaaagatg

SEQ ID NO: 205981 - DNA, 103 bp, Artificial Sequence
  Synthetic Polynucleotide
taatacgactcactatagggacggccgagttctggtgcgcgccgcccgcaaacagaggagatgcgggatgcgcgcaccaaacctggcggcagcgcaaaagatg

SEQ ID NO: 205982 - DNA, 103 bp, Artificial Sequence
  Synthetic Polynucleotide
taatacgactcactatagggcgccgccgccacggccgagttctggtgcgcaacagaggagagcgcacatgaactcggccaacctggcggcagcgcaaaagatg

SEQ ID NO: 205983 - DNA, 103 bp, Artificial Sequence
  Synthetic Polynucleotide
taatacgactcactatagggccgccgccgccgccgccgccacggccgagtaacagaggagaactcggatgtggcggcggaacctggcggcagcgcaaaagatg

SEQ ID NO: 205984 - DNA, 103 bp, Artificial Sequence
  Synthetic Polynucleotide
taatacgactcactatagggcccccgcctccgcccccgccgccgcccgccaacagaggagaggcgggatgcggcgggggaacctggcggcagcgcaaaagatg

SEQ ID NO: 205985 - DNA, 103 bp, Artificial Sequence
  Synthetic Polynucleotide
taatacgactcactataggggacgcggccgccgccgccgccgccgccgccaacagaggagaggcggcatgggcggcggcaacctggcggcagcgcaaaagatg

SEQ ID NO: 205986 - DNA, 103 bp, Artificial Sequence
  Synthetic Polynucleotide
taatacgactcactatagggggcgcccgacgacgcggccgccgccgccgcaacagaggagagcggcgatggcggccgcgaacctggcggcagcgcaaaagatg

SEQ ID NO: 205987 - DNA, 103 bp, Artificial Sequence
  Synthetic Polynucleotide
taatacgactcactataggggcgcgcccagggcgcccgacgacgcggccgaacagaggagacggccgatgcgtcgggcgaacctggcggcagcgcaaaagatg

SEQ ID NO: 205988 - DNA, 103 bp, Artificial Sequence
  Synthetic Polynucleotide
taatacgactcactatagggagagagcccagcgcgcccagggcgcccgacaacagaggagagtcgggatgcctgggcgcaacctggcggcagcgcaaaagatg

SEQ ID NO: 205989 - DNA, 103 bp, Artificial Sequence
  Synthetic Polynucleotide
taatacgactcactatagggcgacttcaccagagagcccagcgcgcccagaacagaggagactgggcatgctgggctctaacctggcggcagcgcaaaagatg

SEQ ID NO: 205990 - DNA, 103 bp, Artificial Sequence
  Synthetic Polynucleotide
taatacgactcactatagggcgctgggctccgacttcaccagagagcccaaacagaggagatgggctatgtggtgaagtaacctggcggcagcgcaaaagatg

SEQ ID NO: 205991 - DNA, 103 bp, Artificial Sequence
  Synthetic Polynucleotide
taatacgactcactatagggggcgggctgccgctgggctccgacttcaccaacagaggagaggtgaaatgggagcccagaacctggcggcagcgcaaaagatg

SEQ ID NO: 205992 - DNA, 103 bp, Artificial Sequence
  Synthetic Polynucleotide
taatacgactcactatagggcgctggggcgggcgggctgccgctgggctcaacagaggagagagcccatgggcagcccgaacctggcggcagcgcaaaagatg

SEQ ID NO: 205993 - DNA, 103 bp, Artificial Sequence
  Synthetic Polynucleotide
taatacgactcactatagggcccgcgagtgcgctggggcgggcgggctgcaacagaggagagcagccatgccgccccagaacctggcggcagcgcaaaagatg

SEQ ID NO: 205994 - DNA, 103 bp, Artificial Sequence
  Synthetic Polynucleotide
taatacgactcactataggggggcacggcgcccgcgagtgcgctggggcgaacagaggagacgccccatggcactcgcgaacctggcggcagcgcaaaagatg

SEQ ID NO: 205995 - DNA, 103 bp, Artificial Sequence
  Synthetic Polynucleotide
taatacgactcactatagggcacctccgataggtcctgctcctccgccataacagaggagaatggcgatggagcaggacaacctggcggcagcgcaaaagatg

SEQ ID NO: 205996 - DNA, 103 bp, Artificial Sequence
  Synthetic Polynucleotide
taatacgactcactatagggcgatccgccgccgccgccgtcgggccctagaacagaggagactagggatggacggcggcaacctggcggcagcgcaaaagatg

SEQ ID NO: 205997 - DNA, 103 bp, Artificial Sequence
  Synthetic Polynucleotide
taatacgactcactatagggcacgcctggtggcttggagatccaggcggaaacagaggagatccgccatgatctccaagaacctggcggcagcgcaaaagatg

SEQ ID NO: 205998 - DNA, 103 bp, Artificial Sequence
  Synthetic Polynucleotide
taatacgactcactatagggtgggcagagccacgcctggtggcttggagaaacagaggagatctccaatgcaccaggcgaacctggcggcagcgcaaaagatg

SEQ ID NO: 205999 - DNA, 103 bp, Artificial Sequence
  Synthetic Polynucleotide
taatacgactcactatagggggtgagaccgtgggcagagccacgcctggtaacagaggagaaccaggatgggctctgccaacctggcggcagcgcaaaagatg

SEQ ID NO: 206000 - DNA, 103 bp, Artificial Sequence
  Synthetic Polynucleotide
taatacgactcactatagggcacaccaggtggtgagaccgtgggcagagcaacagaggagagctctgatgacggtctcaaacctggcggcagcgcaaaagatg

SEQ ID NO: 206001 - DNA, 103 bp, Artificial Sequence
  Synthetic Polynucleotide
taatacgactcactatagggctttggcatccacaccaggtggtgagaccgaacagaggagacggtctatgcacctggtgaacctggcggcagcgcaaaagatg

SEQ ID NO: 206002 - DNA, 103 bp, Artificial Sequence
  Synthetic Polynucleotide
taatacgactcactatagggttcacctgggctttggcatccacaccaggtaacagaggagaacctggatgggatgccaaaacctggcggcagcgcaaaagatg

SEQ ID NO: 206003 - DNA, 103 bp, Artificial Sequence
  Synthetic Polynucleotide
taatacgactcactatagggggtctctgtcttcacctgggctttggcatcaacagaggagagatgccatggcccaggtgaacctggcggcagcgcaaaagatg

SEQ ID NO: 206004 - DNA, 103 bp, Artificial Sequence
  Synthetic Polynucleotide
taatacgactcactatagggggggccccgcggtctctgtcttcacctgggaacagaggagacccaggatgagacagagaaacctggcggcagcgcaaaagatg

SEQ ID NO: 206005 - DNA, 103 bp, Artificial Sequence
  Synthetic Polynucleotide
taatacgactcactataggggggggcccctggggccccgcggtctctgtcaacagaggagagacagaatgcgcggggccaacctggcggcagcgcaaaagatg

SEQ ID NO: 206006 - DNA, 103 bp, Artificial Sequence
  Synthetic Polynucleotide
taatacgactcactatagggggtgtagtgtgggggcccctggggccccgcaacagaggagagcggggatgcaggggcccaacctggcggcagcgcaaaagatg

SEQ ID NO: 206007 - DNA, 103 bp, Artificial Sequence
  Synthetic Polynucleotide
taatacgactcactatagggctcgcaggcccgatccgccgccgccgccgtaacagaggagaacggcgatggcggcggataacctggcggcagcgcaaaagatg

SEQ ID NO: 206008 - DNA, 103 bp, Artificial Sequence
  Synthetic Polynucleotide
taatacgactcactatagggatggctggtcggtgtagtgtgggggcccctaacagaggagaaggggcatgcacactacaaacctggcggcagcgcaaaagatg

SEQ ID NO: 206009 - DNA, 103 bp, Artificial Sequence
  Synthetic Polynucleotide
taatacgactcactatagggtgtgaggtggatggctggtcggtgtagtgtaacagaggagaacactaatgcgaccagccaacctggcggcagcgcaaaagatg

SEQ ID NO: 206010 - DNA, 103 bp, Artificial Sequence
  Synthetic Polynucleotide
taatacgactcactataggggtaggcgatctgtgaggtggatggctggtcaacagaggagagaccagatgtccacctcaaacctggcggcagcgcaaaagatg

SEQ ID NO: 206011 - DNA, 103 bp, Artificial Sequence
  Synthetic Polynucleotide
taatacgactcactatagggtgagggaggtgtaggcgatctgtgaggtggaacagaggagaccacctatgagatcgcctaacctggcggcagcgcaaaagatg

SEQ ID NO: 206012 - DNA, 103 bp, Artificial Sequence
  Synthetic Polynucleotide
taatacgactcactatagggtggggcaggctgagggaggtgtaggcgatcaacagaggagagatcgcatgcacctccctaacctggcggcagcgcaaaagatg

SEQ ID NO: 206013 - DNA, 103 bp, Artificial Sequence
  Synthetic Polynucleotide
taatacgactcactatagggtgagccatagtggggcaggctgagggaggtaacagaggagaacctccatgagcctgcccaacctggcggcagcgcaaaagatg

SEQ ID NO: 206014 - DNA, 103 bp, Artificial Sequence
  Synthetic Polynucleotide
taatacgactcactatagggaggggaaggctgagccatagtggggcaggcaacagaggagagcctgcatgactatggctaacctggcggcagcgcaaaagatg

SEQ ID NO: 206015 - DNA, 103 bp, Artificial Sequence
  Synthetic Polynucleotide
taatacgactcactatagggcgggagatggaggggaaggctgagccatagaacagaggagactatggatgagccttcccaacctggcggcagcgcaaaagatg

SEQ ID NO: 206016 - DNA, 103 bp, Artificial Sequence
  Synthetic Polynucleotide
taatacgactcactatagggaaactgggggcgggagatggaggggaaggcaacagaggagagccttcatgtccatctccaacctggcggcagcgcaaaagatg

SEQ ID NO: 206017 - DNA, 103 bp, Artificial Sequence
  Synthetic Polynucleotide
taatacgactcactatagggcagagtagtcaaactgggggcgggagatggaacagaggagaccatctatggcccccagtaacctggcggcagcgcaaaagatg

SEQ ID NO: 206018 - DNA, 103 bp, Artificial Sequence
  Synthetic Polynucleotide
taatacgactcactatagggcccgggctggctcgcaggcccgatccgccgaacagaggagacggcggatggggcctgcgaacctggcggcagcgcaaaagatg

SEQ ID NO: 206019 - DNA, 103 bp, Artificial Sequence
  Synthetic Polynucleotide
taatacgactcactatagggggctgatggtcagagtagtcaaactgggggaacagaggagacccccaatgtgactactcaacctggcggcagcgcaaaagatg

SEQ ID NO: 206020 - DNA, 103 bp, Artificial Sequence
  Synthetic Polynucleotide
taatacgactcactataggggggtcctgagggctgatggtcagagtagtcaacagaggagagactacatggaccatcagaacctggcggcagcgcaaaagatg

SEQ ID NO: 206021 - DNA, 103 bp, Artificial Sequence
  Synthetic Polynucleotide
taatacgactcactatagggggccataatagggtcctgagggctgatggtaacagaggagaaccatcatgcctcaggacaacctggcggcagcgcaaaagatg

SEQ ID NO: 206022 - DNA, 103 bp, Artificial Sequence
  Synthetic Polynucleotide
taatacgactcactatagggtggcccgagtggccataatagggtcctgagaacagaggagactcaggatgctattatggaacctggcggcagcgcaaaagatg

SEQ ID NO: 206023 - DNA, 103 bp, Artificial Sequence
  Synthetic Polynucleotide
taatacgactcactataggggccagaggcctggcccgagtggccataataaacagaggagatattatatgcactcgggcaacctggcggcagcgcaaaagatg

SEQ ID NO: 206024 - DNA, 103 bp, Artificial Sequence
  Synthetic Polynucleotide
taatacgactcactatagggccgagtagaggccagaggcctggcccgagtaacagaggagaactcggatgaggcctctgaacctggcggcagcgcaaaagatg

SEQ ID NO: 206025 - DNA, 103 bp, Artificial Sequence
  Synthetic Polynucleotide
taatacgactcactatagggtaggagaaggccgagtagaggccagaggccaacagaggagaggcctcatgcctctactcaacctggcggcagcgcaaaagatg

SEQ ID NO: 206026 - DNA, 103 bp, Artificial Sequence
  Synthetic Polynucleotide
taatacgactcactataggggggccccatataggagaaggccgagtagagaacagaggagactctacatggccttctccaacctggcggcagcgcaaaagatg

SEQ ID NO: 206027 - DNA, 103 bp, Artificial Sequence
  Synthetic Polynucleotide
taatacgactcactataggggccgctgcgagggccccatataggagaaggaacagaggagaccttctatgatatggggcaacctggcggcagcgcaaaagatg

SEQ ID NO: 206028 - DNA, 103 bp, Artificial Sequence
  Synthetic Polynucleotide
taatacgactcactataggggtgtagaggggccgctgcgagggccccataaacagaggagatatgggatgctcgcagcgaacctggcggcagcgcaaaagatg

SEQ ID NO: 206029 - DNA, 103 bp, Artificial Sequence
  Synthetic Polynucleotide
taatacgactcactatagggctcgcctggccccgggctggctcgcaggccaacagaggagaggcctgatggccagcccgaacctggcggcagcgcaaaagatg

SEQ ID NO: 206030 - DNA, 103 bp, Artificial Sequence
  Synthetic Polynucleotide
taatacgactcactatagggagagatggccgtgtagaggggccgctgcgaaacagaggagatcgcagatgcccctctacaacctggcggcagcgcaaaagatg

SEQ ID NO: 206031 - DNA, 103 bp, Artificial Sequence
  Synthetic Polynucleotide
taatacgactcactatagggggctggggtcagagatggccgtgtagagggaacagaggagaccctctatgcggccatctaacctggcggcagcgcaaaagatg

SEQ ID NO: 206032 - DNA, 103 bp, Artificial Sequence
  Synthetic Polynucleotide
taatacgactcactatagggggccctgaggggctggggtcagagatggccaacagaggagaggccatatgtgaccccagaacctggcggcagcgcaaaagatg

SEQ ID NO: 206033 - DNA, 103 bp, Artificial Sequence
  Synthetic Polynucleotide
taatacgactcactataggggtgggactggggccctgaggggctggggtcaacagaggagagaccccatgccctcagggaacctggcggcagcgcaaaagatg

SEQ ID NO: 206034 - DNA, 103 bp, Artificial Sequence
  Synthetic Polynucleotide
taatacgactcactataggggtgtggggctgtgggactggggccctgaggaacagaggagacctcagatgcccagtcccaacctggcggcagcgcaaaagatg

SEQ ID NO: 206035 - DNA, 103 bp, Artificial Sequence
  Synthetic Polynucleotide
taatacgactcactatagggtgctcccagtgtgtggggctgtgggactggaacagaggagaccagtcatgcagccccacaacctggcggcagcgcaaaagatg

SEQ ID NO: 206036 - DNA, 103 bp, Artificial Sequence
  Synthetic Polynucleotide
taatacgactcactatagggatatactggctgctcccagtgtgtggggctaacagaggagaagccccatgcactgggagaacctggcggcagcgcaaaagatg

SEQ ID NO: 206037 - DNA, 103 bp, Artificial Sequence
  Synthetic Polynucleotide
taatacgactcactatagggacagtgtcgtatatactggctgctcccagtaacagaggagaactgggatgagccagtataacctggcggcagcgcaaaagatg

SEQ ID NO: 206038 - DNA, 103 bp, Artificial Sequence
  Synthetic Polynucleotide
taatacgactcactatagggtagggccgggacagtgtcgtatatactggcaacagaggagagccagtatgtacgacactaacctggcggcagcgcaaaagatg

SEQ ID NO: 206039 - DNA, 103 bp, Artificial Sequence
  Synthetic Polynucleotide
taatacgactcactatagggccttgcccagctcgcctggccccgggctggaacagaggagaccagccatgggccaggcgaacctggcggcagcgcaaaagatg

SEQ ID NO: 206040 - DNA, 103 bp, Artificial Sequence
  Synthetic Polynucleotide
taatacgactcactatagggtccttcttgaccttgcccagctcgcctggcaacagaggagagccaggatggctgggcaaaacctggcggcagcgcaaaagatg

SEQ ID NO: 206041 - DNA, 103 bp, Artificial Sequence
  Synthetic Polynucleotide
taatacgactcactataggggtcctgctgctccttcttgaccttgcccagaacagaggagactgggcatggtcaagaagaacctggcggcagcgcaaaagatg

SEQ ID NO: 206042 - DNA, 103 bp, Artificial Sequence
  Synthetic Polynucleotide
taatacgactcactatagggccgcctcgccgtcctgctgctccttcttgaaacagaggagatcaagaatgagcagcaggaacctggcggcagcgcaaaagatg

SEQ ID NO: 206043 - DNA, 103 bp, Artificial Sequence
  Synthetic Polynucleotide
taatacgactcactatagggttgtcatcgtccgcctcgccgtcctgctgcaacagaggagagcagcaatgcggcgaggcaacctggcggcagcgcaaaagatg

SEQ ID NO: 206044 - DNA, 103 bp, Artificial Sequence
  Synthetic Polynucleotide
taatacgactcactatagggcacggggaacttgtcatcgtccgcctcgccaacagaggagaggcgagatggacgatgacaacctggcggcagcgcaaaagatg

SEQ ID NO: 206045 - DNA, 103 bp, Artificial Sequence
  Synthetic Polynucleotide
taatacgactcactatagggggctcagctccacctccgataggtcctgctaacagaggagaagcaggatgtatcggaggaacctggcggcagcgcaaaagatg

SEQ ID NO: 206046 - DNA, 103 bp, Artificial Sequence
  Synthetic Polynucleotide
taatacgactcactatagggcgcggatgcacacggggaacttgtcatcgtaacagaggagaacgatgatgagttccccgaacctggcggcagcgcaaaagatg

SEQ ID NO: 206047 - DNA, 103 bp, Artificial Sequence
  Synthetic Polynucleotide
taatacgactcactatagggctgacggcctcgcggatgcacacggggaacaacagaggagagttcccatggtgcatccgaacctggcggcagcgcaaaagatg

SEQ ID NO: 206048 - DNA, 103 bp, Artificial Sequence
  Synthetic Polynucleotide
taatacgactcactataggggagcacctggctgacggcctcgcggatgcaaacagaggagatgcatcatggaggccgtcaacctggcggcagcgcaaaagatg

SEQ ID NO: 206049 - DNA, 103 bp, Artificial Sequence
  Synthetic Polynucleotide
taatacgactcactatagggcgtagccgctgagcacctggctgacggcctaacagaggagaaggccgatggccaggtgcaacctggcggcagcgcaaaagatg

SEQ ID NO: 206050 - DNA, 103 bp, Artificial Sequence
  Synthetic Polynucleotide
taatacgactcactatagggagcgtccagtcgtagccgctgagcacctggaacagaggagaccaggtatgcagcggctaaacctggcggcagcgcaaaagatg

SEQ ID NO: 206051 - DNA, 103 bp, Artificial Sequence
  Synthetic Polynucleotide
taatacgactcactatagggcatgggcaccagcgtccagtcgtagccgctaacagaggagaagcggcatggactggacgaacctggcggcagcgcaaaagatg

SEQ ID NO: 206052 - DNA, 103 bp, Artificial Sequence
  Synthetic Polynucleotide
taatacgactcactatagggcgcgcacgggcatgggcaccagcgtccagtaacagaggagaactggaatgtggtgcccaaacctggcggcagcgcaaaagatg

SEQ ID NO: 206053 - DNA, 103 bp, Artificial Sequence
  Synthetic Polynucleotide
taatacgactcactataggggcgccgttgacgcgcacgggcatgggcaccaacagaggagaggtgccatggcccgtgcgaacctggcggcagcgcaaaagatg

SEQ ID NO: 206054 - DNA, 103 bp, Artificial Sequence
  Synthetic Polynucleotide
taatacgactcactataggggcttttgctggcgccgttgacgcgcacgggaacagaggagacccgtgatggtcaacggcaacctggcggcagcgcaaaagatg

SEQ ID NO: 206055 - DNA, 103 bp, Artificial Sequence
  Synthetic Polynucleotide
taatacgactcactatagggcgtgcggcttgcttttgctggcgccgttgaaacagaggagatcaacgatgccagcaaaaaacctggcggcagcgcaaaagatg

SEQ ID NO: 206056 - DNA, 103 bp, Artificial Sequence
  Synthetic Polynucleotide
taatacgactcactataggggagcccacggggctcagctccacctccgataacagaggagaatcggaatgggagctgagaacctggcggcagcgcaaaagatg

SEQ ID NO: 206057 - DNA, 103 bp, Artificial Sequence
  Synthetic Polynucleotide
taatacgactcactatagggggccgcttgacgtgcggcttgcttttgctgaacagaggagacagcaaatgcaagccgcaaacctggcggcagcgcaaaagatg

SEQ ID NO: 206058 - DNA, 103 bp, Artificial Sequence
  Synthetic Polynucleotide
taatacgactcactatagggggcgttcatgggccgcttgacgtgcggcttaacagaggagaaagccgatggtcaagcggaacctggcggcagcgcaaaagatg

SEQ ID NO: 206059 - DNA, 103 bp, Artificial Sequence
  Synthetic Polynucleotide
taatacgactcactatagggacaccatgaaggcgttcatgggccgcttgaaacagaggagatcaagcatgccatgaacgaacctggcggcagcgcaaaagatg

SEQ ID NO: 206060 - DNA, 103 bp, Artificial Sequence
  Synthetic Polynucleotide
taatacgactcactataggggcctgagcccacaccatgaaggcgttcatgaacagaggagacatgaaatgcttcatggtaacctggcggcagcgcaaaagatg

SEQ ID NO: 206061 - DNA, 103 bp, Artificial Sequence
  Synthetic Polynucleotide
taatacgactcactatagggcctgcgcgctgcctgagcccacaccatgaaaacagaggagattcatgatgtgggctcagaacctggcggcagcgcaaaagatg

SEQ ID NO: 206062 - DNA, 103 bp, Artificial Sequence
  Synthetic Polynucleotide
taatacgactcactatagggccgcgagcttcctgcgcgctgcctgagcccaacagaggagagggctcatgcagcgcgcaaacctggcggcagcgcaaaagatg

SEQ ID NO: 206063 - DNA, 103 bp, Artificial Sequence
  Synthetic Polynucleotide
taatacgactcactataggggggtactggtccgcgagcttcctgcgcgctaacagaggagaagcgcgatggaagctcgcaacctggcggcagcgcaaaagatg

SEQ ID NO: 206064 - DNA, 103 bp, Artificial Sequence
  Synthetic Polynucleotide
taatacgactcactataggggtgcaggtgcgggtactggtccgcgagcttaacagaggagaaagctcatggaccagtacaacctggcggcagcgcaaaagatg

SEQ ID NO: 206065 - DNA, 103 bp, Artificial Sequence
  Synthetic Polynucleotide
taatacgactcactataggggctcagcgttgtgcaggtgcgggtactggtaacagaggagaaccagtatgcgcacctgcaacctggcggcagcgcaaaagatg

SEQ ID NO: 206066 - DNA, 103 bp, Artificial Sequence
  Synthetic Polynucleotide
taatacgactcactataggggtcttgctgagctcagcgttgtgcaggtgcaacagaggagagcacctatgcaacgctgaaacctggcggcagcgcaaaagatg

SEQ ID NO: 206067 - DNA, 103 bp, Artificial Sequence
  Synthetic Polynucleotide
taatacgactcactataggggggctcctccgagcccacggggctcagctcaacagaggagagagctgatgcccgtgggcaacctggcggcagcgcaaaagatg

SEQ ID NO: 206068 - DNA, 103 bp, Artificial Sequence
  Synthetic Polynucleotide
taatacgactcactatagggcttgcccagcgtcttgctgagctcagcgttaacagaggagaaacgctatgctcagcaagaacctggcggcagcgcaaaagatg

SEQ ID NO: 206069 - DNA, 103 bp, Artificial Sequence
  Synthetic Polynucleotide
taatacgactcactataggggcctccagagcttgcccagcgtcttgctgaaacagaggagatcagcaatgcgctgggcaaacctggcggcagcgcaaaagatg

SEQ ID NO: 206070 - DNA, 103 bp, Artificial Sequence
  Synthetic Polynucleotide
taatacgactcactatagggtcgttcagcagcctccagagcttgcccagcaacagaggagagctgggatggctctggagaacctggcggcagcgcaaaagatg

SEQ ID NO: 206071 - DNA, 103 bp, Artificial Sequence
  Synthetic Polynucleotide
taatacgactcactatagggcttgtcactttcgttcagcagcctccagagaacagaggagactctggatgctgctgaacaacctggcggcagcgcaaaagatg

SEQ ID NO: 206072 - DNA, 103 bp, Artificial Sequence
  Synthetic Polynucleotide
taatacgactcactatagggtgaaggggcgcttgtcactttcgttcagcaaacagaggagatgctgaatgaaagtgacaaacctggcggcagcgcaaaagatg

SEQ ID NO: 206073 - DNA, 103 bp, Artificial Sequence
  Synthetic Polynucleotide
taatacgactcactataggggcctcctcgatgaaggggcgcttgtcacttaacagaggagaaagtgaatggcgccccttaacctggcggcagcgcaaaagatg

SEQ ID NO: 206074 - DNA, 103 bp, Artificial Sequence
  Synthetic Polynucleotide
taatacgactcactataggggagccgctcagcctcctcgatgaaggggcgaacagaggagacgccccatgatcgaggagaacctggcggcagcgcaaaagatg

SEQ ID NO: 206075 - DNA, 103 bp, Artificial Sequence
  Synthetic Polynucleotide
taatacgactcactataggggctgcatacggagccgctcagcctcctcgaaacagaggagatcgaggatgctgagcggcaacctggcggcagcgcaaaagatg

SEQ ID NO: 206076 - DNA, 103 bp, Artificial Sequence
  Synthetic Polynucleotide
taatacgactcactatagggtctttcttgtgctgcatacggagccgctcaaacagaggagatgagcgatgccgtatgcaaacctggcggcagcgcaaaagatg

SEQ ID NO: 206077 - DNA, 103 bp, Artificial Sequence
  Synthetic Polynucleotide
taatacgactcactataggggtccgggtggtctttcttgtgctgcatacgaacagaggagacgtatgatgcacaagaaaaacctggcggcagcgcaaaagatg

SEQ ID NO: 206078 - DNA, 103 bp, Artificial Sequence
  Synthetic Polynucleotide
taatacgactcactatagggacaggcagcggggctcctccgagcccacggaacagaggagaccgtggatgcggaggagcaacctggcggcagcgcaaaagatg

SEQ ID NO: 206079 - DNA, 103 bp, Artificial Sequence
  Synthetic Polynucleotide
taatacgactcactatagggggtacttgtagtccgggtggtctttcttgtaacagaggagaacaagaatgaccacccggaacctggcggcagcgcaaaagatg

SEQ ID NO: 206080 - DNA, 103 bp, Artificial Sequence
  Synthetic Polynucleotide
taatacgactcactatagggcgcctgggctggtacttgtagtccgggtggaacagaggagaccacccatgctacaagtaaacctggcggcagcgcaaaagatg

SEQ ID NO: 206081 - DNA, 103 bp, Artificial Sequence
  Synthetic Polynucleotide
taatacgactcactataggggttcttccgccgcctgggctggtacttgtaaacagaggagatacaagatgcagcccaggaacctggcggcagcgcaaaagatg

SEQ ID NO: 206082 - DNA, 103 bp, Artificial Sequence
  Synthetic Polynucleotide
taatacgactcactatagggcggccttcccgttcttccgccgcctgggctaacagaggagaagcccaatgggcggaagaaacctggcggcagcgcaaaagatg

SEQ ID NO: 206083 - DNA, 103 bp, Artificial Sequence
  Synthetic Polynucleotide
taatacgactcactatagggtcgccctgggcggccttcccgttcttccgcaacagaggagagcggaaatgcgggaaggcaacctggcggcagcgcaaaagatg

SEQ ID NO: 206084 - DNA, 103 bp, Artificial Sequence
  Synthetic Polynucleotide
taatacgactcactataggggcactccgcctcgccctgggcggccttcccaacagaggagagggaagatggcccagggcaacctggcggcagcgcaaaagatg

SEQ ID NO: 206085 - DNA, 103 bp, Artificial Sequence
  Synthetic Polynucleotide
taatacgactcactatagggccccaccggggcactccgcctcgccctgggaacagaggagacccaggatgaggcggagtaacctggcggcagcgcaaaagatg

SEQ ID NO: 206086 - DNA, 103 bp, Artificial Sequence
  Synthetic Polynucleotide
taatacgactcactatagggtgctcggcctccccaccggggcactccgccaacagaggagaggcggaatgccccggtggaacctggcggcagcgcaaaagatg

SEQ ID NO: 206087 - DNA, 103 bp, Artificial Sequence
  Synthetic Polynucleotide
taatacgactcactatagggggtcccaccttgctcggcctccccaccgggaacagaggagacccggtatggaggccgagaacctggcggcagcgcaaaagatg

SEQ ID NO: 206088 - DNA, 103 bp, Artificial Sequence
  Synthetic Polynucleotide
taatacgactcactatagggggatggcggcggtcccaccttgctcggcctaacagaggagaaggccgatgaaggtgggaaacctggcggcagcgcaaaagatg

SEQ ID NO: 206089 - DNA, 103 bp, Artificial Sequence
  Synthetic Polynucleotide
taatacgactcactatagggctccccggggacaggcagcggggctcctccaacagaggagaggaggaatgccgctgcctaacctggcggcagcgcaaaagatg

SEQ ID NO: 206090 - DNA, 103 bp, Artificial Sequence
  Synthetic Polynucleotide
taatacgactcactatagggtagtgggcctggatggcggcggtcccacctaacagaggagaaggtggatgcgccgccataacctggcggcagcgcaaaagatg

SEQ ID NO: 206091 - DNA, 103 bp, Artificial Sequence
  Synthetic Polynucleotide
taatacgactcactatagggggcgctcttgtagtgggcctggatggcggcaacagaggagagccgccatgcaggcccacaacctggcggcagcgcaaaagatg

SEQ ID NO: 206092 - DNA, 103 bp, Artificial Sequence
  Synthetic Polynucleotide
taatacgactcactatagggggtccaagtgggcgctcttgtagtgggcctaacagaggagaaggcccatgacaagagcgaacctggcggcagcgcaaaagatg

SEQ ID NO: 206093 - DNA, 103 bp, Artificial Sequence
  Synthetic Polynucleotide
taatacgactcactataggggggtgccggtggtccaagtgggcgctcttgaacagaggagacaagagatgccacttggaaacctggcggcagcgcaaaagatg

SEQ ID NO: 206094 - DNA, 103 bp, Artificial Sequence
  Synthetic Polynucleotide
taatacgactcactataggggccctctcctgggtgccggtggtccaagtgaacagaggagacacttgatgcaccggcacaacctggcggcagcgcaaaagatg

SEQ ID NO: 206095 - DNA, 103 bp, Artificial Sequence
  Synthetic Polynucleotide
taatacgactcactatagggacatgggggagccctctcctgggtgccggtaacagaggagaaccggcatgcaggagaggaacctggcggcagcgcaaaagatg

SEQ ID NO: 206096 - DNA, 103 bp, Artificial Sequence
  Synthetic Polynucleotide
taatacgactcactatagggttcccatctgacatgggggagccctctcctaacagaggagaaggagaatgctcccccataacctggcggcagcgcaaaagatg

SEQ ID NO: 206097 - DNA, 103 bp, Artificial Sequence
  Synthetic Polynucleotide
taatacgactcactataggggtgctcggggttcccatctgacatgggggaaacagaggagatcccccatgtcagatgggaacctggcggcagcgcaaaagatg

SEQ ID NO: 206098 - DNA, 103 bp, Artificial Sequence
  Synthetic Polynucleotide
taatacgactcactatagggggcctgaggggtgctcggggttcccatctgaacagaggagacagatgatgaccccgagcaacctggcggcagcgcaaaagatg

SEQ ID NO: 206099 - DNA, 103 bp, Artificial Sequence
  Synthetic Polynucleotide
taatacgactcactatagggccatggctctggcctgaggggtgctcggggaacagaggagaccccgaatgcccctcaggaacctggcggcagcgcaaaagatg

SEQ ID NO: 206100 - DNA, 103 bp, Artificial Sequence
  Synthetic Polynucleotide
taatacgactcactatagggcgagggcgcgctccccggggacaggcagcgaacagaggagacgctgcatgtccccggggaacctggcggcagcgcaaaagatg

SEQ ID NO: 206101 - DNA, 103 bp, Artificial Sequence
  Synthetic Polynucleotide
taatacgactcactatagggggtgggtgggccatggctctggcctgagggaacagaggagaccctcaatgcagagccataacctggcggcagcgcaaaagatg

SEQ ID NO: 206102 - DNA, 103 bp, Artificial Sequence
  Synthetic Polynucleotide
taatacgactcactatagggtggttggaggggtgggtgggccatggctctaacagaggagaagagccatggcccacccaaacctggcggcagcgcaaaagatg

SEQ ID NO: 206103 - DNA, 103 bp, Artificial Sequence
  Synthetic Polynucleotide
taatacgactcactataggggtcttcggggtggttggaggggtgggtgggaacagaggagacccaccatgccctccaacaacctggcggcagcgcaaaagatg

SEQ ID NO: 206104 - DNA, 103 bp, Artificial Sequence
  Synthetic Polynucleotide
taatacgactcactatagggctgcagctctgtcttcggggtggttggaggaacagaggagacctccaatgaccccgaagaacctggcggcagcgcaaaagatg

SEQ ID NO: 206105 - DNA, 103 bp, Artificial Sequence
  Synthetic Polynucleotide
taatacgactcactatagggccttgcccgactgcagctctgtcttcggggaacagaggagaccccgaatgcagagctgcaacctggcggcagcgcaaaagatg

SEQ ID NO: 206106 - DNA, 103 bp, Artificial Sequence
  Synthetic Polynucleotide
taatacgactcactatagggttcgggtctgccttgcccgactgcagctctaacagaggagaagagctatggtcgggcaaaacctggcggcagcgcaaaagatg

SEQ ID NO: 206107 - DNA, 103 bp, Artificial Sequence
  Synthetic Polynucleotide
taatacgactcactatagggcccgtcccgcttcgggtctgccttgcccgaaacagaggagatcgggcatggcagacccgaacctggcggcagcgcaaaagatg

SEQ ID NO: 206108 - DNA, 103 bp, Artificial Sequence
  Synthetic Polynucleotide
taatacgactcactatagggccatggagcgcccgtcccgcttcgggtctgaacagaggagacagaccatgagcgggacgaacctggcggcagcgcaaaagatg

SEQ ID NO: 206109 - DNA, 103 bp, Artificial Sequence
  Synthetic Polynucleotide
taatacgactcactatagggccgccctcccccatggagcgcccgtcccgcaacagaggagagcgggaatggcgctccataacctggcggcagcgcaaaagatg

SEQ ID NO: 206110 - DNA, 103 bp, Artificial Sequence
  Synthetic Polynucleotide
taatacgactcactataggggtgaggcttcccgccctcccccatggagcgaacagaggagacgctccatgggggagggcaacctggcggcagcgcaaaagatg

SEQ ID NO: 206111 - DNA, 103 bp, Artificial Sequence
  Synthetic Polynucleotide
taatacgactcactatagggcgggccctagcgagggcgcgctccccggggaacagaggagaccccggatggcgcgccctaacctggcggcagcgcaaaagatg

SEQ ID NO: 206112 - DNA, 103 bp, Artificial Sequence
  Synthetic Polynucleotide
taatacgactcactatagggcgaagtcgatgtgaggcttcccgccctcccaacagaggagagggaggatgggaagcctcaacctggcggcagcgcaaaagatg

SEQ ID NO: 206113 - DNA, 103 bp, Artificial Sequence
  Synthetic Polynucleotide
taatacgactcactatagggtccacgttgccgaagtcgatgtgaggcttcaacagaggagagaagccatgcatcgacttaacctggcggcagcgcaaaagatg

SEQ ID NO: 206114 - DNA, 103 bp, Artificial Sequence
  Synthetic Polynucleotide
taatacgactcactatagggctcaccaatgtccacgttgccgaagtcgataacagaggagaatcgacatgggcaacgtgaacctggcggcagcgcaaaagatg

SEQ ID NO: 206115 - DNA, 103 bp, Artificial Sequence
  Synthetic Polynucleotide
taatacgactcactatagggcgtggctgatctcaccaatgtccacgttgcaacagaggagagcaacgatgacattggtgaacctggcggcagcgcaaaagatg

SEQ ID NO: 206116 - DNA, 103 bp, Artificial Sequence
  Synthetic Polynucleotide
taatacgactcactataggggacattacctcgtggctgatctcaccaatgaacagaggagacattggatggatcagccaaacctggcggcagcgcaaaagatg

SEQ ID NO: 206117 - DNA, 103 bp, Artificial Sequence
  Synthetic Polynucleotide
taatacgactcactatagggctccatgttggacattacctcgtggctgataacagaggagaatcagcatggaggtaatgaacctggcggcagcgcaaaagatg

SEQ ID NO: 206118 - DNA, 103 bp, Artificial Sequence
  Synthetic Polynucleotide
taatacgactcactatagggcatcaaaggtctccatgttggacattacctaacagaggagaaggtaaatgccaacatggaacctggcggcagcgcaaaagatg

SEQ ID NO: 206119 - DNA, 103 bp, Artificial Sequence
  Synthetic Polynucleotide
taatacgactcactatagggaactcagccacatcaaaggtctccatgttgaacagaggagacaacatatggacctttgaaacctggcggcagcgcaaaagatg

SEQ ID NO: 206120 - DNA, 103 bp, Artificial Sequence
  Synthetic Polynucleotide
taatacgactcactataggggtactggtccaactcagccacatcaaaggtaacagaggagaacctttatggtggctgagaacctggcggcagcgcaaaagatg

SEQ ID NO: 206121 - DNA, 103 bp, Artificial Sequence
  Synthetic Polynucleotide
taatacgactcactatagggtgggcggcaggtactggtccaactcagccaaacagaggagatggctgatgtggaccagtaacctggcggcagcgcaaaagatg

SEQ ID NO: 206122 - DNA, 103 bp, Artificial Sequence
  Synthetic Polynucleotide
taatacgactcactatagggccgccgccgtcgggccctagcgagggcgcgaacagaggagacgcgccatggctagggccaacctggcggcagcgcaaaagatg

SEQ ID NO: 206123 - DNA, 103 bp, Artificial Sequence
  Synthetic Polynucleotide
taatacgactcactataggggggtgcccattgggcggcaggtactggtccaacagaggagaggaccaatgcctgccgccaacctggcggcagcgcaaaagatg

SEQ ID NO: 206124 - DNA, 103 bp, Artificial Sequence
  Synthetic Polynucleotide
taatacgactcactatagggcacatggcctgggtgcccattgggcggcagaacagaggagactgccgatgaatgggcacaacctggcggcagcgcaaaagatg

SEQ ID NO: 206125 - DNA, 103 bp, Artificial Sequence
  Synthetic Polynucleotide
taatacgactcactatagggagtagctgctcacatggcctgggtgcccataacagaggagaatgggcatgcaggccatgaacctggcggcagcgcaaaagatg

SEQ ID NO: 206126 - DNA, 103 bp, Artificial Sequence
  Synthetic Polynucleotide
taatacgactcactatagggccggctgctgagtagctgctcacatggcctaacagaggagaaggccaatggagcagctaaacctggcggcagcgcaaaagatg

SEQ ID NO: 206127 - DNA, 103 bp, Artificial Sequence
  Synthetic Polynucleotide
taatacgactcactatagggcagcccatagccggctgctgagtagctgctaacagaggagaagcagcatgtcagcagccaacctggcggcagcgcaaaagatg

SEQ ID NO: 206128 - DNA, 103 bp, Artificial Sequence
  Synthetic Polynucleotide
taatacgactcactataggggggcactgcccagcccatagccggctgctgaacagaggagacagcagatggctatgggcaacctggcggcagcgcaaaagatg

SEQ ID NO: 206129 - DNA, 103 bp, Artificial Sequence
  Synthetic Polynucleotide
taatacgactcactataggggccacggccagggcactgcccagcccatagaacagaggagactatggatggggcagtgcaacctggcggcagcgcaaaagatg

SEQ ID NO: 206130 - DNA, 103 bp, Artificial Sequence
  Synthetic Polynucleotide
taatacgactcactataggggtgtccactggccacggccagggcactgccaacagaggagaggcagtatgctggccgtgaacctggcggcagcgcaaaagatg

SEQ ID NO: 206131 - DNA, 103 bp, Artificial Sequence
  Synthetic Polynucleotide
taatacgactcactatagggtccaggcggagtgtccactggccacggccaaacagaggagatggccgatgccagtggacaacctggcggcagcgcaaaagatg

SEQ ID NO: 206132 - DNA, 103 bp, Artificial Sequence
  Synthetic Polynucleotide
taatacgactcactatagggggcttggagatccaggcggagtgtccactgaacagaggagacagtggatgctccgcctgaacctggcggcagcgcaaaagatg

SEQ ID NO: 206133 - DNA, 103 bp, Artificial Sequence
  Synthetic Polynucleotide
taatacgactcactatagggcgcttccaagctctccgcctgctgcaccataacagaggagaatggtgatgcaggcggagaacctggcggcagcgcaaaagatg

SEQ ID NO: 206134 - DNA, 103 bp, Artificial Sequence
  Synthetic Polynucleotide
taatacgactcactataggggtctgggtcgctctcgtccagggccaccggaacagaggagaccggtgatgctggacgagaacctggcggcagcgcaaaagatg

SEQ ID NO: 206135 - DNA, 103 bp, Artificial Sequence
  Synthetic Polynucleotide
taatacgactcactatagggggacaccgagcgcgaggacgcgggcgacagaacagaggagactgtcgatggcgtcctcgaacctggcggcagcgcaaaagatg

SEQ ID NO: 206136 - DNA, 103 bp, Artificial Sequence
  Synthetic Polynucleotide
taatacgactcactatagggacgaggaggtggacaccgagcgcgaggacgaacagaggagacgtcctatggctcggtgtaacctggcggcagcgcaaaagatg

SEQ ID NO: 206137 - DNA, 103 bp, Artificial Sequence
  Synthetic Polynucleotide
taatacgactcactatagggctgctgctggacgaggaggtggacaccgagaacagaggagactcggtatgcacctcctcaacctggcggcagcgcaaaagatg

SEQ ID NO: 206138 - DNA, 103 bp, Artificial Sequence
  Synthetic Polynucleotide
taatacgactcactataggggctgctgccgctgctgctggacgaggaggtaacagaggagaacctccatgtccagcagcaacctggcggcagcgcaaaagatg

SEQ ID NO: 206139 - DNA, 103 bp, Artificial Sequence
  Synthetic Polynucleotide
taatacgactcactatagggtgctgccgctgctgctgccgctgctgctggaacagaggagaccagcaatggcggcagcaaacctggcggcagcgcaaaagatg

SEQ ID NO: 206140 - DNA, 103 bp, Artificial Sequence
  Synthetic Polynucleotide
taatacgactcactatagggtcctcgccgctgctgccgctgctgctgccgaacagaggagacggcagatgcagcggcagaacctggcggcagcgcaaaagatg

SEQ ID NO: 206141 - DNA, 103 bp, Artificial Sequence
  Synthetic Polynucleotide
taatacgactcactataggggtcgtcggcgtcctcgccgctgctgccgctaacagaggagaagcggcatgagcggcgagaacctggcggcagcgcaaaagatg

SEQ ID NO: 206142 - DNA, 103 bp, Artificial Sequence
  Synthetic Polynucleotide
taatacgactcactatagggcgaacatcaggtcgtcggcgtcctcgccgcaacagaggagagcggcgatgacgccgacgaacctggcggcagcgcaaaagatg

SEQ ID NO: 206143 - DNA, 103 bp, Artificial Sequence
  Synthetic Polynucleotide
taatacgactcactatagggaagctcaggtcgaacatcaggtcgtcggcgaacagaggagacgccgaatgcctgatgttaacctggcggcagcgcaaaagatg

SEQ ID NO: 206144 - DNA, 103 bp, Artificial Sequence
  Synthetic Polynucleotide
taatacgactcactatagggagagaaattcaagctcaggtcgaacatcagaacagaggagactgatgatggacctgagcaacctggcggcagcgcaaaagatg

SEQ ID NO: 206145 - DNA, 103 bp, Artificial Sequence
  Synthetic Polynucleotide
taatacgactcactatagggtcttgcaccagtctgggtcgctctcgtccaaacagaggagatggacgatggcgacccagaacctggcggcagcgcaaaagatg

SEQ ID NO: 206146 - DNA, 103 bp, Artificial Sequence
  Synthetic Polynucleotide
taatacgactcactataggggcgcgctttgagagaaattcaagctcaggtaacagaggagaacctgaatgtgaatttctaacctggcggcagcgcaaaagatg

SEQ ID NO: 206147 - DNA, 103 bp, Artificial Sequence
  Synthetic Polynucleotide
taatacgactcactatagggctggcgctgtgcgcgctttgagagaaattcaacagaggagagaatttatgtcaaagcgcaacctggcggcagcgcaaaagatg

SEQ ID NO: 206148 - DNA, 103 bp, Artificial Sequence
  Synthetic Polynucleotide
taatacgactcactatagggctgctgctcgctggcgctgtgcgcgctttgaacagaggagacaaagcatgcacagcgccaacctggcggcagcgcaaaagatg

SEQ ID NO: 206149 - DNA, 103 bp, Artificial Sequence
  Synthetic Polynucleotide
taatacgactcactatagggcgccccccagctgctgctcgctggcgctgtaacagaggagaacagcgatggcgagcagcaacctggcggcagcgcaaaagatg

SEQ ID NO: 206150 - DNA, 103 bp, Artificial Sequence
  Synthetic Polynucleotide
taatacgactcactataggggccgccgcgccgccccccagctgctgctcgaacagaggagacgagcaatggctggggggaacctggcggcagcgcaaaagatg

SEQ ID NO: 206151 - DNA, 103 bp, Artificial Sequence
  Synthetic Polynucleotide
taatacgactcactatagggcaggttcccggccgccgcgccgccccccagaacagaggagactggggatgggcgcggcgaacctggcggcagcgcaaaagatg

SEQ ID NO: 206152 - DNA, 103 bp, Artificial Sequence
  Synthetic Polynucleotide
taatacgactcactataggggcgacagggacaggttcccggccgccgcgcaacagaggagagcgcggatgccgggaaccaacctggcggcagcgcaaaagatg

SEQ ID NO: 206153 - DNA, 103 bp, Artificial Sequence
  Synthetic Polynucleotide
taatacgactcactatagggttatccaccagcgacagggacaggttcccgaacagaggagacgggaaatggtccctgtcaacctggcggcagcgcaaaagatg

SEQ ID NO: 206154 - DNA, 103 bp, Artificial Sequence
  Synthetic Polynucleotide
taatacgactcactatagggatccaaatccttatccaccagcgacagggaaacagaggagatccctgatgctggtggataacctggcggcagcgcaaaagatg

SEQ ID NO: 206155 - DNA, 103 bp, Artificial Sequence
  Synthetic Polynucleotide
taatacgactcactatagggcgctgaacgaatccaaatccttatccaccaaacagaggagatggtggatgaggatttggaacctggcggcagcgcaaaagatg

SEQ ID NO: 206156 - DNA, 103 bp, Artificial Sequence
  Synthetic Polynucleotide
taatacgactcactatagggcccgacgccgtcttgcaccagtctgggtcgaacagaggagacgacccatgctggtgcaaaacctggcggcagcgcaaaagatg

SEQ ID NO: 206157 - DNA, 103 bp, Artificial Sequence
  Synthetic Polynucleotide
taatacgactcactatagggaggctgccctcgctgaacgaatccaaatccaacagaggagaggatttatgttcgttcagaacctggcggcagcgcaaaagatg

SEQ ID NO: 206158 - DNA, 103 bp, Artificial Sequence
  Synthetic Polynucleotide
taatacgactcactataggggtgggagcccaggctgccctcgctgaacgaaacagaggagatcgttcatggagggcagcaacctggcggcagcgcaaaagatg

SEQ ID NO: 206159 - DNA, 103 bp, Artificial Sequence
  Synthetic Polynucleotide
taatacgactcactatagggggaactcgaagtgggagcccaggctgccctaacagaggagaagggcaatgtgggctcccaacctggcggcagcgcaaaagatg

SEQ ID NO: 206160 - DNA, 103 bp, Artificial Sequence
  Synthetic Polynucleotide
taatacgactcactatagggcagtagtcggggaactcgaagtgggagcccaacagaggagagggctcatgcttcgagttaacctggcggcagcgcaaaagatg

SEQ ID NO: 206161 - DNA, 103 bp, Artificial Sequence
  Synthetic Polynucleotide
taatacgactcactatagggctccggcgtgcagtagtcggggaactcgaaaacagaggagattcgagatgcccgactacaacctggcggcagcgcaaaagatg

SEQ ID NO: 206162 - DNA, 103 bp, Artificial Sequence
  Synthetic Polynucleotide
taatacgactcactatagggtctcgctcagctccggcgtgcagtagtcggaacagaggagaccgactatggcacgccggaacctggcggcagcgcaaaagatg

SEQ ID NO: 206163 - DNA, 103 bp, Artificial Sequence
  Synthetic Polynucleotide
taatacgactcactatagggcccgcgatcatctcgctcagctccggcgtgaacagaggagacacgccatggctgagcgaaacctggcggcagcgcaaaagatg

SEQ ID NO: 206164 - DNA, 103 bp, Artificial Sequence
  Synthetic Polynucleotide
taatacgactcactatagggcagccagtcccccgcgatcatctcgctcagaacagaggagactgagcatgatgatcgcgaacctggcggcagcgcaaaagatg

SEQ ID NO: 206165 - DNA, 103 bp, Artificial Sequence
  Synthetic Polynucleotide
taatacgactcactatagggagttcgcctccagccagtcccccgcgatcaaacagaggagatgatcgatggggactggcaacctggcggcagcgcaaaagatg

SEQ ID NO: 206166 - DNA, 103 bp, Artificial Sequence
  Synthetic Polynucleotide
taatacgactcactatagggaggtcggagaagttcgcctccagccagtccaacagaggagaggactgatgggaggcgaaaacctggcggcagcgcaaaagatg

SEQ ID NO: 206167 - DNA, 103 bp, Artificial Sequence
  Synthetic Polynucleotide
taatacgactcactatagggcttgatgtggcccgacgccgtcttgcaccaaacagaggagatggtgcatgacggcgtcgaacctggcggcagcgcaaaagatg

SEQ ID NO: 206168 - DNA, 103 bp, Artificial Sequence
  Synthetic Polynucleotide
taatacgactcactatagggtgtgaacaccaggtcggagaagttcgcctcaacagaggagagaggcgatgttctccgacaacctggcggcagcgcaaaagatg

SEQ ID NO: 206169 - DNA, 103 bp, Artificial Sequence
  Synthetic Polynucleotide
taatacgactcactatagggtcatcggccgcttgatgtggcccgacgccgaacagaggagacggcgtatggccacatcaaacctggcggcagcgcaaaagatg

SEQ ID NO: 206170 - DNA, 103 bp, Artificial Sequence
  Synthetic Polynucleotide
taatacgactcactatagggatgaacgcgttcatcggccgcttgatgtggaacagaggagaccacatatggcggccgataacctggcggcagcgcaaaagatg

SEQ ID NO: 206171 - DNA, 103 bp, Artificial Sequence
  Synthetic Polynucleotide
taatacgactcactatagggggaccataccatgaacgcgttcatcggccgaacagaggagacggccgatgaacgcgttcaacctggcggcagcgcaaaagatg

SEQ ID NO: 206172 - DNA, 103 bp, Artificial Sequence
  Synthetic Polynucleotide
taatacgactcactataggggttcgatcttggaccataccatgaacgcgtaacagaggagaacgcgtatgtggtatggtaacctggcggcagcgcaaaagatg

SEQ ID NO: 206173 - DNA, 103 bp, Artificial Sequence
  Synthetic Polynucleotide
taatacgactcactatagggatcttcctgcgttcgatcttggaccataccaacagaggagaggtatgatgcaagatcgaaacctggcggcagcgcaaaagatg

SEQ ID NO: 206174 - DNA, 103 bp, Artificial Sequence
  Synthetic Polynucleotide
taatacgactcactatagggctgctccatgatcttcctgcgttcgatcttaacagaggagaaagatcatgcgcaggaagaacctggcggcagcgcaaaagatg

SEQ ID NO: 206175 - DNA, 103 bp, Artificial Sequence
  Synthetic Polynucleotide
taatacgactcactatagggggttgctctccgcttccaagctctccgcctaacagaggagaaggcggatggcttggaagaacctggcggcagcgcaaaagatg

SEQ ID NO: 206176 - DNA, 103 bp, Artificial Sequence
  Synthetic Polynucleotide
taatacgactcactatagggtgtccggagactgctccatgatcttcctgcaacagaggagagcaggaatgtcatggagcaacctggcggcagcgcaaaagatg

SEQ ID NO: 206177 - DNA, 103 bp, Artificial Sequence
  Synthetic Polynucleotide
taatacgactcactataggggcgttgtgcatgtccggagactgctccatgaacagaggagacatggaatggtctccggaaacctggcggcagcgcaaaagatg

SEQ ID NO: 206178 - DNA, 103 bp, Artificial Sequence
  Synthetic Polynucleotide
taatacgactcactatagggggagatctcggcgttgtgcatgtccggagaaacagaggagatctccgatgatgcacaacaacctggcggcagcgcaaaagatg

SEQ ID NO: 206179 - DNA, 103 bp, Artificial Sequence
  Synthetic Polynucleotide
taatacgactcactatagggccagcctcttggagatctcggcgttgtgcaaacagaggagatgcacaatgccgagatctaacctggcggcagcgcaaaagatg

SEQ ID NO: 206180 - DNA, 103 bp, Artificial Sequence
  Synthetic Polynucleotide
taatacgactcactatagggcagcgcttgcccagcctcttggagatctcgaacagaggagacgagatatgcaagaggctaacctggcggcagcgcaaaagatg

SEQ ID NO: 206181 - DNA, 103 bp, Artificial Sequence
  Synthetic Polynucleotide
taatacgactcactatagggcagcattttccagcgcttgcccagcctcttaacagaggagaaagaggatgggcaagcgcaacctggcggcagcgcaaaagatg

SEQ ID NO: 206182 - DNA, 103 bp, Artificial Sequence
  Synthetic Polynucleotide
taatacgactcactatagggcgctgtccttcagcattttccagcgcttgcaacagaggagagcaagcatgggaaaatgcaacctggcggcagcgcaaaagatg

SEQ ID NO: 206183 - DNA, 103 bp, Artificial Sequence
  Synthetic Polynucleotide
taatacgactcactataggggggatcttctcgctgtccttcagcattttcaacagaggagagaaaatatggaaggacagaacctggcggcagcgcaaaagatg

SEQ ID NO: 206184 - DNA, 103 bp, Artificial Sequence
  Synthetic Polynucleotide
taatacgactcactatagggccggatgaacgggatcttctcgctgtccttaacagaggagaaaggacatggagaagatcaacctggcggcagcgcaaaagatg

SEQ ID NO: 206185 - DNA, 103 bp, Artificial Sequence
  Synthetic Polynucleotide
taatacgactcactataggggctccgcctcccggatgaacgggatcttctaacagaggagaagaagaatgcgttcatccaacctggcggcagcgcaaaagatg

SEQ ID NO: 206186 - DNA, 103 bp, Artificial Sequence
  Synthetic Polynucleotide
taatacgactcactatagggtcccggggcaggttgctctccgcttccaagaacagaggagacttggaatgggagagcaaaacctggcggcagcgcaaaagatg

SEQ ID NO: 206187 - DNA, 103 bp, Artificial Sequence
  Synthetic Polynucleotide
taatacgactcactatagggagccgcagccgctccgcctcccggatgaacaacagaggagagttcatatgggaggcggaaacctggcggcagcgcaaaagatg

SEQ ID NO: 206188 - DNA, 103 bp, Artificial Sequence
  Synthetic Polynucleotide
taatacgactcactatagggcatgtgcttgagccgcagccgctccgcctcaacagaggagagaggcgatgcggctgcggaacctggcggcagcgcaaaagatg

SEQ ID NO: 206189 - DNA, 103 bp, Artificial Sequence
  Synthetic Polynucleotide
taatacgactcactatagggggtagtcggccatgtgcttgagccgcagccaacagaggagaggctgcatgtcaagcacaaacctggcggcagcgcaaaagatg

SEQ ID NO: 206190 - DNA, 103 bp, Artificial Sequence
  Synthetic Polynucleotide
taatacgactcactatagggttgtagtcggggtagtcggccatgtgcttgaacagaggagacaagcaatgggccgactaaacctggcggcagcgcaaaagatg

SEQ ID NO: 206191 - DNA, 103 bp, Artificial Sequence
  Synthetic Polynucleotide
taatacgactcactataggggggccggtacttgtagtcggggtagtcggcaacagaggagagccgacatgcccgactacaacctggcggcagcgcaaaagatg

SEQ ID NO: 206192 - DNA, 103 bp, Artificial Sequence
  Synthetic Polynucleotide
taatacgactcactataggggctttttccggggccggtacttgtagtcggaacagaggagaccgactatgagtaccggcaacctggcggcagcgcaaaagatg

SEQ ID NO: 206193 - DNA, 103 bp, Artificial Sequence
  Synthetic Polynucleotide
taatacgactcactatagggtccattttgggctttttccggggccggtacaacagaggagagtaccgatgccggaaaaaaacctggcggcagcgcaaaagatg

SEQ ID NO: 206194 - DNA, 103 bp, Artificial Sequence
  Synthetic Polynucleotide
taatacgactcactatagggggccgaggggtccattttgggctttttccgaacagaggagacggaaaatgcccaaaatgaacctggcggcagcgcaaaagatg

SEQ ID NO: 206195 - DNA, 103 bp, Artificial Sequence
  Synthetic Polynucleotide
taatacgactcactatagggcgctgggcttggccgaggggtccattttggaacagaggagaccaaaaatgacccctcggaacctggcggcagcgcaaaagatg

SEQ ID NO: 206196 - DNA, 103 bp, Artificial Sequence
  Synthetic Polynucleotide
taatacgactcactatagggctctggctggcgctgggcttggccgaggggaacagaggagacccctcatgcaagcccagaacctggcggcagcgcaaaagatg

SEQ ID NO: 206197 - DNA, 103 bp, Artificial Sequence
  Synthetic Polynucleotide
taatacgactcactataggggtccagcgcctcccggggcaggttgctctcaacagaggagagagagcatgctgccccggaacctggcggcagcgcaaaagatg

SEQ ID NO: 206198 - DNA, 103 bp, Artificial Sequence
  Synthetic Polynucleotide
taatacgactcactatagggcttctctgggctctggctggcgctgggcttaacagaggagaaagcccatggccagccagaacctggcggcagcgcaaaagatg

SEQ ID NO: 206199 - DNA, 103 bp, Artificial Sequence
  Synthetic Polynucleotide
taatacgactcactatagggcggccgcgctcttctctgggctctggctggaacagaggagaccagccatggcccagagaaacctggcggcagcgcaaaagatg

SEQ ID NO: 206200 - DNA, 103 bp, Artificial Sequence
  Synthetic Polynucleotide
taatacgactcactatagggccgccgccgccggccgcgctcttctctgggaacagaggagacccagaatggagcgcggcaacctggcggcagcgcaaaagatg

SEQ ID NO: 206201 - DNA, 103 bp, Artificial Sequence
  Synthetic Polynucleotide
taatacgactcactatagggcgcgctcccgccgccgccgccggccgcgctaacagaggagaagcgcgatgggcggcggcaacctggcggcagcgcaaaagatg

SEQ ID NO: 206202 - DNA, 103 bp, Artificial Sequence
  Synthetic Polynucleotide
taatacgactcactatagggcgcctccgcccgcgctcccgccgccgccgcaacagaggagagcggcgatggcgggagcgaacctggcggcagcgcaaaagatg

SEQ ID NO: 206203 - DNA, 103 bp, Artificial Sequence
  Synthetic Polynucleotide
taatacgactcactataggggcaccgcccgcgcctccgcccgcgctcccgaacagaggagacgggagatggggcggaggaacctggcggcagcgcaaaagatg

SEQ ID NO: 206204 - DNA, 103 bp, Artificial Sequence
  Synthetic Polynucleotide
taatacgactcactatagggggaggtcttggcaccgcccgcgcctccgccaacagaggagaggcggaatggcgggcggtaacctggcggcagcgcaaaagatg

SEQ ID NO: 206205 - DNA, 103 bp, Artificial Sequence
  Synthetic Polynucleotide
taatacgactcactatagggtggagcccttggaggtcttggcaccgcccgaacagaggagacgggcgatgccaagacctaacctggcggcagcgcaaaagatg

SEQ ID NO: 206206 - DNA, 103 bp, Artificial Sequence
  Synthetic Polynucleotide
taatacgactcactatagggcatttcttgctggagcccttggaggtcttgaacagaggagacaagacatgcaagggctcaacctggcggcagcgcaaaagatg

SEQ ID NO: 206207 - DNA, 103 bp, Artificial Sequence
  Synthetic Polynucleotide
taatacgactcactataggggagcttgccgcatttcttgctggagcccttaacagaggagaaagggcatgagcaagaaaaacctggcggcagcgcaaaagatg

SEQ ID NO: 206208 - DNA, 103 bp, Artificial Sequence
  Synthetic Polynucleotide
taatacgactcactatagggcctcctccgtgtccagcgcctcccggggcaaacagaggagatgccccatgaggcgctggaacctggcggcagcgcaaaagatg

SEQ ID NO: 206209 - DNA, 103 bp, Artificial Sequence
  Synthetic Polynucleotide
taatacgactcactatagggcgggggccttgagcttgccgcatttcttgcaacagaggagagcaagaatggcggcaagcaacctggcggcagcgcaaaagatg

SEQ ID NO: 206210 - DNA, 103 bp, Artificial Sequence
  Synthetic Polynucleotide
taatacgactcactatagggcccgcggccgcgggggccttgagcttgccgaacagaggagacggcaaatgcaaggccccaacctggcggcagcgcaaaagatg

SEQ ID NO: 206211 - DNA, 103 bp, Artificial Sequence
  Synthetic Polynucleotide
taatacgactcactatagggcgccttggcgcccgcggccgcgggggccttaacagaggagaaaggccatggcggccgcgaacctggcggcagcgcaaaagatg

SEQ ID NO: 206212 - DNA, 103 bp, Artificial Sequence
  Synthetic Polynucleotide
taatacgactcactatagggtgcccgcgcccgccttggcgcccgcggccgaacagaggagacggccgatggcgccaaggaacctggcggcagcgcaaaagatg

SEQ ID NO: 206213 - DNA, 103 bp, Artificial Sequence
  Synthetic Polynucleotide
taatacgactcactatagggtgggccgccttgcccgcgcccgccttggcgaacagaggagacgccaaatggggcgcgggaacctggcggcagcgcaaaagatg

SEQ ID NO: 206214 - DNA, 103 bp, Artificial Sequence
  Synthetic Polynucleotide
taatacgactcactataggggtccccggactgggccgccttgcccgcgccaacagaggagaggcgcgatgaaggcggccaacctggcggcagcgcaaaagatg

SEQ ID NO: 206215 - DNA, 103 bp, Artificial Sequence
  Synthetic Polynucleotide
taatacgactcactatagggcgcccccgtagtccccggactgggccgcctaacagaggagaaggcggatgagtccggggaacctggcggcagcgcaaaagatg

SEQ ID NO: 206216 - DNA, 103 bp, Artificial Sequence
  Synthetic Polynucleotide
taatacgactcactatagggtcgtcgcccgcgcccccgtagtccccggacaacagaggagagtccggatgctacgggggaacctggcggcagcgcaaaagatg

SEQ ID NO: 206217 - DNA, 103 bp, Artificial Sequence
  Synthetic Polynucleotide
taatacgactcactatagggcagcacgtagtcgtcgcccgcgcccccgtaaacagaggagatacgggatggcgggcgacaacctggcggcagcgcaaaagatg

SEQ ID NO: 206218 - DNA, 103 bp, Artificial Sequence
  Synthetic Polynucleotide
taatacgactcactataggggcaggctgcccagcacgtagtcgtcgcccgaacagaggagacgggcgatgactacgtgcaacctggcggcagcgcaaaagatg

SEQ ID NO: 206219 - DNA, 103 bp, Artificial Sequence
  Synthetic Polynucleotide
taatacgactcactatagggatgaattcgccctcctccgtgtccagcgccaacagaggagaggcgctatgcacggaggaaacctggcggcagcgcaaaagatg

SEQ ID NO: 206220 - DNA, 103 bp, Artificial Sequence
  Synthetic Polynucleotide
taatacgactcactatagggccgctcacgcgcaggctgcccagcacgtagaacagaggagactacgtatggggcagcctaacctggcggcagcgcaaaagatg

SEQ ID NO: 206221 - DNA, 103 bp, Artificial Sequence
  Synthetic Polynucleotide
taatacgactcactataggggccgcccgagccgctcacgcgcaggctgccaacagaggagaggcagcatgcgcgtgagcaacctggcggcagcgcaaaagatg

SEQ ID NO: 206222 - DNA, 103 bp, Artificial Sequence
  Synthetic Polynucleotide
taatacgactcactatagggccgcgccgccgccgcccgagccgctcacgcaacagaggagagcgtgaatggctcgggcgaacctggcggcagcgcaaaagatg

SEQ ID NO: 206223 - DNA, 103 bp, Artificial Sequence
  Synthetic Polynucleotide
taatacgactcactatagggaccgtcttgcccgcgccgccgccgcccgagaacagaggagactcgggatgcggcggcgcaacctggcggcagcgcaaaagatg

SEQ ID NO: 206224 - DNA, 103 bp, Artificial Sequence
  Synthetic Polynucleotide
taatacgactcactatagggcacgcacttgaccgtcttgcccgcgccgccaacagaggagaggcggcatgggcaagacgaacctggcggcagcgcaaaagatg

SEQ ID NO: 206225 - DNA, 103 bp, Artificial Sequence
  Synthetic Polynucleotide
taatacgactcactatagggcatccagaaacacgcacttgaccgtcttgcaacagaggagagcaagaatgtcaagtgcgaacctggcggcagcgcaaaagatg

SEQ ID NO: 206226 - DNA, 103 bp, Artificial Sequence
  Synthetic Polynucleotide
taatacgactcactatagggtcgtcgtcctcatccagaaacacgcacttgaacagaggagacaagtgatggtttctggaaacctggcggcagcgcaaaagatg

SEQ ID NO: 206227 - DNA, 103 bp, Artificial Sequence
  Synthetic Polynucleotide
taatacgactcactataggggtcgtcgtcgtcgtcgtcctcatccagaaaaacagaggagatttctgatggaggacgacaacctggcggcagcgcaaaagatg

SEQ ID NO: 206228 - DNA, 103 bp, Artificial Sequence
  Synthetic Polynucleotide
taatacgactcactatagggcgtcgtcgtcgtcgtcgtcgtcgtcgtcctaacagaggagaaggacgatgacgacgacgaacctggcggcagcgcaaaagatg

SEQ ID NO: 206229 - DNA, 103 bp, Artificial Sequence
  Synthetic Polynucleotide
taatacgactcactatagggagctgcagctcgtcgtcgtcgtcgtcgtcgaacagaggagacgacgaatgcgacgacgaaacctggcggcagcgcaaaagatg

SEQ ID NO: 206230 - DNA, 103 bp, Artificial Sequence
  Synthetic Polynucleotide
taatacgactcactataggggctgcaagccatgaattcgccctcctccgtaacagaggagaacggagatgggcgaattcaacctggcggcagcgcaaaagatg

SEQ ID NO: 206231 - DNA, 103 bp, Artificial Sequence
  Synthetic Polynucleotide
taatacgactcactatagggtttgatctgcagctgcagctcgtcgtcgtcaacagaggagagacgacatggagctgcagaacctggcggcagcgcaaaagatg

SEQ ID NO: 206232 - DNA, 103 bp, Artificial Sequence
  Synthetic Polynucleotide
taatacgactcactatagggccggctcctgtttgatctgcagctgcagctaacagaggagaagctgcatgtgcagatcaaacctggcggcagcgcaaaagatg

SEQ ID NO: 206233 - DNA, 103 bp, Artificial Sequence
  Synthetic Polynucleotide
taatacgactcactatagggtcctcctcgtccggctcctgtttgatctgcaacagaggagagcagatatgacaggagccaacctggcggcagcgcaaaagatg

SEQ ID NO: 206234 - DNA, 103 bp, Artificial Sequence
  Synthetic Polynucleotide
taatacgactcactatagggtggttcctcgtcctcctcgtccggctcctgaacagaggagacaggagatggacgaggagaacctggcggcagcgcaaaagatg

SEQ ID NO: 206235 - DNA, 103 bp, Artificial Sequence
  Synthetic Polynucleotide
taatacgactcactataggggctggtgcggtggttcctcgtcctcctcgtaacagaggagaacgaggatgacgaggaacaacctggcggcagcgcaaaagatg

SEQ ID NO: 206236 - DNA, 103 bp, Artificial Sequence
  Synthetic Polynucleotide
taatacgactcactatagggtgcaggagctgctggtgcggtggttcctcgaacagaggagacgaggaatgaccgcaccaaacctggcggcagcgcaaaagatg

SEQ ID NO: 206237 - DNA, 103 bp, Artificial Sequence
  Synthetic Polynucleotide
taatacgactcactatagggccccggcggctgcaggagctgctggtgcggaacagaggagaccgcacatgcagctcctgaacctggcggcagcgcaaaagatg

SEQ ID NO: 206238 - DNA, 103 bp, Artificial Sequence
  Synthetic Polynucleotide
taatacgactcactatagggacggctgctgccccggcggctgcaggagctaacagaggagaagctccatgagccgccggaacctggcggcagcgcaaaagatg

SEQ ID NO: 206239 - DNA, 103 bp, Artificial Sequence
  Synthetic Polynucleotide
taatacgactcactatagggagcagctgcgacggctgctgccccggcggcaacagaggagagccgccatggcagcagccaacctggcggcagcgcaaaagatg

SEQ ID NO: 206240 - DNA, 103 bp, Artificial Sequence
  Synthetic Polynucleotide
taatacgactcactataggggtagcgtctcagcagctgcgacggctgctgaacagaggagacagcagatgtcgcagctgaacctggcggcagcgcaaaagatg

SEQ ID NO: 206241 - DNA, 103 bp, Artificial Sequence
  Synthetic Polynucleotide
taatacgactcactataggggggccaccgggctgcaagccatgaattcgcaacagaggagagcgaatatgtggcttgcaaacctggcggcagcgcaaaagatg

SEQ ID NO: 206242 - DNA, 103 bp, Artificial Sequence
  Synthetic Polynucleotide
taatacgactcactatagggtggcgacgttgtagcgtctcagcagctgcgaacagaggagacgcagcatgtgagacgctaacctggcggcagcgcaaaagatg

SEQ ID NO: 206243 - DNA, 103 bp, Artificial Sequence
  Synthetic Polynucleotide
taatacgactcactataggggcgggcactttggcgacgttgtagcgtctcaacagaggagagagacgatgcaacgtcgcaacctggcggcagcgcaaaagatg

SEQ ID NO: 206244 - DNA, 103 bp, Artificial Sequence
  Synthetic Polynucleotide
taatacgactcactatagggcgtagggctggcgggcactttggcgacgttaacagaggagaaacgtcatgaaagtgcccaacctggcggcagcgcaaaagatg

SEQ ID NO: 206245 - DNA, 103 bp, Artificial Sequence
  Synthetic Polynucleotide
taatacgactcactatagggagctgctcagcgtagggctggcgggcacttaacagaggagaaagtgcatgccagccctaaacctggcggcagcgcaaaagatg

SEQ ID NO: 206246 - DNA, 103 bp, Artificial Sequence
  Synthetic Polynucleotide
taatacgactcactataggggactccgccgagctgctcagcgtagggctgaacagaggagacagcccatggctgagcagaacctggcggcagcgcaaaagatg

SEQ ID NO: 206247 - DNA, 103 bp, Artificial Sequence
  Synthetic Polynucleotide
taatacgactcactatagggtccctcgggggactccgccgagctgctcagaacagaggagactgagcatgtcggcggagaacctggcggcagcgcaaaagatg

SEQ ID NO: 206248 - DNA, 103 bp, Artificial Sequence
  Synthetic Polynucleotide
taatacgactcactatagggagaggctcgctccctcgggggactccgccgaacagaggagacggcggatgcccccgaggaacctggcggcagcgcaaaagatg

SEQ ID NO: 206249 - DNA, 103 bp, Artificial Sequence
  Synthetic Polynucleotide
taatacgactcactatagggacctcgtcgtagaggctcgctccctcggggaacagaggagaccccgaatgagcgagcctaacctggcggcagcgcaaaagatg

SEQ ID NO: 206250 - DNA, 103 bp, Artificial Sequence
  Synthetic Polynucleotide
taatacgactcactataggggccggcccgcacctcgtcgtagaggctcgcaacagaggagagcgagcatgtacgacgagaacctggcggcagcgcaaaagatg

SEQ ID NO: 206251 - DNA, 103 bp, Artificial Sequence
  Synthetic Polynucleotide
taatacgactcactatagggccgaggtcgcgccggcccgcacctcgtcgtaacagaggagaacgacgatgtgcgggccgaacctggcggcagcgcaaaagatg

SEQ ID NO: 206252 - DNA, 103 bp, Artificial Sequence
  Synthetic Polynucleotide
taatacgactcactatagggctctcgtccagggccaccgggctgcaagccaacagaggagaggcttgatgcccggtggcaacctggcggcagcgcaaaagatg

SEQ ID NO: 206253 - DNA, 103 bp, Artificial Sequence
  Synthetic Polynucleotide
taatacgactcactatagggcccccggcgcccgaggtcgcgccggcccgcaacagaggagagcgggcatgcgcgacctcaacctggcggcagcgcaaaagatg

SEQ ID NO: 206254 - DNA, 103 bp, Artificial Sequence
  Synthetic Polynucleotide
taatacgactcactataggggcggctgccgcccccggcgcccgaggtcgcaacagaggagagcgaccatgggcgccgggaacctggcggcagcgcaaaagatg

SEQ ID NO: 206255 - DNA, 103 bp, Artificial Sequence
  Synthetic Polynucleotide
taatacgactcactatagggtgtagtagaggcggctgccgcccccggcgcaacagaggagagcgccgatggcggcagccaacctggcggcagcgcaaaagatg

SEQ ID NO: 206256 - DNA, 103 bp, Artificial Sequence
  Synthetic Polynucleotide
taatacgactcactatagggttcttgaagctgtagtagaggcggctgccgaacagaggagacggcagatgcctctactaaacctggcggcagcgcaaaagatg

SEQ ID NO: 206257 - DNA, 103 bp, Artificial Sequence
  Synthetic Polynucleotide
taatacgactcactatagggcttggtgatgttcttgaagctgtagtagagaacagaggagactctacatgagcttcaagaacctggcggcagcgcaaaagatg

SEQ ID NO: 206258 - DNA, 103 bp, Artificial Sequence
  Synthetic Polynucleotide
taatacgactcactataggggcgggtgctgcttggtgatgttcttgaagcaacagaggagagcttcaatgacatcaccaaacctggcggcagcgcaaaagatg

SEQ ID NO: 206259 - DNA, 103 bp, Artificial Sequence
  Synthetic Polynucleotide
taatacgactcactataggggcgagcggcggcgggtgctgcttggtgatgaacagaggagacatcacatggcagcacccaacctggcggcagcgcaaaagatg

SEQ ID NO: 206260 - DNA, 103 bp, Artificial Sequence
  Synthetic Polynucleotide
taatacgactcactatagggcgcgggctgcgcgagcggcggcgggtgctgaacagaggagacagcacatgccgccgctcaacctggcggcagcgcaaaagatg

SEQ ID NO: 206261 - DNA, 103 bp, Artificial Sequence
  Synthetic Polynucleotide
taatacgactcactatagggcgggcgacagcgcgggctgcgcgagcggcgaacagaggagacgccgcatgcgcagcccgaacctggcggcagcgcaaaagatg

SEQ ID NO: 206262 - DNA, 103 bp, Artificial Sequence
  Synthetic Polynucleotide
taatacgactcactatagggcgcgaggacgcgggcgacagcgcgggctgcaacagaggagagcagccatggctgtcgccaacctggcggcagcgcaaaagatg

SEQ ID NO: 206263 - DNA, 103 bp, Artificial Sequence
  Synthetic Polynucleotide
taatacgactcactatagggcttggccctcgcgccccgctgctgcaccataacagaggagaatggtgatgcagcggggcaacctggcggcagcgcaaaagatg

SEQ ID NO: 206264 - DNA, 103 bp, Artificial Sequence
  Synthetic Polynucleotide
taatacgactcactataggggatgtggccgctcggggtcttgcaccagccaacagaggagaggctggatgaagaccccgaacctggcggcagcgcaaaagatg

SEQ ID NO: 206265 - DNA, 103 bp, Artificial Sequence
  Synthetic Polynucleotide
taatacgactcactatagggtcggcctcttgatgtggccgctcggggtctaacagaggagaagacccatggcggccacaaacctggcggcagcgcaaaagatg

SEQ ID NO: 206266 - DNA, 103 bp, Artificial Sequence
  Synthetic Polynucleotide
taatacgactcactatagggaatgcgttcatcggcctcttgatgtggccgaacagaggagacggccaatgcaagaggccaacctggcggcagcgcaaaagatg

SEQ ID NO: 206267 - DNA, 103 bp, Artificial Sequence
  Synthetic Polynucleotide
taatacgactcactatagggccacaccatgaatgcgttcatcggcctcttaacagaggagaaagaggatgatgaacgcaaacctggcggcagcgcaaaagatg

SEQ ID NO: 206268 - DNA, 103 bp, Artificial Sequence
  Synthetic Polynucleotide
taatacgactcactatagggcgtgctgcgaccacaccatgaatgcgttcaaacagaggagatgaacgatgtcatggtgtaacctggcggcagcgcaaaagatg

SEQ ID NO: 206269 - DNA, 103 bp, Artificial Sequence
  Synthetic Polynucleotide
taatacgactcactatagggttccgccgttcgtgctgcgaccacaccatgaacagaggagacatggtatggtcgcagcaaacctggcggcagcgcaaaagatg

SEQ ID NO: 206270 - DNA, 103 bp, Artificial Sequence
  Synthetic Polynucleotide
taatacgactcactataggggtccatgatcttccgccgttcgtgctgcgaaacagaggagatcgcagatggaacggcggaacctggcggcagcgcaaaagatg

SEQ ID NO: 206271 - DNA, 103 bp, Artificial Sequence
  Synthetic Polynucleotide
taatacgactcactatagggcgggccactggtccatgatcttccgccgttaacagaggagaaacggcatgagatcatggaacctggcggcagcgcaaaagatg

SEQ ID NO: 206272 - DNA, 103 bp, Artificial Sequence
  Synthetic Polynucleotide
taatacgactcactatagggttgtgcatgtcgggccactggtccatgatcaacagaggagagatcatatgccagtggccaacctggcggcagcgcaaaagatg

SEQ ID NO: 206273 - DNA, 103 bp, Artificial Sequence
  Synthetic Polynucleotide
taatacgactcactataggggatctcggcgttgtgcatgtcgggccactgaacagaggagacagtggatggacatgcacaacctggcggcagcgcaaaagatg

SEQ ID NO: 206274 - DNA, 103 bp, Artificial Sequence
  Synthetic Polynucleotide
taatacgactcactatagggcgccgtcccgcttggccctcgcgccccgctaacagaggagaagcgggatgcgagggccaaacctggcggcagcgcaaaagatg

SEQ ID NO: 206275 - DNA, 103 bp, Artificial Sequence
  Synthetic Polynucleotide
taatacgactcactatagggggcgcttggagatctcggcgttgtgcatgtaacagaggagaacatgcatgacgccgagaaacctggcggcagcgcaaaagatg

SEQ ID NO: 206276 - DNA, 103 bp, Artificial Sequence
  Synthetic Polynucleotide
taatacgactcactatagggcggcggcccaggcgcttggagatctcggcgaacagaggagacgccgaatgctccaagcgaacctggcggcagcgcaaaagatg

SEQ ID NO: 206277 - DNA, 103 bp, Artificial Sequence
  Synthetic Polynucleotide
taatacgactcactatagggcagctgccagcggcggcccaggcgcttggaaacagaggagatccaagatgctgggccgcaacctggcggcagcgcaaaagatg

SEQ ID NO: 206278 - DNA, 103 bp, Artificial Sequence
  Synthetic Polynucleotide
taatacgactcactatagggagtcctgcagcagctgccagcggcggcccaaacagaggagatgggccatggctggcagcaacctggcggcagcgcaaaagatg

SEQ ID NO: 206279 - DNA, 103 bp, Artificial Sequence
  Synthetic Polynucleotide
taatacgactcactatagggatcttctccgagtcctgcagcagctgccagaacagaggagactggcaatggctgcaggaaacctggcggcagcgcaaaagatg

SEQ ID NO: 206280 - DNA, 103 bp, Artificial Sequence
  Synthetic Polynucleotide
taatacgactcactatagggcacgaacgggatcttctccgagtcctgcagaacagaggagactgcagatgtcggagaagaacctggcggcagcgcaaaagatg

SEQ ID NO: 206281 - DNA, 103 bp, Artificial Sequence
  Synthetic Polynucleotide
taatacgactcactatagggccgcctcccgcacgaacgggatcttctccgaacagaggagacggagaatgtcccgttcgaacctggcggcagcgcaaaagatg

SEQ ID NO: 206282 - DNA, 103 bp, Artificial Sequence
  Synthetic Polynucleotide
taatacgactcactatagggcgcagccgctccgcctcccgcacgaacgggaacagaggagacccgttatggcgggaggcaacctggcggcagcgcaaaagatg

SEQ ID NO: 206283 - DNA, 103 bp, Artificial Sequence
  Synthetic Polynucleotide
taatacgactcactataggggtgcttgagccgcagccgctccgcctcccgaacagaggagacgggagatggagcggctgaacctggcggcagcgcaaaagatg

SEQ ID NO: 206284 - DNA, 103 bp, Artificial Sequence
  Synthetic Polynucleotide
taatacgactcactatagggaatccgccatgtgcttgagccgcagccgctaacagaggagaagcggcatgggctcaagcaacctggcggcagcgcaaaagatg

SEQ ID NO: 206285 - DNA, 103 bp, Artificial Sequence
  Synthetic Polynucleotide
taatacgactcactatagggggcggcggcccgccgtcccgcttggccctcaacagaggagagagggcatggcgggacggaacctggcggcagcgcaaaagatg

SEQ ID NO: 206286 - DNA, 103 bp, Artificial Sequence
  Synthetic Polynucleotide
taatacgactcactatagggtagtccgggtaatccgccatgtgcttgagcaacagaggagagctcaaatgcatggcggaaacctggcggcagcgcaaaagatg

SEQ ID NO: 206287 - DNA, 103 bp, Artificial Sequence
  Synthetic Polynucleotide
taatacgactcactatagggccggtacttgtagtccgggtaatccgccataacagaggagaatggcgatgtacccggacaacctggcggcagcgcaaaagatg

SEQ ID NO: 206288 - DNA, 103 bp, Artificial Sequence
  Synthetic Polynucleotide
taatacgactcactatagggttttgcgcggccggtacttgtagtccgggtaacagaggagaacccggatgacaagtaccaacctggcggcagcgcaaaagatg

SEQ ID NO: 206289 - DNA, 103 bp, Artificial Sequence
  Synthetic Polynucleotide
taatacgactcactatagggcccttgctctttttgcgcggccggtacttgaacagaggagacaagtaatggccgcgcaaaacctggcggcagcgcaaaagatg

SEQ ID NO: 206290 - DNA, 103 bp, Artificial Sequence
  Synthetic Polynucleotide
taatacgactcactatagggggcgggcgcccccttgctctttttgcgcggaacagaggagaccgcgcatgaagagcaagaacctggcggcagcgcaaaagatg

SEQ ID NO: 206291 - DNA, 103 bp, Artificial Sequence
  Synthetic Polynucleotide
taatacgactcactataggggccgcgccttggcgggcgcccccttgctctaacagaggagaagagcaatggggcgcccgaacctggcggcagcgcaaaagatg

SEQ ID NO: 206292 - DNA, 103 bp, Artificial Sequence
  Synthetic Polynucleotide
taatacgactcactatagggggggggcggggccgcgccttggcgggcgccaacagaggagaggcgccatgcaaggcgcgaacctggcggcagcgcaaaagatg

SEQ ID NO: 206293 - DNA, 103 bp, Artificial Sequence
  Synthetic Polynucleotide
taatacgactcactataggggctaccaccgggggggcggggccgcgccttaacagaggagaaaggcgatgccccgccccaacctggcggcagcgcaaaagatg

SEQ ID NO: 206294 - DNA, 103 bp, Artificial Sequence
  Synthetic Polynucleotide
taatacgactcactatagggtgccgccaccgctaccaccgggggggcgggaacagaggagacccgccatgccggtggtaaacctggcggcagcgcaaaagatg

SEQ ID NO: 206295 - DNA, 103 bp, Artificial Sequence
  Synthetic Polynucleotide
taatacgactcactatagggttgagccggctgccgccaccgctaccaccgaacagaggagacggtggatgcggtggcggaacctggcggcagcgcaaaagatg

SEQ ID NO: 206296 - DNA, 103 bp, Artificial Sequence
  Synthetic Polynucleotide
taatacgactcactataggggggtcccgggggcggcggcccgccgtcccgaacagaggagacgggacatggggccgccgaacctggcggcagcgcaaaagatg

SEQ ID NO: 206297 - DNA, 103 bp, Artificial Sequence
  Synthetic Polynucleotide
taatacgactcactatagggcggcccgggcttgagccggctgccgccaccaacagaggagaggtggcatgagccggctcaacctggcggcagcgcaaaagatg

SEQ ID NO: 206298 - DNA, 103 bp, Artificial Sequence
  Synthetic Polynucleotide
taatacgactcactatagggcaggcagctgcggcccgggcttgagccggcaacagaggagagccggcatgagcccgggcaacctggcggcagcgcaaaagatg

SEQ ID NO: 206299 - DNA, 103 bp, Artificial Sequence
  Synthetic Polynucleotide
taatacgactcactatagggcccccgcggccaggcagctgcggcccgggcaacagaggagagcccggatggcagctgccaacctggcggcagcgcaaaagatg

SEQ ID NO: 206300 - DNA, 103 bp, Artificial Sequence
  Synthetic Polynucleotide
taatacgactcactatagggtgctcggcggcccccgcggccaggcagctgaacagaggagacagctgatgggccgcgggaacctggcggcagcgcaaaagatg

SEQ ID NO: 206301 - DNA, 103 bp, Artificial Sequence
  Synthetic Polynucleotide
taatacgactcactataggggccctcccgctgctcggcggcccccgcggcaacagaggagagccgcgatggccgccgagaacctggcggcagcgcaaaagatg

SEQ ID NO: 206302 - DNA, 103 bp, Artificial Sequence
  Synthetic Polynucleotide
taatacgactcactatagggccccccaaaggccctcccgctgctcggcggaacagaggagaccgccgatgagcgggaggaacctggcggcagcgcaaaagatg

SEQ ID NO: 206303 - DNA, 103 bp, Artificial Sequence
  Synthetic Polynucleotide
taatacgactcactatagggcgccgccccgccccccaaaggccctcccgcaacagaggagagcgggaatgcctttggggaacctggcggcagcgcaaaagatg

SEQ ID NO: 206304 - DNA, 103 bp, Artificial Sequence
  Synthetic Polynucleotide
taatacgactcactatagggcctcgggcgccgccgccccgccccccaaagaacagaggagactttggatggcggggcggaacctggcggcagcgcaaaagatg

SEQ ID NO: 206305 - DNA, 103 bp, Artificial Sequence
  Synthetic Polynucleotide
taatacgactcactatagggtcatcgtcgtcctcgggcgccgccgccccgaacagaggagacggggcatgggcgcccgaaacctggcggcagcgcaaaagatg

SEQ ID NO: 206306 - DNA, 103 bp, Artificial Sequence
  Synthetic Polynucleotide
taatacgactcactataggggtcgtcgtcttcatcgtcgtcctcgggcgcaacagaggagagcgcccatggacgacgataacctggcggcagcgcaaaagatg

SEQ ID NO: 206307 - DNA, 103 bp, Artificial Sequence
  Synthetic Polynucleotide
taatacgactcactatagggcggccggcccgggtcccgggggcggcggccaacagaggagaggccgcatgccccgggacaacctggcggcagcgcaaaagatg

SEQ ID NO: 206308 - DNA, 103 bp, Artificial Sequence
  Synthetic Polynucleotide
taatacgactcactataggggcagctcctcgtcgtcgtcttcatcgtcgtaacagaggagaacgacgatgaagacgacgaacctggcggcagcgcaaaagatg

SEQ ID NO: 206309 - DNA, 103 bp, Artificial Sequence
  Synthetic Polynucleotide
taatacgactcactatagggcgcacttccagcagctcctcgtcgtcgtctaacagaggagaagacgaatgcgaggagctaacctggcggcagcgcaaaagatg

SEQ ID NO: 206310 - DNA, 103 bp, Artificial Sequence
  Synthetic Polynucleotide
taatacgactcactatagggctcgaccaggcgcacttccagcagctcctcaacagaggagagaggagatgctggaagtgaacctggcggcagcgcaaaagatg

SEQ ID NO: 206311 - DNA, 103 bp, Artificial Sequence
  Synthetic Polynucleotide
taatacgactcactataggggccccggggtctcgaccaggcgcacttccaaacagaggagatggaagatggcctggtcgaacctggcggcagcgcaaaagatg

SEQ ID NO: 206312 - DNA, 103 bp, Artificial Sequence
  Synthetic Polynucleotide
taatacgactcactatagggcacagctcccgccccggggtctcgaccaggaacagaggagacctggtatggaccccgggaacctggcggcagcgcaaaagatg

SEQ ID NO: 206313 - DNA, 103 bp, Artificial Sequence
  Synthetic Polynucleotide
taatacgactcactataggggaccatcctccacagctcccgccccggggtaacagaggagaaccccgatgcgggagctgaacctggcggcagcgcaaaagatg

SEQ ID NO: 206314 - DNA, 103 bp, Artificial Sequence
  Synthetic Polynucleotide
taatacgactcactataggggtcccgccgggaccatcctccacagctcccaacagaggagagggagcatgggaggatggaacctggcggcagcgcaaaagatg

SEQ ID NO: 206315 - DNA, 103 bp, Artificial Sequence
  Synthetic Polynucleotide
taatacgactcactatagggcgagcggcccgtcccgccgggaccatcctcaacagaggagagaggatatgcccggcgggaacctggcggcagcgcaaaagatg

SEQ ID NO: 206316 - DNA, 103 bp, Artificial Sequence
  Synthetic Polynucleotide
taatacgactcactatagggcgcttgtccccgagcggcccgtcccgccggaacagaggagaccggcgatgcgggccgctaacctggcggcagcgcaaaagatg

SEQ ID NO: 206317 - DNA, 103 bp, Artificial Sequence
  Synthetic Polynucleotide
taatacgactcactataggggggcgcgctccgcttgtccccgagcggcccaacagaggagagggccgatgggggacaagaacctggcggcagcgcaaaagatg

SEQ ID NO: 206318 - DNA, 103 bp, Artificial Sequence
  Synthetic Polynucleotide
taatacgactcactataggggccccctcctcggccggcccgggtcccgggaacagaggagacccgggatgcgggccggcaacctggcggcagcgcaaaagatg

SEQ ID NO: 206319 - DNA, 103 bp, Artificial Sequence
  Synthetic Polynucleotide
taatacgactcactataggggacggcccttgggcgcgctccgcttgtcccaacagaggagagggacaatgggagcgcgcaacctggcggcagcgcaaaagatg

SEQ ID NO: 206320 - DNA, 103 bp, Artificial Sequence
  Synthetic Polynucleotide
taatacgactcactatagggcccctcgcccgacggcccttgggcgcgctcaacagaggagagagcgcatgcaagggccgaacctggcggcagcgcaaaagatg

SEQ ID NO: 206321 - DNA, 103 bp, Artificial Sequence
  Synthetic Polynucleotide
taatacgactcactatagggcggcggccgccccctcgcccgacggcccttaacagaggagaaagggcatgcgggcgaggaacctggcggcagcgcaaaagatg

SEQ ID NO: 206322 - DNA, 103 bp, Artificial Sequence
  Synthetic Polynucleotide
taatacgactcactataggggcggcggcggcggcggccgccccctcgcccaacagaggagagggcgaatgggcggccgcaacctggcggcagcgcaaaagatg

SEQ ID NO: 206323 - DNA, 103 bp, Artificial Sequence
  Synthetic Polynucleotide
taatacgactcactatagggtgtcggggaggcggcggcggcggcggccgcaacagaggagagcggccatggccgccgccaacctggcggcagcgcaaaagatg

SEQ ID NO: 206324 - DNA, 103 bp, Artificial Sequence
  Synthetic Polynucleotide
taatacgactcactatagggcctccgacggtgtcggggaggcggcggcggaacagaggagaccgccgatgcctccccgaaacctggcggcagcgcaaaagatg

SEQ ID NO: 206325 - DNA, 103 bp, Artificial Sequence
  Synthetic Polynucleotide
taatacgactcactatagggggctcctcgtcctccgacggtgtcggggagaacagaggagactccccatgaccgtcggaaacctggcggcagcgcaaaagatg

SEQ ID NO: 206326 - DNA, 103 bp, Artificial Sequence
  Synthetic Polynucleotide
taatacgactcactatagggctcttcctccggctcctcgtcctccgacggaacagaggagaccgtcgatggacgaggagaacctggcggcagcgcaaaagatg

SEQ ID NO: 206327 - DNA, 103 bp, Artificial Sequence
  Synthetic Polynucleotide
taatacgactcactatagggcctcctcctcctcttcctccggctcctcgtaacagaggagaacgaggatgcggaggaagaacctggcggcagcgcaaaagatg

SEQ ID NO: 206328 - DNA, 103 bp, Artificial Sequence
  Synthetic Polynucleotide
taatacgactcactataggggccgctgccgcctcctcctcctcttcctccaacagaggagaggaggaatgggaggaggaaacctggcggcagcgcaaaagatg

SEQ ID NO: 206329 - DNA, 103 bp, Artificial Sequence
  Synthetic Polynucleotide
taatacgactcactataggggggctcgcgcgccccctcctcggccggcccaacagaggagagggccgatggaggaggggaacctggcggcagcgcaaaagatg

SEQ ID NO: 206330 - DNA, 103 bp, Artificial Sequence
  Synthetic Polynucleotide
taatacgactcactatagggaccttcctcagccgctgccgcctcctcctcaacagaggagagaggagatggcggcagcgaacctggcggcagcgcaaaagatg

SEQ ID NO: 206331 - DNA, 103 bp, Artificial Sequence
  Synthetic Polynucleotide
taatacgactcactatagggtctcctcttcaccttcctcagccgctgccgaacagaggagacggcagatgctgaggaagaacctggcggcagcgcaaaagatg

SEQ ID NO: 206332 - DNA, 103 bp, Artificial Sequence
  Synthetic Polynucleotide
taatacgactcactataggggacgccaccgtctcctcttcaccttcctcaaacagaggagatgaggaatgtgaagaggaaacctggcggcagcgcaaaagatg

SEQ ID NO: 206333 - DNA, 103 bp, Artificial Sequence
  Synthetic Polynucleotide
taatacgactcactatagggctcctcccccgacgccaccgtctcctcttcaacagaggagagaagagatgacggtggcgaacctggcggcagcgcaaaagatg

SEQ ID NO: 206334 - DNA, 103 bp, Artificial Sequence
  Synthetic Polynucleotide
taatacgactcactatagggagcccagcgactcctcccccgacgccaccgaacagaggagacggtggatgcgggggaggaacctggcggcagcgcaaaagatg

SEQ ID NO: 206335 - DNA, 103 bp, Artificial Sequence
  Synthetic Polynucleotide
taatacgactcactatagggctggacagaaagcccagcgactcctcccccaacagaggagagggggaatggtcgctgggaacctggcggcagcgcaaaagatg

SEQ ID NO: 206336 - DNA, 103 bp, Artificial Sequence
  Synthetic Polynucleotide
taatacgactcactatagggagggggcagcctggacagaaagcccagcgaaacagaggagatcgctgatgtttctgtccaacctggcggcagcgcaaaagatg

SEQ ID NO: 206337 - DNA, 103 bp, Artificial Sequence
  Synthetic Polynucleotide
taatacgactcactatagggcggccgggccagggggcagcctggacagaaaacagaggagattctgtatgggctgccccaacctggcggcagcgcaaaagatg

SEQ ID NO: 206338 - DNA, 103 bp, Artificial Sequence
  Synthetic Polynucleotide
taatacgactcactatagggcagtccaggccggccgggccagggggcagcaacagaggagagctgccatgtggcccggcaacctggcggcagcgcaaaagatg

SEQ ID NO: 206339 - DNA, 103 bp, Artificial Sequence
  Synthetic Polynucleotide
taatacgactcactatagggcagggcgctgcagtccaggccggccgggccaacagaggagaggcccgatgggcctggacaacctggcggcagcgcaaaagatg

SEQ ID NO: 206340 - DNA, 103 bp, Artificial Sequence
  Synthetic Polynucleotide
taatacgactcactatagggtgcaccagccgggctcgcgcgccccctcctaacagaggagaaggaggatgcgcgcgagcaacctggcggcagcgcaaaagatg

SEQ ID NO: 206341 - DNA, 103 bp, Artificial Sequence
  Synthetic Polynucleotide
taatacgactcactatagggggtcgcgatccagggcgctgcagtccaggcaacagaggagagcctggatggcagcgcccaacctggcggcagcgcaaaagatg

SEQ ID NO: 206342 - DNA, 103 bp, Artificial Sequence
  Synthetic Polynucleotide
taatacgactcactatagggtgcaggtccgggtcgcgatccagggcgctgaacagaggagacagcgcatgggatcgcgaaacctggcggcagcgcaaaagatg

SEQ ID NO: 206343 - DNA, 103 bp, Artificial Sequence
  Synthetic Polynucleotide
taatacgactcactatagggcgagggaggctgcaggtccgggtcgcgatcaacagaggagagatcgcatgccggacctgaacctggcggcagcgcaaaagatg

SEQ ID NO: 206344 - DNA, 103 bp, Artificial Sequence
  Synthetic Polynucleotide
taatacgactcactataggggcgacgtgcccgagggaggctgcaggtccgaacagaggagacggaccatgagcctccctaacctggcggcagcgcaaaagatg

SEQ ID NO: 206345 - DNA, 103 bp, Artificial Sequence
  Synthetic Polynucleotide
taatacgactcactatagggaactcgaagtgcgacgtgcccgagggaggcaacagaggagagcctccatggggcacgtcaacctggcggcagcgcaaaagatg

SEQ ID NO: 206346 - DNA, 103 bp, Artificial Sequence
  Synthetic Polynucleotide
taatacgactcactataggggtagtccgggaactcgaagtgcgacgtgccaacagaggagaggcacgatgcacttcgagaacctggcggcagcgcaaaagatg

SEQ ID NO: 206347 - DNA, 103 bp, Artificial Sequence
  Synthetic Polynucleotide
taatacgactcactatagggcgggggtgcagtagtccgggaactcgaagtaacagaggagaacttcgatgtcccggactaacctggcggcagcgcaaaagatg

SEQ ID NO: 206348 - DNA, 103 bp, Artificial Sequence
  Synthetic Polynucleotide
taatacgactcactatagggtcggtaacctcgggggtgcagtagtccgggaacagaggagacccggaatgctgcaccccaacctggcggcagcgcaaaagatg

SEQ ID NO: 206349 - DNA, 103 bp, Artificial Sequence
  Synthetic Polynucleotide
taatacgactcactatagggcgcgatcatctcggtaacctcgggggtgcaaacagaggagatgcaccatggaggttaccaacctggcggcagcgcaaaagatg

SEQ ID NO: 206350 - DNA, 103 bp, Artificial Sequence
  Synthetic Polynucleotide
taatacgactcactataggggccagtcccccgcgatcatctcggtaacctaacagaggagaaggttaatgagatgatcgaacctggcggcagcgcaaaagatg

SEQ ID NO: 206351 - DNA, 103 bp, Artificial Sequence
  Synthetic Polynucleotide
taatacgactcactatagggctcggggtcttgcaccagccgggctcgcgcaacagaggagagcgcgaatgcggctggtgaacctggcggcagcgcaaaagatg

SEQ ID NO: 206352 - DNA, 103 bp, Artificial Sequence
  Synthetic Polynucleotide
taatacgactcactatagggctagacgggcgccagtcccccgcgatcatcaacagaggagagatgatatggggggactgaacctggcggcagcgcaaaagatg

SEQ ID NO: 206353 - DNA, 103 bp, Artificial Sequence
  Synthetic Polynucleotide
taatacgactcactataggggtctgcgatgctagacgggcgccagtccccaacagaggagaggggacatgcgcccgtctaacctggcggcagcgcaaaagatg

SEQ ID NO: 206354 - DNA, 103 bp, Artificial Sequence
  Synthetic Polynucleotide
taatacgactcactatagggtgaaaaccaggtctgcgatgctagacgggcaacagaggagagcccgtatggcatcgcagaacctggcggcagcgcaaaagatg

SEQ ID NO: 206355 - DNA, 103 bp, Artificial Sequence
  Synthetic Polynucleotide
taatacgactcactatagggctgggcagagatggggctcctcatggacataacagaggagaatgtccatgaggagccccaacctggcggcagcgcaaaagatg

SEQ ID NO: 206356 - DNA, 103 bp, Artificial Sequence
  Synthetic Polynucleotide
taatacgactcactatagggtgagccctggggggcctcgtggcaaggctcaacagaggagagagcctatgcacgaggccaacctggcggcagcgcaaaagatg

SEQ ID NO: 206357 - DNA, 103 bp, Artificial Sequence
  Synthetic Polynucleotide
taatacgactcactatagggaggcaggctcggggggctggactgcaggtcaacagaggagagacctgatgtccagccccaacctggcggcagcgcaaaagatg

SEQ ID NO: 206358 - DNA, 103 bp, Artificial Sequence
  Synthetic Polynucleotide
taatacgactcactatagggggaagcccagaggcaggctcggggggctggaacagaggagaccagccatgcgagcctgcaacctggcggcagcgcaaaagatg

SEQ ID NO: 206359 - DNA, 103 bp, Artificial Sequence
  Synthetic Polynucleotide
taatacgactcactatagggccttcaccaaggaagcccagaggcaggctcaacagaggagagagcctatgtctgggcttaacctggcggcagcgcaaaagatg

SEQ ID NO: 206360 - DNA, 103 bp, Artificial Sequence
  Synthetic Polynucleotide
taatacgactcactataggggacagcgtccccttcaccaaggaagcccagaacagaggagactgggcatgcttggtgaaaacctggcggcagcgcaaaagatg

SEQ ID NO: 206361 - DNA, 103 bp, Artificial Sequence
  Synthetic Polynucleotide
taatacgactcactatagggtggctttggtgacagcgtccccttcaccaaaacagaggagattggtgatggggacgctgaacctggcggcagcgcaaaagatg

SEQ ID NO: 206362 - DNA, 103 bp, Artificial Sequence
  Synthetic Polynucleotide
taatacgactcactataggggcatcctggatggctttggtgacagcgtccaacagaggagaggacgcatgcaccaaagcaacctggcggcagcgcaaaagatg

SEQ ID NO: 206363 - DNA, 103 bp, Artificial Sequence
  Synthetic Polynucleotide
taatacgactcactatagggcagctgccgagcatcctggatggctttggtaacagaggagaaccaaaatgatccaggataacctggcggcagcgcaaaagatg

SEQ ID NO: 206364 - DNA, 103 bp, Artificial Sequence
  Synthetic Polynucleotide
taatacgactcactatagggggctgtgcagcagctgccgagcatcctggaaacagaggagatccaggatgctcggcagcaacctggcggcagcgcaaaagatg

SEQ ID NO: 206365 - DNA, 103 bp, Artificial Sequence
  Synthetic Polynucleotide
taatacgactcactataggggccccactgtggctgtgcagcagctgccgaaacagaggagatcggcaatggctgcacagaacctggcggcagcgcaaaagatg

SEQ ID NO: 206366 - DNA, 103 bp, Artificial Sequence
  Synthetic Polynucleotide
taatacgactcactataggggccatccaaggccccactgtggctgtgcagaacagaggagactgcacatgcacagtgggaacctggcggcagcgcaaaagatg

SEQ ID NO: 206367 - DNA, 103 bp, Artificial Sequence
  Synthetic Polynucleotide
taatacgactcactatagggcggcagtggctgagccctggggggcctcgtaacagaggagaacgaggatgcccagggctaacctggcggcagcgcaaaagatg

SEQ ID NO: 206368 - DNA, 103 bp, Artificial Sequence
  Synthetic Polynucleotide
taatacgactcactatagggtgttgggggagccatccaaggccccactgtaacagaggagaacagtgatgccttggatgaacctggcggcagcgcaaaagatg

SEQ ID NO: 206369 - DNA, 103 bp, Artificial Sequence
  Synthetic Polynucleotide
taatacgactcactatagggcggaagggggtgttgggggagccatccaagaacagaggagacttggaatgctcccccaaaacctggcggcagcgcaaaagatg

SEQ ID NO: 206370 - DNA, 103 bp, Artificial Sequence
  Synthetic Polynucleotide
taatacgactcactataggggaggtccttacggaagggggtgttgggggaaacagaggagatcccccatgacccccttcaacctggcggcagcgcaaaagatg

SEQ ID NO: 206371 - DNA, 103 bp, Artificial Sequence
  Synthetic Polynucleotide
taatacgactcactatagggccaggctgatgaggtccttacggaagggggaacagaggagaccccctatggtaaggaccaacctggcggcagcgcaaaagatg

SEQ ID NO: 206372 - DNA, 103 bp, Artificial Sequence
  Synthetic Polynucleotide
taatacgactcactatagggggggatgagtccaggctgatgaggtccttaaacagaggagataaggaatgcatcagcctaacctggcggcagcgcaaaagatg

SEQ ID NO: 206373 - DNA, 103 bp, Artificial Sequence
  Synthetic Polynucleotide
taatacgactcactatagggctccttggctggggatgagtccaggctgataacagaggagaatcagcatggactcatccaacctggcggcagcgcaaaagatg

SEQ ID NO: 206374 - DNA, 103 bp, Artificial Sequence
  Synthetic Polynucleotide
taatacgactcactatagggcctccagccgctccttggctggggatgagtaacagaggagaactcatatgcagccaaggaacctggcggcagcgcaaaagatg

SEQ ID NO: 206375 - DNA, 103 bp, Artificial Sequence
  Synthetic Polynucleotide
taatacgactcactatagggacacagccgtcctccagccgctccttggctaacagaggagaagccaaatggcggctggaaacctggcggcagcgcaaaagatg

SEQ ID NO: 206376 - DNA, 103 bp, Artificial Sequence
  Synthetic Polynucleotide
taatacgactcactatagggcagtgggtgcacacagccgtcctccagccgaacagaggagacggctgatggacggctgtaacctggcggcagcgcaaaagatg

SEQ ID NO: 206377 - DNA, 103 bp, Artificial Sequence
  Synthetic Polynucleotide
taatacgactcactatagggtggcttcctccagtgggtgcacacagccgtaacagaggagaacggctatgtgcacccacaacctggcggcagcgcaaaagatg

SEQ ID NO: 206378 - DNA, 103 bp, Artificial Sequence
  Synthetic Polynucleotide
taatacgactcactatagggtgaggttcagcggcagtggctgagccctggaacagaggagaccagggatgagccactgcaacctggcggcagcgcaaaagatg

SEQ ID NO: 206379 - DNA, 103 bp, Artificial Sequence
  Synthetic Polynucleotide
taatacgactcactatagggcagctcagcatggcttcctccagtgggtgcaacagaggagagcacccatgggaggaagcaacctggcggcagcgcaaaagatg

SEQ ID NO: 206380 - DNA, 103 bp, Artificial Sequence
  Synthetic Polynucleotide
taatacgactcactatagggatccatgtcgcagctcagcatggcttcctcaacagaggagagaggaaatgatgctgagcaacctggcggcagcgcaaaagatg

SEQ ID NO: 206381 - DNA, 103 bp, Artificial Sequence
  Synthetic Polynucleotide
taatacgactcactatagggggcgggagccatccatgtcgcagctcagcaaacagaggagatgctgaatggcgacatggaacctggcggcagcgcaaaagatg

SEQ ID NO: 206382 - DNA, 103 bp, Artificial Sequence
  Synthetic Polynucleotide
taatacgactcactatagggtcggggaagtggcgggagccatccatgtcgaacagaggagacgacatatgtggctcccgaacctggcggcagcgcaaaagatg

SEQ ID NO: 206383 - DNA, 103 bp, Artificial Sequence
  Synthetic Polynucleotide
taatacgactcactataggggtttcgggactcggggaagtggcgggagccaacagaggagaggctccatgcacttccccaacctggcggcagcgcaaaagatg

SEQ ID NO: 206384 - DNA, 103 bp, Artificial Sequence
  Synthetic Polynucleotide
taatacgactcactatagggtgtggctgctgtttcgggactcggggaagtaacagaggagaacttccatgagtcccgaaaacctggcggcagcgcaaaagatg

SEQ ID NO: 206385 - DNA, 103 bp, Artificial Sequence
  Synthetic Polynucleotide
taatacgactcactatagggggcctcttgatgtggctgctgtttcgggacaacagaggagagtcccgatgcagcagccaaacctggcggcagcgcaaaagatg

SEQ ID NO: 206386 - DNA, 103 bp, Artificial Sequence
  Synthetic Polynucleotide
taatacgactcactatagggggcgttcatgggcctcttgatgtggctgctaacagaggagaagcagcatgatcaagaggaacctggcggcagcgcaaaagatg

SEQ ID NO: 206387 - DNA, 103 bp, Artificial Sequence
  Synthetic Polynucleotide
taatacgactcactatagggacaccatgaaggcgttcatgggcctcttgaaacagaggagatcaagaatgccatgaacgaacctggcggcagcgcaaaagatg

SEQ ID NO: 206388 - DNA, 103 bp, Artificial Sequence
  Synthetic Polynucleotide
taatacgactcactatagggtccttggcccacaccatgaaggcgttcatgaacagaggagacatgaaatgcttcatggtaacctggcggcagcgcaaaagatg

SEQ ID NO: 206389 - DNA, 103 bp, Artificial Sequence
  Synthetic Polynucleotide
taatacgactcactataggggtctccaggctgaggttcagcggcagtggcaacagaggagagccactatggctgaacctaacctggcggcagcgcaaaagatg

SEQ ID NO: 206390 - DNA, 103 bp, Artificial Sequence
  Synthetic Polynucleotide
taatacgactcactatagggcctccgctcatccttggcccacaccatgaaaacagaggagattcatgatgtgggccaagaacctggcggcagcgcaaaagatg

SEQ ID NO: 206391 - DNA, 103 bp, Artificial Sequence
  Synthetic Polynucleotide
taatacgactcactataggggcaggatcttcctccgctcatccttggcccaacagaggagagggccaatgatgagcggaaacctggcggcagcgcaaaagatg

SEQ ID NO: 206392 - DNA, 103 bp, Artificial Sequence
  Synthetic Polynucleotide
taatacgactcactataggggggaaggcttgcaggatcttcctccgctcaaacagaggagatgagcgatggaagatcctaacctggcggcagcgcaaaagatg

SEQ ID NO: 206393 - DNA, 103 bp, Artificial Sequence
  Synthetic Polynucleotide
taatacgactcactataggggtgcatgtctgggaaggcttgcaggatcttaacagaggagaaagatcatgcaagccttcaacctggcggcagcgcaaaagatg

SEQ ID NO: 206394 - DNA, 103 bp, Artificial Sequence
  Synthetic Polynucleotide
taatacgactcactatagggtgctggagttgtgcatgtctgggaaggcttaacagaggagaaagcctatgcagacatgcaacctggcggcagcgcaaaagatg

SEQ ID NO: 206395 - DNA, 103 bp, Artificial Sequence
  Synthetic Polynucleotide
taatacgactcactatagggatcttgctgatgctggagttgtgcatgtctaacagaggagaagacatatgcaactccagaacctggcggcagcgcaaaagatg

SEQ ID NO: 206396 - DNA, 103 bp, Artificial Sequence
  Synthetic Polynucleotide
taatacgactcactatagggagatccaaggatcttgctgatgctggagttaacagaggagaaactccatgatcagcaagaacctggcggcagcgcaaaagatg

SEQ ID NO: 206397 - DNA, 103 bp, Artificial Sequence
  Synthetic Polynucleotide
taatacgactcactatagggacttccagcgagatccaaggatcttgctgaaacagaggagatcagcaatgtccttggataacctggcggcagcgcaaaagatg

SEQ ID NO: 206398 - DNA, 103 bp, Artificial Sequence
  Synthetic Polynucleotide
taatacgactcactatagggttggtcatggacttccagcgagatccaaggaacagaggagaccttggatgtcgctggaaaacctggcggcagcgcaaaagatg

SEQ ID NO: 206399 - DNA, 103 bp, Artificial Sequence
  Synthetic Polynucleotide
taatacgactcactatagggcttctcctggttggtcatggacttccagcgaacagaggagacgctggatgtccatgaccaacctggcggcagcgcaaaagatg

SEQ ID NO: 206400 - DNA, 103 bp, Artificial Sequence
  Synthetic Polynucleotide
taatacgactcactatagggcccgggctgggtctccaggctgaggttcagaacagaggagactgaacatgagcctggagaacctggcggcagcgcaaaagatg

SEQ ID NO: 206401 - DNA, 103 bp, Artificial Sequence
  Synthetic Polynucleotide
taatacgactcactatagggagtagggctgcttctcctggttggtcatggaacagaggagaccatgaatgaccaggagaaacctggcggcagcgcaaaagatg

SEQ ID NO: 206402 - DNA, 103 bp, Artificial Sequence
  Synthetic Polynucleotide
taatacgactcactatagggtgttcctcatagtagggctgcttctcctggaacagaggagaccaggaatggcagccctaaacctggcggcagcgcaaaagatg

SEQ ID NO: 206403 - DNA, 103 bp, Artificial Sequence
  Synthetic Polynucleotide
taatacgactcactatagggcagccgcgcctgttcctcatagtagggctgaacagaggagacagcccatgtatgaggaaaacctggcggcagcgcaaaagatg

SEQ ID NO: 206404 - DNA, 103 bp, Artificial Sequence
  Synthetic Polynucleotide
taatacgactcactataggggctgccggctcagccgcgcctgttcctcataacagaggagaatgaggatgaggcgcggcaacctggcggcagcgcaaaagatg

SEQ ID NO: 206405 - DNA, 103 bp, Artificial Sequence
  Synthetic Polynucleotide
taatacgactcactatagggttctccaggtgctgccggctcagccgcgccaacagaggagaggcgcgatggagccggcaaacctggcggcagcgcaaaagatg

SEQ ID NO: 206406 - DNA, 103 bp, Artificial Sequence
  Synthetic Polynucleotide
taatacgactcactataggggtcaggatacttctccaggtgctgccggctaacagaggagaagccggatgcacctggagaacctggcggcagcgcaaaagatg

SEQ ID NO: 206407 - DNA, 103 bp, Artificial Sequence
  Synthetic Polynucleotide
taatacgactcactatagggtgtacttgtagtcaggatacttctccaggtaacagaggagaacctggatgagtatcctgaacctggcggcagcgcaaaagatg

SEQ ID NO: 206408 - DNA, 103 bp, Artificial Sequence
  Synthetic Polynucleotide
taatacgactcactatagggggccgcggcttgtacttgtagtcaggatacaacagaggagagtatccatgctacaagtaaacctggcggcagcgcaaaagatg

SEQ ID NO: 206409 - DNA, 103 bp, Artificial Sequence
  Synthetic Polynucleotide
taatacgactcactatagggggtgcgcttgggccgcggcttgtacttgtaaacagaggagatacaagatgaagccgcggaacctggcggcagcgcaaaagatg

SEQ ID NO: 206410 - DNA, 103 bp, Artificial Sequence
  Synthetic Polynucleotide
taatacgactcactatagggccacgatgcaggtgcgcttgggccgcggctaacagaggagaagccgcatgccaagcgcaaacctggcggcagcgcaaaagatg

SEQ ID NO: 206411 - DNA, 103 bp, Artificial Sequence
  Synthetic Polynucleotide
taatacgactcactatagggtcctgggaggcccgggctgggtctccaggcaacagaggagagcctggatgcccagcccgaacctggcggcagcgcaaaagatg

SEQ ID NO: 206412 - DNA, 103 bp, Artificial Sequence
  Synthetic Polynucleotide
taatacgactcactatagggcgcttgccctccacgatgcaggtgcgcttgaacagaggagacaagcgatgctgcatcgtaacctggcggcagcgcaaaagatg

SEQ ID NO: 206413 - DNA, 103 bp, Artificial Sequence
  Synthetic Polynucleotide
taatacgactcactatagggcacgcgcagccgcttgccctccacgatgcaaacagaggagatgcatcatggagggcaagaacctggcggcagcgcaaaagatg

SEQ ID NO: 206414 - DNA, 103 bp, Artificial Sequence
  Synthetic Polynucleotide
taatacgactcactatagggtgtactctcccacgcgcagccgcttgccctaacagaggagaagggcaatgggctgcgcgaacctggcggcagcgcaaaagatg

SEQ ID NO: 206415 - DNA, 103 bp, Artificial Sequence
  Synthetic Polynucleotide
taatacgactcactatagggatcagggccttgtactctcccacgcgcagcaacagaggagagctgcgatggggagagtaaacctggcggcagcgcaaaagatg

SEQ ID NO: 206416 - DNA, 103 bp, Artificial Sequence
  Synthetic Polynucleotide
taatacgactcactatagggccgggtcctcatcagggccttgtactctccaacagaggagaggagagatgaaggccctgaacctggcggcagcgcaaaagatg

SEQ ID NO: 206417 - DNA, 103 bp, Artificial Sequence
  Synthetic Polynucleotide
taatacgactcactatagggcatcctgacgccgggtcctcatcagggcctaacagaggagaaggcccatgtgaggacccaacctggcggcagcgcaaaagatg

SEQ ID NO: 206418 - DNA, 103 bp, Artificial Sequence
  Synthetic Polynucleotide
taatacgactcactatagggctctggcgggcatcctgacgccgggtcctcaacagaggagagaggacatggcgtcaggaaacctggcggcagcgcaaaagatg

SEQ ID NO: 206419 - DNA, 103 bp, Artificial Sequence
  Synthetic Polynucleotide
taatacgactcactataggggatcacgtagctctggcgggcatcctgacgaacagaggagacgtcagatggcccgccagaacctggcggcagcgcaaaagatg

SEQ ID NO: 206420 - DNA, 103 bp, Artificial Sequence
  Synthetic Polynucleotide
taatacgactcactatagggcctgcggggggatcacgtagctctggcgggaacagaggagacccgccatggctacgtgaaacctggcggcagcgcaaaagatg

SEQ ID NO: 206421 - DNA, 103 bp, Artificial Sequence
  Synthetic Polynucleotide
taatacgactcactatagggacctggccagcctgcggggggatcacgtagaacagaggagactacgtatgccccccgcaaacctggcggcagcgcaaaagatg

SEQ ID NO: 206422 - DNA, 103 bp, Artificial Sequence
  Synthetic Polynucleotide
taatacgactcactataggggtcagcactatcctgggaggcccgggctggaacagaggagaccagccatggcctcccagaacctggcggcagcgcaaaagatg

SEQ ID NO: 206423 - DNA, 103 bp, Artificial Sequence
  Synthetic Polynucleotide
taatacgactcactataggggctcatctgcacctggccagcctgcgggggaacagaggagacccccgatggctggccagaacctggcggcagcgcaaaagatg

SEQ ID NO: 206424 - DNA, 103 bp, Artificial Sequence
  Synthetic Polynucleotide
taatacgactcactatagggcatctgaggagctcatctgcacctggccagaacagaggagactggccatgtgcagatgaaacctggcggcagcgcaaaagatg

SEQ ID NO: 206425 - DNA, 103 bp, Artificial Sequence
  Synthetic Polynucleotide
taatacgactcactataggggggtacaggacatctgaggagctcatctgcaacagaggagagcagatatgctcctcagaaacctggcggcagcgcaaaagatg

SEQ ID NO: 206426 - DNA, 103 bp, Artificial Sequence
  Synthetic Polynucleotide
taatacgactcactatagggtgctgcccgagggtacaggacatctgaggaaacagaggagatcctcaatggtcctgtacaacctggcggcagcgcaaaagatg

SEQ ID NO: 206427 - DNA, 103 bp, Artificial Sequence
  Synthetic Polynucleotide
taatacgactcactataggggcggcatgcctgctgcccgagggtacaggaaacagaggagatcctgtatgctcgggcagaacctggcggcagcgcaaaagatg

SEQ ID NO: 206428 - DNA, 103 bp, Artificial Sequence
  Synthetic Polynucleotide
taatacgactcactatagggggctgtgccagcggcatgcctgctgcccgaaacagaggagatcgggcatgaggcatgccaacctggcggcagcgcaaaagatg

SEQ ID NO: 206429 - DNA, 103 bp, Artificial Sequence
  Synthetic Polynucleotide
taatacgactcactatagggctccaccagtggctgtgccagcggcatgccaacagaggagaggcatgatgctggcacagaacctggcggcagcgcaaaagatg

SEQ ID NO: 206430 - DNA, 103 bp, Artificial Sequence
  Synthetic Polynucleotide
taatacgactcactatagggggacatagtgctccaccagtggctgtgccaaacagaggagatggcacatgcactggtggaacctggcggcagcgcaaaagatg

SEQ ID NO: 206431 - DNA, 103 bp, Artificial Sequence
  Synthetic Polynucleotide
taatacgactcactatagggaggctacgagggacatagtgctccaccagtaacagaggagaactggtatggcactatgtaacctggcggcagcgcaaaagatg

SEQ ID NO: 206432 - DNA, 103 bp, Artificial Sequence
  Synthetic Polynucleotide
taatacgactcactataggggttggggtccaggctacgagggacatagtgaacagaggagacactatatgcctcgtagcaacctggcggcagcgcaaaagatg

SEQ ID NO: 206433 - DNA, 103 bp, Artificial Sequence
  Synthetic Polynucleotide
taatacgactcactataggggagcttgggggtcagcactatcctgggaggaacagaggagacctcccatgatagtgctgaacctggcggcagcgcaaaagatg

SEQ ID NO: 206434 - DNA, 103 bp, Artificial Sequence
  Synthetic Polynucleotide
taatacgactcactatagggtcacaggcatgttggggtccaggctacgagaacagaggagactcgtaatgtggaccccaaacctggcggcagcgcaaaagatg

SEQ ID NO: 206435 - DNA, 103 bp, Artificial Sequence
  Synthetic Polynucleotide
taatacgactcactataggggtgttgacgatcacaggcatgttggggtccaacagaggagaggacccatgcatgcctgtaacctggcggcagcgcaaaagatg

SEQ ID NO: 206436 - DNA, 103 bp, Artificial Sequence
  Synthetic Polynucleotide
taatacgactcactataggggaggctgcaggtgttgacgatcacaggcataacagaggagaatgcctatgatcgtcaacaacctggcggcagcgcaaaagatg

SEQ ID NO: 206437 - DNA, 103 bp, Artificial Sequence
  Synthetic Polynucleotide
taatacgactcactatagggcctcctctctgaggctgcaggtgttgacgaaacagaggagatcgtcaatgcctgcagccaacctggcggcagcgcaaaagatg

SEQ ID NO: 206438 - DNA, 103 bp, Artificial Sequence
  Synthetic Polynucleotide
taatacgactcactataggggtgccctcaccctcctctctgaggctgcagaacagaggagactgcagatgcagagaggaaacctggcggcagcgcaaaagatg

SEQ ID NO: 206439 - DNA, 103 bp, Artificial Sequence
  Synthetic Polynucleotide
taatacgactcactatagggcctgtcatctgtgccctcaccctcctctctaacagaggagaagagagatgggtgagggcaacctggcggcagcgcaaaagatg

SEQ ID NO: 206440 - DNA, 103 bp, Artificial Sequence
  Synthetic Polynucleotide
taatacgactcactatagggccaccgagtgcctgtcatctgtgccctcacaacagaggagagtgaggatgcagatgacaaacctggcggcagcgcaaaagatg

SEQ ID NO: 206441 - DNA, 103 bp, Artificial Sequence
  Synthetic Polynucleotide
taatacgactcactatagggtcgccatcagccaccgagtgcctgtcatctaacagaggagaagatgaatggcactcggtaacctggcggcagcgcaaaagatg

SEQ ID NO: 206442 - DNA, 103 bp, Artificial Sequence
  Synthetic Polynucleotide
taatacgactcactatagggccggtacatctcgccatcagccaccgagtgaacagaggagacactcgatggctgatggcaacctggcggcagcgcaaaagatg

SEQ ID NO: 206443 - DNA, 103 bp, Artificial Sequence
  Synthetic Polynucleotide
taatacgactcactatagggcctcgctgtaccggtacatctcgccatcagaacagaggagactgatgatgagatgtaccaacctggcggcagcgcaaaagatg

SEQ ID NO: 206444 - DNA, 103 bp, Artificial Sequence
  Synthetic Polynucleotide
taatacgactcactatagggccctgggctggagcttgggggtcagcactaaacagaggagatagtgcatgcccccaagcaacctggcggcagcgcaaaagatg

SEQ ID NO: 206445 - DNA, 103 bp, Artificial Sequence
  Synthetic Polynucleotide
taatacgactcactataggggagtcctcgtcctcgctgtaccggtacatcaacagaggagagatgtaatggtacagcgaaacctggcggcagcgcaaaagatg

SEQ ID NO: 206446 - DNA, 103 bp, Artificial Sequence
  Synthetic Polynucleotide
taatacgactcactatagggttcgccctccgagtcctcgtcctcgctgtaaacagaggagatacagcatggacgaggacaacctggcggcagcgcaaaagatg

SEQ ID NO: 206447 - DNA, 103 bp, Artificial Sequence
  Synthetic Polynucleotide
taatacgactcactatagggcgctcttctcttcgccctccgagtcctcgtaacagaggagaacgaggatgcggagggcgaacctggcggcagcgcaaaagatg

SEQ ID NO: 206448 - DNA, 103 bp, Artificial Sequence
  Synthetic Polynucleotide
taatacgactcactatagggaactccccatcgctcttctcttcgccctccaacagaggagaggagggatgagagaagagaacctggcggcagcgcaaaagatg

SEQ ID NO: 206449 - DNA, 103 bp, Artificial Sequence
  Synthetic Polynucleotide
taatacgactcactataggggagcaccaccaactccccatcgctcttctcaacagaggagagagaagatggatggggagaacctggcggcagcgcaaaagatg

SEQ ID NO: 206450 - DNA, 103 bp, Artificial Sequence
  Synthetic Polynucleotide
taatacgactcactatagggcctgaaattcccctgggctggagcttggggaacagaggagaccccaaatgccagcccagaacctggcggcagcgcaaaagatg

SEQ ID NO: 206451 - DNA, 103 bp, Artificial Sequence
  Synthetic Polynucleotide
taatacgactcactatagggccagggccagctgggcagagatggggctccaacagaggagaggagccatgtctctgcccaacctggcggcagcgcaaaagatg

SEQ ID NO: 206452 - DNA, 103 bp, Artificial Sequence
  Synthetic Polynucleotide
taatacgactcactatagggcccaggagcccctgaaattcccctgggctgaacagaggagacagcccatgggaatttcaaacctggcggcagcgcaaaagatg

SEQ ID NO: 206453 - DNA, 103 bp, Artificial Sequence
  Synthetic Polynucleotide
taatacgactcactataggggagctacagtcccaggagcccctgaaattcaacagaggagagaatttatggggctcctgaacctggcggcagcgcaaaagatg

SEQ ID NO: 206454 - DNA, 103 bp, Artificial Sequence
  Synthetic Polynucleotide
taatacgactcactatagggaccctctggagagctacagtcccaggagccaacagaggagaggctccatggactgtagcaacctggcggcagcgcaaaagatg

SEQ ID NO: 206455 - DNA, 103 bp, Artificial Sequence
  Synthetic Polynucleotide
taatacgactcactataggggggacccattaccctctggagagctacagtaacagaggagaactgtaatgctccagaggaacctggcggcagcgcaaaagatg

SEQ ID NO: 206456 - DNA, 103 bp, Artificial Sequence
  Synthetic Polynucleotide
taatacgactcactatagggttgggttctggggacccattaccctctggaaacagaggagatccagaatgtaatgggtcaacctggcggcagcgcaaaagatg

SEQ ID NO: 206457 - DNA, 103 bp, Artificial Sequence
  Synthetic Polynucleotide
taatacgactcactatagggtcctggtctcttgggttctggggacccattaacagaggagaaatgggatgccagaacccaacctggcggcagcgcaaaagatg

SEQ ID NO: 206458 - DNA, 103 bp, Artificial Sequence
  Synthetic Polynucleotide
taatacgactcactatagggcctccgacactcctggtctcttgggttctgaacagaggagacagaacatgagagaccagaacctggcggcagcgcaaaagatg

SEQ ID NO: 206459 - DNA, 103 bp, Artificial Sequence
  Synthetic Polynucleotide
taatacgactcactatagggccagaggcagcctccgacactcctggtctcaacagaggagagagaccatgagtgtcggaaacctggcggcagcgcaaaagatg

SEQ ID NO: 206460 - DNA, 103 bp, Artificial Sequence
  Synthetic Polynucleotide
taatacgactcactatagggctcctggcttccagaggcagcctccgacacaacagaggagagtgtcgatggctgcctctaacctggcggcagcgcaaaagatg

SEQ ID NO: 206461 - DNA, 103 bp, Artificial Sequence
  Synthetic Polynucleotide
taatacgactcactatagggagtccagcttctcctggcttccagaggcagaacagaggagactgcctatggaagccaggaacctggcggcagcgcaaaagatg

SEQ ID NO: 206462 - DNA, 103 bp, Artificial Sequence
  Synthetic Polynucleotide
taatacgactcactatagggccaacgccatccagggccagctgggcagagaacagaggagactctgcatggctggccctaacctggcggcagcgcaaaagatg

SEQ ID NO: 206463 - DNA, 103 bp, Artificial Sequence
  Synthetic Polynucleotide
taatacgactcactatagggtttcggttgaagtccagcttctcctggcttaacagaggagaaagccaatggaagctggaaacctggcggcagcgcaaaagatg

SEQ ID NO: 206464 - DNA, 103 bp, Artificial Sequence
  Synthetic Polynucleotide
taatacgactcactatagggttctttcaaatttcggttgaagtccagcttaacagaggagaaagctgatgttcaaccgaaacctggcggcagcgcaaaagatg

SEQ ID NO: 206465 - DNA, 103 bp, Artificial Sequence
  Synthetic Polynucleotide
taatacgactcactatagggctggcaccacttctttcaaatttcggttgaaacagaggagatcaaccatgatttgaaagaacctggcggcagcgcaaaagatg

SEQ ID NO: 206466 - DNA, 103 bp, Artificial Sequence
  Synthetic Polynucleotide
taatacgactcactatagggttctctatggctggcaccacttctttcaaaaacagaggagatttgaaatgagtggtgccaacctggcggcagcgcaaaagatg

SEQ ID NO: 206467 - DNA, 103 bp, Artificial Sequence
  Synthetic Polynucleotide
taatacgactcactatagggggacaacagcttctctatggctggcaccacaacagaggagagtggtgatggccatagagaacctggcggcagcgcaaaagatg

SEQ ID NO: 206468 - DNA, 103 bp, Artificial Sequence
  Synthetic Polynucleotide
taatacgactcactatagggtccagtcactggacaacagcttctctatggaacagaggagaccatagatgagctgttgtaacctggcggcagcgcaaaagatg

SEQ ID NO: 206469 - DNA, 103 bp, Artificial Sequence
  Synthetic Polynucleotide
taatacgactcactatagggaacctctccttccagtcactggacaacagcaacagaggagagctgttatgcagtgactgaacctggcggcagcgcaaaagatg

SEQ ID NO: 206470 - DNA, 103 bp, Artificial Sequence
  Synthetic Polynucleotide
taatacgactcactatagggccttcctagaaacctctccttccagtcactaacagaggagaagtgacatgaaggagaggaacctggcggcagcgcaaaagatg

SEQ ID NO: 206471 - DNA, 103 bp, Artificial Sequence
  Synthetic Polynucleotide
taatacgactcactatagggccatagagttccttcctagaaacctctcctaacagaggagaaggagaatgttctaggaaaacctggcggcagcgcaaaagatg

SEQ ID NO: 206472 - DNA, 103 bp, Artificial Sequence
  Synthetic Polynucleotide
taatacgactcactatagggtctttggcttccatagagttccttcctagaaacagaggagatctaggatggaactctataacctggcggcagcgcaaaagatg

SEQ ID NO: 206473 - DNA, 103 bp, Artificial Sequence
  Synthetic Polynucleotide
taatacgactcactatagggcaccatggtgccaacgccatccagggccagaacagaggagactggccatggatggcgttaacctggcggcagcgcaaaagatg

SEQ ID NO: 206474 - DNA, 103 bp, Artificial Sequence
  Synthetic Polynucleotide
taatacgactcactatagggccctttgacatctttggcttccatagagttaacagaggagaaactctatggaagccaaaaacctggcggcagcgcaaaagatg

SEQ ID NO: 206475 - DNA, 103 bp, Artificial Sequence
  Synthetic Polynucleotide
taatacgactcactatagggtctcttgggtccctttgacatctttggcttaacagaggagaaagccaatgatgtcaaagaacctggcggcagcgcaaaagatg

SEQ ID NO: 206476 - DNA, 103 bp, Artificial Sequence
  Synthetic Polynucleotide
taatacgactcactatagggtctgctaggctctcttgggtccctttgacaaacagaggagatgtcaaatggacccaagaaacctggcggcagcgcaaaagatg

SEQ ID NO: 206477 - DNA, 103 bp, Artificial Sequence
  Synthetic Polynucleotide
taatacgactcactataggggagctccttctctgctaggctctcttgggtaacagaggagaacccaaatgagcctagcaaacctggcggcagcgcaaaagatg

SEQ ID NO: 206478 - DNA, 103 bp, Artificial Sequence
  Synthetic Polynucleotide
taatacgactcactatagggccagaagctggagctccttctctgctaggcaacagaggagagcctagatgagaaggagcaacctggcggcagcgcaaaagatg

SEQ ID NO: 206479 - DNA, 103 bp, Artificial Sequence
  Synthetic Polynucleotide
taatacgactcactatagggtgaatcatgaccagaagctggagctccttcaacagaggagagaaggaatgccagcttctaacctggcggcagcgcaaaagatg

SEQ ID NO: 206480 - DNA, 103 bp, Artificial Sequence
  Synthetic Polynucleotide
taatacgactcactatagggggacagctggtgaatcatgaccagaagctgaacagaggagacagcttatggtcatgattaacctggcggcagcgcaaaagatg

SEQ ID NO: 206481 - DNA, 103 bp, Artificial Sequence
  Synthetic Polynucleotide
taatacgactcactatagggcccgcagggtggacagctggtgaatcatgaaacagaggagatcatgaatgaccagctgtaacctggcggcagcgcaaaagatg

SEQ ID NO: 206482 - DNA, 103 bp, Artificial Sequence
  Synthetic Polynucleotide
taatacgactcactatagggaggagctggtcccgcagggtggacagctggaacagaggagaccagctatgcaccctgcgaacctggcggcagcgcaaaagatg

SEQ ID NO: 206483 - DNA, 103 bp, Artificial Sequence
  Synthetic Polynucleotide
taatacgactcactataggggtgggctgtcaggagctggtcccgcagggtaacagaggagaaccctgatggaccagctcaacctggcggcagcgcaaaagatg

SEQ ID NO: 206484 - DNA, 103 bp, Artificial Sequence
  Synthetic Polynucleotide
taatacgactcactatagggtggtgcagttcaccatggtgccaacgccataacagaggagaatggcgatggcaccatggaacctggcggcagcgcaaaagatg

SEQ ID NO: 206485 - DNA, 103 bp, Artificial Sequence
  Synthetic Polynucleotide
taatacgactcactatagggtctgctccgagtgggctgtcaggagctggtaacagaggagaaccagcatgtgacagcccaacctggcggcagcgcaaaagatg

SEQ ID NO: 206486 - DNA, 103 bp, Artificial Sequence
  Synthetic Polynucleotide
taatacgactcactataggggccatgttcttctgctccgagtgggctgtcaacagaggagagacagcatgctcggagcaaacctggcggcagcgcaaaagatg

SEQ ID NO: 206487 - DNA, 103 bp, Artificial Sequence
  Synthetic Polynucleotide
taatacgactcactatagggcagcatggcagccatgttcttctgctccgaaacagaggagatcggagatgaagaacatgaacctggcggcagcgcaaaagatg

SEQ ID NO: 206488 - DNA, 103 bp, Artificial Sequence
  Synthetic Polynucleotide
taatacgactcactataggggcttctcaaacagcatggcagccatgttctaacagaggagaagaacaatgctgccatgcaacctggcggcagcgcaaaagatg

SEQ ID NO: 206489 - DNA, 103 bp, Artificial Sequence
  Synthetic Polynucleotide
taatacgactcactatagggtgctgctgctgcttctcaaacagcatggcaaacagaggagatgccatatggtttgagaaaacctggcggcagcgcaaaagatg

SEQ ID NO: 206490 - DNA, 103 bp, Artificial Sequence
  Synthetic Polynucleotide
taatacgactcactatagggaagctccatctgctgctgctgcttctcaaaaacagaggagatttgagatgcagcagcagaacctggcggcagcgcaaaagatg

SEQ ID NO: 206491 - DNA, 103 bp, Artificial Sequence
  Synthetic Polynucleotide
taatacgactcactataggggctgccgggcaagctccatctgctgctgctaacagaggagaagcagcatgagatggagcaacctggcggcagcgcaaaagatg

SEQ ID NO: 206492 - DNA, 103 bp, Artificial Sequence
  Synthetic Polynucleotide
taatacgactcactatagggtgctcctgctgctgccgggcaagctccatcaacagaggagagatggaatgtgcccggcaaacctggcggcagcgcaaaagatg

SEQ ID NO: 206493 - DNA, 103 bp, Artificial Sequence
  Synthetic Polynucleotide
taatacgactcactatagggctttgcaatctgctcctgctgctgccgggcaacagaggagagcccggatgcagcaggagaacctggcggcagcgcaaaagatg

SEQ ID NO: 206494 - DNA, 103 bp, Artificial Sequence
  Synthetic Polynucleotide
taatacgactcactataggggctgctgctgctttgcaatctgctcctgctaacagaggagaagcaggatgagattgcaaaacctggcggcagcgcaaaagatg

SEQ ID NO: 206495 - DNA, 103 bp, Artificial Sequence
  Synthetic Polynucleotide
taatacgactcactatagggtctgacttgatggtgcagttcaccatggtgaacagaggagacaccatatggaactgcacaacctggcggcagcgcaaaagatg

SEQ ID NO: 206496 - DNA, 103 bp, Artificial Sequence
  Synthetic Polynucleotide
taatacgactcactatagggtgaatcagctgctgctgctgctttgcaatcaacagaggagagattgcatggcagcagcaaacctggcggcagcgcaaaagatg

SEQ ID NO: 206497 - DNA, 103 bp, Artificial Sequence
  Synthetic Polynucleotide
taatacgactcactatagggatgctgctgctgaatcagctgctgctgctgaacagaggagacagcagatgcagctgattaacctggcggcagcgcaaaagatg

SEQ ID NO: 206498 - DNA, 103 bp, Artificial Sequence
  Synthetic Polynucleotide
taatacgactcactatagggggttgatcttatgctgctgctgaatcagctaacagaggagaagctgaatgagcagcagcaacctggcggcagcgcaaaagatg

SEQ ID NO: 206499 - DNA, 103 bp, Artificial Sequence
  Synthetic Polynucleotide
taatacgactcactatagggtgctgaaggaggttgatcttatgctgctgcaacagaggagagcagcaatgtaagatcaaaacctggcggcagcgcaaaagatg

SEQ ID NO: 206500 - DNA, 103 bp, Artificial Sequence
  Synthetic Polynucleotide
taatacgactcactatagggctggatctgctgctgaaggaggttgatcttaacagaggagaaagatcatgctccttcagaacctggcggcagcgcaaaagatg

SEQ ID NO: 206501 - DNA, 103 bp, Artificial Sequence
  Synthetic Polynucleotide
taatacgactcactatagggtgttaacctgctggatctgctgctgaaggaaacagaggagatccttcatgagcagatccaacctggcggcagcgcaaaagatg

SEQ ID NO: 206502 - DNA, 103 bp, Artificial Sequence
  Synthetic Polynucleotide
taatacgactcactatagggacataaggcatgttaacctgctggatctgcaacagaggagagcagatatggcaggttaaaacctggcggcagcgcaaaagatg

SEQ ID NO: 206503 - DNA, 103 bp, Artificial Sequence
  Synthetic Polynucleotide
taatacgactcactatagggtgggatcatgacataaggcatgttaacctgaacagaggagacaggttatgatgccttataacctggcggcagcgcaaaagatg

SEQ ID NO: 206504 - DNA, 103 bp, Artificial Sequence
  Synthetic Polynucleotide
taatacgactcactataggggggggaaggctgggatcatgacataaggcaaacagaggagatgccttatgtcatgatccaacctggcggcagcgcaaaagatg

SEQ ID NO: 206505 - DNA, 103 bp, Artificial Sequence
  Synthetic Polynucleotide
taatacgactcactatagggtggtggcttggggggaaggctgggatcatgaacagaggagacatgatatgagccttcccaacctggcggcagcgcaaaagatg

SEQ ID NO: 206506 - DNA, 103 bp, Artificial Sequence
  Synthetic Polynucleotide
taatacgactcactatagggtttcttctcctctgacttgatggtgcagttaacagaggagaaactgcatgatcaagtcaaacctggcggcagcgcaaaagatg

SEQ ID NO: 206507 - DNA, 103 bp, Artificial Sequence
  Synthetic Polynucleotide
taatacgactcactatagggaggcagaggttggtggcttggggggaaggcaacagaggagagccttcatgccaagccacaacctggcggcagcgcaaaagatg

SEQ ID NO: 206508 - DNA, 103 bp, Artificial Sequence
  Synthetic Polynucleotide
taatacgactcactatagggcaggggtgacaggcagaggttggtggcttgaacagaggagacaagccatgaacctctgcaacctggcggcagcgcaaaagatg

SEQ ID NO: 206509 - DNA, 103 bp, Artificial Sequence
  Synthetic Polynucleotide
taatacgactcactatagggagctgggagtcaggggtgacaggcagaggtaacagaggagaacctctatgtgtcaccccaacctggcggcagcgcaaaagatg

SEQ ID NO: 206510 - DNA, 103 bp, Artificial Sequence
  Synthetic Polynucleotide
taatacgactcactataggggggtaaggccagctgggagtcaggggtgacaacagaggagagtcaccatggactcccagaacctggcggcagcgcaaaagatg

SEQ ID NO: 206511 - DNA, 103 bp, Artificial Sequence
  Synthetic Polynucleotide
taatacgactcactatagggtgggctgaatgggtaaggccagctgggagtaacagaggagaactcccatgtggccttacaacctggcggcagcgcaaaagatg

SEQ ID NO: 206512 - DNA, 103 bp, Artificial Sequence
  Synthetic Polynucleotide
taatacgactcactatagggttgcagggaatgggctgaatgggtaaggccaacagaggagaggccttatgcattcagccaacctggcggcagcgcaaaagatg

SEQ ID NO: 206513 - DNA, 103 bp, Artificial Sequence
  Synthetic Polynucleotide
taatacgactcactatagggctccactggtttgcagggaatgggctgaataacagaggagaattcagatgattccctgcaacctggcggcagcgcaaaagatg

SEQ ID NO: 206514 - DNA, 103 bp, Artificial Sequence
  Synthetic Polynucleotide
taatacgactcactataggggcagcggatactccactggtttgcagggaaaacagaggagattccctatgaaccagtggaacctggcggcagcgcaaaagatg

SEQ ID NO: 206515 - DNA, 103 bp, Artificial Sequence
  Synthetic Polynucleotide
taatacgactcactatagggtgcagcagctgcagcggatactccactggtaacagaggagaaccagtatggtatccgctaacctggcggcagcgcaaaagatg

SEQ ID NO: 206516 - DNA, 103 bp, Artificial Sequence
  Synthetic Polynucleotide
taatacgactcactatagggaggggggctgtgcagcagctgcagcggataaacagaggagatatccgatgcagctgctgaacctggcggcagcgcaaaagatg

SEQ ID NO: 206517 - DNA, 103 bp, Artificial Sequence
  Synthetic Polynucleotide
taatacgactcactatagggggcaaggctctttcttctcctctgacttgaaacagaggagatcaagtatgaggagaagaaacctggcggcagcgcaaaagatg

SEQ ID NO: 206518 - DNA, 103 bp, Artificial Sequence
  Synthetic Polynucleotide
taatacgactcactatagggccactggggcaggggggctgtgcagcagctaacagaggagaagctgcatgacagcccccaacctggcggcagcgcaaaagatg

SEQ ID NO: 206519 - DNA, 103 bp, Artificial Sequence
  Synthetic Polynucleotide
taatacgactcactatagggggcctcttcaccactggggcaggggggctgaacagaggagacagcccatgtgccccagtaacctggcggcagcgcaaaagatg

SEQ ID NO: 206520 - DNA, 103 bp, Artificial Sequence
  Synthetic Polynucleotide
taatacgactcactatagggcatggccccaggcctcttcaccactggggcaacagaggagagccccaatggtgaagaggaacctggcggcagcgcaaaagatg

SEQ ID NO: 206521 - DNA, 103 bp, Artificial Sequence
  Synthetic Polynucleotide
taatacgactcactatagggggtgggtggccatggccccaggcctcttcaaacagaggagatgaagaatgctggggccaaacctggcggcagcgcaaaagatg

SEQ ID NO: 206522 - DNA, 103 bp, Artificial Sequence
  Synthetic Polynucleotide
taatacgactcactatagggtgcagggggtggtgggtggccatggccccaaacagaggagatggggcatgggccacccaaacctggcggcagcgcaaaagatg

SEQ ID NO: 206523 - DNA, 103 bp, Artificial Sequence
  Synthetic Polynucleotide
taatacgactcactatagggggagggctcctgcagggggtggtgggtggcaacagaggagagccaccatgcaccccctgaacctggcggcagcgcaaaagatg

SEQ ID NO: 206524 - DNA, 103 bp, Artificial Sequence
  Synthetic Polynucleotide
taatacgactcactatagggtcaggggctgggagggctcctgcagggggtaacagaggagaacccccatgaggagccctaacctggcggcagcgcaaaagatg

SEQ ID NO: 206525 - DNA, 103 bp, Artificial Sequence
  Synthetic Polynucleotide
taatacgactcactataggggctgtgaggttcaggggctgggagggctccaacagaggagaggagccatgccagcccctaacctggcggcagcgcaaaagatg

SEQ ID NO: 206526 - DNA, 103 bp, Artificial Sequence
  Synthetic Polynucleotide
taatacgactcactatagggcttgggcttggctgtgaggttcaggggctgaacagaggagacagcccatgaacctcacaaacctggcggcagcgcaaaagatg

SEQ ID NO: 206527 - DNA, 103 bp, Artificial Sequence
  Synthetic Polynucleotide
taatacgactcactataggggctcgggggccttgggcttggctgtgaggtaacagaggagaacctcaatgccaagcccaaacctggcggcagcgcaaaagatg

SEQ ID NO: 206528 - DNA, 103 bp, Artificial Sequence
  Synthetic Polynucleotide
taatacgactcactatagggggggcctcgtggcaaggctctttcttctccaacagaggagaggagaaatgagagccttgaacctggcggcagcgcaaaagatg

SEQ ID NO: 206529 - DNA, 103 bp, Artificial Sequence
  Synthetic Polynucleotide
taatacgactcactataggggtgttgggcagctcgggggccttgggcttgaacagaggagacaagccatgggcccccgaaacctggcggcagcgcaaaagatg

SEQ ID NO: 206530 - DNA, 103 bp, Artificial Sequence
  Synthetic Polynucleotide
taatacgactcactatagggggagctggaggtgttgggcagctcgggggcaacagaggagagcccccatgctgcccaacaacctggcggcagcgcaaaagatg

SEQ ID NO: 206531 - DNA, 103 bp, Artificial Sequence
  Synthetic Polynucleotide
taatacgactcactatagggtcaggcttggggagctggaggtgttgggcaaacagaggagatgcccaatgcctccagctaacctggcggcagcgcaaaagatg

SEQ ID NO: 206532 - DNA, 103 bp, Artificial Sequence
  Synthetic Polynucleotide
taatacgactcactatagggctgctcatcttcaggcttggggagctggagaacagaggagactccagatgcccaagcctaacctggcggcagcgcaaaagatg

SEQ ID NO: 206533 - DNA, 103 bp, Artificial Sequence
  Synthetic Polynucleotide
taatacgactcactataggggggcacacagctgctcatcttcaggcttggaacagaggagaccaagcatgaagatgagcaacctggcggcagcgcaaaagatg

SEQ ID NO: 206534 - DNA, 103 bp, Artificial Sequence
  Synthetic Polynucleotide
taatacgactcactatagggtgggggggcggggcacacagctgctcatctaacagaggagaagatgaatggctgtgtgcaacctggcggcagcgcaaaagatg

SEQ ID NO: 206535 - DNA, 103 bp, Artificial Sequence
  Synthetic Polynucleotide
taatacgactcactatagggcctccatggctgggggggcggggcacacagaacagaggagactgtgtatgccgccccccaacctggcggcagcgcaaaagatg

SEQ ID NO: 206536 - DNA, 103 bp, Artificial Sequence
  Synthetic Polynucleotide
taatacgactcactatagggccgcgtggggcctccatggctgggggggcgaacagaggagacgccccatgagccatggaaacctggcggcagcgcaaaagatg

SEQ ID NO: 206537 - DNA, 103 bp, Artificial Sequence
  Synthetic Polynucleotide
taatacgactcactatagggactgcaggtcccgcgtggggcctccatggcaacagaggagagccatgatggccccacgcaacctggcggcagcgcaaaagatg

SEQ ID NO: 206538 - DNA, 103 bp, Artificial Sequence
  Synthetic Polynucleotide
taatacgactcactatagggggggggctggactgcaggtcccgcgtggggaacagaggagaccccacatgggacctgcaaacctggcggcagcgcaaaagatg

SEQ ID NO: 206539 - DNA, 103 bp, Artificial Sequence
  Synthetic Polynucleotide
taatacgactcactatagggactggcgtatcccgcatccgggctgctcataacagaggagaatgagcatgccggatgcgaacctggcggcagcgcaaaagatg

SEQ ID NO: 206540 - DNA, 103 bp, Artificial Sequence
  Synthetic Polynucleotide
taatacgactcactatagggcccgatggggctcagcgactcggcccagggaacagaggagaccctggatggagtcgctgaacctggcggcagcgcaaaagatg

SEQ ID NO: 206541 - DNA, 103 bp, Artificial Sequence
  Synthetic Polynucleotide
taatacgactcactatagggcagtgcctccggagggggcgacggctgtccaacagaggagaggacagatgtcgccccctaacctggcggcagcgcaaaagatg

SEQ ID NO: 206542 - DNA, 103 bp, Artificial Sequence
  Synthetic Polynucleotide
taatacgactcactatagggcccggcagggcagtgcctccggagggggcgaacagaggagacgccccatgcggaggcacaacctggcggcagcgcaaaagatg

SEQ ID NO: 206543 - DNA, 103 bp, Artificial Sequence
  Synthetic Polynucleotide
taatacgactcactatagggtccgtgccgtcccggcagggcagtgcctccaacagaggagaggaggcatggccctgccgaacctggcggcagcgcaaaagatg

SEQ ID NO: 206544 - DNA, 103 bp, Artificial Sequence
  Synthetic Polynucleotide
taatacgactcactatagggctgactggggtccgtgccgtcccggcagggaacagaggagaccctgcatggacggcacgaacctggcggcagcgcaaaagatg

SEQ ID NO: 206545 - DNA, 103 bp, Artificial Sequence
  Synthetic Polynucleotide
taatacgactcactataggggctcggcgggctgactggggtccgtgccgtaacagaggagaacggcaatgaccccagtcaacctggcggcagcgcaaaagatg

SEQ ID NO: 206546 - DNA, 103 bp, Artificial Sequence
  Synthetic Polynucleotide
taatacgactcactatagggtccccgaggagctcggcgggctgactggggaacagaggagaccccagatggcccgccgaaacctggcggcagcgcaaaagatg

SEQ ID NO: 206547 - DNA, 103 bp, Artificial Sequence
  Synthetic Polynucleotide
taatacgactcactataggggcggtccacctccccgaggagctcggcgggaacagaggagacccgccatgctcctcgggaacctggcggcagcgcaaaagatg

SEQ ID NO: 206548 - DNA, 103 bp, Artificial Sequence
  Synthetic Polynucleotide
taatacgactcactatagggcaaattccgtgcggtccacctccccgaggaaacagaggagatcctcgatgaggtggaccaacctggcggcagcgcaaaagatg

SEQ ID NO: 206549 - DNA, 103 bp, Artificial Sequence
  Synthetic Polynucleotide
taatacgactcactatagggagatactgttcaaattccgtgcggtccaccaacagaggagaggtggaatgcacggaattaacctggcggcagcgcaaaagatg

SEQ ID NO: 206550 - DNA, 103 bp, Artificial Sequence
  Synthetic Polynucleotide
taatacgactcactatagggcacgaagtgcagatactgttcaaattccgtaacagaggagaacggaaatggaacagtataacctggcggcagcgcaaaagatg

SEQ ID NO: 206551 - DNA, 103 bp, Artificial Sequence
  Synthetic Polynucleotide
taatacgactcactatagggccttcatgtccccgatggggctcagcgactaacagaggagaagtcgcatggccccatcgaacctggcggcagcgcaaaagatg

SEQ ID NO: 206552 - DNA, 103 bp, Artificial Sequence
  Synthetic Polynucleotide
taatacgactcactatagggcaggcttgcacacgaagtgcagatactgttaacagaggagaaacagtatgtgcacttcgaacctggcggcagcgcaaaagatg

SEQ ID NO: 206553 - DNA, 103 bp, Artificial Sequence
  Synthetic Polynucleotide
taatacgactcactatagggaggcccatctcaggcttgcacacgaagtgcaacagaggagagcacttatggtgcaagccaacctggcggcagcgcaaaagatg

SEQ ID NO: 206554 - DNA, 103 bp, Artificial Sequence
  Synthetic Polynucleotide
taatacgactcactatagggctggtaggggaggcccatctcaggcttgcaaacagaggagatgcaagatggagatgggcaacctggcggcagcgcaaaagatg

SEQ ID NO: 206555 - DNA, 103 bp, Artificial Sequence
  Synthetic Polynucleotide
taatacgactcactatagggagtcatgcccctggtaggggaggcccatctaacagaggagaagatggatgtcccctaccaacctggcggcagcgcaaaagatg

SEQ ID NO: 206556 - DNA, 103 bp, Artificial Sequence
  Synthetic Polynucleotide
taatacgactcactatagggttcacaccggagtcatgcccctggtaggggaacagaggagacccctaatgggggcatgaaacctggcggcagcgcaaaagatg

SEQ ID NO: 206557 - DNA, 103 bp, Artificial Sequence
  Synthetic Polynucleotide
taatacgactcactataggggtcggggagattcacaccggagtcatgcccaacagaggagagggcatatgtccggtgtgaacctggcggcagcgcaaaagatg

SEQ ID NO: 206558 - DNA, 103 bp, Artificial Sequence
  Synthetic Polynucleotide
taatacgactcactatagggccccgtggctgtcggggagattcacaccggaacagaggagaccggtgatgatctccccgaacctggcggcagcgcaaaagatg

SEQ ID NO: 206559 - DNA, 103 bp, Artificial Sequence
  Synthetic Polynucleotide
taatacgactcactataggggaggaaatggccccgtggctgtcggggagaaacagaggagatctcccatgcagccacggaacctggcggcagcgcaaaagatg

SEQ ID NO: 206560 - DNA, 103 bp, Artificial Sequence
  Synthetic Polynucleotide
taatacgactcactatagggggacaccaccgaggaaatggccccgtggctaacagaggagaagccacatggccatttccaacctggcggcagcgcaaaagatg

SEQ ID NO: 206561 - DNA, 103 bp, Artificial Sequence
  Synthetic Polynucleotide
taatacgactcactatagggagctggcgtcggacaccaccgaggaaatggaacagaggagaccatttatgcggtggtgtaacctggcggcagcgcaaaagatg

SEQ ID NO: 206562 - DNA, 103 bp, Artificial Sequence
  Synthetic Polynucleotide
taatacgactcactatagggtcgcccttcaccttcatgtccccgatggggaacagaggagaccccatatgggacatgaaaacctggcggcagcgcaaaagatg

SEQ ID NO: 206563 - DNA, 103 bp, Artificial Sequence
  Synthetic Polynucleotide
taatacgactcactatagggtataccgcggagctggcgtcggacaccaccaacagaggagaggtggtatgcgacgccagaacctggcggcagcgcaaaagatg

SEQ ID NO: 206564 - DNA, 103 bp, Artificial Sequence
  Synthetic Polynucleotide
taatacgactcactataggggttgcagtaatataccgcggagctggcgtcaacagaggagagacgccatgtccgcggtaaacctggcggcagcgcaaaagatg

SEQ ID NO: 206565 - DNA, 103 bp, Artificial Sequence
  Synthetic Polynucleotide
taatacgactcactatagggcgtcaggatagttgcagtaatataccgcggaacagaggagaccgcggatgattactgcaaacctggcggcagcgcaaaagatg

SEQ ID NO: 206566 - DNA, 103 bp, Artificial Sequence
  Synthetic Polynucleotide
taatacgactcactatagggcgccggcgcctcgcccttcaccttcatgtcaacagaggagagacatgatggtgaagggcaacctggcggcagcgcaaaagatg

SEQ ID NO: 206567 - DNA, 103 bp, Artificial Sequence
  Synthetic Polynucleotide
taatacgactcactatagggctccgctgttcgccggcgcctcgcccttcaaacagaggagatgaaggatgaggcgccggaacctggcggcagcgcaaaagatg

SEQ ID NO: 206568 - DNA, 103 bp, Artificial Sequence
  Synthetic Polynucleotide
taatacgactcactatagggccggccggtgctccgctgttcgccggcgccaacagaggagaggcgccatggaacagcggaacctggcggcagcgcaaaagatg

SEQ ID NO: 206569 - DNA, 103 bp, Artificial Sequence
  Synthetic Polynucleotide
taatacgactcactataggggcccgcggccccggccggtgctccgctgttaacagaggagaaacagcatggcaccggccaacctggcggcagcgcaaaagatg

SEQ ID NO: 206570 - DNA, 103 bp, Artificial Sequence
  Synthetic Polynucleotide
taatacgactcactatagggccttggctcggcccgcggccccggccggtgaacagaggagacaccggatggggccgcggaacctggcggcagcgcaaaagatg

SEQ ID NO: 206571 - DNA, 103 bp, Artificial Sequence
  Synthetic Polynucleotide
taatacgactcactatagggcgggactcgcccttggctcggcccgcggccaacagaggagaggccgcatgccgagccaaaacctggcggcagcgcaaaagatg

SEQ ID NO: 206572 - DNA, 103 bp, Artificial Sequence
  Synthetic Polynucleotide
taatacgactcactatagggccgccggatacgggactcgcccttggctcgaacagaggagacgagccatgggcgagtccaacctggcggcagcgcaaaagatg

SEQ ID NO: 206573 - DNA, 103 bp, Artificial Sequence
  Synthetic Polynucleotide
taatacgactcactatagggtctggtcgtcactggcgtatcccgcatccgaacagaggagacggatgatggatacgccaaacctggcggcagcgcaaaagatg

SEQ ID NO: 206574 - DNA, 103 bp, Artificial Sequence
  Synthetic Polynucleotide
taatacgactcactatagggcgttcatcggccgccggatacgggactcgcaacagaggagagcgagtatggtatccggcaacctggcggcagcgcaaaagatg

SEQ ID NO: 206575 - DNA, 103 bp, Artificial Sequence
  Synthetic Polynucleotide
taatacgactcactatagggaccatgaaagcgttcatcggccgccggataaacagaggagatatccgatggccgatgaaaacctggcggcagcgcaaaagatg

SEQ ID NO: 206576 - DNA, 103 bp, Artificial Sequence
  Synthetic Polynucleotide
taatacgactcactatagggcttagcccacaccatgaaagcgttcatcggaacagaggagaccgatgatggctttcatgaacctggcggcagcgcaaaagatg

SEQ ID NO: 206577 - DNA, 103 bp, Artificial Sequence
  Synthetic Polynucleotide
taatacgactcactatagggtgcgctcgtccttagcccacaccatgaaagaacagaggagactttcaatgtgtgggctaaacctggcggcagcgcaaaagatg

SEQ ID NO: 206578 - DNA, 103 bp, Artificial Sequence
  Synthetic Polynucleotide
taatacgactcactataggggccagccgcttgcgctcgtccttagcccacaacagaggagagtgggcatgggacgagcgaacctggcggcagcgcaaaagatg

SEQ ID NO: 206579 - DNA, 103 bp, Artificial Sequence
  Synthetic Polynucleotide
taatacgactcactatagggattctgctgcgccagccgcttgcgctcgtcaacagaggagagacgagatgaagcggctgaacctggcggcagcgcaaaagatg

SEQ ID NO: 206580 - DNA, 103 bp, Artificial Sequence
  Synthetic Polynucleotide
taatacgactcactataggggcaggtctggattctgctgcgccagccgctaacagaggagaagcggcatgcgcagcagaaacctggcggcagcgcaaaagatg

SEQ ID NO: 206581 - DNA, 103 bp, Artificial Sequence
  Synthetic Polynucleotide
taatacgactcactatagggtcggcgttgtgcaggtctggattctgctgcaacagaggagagcagcaatgtccagacctaacctggcggcagcgcaaaagatg

SEQ ID NO: 206582 - DNA, 103 bp, Artificial Sequence
  Synthetic Polynucleotide
taatacgactcactatagggcttgctcaactcggcgttgtgcaggtctggaacagaggagaccagacatgcacaacgccaacctggcggcagcgcaaaagatg

SEQ ID NO: 206583 - DNA, 103 bp, Artificial Sequence
  Synthetic Polynucleotide
taatacgactcactatagggtgcccagcatcttgctcaactcggcgttgtaacagaggagaacaacgatgagttgagcaaacctggcggcagcgcaaaagatg

SEQ ID NO: 206584 - DNA, 103 bp, Artificial Sequence
  Synthetic Polynucleotide
taatacgactcactatagggtgggtctggctctggtcgtcactggcgtataacagaggagaatacgcatgtgacgaccaaacctggcggcagcgcaaaagatg

SEQ ID NO: 206585 - DNA, 103 bp, Artificial Sequence
  Synthetic Polynucleotide
taatacgactcactatagggttccacgacttgcccagcatcttgctcaacaacagaggagagttgagatggatgctgggaacctggcggcagcgcaaaagatg

SEQ ID NO: 206586 - DNA, 103 bp, Artificial Sequence
  Synthetic Polynucleotide
taatacgactcactatagggcgtcagcgccttccacgacttgcccagcataacagaggagaatgctgatgaagtcgtggaacctggcggcagcgcaaaagatg

SEQ ID NO: 206587 - DNA, 103 bp, Artificial Sequence
  Synthetic Polynucleotide
taatacgactcactatagggtctccgccagcgtcagcgccttccacgactaacagaggagaagtcgtatgaggcgctgaaacctggcggcagcgcaaaagatg

SEQ ID NO: 206588 - DNA, 103 bp, Artificial Sequence
  Synthetic Polynucleotide
taatacgactcactatagggaagggccgcttctccgccagcgtcagcgccaacagaggagaggcgctatggctggcggaaacctggcggcagcgcaaaagatg

SEQ ID NO: 206589 - DNA, 103 bp, Artificial Sequence
  Synthetic Polynucleotide
taatacgactcactatagggctcctccacgaagggccgcttctccgccagaacagaggagactggcgatgaagcggcccaacctggcggcagcgcaaaagatg

SEQ ID NO: 206590 - DNA, 103 bp, Artificial Sequence
  Synthetic Polynucleotide
taatacgactcactataggggccgctctgcctcctccacgaagggccgctaacagaggagaagcggcatgtcgtggaggaacctggcggcagcgcaaaagatg

SEQ ID NO: 206591 - DNA, 103 bp, Artificial Sequence
  Synthetic Polynucleotide
taatacgactcactatagggtgcacgcgcagccgctctgcctcctccacgaacagaggagacgtggaatgggcagagcgaacctggcggcagcgcaaaagatg

SEQ ID NO: 206592 - DNA, 103 bp, Artificial Sequence
  Synthetic Polynucleotide
taatacgactcactatagggctgcatgtgctgcacgcgcagccgctctgcaacagaggagagcagagatgctgcgcgtgaacctggcggcagcgcaaaagatg

SEQ ID NO: 206593 - DNA, 103 bp, Artificial Sequence
  Synthetic Polynucleotide
taatacgactcactatagggtggggtggtcctgcatgtgctgcacgcgcaaacagaggagatgcgcgatgagcacatgcaacctggcggcagcgcaaaagatg

SEQ ID NO: 206594 - DNA, 103 bp, Artificial Sequence
  Synthetic Polynucleotide
taatacgactcactatagggtacttgtagttggggtggtcctgcatgtgcaacagaggagagcacatatgggaccacccaacctggcggcagcgcaaaagatg

SEQ ID NO: 206595 - DNA, 103 bp, Artificial Sequence
  Synthetic Polynucleotide
taatacgactcactatagggcagcgcgctctgggtctggctctggtcgtcaacagaggagagacgacatgagccagaccaacctggcggcagcgcaaaagatg

SEQ ID NO: 206596 - DNA, 103 bp, Artificial Sequence
  Synthetic Polynucleotide
taatacgactcactatagggccgcggccggtacttgtagttggggtggtcaacagaggagagaccacatgaactacaagaacctggcggcagcgcaaaagatg

SEQ ID NO: 206597 - DNA, 103 bp, Artificial Sequence
  Synthetic Polynucleotide
taatacgactcactataggggcttgcgccgccgcggccggtacttgtagtaacagaggagaactacaatgaccggccgcaacctggcggcagcgcaaaagatg

SEQ ID NO: 206598 - DNA, 103 bp, Artificial Sequence
  Synthetic Polynucleotide
taatacgactcactatagggcgcttcacctgcttgcgccgccgcggccggaacagaggagaccggccatggcggcgcaaaacctggcggcagcgcaaaagatg

SEQ ID NO: 206599 - DNA, 103 bp, Artificial Sequence
  Synthetic Polynucleotide
taatacgactcactatagggccgcttcagccgcttcacctgcttgcgccgaacagaggagacggcgcatgcaggtgaagaacctggcggcagcgcaaaagatg

SEQ ID NO: 206600 - DNA, 103 bp, Artificial Sequence
  Synthetic Polynucleotide
taatacgactcactatagggcgccctccacccgcttcagccgcttcacctaacagaggagaaggtgaatgggctgaagcaacctggcggcagcgcaaaagatg

SEQ ID NO: 206601 - DNA, 103 bp, Artificial Sequence
  Synthetic Polynucleotide
taatacgactcactatagggtgcaggaagccgccctccacccgcttcagcaacagaggagagctgaaatgggtggagggaacctggcggcagcgcaaaagatg

SEQ ID NO: 206602 - DNA, 103 bp, Artificial Sequence
  Synthetic Polynucleotide
taatacgactcactatagggagccaggccgtgcaggaagccgccctccacaacagaggagagtggagatgggcttcctgaacctggcggcagcgcaaaagatg

SEQ ID NO: 206603 - DNA, 103 bp, Artificial Sequence
  Synthetic Polynucleotide
taatacgactcactatagggcctgcggctcagccaggccgtgcaggaagcaacagaggagagcttccatgacggcctggaacctggcggcagcgcaaaagatg

SEQ ID NO: 206604 - DNA, 103 bp, Artificial Sequence
  Synthetic Polynucleotide
taatacgactcactatagggagcgcggccgcctgcggctcagccaggccgaacagaggagacggcctatgtgagccgcaaacctggcggcagcgcaaaagatg

SEQ ID NO: 206605 - DNA, 103 bp, Artificial Sequence
  Synthetic Polynucleotide
taatacgactcactatagggctcggggcccagcgcggccgcctgcggctcaacagaggagagagccgatggcggccgcgaacctggcggcagcgcaaaagatg

SEQ ID NO: 206606 - DNA, 103 bp, Artificial Sequence
  Synthetic Polynucleotide
taatacgactcactatagggtcaccgcgggcagcgcgctctgggtctggcaacagaggagagccagaatgagagcgcgcaacctggcggcagcgcaaaagatg

SEQ ID NO: 206607 - DNA, 103 bp, Artificial Sequence
  Synthetic Polynucleotide
taatacgactcactatagggcgcggccgccctcggggcccagcgcggccgaacagaggagacggccgatgtgggccccgaacctggcggcagcgcaaaagatg

SEQ ID NO: 206608 - DNA, 103 bp, Artificial Sequence
  Synthetic Polynucleotide
taatacgactcactatagggtccatggccacgcggccgccctcggggcccaacagaggagagggcccatggggcggccgaacctggcggcagcgcaaaagatg

SEQ ID NO: 206609 - DNA, 103 bp, Artificial Sequence
  Synthetic Polynucleotide
taatacgactcactataggggcccaggccgtccatggccacgcggccgccaacagaggagaggcggcatggtggccatgaacctggcggcagcgcaaaagatg

SEQ ID NO: 206610 - DNA, 103 bp, Artificial Sequence
  Synthetic Polynucleotide
taatacgactcactatagggggaactggaggcccaggccgtccatggccaaacagaggagatggccaatgacggcctggaacctggcggcagcgcaaaagatg

SEQ ID NO: 206611 - DNA, 103 bp, Artificial Sequence
  Synthetic Polynucleotide
taatacgactcactatagggccctgctcggggaactggaggcccaggccgaacagaggagacggcctatgcctccagttaacctggcggcagcgcaaaagatg

SEQ ID NO: 206612 - DNA, 103 bp, Artificial Sequence
  Synthetic Polynucleotide
taatacgactcactatagggggcggggaagccctgctcggggaactggagaacagaggagactccagatgcccgagcagaacctggcggcagcgcaaaagatg

SEQ ID NO: 206613 - DNA, 103 bp, Artificial Sequence
  Synthetic Polynucleotide
taatacgactcactataggggcggcgggccggcggggaagccctgctcggaacagaggagaccgagcatggcttccccgaacctggcggcagcgcaaaagatg

SEQ ID NO: 206614 - DNA, 103 bp, Artificial Sequence
  Synthetic Polynucleotide
taatacgactcactatagggggaggcagcagcggcgggccggcggggaagaacagaggagacttcccatgcggcccgccaacctggcggcagcgcaaaagatg

SEQ ID NO: 206615 - DNA, 103 bp, Artificial Sequence
  Synthetic Polynucleotide
taatacgactcactataggggcccatgtgcggaggcagcagcggcgggccaacagaggagaggcccgatgctgctgcctaacctggcggcagcgcaaaagatg

SEQ ID NO: 206616 - DNA, 103 bp, Artificial Sequence
  Synthetic Polynucleotide
taatacgactcactatagggggtagtggccgcccatgtgcggaggcagcaaacagaggagatgctgcatgcgcacatggaacctggcggcagcgcaaaagatg

SEQ ID NO: 206617 - DNA, 103 bp, Artificial Sequence
  Synthetic Polynucleotide
taatacgactcactatagggagcccggccatcaccgcgggcagcgcgctcaacagaggagagagcgcatggcccgcggtaacctggcggcagcgcaaaagatg

SEQ ID NO: 206618 - DNA, 103 bp, Artificial Sequence
  Synthetic Polynucleotide
taatacgactcactatagggtggcagtcgcggtagtggccgcccatgtgcaacagaggagagcacatatgcggccactaaacctggcggcagcgcaaaagatg

SEQ ID NO: 206619 - DNA, 103 bp, Artificial Sequence
  Synthetic Polynucleotide
taatacgactcactataggggcccagactctggcagtcgcggtagtggccaacagaggagaggccacatgcgcgactgcaacctggcggcagcgcaaaagatg

SEQ ID NO: 206620 - DNA, 103 bp, Artificial Sequence
  Synthetic Polynucleotide
taatacgactcactataggggcggaggcgcgcccagactctggcagtcgcaacagaggagagcgactatgagagtctggaacctggcggcagcgcaaaagatg

SEQ ID NO: 206621 - DNA, 103 bp, Artificial Sequence
  Synthetic Polynucleotide
taatacgactcactatagggtagccgtcgagcggaggcgcgcccagactcaacagaggagagagtctatgcgcgcctccaacctggcggcagcgcaaaagatg

SEQ ID NO: 206622 - DNA, 103 bp, Artificial Sequence
  Synthetic Polynucleotide
taatacgactcactataggggggcaacgggtagccgtcgagcggaggcgcaacagaggagagcgcctatgctcgacggcaacctggcggcagcgcaaaagatg

SEQ ID NO: 206623 - DNA, 103 bp, Artificial Sequence
  Synthetic Polynucleotide
taatacgactcactatagggtgtcgggcgtgggcaacgggtagccgtcgaaacagaggagatcgacgatgacccgttgcaacctggcggcagcgcaaaagatg

SEQ ID NO: 206624 - DNA, 103 bp, Artificial Sequence
  Synthetic Polynucleotide
taatacgactcactatagggagcggggacgtgtcgggcgtgggcaacgggaacagaggagacccgttatgcacgcccgaaacctggcggcagcgcaaaagatg

SEQ ID NO: 206625 - DNA, 103 bp, Artificial Sequence
  Synthetic Polynucleotide
taatacgactcactatagggcacgccgtccagcggggacgtgtcgggcgtaacagaggagaacgcccatgacgtccccgaacctggcggcagcgcaaaagatg

SEQ ID NO: 206626 - DNA, 103 bp, Artificial Sequence
  Synthetic Polynucleotide
taatacgactcactatagggggtcggggtccacgccgtccagcggggacgaacagaggagacgtcccatgtggacggcgaacctggcggcagcgcaaaagatg

SEQ ID NO: 206627 - DNA, 103 bp, Artificial Sequence
  Synthetic Polynucleotide
taatacgactcactatagggaagaaagccgggtcggggtccacgccgtccaacagaggagaggacggatgggaccccgaaacctggcggcagcgcaaaagatg

SEQ ID NO: 206628 - DNA, 103 bp, Artificial Sequence
  Synthetic Polynucleotide
taatacgactcactataggggcaggggcccagcccggccatcaccgcgggaacagaggagacccgcgatgatggccgggaacctggcggcagcgcaaaagatg

SEQ ID NO: 206629 - DNA, 103 bp, Artificial Sequence
  Synthetic Polynucleotide
taatacgactcactatagggcggggcggcgaagaaagccgggtcggggtcaacagaggagagaccccatgccggctttcaacctggcggcagcgcaaaagatg

SEQ ID NO: 206630 - DNA, 103 bp, Artificial Sequence
  Synthetic Polynucleotide
taatacgactcactatagggccccgggcatcggggcggcgaagaaagccgaacagaggagacggcttatgtcgccgcccaacctggcggcagcgcaaaagatg

SEQ ID NO: 206631 - DNA, 103 bp, Artificial Sequence
  Synthetic Polynucleotide
taatacgactcactataggggccgggcagtccccgggcatcggggcggcgaacagaggagacgccgcatggatgcccggaacctggcggcagcgcaaaagatg

SEQ ID NO: 206632 - DNA, 103 bp, Artificial Sequence
  Synthetic Polynucleotide
taatacgactcactatagggggtgccggccgccgggcagtccccgggcataacagaggagaatgcccatggactgcccgaacctggcggcagcgcaaaagatg

SEQ ID NO: 206633 - DNA, 103 bp, Artificial Sequence
  Synthetic Polynucleotide
taatacgactcactatagggcgtagctgtaggtgccggccgccgggcagtaacagaggagaactgccatgcggccggcaaacctggcggcagcgcaaaagatg

SEQ ID NO: 206634 - DNA, 103 bp, Artificial Sequence
  Synthetic Polynucleotide
taatacgactcactataggggagacctgcgcgtagctgtaggtgccggccaacagaggagaggccggatgctacagctaaacctggcggcagcgcaaaagatg

SEQ ID NO: 206635 - DNA, 103 bp, Artificial Sequence
  Synthetic Polynucleotide
taatacgactcactatagggagcgtagtccgagacctgcgcgtagctgtaaacagaggagatacagcatggcgcaggtcaacctggcggcagcgcaaaagatg

SEQ ID NO: 206636 - DNA, 103 bp, Artificial Sequence
  Synthetic Polynucleotide
taatacgactcactatagggccggggggccagcgtagtccgagacctgcgaacagaggagacgcaggatgcggactacgaacctggcggcagcgcaaaagatg

SEQ ID NO: 206637 - DNA, 103 bp, Artificial Sequence
  Synthetic Polynucleotide
taatacgactcactataggggcgggaggctccggggggccagcgtagtccaacagaggagaggactaatgtggccccccaacctggcggcagcgcaaaagatg

SEQ ID NO: 206638 - DNA, 103 bp, Artificial Sequence
  Synthetic Polynucleotide
taatacgactcactatagggcatgggaccggcgggaggctccggggggccaacagaggagaggccccatggagcctcccaacctggcggcagcgcaaaagatg

SEQ ID NO: 206639 - DNA, 103 bp, Artificial Sequence
  Synthetic Polynucleotide
taatacgactcactatagggcggcccaggggcaggggcccagcccggccaaacagaggagatggccgatgtgggcccctaacctggcggcagcgcaaaagatg

SEQ ID NO: 206640 - DNA, 103 bp, Artificial Sequence
  Synthetic Polynucleotide
taatacgactcactataggggtcgggggtgcatgggaccggcgggaggctaacagaggagaagcctcatgccggtcccaaacctggcggcagcgcaaaagatg

SEQ ID NO: 206641 - DNA, 103 bp, Artificial Sequence
  Synthetic Polynucleotide
taatacgactcactatagggtctgggccgagtcgggggtgcatgggaccgaacagaggagacggtccatggcacccccgaacctggcggcagcgcaaaagatg

SEQ ID NO: 206642 - DNA, 103 bp, Artificial Sequence
  Synthetic Polynucleotide
taatacgactcactatagggacccgcgggctctgggccgagtcgggggtgaacagaggagacaccccatgctcggcccaaacctggcggcagcgcaaaagatg

SEQ ID NO: 206643 - DNA, 103 bp, Artificial Sequence
  Synthetic Polynucleotide
taatacgactcactataggggaatcgagggacccgcgggctctgggccgaaacagaggagatcggccatgagcccgcggaacctggcggcagcgcaaaagatg

SEQ ID NO: 206644 - DNA, 103 bp, Artificial Sequence
  Synthetic Polynucleotide
taatacgactcactatagggaggaggcccggaatcgagggacccgcgggcaacagaggagagcccgcatgtccctcgataacctggcggcagcgcaaaagatg

SEQ ID NO: 206645 - DNA, 103 bp, Artificial Sequence
  Synthetic Polynucleotide
taatacgactcactataggggggtggcgccaggaggcccggaatcgagggaacagaggagaccctcgatgccgggcctcaacctggcggcagcgcaaaagatg

SEQ ID NO: 206646 - DNA, 103 bp, Artificial Sequence
  Synthetic Polynucleotide
taatacgactcactataggggaagggcgctgggtggcgccaggaggcccgaacagaggagacgggccatgtggcgccacaacctggcggcagcgcaaaagatg

SEQ ID NO: 206647 - DNA, 103 bp, Artificial Sequence
  Synthetic Polynucleotide
taatacgactcactatagggtagtacacgtgaagggcgctgggtggcgccaacagaggagaggcgccatgcagcgccctaacctggcggcagcgcaaaagatg

SEQ ID NO: 206648 - DNA, 103 bp, Artificial Sequence
  Synthetic Polynucleotide
taatacgactcactatagggcatcgcgccgtagtacacgtgaagggcgctaacagaggagaagcgccatgcacgtgtacaacctggcggcagcgcaaaagatg

SEQ ID NO: 206649 - DNA, 103 bp, Artificial Sequence
  Synthetic Polynucleotide
taatacgactcactatagggcgggcgagcccatcgcgccgtagtacacgtaacagaggagaacgtgtatgacggcgcgaaacctggcggcagcgcaaaagatg

SEQ ID NO: 206650 - DNA, 103 bp, Artificial Sequence
  Synthetic Polynucleotide
taatacgactcactatagggctcagcgactcggcccaggggcaggggcccaacagaggagagggcccatgcccctgggcaacctggcggcagcgcaaaagatg

SEQ ID NO: 206651 - DNA, 103 bp, Artificial Sequence
  Synthetic Polynucleotide
taatacgactcactatagggccgcccgccccgggcgagcccatcgcgccgaacagaggagacggcgcatggggctcgccaacctggcggcagcgcaaaagatg

SEQ ID NO: 206652 - DNA, 103 bp, Artificial Sequence
  Synthetic Polynucleotide
taatacgactcactataggggccgcgcccgccgcccgccccgggcgagccaacagaggagaggctcgatgggggcgggcaacctggcggcagcgcaaaagatg

SEQ ID NO: 206653 - DNA, 103 bp, Artificial Sequence
  Synthetic Polynucleotide
taatacgactcactataggggcatctggaagccgcgcccgccgcccgcccaacagaggagagggcggatggcgggcgcgaacctggcggcagcgcaaaagatg

SEQ ID NO: 206654 - DNA, 103 bp, Artificial Sequence
  Synthetic Polynucleotide
taatacgactcactatagggtgttgcggctgcatctggaagccgcgcccgaacagaggagacgggcgatgcttccagataacctggcggcagcgcaaaagatg

SEQ ID NO: 206655 - DNA, 103 bp, Artificial Sequence
  Synthetic Polynucleotide
taatacgactcactatagggctggtgctggtgttgcggctgcatctggaaaacagaggagattccagatgcagccgcaaaacctggcggcagcgcaaaagatg

SEQ ID NO: 206656 - DNA, 103 bp, Artificial Sequence
  Synthetic Polynucleotide
taatacgactcactatagggggtgctggtgctggtgctggtgttgcggctaacagaggagaagccgcatgaccagcaccaacctggcggcagcgcaaaagatg

SEQ ID NO: 206657 - DNA, 103 bp, Artificial Sequence
  Synthetic Polynucleotide
taatacgactcactataggggggtggtgctggtgctggtgctggtgctggaacagaggagaccagcaatggcaccagcaaacctggcggcagcgcaaaagatg

SEQ ID NO: 206658 - DNA, 103 bp, Artificial Sequence
  Synthetic Polynucleotide
taatacgactcactatagggggggcccggggggtggtgctggtgctggtgaacagaggagacaccagatgcagcaccacaacctggcggcagcgcaaaagatg

SEQ ID NO: 206659 - DNA, 103 bp, Artificial Sequence
  Synthetic Polynucleotide
taatacgactcactatagggacggctgtccggggcccggggggtggtgctaacagaggagaagcaccatgccccgggccaacctggcggcagcgcaaaagatg

SEQ ID NO: 206660 - DNA, 103 bp, Artificial Sequence
  Synthetic Polynucleotide
taatacgactcactatagggggagggggcgacggctgtccggggcccgggaacagaggagacccgggatgcggacagccaacctggcggcagcgcaaaagatg

SEQ ID NO: 206661 - DNA, 103 bp, Artificial Sequence
  Synthetic Polynucleotide
taatacgactcactatagggtgcgccgtagccgggcggcgatctctgcataacagaggagaatgcagatgtcgccgcccaacctggcggcagcgcaaaagatg

SEQ ID NO: 206662 - DNA, 103 bp, Artificial Sequence
  Synthetic Polynucleotide
taatacgactcactatagggggcggggccggcggcgaggccgcgcgtgtcaacagaggagagacacgatgggcctcgccaacctggcggcagcgcaaaagatg

SEQ ID NO: 206663 - DNA, 103 bp, Artificial Sequence
  Synthetic Polynucleotide
taatacgactcactatagggggcgtcgggccgagtccggctgcagttgagaacagaggagactcaacatgagccggactaacctggcggcagcgcaaaagatg

SEQ ID NO: 206664 - DNA, 103 bp, Artificial Sequence
  Synthetic Polynucleotide
taatacgactcactatagggggagcccgggggcgtcgggccgagtccggcaacagaggagagccggaatgggcccgacgaacctggcggcagcgcaaaagatg

SEQ ID NO: 206665 - DNA, 103 bp, Artificial Sequence
  Synthetic Polynucleotide
taatacgactcactatagggacgtggtacgggagcccgggggcgtcgggcaacagaggagagcccgaatgccccgggctaacctggcggcagcgcaaaagatg

SEQ ID NO: 206666 - DNA, 103 bp, Artificial Sequence
  Synthetic Polynucleotide
taatacgactcactatagggggccagtgccacgtggtacgggagcccgggaacagaggagacccgggatgccgtaccacaacctggcggcagcgcaaaagatg

SEQ ID NO: 206667 - DNA, 103 bp, Artificial Sequence
  Synthetic Polynucleotide
taatacgactcactatagggggcccagtttggccagtgccacgtggtacgaacagaggagacgtaccatgtggcactggaacctggcggcagcgcaaaagatg

SEQ ID NO: 206668 - DNA, 103 bp, Artificial Sequence
  Synthetic Polynucleotide
taatacgactcactatagggatggcgcgcgggcccagtttggccagtgccaacagaggagaggcactatgcaaactgggaacctggcggcagcgcaaaagatg

SEQ ID NO: 206669 - DNA, 103 bp, Artificial Sequence
  Synthetic Polynucleotide
taatacgactcactatagggtgggcaggacatggcgcgcgggcccagtttaacagaggagaaaactgatgccgcgcgccaacctggcggcagcgcaaaagatg

SEQ ID NO: 206670 - DNA, 103 bp, Artificial Sequence
  Synthetic Polynucleotide
taatacgactcactatagggtgctctcctctgggcaggacatggcgcgcgaacagaggagacgcgcgatgtgtcctgccaacctggcggcagcgcaaaagatg

SEQ ID NO: 206671 - DNA, 103 bp, Artificial Sequence
  Synthetic Polynucleotide
taatacgactcactataggggagatcaggctgctctcctctgggcaggacaacagaggagagtcctgatgagaggagagaacctggcggcagcgcaaaagatg

SEQ ID NO: 206672 - DNA, 103 bp, Artificial Sequence
  Synthetic Polynucleotide
taatacgactcactatagggcgacagcgcggagatcaggctgctctcctcaacagaggagagaggagatgagcctgatcaacctggcggcagcgcaaaagatg

SEQ ID NO: 206673 - DNA, 103 bp, Artificial Sequence
  Synthetic Polynucleotide
taatacgactcactatagggcggcgagggcggcggggccggcggcgaggcaacagaggagagcctcgatgccggccccgaacctggcggcagcgcaaaagatg

SEQ ID NO: 206674 - DNA, 103 bp, Artificial Sequence
  Synthetic Polynucleotide
taatacgactcactatagggtgctggcgtccgacagcgcggagatcaggcaacagaggagagcctgaatgccgcgctgtaacctggcggcagcgcaaaagatg

SEQ ID NO: 206675 - DNA, 103 bp, Artificial Sequence
  Synthetic Polynucleotide
taatacgactcactatagggtagaccgcgctgctggcgtccgacagcgcgaacagaggagacgcgctatgggacgccagaacctggcggcagcgcaaaagatg

SEQ ID NO: 206676 - DNA, 103 bp, Artificial Sequence
  Synthetic Polynucleotide
taatacgactcactatagggcgcgctgtaatagaccgcgctgctggcgtcaacagaggagagacgccatgagcgcggtcaacctggcggcagcgcaaaagatg

SEQ ID NO: 206677 - DNA, 103 bp, Artificial Sequence
  Synthetic Polynucleotide
taatacgactcactatagggcggagatgcacgcgctgtaatagaccgcgcaacagaggagagcgcggatgattacagcgaacctggcggcagcgcaaaagatg

SEQ ID NO: 206678 - DNA, 103 bp, Artificial Sequence
  Synthetic Polynucleotide
taatacgactcactataggggcggcgggcgcggcgagggcggcggggccgaacagaggagacggcccatgcgccctcgcaacctggcggcagcgcaaaagatg

SEQ ID NO: 206679 - DNA, 103 bp, Artificial Sequence
  Synthetic Polynucleotide
taatacgactcactatagggcgaggcgggcgcggcgggcgcggcgagggcaacagaggagagccctcatggcgcccgccaacctggcggcagcgcaaaagatg

SEQ ID NO: 206680 - DNA, 103 bp, Artificial Sequence
  Synthetic Polynucleotide
taatacgactcactatagggggctgggcggcgaggcgggcgcggcgggcgaacagaggagacgcccgatgcgcccgcctaacctggcggcagcgcaaaagatg

SEQ ID NO: 206681 - DNA, 103 bp, Artificial Sequence
  Synthetic Polynucleotide
taatacgactcactatagggctgcgctgcgggctgggcggcgaggcgggcaacagaggagagcccgcatggccgcccagaacctggcggcagcgcaaaagatg

SEQ ID NO: 206682 - DNA, 103 bp, Artificial Sequence
  Synthetic Polynucleotide
taatacgactcactataggggcgcgggggactgcgctgcgggctgggcggaacagaggagaccgcccatgccgcagcgcaacctggcggcagcgcaaaagatg

SEQ ID NO: 206683 - DNA, 103 bp, Artificial Sequence
  Synthetic Polynucleotide
taatacgactcactataggggctcggggctgcgcgggggactgcgctgcgaacagaggagacgcagcatggtcccccgcaacctggcggcagcgcaaaagatg

SEQ ID NO: 206684 - DNA, 103 bp, Artificial Sequence
  Synthetic Polynucleotide
taatacgactcactatagggtagcgccccggctcggggctgcgcgggggaaacagaggagatcccccatgcagccccgaaacctggcggcagcgcaaaagatg

SEQ ID NO: 206685 - DNA, 103 bp, Artificial Sequence
  Synthetic Polynucleotide
taatacgactcactataggggctgaggccatagcgccccggctcggggctaacagaggagaagccccatgccggggcgcaacctggcggcagcgcaaaagatg

SEQ ID NO: 206686 - DNA, 103 bp, Artificial Sequence
  Synthetic Polynucleotide
taatacgactcactatagggggtcgtcctgtgcgccgtagccgggcggcgaacagaggagacgccgcatggctacggcgaacctggcggcagcgcaaaagatg

SEQ ID NO: 206687 - DNA, 103 bp, Artificial Sequence
  Synthetic Polynucleotide
taatacgactcactatagggggccggccgggctgaggccatagcgccccgaacagaggagacggggcatgatggcctcaaacctggcggcagcgcaaaagatg

SEQ ID NO: 206688 - DNA, 103 bp, Artificial Sequence
  Synthetic Polynucleotide
taatacgactcactatagggcgttccccgcggccggccgggctgaggccaaacagaggagatggcctatgcccggccggaacctggcggcagcgcaaaagatg

SEQ ID NO: 206689 - DNA, 103 bp, Artificial Sequence
  Synthetic Polynucleotide
taatacgactcactatagggtgccgcctggcgttccccgcggccggccggaacagaggagaccggccatgcgcggggaaaacctggcggcagcgcaaaagatg

SEQ ID NO: 206690 - DNA, 103 bp, Artificial Sequence
  Synthetic Polynucleotide
taatacgactcactataggggcgactcgtctgccgcctggcgttccccgcaacagaggagagcggggatggccaggcggaacctggcggcagcgcaaaagatg

SEQ ID NO: 206691 - DNA, 103 bp, Artificial Sequence
  Synthetic Polynucleotide
taatacgactcactatagggcgccggatgcgcgactcgtctgccgcctggaacagaggagaccaggcatgagacgagtcaacctggcggcagcgcaaaagatg

SEQ ID NO: 206692 - DNA, 103 bp, Artificial Sequence
  Synthetic Polynucleotide
taatacgactcactataggggttcatgggccgccggatgcgcgactcgtcaacagaggagagacgagatgcgcatccggaacctggcggcagcgcaaaagatg

SEQ ID NO: 206693 - DNA, 103 bp, Artificial Sequence
  Synthetic Polynucleotide
taatacgactcactatagggccatgaaggcgttcatgggccgccggatgcaacagaggagagcatccatgggcccatgaaacctggcggcagcgcaaaagatg

SEQ ID NO: 206694 - DNA, 103 bp, Artificial Sequence
  Synthetic Polynucleotide
taatacgactcactatagggtttgcccacaccatgaaggcgttcatgggcaacagaggagagcccatatgcgccttcataacctggcggcagcgcaaaagatg

SEQ ID NO: 206695 - DNA, 103 bp, Artificial Sequence
  Synthetic Polynucleotide
taatacgactcactataggggcgctcgtcctttgcccacaccatgaaggcaacagaggagagccttcatggtgtgggcaaacctggcggcagcgcaaaagatg

SEQ ID NO: 206696 - DNA, 103 bp, Artificial Sequence
  Synthetic Polynucleotide
taatacgactcactatagggccagccgcttgcgctcgtcctttgcccacaaacagaggagatgtgggatgaggacgagcaacctggcggcagcgcaaaagatg

SEQ ID NO: 206697 - DNA, 103 bp, Artificial Sequence
  Synthetic Polynucleotide
taatacgactcactatagggcgggcgggcgggtcgtcctgtgcgccgtagaacagaggagactacggatgacaggacgaaacctggcggcagcgcaaaagatg

SEQ ID NO: 206698 - DNA, 103 bp, Artificial Sequence
  Synthetic Polynucleotide
taatacgactcactatagggttctgctgagccagccgcttgcgctcgtccaacagaggagaggacgaatgcaagcggctaacctggcggcagcgcaaaagatg

SEQ ID NO: 206699 - DNA, 103 bp, Artificial Sequence
  Synthetic Polynucleotide
taatacgactcactatagggcaggtccgggttctgctgagccagccgcttaacagaggagaaagcggatggctcagcagaacctggcggcagcgcaaaagatg

SEQ ID NO: 206700 - DNA, 103 bp, Artificial Sequence
  Synthetic Polynucleotide
taatacgactcactatagggccgcgttgtgcaggtccgggttctgctgagaacagaggagactcagcatgacccggaccaacctggcggcagcgcaaaagatg

SEQ ID NO: 206701 - DNA, 103 bp, Artificial Sequence
  Synthetic Polynucleotide
taatacgactcactatagggttgctgagcaccgcgttgtgcaggtccgggaacagaggagacccggaatggcacaacgcaacctggcggcagcgcaaaagatg

SEQ ID NO: 206702 - DNA, 103 bp, Artificial Sequence
  Synthetic Polynucleotide
taatacgactcactataggggcccagcatcttgctgagcaccgcgttgtgaacagaggagacacaacatggtgctcagcaacctggcggcagcgcaaaagatg

SEQ ID NO: 206703 - DNA, 103 bp, Artificial Sequence
  Synthetic Polynucleotide
taatacgactcactatagggtccacgctttgcccagcatcttgctgagcaaacagaggagatgctcaatgagatgctggaacctggcggcagcgcaaaagatg

SEQ ID NO: 206704 - DNA, 103 bp, Artificial Sequence
  Synthetic Polynucleotide
taatacgactcactatagggttcagctccttccacgctttgcccagcatcaacagaggagagatgctatgcaaagcgtgaacctggcggcagcgcaaaagatg

SEQ ID NO: 206705 - DNA, 103 bp, Artificial Sequence
  Synthetic Polynucleotide
taatacgactcactatagggctccgccgcgttcagctccttccacgctttaacagaggagaaaagcgatgaaggagctgaacctggcggcagcgcaaaagatg

SEQ ID NO: 206706 - DNA, 103 bp, Artificial Sequence
  Synthetic Polynucleotide
taatacgactcactatagggagggccgcttctccgccgcgttcagctcctaacagaggagaaggagcatgacgcggcggaacctggcggcagcgcaaaagatg

SEQ ID NO: 206707 - DNA, 103 bp, Artificial Sequence
  Synthetic Polynucleotide
taatacgactcactatagggtcctccacgaagggccgcttctccgccgcgaacagaggagacgcggcatggaagcggccaacctggcggcagcgcaaaagatg

SEQ ID NO: 206708 - DNA, 103 bp, Artificial Sequence
  Synthetic Polynucleotide
taatacgactcactatagggacagtcgcggcgggcgggcgggtcgtcctgaacagaggagacaggacatgccgcccgccaacctggcggcagcgcaaaagatg

SEQ ID NO: 206709 - DNA, 103 bp, Artificial Sequence
  Synthetic Polynucleotide
taatacgactcactatagggccgttcggcttcctccacgaagggccgcttaacagaggagaaagcggatgttcgtggagaacctggcggcagcgcaaaagatg

SEQ ID NO: 206710 - DNA, 103 bp, Artificial Sequence
  Synthetic Polynucleotide
taatacgactcactataggggcacgcgcagccgttcggcttcctccacgaaacagaggagatcgtggatgaagccgaacaacctggcggcagcgcaaaagatg

SEQ ID NO: 206711 - DNA, 103 bp, Artificial Sequence
  Synthetic Polynucleotide
taatacgactcactatagggcgcaagtgctgcacgcgcagccgttcggctaacagaggagaagccgaatggctgcgcgtaacctggcggcagcgcaaaagatg

SEQ ID NO: 206712 - DNA, 103 bp, Artificial Sequence
  Synthetic Polynucleotide
taatacgactcactatagggggggtggtcgcgcaagtgctgcacgcgcagaacagaggagactgcgcatgcagcacttgaacctggcggcagcgcaaaagatg

SEQ ID NO: 206713 - DNA, 103 bp, Artificial Sequence
  Synthetic Polynucleotide
taatacgactcactatagggacttgtagttggggtggtcgcgcaagtgctaacagaggagaagcactatggcgaccaccaacctggcggcagcgcaaaagatg

SEQ ID NO: 206714 - DNA, 103 bp, Artificial Sequence
  Synthetic Polynucleotide
taatacgactcactatagggcgcggccggtacttgtagttggggtggtcgaacagaggagacgaccaatgcaactacaaaacctggcggcagcgcaaaagatg

SEQ ID NO: 206715 - DNA, 103 bp, Artificial Sequence
  Synthetic Polynucleotide
taatacgactcactatagggcttcttgcggcgcggccggtacttgtagttaacagaggagaaactacatgtaccggccgaacctggcggcagcgcaaaagatg

SEQ ID NO: 206716 - DNA, 103 bp, Artificial Sequence
  Synthetic Polynucleotide
taatacgactcactatagggtgcgcgcctgcttcttgcggcgcggccggtaacagaggagaaccggcatggccgcaagaaacctggcggcagcgcaaaagatg

SEQ ID NO: 206717 - DNA, 103 bp, Artificial Sequence
  Synthetic Polynucleotide
taatacgactcactatagggcgccgggccttgcgcgcctgcttcttgcggaacagaggagaccgcaaatggcaggcgcgaacctggcggcagcgcaaaagatg

SEQ ID NO: 206718 - DNA, 103 bp, Artificial Sequence
  Synthetic Polynucleotide
taatacgactcactataggggggctccagccgccgggccttgcgcgcctgaacagaggagacaggcgatgaaggcccggaacctggcggcagcgcaaaagatg

SEQ ID NO: 206719 - DNA, 103 bp, Artificial Sequence
  Synthetic Polynucleotide
taatacgactcactataggggggcccatgcacagtcgcggcgggcgggcgaacagaggagacgcccgatggccgcgactaacctggcggcagcgcaaaagatg

SEQ ID NO: 206720 - DNA, 103 bp, Artificial Sequence
  Synthetic Polynucleotide
taatacgactcactataggggcaggaggccgggctccagccgccgggcctaacagaggagaaggcccatgggctggagcaacctggcggcagcgcaaaagatg

SEQ ID NO: 206721 - DNA, 103 bp, Artificial Sequence
  Synthetic Polynucleotide
taatacgactcactatagggaatcccgggagcaggaggccgggctccagcaacagaggagagctggaatgcggcctcctaacctggcggcagcgcaaaagatg

SEQ ID NO: 206722 - DNA, 103 bp, Artificial Sequence
  Synthetic Polynucleotide
taatacgactcactatagggcgggggcgctaatcccgggagcaggaggccaacagaggagaggcctcatgctcccgggaaacctggcggcagcgcaaaagatg

SEQ ID NO: 206723 - DNA, 103 bp, Artificial Sequence
  Synthetic Polynucleotide
taatacgactcactataggggcggtggctgcgggggcgctaatcccgggaaacagaggagatcccggatgtagcgccccaacctggcggcagcgcaaaagatg

SEQ ID NO: 206724 - DNA, 103 bp, Artificial Sequence
  Synthetic Polynucleotide
taatacgactcactatagggaaaggctcgggcggtggctgcgggggcgctaacagaggagaagcgccatggcagccaccaacctggcggcagcgcaaaagatg

SEQ ID NO: 206725 - DNA, 103 bp, Artificial Sequence
  Synthetic Polynucleotide
taatacgactcactatagggcgccgcggggaaaggctcgggcggtggctgaacagaggagacagccaatgcccgagcctaacctggcggcagcgcaaaagatg

SEQ ID NO: 206726 - DNA, 103 bp, Artificial Sequence
  Synthetic Polynucleotide
taatacgactcactatagggccgagccagacgccgcggggaaaggctcggaacagaggagaccgagcatgtccccgcggaacctggcggcagcgcaaaagatg

SEQ ID NO: 206727 - DNA, 103 bp, Artificial Sequence
  Synthetic Polynucleotide
taatacgactcactatagggaaggcgcgagccgagccagacgccgcggggaacagaggagaccccgcatggtctggctcaacctggcggcagcgcaaaagatg

SEQ ID NO: 206728 - DNA, 103 bp, Artificial Sequence
  Synthetic Polynucleotide
taatacgactcactatagggcagctcgcggaaggcgcgagccgagccagaaacagaggagatctggcatggctcgcgccaacctggcggcagcgcaaaagatg

SEQ ID NO: 206729 - DNA, 103 bp, Artificial Sequence
  Synthetic Polynucleotide
taatacgactcactatagggccagcgggggcagctcgcggaaggcgcgagaacagaggagactcgcgatgtccgcgagcaacctggcggcagcgcaaaagatg

SEQ ID NO: 206730 - DNA, 103 bp, Artificial Sequence
  Synthetic Polynucleotide
taatacgactcactatagggccgtgtcccggggcccatgcacagtcgcggaacagaggagaccgcgaatgtgcatgggcaacctggcggcagcgcaaaagatg

SEQ ID NO: 206731 - DNA, 103 bp, Artificial Sequence
  Synthetic Polynucleotide
taatacgactcactatagggaactcggcgcccagcgggggcagctcgcggaacagaggagaccgcgaatggcccccgctaacctggcggcagcgcaaaagatg

SEQ ID NO: 206732 - DNA, 103 bp, Artificial Sequence
  Synthetic Polynucleotide
taatacgactcactatagggcaggccgtcgaactcggcgcccagcgggggaacagaggagacccccgatgggcgccgagaacctggcggcagcgcaaaagatg

SEQ ID NO: 206733 - DNA, 103 bp, Artificial Sequence
  Synthetic Polynucleotide
taatacgactcactatagggtgggcagccccaggccgtcgaactcggcgcaacagaggagagcgccgatgtcgacggccaacctggcggcagcgcaaaagatg

SEQ ID NO: 206734 - DNA, 103 bp, Artificial Sequence
  Synthetic Polynucleotide
taatacgactcactatagggcgctcgggcgtgggcagccccaggccgtcgaacagaggagacgacggatgggggctgccaacctggcggcagcgcaaaagatg

SEQ ID NO: 206735 - DNA, 103 bp, Artificial Sequence
  Synthetic Polynucleotide
taatacgactcactatagggcagaggcgagcgctcgggcgtgggcagcccaacagaggagagggctgatgacgcccgagaacctggcggcagcgcaaaagatg

SEQ ID NO: 206736 - DNA, 103 bp, Artificial Sequence
  Synthetic Polynucleotide
taatacgactcactatagggccaggccgtccagaggcgagcgctcgggcgaacagaggagacgcccgatggctcgcctcaacctggcggcagcgcaaaagatg

SEQ ID NO: 206737 - DNA, 103 bp, Artificial Sequence
  Synthetic Polynucleotide
taatacgactcactatagggtcgccgggctccaggccgtccagaggcgagaacagaggagactcgccatgggacggcctaacctggcggcagcgcaaaagatg

SEQ ID NO: 206738 - DNA, 103 bp, Artificial Sequence
  Synthetic Polynucleotide
taatacgactcactataggggaaggcagcctcgccgggctccaggccgtcaacagaggagagacggcatggagcccggcaacctggcggcagcgcaaaagatg

SEQ ID NO: 206739 - DNA, 103 bp, Artificial Sequence
  Synthetic Polynucleotide
taatacgactcactataggggcggtgggaagaaggcagcctcgccgggctaacagaggagaagcccgatgaggctgcctaacctggcggcagcgcaaaagatg

SEQ ID NO: 206740 - DNA, 103 bp, Artificial Sequence
  Synthetic Polynucleotide
taatacgactcactatagggggcgccgcgggcggtgggaagaaggcagccaacagaggagaggctgcatgcttcccaccaacctggcggcagcgcaaaagatg

SEQ ID NO: 206741 - DNA, 103 bp, Artificial Sequence
  Synthetic Polynucleotide
taatacgactcactatagggagcggcggccccgtgtcccggggcccatgcaacagaggagagcatggatgccgggacacaacctggcggcagcgcaaaagatg

SEQ ID NO: 206742 - DNA, 103 bp, Artificial Sequence
  Synthetic Polynucleotide
taatacgactcactataggggcagtcctcgggcgccgcgggcggtgggaaaacagaggagattcccaatgcccgcggcgaacctggcggcagcgcaaaagatg

SEQ ID NO: 206743 - DNA, 103 bp, Artificial Sequence
  Synthetic Polynucleotide
taatacgactcactataggggccgcagcgcgcagtcctcgggcgccgcggaacagaggagaccgcggatgccgaggactaacctggcggcagcgcaaaagatg

SEQ ID NO: 206744 - DNA, 103 bp, Artificial Sequence
  Synthetic Polynucleotide
taatacgactcactataggggcgcggaagggccgcagcgcgcagtcctcgaacagaggagacgaggaatgcgcgctgcgaacctggcggcagcgcaaaagatg

SEQ ID NO: 206745 - DNA, 103 bp, Artificial Sequence
  Synthetic Polynucleotide
taatacgactcactatagggcgcgtagggcgcgcggaagggccgcagcgcaacagaggagagcgctgatgcccttccgcaacctggcggcagcgcaaaagatg

SEQ ID NO: 206746 - DNA, 103 bp, Artificial Sequence
  Synthetic Polynucleotide
taatacgactcactatagggactcggtgggcgcgtagggcgcgcggaaggaacagaggagaccttccatgcgccctacgaacctggcggcagcgcaaaagatg

SEQ ID NO: 206747 - DNA, 103 bp, Artificial Sequence
  Synthetic Polynucleotide
taatacgactcactatagggtcccgcgacaactcggtgggcgcgtagggcaacagaggagagccctaatggcccaccgaaacctggcggcagcgcaaaagatg

SEQ ID NO: 206748 - DNA, 103 bp, Artificial Sequence
  Synthetic Polynucleotide
taatacgactcactatagggaccgccggggtcccgcgacaactcggtgggaacagaggagacccaccatgttgtcgcggaacctggcggcagcgcaaaagatg

SEQ ID NO: 206749 - DNA, 103 bp, Artificial Sequence
  Synthetic Polynucleotide
taatacgactcactatagggccccgtagcaaccgccggggtcccgcgacaaacagaggagatgtcgcatgaccccggcgaacctggcggcagcgcaaaagatg

SEQ ID NO: 206750 - DNA, 103 bp, Artificial Sequence
  Synthetic Polynucleotide
taatacgactcactataggggccaggggagccccgtagcaaccgccggggaacagaggagaccccggatgttgctacggaacctggcggcagcgcaaaagatg

SEQ ID NO: 206751 - DNA, 103 bp, Artificial Sequence
  Synthetic Polynucleotide
taatacgactcactataggggagcgcctccgccaggggagccccgtagcaaacagaggagatgctacatggctcccctgaacctggcggcagcgcaaaagatg

SEQ ID NO: 206752 - DNA, 103 bp, Artificial Sequence
  Synthetic Polynucleotide
taatacgactcactatagggcgcgcgtgtcagcggcggccccgtgtcccgaacagaggagacgggacatggggccgccgaacctggcggcagcgcaaaagatg

SEQ ID NO: 206753 - DNA, 103 bp, Artificial Sequence
  Synthetic Polynucleotide
taatacgactcactataggggcgcggtcctgagcgcctccgccaggggagaacagaggagactccccatgcggaggcgcaacctggcggcagcgcaaaagatg

SEQ ID NO: 206754 - DNA, 103 bp, Artificial Sequence
  Synthetic Polynucleotide
taatacgactcactataggggccgcggggggcgcggtcctgagcgcctccaacagaggagaggaggcatgcaggaccgcaacctggcggcagcgcaaaagatg

SEQ ID NO: 206755 - DNA, 103 bp, Artificial Sequence
  Synthetic Polynucleotide
taatacgactcactatagggagcgagcggcgccgcggggggcgcggtcctaacagaggagaaggaccatgccccccgcgaacctggcggcagcgcaaaagatg

SEQ ID NO: 206756 - DNA, 103 bp, Artificial Sequence
  Synthetic Polynucleotide
taatacgactcactatagggagtacaggccagcgagcggcgccgcgggggaacagaggagacccccgatgcgccgctcgaacctggcggcagcgcaaaagatg

SEQ ID NO: 206757 - DNA, 103 bp, Artificial Sequence
  Synthetic Polynucleotide
taatacgactcactatagggagggtgccgtagtacaggccagcgagcggcaacagaggagagccgctatgtggcctgtaaacctggcggcagcgcaaaagatg

SEQ ID NO: 206758 - DNA, 103 bp, Artificial Sequence
  Synthetic Polynucleotide
taatacgactcactataggggggcgtgcccagggtgccgtagtacaggccaacagaggagaggcctgatgtacggcaccaacctggcggcagcgcaaaagatg

SEQ ID NO: 206759 - DNA, 103 bp, Artificial Sequence
  Synthetic Polynucleotide
taatacgactcactatagggggtacgggccgggcgtgcccagggtgccgtaacagaggagaacggcaatgtgggcacgcaacctggcggcagcgcaaaagatg

SEQ ID NO: 206760 - DNA, 103 bp, Artificial Sequence
  Synthetic Polynucleotide
taatacgactcactatagggagcgggccggggtacgggccgggcgtgcccaacagaggagagggcacatgcggcccgtaaacctggcggcagcgcaaaagatg

SEQ ID NO: 206761 - DNA, 103 bp, Artificial Sequence
  Synthetic Polynucleotide
taatacgactcactatagggcggcggcgacagcgggccggggtacgggccaacagaggagaggcccgatgcccggcccgaacctggcggcagcgcaaaagatg

SEQ ID NO: 206762 - DNA, 103 bp, Artificial Sequence
  Synthetic Polynucleotide
taatacgactcactataggggggcctcgggcggcggcgacagcgggccggaacagaggagaccggccatgtgtcgccgcaacctggcggcagcgcaaaagatg

SEQ ID NO: 206763 - DNA, 103 bp, Artificial Sequence
  Synthetic Polynucleotide
taatacgactcactataggggcggcgaggccgcgcgtgtcagcggcggccaacagaggagaggccgcatgtgacacgcgaacctggcggcagcgcaaaagatg

SEQ ID NO: 206764 - DNA, 103 bp, Artificial Sequence
  Synthetic Polynucleotide
taatacgactcactatagggtccagcggcggggcctcgggcggcggcgacaacagaggagagtcgccatggcccgaggcaacctggcggcagcgcaaaagatg

SEQ ID NO: 206765 - DNA, 103 bp, Artificial Sequence
  Synthetic Polynucleotide
taatacgactcactatagggctcggcgctctccagcggcggggcctcgggaacagaggagacccgagatgccgccgctgaacctggcggcagcgcaaaagatg

SEQ ID NO: 206766 - DNA, 103 bp, Artificial Sequence
  Synthetic Polynucleotide
taatacgactcactataggggccccagcggctcggcgctctccagcggcgaacagaggagacgccgcatgagagcgccgaacctggcggcagcgcaaaagatg

SEQ ID NO: 206767 - DNA, 103 bp, Artificial Sequence
  Synthetic Polynucleotide
taatacgactcactatagggtcggcggcgggccccagcggctcggcgctcaacagaggagagagcgcatggccgctgggaacctggcggcagcgcaaaagatg

SEQ ID NO: 206768 - DNA, 103 bp, Artificial Sequence
  Synthetic Polynucleotide
taatacgactcactatagggggcccacagatcggcggcgggccccagcggaacagaggagaccgctgatgcccgccgccaacctggcggcagcgcaaaagatg

SEQ ID NO: 206769 - DNA, 103 bp, Artificial Sequence
  Synthetic Polynucleotide
taatacgactcactatagggggtccacgtcggcccacagatcggcggcggaacagaggagaccgccgatgatctgtgggaacctggcggcagcgcaaaagatg

SEQ ID NO: 206770 - DNA, 103 bp, Artificial Sequence
  Synthetic Polynucleotide
taatacgactcactatagggaactcggtgaggtccacgtcggcccacagaaacagaggagatctgtgatgcgacgtggaaacctggcggcagcgcaaaagatg

SEQ ID NO: 206771 - DNA, 103 bp, Artificial Sequence
  Synthetic Polynucleotide
taatacgactcactataggggtactggtcgaactcggtgaggtccacgtcaacagaggagagacgtgatgctcaccgagaacctggcggcagcgcaaaagatg

SEQ ID NO: 206772 - DNA, 103 bp, Artificial Sequence
  Synthetic Polynucleotide
taatacgactcactatagggtgcagttgaggtactggtcgaactcggtgaaacagaggagatcaccgatgtcgaccagtaacctggcggcagcgcaaaagatg

SEQ ID NO: 206773 - DNA, 103 bp, Artificial Sequence
  Synthetic Polynucleotide
taatacgactcactatagggcgagtccggctgcagttgaggtactggtcgaacagaggagacgaccaatgcctcaactgaacctggcggcagcgcaaaagatg

SEQ ID NO: 206774 - DNA, 103 bp, Artificial Sequence
  Synthetic Polynucleotide
taatacgactcactatagggcttcagctccgtctccatcatgttgtacataacagaggagaatgtacatgatgatggagaacctggcggcagcgcaaaagatg

SEQ ID NO: 206775 - DNA, 103 bp, Artificial Sequence
  Synthetic Polynucleotide
taatacgactcactataggggcggtccgggctgtttttctggttgccgccaacagaggagaggcggcatgcagaaaaacaacctggcggcagcgcaaaagatg

SEQ ID NO: 206776 - DNA, 103 bp, Artificial Sequence
  Synthetic Polynucleotide
taatacgactcactataggggccgcttgacgcggtccgggctgtttttctaacagaggagaagaaaaatggcccggaccaacctggcggcagcgcaaaagatg

SEQ ID NO: 206777 - DNA, 103 bp, Artificial Sequence
  Synthetic Polynucleotide
taatacgactcactataggggcattcatgggccgcttgacgcggtccgggaacagaggagacccggaatgcgtcaagcgaacctggcggcagcgcaaaagatg

SEQ ID NO: 206778 - DNA, 103 bp, Artificial Sequence
  Synthetic Polynucleotide
taatacgactcactatagggcaccatgaaggcattcatgggccgcttgacaacagaggagagtcaagatgcccatgaataacctggcggcagcgcaaaagatg

SEQ ID NO: 206779 - DNA, 103 bp, Artificial Sequence
  Synthetic Polynucleotide
taatacgactcactatagggcgcgggaccacaccatgaaggcattcatggaacagaggagaccatgaatgccttcatggaacctggcggcagcgcaaaagatg

SEQ ID NO: 206780 - DNA, 103 bp, Artificial Sequence; identical to SEQ ID NO: 205905
  Synthetic Polynucleotide

SEQ ID NO: 206781 - DNA, 103 bp, Artificial Sequence; identical to SEQ ID NO: 205906
  Synthetic Polynucleotide

SEQ ID NO: 206782 - DNA, 103 bp, Artificial Sequence; identical to SEQ ID NO: 205908
  Synthetic Polynucleotide

SEQ ID NO: 206783 - DNA, 103 bp, Artificial Sequence; identical to SEQ ID NO: 205909
  Synthetic Polynucleotide

SEQ ID NO: 206784 - DNA, 103 bp, Artificial Sequence; identical to SEQ ID NO: 205910
  Synthetic Polynucleotide

SEQ ID NO: 206785 - DNA, 103 bp, Artificial Sequence
  Synthetic Polynucleotide
taatacgactcactatagggggcccggcggcttcagctccgtctccatcaaacagaggagatgatggatgcggagctgaaacctggcggcagcgcaaaagatg

SEQ ID NO: 206786 - DNA, 103 bp, Artificial Sequence; identical to SEQ ID NO: 205911
  Synthetic Polynucleotide

SEQ ID NO: 206787 - DNA, 103 bp, Artificial Sequence
  Synthetic Polynucleotide
taatacgactcactataggggcgcccaggcgcttgctgatctccgagttgaacagaggagacaactcatggatcagcaaaacctggcggcagcgcaaaagatg

SEQ ID NO: 206788 - DNA, 103 bp, Artificial Sequence
  Synthetic Polynucleotide
taatacgactcactatagggtttccactcggcgcccaggcgcttgctgataacagaggagaatcagcatgcgcctgggcaacctggcggcagcgcaaaagatg

SEQ ID NO: 206789 - DNA, 103 bp, Artificial Sequence
  Synthetic Polynucleotide
taatacgactcactatagggccgacaaaagtttccactcggcgcccaggcaacagaggagagcctggatgccgagtggaaacctggcggcagcgcaaaagatg

SEQ ID NO: 206790 - DNA, 103 bp, Artificial Sequence
  Synthetic Polynucleotide
taatacgactcactatagggttctccgtctccgacaaaagtttccactcgaacagaggagacgagtgatgacttttgtcaacctggcggcagcgcaaaagatg

SEQ ID NO: 206791 - DNA, 103 bp, Artificial Sequence
  Synthetic Polynucleotide
taatacgactcactataggggaacggccgcttctccgtctccgacaaaagaacagaggagacttttgatggagacggagaacctggcggcagcgcaaaagatg

SEQ ID NO: 206792 - DNA, 103 bp, Artificial Sequence
  Synthetic Polynucleotide
taatacgactcactatagggcctcgtcgatgaacggccgcttctccgtctaacagaggagaagacggatgagcggccgtaacctggcggcagcgcaaaagatg

SEQ ID NO: 206793 - DNA, 103 bp, Artificial Sequence
  Synthetic Polynucleotide
taatacgactcactatagggagccgcttagcctcgtcgatgaacggccgcaacagaggagagcggccatgcatcgacgaaacctggcggcagcgcaaaagatg

SEQ ID NO: 206794 - DNA, 103 bp, Artificial Sequence
  Synthetic Polynucleotide
taatacgactcactatagggcagcgctcgcagccgcttagcctcgtcgataacagaggagaatcgacatggctaagcggaacctggcggcagcgcaaaagatg

SEQ ID NO: 206795 - DNA, 103 bp, Artificial Sequence
  Synthetic Polynucleotide
taatacgactcactatagggccttcatgtgcagcgctcgcagccgcttagaacagaggagactaagcatgtgcgagcgcaacctggcggcagcgcaaaagatg

SEQ ID NO: 206796 - DNA, 103 bp, Artificial Sequence
  Synthetic Polynucleotide
taatacgactcactataggggtttgctgcgggcccggcggcttcagctccaacagaggagaggagctatggccgccgggaacctggcggcagcgcaaaagatg

SEQ ID NO: 206797 - DNA, 103 bp, Artificial Sequence
  Synthetic Polynucleotide
taatacgactcactatagggtccgggtgctccttcatgtgcagcgctcgcaacagaggagagcgagcatggcacatgaaaacctggcggcagcgcaaaagatg

SEQ ID NO: 206798 - DNA, 103 bp, Artificial Sequence
  Synthetic Polynucleotide
taatacgactcactataggggtatttataatccgggtgctccttcatgtgaacagaggagacacatgatggagcacccgaacctggcggcagcgcaaaagatg

SEQ ID NO: 206799 - DNA, 103 bp, Artificial Sequence
  Synthetic Polynucleotide
taatacgactcactataggggccggggccggtatttataatccgggtgctaacagaggagaagcaccatgattataaataacctggcggcagcgcaaaagatg

SEQ ID NO: 206800 - DNA, 103 bp, Artificial Sequence
  Synthetic Polynucleotide
taatacgactcactatagggttggttttccgccggggccggtatttataaaacagaggagattataaatgccggccccgaacctggcggcagcgcaaaagatg

SEQ ID NO: 206801 - DNA, 103 bp, Artificial Sequence
  Synthetic Polynucleotide
taatacgactcactatagggcatgagcgtcttggttttccgccggggccgaacagaggagacggcccatgcggaaaaccaacctggcggcagcgcaaaagatg

SEQ ID NO: 206802 - DNA, 103 bp, Artificial Sequence
  Synthetic Polynucleotide
taatacgactcactatagggtatccttcttcatgagcgtcttggttttccaacagaggagaggaaaaatgagacgctcaaacctggcggcagcgcaaaagatg

SEQ ID NO: 206803 - DNA, 103 bp, Artificial Sequence
  Synthetic Polynucleotide
taatacgactcactatagggagcgtgtacttatccttcttcatgagcgtcaacagaggagagacgctatggaagaaggaaacctggcggcagcgcaaaagatg

SEQ ID NO: 206804 - DNA, 103 bp, Artificial Sequence
  Synthetic Polynucleotide
taatacgactcactatagggcccgccgggcagcgtgtacttatccttcttaacagaggagaaagaagatgaagtacacgaacctggcggcagcgcaaaagatg

SEQ ID NO: 206805 - DNA, 103 bp, Artificial Sequence
  Synthetic Polynucleotide
taatacgactcactataggggggccagcagcccgccgggcagcgtgtactaacagaggagaagtacaatgtgcccggcgaacctggcggcagcgcaaaagatg

SEQ ID NO: 206806 - DNA, 103 bp, Artificial Sequence
  Synthetic Polynucleotide
taatacgactcactatagggttgccgccgggggccagcagcccgccgggcaacagaggagagcccggatggctgctggcaacctggcggcagcgcaaaagatg

SEQ ID NO: 206807 - DNA, 103 bp, Artificial Sequence
  Synthetic Polynucleotide
taatacgactcactataggggccccccgaagtttgctgcgggcccggcggaacagaggagaccgccgatgccgcagcaaaacctggcggcagcgcaaaagatg

SEQ ID NO: 206808 - DNA, 103 bp, Artificial Sequence
  Synthetic Polynucleotide
taatacgactcactatagggcgccatgctattgccgccgggggccagcagaacagaggagactgctgatgcccggcggcaacctggcggcagcgcaaaagatg

SEQ ID NO: 206809 - DNA, 103 bp, Artificial Sequence
  Synthetic Polynucleotide
taatacgactcactatagggcgaccccgctcgccatgctattgccgccggaacagaggagaccggcgatgatagcatggaacctggcggcagcgcaaaagatg

SEQ ID NO: 206810 - DNA, 103 bp, Artificial Sequence
  Synthetic Polynucleotide
taatacgactcactataggggcgcccaccccgaccccgctcgccatgctaaacagaggagatagcatatggagcggggtaacctggcggcagcgcaaaagatg

SEQ ID NO: 206811 - DNA, 103 bp, Artificial Sequence
  Synthetic Polynucleotide
taatacgactcactataggggcccaggccggcgcccaccccgaccccgctaacagaggagaagcgggatgggggtgggcaacctggcggcagcgcaaaagatg

SEQ ID NO: 206812 - DNA, 103 bp, Artificial Sequence
  Synthetic Polynucleotide
taatacgactcactatagggtcacgcccgcgcccaggccggcgcccacccaacagaggagagggtggatgccggcctggaacctggcggcagcgcaaaagatg

SEQ ID NO: 206813 - DNA, 103 bp, Artificial Sequence
  Synthetic Polynucleotide
taatacgactcactatagggatgcgctggttcacgcccgcgcccaggccgaacagaggagacggcctatgcgcgggcgtaacctggcggcagcgcaaaagatg

SEQ ID NO: 206814 - DNA, 103 bp, Artificial Sequence
  Synthetic Polynucleotide
taatacgactcactataggggtaactgtccatgcgctggttcacgcccgcaacagaggagagcgggcatgaaccagcgcaacctggcggcagcgcaaaagatg

SEQ ID NO: 206815 - DNA, 103 bp, Artificial Sequence
  Synthetic Polynucleotide
taatacgactcactatagggtcatgtgcgcgtaactgtccatgcgctggtaacagaggagaaccagcatgtggacagttaacctggcggcagcgcaaaagatg

SEQ ID NO: 206816 - DNA, 103 bp, Artificial Sequence
  Synthetic Polynucleotide
taatacgactcactatagggctccagccgttcatgtgcgcgtaactgtccaacagaggagaggacagatgcgcgcacataacctggcggcagcgcaaaagatg

SEQ ID NO: 206817 - DNA, 103 bp, Artificial Sequence
  Synthetic Polynucleotide
taatacgactcactataggggctgccgttgctccagccgttcatgtgcgcaacagaggagagcgcacatgaacggctggaacctggcggcagcgcaaaagatg

SEQ ID NO: 206818 - DNA, 103 bp, Artificial Sequence
  Synthetic Polynucleotide
taatacgactcactatagggtgccgccgccgccccccgaagtttgctgcgaacagaggagacgcagcatgcttcgggggaacctggcggcagcgcaaaagatg

SEQ ID NO: 206819 - DNA, 103 bp, Artificial Sequence
  Synthetic Polynucleotide
taatacgactcactatagggtcatgctgtagctgccgttgctccagccgtaacagaggagaacggctatggcaacggcaaacctggcggcagcgcaaaagatg

SEQ ID NO: 206820 - DNA, 103 bp, Artificial Sequence
  Synthetic Polynucleotide
taatacgactcactatagggtggtcctgcatcatgctgtagctgccgttgaacagaggagacaacggatgctacagcataacctggcggcagcgcaaaagatg

SEQ ID NO: 206821 - DNA, 103 bp, Artificial Sequence
  Synthetic Polynucleotide
taatacgactcactataggggtagcccagctggtcctgcatcatgctgtaaacagaggagatacagcatgatgcaggacaacctggcggcagcgcaaaagatg

SEQ ID NO: 206822 - DNA, 103 bp, Artificial Sequence
  Synthetic Polynucleotide
taatacgactcactatagggggtgctgcgggtagcccagctggtcctgcaaacagaggagatgcaggatgagctgggctaacctggcggcagcgcaaaagatg

SEQ ID NO: 206823 - DNA, 103 bp, Artificial Sequence
  Synthetic Polynucleotide
taatacgactcactatagggttgaggcccgggtgctgcgggtagcccagcaacagaggagagctgggatgcccgcagcaaacctggcggcagcgcaaaagatg

SEQ ID NO: 206824 - DNA, 103 bp, Artificial Sequence
  Synthetic Polynucleotide
taatacgactcactataggggccgtgcgcattgaggcccgggtgctgcggaacagaggagaccgcagatgccgggcctcaacctggcggcagcgcaaaagatg

SEQ ID NO: 206825 - DNA, 103 bp, Artificial Sequence
  Synthetic Polynucleotide
taatacgactcactatagggtctgcgctgcgccgtgcgcattgaggcccgaacagaggagacgggccatgatgcgcacgaacctggcggcagcgcaaaagatg

SEQ ID NO: 206826 - DNA, 103 bp, Artificial Sequence
  Synthetic Polynucleotide
taatacgactcactatagggatgggctgcatctgcgctgcgccgtgcgcaaacagaggagatgcgcaatgcgcagcgcaaacctggcggcagcgcaaaagatg

SEQ ID NO: 206827 - DNA, 103 bp, Artificial Sequence
  Synthetic Polynucleotide
taatacgactcactataggggtagcggtgcatgggctgcatctgcgctgcaacagaggagagcagcgatgatgcagcccaacctggcggcagcgcaaaagatg

SEQ ID NO: 206828 - DNA, 103 bp, Artificial Sequence
  Synthetic Polynucleotide
taatacgactcactatagggcgctcacgtcgtagcggtgcatgggctgcaaacagaggagatgcagcatgtgcaccgctaacctggcggcagcgcaaaagatg

SEQ ID NO: 206829 - DNA, 103 bp, Artificial Sequence
  Synthetic Polynucleotide
taatacgactcactataggggcggtggagttgccgccgccgccccccgaaaacagaggagattcgggatgcggcggcggaacctggcggcagcgcaaaagatg

SEQ ID NO: 206830 - DNA, 103 bp, Artificial Sequence
  Synthetic Polynucleotide
taatacgactcactatagggtactgcagggcgctcacgtcgtagcggtgcaacagaggagagcaccgatgcgacgtgagaacctggcggcagcgcaaaagatg

SEQ ID NO: 206831 - DNA, 103 bp, Artificial Sequence
  Synthetic Polynucleotide
taatacgactcactatagggcatggagttgtactgcagggcgctcacgtcaacagaggagagacgtgatggccctgcagaacctggcggcagcgcaaaagatg

SEQ ID NO: 206832 - DNA, 103 bp, Artificial Sequence
  Synthetic Polynucleotide
taatacgactcactataggggcgagctggtcatggagttgtactgcagggaacagaggagaccctgcatgacaactccaaacctggcggcagcgcaaaagatg

SEQ ID NO: 206833 - DNA, 103 bp, Artificial Sequence
  Synthetic Polynucleotide
taatacgactcactatagggatgtaggtctgcgagctggtcatggagttgaacagaggagacaactcatggaccagctcaacctggcggcagcgcaaaagatg

SEQ ID NO: 206834 - DNA, 103 bp, Artificial Sequence
  Synthetic Polynucleotide
taatacgactcactatagggcgagccgttcatgtaggtctgcgagctggtaacagaggagaaccagcatgcagacctacaacctggcggcagcgcaaaagatg

SEQ ID NO: 206835 - DNA, 103 bp, Artificial Sequence
  Synthetic Polynucleotide
taatacgactcactatagggtgtaggtgggcgagccgttcatgtaggtctaacagaggagaagacctatgtgaacggctaacctggcggcagcgcaaaagatg

SEQ ID NO: 206836 - DNA, 103 bp, Artificial Sequence
  Synthetic Polynucleotide
taatacgactcactatagggtaggacatgctgtaggtgggcgagccgttcaacagaggagagaacggatggcccacctaaacctggcggcagcgcaaaagatg

SEQ ID NO: 206837 - DNA, 103 bp, Artificial Sequence
  Synthetic Polynucleotide
taatacgactcactatagggctgctgcgagtaggacatgctgtaggtgggaacagaggagacccaccatgagcatgtccaacctggcggcagcgcaaaagatg

SEQ ID NO: 206838 - DNA, 103 bp, Artificial Sequence
  Synthetic Polynucleotide
taatacgactcactatagggcaggggtgccctgctgcgagtaggacatgcaacagaggagagcatgtatgactcgcagcaacctggcggcagcgcaaaagatg

SEQ ID NO: 206839 - DNA, 103 bp, Artificial Sequence
  Synthetic Polynucleotide
taatacgactcactatagggagagccatgccaggggtgccctgctgcgagaacagaggagactcgcaatggggcaccccaacctggcggcagcgcaaaagatg

SEQ ID NO: 206840 - DNA, 103 bp, Artificial Sequence
  Synthetic Polynucleotide
taatacgactcactatagggggccgccgccgcggtggagttgccgccgccaacagaggagaggcggcatgaactccaccaacctggcggcagcgcaaaagatg

SEQ ID NO: 206841 - DNA, 103 bp, Artificial Sequence
  Synthetic Polynucleotide
taatacgactcactatagggcatggagccaagagccatgccaggggtgccaacagaggagaggcaccatgggcatggctaacctggcggcagcgcaaaagatg

SEQ ID NO: 206842 - DNA, 103 bp, Artificial Sequence
  Synthetic Polynucleotide
taatacgactcactatagggccaccgaacccatggagccaagagccatgcaacagaggagagcatggatgttggctccaaacctggcggcagcgcaaaagatg

SEQ ID NO: 206843 - DNA, 103 bp, Artificial Sequence
  Synthetic Polynucleotide
taatacgactcactatagggtcggacttgaccaccgaacccatggagccaaacagaggagatggctcatggggttcggtaacctggcggcagcgcaaaagatg

SEQ ID NO: 206844 - DNA, 103 bp, Artificial Sequence
  Synthetic Polynucleotide
taatacgactcactatagggggagctggcctcggacttgaccaccgaaccaacagaggagaggttcgatggtcaagtccaacctggcggcagcgcaaaagatg

SEQ ID NO: 206845 - DNA, 103 bp, Artificial Sequence
  Synthetic Polynucleotide
taatacgactcactatagggcaggggggctggagctggcctcggacttgaaacagaggagatcaagtatgaggccagctaacctggcggcagcgcaaaagatg

SEQ ID NO: 206846 - DNA, 103 bp, Artificial Sequence
  Synthetic Polynucleotide
taatacgactcactataggggaggtaaccacaggggggctggagctggccaacagaggagaggccagatgcagccccccaacctggcggcagcgcaaaagatg

SEQ ID NO: 206847 - DNA, 103 bp, Artificial Sequence
  Synthetic Polynucleotide
taatacgactcactataggggtgggaggaagaggtaaccacaggggggctaacagaggagaagccccatggtggttaccaacctggcggcagcgcaaaagatg

SEQ ID NO: 206848 - DNA, 103 bp, Artificial Sequence
  Synthetic Polynucleotide
taatacgactcactataggggcgccctggagtgggaggaagaggtaaccaaacagaggagatggttaatgcttcctcccaacctggcggcagcgcaaaagatg

SEQ ID NO: 206849 - DNA, 103 bp, Artificial Sequence
  Synthetic Polynucleotide
taatacgactcactataggggcctggcagggcgccctggagtgggaggaaaacagaggagattcctcatgctccagggcaacctggcggcagcgcaaaagatg

SEQ ID NO: 206850 - DNA, 103 bp, Artificial Sequence
  Synthetic Polynucleotide
taatacgactcactataggggaggtccccggcctggcagggcgccctggaaacagaggagatccaggatgccctgccagaacctggcggcagcgcaaaagatg

SEQ ID NO: 206851 - DNA, 103 bp, Artificial Sequence
  Synthetic Polynucleotide
taatacgactcactatagggggttgccgccggccgccgccgcggtggagtaacagaggagaactccaatgcggcggcggaacctggcggcagcgcaaaagatg

SEQ ID NO: 206852 - DNA, 103 bp, Artificial Sequence
  Synthetic Polynucleotide
taatacgactcactatagggtcatgtcccggaggtccccggcctggcaggaacagaggagacctgccatgccggggaccaacctggcggcagcgcaaaagatg

SEQ ID NO: 206853 - DNA, 103 bp, Artificial Sequence
  Synthetic Polynucleotide
taatacgactcactatagggtacatgctgatcatgtcccggaggtccccgaacagaggagacggggaatgccgggacataacctggcggcagcgcaaaagatg

SEQ ID NO: 206854 - DNA, 103 bp, Artificial Sequence
  Synthetic Polynucleotide
taatacgactcactataggggccggggagatacatgctgatcatgtcccgaacagaggagacgggacatgatcagcatgaacctggcggcagcgcaaaagatg

SEQ ID NO: 206855 - DNA, 103 bp, Artificial Sequence
  Synthetic Polynucleotide
taatacgactcactataggggcacctcggcgccggggagatacatgctgaaacagaggagatcagcaatgatctccccgaacctggcggcagcgcaaaagatg

SEQ ID NO: 206856 - DNA, 103 bp, Artificial Sequence
  Synthetic Polynucleotide
taatacgactcactataggggcgggttccggcacctcggcgccggggagaaacagaggagatctcccatgcgccgaggtaacctggcggcagcgcaaaagatg

SEQ ID NO: 206857 - DNA, 103 bp, Artificial Sequence
  Synthetic Polynucleotide
taatacgactcactataggggctgggggcggcgggttccggcacctcggcaacagaggagagccgagatgccggaacccaacctggcggcagcgcaaaagatg

SEQ ID NO: 206858 - DNA, 103 bp, Artificial Sequence
  Synthetic Polynucleotide
taatacgactcactatagggtgtgaagtctgctgggggcggcgggttccgaacagaggagacggaacatgccgcccccaaacctggcggcagcgcaaaagatg

SEQ ID NO: 206859 - DNA, 103 bp, Artificial Sequence
  Synthetic Polynucleotide
taatacgactcactatagggtgctgggacatgtgaagtctgctgggggcgaacagaggagacgccccatgcagacttcaaacctggcggcagcgcaaaagatg

SEQ ID NO: 206860 - DNA, 103 bp, Artificial Sequence
  Synthetic Polynucleotide
taatacgactcactataggggctctggtagtgctgggacatgtgaagtctaacagaggagaagacttatgatgtcccagaacctggcggcagcgcaaaagatg

SEQ ID NO: 206861 - DNA, 103 bp, Artificial Sequence
  Synthetic Polynucleotide
taatacgactcactataggggcaccgggccgctctggtagtgctgggacaaacagaggagatgtcccatgactaccagaaacctggcggcagcgcaaaagatg

SEQ ID NO: 206862 - DNA, 103 bp, Artificial Sequence
  Synthetic Polynucleotide
taatacgactcactatagggctgtttttctggttgccgccggccgccgccaacagaggagaggcggcatgcggcggcaaaacctggcggcagcgcaaaagatg

SEQ ID NO: 206863 - DNA, 103 bp, Artificial Sequence
  Synthetic Polynucleotide
taatacgactcactataggggccgtgccgggcaccgggccgctctggtagaacagaggagactaccaatgcggcccggtaacctggcggcagcgcaaaagatg

SEQ ID NO: 206864 - DNA, 103 bp, Artificial Sequence
  Synthetic Polynucleotide
taatacgactcactataggggccgttaatggccgtgccgggcaccgggccaacagaggagaggcccgatgcccggcacgaacctggcggcagcgcaaaagatg

SEQ ID NO: 206865 - DNA, 103 bp, Artificial Sequence
  Synthetic Polynucleotide
taatacgactcactatagggggggcagtgtgccgttaatggccgtgccggaacagaggagaccggcaatgccattaacgaacctggcggcagcgcaaaagatg

SEQ ID NO: 206866 - DNA, 103 bp, Artificial Sequence
  Synthetic Polynucleotide
taatacgactcactatagggatgtgtgagaggggcagtgtgccgttaatgaacagaggagacattaaatgcacactgccaacctggcggcagcgcaaaagatg

SEQ ID NO: 206867 - DNA, 103 bp, Artificial Sequence
  Synthetic Polynucleotide
taatacgactcactatagggccgcttgacgtggtccaccggcttggacataacagaggagaatgtccatgccggtggacaacctggcggcagcgcaaaagatg

SEQ ID NO: 206868 - DNA, 103 bp, Artificial Sequence
  Synthetic Polynucleotide
taatacgactcactatagggcttgctgatctccgagttgtgcatcttgggaacagaggagacccaagatgcacaactcgaacctggcggcagcgcaaaagatg

SEQ ID NO: 206869 - DNA, 103 bp, Artificial Sequence
  Synthetic Polynucleotide
taatacgactcactatagggcgcccaagcgcttgctgatctccgagttgtaacagaggagaacaactatgagatcagcaaacctggcggcagcgcaaaagatg

SEQ ID NO: 206870 - DNA, 103 bp, Artificial Sequence
  Synthetic Polynucleotide
taatacgactcactatagggttccactcggcgcccaagcgcttgctgatcaacagaggagagatcagatggcgcttgggaacctggcggcagcgcaaaagatg

SEQ ID NO: 206871 - DNA, 103 bp, Artificial Sequence
  Synthetic Polynucleotide
taatacgactcactatagggtgtgagcagtttccactcggcgcccaagcgaacagaggagacgcttgatggccgagtggaacctggcggcagcgcaaaagatg

SEQ ID NO: 206872 - DNA, 103 bp, Artificial Sequence
  Synthetic Polynucleotide
taatacgactcactatagggtctccgactctgtgagcagtttccactcggaacagaggagaccgagtatgaactgctcaaacctggcggcagcgcaaaagatg

SEQ ID NO: 206873 - DNA, 103 bp, Artificial Sequence
  Synthetic Polynucleotide
taatacgactcactatagggaacggccgcttctccgactctgtgagcagtaacagaggagaactgctatgagagtcggaaacctggcggcagcgcaaaagatg

SEQ ID NO: 206874 - DNA, 103 bp, Artificial Sequence
  Synthetic Polynucleotide
taatacgactcactatagggctcgtcgatgaacggccgcttctccgactcaacagaggagagagtcgatgaagcggccgaacctggcggcagcgcaaaagatg

SEQ ID NO: 206875 - DNA, 103 bp, Artificial Sequence
  Synthetic Polynucleotide
taatacgactcactataggggacgcttggcctcgtcgatgaacggccgctaacagaggagaagcggcatgtcatcgacgaacctggcggcagcgcaaaagatg

SEQ ID NO: 206876 - DNA, 103 bp, Artificial Sequence
  Synthetic Polynucleotide
taatacgactcactatagggatggcgcgtagacgcttggcctcgtcgatgaacagaggagacatcgaatgggccaagcgaacctggcggcagcgcaaaagatg

SEQ ID NO: 206877 - DNA, 103 bp, Artificial Sequence
  Synthetic Polynucleotide
taatacgactcactatagggcttcatgtgcatggcgcgtagacgcttggcaacagaggagagccaagatgctacgcgccaacctggcggcagcgcaaaagatg

SEQ ID NO: 206878 - DNA, 103 bp, Artificial Sequence
  Synthetic Polynucleotide
taatacgactcactatagggcgttcatgggccgcttgacgtggtccaccgaacagaggagacggtggatgacgtcaagcaacctggcggcagcgcaaaagatg

SEQ ID NO: 206879 - DNA, 103 bp, Artificial Sequence
  Synthetic Polynucleotide
taatacgactcactatagggcggggtgctccttcatgtgcatggcgcgtaaacagaggagatacgcgatgtgcacatgaaacctggcggcagcgcaaaagatg

SEQ ID NO: 206880 - DNA, 103 bp, Artificial Sequence
  Synthetic Polynucleotide
taatacgactcactatagggtacttgtagtcggggtgctccttcatgtgcaacagaggagagcacatatgggagcacccaacctggcggcagcgcaaaagatg

SEQ ID NO: 206881 - DNA, 103 bp, Artificial Sequence
  Synthetic Polynucleotide
taatacgactcactatagggccgcggccggtacttgtagtcggggtgctcaacagaggagagagcacatggactacaagaacctggcggcagcgcaaaagatg

SEQ ID NO: 206882 - DNA, 103 bp, Artificial Sequence
  Synthetic Polynucleotide
taatacgactcactatagggtgggcttgcgccgcggccggtacttgtagtaacagaggagaactacaatgaccggccgcaacctggcggcagcgcaaaagatg

SEQ ID NO: 206883 - DNA, 103 bp, Artificial Sequence
  Synthetic Polynucleotide
taatacgactcactatagggagcagcgtcttgggcttgcgccgcggccggaacagaggagaccggccatggcgcaagccaacctggcggcagcgcaaaagatg

SEQ ID NO: 206884 - DNA, 103 bp, Artificial Sequence
  Synthetic Polynucleotide
taatacgactcactataggggtccttcttgagcagcgtcttgggcttgcgaacagaggagacgcaagatgaagacgctgaacctggcggcagcgcaaaagatg

SEQ ID NO: 206885 - DNA, 103 bp, Artificial Sequence
  Synthetic Polynucleotide
taatacgactcactatagggaggcgaacttgtccttcttgagcagcgtctaacagaggagaagacgcatgtcaagaaggaacctggcggcagcgcaaaagatg

SEQ ID NO: 206886 - DNA, 103 bp, Artificial Sequence
  Synthetic Polynucleotide
taatacgactcactatagggggcaccgggaaggcgaacttgtccttcttgaacagaggagacaagaaatgcaagttcgcaacctggcggcagcgcaaaagatg

SEQ ID NO: 206887 - DNA, 103 bp, Artificial Sequence
  Synthetic Polynucleotide
taatacgactcactatagggcaggccgtagggcaccgggaaggcgaacttaacagaggagaaagttcatgttcccggtgaacctggcggcagcgcaaaagatg

SEQ ID NO: 206888 - DNA, 103 bp, Artificial Sequence
  Synthetic Polynucleotide
taatacgactcactatagggccacgccgcccaggccgtagggcaccgggaaacagaggagatcccggatgcctacggccaacctggcggcagcgcaaaagatg

SEQ ID NO: 206889 - DNA, 103 bp, Artificial Sequence
  Synthetic Polynucleotide
taatacgactcactatagggaccatgaaggcgttcatgggccgcttgacgaacagaggagacgtcaaatggcccatgaaaacctggcggcagcgcaaaagatg

SEQ ID NO: 206890 - DNA, 103 bp, Artificial Sequence
  Synthetic Polynucleotide
taatacgactcactatagggtcggcgtccgccacgccgcccaggccgtagaacagaggagactacggatggggcggcgtaacctggcggcagcgcaaaagatg

SEQ ID NO: 206891 - DNA, 103 bp, Artificial Sequence
  Synthetic Polynucleotide
taatacgactcactatagggcgcagggtgctcggcgtccgccacgccgccaacagaggagaggcggcatggcggacgccaacctggcggcagcgcaaaagatg

SEQ ID NO: 206892 - DNA, 103 bp, Artificial Sequence
  Synthetic Polynucleotide
taatacgactcactatagggccgccttgagcgcagggtgctcggcgtccgaacagaggagacggacgatgagcaccctgaacctggcggcagcgcaaaagatg

SEQ ID NO: 206893 - DNA, 103 bp, Artificial Sequence
  Synthetic Polynucleotide
taatacgactcactatagggagcccggcgcccgccttgagcgcagggtgcaacagaggagagcacccatggctcaaggcaacctggcggcagcgcaaaagatg

SEQ ID NO: 206894 - DNA, 103 bp, Artificial Sequence
  Synthetic Polynucleotide
taatacgactcactatagggccccgcgtgcagcccggcgcccgccttgagaacagaggagactcaagatgggcgccgggaacctggcggcagcgcaaaagatg

SEQ ID NO: 206895 - DNA, 103 bp, Artificial Sequence
  Synthetic Polynucleotide
taatacgactcactatagggcgccgcccgcccccgcgtgcagcccggcgcaacagaggagagcgccgatgtgcacgcggaacctggcggcagcgcaaaagatg

SEQ ID NO: 206896 - DNA, 103 bp, Artificial Sequence
  Synthetic Polynucleotide
taatacgactcactatagggggcaccaggccgccgcccgcccccgcgtgcaacagaggagagcacgcatgggcgggcggaacctggcggcagcgcaaaagatg

SEQ ID NO: 206897 - DNA, 103 bp, Artificial Sequence
  Synthetic Polynucleotide
taatacgactcactatagggcagcgactcaggcaccaggccgccgcccgcaacagaggagagcgggcatgggcctggtgaacctggcggcagcgcaaaagatg

SEQ ID NO: 206898 - DNA, 103 bp, Artificial Sequence
  Synthetic Polynucleotide
taatacgactcactataggggattggcgagcagcgactcaggcaccaggcaacagaggagagcctggatgctgagtcgcaacctggcggcagcgcaaaagatg

SEQ ID NO: 206899 - DNA, 103 bp, Artificial Sequence
  Synthetic Polynucleotide
taatacgactcactataggggccttctcgggattggcgagcagcgactcaaacagaggagatgagtcatggctcgccaaaacctggcggcagcgcaaaagatg

SEQ ID NO: 206900 - DNA, 103 bp, Artificial Sequence
  Synthetic Polynucleotide
taatacgactcactatagggccgcgaccacaccatgaaggcgttcatgggaacagaggagacccatgatggccttcatgaacctggcggcagcgcaaaagatg

SEQ ID NO: 206901 - DNA, 103 bp, Artificial Sequence
  Synthetic Polynucleotide
taatacgactcactatagggggccgcggccgccttctcgggattggcgagaacagaggagactcgccatgcccgagaagaacctggcggcagcgcaaaagatg

SEQ ID NO: 206902 - DNA, 103 bp, Artificial Sequence
  Synthetic Polynucleotide
taatacgactcactatagggcagcggcggcggccgcggccgccttctcggaacagaggagaccgagaatgcggccgcggaacctggcggcagcgcaaaagatg

SEQ ID NO: 206903 - DNA, 103 bp, Artificial Sequence
  Synthetic Polynucleotide
taatacgactcactatagggcgtgcggcggcagcggcggcggccgcggccaacagaggagaggccgcatgcgccgccgcaacctggcggcagcgcaaaagatg

SEQ ID NO: 206904 - DNA, 103 bp, Artificial Sequence
  Synthetic Polynucleotide
taatacgactcactataggggaagaagacgcgtgcggcggcagcggcggcaacagaggagagccgccatggccgccgcaaacctggcggcagcgcaaaagatg

SEQ ID NO: 206905 - DNA, 103 bp, Artificial Sequence
  Synthetic Polynucleotide
taatacgactcactatagggccgactgcgggaagaagacgcgtgcggcggaacagaggagaccgccgatggcgtcttctaacctggcggcagcgcaaaagatg

SEQ ID NO: 206906 - DNA, 103 bp, Artificial Sequence
  Synthetic Polynucleotide
taatacgactcactataggggcggcagcggccgactgcgggaagaagacgaacagaggagacgtcttatgcccgcagtcaacctggcggcagcgcaaaagatg

SEQ ID NO: 206907 - DNA, 103 bp, Artificial Sequence
  Synthetic Polynucleotide
taatacgactcactatagggggcagcggcggcggcagcggccgactgcggaacagaggagaccgcagatggccgctgccaacctggcggcagcgcaaaagatg

SEQ ID NO: 206908 - DNA, 103 bp, Artificial Sequence
  Synthetic Polynucleotide
taatacgactcactatagggcggcggcggcggcagcggcggcggcagcggaacagaggagaccgctgatgccgccgctgaacctggcggcagcgcaaaagatg

SEQ ID NO: 206909 - DNA, 103 bp, Artificial Sequence
  Synthetic Polynucleotide
taatacgactcactatagggcccgcggcggcggcggcggcggcagcggcgaacagaggagacgccgcatgcgccgccgcaacctggcggcagcgcaaaagatg

SEQ ID NO: 206910 - DNA, 103 bp, Artificial Sequence
  Synthetic Polynucleotide
taatacgactcactataggggtaggggctgcccgcggcggcggcggcggcaacagaggagagccgccatggccgccgcgaacctggcggcagcgcaaaagatg

SEQ ID NO: 206911 - DNA, 103 bp, Artificial Sequence
  Synthetic Polynucleotide
taatacgactcactataggggccgctgagcccgcgaccacaccatgaaggaacagaggagaccttcaatgtgtggtcgcaacctggcggcagcgcaaaagatg

SEQ ID NO: 206912 - DNA, 103 bp, Artificial Sequence
  Synthetic Polynucleotide
taatacgactcactatagggcgagcagcgagtaggggctgcccgcggcggaacagaggagaccgccgatggcagcccctaacctggcggcagcgcaaaagatg

SEQ ID NO: 206913 - DNA, 103 bp, Artificial Sequence
  Synthetic Polynucleotide
taatacgactcactataggggagcccaggtcgagcagcgagtaggggctgaacagaggagacagcccatgctcgctgctaacctggcggcagcgcaaaagatg

SEQ ID NO: 206914 - DNA, 103 bp, Artificial Sequence
  Synthetic Polynucleotide
taatacgactcactatagggtgccattttggagcccaggtcgagcagcgaaacagaggagatcgctgatggacctgggcaacctggcggcagcgcaaaagatg

SEQ ID NO: 206915 - DNA, 103 bp, Artificial Sequence
  Synthetic Polynucleotide
taatacgactcactatagggacgagatctctgccattttggagcccaggtaacagaggagaacctggatgccaaaatggaacctggcggcagcgcaaaagatg

SEQ ID NO: 206916 - DNA, 103 bp, Artificial Sequence
  Synthetic Polynucleotide
taatacgactcactataggggacgaggacgacgagatctctgccattttgaacagaggagacaaaatatgagagatctcaacctggcggcagcgcaaaagatg

SEQ ID NO: 206917 - DNA, 103 bp, Artificial Sequence
  Synthetic Polynucleotide
taatacgactcactatagggcgggaggccggacgaggacgacgagatctcaacagaggagagagatcatgtcgtcctcgaacctggcggcagcgcaaaagatg

SEQ ID NO: 206918 - DNA, 103 bp, Artificial Sequence
  Synthetic Polynucleotide
taatacgactcactatagggacgacgcgtacgggaggccggacgaggacgaacagaggagacgtcctatgccggcctccaacctggcggcagcgcaaaagatg

SEQ ID NO: 206919 - DNA, 103 bp, Artificial Sequence
  Synthetic Polynucleotide
taatacgactcactatagggtagcccagcgacgacgcgtacgggaggccgaacagaggagacggcctatggtacgcgtcaacctggcggcagcgcaaaagatg

SEQ ID NO: 206920 - DNA, 103 bp, Artificial Sequence
  Synthetic Polynucleotide
taatacgactcactatagggcgcggtcgggtagcccagcgacgacgcgtaaacagaggagatacgcgatgtcgctgggcaacctggcggcagcgcaaaagatg

SEQ ID NO: 206921 - DNA, 103 bp, Artificial Sequence
  Synthetic Polynucleotide
taatacgactcactatagggcgcccgcgcccgcggtcgggtagcccagcgaacagaggagacgctggatgacccgaccgaacctggcggcagcgcaaaagatg

SEQ ID NO: 206922 - DNA, 103 bp, Artificial Sequence
  Synthetic Polynucleotide
taatacgactcactataggggccatcttgcgccgctgagcccgcgaccacaacagaggagagtggtcatgggctcagcgaacctggcggcagcgcaaaagatg

SEQ ID NO: 206923 - DNA, 103 bp, Artificial Sequence
  Synthetic Polynucleotide
taatacgactcactatagggccgtggaaggcgcccgcgcccgcggtcgggaacagaggagacccgacatggggcgcgggaacctggcggcagcgcaaaagatg

SEQ ID NO: 206924 - DNA, 103 bp, Artificial Sequence
  Synthetic Polynucleotide
taatacgactcactatagggcgccgccgcgccgtggaaggcgcccgcgccaacagaggagaggcgcgatggccttccacaacctggcggcagcgcaaaagatg

SEQ ID NO: 206925 - DNA, 103 bp, Artificial Sequence
  Synthetic Polynucleotide
taatacgactcactatagggctgcagccgccgccgccgcgccgtggaaggaacagaggagaccttccatggcgcggcggaacctggcggcagcgcaaaagatg

SEQ ID NO: 206926 - DNA, 103 bp, Artificial Sequence
  Synthetic Polynucleotide
taatacgactcactataggggcggccgccgctgcagccgccgccgccgcgaacagaggagacgcggcatgggcggctgcaacctggcggcagcgcaaaagatg

SEQ ID NO: 206927 - DNA, 103 bp, Artificial Sequence
  Synthetic Polynucleotide
taatacgactcactatagggcccggcggcggcggccgccgctgcagccgcaacagaggagagcggctatggcggcggccaacctggcggcagcgcaaaagatg

SEQ ID NO: 206928 - DNA, 103 bp, Artificial Sequence
  Synthetic Polynucleotide
taatacgactcactataggggcgtgtgccccccggcggcggcggccgccgaacagaggagacggcggatgccgccgccgaacctggcggcagcgcaaaagatg

SEQ ID NO: 206929 - DNA, 103 bp, Artificial Sequence
  Synthetic Polynucleotide
taatacgactcactataggggggtgcgagtgcgtgtgccccccggcggcgaacagaggagacgccgcatgggggcacacaacctggcggcagcgcaaaagatg

SEQ ID NO: 206930 - DNA, 103 bp, Artificial Sequence
  Synthetic Polynucleotide
taatacgactcactataggggcccgggctggggtgcgagtgcgtgtgcccaacagaggagagggcacatgcactcgcacaacctggcggcagcgcaaaagatg

SEQ ID NO: 206931 - DNA, 103 bp, Artificial Sequence
  Synthetic Polynucleotide
taatacgactcactatagggagcccgggttgcccgggctggggtgcgagtaacagaggagaactcgcatgccagcccggaacctggcggcagcgcaaaagatg

SEQ ID NO: 206932 - DNA, 103 bp, Artificial Sequence
  Synthetic Polynucleotide
taatacgactcactataggggggatcatgtagcccgggttgcccgggctgaacagaggagacagcccatgcaacccgggaacctggcggcagcgcaaaagatg

SEQ ID NO: 206933 - DNA, 103 bp, Artificial Sequence
  Synthetic Polynucleotide
taatacgactcactataggggttctcctgggccatcttgcgccgctgagcaacagaggagagctcagatgcgcaagatgaacctggcggcagcgcaaaagatg

SEQ ID NO: 206934 - DNA, 103 bp, Artificial Sequence
  Synthetic Polynucleotide
taatacgactcactataggggcagttgcacgggatcatgtagcccgggttaacagaggagaaacccgatgtacatgatcaacctggcggcagcgcaaaagatg

SEQ ID NO: 206935 - DNA, 103 bp, Artificial Sequence
  Synthetic Polynucleotide
taatacgactcactataggggccacgcgctgcagttgcacgggatcatgtaacagaggagaacatgaatgcgtgcaactaacctggcggcagcgcaaaagatg

SEQ ID NO: 206936 - DNA, 103 bp, Artificial Sequence
  Synthetic Polynucleotide
taatacgactcactatagggccggggctgggccacgcgctgcagttgcacaacagaggagagtgcaaatgcagcgcgtgaacctggcggcagcgcaaaagatg

SEQ ID NO: 206937 - DNA, 103 bp, Artificial Sequence
  Synthetic Polynucleotide
taatacgactcactatagggcggctgcagcccggggctgggccacgcgctaacagaggagaagcgcgatgcccagccccaacctggcggcagcgcaaaagatg

SEQ ID NO: 206938 - DNA, 103 bp, Artificial Sequence
  Synthetic Polynucleotide
taatacgactcactatagggaggcgagcggcggctgcagcccggggctggaacagaggagaccagccatgggctgcagcaacctggcggcagcgcaaaagatg

SEQ ID NO: 206939 - DNA, 103 bp, Artificial Sequence
  Synthetic Polynucleotide
taatacgactcactatagggagcaggatgtaggcgagcggcggctgcagcaacagaggagagctgcaatggccgctcgcaacctggcggcagcgcaaaagatg

SEQ ID NO: 206940 - DNA, 103 bp, Artificial Sequence
  Synthetic Polynucleotide
taatacgactcactatagggcatgcccggcagcaggatgtaggcgagcggaacagaggagaccgctcatgtacatcctgaacctggcggcagcgcaaaagatg

SEQ ID NO: 206941 - DNA, 103 bp, Artificial Sequence
  Synthetic Polynucleotide
taatacgactcactatagggggggcttgcccatgcccggcagcaggatgtaacagaggagaacatccatgtgccgggcaaacctggcggcagcgcaaaagatg

SEQ ID NO: 206942 - DNA, 103 bp, Artificial Sequence
  Synthetic Polynucleotide
taatacgactcactataggggggtccagctggggcttgcccatgcccggcaacagaggagagccgggatggggcaagccaacctggcggcagcgcaaaagatg

SEQ ID NO: 206943 - DNA, 103 bp, Artificial Sequence
  Synthetic Polynucleotide
taatacgactcactatagggcgcggggtaggggtccagctggggcttgccaacagaggagaggcaagatgcagctggacaacctggcggcagcgcaaaagatg

SEQ ID NO: 206944 - DNA, 103 bp, Artificial Sequence
  Synthetic Polynucleotide
taatacgactcactataggggcatcttggggttctcctgggccatcttgcaacagaggagagcaagaatgcccaggagaaacctggcggcagcgcaaaagatg

SEQ ID NO: 206945 - DNA, 103 bp, Artificial Sequence
  Synthetic Polynucleotide
taatacgactcactatagggcagcgtaggccgcggggtaggggtccagctaacagaggagaagctggatgcctaccccgaacctggcggcagcgcaaaagatg

SEQ ID NO: 206946 - DNA, 103 bp, Artificial Sequence
  Synthetic Polynucleotide
taatacgactcactatagggcatagcgcggcagcgtaggccgcggggtagaacagaggagactacccatgggcctacgcaacctggcggcagcgcaaaagatg

SEQ ID NO: 206947 - DNA, 103 bp, Artificial Sequence
  Synthetic Polynucleotide
taatacgactcactatagggtccgagttgtgcatcttggggttctcctggaacagaggagaccaggaatgccccaagataacctggcggcagcgcaaaagatg

SEQ ID NO: 206948 - DNA, 103 bp, Artificial Sequence
  Synthetic Polynucleotide
taatacgactcactatagggacctgatgagttctctcgaacaggtcgcataacagaggagaatgcgaatggttcgagagaacctggcggcagcgcaaaagatg

SEQ ID NO: 206949 - DNA, 103 bp, Artificial Sequence
  Synthetic Polynucleotide
taatacgactcactatagggtgggggcctgtgggccagcgagtccggcggaacagaggagaccgccgatgtcgctggccaacctggcggcagcgcaaaagatg

SEQ ID NO: 206950 - DNA, 103 bp, Artificial Sequence
  Synthetic Polynucleotide
taatacgactcactatagggggctgagggcgccatgcccccgtagcccgaaacagaggagatcgggcatggggggcatgaacctggcggcagcgcaaaagatg

SEQ ID NO: 206951 - DNA, 103 bp, Artificial Sequence
  Synthetic Polynucleotide
taatacgactcactatagggcggctgctgtggctgagggcgccatgccccaacagaggagaggggcaatgcgccctcagaacctggcggcagcgcaaaagatg

SEQ ID NO: 206952 - DNA, 103 bp, Artificial Sequence
  Synthetic Polynucleotide
taatacgactcactataggggcggcggccgcggctgctgtggctgagggcaacagaggagagccctcatgcacagcagcaacctggcggcagcgcaaaagatg

SEQ ID NO: 206953 - DNA, 103 bp, Artificial Sequence
  Synthetic Polynucleotide
taatacgactcactatagggctgcccgtaggcggcggccgcggctgctgtaacagaggagaacagcaatggcggccgccaacctggcggcagcgcaaaagatg

SEQ ID NO: 206954 - DNA, 103 bp, Artificial Sequence
  Synthetic Polynucleotide
taatacgactcactatagggtggcgggctgctgcccgtaggcggcggccgaacagaggagacggccgatgcctacgggcaacctggcggcagcgcaaaagatg

SEQ ID NO: 206955 - DNA, 103 bp, Artificial Sequence
  Synthetic Polynucleotide
taatacgactcactataggggccgcggcggtggcgggctgctgcccgtagaacagaggagactacggatggcagcccgcaacctggcggcagcgcaaaagatg

SEQ ID NO: 206956 - DNA, 103 bp, Artificial Sequence
  Synthetic Polynucleotide
taatacgactcactatagggcgcagctgcggccgcggcggtggcgggctgaacagaggagacagcccatgaccgccgcgaacctggcggcagcgcaaaagatg

SEQ ID NO: 206957 - DNA, 103 bp, Artificial Sequence
  Synthetic Polynucleotide
taatacgactcactatagggcggctgcggccgcagctgcggccgcggcggaacagaggagaccgccgatgccgcagctgaacctggcggcagcgcaaaagatg

SEQ ID NO: 206958 - DNA, 103 bp, Artificial Sequence
  Synthetic Polynucleotide
taatacgactcactatagggaggctcatggcggctgcggccgcagctgcgaacagaggagacgcagcatgggccgcagcaacctggcggcagcgcaaaagatg

SEQ ID NO: 206959 - DNA, 103 bp, Artificial Sequence
  Synthetic Polynucleotide
taatacgactcactatagggcatggggcccaggctcatggcggctgcggcaacagaggagagccgcaatggccatgagcaacctggcggcagcgcaaaagatg

SEQ ID NO: 206960 - DNA, 103 bp, Artificial Sequence
  Synthetic Polynucleotide
taatacgactcactataggggagcggagcttgggggcctgtgggccagcgaacagaggagacgctggatgacaggccccaacctggcggcagcgcaaaagatg

SEQ ID NO: 206961 - DNA, 103 bp, Artificial Sequence
  Synthetic Polynucleotide
taatacgactcactatagggctaccgagcccatggggcccaggctcatggaacagaggagaccatgaatgtgggccccaaacctggcggcagcgcaaaagatg

SEQ ID NO: 206962 - DNA, 103 bp, Artificial Sequence
  Synthetic Polynucleotide
taatacgactcactatagggtcagacttcactaccgagcccatggggcccaacagaggagagggcccatggggctcggtaacctggcggcagcgcaaaagatg

SEQ ID NO: 206963 - DNA, 103 bp, Artificial Sequence
  Synthetic Polynucleotide
taatacgactcactatagggcgagctgggctcagacttcactaccgagccaacagaggagaggctcgatggtgaagtctaacctggcggcagcgcaaaagatg

SEQ ID NO: 206964 - DNA, 103 bp, Artificial Sequence
  Synthetic Polynucleotide
taatacgactcactatagggcgggcggcggcgagctgggctcagacttcaaacagaggagatgaagtatgagcccagctaacctggcggcagcgcaaaagatg

SEQ ID NO: 206965 - DNA, 103 bp, Artificial Sequence
  Synthetic Polynucleotide
taatacgactcactataggggatgcgatggcgggcggcggcgagctgggcaacagaggagagcccagatggccgccgccaacctggcggcagcgcaaaagatg

SEQ ID NO: 206966 - DNA, 103 bp, Artificial Sequence
  Synthetic Polynucleotide
taatacgactcactatagggctgagagtgcgatgcgatggcgggcggcggaacagaggagaccgccgatggccatcgcaaacctggcggcagcgcaaaagatg

SEQ ID NO: 206967 - DNA, 103 bp, Artificial Sequence
  Synthetic Polynucleotide
taatacgactcactatagggggcacgcgcgctgagagtgcgatgcgatggaacagaggagaccatcgatgcgcactctcaacctggcggcagcgcaaaagatg

SEQ ID NO: 206968 - DNA, 103 bp, Artificial Sequence
  Synthetic Polynucleotide
taatacgactcactatagggaggtcgccgaggcacgcgcgctgagagtgcaacagaggagagcactcatggcgcgcgtgaacctggcggcagcgcaaaagatg

SEQ ID NO: 206969 - DNA, 103 bp, Artificial Sequence
  Synthetic Polynucleotide
taatacgactcactatagggcatgtcgcgcaggtcgccgaggcacgcgcgaacagaggagacgcgcgatgctcggcgacaacctggcggcagcgcaaaagatg

SEQ ID NO: 206970 - DNA, 103 bp, Artificial Sequence
  Synthetic Polynucleotide
taatacgactcactatagggacatgctgatcatgtcgcgcaggtcgccgaaacagaggagatcggcgatgtgcgcgacaaacctggcggcagcgcaaaagatg

SEQ ID NO: 206971 - DNA, 103 bp, Artificial Sequence
  Synthetic Polynucleotide
taatacgactcactataggggactccgtcggagcggagcttgggggcctgaacagaggagacaggccatgaagctccgcaacctggcggcagcgcaaaagatg

SEQ ID NO: 206972 - DNA, 103 bp, Artificial Sequence
  Synthetic Polynucleotide
taatacgactcactatagggggtggcaggtacatgctgatcatgtcgcgcaacagaggagagcgcgaatggatcagcataacctggcggcagcgcaaaagatg

SEQ ID NO: 206973 - DNA, 103 bp, Artificial Sequence
  Synthetic Polynucleotide
taatacgactcactataggggtccccgccgggtggcaggtacatgctgataacagaggagaatcagcatgtacctgccaaacctggcggcagcgcaaaagatg

SEQ ID NO: 206974 - DNA, 103 bp, Artificial Sequence
  Synthetic Polynucleotide
taatacgactcactatagggcgtcggccgcgtccccgccgggtggcaggtaacagaggagaacctgcatgccggcggggaacctggcggcagcgcaaaagatg

SEQ ID NO: 206975 - DNA, 103 bp, Artificial Sequence
  Synthetic Polynucleotide
taatacgactcactatagggggagaggcggcgtcggccgcgtccccgccgaacagaggagacggcggatgcgcggccgaaacctggcggcagcgcaaaagatg

SEQ ID NO: 206976 - DNA, 103 bp, Artificial Sequence
  Synthetic Polynucleotide
taatacgactcactataggggccgggcagcggagaggcggcgtcggccgcaacagaggagagcggccatggccgcctctaacctggcggcagcgcaaaagatg

SEQ ID NO: 206977 - DNA, 103 bp, Artificial Sequence
  Synthetic Polynucleotide
taatacgactcactataggggcaggcgaccgccgggcagcggagaggcggaacagaggagaccgcctatgcgctgcccgaacctggcggcagcgcaaaagatg

SEQ ID NO: 206978 - DNA, 103 bp, Artificial Sequence
  Synthetic Polynucleotide
taatacgactcactatagggtgcacgccgtgcaggcgaccgccgggcagcaacagaggagagctgccatgcggtcgcctaacctggcggcagcgcaaaagatg

SEQ ID NO: 206979 - DNA, 103 bp, Artificial Sequence
  Synthetic Polynucleotide
taatacgactcactataggggtagtgctggtgcacgccgtgcaggcgaccaacagaggagaggtcgcatgcacggcgtgaacctggcggcagcgcaaaagatg

SEQ ID NO: 206980 - DNA, 103 bp, Artificial Sequence
  Synthetic Polynucleotide
taatacgactcactatagggcggcgccctggtagtgctggtgcacgccgtaacagaggagaacggcgatgaccagcactaacctggcggcagcgcaaaagatg

SEQ ID NO: 206981 - DNA, 103 bp, Artificial Sequence
  Synthetic Polynucleotide
taatacgactcactatagggactgcagtcccggcgccctggtagtgctggaacagaggagaccagcaatgccagggcgcaacctggcggcagcgcaaaagatg

SEQ ID NO: 206982 - DNA, 103 bp, Artificial Sequence
  Synthetic Polynucleotide
taatacgactcactatagggaaggccctgggactccgtcggagcggagctaacagaggagaagctccatgccgacggagaacctggcggcagcgcaaaagatg

SEQ ID NO: 206983 - DNA, 103 bp, Artificial Sequence
  Synthetic Polynucleotide
taatacgactcactatagggcgttccgttgactgcagtcccggcgccctgaacagaggagacagggcatggggactgcaaacctggcggcagcgcaaaagatg

SEQ ID NO: 206984 - DNA, 103 bp, Artificial Sequence
  Synthetic Polynucleotide
taatacgactcactatagggtcagcggcaccgttccgttgactgcagtccaacagaggagaggactgatgtcaacggaaaacctggcggcagcgcaaaagatg

SEQ ID NO: 206985 - DNA, 103 bp, Artificial Sequence
  Synthetic Polynucleotide
taatacgactcactatagggcagatgtgggtcagcggcaccgttccgttgaacagaggagacaacggatgggtgccgctaacctggcggcagcgcaaaagatg

SEQ ID NO: 206986 - DNA, 103 bp, Artificial Sequence
  Synthetic Polynucleotide
taatacgactcactatagggccacggtgaaaaggccctgggactccgtcgaacagaggagacgacggatgcccagggccaacctggcggcagcgcaaaagatg

SEQ ID NO: 206987 - DNA, 103 bp, Artificial Sequence
  Synthetic Polynucleotide
taatacgactcactataggggctggagcggccacggtgaaaaggccctggaacagaggagaccagggatgtttcaccgtaacctggcggcagcgcaaaagatg

SEQ ID NO: 206988 - DNA, 103 bp, Artificial Sequence
  Synthetic Polynucleotide
taatacgactcactatagggcgctcccggggctggagcggccacggtgaaaacagaggagattcaccatggccgctccaaacctggcggcagcgcaaaagatg

SEQ ID NO: 206989 - DNA, 103 bp, Artificial Sequence
  Synthetic Polynucleotide
taatacgactcactataggggaggagaaggcgctcccggggctggagcggaacagaggagaccgctcatgccccgggagaacctggcggcagcgcaaaagatg

SEQ ID NO: 206990 - DNA, 103 bp, Artificial Sequence
  Synthetic Polynucleotide
taatacgactcactatagggagcgtggcgggaggagaaggcgctcccgggaacagaggagacccgggatggccttctccaacctggcggcagcgcaaaagatg

SEQ ID NO: 206991 - DNA, 103 bp, Artificial Sequence
  Synthetic Polynucleotide
taatacgactcactatagggaaggtgcgccagcgtggcgggaggagaaggaacagaggagaccttctatgcccgccacgaacctggcggcagcgcaaaagatg

SEQ ID NO: 206992 - DNA, 103 bp, Artificial Sequence
  Synthetic Polynucleotide
taatacgactcactatagggggcttctcgcacctgatgagttctctcgaaaacagaggagattcgagatgactcatcagaacctggcggcagcgcaaaagatg

SEQ ID NO: 206993 - DNA, 103 bp, Artificial Sequence
  Synthetic Polynucleotide
taatacgactcactataggggggcgggaagaaggtgcgccagcgtggcggaacagaggagaccgccaatgtggcgcaccaacctggcggcagcgcaaaagatg

SEQ ID NO: 206994 - DNA, 103 bp, Artificial Sequence
  Synthetic Polynucleotide
taatacgactcactatagggtacattgccggggcgggaagaaggtgcgccaacagaggagaggcgcaatgtcttcccgcaacctggcggcagcgcaaaagatg

SEQ ID NO: 206995 - DNA, 103 bp, Artificial Sequence
  Synthetic Polynucleotide
taatacgactcactatagggcagaaggctgtacattgccggggcgggaagaacagaggagacttcccatgccggcaatgaacctggcggcagcgcaaaagatg

SEQ ID NO: 206996 - DNA, 103 bp, Artificial Sequence
  Synthetic Polynucleotide
taatacgactcactataggggttcagtctccagaaggctgtacattgccgaacagaggagacggcaaatgacagccttcaacctggcggcagcgcaaaagatg

SEQ ID NO: 206997 - DNA, 103 bp, Artificial Sequence
  Synthetic Polynucleotide
taatacgactcactataggggggttcttgagttcagtctccagaaggctgaacagaggagacagcctatgggagactgaaacctggcggcagcgcaaaagatg

SEQ ID NO: 206998 - DNA, 103 bp, Artificial Sequence
  Synthetic Polynucleotide
taatacgactcactatagggtgtccctacggggttcttgagttcagtctcaacagaggagagagactatgctcaagaacaacctggcggcagcgcaaaagatg

SEQ ID NO: 206999 - DNA, 103 bp, Artificial Sequence
  Synthetic Polynucleotide
taatacgactcactatagggcttgtgtgggtgtccctacggggttcttgaaacagaggagatcaagaatgccgtagggaaacctggcggcagcgcaaaagatg

SEQ ID NO: 207000 - DNA, 103 bp, Artificial Sequence
  Synthetic Polynucleotide
taatacgactcactataggggtgcccgccgcttgtgtgggtgtccctacgaacagaggagacgtaggatgacccacacaaacctggcggcagcgcaaaagatg

SEQ ID NO: 207001 - DNA, 103 bp, Artificial Sequence
  Synthetic Polynucleotide
taatacgactcactatagggggggccgccggtgcccgccgcttgtgtgggaacagaggagacccacaatggcggcgggcaacctggcggcagcgcaaaagatg

SEQ ID NO: 207002 - DNA, 103 bp, Artificial Sequence
  Synthetic Polynucleotide
taatacgactcactatagggccggggctgcggggccgccggtgcccgccgaacagaggagacggcggatgccggcggccaacctggcggcagcgcaaaagatg

SEQ ID NO: 207003 - DNA, 103 bp, Artificial Sequence
  Synthetic Polynucleotide
taatacgactcactatagggggaacccgcgggcttctcgcacctgatgagaacagaggagactcatcatgtgcgagaagaacctggcggcagcgcaaaagatg

SEQ ID NO: 207004 - DNA, 103 bp, Artificial Sequence
  Synthetic Polynucleotide
taatacgactcactatagggcctgcgcctcccggggctgcggggccgccgaacagaggagacggcggatgcgcagccccaacctggcggcagcgcaaaagatg

SEQ ID NO: 207005 - DNA, 103 bp, Artificial Sequence
  Synthetic Polynucleotide
taatacgactcactatagggactactcttgcctgcgcctcccggggctgcaacagaggagagcagccatgggaggcgcaaacctggcggcagcgcaaaagatg

SEQ ID NO: 207006 - DNA, 103 bp, Artificial Sequence
  Synthetic Polynucleotide
taatacgactcactatagggctgcgttcgcactactcttgcctgcgcctcaacagaggagagaggcgatggcaagagtaaacctggcggcagcgcaaaagatg

SEQ ID NO: 207007 - DNA, 103 bp, Artificial Sequence
  Synthetic Polynucleotide
taatacgactcactataggggcgccgccggctgcgttcgcactactcttgaacagaggagacaagagatgtgcgaacgcaacctggcggcagcgcaaaagatg

SEQ ID NO: 207008 - DNA, 103 bp, Artificial Sequence
  Synthetic Polynucleotide
taatacgactcactataggggcccgagttcgcgccgccggctgcgttcgcaacagaggagagcgaacatggccggcggcaacctggcggcagcgcaaaagatg

SEQ ID NO: 207009 - DNA, 103 bp, Artificial Sequence
  Synthetic Polynucleotide
taatacgactcactatagggtgctgccgccgcccgagttcgcgccgccggaacagaggagaccggcgatgcgaactcggaacctggcggcagcgcaaaagatg

SEQ ID NO: 207010 - DNA, 103 bp, Artificial Sequence
  Synthetic Polynucleotide
taatacgactcactataggggcaccaccgctgctgccgccgcccgagttcaacagaggagagaactcatgcggcggcagaacctggcggcagcgcaaaagatg

SEQ ID NO: 207011 - DNA, 103 bp, Artificial Sequence
  Synthetic Polynucleotide
taatacgactcactatagggacctccgctcgcaccaccgctgctgccgccaacagaggagaggcggcatgagcggtggtaacctggcggcagcgcaaaagatg

SEQ ID NO: 207012 - DNA, 103 bp, Artificial Sequence
  Synthetic Polynucleotide
taatacgactcactatagggtacccccgccacctccgctcgcaccaccgcaacagaggagagcggtgatgcgagcggagaacctggcggcagcgcaaaagatg

SEQ ID NO: 207013 - DNA, 103 bp, Artificial Sequence
  Synthetic Polynucleotide
taatacgactcactatagggtcctggtctgtacccccgccacctccgctcaacagaggagagagcggatgtggcgggggaacctggcggcagcgcaaaagatg

SEQ ID NO: 207014 - DNA, 103 bp, Artificial Sequence
  Synthetic Polynucleotide
taatacgactcactatagggcaaatcagcaggaacccgcgggcttctcgcaacagaggagagcgagaatgccgcgggttaacctggcggcagcgcaaaagatg

SEQ ID NO: 207015 - DNA, 103 bp, Artificial Sequence
  Synthetic Polynucleotide
taatacgactcactatagggtttcacacggtcctggtctgtacccccgccaacagaggagaggcgggatgacagaccagaacctggcggcagcgcaaaagatg

SEQ ID NO: 207016 - DNA, 103 bp, Artificial Sequence
  Synthetic Polynucleotide
taatacgactcactatagggtcatgggccgtttcacacggtcctggtctgaacagaggagacagaccatgaccgtgtgaaacctggcggcagcgcaaaagatg

SEQ ID NO: 207017 - DNA, 103 bp, Artificial Sequence
  Synthetic Polynucleotide
taatacgactcactatagggatgaaggcgttcatgggccgtttcacacggaacagaggagaccgtgtatgacggcccataacctggcggcagcgcaaaagatg

SEQ ID NO: 207018 - DNA, 103 bp, Artificial Sequence
  Synthetic Polynucleotide
taatacgactcactatagggggaccataccatgaaggcgttcatgggccgaacagaggagacggcccatgaacgccttcaacctggcggcagcgcaaaagatg

SEQ ID NO: 207019 - DNA, 103 bp, Artificial Sequence
  Synthetic Polynucleotide
taatacgactcactataggggctgcccgcgggaccataccatgaaggcgtaacagaggagaacgcctatgtggtatggtaacctggcggcagcgcaaaagatg

SEQ ID NO: 207020 - DNA, 103 bp, Artificial Sequence
  Synthetic Polynucleotide
taatacgactcactatagggattttgcgccgctgcccgcgggaccataccaacagaggagaggtatgatgccgcgggcaaacctggcggcagcgcaaaagatg

SEQ ID NO: 207021 - DNA, 103 bp, Artificial Sequence
  Synthetic Polynucleotide
taatacgactcactatagggctccagggccattttgcgccgctgcccgcgaacagaggagacgcgggatgcggcgcaaaaacctggcggcagcgcaaaagatg

SEQ ID NO: 207022 - DNA, 103 bp, Artificial Sequence
  Synthetic Polynucleotide
taatacgactcactatagggtcttggggttctccagggccattttgcgccaacagaggagaggcgcaatgtggccctggaacctggcggcagcgcaaaagatg

SEQ ID NO: 207023 - DNA, 103 bp, Artificial Sequence
  Synthetic Polynucleotide
taatacgactcactataggggaattgtgcatcttggggttctccagggccaacagaggagaggccctatggaaccccaaaacctggcggcagcgcaaaagatg

SEQ ID NO: 207024 - DNA, 103 bp, Artificial Sequence
  Synthetic Polynucleotide
taatacgactcactataggggctgatctcagaattgtgcatcttggggttaacagaggagaaaccccatgatgcacaataacctggcggcagcgcaaaagatg

SEQ ID NO: 207025 - DNA, 103 bp, Artificial Sequence
  Synthetic Polynucleotide
taatacgactcactatagggtgctccgcgccaaatcagcaggaacccgcgaacagaggagacgcgggatgctgctgattaacctggcggcagcgcaaaagatg

SEQ ID NO: 207026 - DNA, 103 bp, Artificial Sequence
  Synthetic Polynucleotide
taatacgactcactatagggccaagcgcttgctgatctcagaattgtgcaaacagaggagatgcacaatgctgagatcaaacctggcggcagcgcaaaagatg

SEQ ID NO: 207027 - DNA, 103 bp, Artificial Sequence
  Synthetic Polynucleotide
taatacgactcactatagggcagtcggcgcccaagcgcttgctgatctcaaacagaggagatgagatatgcaagcgcttaacctggcggcagcgcaaaagatg

SEQ ID NO: 207028 - DNA, 103 bp, Artificial Sequence
  Synthetic Polynucleotide
taatacgactcactatagggcagcagtttccagtcggcgcccaagcgcttaacagaggagaaagcgcatgggcgccgacaacctggcggcagcgcaaaagatg

SEQ ID NO: 207029 - DNA, 103 bp, Artificial Sequence
  Synthetic Polynucleotide
taatacgactcactatagggcggcgtcggtcagcagtttccagtcggcgcaacagaggagagcgccgatgggaaactgcaacctggcggcagcgcaaaagatg

SEQ ID NO: 207030 - DNA, 103 bp, Artificial Sequence
  Synthetic Polynucleotide
taatacgactcactatagggggtcgcttctcggcgtcggtcagcagtttcaacagaggagagaaactatggaccgacgcaacctggcggcagcgcaaaagatg

SEQ ID NO: 207031 - DNA, 103 bp, Artificial Sequence
  Synthetic Polynucleotide
taatacgactcactataggggtcgatgaatggtcgcttctcggcgtcggtaacagaggagaaccgacatggagaagcgaaacctggcggcagcgcaaaagatg

SEQ ID NO: 207032 - DNA, 103 bp, Artificial Sequence
  Synthetic Polynucleotide
taatacgactcactataggggcttggcctcgtcgatgaatggtcgcttctaacagaggagaagaagcatgcattcatcgaacctggcggcagcgcaaaagatg

SEQ ID NO: 207033 - DNA, 103 bp, Artificial Sequence
  Synthetic Polynucleotide
taatacgactcactataggggcgcgaagtcgcttggcctcgtcgatgaataacagaggagaattcatatgcgaggccaaaacctggcggcagcgcaaaagatg

SEQ ID NO: 207034 - DNA, 103 bp, Artificial Sequence
  Synthetic Polynucleotide
taatacgactcactatagggcatgtgcacggcgcgaagtcgcttggcctcaacagaggagagaggccatgcgacttcgcaacctggcggcagcgcaaaagatg

SEQ ID NO: 207035 - DNA, 103 bp, Artificial Sequence
  Synthetic Polynucleotide
taatacgactcactataggggatactccttcatgtgcacggcgcgaagtcaacagaggagagacttcatgccgtgcacaaacctggcggcagcgcaaaagatg

SEQ ID NO: 207036 - DNA, 103 bp, Artificial Sequence
  Synthetic Polynucleotide
taatacgactcactatagggcttatcaaaatgctccgcgccaaatcagcaaacagaggagatgctgaatgggcgcggagaacctggcggcagcgcaaaagatg

SEQ ID NO: 207037 - DNA, 103 bp, Artificial Sequence
  Synthetic Polynucleotide
taatacgactcactatagggttgtagtccggatactccttcatgtgcacgaacagaggagacgtgcaatggaaggagtaaacctggcggcagcgcaaaagatg

SEQ ID NO: 207038 - DNA, 103 bp, Artificial Sequence
  Synthetic Polynucleotide
taatacgactcactatagggcggtcggtacttgtagtccggatactccttaacagaggagaaaggagatgccggactacaacctggcggcagcgcaaaagatg

SEQ ID NO: 207039 - DNA, 103 bp, Artificial Sequence
  Synthetic Polynucleotide
taatacgactcactatagggtcttgcggcgcggtcggtacttgtagtccgaacagaggagacggactatgagtaccgacaacctggcggcagcgcaaaagatg

SEQ ID NO: 207040 - DNA, 103 bp, Artificial Sequence
  Synthetic Polynucleotide
taatacgactcactatagggagcgtcttggtcttgcggcgcggtcggtacaacagaggagagtaccgatggcgccgcaaaacctggcggcagcgcaaaagatg

SEQ ID NO: 207041 - DNA, 103 bp, Artificial Sequence
  Synthetic Polynucleotide
taatacgactcactatagggtttcttgagcagcgtcttggtcttgcggcgaacagaggagacgccgcatgaccaagacgaacctggcggcagcgcaaaagatg

SEQ ID NO: 207042 - DNA, 103 bp, Artificial Sequence
  Synthetic Polynucleotide
taatacgactcactatagggagtacttatctttcttgagcagcgtcttggaacagaggagaccaagaatgtgctcaagaaacctggcggcagcgcaaaagatg

SEQ ID NO: 207043 - DNA, 103 bp, Artificial Sequence
  Synthetic Polynucleotide
taatacgactcactatagggctgggcagggagtacttatctttcttgagcaacagaggagagctcaaatgagataagtaaacctggcggcagcgcaaaagatg

SEQ ID NO: 207044 - DNA, 103 bp, Artificial Sequence
  Synthetic Polynucleotide
taatacgactcactatagggcaggaggccgctgggcagggagtacttatcaacagaggagagataagatgtccctgcccaacctggcggcagcgcaaaagatg

SEQ ID NO: 207045 - DNA, 103 bp, Artificial Sequence
  Synthetic Polynucleotide
taatacgactcactatagggcaccgggaggcaggaggccgctgggcagggaacagaggagaccctgcatggcggcctccaacctggcggcagcgcaaaagatg

SEQ ID NO: 207046 - DNA, 103 bp, Artificial Sequence
  Synthetic Polynucleotide
taatacgactcactataggggcggccgcggcaccgggaggcaggaggccgaacagaggagacggcctatggcctcccggaacctggcggcagcgcaaaagatg

SEQ ID NO: 207047 - DNA, 103 bp, Artificial Sequence
  Synthetic Polynucleotide
taatacgactcactataggggaagggtaggcttatcaaaatgctccgcgcaacagaggagagcgcggatgattttgataaacctggcggcagcgcaaaagatg

SEQ ID NO: 207048 - DNA, 103 bp, Artificial Sequence
  Synthetic Polynucleotide
taatacgactcactatagggagcggcggcggcggccgcggcaccgggaggaacagaggagacctcccatggccgcggccaacctggcggcagcgcaaaagatg

SEQ ID NO: 207049 - DNA, 103 bp, Artificial Sequence
  Synthetic Polynucleotide
taatacgactcactatagggcggccgcggcagcggcggcggcggccgcggaacagaggagaccgcggatgccgccgccgaacctggcggcagcgcaaaagatg

SEQ ID NO: 207050 - DNA, 103 bp, Artificial Sequence
  Synthetic Polynucleotide
taatacgactcactataggggcagcggctgcggccgcggcagcggcggcgaacagaggagacgccgcatgtgccgcggcaacctggcggcagcgcaaaagatg

SEQ ID NO: 207051 - DNA, 103 bp, Artificial Sequence
  Synthetic Polynucleotide
taatacgactcactatagggactgctggcggcagcggctgcggccgcggcaacagaggagagccgcgatggcagccgctaacctggcggcagcgcaaaagatg

SEQ ID NO: 207052 - DNA, 103 bp, Artificial Sequence
  Synthetic Polynucleotide
taatacgactcactatagggcgcccaccggactgctggcggcagcggctgaacagaggagacagccgatgccgccagcaaacctggcggcagcgcaaaagatg

SEQ ID NO: 207053 - DNA, 103 bp, Artificial Sequence
  Synthetic Polynucleotide
taatacgactcactatagggcgctggcccacgcccaccggactgctggcgaacagaggagacgccagatgtccggtgggaacctggcggcagcgcaaaagatg

SEQ ID NO: 207054 - DNA, 103 bp, Artificial Sequence
  Synthetic Polynucleotide
taatacgactcactatagggcgtgtccaggcgctggcccacgcccaccggaacagaggagaccggtgatggtgggccagaacctggcggcagcgcaaaagatg

SEQ ID NO: 207055 - DNA, 103 bp, Artificial Sequence
  Synthetic Polynucleotide
taatacgactcactatagggcgtgcgtgtacgtgtccaggcgctggcccaaacagaggagatgggccatggcctggacaaacctggcggcagcgcaaaagatg

SEQ ID NO: 207056 - DNA, 103 bp, Artificial Sequence
  Synthetic Polynucleotide
taatacgactcactatagggcagccgttcacgtgcgtgtacgtgtccaggaacagaggagacctggaatggtacacgcaaacctggcggcagcgcaaaagatg

SEQ ID NO: 207057 - DNA, 103 bp, Artificial Sequence
  Synthetic Polynucleotide
taatacgactcactataggggccgttggcccagccgttcacgtgcgtgtaaacagaggagatacacgatggtgaacggcaacctggcggcagcgcaaaagatg

SEQ ID NO: 207058 - DNA, 103 bp, Artificial Sequence
  Synthetic Polynucleotide
taatacgactcactatagggagtccggcgggaagggtaggcttatcaaaaaacagaggagattttgaatggcctaccctaacctggcggcagcgcaaaagatg

SEQ ID NO: 207059 - DNA, 103 bp, Artificial Sequence
  Synthetic Polynucleotide
taatacgactcactataggggcgagtacgcgccgttggcccagccgttcaaacagaggagatgaacgatggggccaacgaacctggcggcagcgcaaaagatg

SEQ ID NO: 207060 - DNA, 103 bp, Artificial Sequence
  Synthetic Polynucleotide
taatacgactcactatagggtcctgcaccagcgagtacgcgccgttggccaacagaggagaggccaaatgcgcgtactcaacctggcggcagcgcaaaagatg

SEQ ID NO: 207061 - DNA, 103 bp, Artificial Sequence
  Synthetic Polynucleotide
taatacgactcactataggggcccagctgctcctgcaccagcgagtacgcaacagaggagagcgtacatgctggtgcagaacctggcggcagcgcaaaagatg

SEQ ID NO: 207062 - DNA, 103 bp, Artificial Sequence
  Synthetic Polynucleotide
taatacgactcactataggggctgcgcgtagcccagctgctcctgcaccaaacagaggagatggtgcatgagcagctggaacctggcggcagcgcaaaagatg

SEQ ID NO: 207063 - DNA, 103 bp, Artificial Sequence
  Synthetic Polynucleotide
taatacgactcactatagggatgctcgggggctgcgcgtagcccagctgcaacagaggagagcagctatgctacgcgcaaacctggcggcagcgcaaaagatg

SEQ ID NO: 207064 - DNA, 103 bp, Artificial Sequence
  Synthetic Polynucleotide
taatacgactcactatagggcgggctgctcatgctcgggggctgcgcgtaaacagaggagatacgcgatgcccccgagcaacctggcggcagcgcaaaagatg

SEQ ID NO: 207065 - DNA, 103 bp, Artificial Sequence
  Synthetic Polynucleotide
taatacgactcactataggggcggcggcggcgggctgctcatgctcggggaacagaggagaccccgaatgtgagcagccaacctggcggcagcgcaaaagatg

SEQ ID NO: 207066 - DNA, 103 bp, Artificial Sequence
  Synthetic Polynucleotide
taatacgactcactatagggggcagcgcgggcggcggcggcgggctgctcaacagaggagagagcagatggccgccgccaacctggcggcagcgcaaaagatg

SEQ ID NO: 207067 - DNA, 103 bp, Artificial Sequence
  Synthetic Polynucleotide
taatacgactcactataggggtgcatcggcggcagcgcgggcggcggcggaacagaggagaccgccgatgcccgcgctgaacctggcggcagcgcaaaagatg

SEQ ID NO: 207068 - DNA, 103 bp, Artificial Sequence
  Synthetic Polynucleotide
taatacgactcactatagggtgtcgtagcggtgcatcggcggcagcgcggaacagaggagaccgcgcatgcgccgatgcaacctggcggcagcgcaaaagatg

SEQ ID NO: 207069 - DNA, 103 bp, Artificial Sequence
  Synthetic Polynucleotide
taatacgactcactatagggtgggccagcgagtccggcgggaagggtaggaacagaggagacctaccatgcccgccggaaacctggcggcagcgcaaaagatg

SEQ ID NO: 207070 - DNA, 103 bp, Artificial Sequence
  Synthetic Polynucleotide
taatacgactcactatagggaggccggccatgtcgtagcggtgcatcggcaacagaggagagccgatatgccgctacgaaacctggcggcagcgcaaaagatg

SEQ ID NO: 207071 - DNA, 103 bp, Artificial Sequence
  Synthetic Polynucleotide
taatacgactcactataggggctgtactgcaggccggccatgtcgtagcgaacagaggagacgctacatgatggccggcaacctggcggcagcgcaaaagatg

SEQ ID NO: 207072 - DNA, 103 bp, Artificial Sequence
  Synthetic Polynucleotide
taatacgactcactataggggcatcattgggctgtactgcaggccggccaaacagaggagatggccgatgtgcagtacaaacctggcggcagcgcaaaagatg

SEQ ID NO: 207073 - DNA, 103 bp, Artificial Sequence
  Synthetic Polynucleotide
taatacgactcactataggggcgccgggcggcatcattgggctgtactgcaacagaggagagcagtaatgcccaatgataacctggcggcagcgcaaaagatg

SEQ ID NO: 207074 - DNA, 103 bp, Artificial Sequence
  Synthetic Polynucleotide
taatacgactcactataggggtagctctgagcgccgggcggcatcattggaacagaggagaccaatgatgccgcccggcaacctggcggcagcgcaaaagatg

SEQ ID NO: 207075 - DNA, 103 bp, Artificial Sequence
  Synthetic Polynucleotide
taatacgactcactatagggcgacgttcatgtagctctgagcgccgggcgaacagaggagacgcccgatgctcagagctaacctggcggcagcgcaaaagatg

SEQ ID NO: 207076 - DNA, 103 bp, Artificial Sequence
  Synthetic Polynucleotide
taatacgactcactataggggccgcggcagcgacgttcatgtagctctgaaacagaggagatcagagatgcatgaacgtaacctggcggcagcgcaaaagatg

SEQ ID NO: 207077 - DNA, 103 bp, Artificial Sequence
  Synthetic Polynucleotide
taatacgactcactatagggggcggcggcggccgcggcagcgacgttcataacagaggagaatgaacatggctgccgcgaacctggcggcagcgcaaaagatg

SEQ ID NO: 207078 - DNA, 103 bp, Artificial Sequence
  Synthetic Polynucleotide
taatacgactcactatagggcgtagcccgaggcggcggcggccgcggcagaacagaggagactgccgatgccgccgccgaacctggcggcagcgcaaaagatg

SEQ ID NO: 207079 - DNA, 103 bp, Artificial Sequence
  Synthetic Polynucleotide
taatacgactcactataggggccatgcccccgtagcccgaggcggcggcgaacagaggagacgccgcatgctcgggctaaacctggcggcagcgcaaaagatg

SEQ ID NO: 207080 - DNA, 103 bp, Artificial Sequence
  Synthetic Polynucleotide
taatacgactcactataggggttctcggcattgttggtttgctgcaccataacagaggagaatggtgatgcaaaccaacaacctggcggcagcgcaaaagatg

SEQ ID NO: 207081 - DNA, 103 bp, Artificial Sequence
  Synthetic Polynucleotide
taatacgactcactatagggggcggtggagccgggcgtgggggaggaggcaacagaggagagcctccatgcccacgcccaacctggcggcagcgcaaaagatg

SEQ ID NO: 207082 - DNA, 103 bp, Artificial Sequence
  Synthetic Polynucleotide
taatacgactcactataggggctcaggctgggcgcgtcgggcgagcagccaacagaggagaggctgcatgcccgacgcgaacctggcggcagcgcaaaagatg

SEQ ID NO: 207083 - DNA, 103 bp, Artificial Sequence
  Synthetic Polynucleotide
taatacgactcactatagggtgctgcggccgctcaggctgggcgcgtcggaacagaggagaccgacgatgccagcctgaaacctggcggcagcgcaaaagatg

SEQ ID NO: 207084 - DNA, 103 bp, Artificial Sequence
  Synthetic Polynucleotide
taatacgactcactataggggaggcggcgctgctgcggccgctcaggctgaacagaggagacagcctatgcggccgcagaacctggcggcagcgcaaaagatg

SEQ ID NO: 207085 - DNA, 103 bp, Artificial Sequence
  Synthetic Polynucleotide
taatacgactcactatagggggcgggggacgaggcggcgctgctgcggccaacagaggagaggccgcatgagcgccgccaacctggcggcagcgcaaaagatg

SEQ ID NO: 207086 - DNA, 103 bp, Artificial Sequence
  Synthetic Polynucleotide
taatacgactcactatagggagcggccggcggcgggggacgaggcggcgcaacagaggagagcgccgatgcgtcccccgaacctggcggcagcgcaaaagatg

SEQ ID NO: 207087 - DNA, 103 bp, Artificial Sequence
  Synthetic Polynucleotide
taatacgactcactatagggtcggcgggcgagcggccggcggcgggggacaacagaggagagtccccatgcgccggccgaacctggcggcagcgcaaaagatg

SEQ ID NO: 207088 - DNA, 103 bp, Artificial Sequence
  Synthetic Polynucleotide
taatacgactcactataggggccgcggtggtcggcgggcgagcggccggcaacagaggagagccggcatgtcgcccgccaacctggcggcagcgcaaaagatg

SEQ ID NO: 207089 - DNA, 103 bp, Artificial Sequence
  Synthetic Polynucleotide
taatacgactcactatagggggctggcgtagccgcggtggtcggcgggcgaacagaggagacgcccgatgaccaccgcgaacctggcggcagcgcaaaagatg

SEQ ID NO: 207090 - DNA, 103 bp, Artificial Sequence
  Synthetic Polynucleotide
taatacgactcactataggggcggcgcgcaggctggcgtagccgcggtggaacagaggagaccaccgatgctacgccagaacctggcggcagcgcaaaagatg

SEQ ID NO: 207091 - DNA, 103 bp, Artificial Sequence
  Synthetic Polynucleotide
taatacgactcactatagggggcgggcgaggcggcgcgcaggctggcgtaaacagaggagatacgccatgctgcgcgccaacctggcggcagcgcaaaagatg

SEQ ID NO: 207092 - DNA, 103 bp, Artificial Sequence
  Synthetic Polynucleotide
taatacgactcactatagggcgcccgtggaggcggtggagccgggcgtggaacagaggagaccacgcatggctccaccgaacctggcggcagcgcaaaagatg

SEQ ID NO: 207093 - DNA, 103 bp, Artificial Sequence
  Synthetic Polynucleotide
taatacgactcactatagggcgctggacggggcgggcgaggcggcgcgcaaacagaggagatgcgcgatgcctcgcccgaacctggcggcagcgcaaaagatg

SEQ ID NO: 207094 - DNA, 103 bp, Artificial Sequence
  Synthetic Polynucleotide
taatacgactcactatagggtgcgagggcgcgctggacggggcgggcgagaacagaggagactcgccatgcccgtccagaacctggcggcagcgcaaaagatg

SEQ ID NO: 207095 - DNA, 103 bp, Artificial Sequence
  Synthetic Polynucleotide
taatacgactcactatagggggaggacgcgtgcgagggcgcgctggacggaacagaggagaccgtccatggcgccctcgaacctggcggcagcgcaaaagatg

SEQ ID NO: 207096 - DNA, 103 bp, Artificial Sequence
  Synthetic Polynucleotide
taatacgactcactatagggacgaggccgaggaggacgcgtgcgagggcgaacagaggagacgccctatgacgcgtcctaacctggcggcagcgcaaaagatg

SEQ ID NO: 207097 - DNA, 103 bp, Artificial Sequence
  Synthetic Polynucleotide
taatacgactcactataggggaggagtgggacgaggccgaggaggacgcgaacagaggagacgcgtcatgctcggcctcaacctggcggcagcgcaaaagatg

SEQ ID NO: 207098 - DNA, 103 bp, Artificial Sequence
  Synthetic Polynucleotide
taatacgactcactatagggggaggaagaggaggagtgggacgaggccgaaacagaggagatcggccatgtcccactccaacctggcggcagcgcaaaagatg

SEQ ID NO: 207099 - DNA, 103 bp, Artificial Sequence
  Synthetic Polynucleotide
taatacgactcactatagggagcccgaggaggaggaagaggaggagtgggaacagaggagacccactatgcctcttcctaacctggcggcagcgcaaaagatg

SEQ ID NO: 207100 - DNA, 103 bp, Artificial Sequence
  Synthetic Polynucleotide
taatacgactcactataggggaggacgaggagcccgaggaggaggaagagaacagaggagactcttcatgctcctcgggaacctggcggcagcgcaaaagatg

SEQ ID NO: 207101 - DNA, 103 bp, Artificial Sequence
  Synthetic Polynucleotide
taatacgactcactatagggctcgtcgtcggaggacgaggagcccgaggaaacagaggagatcctcgatgtcctcgtccaacctggcggcagcgcaaaagatg

SEQ ID NO: 207102 - DNA, 103 bp, Artificial Sequence
  Synthetic Polynucleotide
taatacgactcactatagggcgtcttcgaactcgtcgtcggaggacgaggaacagaggagacctcgtatgccgacgacgaacctggcggcagcgcaaaagatg

SEQ ID NO: 207103 - DNA, 103 bp, Artificial Sequence
  Synthetic Polynucleotide
taatacgactcactatagggtcggccttgccgcccgtggaggcggtggagaacagaggagactccacatgctccacgggaacctggcggcagcgcaaaagatg

SEQ ID NO: 207104 - DNA, 103 bp, Artificial Sequence
  Synthetic Polynucleotide
taatacgactcactatagggtcgagcaggtcgtcttcgaactcgtcgtcgaacagaggagacgacgaatggttcgaagaaacctggcggcagcgcaaaagatg

SEQ ID NO: 207105 - DNA, 103 bp, Artificial Sequence
  Synthetic Polynucleotide
taatacgactcactatagggggggttcaggtcgagcaggtcgtcttcgaaaacagaggagattcgaaatggacctgctcaacctggcggcagcgcaaaagatg

SEQ ID NO: 207106 - DNA, 103 bp, Artificial Sequence
  Synthetic Polynucleotide
taatacgactcactatagggagtttgagctggggttcaggtcgagcaggtaacagaggagaacctgcatgacctgaaccaacctggcggcagcgcaaaagatg

SEQ ID NO: 207107 - DNA, 103 bp, Artificial Sequence
  Synthetic Polynucleotide
taatacgactcactatagggatgctctcaaagtttgagctggggttcaggaacagaggagacctgaaatgcagctcaaaaacctggcggcagcgcaaaagatg

SEQ ID NO: 207108 - DNA, 103 bp, Artificial Sequence
  Synthetic Polynucleotide
taatacgactcactataggggcccagggacatgctctcaaagtttgagctaacagaggagaagctcaatgtttgagagcaacctggcggcagcgcaaaagatg

SEQ ID NO: 207109 - DNA, 103 bp, Artificial Sequence
  Synthetic Polynucleotide
taatacgactcactatagggaactgaagctgcccagggacatgctctcaaaacagaggagattgagaatgtgtccctggaacctggcggcagcgcaaaagatg

SEQ ID NO: 207110 - DNA, 103 bp, Artificial Sequence
  Synthetic Polynucleotide
taatacgactcactataggggccgacgacgaactgaagctgcccagggacaacagaggagagtccctatgcagcttcagaacctggcggcagcgcaaaagatg

SEQ ID NO: 207111 - DNA, 103 bp, Artificial Sequence
  Synthetic Polynucleotide
taatacgactcactatagggccggtcgagcgccgacgacgaactgaagctaacagaggagaagcttcatgtcgtcgtcgaacctggcggcagcgcaaaagatg

SEQ ID NO: 207112 - DNA, 103 bp, Artificial Sequence
  Synthetic Polynucleotide
taatacgactcactatagggaatccaggtcccggtcgagcgccgacgacgaacagaggagacgtcgtatgcgctcgaccaacctggcggcagcgcaaaagatg

SEQ ID NO: 207113 - DNA, 103 bp, Artificial Sequence
  Synthetic Polynucleotide
taatacgactcactatagggtcgaagttaaaatccaggtcccggtcgagcaacagaggagagctcgaatgggacctggaaacctggcggcagcgcaaaagatg

SEQ ID NO: 207114 - DNA, 103 bp, Artificial Sequence
  Synthetic Polynucleotide
taatacgactcactataggggctcgggtcgtcggccttgccgcccgtggaaacagaggagatccacgatgggcaaggccaacctggcggcagcgcaaaagatg

SEQ ID NO: 207115 - DNA, 103 bp, Artificial Sequence
  Synthetic Polynucleotide
taatacgactcactatagggggagccgggctcgaagttaaaatccaggtcaacagaggagagacctgatgtttaacttcaacctggcggcagcgcaaaagatg

SEQ ID NO: 207116 - DNA, 103 bp, Artificial Sequence
  Synthetic Polynucleotide
taatacgactcactatagggagtgcgagccggagccgggctcgaagttaaaacagaggagattaactatgagcccggctaacctggcggcagcgcaaaagatg

SEQ ID NO: 207117 - DNA, 103 bp, Artificial Sequence
  Synthetic Polynucleotide
taatacgactcactataggggggaactcgaagtgcgagccggagccgggcaacagaggagagcccggatgcggctcgcaaacctggcggcagcgcaaaagatg

SEQ ID NO: 207118 - DNA, 103 bp, Artificial Sequence
  Synthetic Polynucleotide
taatacgactcactataggggcagtagtccgggaactcgaagtgcgagccaacagaggagaggctcgatgttcgagttcaacctggcggcagcgcaaaagatg

SEQ ID NO: 207119 - DNA, 103 bp, Artificial Sequence
  Synthetic Polynucleotide
taatacgactcactatagggcctcgggcgtgcagtagtccgggaactcgaaacagaggagatcgagtatgcggactactaacctggcggcagcgcaaaagatg

SEQ ID NO: 207120 - DNA, 103 bp, Artificial Sequence
  Synthetic Polynucleotide
taatacgactcactatagggatctcgctcacctcgggcgtgcagtagtccaacagaggagaggactaatgcacgcccgaaacctggcggcagcgcaaaagatg

SEQ ID NO: 207121 - DNA, 103 bp, Artificial Sequence
  Synthetic Polynucleotide
taatacgactcactatagggtcccgagatcatctcgctcacctcgggcgtaacagaggagaacgcccatggtgagcgagaacctggcggcagcgcaaaagatg

SEQ ID NO: 207122 - DNA, 103 bp, Artificial Sequence
  Synthetic Polynucleotide
taatacgactcactatagggcgagccagtctcccgagatcatctcgctcaaacagaggagatgagcgatgtgatctcggaacctggcggcagcgcaaaagatg

SEQ ID NO: 207123 - DNA, 103 bp, Artificial Sequence
  Synthetic Polynucleotide
taatacgactcactatagggatgctggactcgagccagtctcccgagatcaacagaggagagatctcatgagactggctaacctggcggcagcgcaaaagatg

SEQ ID NO: 207124 - DNA, 103 bp, Artificial Sequence
  Synthetic Polynucleotide
taatacgactcactatagggcaggttggagatgctggactcgagccagtcaacagaggagagactggatggagtccagcaacctggcggcagcgcaaaagatg

SEQ ID NO: 207125 - DNA, 103 bp, Artificial Sequence
  Synthetic Polynucleotide
taatacgactcactatagggtcttgcaccagctcgggtcgtcggccttgcaacagaggagagcaaggatgacgacccgaaacctggcggcagcgcaaaagatg

SEQ ID NO: 207126 - DNA, 103 bp, Artificial Sequence
  Synthetic Polynucleotide
taatacgactcactatagggaggtgaaaaccaggttggagatgctggactaacagaggagaagtccaatgtctccaaccaacctggcggcagcgcaaaagatg

SEQ ID NO: 207127 - DNA, 103 bp, Artificial Sequence
  Synthetic Polynucleotide
taatacgactcactatagggccactcggggtcttgcaccagctcgggtcgaacagaggagacgacccatgctggtgcaaaacctggcggcagcgcaaaagatg

SEQ ID NO: 207128 - DNA, 103 bp, Artificial Sequence
  Synthetic Polynucleotide
taatacgactcactatagggcttgatgtgcccactcggggtcttgcaccaaacagaggagatggtgcatgaccccgagtaacctggcggcagcgcaaaagatg

SEQ ID NO: 207129 - DNA, 103 bp, Artificial Sequence
  Synthetic Polynucleotide
taatacgactcactatagggtcatgggtcgcttgatgtgcccactcggggaacagaggagaccccgaatgggcacatcaaacctggcggcagcgcaaaagatg

SEQ ID NO: 207130 - DNA, 103 bp, Artificial Sequence
  Synthetic Polynucleotide
taatacgactcactatagggatgaaggcgttcatgggtcgcttgatgtgcaacagaggagagcacatatggcgacccataacctggcggcagcgcaaaagatg

SEQ ID NO: 207131 - DNA, 103 bp, Artificial Sequence
  Synthetic Polynucleotide
taatacgactcactatagggcgaccacaccatgaaggcgttcatgggtcgaacagaggagacgacccatgaacgccttcaacctggcggcagcgcaaaagatg

SEQ ID NO: 207132 - DNA, 103 bp, Artificial Sequence
  Synthetic Polynucleotide
taatacgactcactataggggcgcttccgtgttctcggcattgttggtttaacagaggagaaaaccaatgatgccgagaaacctggcggcagcgcaaaagatg

SEQ ID NO: 207133 - DNA, 103 bp, Artificial Sequence
  Synthetic Polynucleotide
taatacgactcactataggggctcgatctgcgaccacaccatgaaggcgtaacagaggagaacgcctatgtggtgtggtaacctggcggcagcgcaaaagatg

SEQ ID NO: 207134 - DNA, 103 bp, Artificial Sequence
  Synthetic Polynucleotide
taatacgactcactatagggatcttgcgccgctcgatctgcgaccacaccaacagaggagaggtgtgatggcagatcgaaacctggcggcagcgcaaaagatg

SEQ ID NO: 207135 - DNA, 103 bp, Artificial Sequence
  Synthetic Polynucleotide
taatacgactcactatagggctgctccatgatcttgcgccgctcgatctgaacagaggagacagatcatgcggcgcaagaacctggcggcagcgcaaaagatg

SEQ ID NO: 207136 - DNA, 103 bp, Artificial Sequence
  Synthetic Polynucleotide
taatacgactcactatagggtgtcgggcgactgctccatgatcttgcgccaacagaggagaggcgcaatgtcatggagcaacctggcggcagcgcaaaagatg

SEQ ID NO: 207137 - DNA, 103 bp, Artificial Sequence
  Synthetic Polynucleotide
taatacgactcactataggggcgttgtgcatgtcgggcgactgctccatgaacagaggagacatggaatggtcgcccgaaacctggcggcagcgcaaaagatg

SEQ ID NO: 207138 - DNA, 103 bp, Artificial Sequence
  Synthetic Polynucleotide
taatacgactcactatagggggagatctcggcgttgtgcatgtcgggcgaaacagaggagatcgcccatgatgcacaacaacctggcggcagcgcaaaagatg

SEQ ID NO: 207139 - DNA, 103 bp, Artificial Sequence
  Synthetic Polynucleotide
taatacgactcactatagggccagccgcttggagatctcggcgttgtgcaaacagaggagatgcacaatgccgagatctaacctggcggcagcgcaaaagatg

SEQ ID NO: 207140 - DNA, 103 bp, Artificial Sequence
  Synthetic Polynucleotide
taatacgactcactatagggcagcgtttgcccagccgcttggagatctcgaacagaggagacgagatatgcaagcggctaacctggcggcagcgcaaaagatg

SEQ ID NO: 207141 - DNA, 103 bp, Artificial Sequence
  Synthetic Polynucleotide
taatacgactcactataggggagcagcttccagcgtttgcccagccgcttaacagaggagaaagcggatgggcaaacgcaacctggcggcagcgcaaaagatg

SEQ ID NO: 207142 - DNA, 103 bp, Artificial Sequence
  Synthetic Polynucleotide
taatacgactcactatagggcgctgtctttgagcagcttccagcgtttgcaacagaggagagcaaacatgggaagctgcaacctggcggcagcgcaaaagatg

SEQ ID NO: 207143 - DNA, 103 bp, Artificial Sequence
  Synthetic Polynucleotide
taatacgactcactatagggccggccagcagcgcttccgtgttctcggcaaacagaggagatgccgaatgcacggaagcaacctggcggcagcgcaaaagatg

SEQ ID NO: 207144 - DNA, 103 bp, Artificial Sequence
  Synthetic Polynucleotide
taatacgactcactataggggggatcttgtcgctgtctttgagcagcttcaacagaggagagaagctatgcaaagacagaacctggcggcagcgcaaaagatg

SEQ ID NO: 207145 - DNA, 103 bp, Artificial Sequence
  Synthetic Polynucleotide
taatacgactcactatagggtcgaatgaaagggatcttgtcgctgtctttaacagaggagaaaagacatggacaagatcaacctggcggcagcgcaaaagatg

SEQ ID NO: 207146 - DNA, 103 bp, Artificial Sequence
  Synthetic Polynucleotide
taatacgactcactataggggctccgcctctcgaatgaaagggatcttgtaacagaggagaacaagaatgctttcattcaacctggcggcagcgcaaaagatg

SEQ ID NO: 207147 - DNA, 103 bp, Artificial Sequence
  Synthetic Polynucleotide
taatacgactcactatagggaggcgcagccgctccgcctctcgaatgaaaaacagaggagatttcatatgagaggcggaaacctggcggcagcgcaaaagatg

SEQ ID NO: 207148 - DNA, 103 bp, Artificial Sequence
  Synthetic Polynucleotide
taatacgactcactatagggcatgtgcttgaggcgcagccgctccgcctcaacagaggagagaggcgatgcggctgcgcaacctggcggcagcgcaaaagatg

SEQ ID NO: 207149 - DNA, 103 bp, Artificial Sequence
  Synthetic Polynucleotide
taatacgactcactatagggggtagtcagccatgtgcttgaggcgcagccaacagaggagaggctgcatgtcaagcacaaacctggcggcagcgcaaaagatg

SEQ ID NO: 207150 - DNA, 103 bp, Artificial Sequence
  Synthetic Polynucleotide
taatacgactcactatagggttgtagtcggggtagtcagccatgtgcttgaacagaggagacaagcaatgggctgactaaacctggcggcagcgcaaaagatg

SEQ ID NO: 207151 - DNA, 103 bp, Artificial Sequence
  Synthetic Polynucleotide
taatacgactcactataggggggccggtacttgtagtcggggtagtcagcaacagaggagagctgacatgcccgactacaacctggcggcagcgcaaaagatg

SEQ ID NO: 207152 - DNA, 103 bp, Artificial Sequence
  Synthetic Polynucleotide
taatacgactcactatagggccttcttcctgggccggtacttgtagtcggaacagaggagaccgactatgagtaccggcaacctggcggcagcgcaaaagatg

SEQ ID NO: 207153 - DNA, 103 bp, Artificial Sequence
  Synthetic Polynucleotide
taatacgactcactatagggccggacttcaccttcttcctgggccggtacaacagaggagagtaccgatgcaggaagaaaacctggcggcagcgcaaaagatg

SEQ ID NO: 207154 - DNA, 103 bp, Artificial Sequence
  Synthetic Polynucleotide
taatacgactcactatagggcgagctctcgccggccagcagcgcttccgtaacagaggagaacggaaatgctgctggccaacctggcggcagcgcaaaagatg

SEQ ID NO: 207155 - DNA, 103 bp, Artificial Sequence
  Synthetic Polynucleotide
taatacgactcactataggggttggcgttgccggacttcaccttcttcctaacagaggagaaggaagatggtgaagtccaacctggcggcagcgcaaaagatg

SEQ ID NO: 207156 - DNA, 103 bp, Artificial Sequence
  Synthetic Polynucleotide
taatacgactcactatagggaggagctggagttggcgttgccggacttcaaacagaggagatgaagtatggcaacgccaaacctggcggcagcgcaaaagatg

SEQ ID NO: 207157 - DNA, 103 bp, Artificial Sequence
  Synthetic Polynucleotide
taatacgactcactataggggcggcggccgaggagctggagttggcgttgaacagaggagacaacgcatgctccagctcaacctggcggcagcgcaaaagatg

SEQ ID NO: 207158 - DNA, 103 bp, Artificial Sequence
  Synthetic Polynucleotide
taatacgactcactatagggcttggaggaggcggcggccgaggagctggaaacagaggagatccagcatgtcggccgccaacctggcggcagcgcaaaagatg

SEQ ID NO: 207159 - DNA, 103 bp, Artificial Sequence
  Synthetic Polynucleotide
taatacgactcactatagggtctcccccggcttggaggaggcggcggccgaacagaggagacggccgatgcctcctccaaacctggcggcagcgcaaaagatg

SEQ ID NO: 207160 - DNA, 103 bp, Artificial Sequence
  Synthetic Polynucleotide
taatacgactcactatagggttgtctcccttctcccccggcttggaggagaacagaggagactcctcatggccgggggaaacctggcggcagcgcaaaagatg

SEQ ID NO: 207161 - DNA, 103 bp, Artificial Sequence
  Synthetic Polynucleotide
taatacgactcactataggggccaccgaccttgtctcccttctcccccggaacagaggagaccggggatgaagggagacaacctggcggcagcgcaaaagatg

SEQ ID NO: 207162 - DNA, 103 bp, Artificial Sequence
  Synthetic Polynucleotide
taatacgactcactatagggccccgccactgccaccgaccttgtctccctaacagaggagaagggagatgaggtcggtgaacctggcggcagcgcaaaagatg

SEQ ID NO: 207163 - DNA, 103 bp, Artificial Sequence
  Synthetic Polynucleotide
taatacgactcactatagggccatggccgcccccgccactgccaccgaccaacagaggagaggtcggatgcagtggcggaacctggcggcagcgcaaaagatg

SEQ ID NO: 207164 - DNA, 103 bp, Artificial Sequence
  Synthetic Polynucleotide
taatacgactcactataggggccgccgcccccatggccgcccccgccactaacagaggagaagtggcatgggcggccataacctggcggcagcgcaaaagatg

SEQ ID NO: 207165 - DNA, 103 bp, Artificial Sequence
  Synthetic Polynucleotide
taatacgactcactatagggcgcccgagtccgagctctcgccggccagcaaacagaggagatgctggatggcgagagctaacctggcggcagcgcaaaagatg

SEQ ID NO: 207166 - DNA, 103 bp, Artificial Sequence
  Synthetic Polynucleotide
taatacgactcactatagggtcccgccgccgccgccgcccccatggccgcaacagaggagagcggccatgggggcggcgaacctggcggcagcgcaaaagatg

SEQ ID NO: 207167 - DNA, 103 bp, Artificial Sequence
  Synthetic Polynucleotide
taatacgactcactataggggcgttgctgctcccgccgccgccgccgcccaacagaggagagggcggatgcggcggcggaacctggcggcagcgcaaaagatg

SEQ ID NO: 207168 - DNA, 103 bp, Artificial Sequence
  Synthetic Polynucleotide
taatacgactcactatagggtcctccccccgcgttgctgctcccgccgccaacagaggagaggcggcatgagcagcaacaacctggcggcagcgcaaaagatg

SEQ ID NO: 207169 - DNA, 103 bp, Artificial Sequence
  Synthetic Polynucleotide
taatacgactcactatagggcaccgccgcctcctccccccgcgttgctgcaacagaggagagcagcaatgcggggggagaacctggcggcagcgcaaaagatg

SEQ ID NO: 207170 - DNA, 103 bp, Artificial Sequence
  Synthetic Polynucleotide
taatacgactcactatagggccgccactcgcaccgccgcctcctccccccaacagaggagaggggggatgaggcggcggaacctggcggcagcgcaaaagatg

SEQ ID NO: 207171 - DNA, 103 bp, Artificial Sequence
  Synthetic Polynucleotide
taatacgactcactataggggttggcgccgccgccactcgcaccgccgccaacagaggagaggcggcatggcgagtggcaacctggcggcagcgcaaaagatg

SEQ ID NO: 207172 - DNA, 103 bp, Artificial Sequence
  Synthetic Polynucleotide
taatacgactcactatagggccggtttggagttggcgccgccgccactcgaacagaggagacgagtgatggcggcgccaaacctggcggcagcgcaaaagatg

SEQ ID NO: 207173 - DNA, 103 bp, Artificial Sequence
  Synthetic Polynucleotide
taatacgactcactatagggtttttctgcgccggtttggagttggcgccgaacagaggagacggcgcatgctccaaaccaacctggcggcagcgcaaaagatg

SEQ ID NO: 207174 - DNA, 103 bp, Artificial Sequence
  Synthetic Polynucleotide
taatacgactcactataggggccgcagctctttttctgcgccggtttggaaacagaggagatccaaaatggcgcagaaaaacctggcggcagcgcaaaagatg

SEQ ID NO: 207175 - DNA, 103 bp, Artificial Sequence
  Synthetic Polynucleotide
taatacgactcactatagggccactttggagccgcagctctttttctgcgaacagaggagacgcagaatgagagctgcgaacctggcggcagcgcaaaagatg

SEQ ID NO: 207176 - DNA, 103 bp, Artificial Sequence
  Synthetic Polynucleotide
taatacgactcactatagggtcgaggccggcgcccgagtccgagctctcgaacagaggagacgagagatgggactcgggaacctggcggcagcgcaaaagatg

SEQ ID NO: 207177 - DNA, 103 bp, Artificial Sequence
  Synthetic Polynucleotide
taatacgactcactataggggcgccgcccgccactttggagccgcagctcaacagaggagagagctgatgctccaaagtaacctggcggcagcgcaaaagatg

SEQ ID NO: 207178 - DNA, 103 bp, Artificial Sequence
  Synthetic Polynucleotide
taatacgactcactatagggcccaccgcccgcgccgcccgccactttggaaacagaggagatccaaaatggcgggcggcaacctggcggcagcgcaaaagatg

SEQ ID NO: 207179 - DNA, 103 bp, Artificial Sequence
  Synthetic Polynucleotide
taatacgactcactataggggtttgctaaccccaccgcccgcgccgcccgaacagaggagacgggcgatgcgggcggtgaacctggcggcagcgcaaaagatg

SEQ ID NO: 207180 - DNA, 103 bp, Artificial Sequence
  Synthetic Polynucleotide
taatacgactcactatagggttggcgtgcggtttgctaaccccaccgcccaacagaggagagggcggatgggttagcaaaacctggcggcagcgcaaaagatg

SEQ ID NO: 207181 - DNA, 103 bp, Artificial Sequence
  Synthetic Polynucleotide
taatacgactcactatagggcaggatgagcttggcgtgcggtttgctaacaacagaggagagttagcatgccgcacgccaacctggcggcagcgcaaaagatg

SEQ ID NO: 207182 - DNA, 103 bp, Artificial Sequence
  Synthetic Polynucleotide
taatacgactcactatagggcgccgcctgccaggatgagcttggcgtgcgaacagaggagacgcacgatgagctcatccaacctggcggcagcgcaaaagatg

SEQ ID NO: 207183 - DNA, 103 bp, Artificial Sequence
  Synthetic Polynucleotide
taatacgactcactatagggccgccgccgccgccgcctgccaggatgagcaacagaggagagctcatatgggcaggcggaacctggcggcagcgcaaaagatg

SEQ ID NO: 207184 - DNA, 103 bp, Artificial Sequence
  Synthetic Polynucleotide
taatacgactcactatagggcgctgctttcccgccgccgccgccgcctgcaacagaggagagcaggcatgggcggcggcaacctggcggcagcgcaaaagatg

SEQ ID NO: 207185 - DNA, 103 bp, Artificial Sequence
  Synthetic Polynucleotide
taatacgactcactatagggcggcggcagccgctgctttcccgccgccgcaacagaggagagcggcgatgggaaagcagaacctggcggcagcgcaaaagatg

SEQ ID NO: 207186 - DNA, 103 bp, Artificial Sequence
  Synthetic Polynucleotide
taatacgactcactatagggaaggaggcggcggcggcagccgctgctttcaacagaggagagaaagcatgggctgccgcaacctggcggcagcgcaaaagatg

SEQ ID NO: 207187 - DNA, 103 bp, Artificial Sequence
  Synthetic Polynucleotide
taatacgactcactataggggattcccagctcgaggccggcgcccgagtcaacagaggagagactcgatggccggcctcaacctggcggcagcgcaaaagatg

SEQ ID NO: 207188 - DNA, 103 bp, Artificial Sequence
  Synthetic Polynucleotide
taatacgactcactatagggttcggcggcgaaggaggcggcggcggcagcaacagaggagagctgccatggccgcctccaacctggcggcagcgcaaaagatg

SEQ ID NO: 207189 - DNA, 103 bp, Artificial Sequence
  Synthetic Polynucleotide
taatacgactcactatagggcccccgcctgttcggcggcgaaggaggcggaacagaggagaccgcctatgtcgccgccgaacctggcggcagcgcaaaagatg

SEQ ID NO: 207190 - DNA, 103 bp, Artificial Sequence
  Synthetic Polynucleotide
taatacgactcactatagggagggcggcggcccccgcctgttcggcggcgaacagaggagacgccgcatgacaggcgggaacctggcggcagcgcaaaagatg

SEQ ID NO: 207191 - DNA, 103 bp, Artificial Sequence
  Synthetic Polynucleotide
taatacgactcactatagggcaggggcagcagggcggcggcccccgcctgaacagaggagacaggcgatggccgccgccaacctggcggcagcgcaaaagatg

SEQ ID NO: 207192 - DNA, 103 bp, Artificial Sequence
  Synthetic Polynucleotide
taatacgactcactatagggcggcggcgcccaggggcagcagggcggcggaacagaggagaccgccgatgtgctgccccaacctggcggcagcgcaaaagatg

SEQ ID NO: 207193 - DNA, 103 bp, Artificial Sequence
  Synthetic Polynucleotide
taatacgactcactatagggtggtggtcggcggcggcgcccaggggcagcaacagaggagagctgccatggggcgccgcaacctggcggcagcgcaaaagatg

SEQ ID NO: 207194 - DNA, 103 bp, Artificial Sequence
  Synthetic Polynucleotide
taatacgactcactataggggtacagcgagtggtggtcggcggcggcgccaacagaggagaggcgccatggccgaccacaacctggcggcagcgcaaaagatg

SEQ ID NO: 207195 - DNA, 103 bp, Artificial Sequence
  Synthetic Polynucleotide
taatacgactcactatagggtccgcgccttgtacagcgagtggtggtcggaacagaggagaccgaccatgactcgctgtaacctggcggcagcgcaaaagatg

SEQ ID NO: 207196 - DNA, 103 bp, Artificial Sequence
  Synthetic Polynucleotide
taatacgactcactataggggcgctgggagtccgcgccttgtacagcgagaacagaggagactcgctatgcaaggcgcgaacctggcggcagcgcaaaagatg

SEQ ID NO: 207197 - DNA, 103 bp, Artificial Sequence
  Synthetic Polynucleotide
taatacgactcactatagggggaggccgaggcgctgggagtccgcgccttaacagaggagaaaggcgatgactcccagcaacctggcggcagcgcaaaagatg

SEQ ID NO: 207198 - DNA, 103 bp, Artificial Sequence
  Synthetic Polynucleotide
taatacgactcactataggggggaggaggcgattcccagctcgaggccggaacagaggagaccggccatgagctgggaaaacctggcggcagcgcaaaagatg

SEQ ID NO: 207199 - DNA, 103 bp, Artificial Sequence
  Synthetic Polynucleotide
taatacgactcactatagggccgaggaggcggaggccgaggcgctgggagaacagaggagactcccaatgcctcggcctaacctggcggcagcgcaaaagatg

SEQ ID NO: 207200 - DNA, 103 bp, Artificial Sequence
  Synthetic Polynucleotide
taatacgactcactataggggccgaggctgccgaggaggcggaggccgagaacagaggagactcggcatgcgcctcctcaacctggcggcagcgcaaaagatg

SEQ ID NO: 207201 - DNA, 103 bp, Artificial Sequence
  Synthetic Polynucleotide
taatacgactcactatagggcgctgcggaggccgaggctgccgaggaggcaacagaggagagcctccatggcagcctcgaacctggcggcagcgcaaaagatg

SEQ ID NO: 207202 - DNA, 103 bp, Artificial Sequence
  Synthetic Polynucleotide
taatacgactcactataggggggccgcgagcgctgcggaggccgaggctgaacagaggagacagcctatgcctccgcagaacctggcggcagcgcaaaagatg

SEQ ID NO: 207203 - DNA, 103 bp, Artificial Sequence
  Synthetic Polynucleotide
taatacgactcactatagggtgcttgcccggggccgcgagcgctgcggagaacagaggagactccgcatggctcgcggcaacctggcggcagcgcaaaagatg

SEQ ID NO: 207204 - DNA, 103 bp, Artificial Sequence
  Synthetic Polynucleotide
taatacgactcactatagggctccgccaggtgcttgcccggggccgcgagaacagaggagactcgcgatgccgggcaagaacctggcggcagcgcaaaagatg

SEQ ID NO: 207205 - DNA, 103 bp, Artificial Sequence
  Synthetic Polynucleotide
taatacgactcactatagggtcaccttcttctccgccaggtgcttgcccgaacagaggagacgggcaatgacctggcggaacctggcggcagcgcaaaagatg

SEQ ID NO: 207206 - DNA, 103 bp, Artificial Sequence
  Synthetic Polynucleotide
taatacgactcactatagggtagacgcgcttcaccttcttctccgccaggaacagaggagacctggcatggaagaaggtaacctggcggcagcgcaaaagatg

SEQ ID NO: 207207 - DNA, 103 bp, Artificial Sequence
  Synthetic Polynucleotide
taatacgactcactataggggccgaacaggtagacgcgcttcaccttcttaacagaggagaaagaagatgaagcgcgtcaacctggcggcagcgcaaaagatg

SEQ ID NO: 207208 - DNA, 103 bp, Artificial Sequence
  Synthetic Polynucleotide
taatacgactcactatagggtgcccaggccgccgaacaggtagacgcgctaacagaggagaagcgcgatgacctgttcgaacctggcggcagcgcaaaagatg

SEQ ID NO: 207209 - DNA, 103 bp, Artificial Sequence
  Synthetic Polynucleotide
taatacgactcactatagggccgggcgtgggggaggaggcgattcccagcaacagaggagagctgggatgcgcctcctcaacctggcggcagcgcaaaagatg

SEQ ID NO: 207210 - DNA, 103 bp, Artificial Sequence
  Synthetic Polynucleotide
taatacgactcactataggggacgacgacgtgcccaggccgccgaacaggaacagaggagacctgttatgcggcctgggaacctggcggcagcgcaaaagatg

SEQ ID NO: 207211 - DNA, 103 bp, Artificial Sequence
  Synthetic Polynucleotide
taatacgactcactataggggcccacgggcgacgacgacgtgcccaggccaacagaggagaggcctgatgacgtcgtcgaacctggcggcagcgcaaaagatg

SEQ ID NO: 207212 - DNA, 103 bp, Artificial Sequence
  Synthetic Polynucleotide
taatacgactcactatagggcgcccacgccgcccacgggcgacgacgacgaacagaggagacgtcgtatgcgcccgtggaacctggcggcagcgcaaaagatg

SEQ ID NO: 207213 - DNA, 103 bp, Artificial Sequence
  Synthetic Polynucleotide
taatacgactcactatagggtcggctcccgcgcccacgccgcccacgggcaacagaggagagcccgtatgcggcgtgggaacctggcggcagcgcaaaagatg

SEQ ID NO: 207214 - DNA, 103 bp, Artificial Sequence
  Synthetic Polynucleotide
taatacgactcactataggggtcgctggggtcggctcccgcgcccacgccaacagaggagaggcgtgatggcgggagccaacctggcggcagcgcaaaagatg

SEQ ID NO: 207215 - DNA, 103 bp, Artificial Sequence
  Synthetic Polynucleotide
taatacgactcactatagggggcccagggggtcgctggggtcggctcccgaacagaggagacgggagatgaccccagcgaacctggcggcagcgcaaaagatg

SEQ ID NO: 207216 - DNA, 103 bp, Artificial Sequence
  Synthetic Polynucleotide
taatacgactcactatagggtcctcgtacaggcccagggggtcgctggggaacagaggagaccccagatgccccctgggaacctggcggcagcgcaaaagatg

SEQ ID NO: 207217 - DNA, 103 bp, Artificial Sequence
  Synthetic Polynucleotide
taatacgactcactatagggcgcgccctcctcctcgtacaggcccaggggaacagaggagacccctgatgctgtacgagaacctggcggcagcgcaaaagatg

SEQ ID NO: 207218 - DNA, 103 bp, Artificial Sequence
  Synthetic Polynucleotide
taatacgactcactataggggcgagcagcccgcgccctcctcctcgtacaaacagaggagatgtacgatgaggagggcgaacctggcggcagcgcaaaagatg

SEQ ID NO: 207219 - DNA, 103 bp, Artificial Sequence
  Synthetic Polynucleotide
taatacgactcactatagggggcgcgtcgggcgagcagcccgcgccctccaacagaggagaggagggatggggctgctcaacctggcggcagcgcaaaagatg

SEQ ID NO: 207220 - DNA, 103 bp, Artificial Sequence
  Synthetic Polynucleotide
taatacgactcactatagggaaatggagaggtggcttgcttggaagacataacagaggagaatgtctatgaagcaagccaacctggcggcagcgcaaaagatg

SEQ ID NO: 207221 - DNA, 103 bp, Artificial Sequence
  Synthetic Polynucleotide
taatacgactcactatagggatgggaggccacatgttgatcactgccctcaacagaggagagagggcatggatcaacataacctggcggcagcgcaaaagatg

SEQ ID NO: 207222 - DNA, 103 bp, Artificial Sequence
  Synthetic Polynucleotide
taatacgactcactatagggctttagcctttggttaatttgtgggtgggaaacagaggagatcccacatgcaaattaacaacctggcggcagcgcaaaagatg

SEQ ID NO: 207223 - DNA, 103 bp, Artificial Sequence
  Synthetic Polynucleotide
taatacgactcactatagggcacttaggccctttagcctttggttaatttaacagaggagaaaattaatgaaaggctaaaacctggcggcagcgcaaaagatg

SEQ ID NO: 207224 - DNA, 103 bp, Artificial Sequence
  Synthetic Polynucleotide
taatacgactcactatagggccaaaacggtcacttaggccctttagccttaacagaggagaaaggctatggggcctaagaacctggcggcagcgcaaaagatg

SEQ ID NO: 207225 - DNA, 103 bp, Artificial Sequence
  Synthetic Polynucleotide
taatacgactcactatagggcaaattcctgccaaaacggtcacttaggccaacagaggagaggcctaatggaccgttttaacctggcggcagcgcaaaagatg

SEQ ID NO: 207226 - DNA, 103 bp, Artificial Sequence
  Synthetic Polynucleotide
taatacgactcactatagggcaaaggtgtccaaattcctgccaaaacggtaacagaggagaaccgttatggcaggaattaacctggcggcagcgcaaaagatg

SEQ ID NO: 207227 - DNA, 103 bp, Artificial Sequence
  Synthetic Polynucleotide
taatacgactcactatagggccaccatgttcaaaggtgtccaaattcctgaacagaggagacaggaaatgggacaccttaacctggcggcagcgcaaaagatg

SEQ ID NO: 207228 - DNA, 103 bp, Artificial Sequence
  Synthetic Polynucleotide
taatacgactcactatagggagagtggccaccaccatgttcaaaggtgtcaacagaggagagacaccatggaacatggtaacctggcggcagcgcaaaagatg

SEQ ID NO: 207229 - DNA, 103 bp, Artificial Sequence
  Synthetic Polynucleotide
taatacgactcactatagggtgtggttgtaagagtggccaccaccatgttaacagaggagaaacatgatggtggccactaacctggcggcagcgcaaaagatg

SEQ ID NO: 207230 - DNA, 103 bp, Artificial Sequence
  Synthetic Polynucleotide
taatacgactcactatagggtcaatctgtttgtggttgtaagagtggccaaacagaggagatggccaatgttacaaccaaacctggcggcagcgcaaaagatg

SEQ ID NO: 207231 - DNA, 103 bp, Artificial Sequence
  Synthetic Polynucleotide
taatacgactcactatagggatagagctgctcaatctgtttgtggttgtaaacagaggagatacaacatgaaacagattaacctggcggcagcgcaaaagatg

SEQ ID NO: 207232 - DNA, 103 bp, Artificial Sequence
  Synthetic Polynucleotide
taatacgactcactataggggcagaggcagatgggaggccacatgttgataacagaggagaatcaacatgtggcctcccaacctggcggcagcgcaaaagatg

SEQ ID NO: 207233 - DNA, 103 bp, Artificial Sequence
  Synthetic Polynucleotide
taatacgactcactataggggctgagcggcatagagctgctcaatctgttaacagaggagaaacagaatgagcagctctaacctggcggcagcgcaaaagatg

SEQ ID NO: 207234 - DNA, 103 bp, Artificial Sequence
  Synthetic Polynucleotide
taatacgactcactatagggatgctggccagctgagcggcatagagctgcaacagaggagagcagctatgtgccgctcaaacctggcggcagcgcaaaagatg

SEQ ID NO: 207235 - DNA, 103 bp, Artificial Sequence
  Synthetic Polynucleotide
taatacgactcactatagggtgacacctgcatgctggccagctgagcggcaacagaggagagccgctatgctggccagcaacctggcggcagcgcaaaagatg

SEQ ID NO: 207236 - DNA, 103 bp, Artificial Sequence
  Synthetic Polynucleotide
taatacgactcactatagggttgctccaggtgacacctgcatgctggccaaacagaggagatggccaatgtgcaggtgtaacctggcggcagcgcaaaagatg

SEQ ID NO: 207237 - DNA, 103 bp, Artificial Sequence
  Synthetic Polynucleotide
taatacgactcactataggggatggcatctttgctccaggtgacacctgcaacagaggagagcaggtatgacctggagcaacctggcggcagcgcaaaagatg

SEQ ID NO: 207238 - DNA, 103 bp, Artificial Sequence
  Synthetic Polynucleotide
taatacgactcactatagggctgtggagttgatggcatctttgctccaggaacagaggagacctggaatgaagatgccaaacctggcggcagcgcaaaagatg

SEQ ID NO: 207239 - DNA, 103 bp, Artificial Sequence
  Synthetic Polynucleotide
taatacgactcactatagggtgtttggtggctgtggagttgatggcatctaacagaggagaagatgcatgcaactccacaacctggcggcagcgcaaaagatg

SEQ ID NO: 207240 - DNA, 103 bp, Artificial Sequence
  Synthetic Polynucleotide
taatacgactcactataggggtccctgctgtgtttggtggctgtggagttaacagaggagaaactccatggccaccaaaaacctggcggcagcgcaaaagatg

SEQ ID NO: 207241 - DNA, 103 bp, Artificial Sequence
  Synthetic Polynucleotide
taatacgactcactatagggaggtgagaccgtccctgctgtgtttggtggaacagaggagaccaccaatgacagcagggaacctggcggcagcgcaaaagatg

SEQ ID NO: 207242 - DNA, 103 bp, Artificial Sequence
  Synthetic Polynucleotide
taatacgactcactatagggttatcccagtaggtgagaccgtccctgctgaacagaggagacagcagatgcggtctcacaacctggcggcagcgcaaaagatg

SEQ ID NO: 207243 - DNA, 103 bp, Artificial Sequence
  Synthetic Polynucleotide
taatacgactcactatagggattatggggtgcagaggcagatgggaggccaacagaggagaggcctcatgtctgcctctaacctggcggcagcgcaaaagatg

SEQ ID NO: 207244 - DNA, 103 bp, Artificial Sequence
  Synthetic Polynucleotide
taatacgactcactatagggttttcattttttatcccagtaggtgagaccaacagaggagaggtctcatgtactgggataacctggcggcagcgcaaaagatg

SEQ ID NO: 207245 - DNA, 103 bp, Artificial Sequence
  Synthetic Polynucleotide
taatacgactcactatagggggtccctctcttttcattttttatcccagtaacagaggagaactgggatgaaaaatgaaaacctggcggcagcgcaaaagatg

SEQ ID NO: 207246 - DNA, 103 bp, Artificial Sequence
  Synthetic Polynucleotide
taatacgactcactatagggttacagggctggtccctctcttttcattttaacagaggagaaaaatgatgagagagggaaacctggcggcagcgcaaaagatg

SEQ ID NO: 207247 - DNA, 103 bp, Artificial Sequence
  Synthetic Polynucleotide
taatacgactcactatagggttaacttgagttacagggctggtccctctcaacagaggagagagaggatgcagccctgtaacctggcggcagcgcaaaagatg

SEQ ID NO: 207248 - DNA, 103 bp, Artificial Sequence
  Synthetic Polynucleotide
taatacgactcactatagggtgcttcatccttaacttgagttacagggctaacagaggagaagccctatgactcaagttaacctggcggcagcgcaaaagatg

SEQ ID NO: 207249 - DNA, 103 bp, Artificial Sequence
  Synthetic Polynucleotide
taatacgactcactataggggctgtgctgctgcttcatccttaacttgagaacagaggagactcaagatgaggatgaagaacctggcggcagcgcaaaagatg

SEQ ID NO: 207250 - DNA, 103 bp, Artificial Sequence
  Synthetic Polynucleotide
taatacgactcactatagggagattcagaggctgtgctgctgcttcatccaacagaggagaggatgaatgagcagcacaaacctggcggcagcgcaaaagatg

SEQ ID NO: 207251 - DNA, 103 bp, Artificial Sequence
  Synthetic Polynucleotide
taatacgactcactatagggtcgggatgagagattcagaggctgtgctgcaacagaggagagcagcaatgcctctgaataacctggcggcagcgcaaaagatg

SEQ ID NO: 207252 - DNA, 103 bp, Artificial Sequence
  Synthetic Polynucleotide
taatacgactcactatagggctgtcttgggtcgggatgagagattcagagaacagaggagactctgaatgtctcatcccaacctggcggcagcgcaaaagatg

SEQ ID NO: 207253 - DNA, 103 bp, Artificial Sequence
  Synthetic Polynucleotide
taatacgactcactatagggacaggctctgctgtcttgggtcgggatgagaacagaggagactcatcatgacccaagacaacctggcggcagcgcaaaagatg

SEQ ID NO: 207254 - DNA, 103 bp, Artificial Sequence
  Synthetic Polynucleotide
taatacgactcactatagggtttgttgtgcattatggggtgcagaggcagaacagaggagactgcctatgcaccccataaacctggcggcagcgcaaaagatg

SEQ ID NO: 207255 - DNA, 103 bp, Artificial Sequence
  Synthetic Polynucleotide
taatacgactcactatagggtggggactttacaggctctgctgtcttgggaacagaggagacccaagatggcagagcctaacctggcggcagcgcaaaagatg

SEQ ID NO: 207256 - DNA, 103 bp, Artificial Sequence
  Synthetic Polynucleotide
taatacgactcactatagggtgggagacgttggggactttacaggctctgaacagaggagacagagcatgtaaagtcccaacctggcggcagcgcaaaagatg

SEQ ID NO: 207257 - DNA, 103 bp, Artificial Sequence
  Synthetic Polynucleotide
taatacgactcactatagggaggttctgggtgggagacgttggggactttaacagaggagaaaagtcatgaacgtctccaacctggcggcagcgcaaaagatg

SEQ ID NO: 207258 - DNA, 103 bp, Artificial Sequence
  Synthetic Polynucleotide
taatacgactcactatagggggctgggaagaggttctgggtgggagacgtaacagaggagaacgtctatgacccagaacaacctggcggcagcgcaaaagatg

SEQ ID NO: 207259 - DNA, 103 bp, Artificial Sequence
  Synthetic Polynucleotide
taatacgactcactatagggtggttttgctggctgggaagaggttctgggaacagaggagacccagaatgtcttcccagaacctggcggcagcgcaaaagatg

SEQ ID NO: 207260 - DNA, 103 bp, Artificial Sequence
  Synthetic Polynucleotide
taatacgactcactatagggttgacagggctggttttgctggctgggaagaacagaggagacttcccatgcagcaaaacaacctggcggcagcgcaaaagatg

SEQ ID NO: 207261 - DNA, 103 bp, Artificial Sequence
  Synthetic Polynucleotide
taatacgactcactataggggtttggcagattgacagggctggttttgctaacagaggagaagcaaaatgagccctgtcaacctggcggcagcgcaaaagatg

SEQ ID NO: 207262 - DNA, 103 bp, Artificial Sequence
  Synthetic Polynucleotide
taatacgactcactatagggtgctgcttttgtttggcagattgacagggcaacagaggagagccctgatgatctgccaaaacctggcggcagcgcaaaagatg

SEQ ID NO: 207263 - DNA, 103 bp, Artificial Sequence
  Synthetic Polynucleotide
taatacgactcactataggggggctagggatgctgcttttgtttggcagaaacagaggagatctgccatgcaaaagcagaacctggcggcagcgcaaaagatg

SEQ ID NO: 207264 - DNA, 103 bp, Artificial Sequence
  Synthetic Polynucleotide
taatacgactcactatagggtcctccaatggggctagggatgctgcttttaacagaggagaaaaagcatgatccctagcaacctggcggcagcgcaaaagatg

SEQ ID NO: 207265 - DNA, 103 bp, Artificial Sequence
  Synthetic Polynucleotide
taatacgactcactatagggcagagtgaggtttgttgtgcattatggggtaacagaggagaaccccaatgtgcacaacaaacctggcggcagcgcaaaagatg

SEQ ID NO: 207266 - DNA, 103 bp, Artificial Sequence
  Synthetic Polynucleotide
taatacgactcactatagggttcccaggcttcctccaatggggctagggaaacagaggagatccctaatgccattggagaacctggcggcagcgcaaaagatg

SEQ ID NO: 207267 - DNA, 103 bp, Artificial Sequence
  Synthetic Polynucleotide
taatacgactcactataggggaggatcctcttcccaggcttcctccaatgaacagaggagacattggatgaagcctgggaacctggcggcagcgcaaaagatg

SEQ ID NO: 207268 - DNA, 103 bp, Artificial Sequence
  Synthetic Polynucleotide
taatacgactcactataggggatatctaaagaggatcctcttcccaggctaacagaggagaagcctgatgagaggatccaacctggcggcagcgcaaaagatg

SEQ ID NO: 207269 - DNA, 103 bp, Artificial Sequence
  Synthetic Polynucleotide
taatacgactcactataggggactagataggatatctaaagaggatcctcaacagaggagagaggatatgctttagataaacctggcggcagcgcaaaagatg

SEQ ID NO: 207270 - DNA, 103 bp, Artificial Sequence
  Synthetic Polynucleotide
taatacgactcactatagggggggagttgagactagataggatatctaaaaacagaggagatttagaatgcctatctagaacctggcggcagcgcaaaagatg

SEQ ID NO: 207271 - DNA, 103 bp, Artificial Sequence
  Synthetic Polynucleotide
taatacgactcactatagggaaaaagggcaggggagttgagactagatagaacagaggagactatctatgctcaactccaacctggcggcagcgcaaaagatg

SEQ ID NO: 207272 - DNA, 103 bp, Artificial Sequence
  Synthetic Polynucleotide
taatacgactcactatagggcctgatccccaaaaagggcaggggagttgaaacagaggagatcaactatgctgccctttaacctggcggcagcgcaaaagatg

SEQ ID NO: 207273 - DNA, 103 bp, Artificial Sequence
  Synthetic Polynucleotide
taatacgactcactatagggatcactgtatcctgatccccaaaaagggcaaacagaggagatgccctatgtggggatcaaacctggcggcagcgcaaaagatg

SEQ ID NO: 207274 - DNA, 103 bp, Artificial Sequence
  Synthetic Polynucleotide
taatacgactcactatagggaatggctttcatcactgtatcctgatccccaacagaggagaggggatatggatacagtgaacctggcggcagcgcaaaagatg

SEQ ID NO: 207275 - DNA, 103 bp, Artificial Sequence
  Synthetic Polynucleotide
taatacgactcactataggggcgcctcctgaatggctttcatcactgtataacagaggagaatacagatgtgaaagccaaacctggcggcagcgcaaaagatg

SEQ ID NO: 207276 - DNA, 103 bp, Artificial Sequence
  Synthetic Polynucleotide
taatacgactcactatagggggtagctcctcagagtgaggtttgttgtgcaacagaggagagcacaaatgacctcactcaacctggcggcagcgcaaaagatg

SEQ ID NO: 207277 - DNA, 103 bp, Artificial Sequence
  Synthetic Polynucleotide
taatacgactcactatagggcgcatcttccgcgcctcctgaatggctttcaacagaggagagaaagcatgtcaggaggcaacctggcggcagcgcaaaagatg

SEQ ID NO: 207278 - DNA, 103 bp, Artificial Sequence
  Synthetic Polynucleotide
taatacgactcactataggggatctgctctcgcatcttccgcgcctcctgaacagaggagacaggagatgcggaagatgaacctggcggcagcgcaaaagatg

SEQ ID NO: 207279 - DNA, 103 bp, Artificial Sequence
  Synthetic Polynucleotide
taatacgactcactataggggctcccgctggatctgctctcgcatcttccaacagaggagaggaagaatggagagcagaaacctggcggcagcgcaaaagatg

SEQ ID NO: 207280 - DNA, 103 bp, Artificial Sequence
  Synthetic Polynucleotide
taatacgactcactatagggtgctgctgttgctcccgctggatctgctctaacagaggagaagagcaatgccagcgggaaacctggcggcagcgcaaaagatg

SEQ ID NO: 207281 - DNA, 103 bp, Artificial Sequence
  Synthetic Polynucleotide
taatacgactcactatagggatgtggctgttgctgctgttgctcccgctgaacagaggagacagcggatgcaacagcagaacctggcggcagcgcaaaagatg

SEQ ID NO: 207282 - DNA, 103 bp, Artificial Sequence
  Synthetic Polynucleotide
taatacgactcactatagggcgtcaacaccatgtggctgttgctgctgttaacagaggagaaacagcatgaacagccacaacctggcggcagcgcaaaagatg

SEQ ID NO: 207283 - DNA, 103 bp, Artificial Sequence
  Synthetic Polynucleotide
taatacgactcactataggggacagtttcccgtcaacaccatgtggctgtaacagaggagaacagccatgtggtgttgaaacctggcggcagcgcaaaagatg

SEQ ID NO: 207284 - DNA, 103 bp, Artificial Sequence
  Synthetic Polynucleotide
taatacgactcactatagggatttatggaggacagtttcccgtcaacaccaacagaggagaggtgttatggggaaactgaacctggcggcagcgcaaaagatg

SEQ ID NO: 207285 - DNA, 103 bp, Artificial Sequence
  Synthetic Polynucleotide
taatacgactcactataggggccccatattatttatggaggacagtttccaacagaggagaggaaacatgcctccataaaacctggcggcagcgcaaaagatg

SEQ ID NO: 207286 - DNA, 103 bp, Artificial Sequence
  Synthetic Polynucleotide
taatacgactcactatagggcagctgttcagccccatattatttatggagaacagaggagactccatatgtaatatgggaacctggcggcagcgcaaaagatg

SEQ ID NO: 207287 - DNA, 103 bp, Artificial Sequence
  Synthetic Polynucleotide
taatacgactcactataggggacaagtgttggtagctcctcagagtgaggaacagaggagacctcacatggaggagctaaacctggcggcagcgcaaaagatg

SEQ ID NO: 207288 - DNA, 103 bp, Artificial Sequence
  Synthetic Polynucleotide
taatacgactcactatagggttcattcctgcagctgttcagccccatattaacagaggagaaatatgatgctgaacagcaacctggcggcagcgcaaaagatg

SEQ ID NO: 207289 - DNA, 103 bp, Artificial Sequence
  Synthetic Polynucleotide
taatacgactcactatagggttctttccttttcattcctgcagctgttcaaacagaggagatgaacaatggcaggaatgaacctggcggcagcgcaaaagatg

SEQ ID NO: 207290 - DNA, 103 bp, Artificial Sequence
  Synthetic Polynucleotide
taatacgactcactatagggtcaaagcgcgttctttccttttcattcctgaacagaggagacaggaaatgaaaggaaagaacctggcggcagcgcaaaagatg

SEQ ID NO: 207291 - DNA, 103 bp, Artificial Sequence
  Synthetic Polynucleotide
taatacgactcactatagggccccaaattctcaaagcgcgttctttccttaacagaggagaaaggaaatgacgcgctttaacctggcggcagcgcaaaagatg

SEQ ID NO: 207292 - DNA, 103 bp, Artificial Sequence
  Synthetic Polynucleotide
taatacgactcactatagggttaactggggccccaaattctcaaagcgcgaacagaggagacgcgctatgagaatttggaacctggcggcagcgcaaaagatg

SEQ ID NO: 207293 - DNA, 103 bp, Artificial Sequence
  Synthetic Polynucleotide
taatacgactcactataggggactttcccgttaactggggccccaaattcaacagaggagagaatttatggccccagttaacctggcggcagcgcaaaagatg

SEQ ID NO: 207294 - DNA, 103 bp, Artificial Sequence
  Synthetic Polynucleotide
taatacgactcactatagggatcttcatttgactttcccgttaactggggaacagaggagaccccagatgacgggaaagaacctggcggcagcgcaaaagatg

SEQ ID NO: 207295 - DNA, 103 bp, Artificial Sequence
  Synthetic Polynucleotide
taatacgactcactatagggccagttttccatcttcatttgactttcccgaacagaggagacgggaaatgcaaatgaagaacctggcggcagcgcaaaagatg

SEQ ID NO: 207296 - DNA, 103 bp, Artificial Sequence
  Synthetic Polynucleotide
taatacgactcactatagggacacctgggcccagttttccatcttcatttaacagaggagaaaatgaatgtggaaaactaacctggcggcagcgcaaaagatg

SEQ ID NO: 207297 - DNA, 103 bp, Artificial Sequence
  Synthetic Polynucleotide
taatacgactcactatagggaaggtcgatgacacctgggcccagttttccaacagaggagaggaaaaatgggcccaggtaacctggcggcagcgcaaaagatg

SEQ ID NO: 207298 - DNA, 103 bp, Artificial Sequence
  Synthetic Polynucleotide
taatacgactcactataggggaatggtactgacaagtgttggtagctcctaacagaggagaaggagcatgcaacacttgaacctggcggcagcgcaaaagatg

SEQ ID NO: 207299 - DNA, 103 bp, Artificial Sequence
  Synthetic Polynucleotide
taatacgactcactatagggctggccgagtaaggtcgatgacacctgggcaacagaggagagcccagatgtcatcgaccaacctggcggcagcgcaaaagatg

SEQ ID NO: 207300 - DNA, 103 bp, Artificial Sequence
  Synthetic Polynucleotide
taatacgactcactatagggtctgcatcttctggccgagtaaggtcgatgaacagaggagacatcgaatgtactcggccaacctggcggcagcgcaaaagatg

SEQ ID NO: 207301 - DNA, 103 bp, Artificial Sequence
  Synthetic Polynucleotide
taatacgactcactatagggggcacctccctctgcatcttctggccgagtaacagaggagaactcggatggaagatgcaaacctggcggcagcgcaaaagatg

SEQ ID NO: 207302 - DNA, 103 bp, Artificial Sequence
  Synthetic Polynucleotide
taatacgactcactatagggcagccacagtggcacctccctctgcatcttaacagaggagaaagatgatgagggaggtgaacctggcggcagcgcaaaagatg

SEQ ID NO: 207303 - DNA, 103 bp, Artificial Sequence
  Synthetic Polynucleotide
taatacgactcactatagggactcgtgcttcagccacagtggcacctcccaacagaggagagggaggatgcactgtggcaacctggcggcagcgcaaaagatg

SEQ ID NO: 207304 - DNA, 103 bp, Artificial Sequence
  Synthetic Polynucleotide
taatacgactcactataggggtccctgtagactcgtgcttcagccacagtaacagaggagaactgtgatggaagcacgaaacctggcggcagcgcaaaagatg

SEQ ID NO: 207305 - DNA, 103 bp, Artificial Sequence
  Synthetic Polynucleotide
taatacgactcactatagggggccgcgggcgtccctgtagactcgtgcttaacagaggagaaagcacatgtctacagggaacctggcggcagcgcaaaagatg

SEQ ID NO: 207306 - DNA, 103 bp, Artificial Sequence
  Synthetic Polynucleotide
taatacgactcactatagggctgctggcacggccgcgggcgtccctgtagaacagaggagactacagatgcgcccgcggaacctggcggcagcgcaaaagatg

SEQ ID NO: 207307 - DNA, 103 bp, Artificial Sequence
  Synthetic Polynucleotide
taatacgactcactataggggtgtggctcgctgctggcacggccgcgggcaacagaggagagcccgcatgcgtgccagcaacctggcggcagcgcaaaagatg

SEQ ID NO: 207308 - DNA, 103 bp, Artificial Sequence
  Synthetic Polynucleotide
taatacgactcactataggggtcgcttaatgtgtggctcgctgctggcacaacagaggagagtgccaatggcgagccacaacctggcggcagcgcaaaagatg

SEQ ID NO: 207309 - DNA, 103 bp, Artificial Sequence
  Synthetic Polynucleotide
taatacgactcactataggggcatcttgttgaatggtactgacaagtgttaacagaggagaaacactatgcagtaccataacctggcggcagcgcaaaagatg

SEQ ID NO: 207310 - DNA, 103 bp, Artificial Sequence
  Synthetic Polynucleotide
taatacgactcactataggggcattcattggtcgcttaatgtgtggctcgaacagaggagacgagccatgcattaagcgaacctggcggcagcgcaaaagatg

SEQ ID NO: 207311 - DNA, 103 bp, Artificial Sequence
  Synthetic Polynucleotide
taatacgactcactatagggaaccatgaatgcattcattggtcgcttaataacagaggagaattaagatgccaatgaataacctggcggcagcgcaaaagatg

SEQ ID NO: 207312 - DNA, 103 bp, Artificial Sequence
  Synthetic Polynucleotide
taatacgactcactatagggcctttgcccaaaccatgaatgcattcattgaacagaggagacaatgaatgcattcatggaacctggcggcagcgcaaaagatg

SEQ ID NO: 207313 - DNA, 103 bp, Artificial Sequence
  Synthetic Polynucleotide
taatacgactcactatagggctcctctcatcctttgcccaaaccatgaataacagaggagaattcatatgttgggcaaaaacctggcggcagcgcaaaagatg

SEQ ID NO: 207314 - DNA, 103 bp, Artificial Sequence
  Synthetic Polynucleotide
taatacgactcactatagggaaggatttttctcctctcatcctttgcccaaacagaggagatgggcaatggatgagaggaacctggcggcagcgcaaaagatg

SEQ ID NO: 207315 - DNA, 103 bp, Artificial Sequence
  Synthetic Polynucleotide
taatacgactcactatagggggaaggcctgaaggatttttctcctctcataacagaggagaatgagaatggaaaaatccaacctggcggcagcgcaaaagatg

SEQ ID NO: 207316 - DNA, 103 bp, Artificial Sequence
  Synthetic Polynucleotide
taatacgactcactatagggtgcatgtcggggaaggcctgaaggatttttaacagaggagaaaaaatatgtcaggccttaacctggcggcagcgcaaaagatg

SEQ ID NO: 207317 - DNA, 103 bp, Artificial Sequence
  Synthetic Polynucleotide
taatacgactcactataggggttggagttatgcatgtcggggaaggcctgaacagaggagacaggccatgcccgacatgaacctggcggcagcgcaaaagatg

SEQ ID NO: 207318 - DNA, 103 bp, Artificial Sequence
  Synthetic Polynucleotide
taatacgactcactatagggttttgctaatgttggagttatgcatgtcggaacagaggagaccgacaatgataactccaaacctggcggcagcgcaaaagatg

SEQ ID NO: 207319 - DNA, 103 bp, Artificial Sequence
  Synthetic Polynucleotide
taatacgactcactataggggatcctaagattttgctaatgttggagttaaacagaggagataactcatgcattagcaaaacctggcggcagcgcaaaagatg

SEQ ID NO: 207320 - DNA, 103 bp, Artificial Sequence
  Synthetic Polynucleotide
taatacgactcactataggggtcccagtcagcatcttgttgaatggtactaacagaggagaagtaccatgcaacaagataacctggcggcagcgcaaaagatg

SEQ ID NO: 207321 - DNA, 103 bp, Artificial Sequence
  Synthetic Polynucleotide
taatacgactcactatagggtttccagcgagatcctaagattttgctaataacagaggagaattagcatgatcttaggaaacctggcggcagcgcaaaagatg

SEQ ID NO: 207322 - DNA, 103 bp, Artificial Sequence
  Synthetic Polynucleotide
taatacgactcactatagggtggacattgatttccagcgagatcctaagaaacagaggagatcttagatgctcgctggaaacctggcggcagcgcaaaagatg

SEQ ID NO: 207323 - DNA, 103 bp, Artificial Sequence
  Synthetic Polynucleotide
taatacgactcactatagggttctcctggttggacattgatttccagcgaaacagaggagatcgctgatgatcaatgtcaacctggcggcagcgcaaaagatg

SEQ ID NO: 207324 - DNA, 103 bp, Artificial Sequence
  Synthetic Polynucleotide
taatacgactcactatagggataaggttgcttctcctggttggacattgaaacagaggagatcaatgatgaaccaggagaacctggcggcagcgcaaaagatg

SEQ ID NO: 207325 - DNA, 103 bp, Artificial Sequence
  Synthetic Polynucleotide
taatacgactcactataggggctcttcataataaggttgcttctcctggtaacagaggagaaccaggatgagcaaccttaacctggcggcagcgcaaaagatg

SEQ ID NO: 207326 - DNA, 103 bp, Artificial Sequence
  Synthetic Polynucleotide
taatacgactcactatagggagccgggcctgctcttcataataaggttgcaacagaggagagcaaccatgttatgaagaaacctggcggcagcgcaaaagatg

SEQ ID NO: 207327 - DNA, 103 bp, Artificial Sequence
  Synthetic Polynucleotide
taatacgactcactataggggatcttgcttagccgggcctgctcttcataaacagaggagatatgaaatgcaggcccggaacctggcggcagcgcaaaagatg

SEQ ID NO: 207328 - DNA, 103 bp, Artificial Sequence
  Synthetic Polynucleotide
taatacgactcactatagggtctctaagtggatcttgcttagccgggcctaacagaggagaaggcccatgtaagcaagaaacctggcggcagcgcaaaagatg

SEQ ID NO: 207329 - DNA, 103 bp, Artificial Sequence
  Synthetic Polynucleotide
taatacgactcactatagggtttgggtacttctctaagtggatcttgcttaacagaggagaaagcaaatgccacttagaaacctggcggcagcgcaaaagatg

SEQ ID NO: 207330 - DNA, 103 bp, Artificial Sequence
  Synthetic Polynucleotide
taatacgactcactataggggtatttatagtttgggtacttctctaagtgaacagaggagacacttaatgaagtacccaaacctggcggcagcgcaaaagatg

SEQ ID NO: 207331 - DNA, 103 bp, Artificial Sequence
  Synthetic Polynucleotide
taatacgactcactatagggctgcacaggcaaatggagaggtggcttgctaacagaggagaagcaagatgcctctccataacctggcggcagcgcaaaagatg

SEQ ID NO: 207332 - DNA, 103 bp, Artificial Sequence
  Synthetic Polynucleotide
taatacgactcactatagggacagaacgctgtcccagtcagcatcttgttaacagaggagaaacaagatgctgactgggaacctggcggcagcgcaaaagatg

SEQ ID NO: 207333 - DNA, 103 bp, Artificial Sequence
  Synthetic Polynucleotide
taatacgactcactataggggtcggggtttgtatttatagtttgggtactaacagaggagaagtaccatgactataaataacctggcggcagcgcaaaagatg

SEQ ID NO: 207334 - DNA, 103 bp, Artificial Sequence
  Synthetic Polynucleotide
taatacgactcactataggggtgcgtttcggtcggggtttgtatttatagaacagaggagactataaatgcaaaccccgaacctggcggcagcgcaaaagatg

SEQ ID NO: 207335 - DNA, 103 bp, Artificial Sequence
  Synthetic Polynucleotide
taatacgactcactatagggaacaatgcaggtgcgtttcggtcggggtttaacagaggagaaaacccatgccgaaacgcaacctggcggcagcgcaaaagatg

SEQ ID NO: 207336 - DNA, 103 bp, Artificial Sequence
  Synthetic Polynucleotide
taatacgactcactatagggttttgccatcaacaatgcaggtgcgtttcgaacagaggagacgaaacatgcctgcattgaacctggcggcagcgcaaaagatg

SEQ ID NO: 207337 - DNA, 103 bp, Artificial Sequence
  Synthetic Polynucleotide
taatacgactcactatagggatccgaagctttttgccatcaacaatgcagaacagaggagactgcatatgtgatggcaaaacctggcggcagcgcaaaagatg

SEQ ID NO: 207338 - DNA, 103 bp, Artificial Sequence
  Synthetic Polynucleotide
taatacgactcactatagggatactccccaatccgaagctttttgccatcaacagaggagagatggcatgaagcttcggaacctggcggcagcgcaaaagatg

SEQ ID NO: 207339 - DNA, 103 bp, Artificial Sequence
  Synthetic Polynucleotide
taatacgactcactatagggtcagttgcttatactccccaatccgaagctaacagaggagaagcttcatgttggggagtaacctggcggcagcgcaaaagatg

SEQ ID NO: 207340 - DNA, 103 bp, Artificial Sequence
  Synthetic Polynucleotide
taatacgactcactatagggcgagacctcatcagttgcttatactccccaaacagaggagatggggaatgtaagcaactaacctggcggcagcgcaaaagatg

SEQ ID NO: 207341 - DNA, 103 bp, Artificial Sequence
  Synthetic Polynucleotide
taatacgactcactatagggctcctgtctccgagacctcatcagttgcttaacagaggagaaagcaaatgatgaggtctaacctggcggcagcgcaaaagatg

SEQ ID NO: 207342 - DNA, 103 bp, Artificial Sequence
  Synthetic Polynucleotide
taatacgactcactatagggactgcctcatctcctgtctccgagacctcaaacagaggagatgaggtatgggagacaggaacctggcggcagcgcaaaagatg

SEQ ID NO: 207343 - DNA, 103 bp, Artificial Sequence
  Synthetic Polynucleotide
taatacgactcactatagggtgctgagatgacagaacgctgtcccagtcaaacagaggagatgactgatgcagcgttctaacctggcggcagcgcaaaagatg

SEQ ID NO: 207344 - DNA, 103 bp, Artificial Sequence
  Synthetic Polynucleotide
taatacgactcactatagggacagtaaagaactgcctcatctcctgtctcaacagaggagagagacaatggatgaggcaaacctggcggcagcgcaaaagatg

SEQ ID NO: 207345 - DNA, 103 bp, Artificial Sequence
  Synthetic Polynucleotide
taatacgactcactatagggctgttgccccacagtaaagaactgcctcataacagaggagaatgaggatgttctttactaacctggcggcagcgcaaaagatg

SEQ ID NO: 207346 - DNA, 103 bp, Artificial Sequence
  Synthetic Polynucleotide
taatacgactcactataggggaatctgaggctgttgccccacagtaaagaaacagaggagatctttaatgtggggcaacaacctggcggcagcgcaaaagatg

SEQ ID NO: 207347 - DNA, 103 bp, Artificial Sequence
  Synthetic Polynucleotide
taatacgactcactataggggtggtgattggaatctgaggctgttgccccaacagaggagaggggcaatggcctcagataacctggcggcagcgcaaaagatg

SEQ ID NO: 207348 - DNA, 103 bp, Artificial Sequence
  Synthetic Polynucleotide
taatacgactcactatagggacctgttcctgtggtgattggaatctgaggaacagaggagacctcagatgccaatcaccaacctggcggcagcgcaaaagatg

SEQ ID NO: 207349 - DNA, 103 bp, Artificial Sequence
  Synthetic Polynucleotide
taatacgactcactataggggatacacaacacctgttcctgtggtgattgaacagaggagacaatcaatgcaggaacagaacctggcggcagcgcaaaagatg

SEQ ID NO: 207350 - DNA, 103 bp, Artificial Sequence
  Synthetic Polynucleotide
taatacgactcactatagggatagcaccaggatacacaacacctgttcctaacagaggagaaggaacatgtgttgtgtaaacctggcggcagcgcaaaagatg

SEQ ID NO: 207351 - DNA, 103 bp, Artificial Sequence
  Synthetic Polynucleotide
taatacgactcactatagggtgccatagtgatagcaccaggatacacaacaacagaggagagttgtgatgcctggtgctaacctggcggcagcgcaaaagatg

SEQ ID NO: 207352 - DNA, 103 bp, Artificial Sequence
  Synthetic Polynucleotide
taatacgactcactataggggtgtggtagttgccatagtgatagcaccagaacagaggagactggtgatgtcactatggaacctggcggcagcgcaaaagatg

SEQ ID NO: 207353 - DNA, 103 bp, Artificial Sequence
  Synthetic Polynucleotide
taatacgactcactatagggtgaggcgatggtgtggtagttgccatagtgaacagaggagacactatatgaactaccacaacctggcggcagcgcaaaagatg

SEQ ID NO: 207354 - DNA, 103 bp, Artificial Sequence
  Synthetic Polynucleotide
taatacgactcactatagggttccattctttgctgagatgacagaacgctaacagaggagaagcgttatgtcatctcagaacctggcggcagcgcaaaagatg

SEQ ID NO: 207355 - DNA, 103 bp, Artificial Sequence
  Synthetic Polynucleotide
taatacgactcactatagggagatgtcatctgaggcgatggtgtggtagtaacagaggagaactaccatgccatcgcctaacctggcggcagcgcaaaagatg

SEQ ID NO: 207356 - DNA, 103 bp, Artificial Sequence
  Synthetic Polynucleotide
taatacgactcactatagggtagagcagtcagatgtcatctgaggcgatgaacagaggagacatcgcatgagatgacataacctggcggcagcgcaaaagatg

SEQ ID NO: 207357 - DNA, 103 bp, Artificial Sequence
  Synthetic Polynucleotide
taatacgactcactataggggccgaggtgctagagcagtcagatgtcatcaacagaggagagatgacatgtgactgctcaacctggcggcagcgcaaaagatg

SEQ ID NO: 207358 - DNA, 103 bp, Artificial Sequence
  Synthetic Polynucleotide
taatacgactcactatagggctccgggctggccgaggtgctagagcagtcaacagaggagagactgcatgagcacctcgaacctggcggcagcgcaaaagatg

SEQ ID NO: 207359 - DNA, 103 bp, Artificial Sequence
  Synthetic Polynucleotide
taatacgactcactatagggggaggctgggctccgggctggccgaggtgcaacagaggagagcacctatgccagcccggaacctggcggcagcgcaaaagatg

SEQ ID NO: 207360 - DNA, 103 bp, Artificial Sequence
  Synthetic Polynucleotide
taatacgactcactatagggtggatgaccgggaggctgggctccgggctgaacagaggagacagcccatggcccagcctaacctggcggcagcgcaaaagatg

SEQ ID NO: 207361 - DNA, 103 bp, Artificial Sequence
  Synthetic Polynucleotide
taatacgactcactatagggataagtgctctggatgaccgggaggctgggaacagaggagacccagcatgccggtcatcaacctggcggcagcgcaaaagatg

SEQ ID NO: 207362 - DNA, 103 bp, Artificial Sequence
  Synthetic Polynucleotide
taatacgactcactatagggtcttcataccataagtgctctggatgaccgaacagaggagacggtcaatgagagcacttaacctggcggcagcgcaaaagatg

SEQ ID NO: 207363 - DNA, 103 bp, Artificial Sequence
  Synthetic Polynucleotide
taatacgactcactatagggccgccatctgtcttcataccataagtgctcaacagaggagagagcacatgtggtatgaaaacctggcggcagcgcaaaagatg

SEQ ID NO: 207364 - DNA, 103 bp, Artificial Sequence
  Synthetic Polynucleotide
taatacgactcactatagggagctaggcttccgccatctgtcttcataccaacagaggagaggtatgatgacagatggcaacctggcggcagcgcaaaagatg

SEQ ID NO: 207365 - DNA, 103 bp, Artificial Sequence
  Synthetic Polynucleotide
taatacgactcactatagggtattctctgattccattctttgctgagatgaacagaggagacatctcatgaaagaatggaacctggcggcagcgcaaaagatg

SEQ ID NO: 207366 - DNA, 103 bp, Artificial Sequence
  Synthetic Polynucleotide
taatacgactcactatagggtttcatttccagctaggcttccgccatctgaacagaggagacagatgatggaagcctagaacctggcggcagcgcaaaagatg

SEQ ID NO: 207367 - DNA, 103 bp, Artificial Sequence
  Synthetic Polynucleotide
taatacgactcactatagggccattgatcatttcatttccagctaggcttaacagaggagaaagcctatgtggaaatgaaacctggcggcagcgcaaaagatg

SEQ ID NO: 207368 - DNA, 103 bp, Artificial Sequence
  Synthetic Polynucleotide
taatacgactcactatagggttcatcctctccattgatcatttcatttccaacagaggagaggaaatatgatgatcaataacctggcggcagcgcaaaagatg

SEQ ID NO: 207369 - DNA, 103 bp, Artificial Sequence
  Synthetic Polynucleotide
taatacgactcactatagggacatttccatttcatcctctccattgatcaaacagaggagatgatcaatggagaggatgaacctggcggcagcgcaaaagatg

SEQ ID NO: 207370 - DNA, 103 bp, Artificial Sequence
  Synthetic Polynucleotide
taatacgactcactatagggtagtcatcatacatttccatttcatcctctaacagaggagaagaggaatgaatggaaataacctggcggcagcgcaaaagatg

SEQ ID NO: 207371 - DNA, 103 bp, Artificial Sequence
  Synthetic Polynucleotide
taatacgactcactataggggtcatcttcatagtcatcatacatttccataacagaggagaatggaaatgtatgatgacaacctggcggcagcgcaaaagatg

SEQ ID NO: 207372 - DNA, 103 bp, Artificial Sequence
  Synthetic Polynucleotide
taatacgactcactatagggctgatttggggtcatcttcatagtcatcataacagaggagaatgatgatgatgaagatgaacctggcggcagcgcaaaagatg

SEQ ID NO: 207373 - DNA, 103 bp, Artificial Sequence
  Synthetic Polynucleotide
taatacgactcactatagggctgctatagtctgatttggggtcatcttcaaacagaggagatgaagaatgccccaaatcaacctggcggcagcgcaaaagatg

SEQ ID NO: 207374 - DNA, 103 bp, Artificial Sequence
  Synthetic Polynucleotide
taatacgactcactatagggttcattttcactgctatagtctgatttgggaacagaggagacccaaaatggactatagcaacctggcggcagcgcaaaagatg

SEQ ID NO: 207375 - DNA, 103 bp, Artificial Sequence
  Synthetic Polynucleotide
taatacgactcactatagggcctccggggcttcattttcactgctatagtaacagaggagaactataatggtgaaaatgaacctggcggcagcgcaaaagatg

SEQ ID NO: 207376 - DNA, 103 bp, Artificial Sequence
  Synthetic Polynucleotide
taatacgactcactatagggcataacttattattctctgattccattcttaacagaggagaaagaatatgatcagagaaaacctggcggcagcgcaaaagatg

SEQ ID NO: 207377 - DNA, 103 bp, Artificial Sequence
  Synthetic Polynucleotide
taatacgactcactataggggcactgacagcctccggggcttcattttcaaacagaggagatgaaaaatgagccccggaaacctggcggcagcgcaaaagatg

SEQ ID NO: 207378 - DNA, 103 bp, Artificial Sequence
  Synthetic Polynucleotide
taatacgactcactatagggatatagggaacataacttattattctctgaaacagaggagatcagagatgaataagttaaacctggcggcagcgcaaaagatg

SEQ ID NO: 207379 - DNA, 103 bp, Artificial Sequence
  Synthetic Polynucleotide
taatacgactcactatagggttcggaaggaatatagggaacataacttataacagaggagaataagtatggttccctataacctggcggcagcgcaaaagatg

SEQ ID NO: 207380 - DNA, 103 bp, Artificial Sequence
  Synthetic Polynucleotide
taatacgactcactataggggtagaggtatttcggaaggaatatagggaaaacagaggagattccctatgttccttccgaacctggcggcagcgcaaaagatg

SEQ ID NO: 207381 - DNA, 103 bp, Artificial Sequence
  Synthetic Polynucleotide
taatacgactcactatagggatgtggtgaggtagaggtatttcggaaggaaacagaggagatccttcatgaatacctctaacctggcggcagcgcaaaagatg

SEQ ID NO: 207382 - DNA, 103 bp, Artificial Sequence
  Synthetic Polynucleotide
taatacgactcactatagggcgtcaggcttatgtggtgaggtagaggtataacagaggagaatacctatgcctcaccacaacctggcggcagcgcaaaagatg

SEQ ID NO: 207383 - DNA, 103 bp, Artificial Sequence
  Synthetic Polynucleotide
taatacgactcactatagggtctccatcagctgcacaggcaaatggagagaacagaggagactctccatgtgcctgtgcaacctggcggcagcgcaaaagatg

SEQ ID NO: 207384 - DNA, 103 bp, Artificial Sequence
  Synthetic Polynucleotide
taatacgactcactatagggcgactcccttcgtcaggcttatgtggtgagaacagaggagactcaccatgtaagcctgaaacctggcggcagcgcaaaagatg

SEQ ID NO: 207385 - DNA, 103 bp, Artificial Sequence
  Synthetic Polynucleotide
taatacgactcactatagggctcacggtcccgactcccttcgtcaggcttaacagaggagaaagcctatggaagggagtaacctggcggcagcgcaaaagatg

SEQ ID NO: 207386 - DNA, 103 bp, Artificial Sequence
  Synthetic Polynucleotide
taatacgactcactatagggtggtcattatctcacggtcccgactcccttaacagaggagaaagggaatggggaccgtgaacctggcggcagcgcaaaagatg

SEQ ID NO: 207387 - DNA, 103 bp, Artificial Sequence
  Synthetic Polynucleotide
taatacgactcactatagggaaagtaacactggtcattatctcacggtccaacagaggagaggaccgatggataatgacaacctggcggcagcgcaaaagatg

SEQ ID NO: 207388 - DNA, 103 bp, Artificial Sequence
  Synthetic Polynucleotide
taatacgactcactatagggtggggttccaaaagtaacactggtcattataacagaggagaataatgatgagtgttactaacctggcggcagcgcaaaagatg

SEQ ID NO: 207389 - DNA, 103 bp, Artificial Sequence
  Synthetic Polynucleotide
taatacgactcactatagggtgcggcgctctggggttccaaaagtaacacaacagaggagagtgttaatgttggaacccaacctggcggcagcgcaaaagatg

SEQ ID NO: 207390 - DNA, 103 bp, Artificial Sequence
  Synthetic Polynucleotide
taatacgactcactatagggagactccctttgcggcgctctggggttccaaacagaggagatggaacatgagagcgccgaacctggcggcagcgcaaaagatg

SEQ ID NO: 207391 - DNA, 103 bp, Artificial Sequence
  Synthetic Polynucleotide
taatacgactcactatagggcacatcggcaagactccctttgcggcgctcaacagaggagagagcgcatgaaagggagtaacctggcggcagcgcaaaagatg

SEQ ID NO: 207392 - DNA, 103 bp, Artificial Sequence
  Synthetic Polynucleotide
taatacgactcactataggggtgtgtccaccacatcggcaagactcccttaacagaggagaaagggaatgttgccgatgaacctggcggcagcgcaaaagatg

SEQ ID NO: 207393 - DNA, 103 bp, Artificial Sequence
  Synthetic Polynucleotide
taatacgactcactatagggttctgtttcagtgtgtccaccacatcggcaaacagaggagatgccgaatgggtggacacaacctggcggcagcgcaaaagatg

SEQ ID NO: 207394 - DNA, 103 bp, Artificial Sequence
  Synthetic Polynucleotide
taatacgactcactatagggcattgcatcctctccatcagctgcacaggcaacagaggagagcctgtatggctgatggaaacctggcggcagcgcaaaagatg

SEQ ID NO: 207395 - DNA, 103 bp, Artificial Sequence
  Synthetic Polynucleotide
taatacgactcactatagggctcaagcttcttctgtttcagtgtgtccacaacagaggagagtggacatgctgaaacagaacctggcggcagcgcaaaagatg

SEQ ID NO: 207396 - DNA, 103 bp, Artificial Sequence
  Synthetic Polynucleotide
taatacgactcactataggggagtcatttcctcaagcttcttctgtttcaaacagaggagatgaaacatgagaagcttgaacctggcggcagcgcaaaagatg

SEQ ID NO: 207397 - DNA, 103 bp, Artificial Sequence
  Synthetic Polynucleotide
taatacgactcactatagggtgttcagtccgagtcatttcctcaagcttcaacagaggagagaagctatgggaaatgacaacctggcggcagcgcaaaagatg

SEQ ID NO: 207398 - DNA, 103 bp, Artificial Sequence
  Synthetic Polynucleotide
taatacgactcactatagggggaatcctcttgttcagtccgagtcatttcaacagaggagagaaatgatgcggactgaaaacctggcggcagcgcaaaagatg

SEQ ID NO: 207399 - DNA, 103 bp, Artificial Sequence
  Synthetic Polynucleotide
taatacgactcactatagggccatgcaggaggaatcctcttgttcagtccaacagaggagaggactgatgaagaggattaacctggcggcagcgcaaaagatg

SEQ ID NO: 207400 - DNA, 103 bp, Artificial Sequence
  Synthetic Polynucleotide
taatacgactcactatagggagtagtttttccatgcaggaggaatcctctaacagaggagaagaggaatgctcctgcataacctggcggcagcgcaaaagatg

SEQ ID NO: 207401 - DNA, 103 bp, Artificial Sequence
  Synthetic Polynucleotide
taatacgactcactatagggatcttttgaaagtagtttttccatgcaggaaacagaggagatcctgcatggaaaaactaaacctggcggcagcgcaaaagatg

SEQ ID NO: 207402 - DNA, 103 bp, Artificial Sequence
  Synthetic Polynucleotide
taatacgactcactatagggtttccttccaatcttttgaaagtagtttttaacagaggagaaaaaacatgtttcaaaagaacctggcggcagcgcaaaagatg

SEQ ID NO: 207403 - DNA, 103 bp, Artificial Sequence
  Synthetic Polynucleotide
taatacgactcactatagggctttccattttttccttccaatcttttgaaaacagaggagattcaaaatgttggaaggaaacctggcggcagcgcaaaagatg

SEQ ID NO: 207404 - DNA, 103 bp, Artificial Sequence
  Synthetic Polynucleotide
taatacgactcactatagggggtatttagtctttccattttttccttccaaacagaggagatggaagatgaaaatggaaaacctggcggcagcgcaaaagatg

SEQ ID NO: 207405 - DNA, 103 bp, Artificial Sequence
  Synthetic Polynucleotide
taatacgactcactatagggaatcctgggtcattgcatcctctccatcagaacagaggagactgatgatgaggatgcaaaacctggcggcagcgcaaaagatg

SEQ ID NO: 207406 - DNA, 103 bp, Artificial Sequence
  Synthetic Polynucleotide
taatacgactcactataggggaagttcactggtatttagtctttccatttaacagaggagaaaatggatggactaaataaacctggcggcagcgcaaaagatg

SEQ ID NO: 207407 - DNA, 103 bp, Artificial Sequence
  Synthetic Polynucleotide
taatacgactcactatagggatttctccaagaagttcactggtatttagtaacagaggagaactaaaatgcagtgaactaacctggcggcagcgcaaaagatg

SEQ ID NO: 207408 - DNA, 103 bp, Artificial Sequence
  Synthetic Polynucleotide
taatacgactcactatagggtgtacctttaatttctccaagaagttcactaacagaggagaagtgaaatgcttggagaaaacctggcggcagcgcaaaagatg

SEQ ID NO: 207409 - DNA, 103 bp, Artificial Sequence
  Synthetic Polynucleotide
taatacgactcactatagggggctctcaggtgtacctttaatttctccaaaacagaggagattggagatgttaaaggtaaacctggcggcagcgcaaaagatg

SEQ ID NO: 207410 - DNA, 103 bp, Artificial Sequence
  Synthetic Polynucleotide
taatacgactcactatagggttttctgccaggctctcaggtgtacctttaaacagaggagataaaggatgacctgagagaacctggcggcagcgcaaaagatg

SEQ ID NO: 207411 - DNA, 103 bp, Artificial Sequence
  Synthetic Polynucleotide
taatacgactcactatagggctgccgttctttttctgccaggctctcaggaacagaggagacctgagatgctggcagaaaacctggcggcagcgcaaaagatg

SEQ ID NO: 207412 - DNA, 103 bp, Artificial Sequence
  Synthetic Polynucleotide
taatacgactcactatagggtggtggagagctgccgttctttttctgccaaacagaggagatggcagatgaagaacggcaacctggcggcagcgcaaaagatg

SEQ ID NO: 207413 - DNA, 103 bp, Artificial Sequence
  Synthetic Polynucleotide
taatacgactcactatagggtgggtaatcatggtggagagctgccgttctaacagaggagaagaacgatggctctccacaacctggcggcagcgcaaaagatg

SEQ ID NO: 207414 - DNA, 103 bp, Artificial Sequence
  Synthetic Polynucleotide
taatacgactcactatagggactgatcagctgggtaatcatggtggagagaacagaggagactctccatgatgattaccaacctggcggcagcgcaaaagatg

SEQ ID NO: 207415 - DNA, 103 bp, Artificial Sequence
  Synthetic Polynucleotide
taatacgactcactataggggctcccgtaaactgatcagctgggtaatcaaacagaggagatgattaatgagctgatcaaacctggcggcagcgcaaaagatg

SEQ ID NO: 207416 - DNA, 103 bp, Artificial Sequence
  Synthetic Polynucleotide
taatacgactcactatagggcttgaggttaaatcctgggtcattgcatccaacagaggagaggatgcatggacccaggaaacctggcggcagcgcaaaagatg

SEQ ID NO: 207417 - DNA, 103 bp, Artificial Sequence
  Synthetic Polynucleotide
taatacgactcactataggggccagtagctgctcccgtaaactgatcagcaacagaggagagctgatatgtttacgggaaacctggcggcagcgcaaaagatg

SEQ ID NO: 207418 - DNA, 103 bp, Artificial Sequence
  Synthetic Polynucleotide
taatacgactcactatagggatcatgcgctgccagtagctgctcccgtaaaacagaggagattacggatgcagctactgaacctggcggcagcgcaaaagatg

SEQ ID NO: 207419 - DNA, 103 bp, Artificial Sequence
  Synthetic Polynucleotide
taatacgactcactatagggttttctgttcatcatgcgctgccagtagctaacagaggagaagctacatgcagcgcatgaacctggcggcagcgcaaaagatg

SEQ ID NO: 207420 - DNA, 103 bp, Artificial Sequence
  Synthetic Polynucleotide
taatacgactcactataggggctgccagttttttctgttcatcatgcgctaacagaggagaagcgcaatgtgaacagaaaacctggcggcagcgcaaaagatg

SEQ ID NO: 207421 - DNA, 103 bp, Artificial Sequence
  Synthetic Polynucleotide
taatacgactcactatagggaatttgtgacgctgccagttttttctgttcaacagaggagagaacagatgaaactggcaaacctggcggcagcgcaaaagatg

SEQ ID NO: 207422 - DNA, 103 bp, Artificial Sequence
  Synthetic Polynucleotide
taatacgactcactataggggttgtttctcaatttgtgacgctgccagttaacagaggagaaactggatgcgtcacaaaaacctggcggcagcgcaaaagatg

SEQ ID NO: 207423 - DNA, 103 bp, Artificial Sequence
  Synthetic Polynucleotide
taatacgactcactatagggatttgctgccgttgtttctcaatttgtgacaacagaggagagtcacaatgtgagaaacaaacctggcggcagcgcaaaagatg

SEQ ID NO: 207424 - DNA, 103 bp, Artificial Sequence
  Synthetic Polynucleotide
taatacgactcactatagggagcaaggtccatttgctgccgttgtttctcaacagaggagagagaaaatgcggcagcaaaacctggcggcagcgcaaaagatg

SEQ ID NO: 207425 - DNA, 103 bp, Artificial Sequence
  Synthetic Polynucleotide
taatacgactcactataggggctgttggcgagcaaggtccatttgctgccaacagaggagaggcagcatgtggaccttgaacctggcggcagcgcaaaagatg

SEQ ID NO: 207426 - DNA, 103 bp, Artificial Sequence
  Synthetic Polynucleotide
taatacgactcactatagggatctgttcttgctgttggcgagcaaggtccaacagaggagaggacctatgtcgccaacaaacctggcggcagcgcaaaagatg

SEQ ID NO: 207427 - DNA, 103 bp, Artificial Sequence
  Synthetic Polynucleotide
taatacgactcactatagggttccttttcccttgaggttaaatcctgggtaacagaggagaacccagatgttaacctcaaacctggcggcagcgcaaaagatg

SEQ ID NO: 207428 - DNA, 103 bp, Artificial Sequence
  Synthetic Polynucleotide
taatacgactcactatagggttgtctcgcaatctgttcttgctgttggcgaacagaggagacgccaaatgcaagaacagaacctggcggcagcgcaaaagatg

SEQ ID NO: 207429 - DNA, 103 bp, Artificial Sequence
  Synthetic Polynucleotide
taatacgactcactataggggttgctgctgttgtctcgcaatctgttcttaacagaggagaaagaacatgttgcgagacaacctggcggcagcgcaaaagatg

SEQ ID NO: 207430 - DNA, 103 bp, Artificial Sequence
  Synthetic Polynucleotide
taatacgactcactatagggtgttgcagaagttgctgctgttgtctcgcaaacagaggagatgcgagatgacagcagcaaacctggcggcagcgcaaaagatg

SEQ ID NO: 207431 - DNA, 103 bp, Artificial Sequence
  Synthetic Polynucleotide
taatacgactcactatagggtttgtgctgctgttgcagaagttgctgctgaacagaggagacagcagatgcttctgcaaaacctggcggcagcgcaaaagatg

SEQ ID NO: 207432 - DNA, 103 bp, Artificial Sequence
  Synthetic Polynucleotide
taatacgactcactatagggggagattaattttgtgctgctgttgcagaaaacagaggagattctgcatgagcagcacaaacctggcggcagcgcaaaagatg

SEQ ID NO: 207433 - DNA, 103 bp, Artificial Sequence
  Synthetic Polynucleotide
taatacgactcactatagggtgttgctgcaggagattaattttgtgctgcaacagaggagagcagcaatgaattaatctaacctggcggcagcgcaaaagatg

SEQ ID NO: 207434 - DNA, 103 bp, Artificial Sequence
  Synthetic Polynucleotide
taatacgactcactatagggaacctggatctgttgctgcaggagattaataacagaggagaattaatatgctgcagcaaaacctggcggcagcgcaaaagatg

SEQ ID NO: 207435 - DNA, 103 bp, Artificial Sequence
  Synthetic Polynucleotide
taatacgactcactatagggtgtgaccctgaacctggatctgttgctgcaaacagaggagatgcagcatgagatccaggaacctggcggcagcgcaaaagatg

SEQ ID NO: 207436 - DNA, 103 bp, Artificial Sequence
  Synthetic Polynucleotide
taatacgactcactatagggagcggaggcatgtgaccctgaacctggatcaacagaggagagatccaatgtcagggtcaaacctggcggcagcgcaaaagatg

SEQ ID NO: 207437 - DNA, 103 bp, Artificial Sequence
  Synthetic Polynucleotide
taatacgactcactatagggtgggatcatgagcggaggcatgtgaccctgaacagaggagacagggtatgatgcctccgaacctggcggcagcgcaaaagatg

SEQ ID NO: 207438 - DNA, 103 bp, Artificial Sequence
  Synthetic Polynucleotide
taatacgactcactatagggcactgccctcttccttttcccttgaggttaaacagaggagataacctatggggaaaaggaacctggcggcagcgcaaaagatg

SEQ ID NO: 207439 - DNA, 103 bp, Artificial Sequence
  Synthetic Polynucleotide
taatacgactcactataggggtggaaaaattgggatcatgagcggaggcaaacagaggagatgcctcatgtcatgatccaacctggcggcagcgcaaaagatg

SEQ ID NO: 207440 - DNA, 103 bp, Artificial Sequence
  Synthetic Polynucleotide
taatacgactcactatagggcgctggtcatgtggaaaaattgggatcatgaacagaggagacatgatatgaatttttccaacctggcggcagcgcaaaagatg

SEQ ID NO: 207441 - DNA, 103 bp, Artificial Sequence
  Synthetic Polynucleotide
taatacgactcactatagggtgccagagtccgctggtcatgtggaaaaataacagaggagaatttttatgcatgaccagaacctggcggcagcgcaaaagatg

SEQ ID NO: 207442 - DNA, 103 bp, Artificial Sequence
  Synthetic Polynucleotide
taatacgactcactatagggcagcagctgctgccagagtccgctggtcataacagaggagaatgaccatgggactctggaacctggcggcagcgcaaaagatg

SEQ ID NO: 207443 - DNA, 103 bp, Artificial Sequence
  Synthetic Polynucleotide
taatacgactcactatagggtgttgggcagcagcagctgctgccagagtcaacagaggagagactctatgagcagctgcaacctggcggcagcgcaaaagatg

SEQ ID NO: 207444 - DNA, 103 bp, Artificial Sequence
  Synthetic Polynucleotide
taatacgactcactataggggaggaatccctgttgggcagcagcagctgcaacagaggagagcagctatggctgcccaaaacctggcggcagcgcaaaagatg

SEQ ID NO: 207445 - DNA, 103 bp, Artificial Sequence
  Synthetic Polynucleotide
taatacgactcactatagggcaggggggaagaggaatccctgttgggcagaacagaggagactgcccatgagggattccaacctggcggcagcgcaaaagatg

SEQ ID NO: 207446 - DNA, 103 bp, Artificial Sequence
  Synthetic Polynucleotide
taatacgactcactatagggtatgttattccaggggggaagaggaatcccaacagaggagagggattatgcttccccccaacctggcggcagcgcaaaagatg

SEQ ID NO: 207447 - DNA, 103 bp, Artificial Sequence
  Synthetic Polynucleotide
taatacgactcactatagggacctggtttgtatgttattccaggggggaaaacagaggagattccccatgggaataacaaacctggcggcagcgcaaaagatg

SEQ ID NO: 207448 - DNA, 103 bp, Artificial Sequence
  Synthetic Polynucleotide
taatacgactcactatagggggtagttatcacctggtttgtatgttattcaacagaggagagaataaatgacaaaccagaacctggcggcagcgcaaaagatg

SEQ ID NO: 207449 - DNA, 103 bp, Artificial Sequence
  Synthetic Polynucleotide
taatacgactcactatagggacatgttgatcactgccctcttccttttccaacagaggagaggaaaaatgagagggcagaacctggcggcagcgcaaaagatg

SEQ ID NO: 207450 - DNA, 103 bp, Artificial Sequence
  Synthetic Polynucleotide
taatacgactcactatagggaactgtacggggtagttatcacctggtttgaacagaggagacaaaccatgtgataactaaacctggcggcagcgcaaaagatg

SEQ ID NO: 207451 - DNA, 103 bp, Artificial Sequence
  Synthetic Polynucleotide
taatacgactcactatagggtgatggaatgaactgtacggggtagttatcaacagaggagagataacatgcccgtacagaacctggcggcagcgcaaaagatg

SEQ ID NO: 207452 - DNA, 103 bp, Artificial Sequence
  Synthetic Polynucleotide
taatacgactcactatagggctgccattgttgatggaatgaactgtacggaacagaggagaccgtacatgtcattccataacctggcggcagcgcaaaagatg

SEQ ID NO: 207453 - DNA, 103 bp, Artificial Sequence
  Synthetic Polynucleotide
taatacgactcactataggggcagcagcagctgccattgttgatggaatgaacagaggagacattccatgaacaatggcaacctggcggcagcgcaaaagatg

SEQ ID NO: 207454 - DNA, 103 bp, Artificial Sequence
  Synthetic Polynucleotide
taatacgactcactataggggagtccagaagcagcagcagctgccattgtaacagaggagaacaatgatggctgctgctaacctggcggcagcgcaaaagatg

SEQ ID NO: 207455 - DNA, 103 bp, Artificial Sequence
  Synthetic Polynucleotide
taatacgactcactataggggtaaagggctgagtccagaagcagcagcagaacagaggagactgctgatgcttctggacaacctggcggcagcgcaaaagatg

SEQ ID NO: 207456 - DNA, 103 bp, Artificial Sequence
  Synthetic Polynucleotide
taatacgactcactatagggttctggagctgtaaagggctgagtccagaaaacagaggagattctggatgcagccctttaacctggcggcagcgcaaaagatg

SEQ ID NO: 207457 - DNA, 103 bp, Artificial Sequence
  Synthetic Polynucleotide
taatacgactcactataggggacatgacccttctggagctgtaaagggctaacagaggagaagccctatgcagctccagaacctggcggcagcgcaaaagatg

SEQ ID NO: 207458 - DNA, 103 bp, Artificial Sequence
  Synthetic Polynucleotide
taatacgactcactataggggtgggtgggagacatgacccttctggagctaacagaggagaagctccatgagggtcatgaacctggcggcagcgcaaaagatg

SEQ ID NO: 207459 - DNA, 103 bp, Artificial Sequence
  Synthetic Polynucleotide
taatacgactcactatagggtggttaatttgtgggtgggagacatgacccaacagaggagagggtcaatgctcccacccaacctggcggcagcgcaaaagatg

SEQ ID NO: 207460 - DNA, 103 bp, Artificial Sequence
  Synthetic Polynucleotide
taatacgactcactatagggccaagggtaggctcccagcagcgaagccataacagaggagaatggctatgctgctgggaaacctggcggcagcgcaaaagatg

SEQ ID NO: 207461 - DNA, 103 bp, Artificial Sequence
  Synthetic Polynucleotide
taatacgactcactataggggcccttgtcccccgggggccgggggacggcaacagaggagagccgtcatgcggcccccgaacctggcggcagcgcaaaagatg

SEQ ID NO: 207462 - DNA, 103 bp, Artificial Sequence
  Synthetic Polynucleotide
taatacgactcactataggggccaggagtgttcaaatactggtcgaattcaacagaggagagaattcatgcagtatttgaacctggcggcagcgcaaaagatg

SEQ ID NO: 207463 - DNA, 103 bp, Artificial Sequence
  Synthetic Polynucleotide
taatacgactcactatagggagtctgggtggccaggagtgttcaaatactaacagaggagaagtattatgacactcctgaacctggcggcagcgcaaaagatg

SEQ ID NO: 207464 - DNA, 103 bp, Artificial Sequence
  Synthetic Polynucleotide
taatacgactcactatagggcctgtggcggagtctgggtggccaggagtgaacagaggagacactccatgccacccagaaacctggcggcagcgcaaaagatg

SEQ ID NO: 207465 - DNA, 103 bp, Artificial Sequence
  Synthetic Polynucleotide
taatacgactcactatagggggccatggcccctgtggcggagtctgggtgaacagaggagacacccaatgtccgccacaaacctggcggcagcgcaaaagatg

SEQ ID NO: 207466 - DNA, 103 bp, Artificial Sequence
  Synthetic Polynucleotide
taatacgactcactataggggcccactgagggccatggcccctgtggcggaacagaggagaccgccaatggggccatggaacctggcggcagcgcaaaagatg

SEQ ID NO: 207467 - DNA, 103 bp, Artificial Sequence
  Synthetic Polynucleotide
taatacgactcactatagggaccggaacatgcccactgagggccatggccaacagaggagaggccatatgcctcagtggaacctggcggcagcgcaaaagatg

SEQ ID NO: 207468 - DNA, 103 bp, Artificial Sequence
  Synthetic Polynucleotide
taatacgactcactatagggcacctgggagaccggaacatgcccactgagaacagaggagactcagtatgcatgttccgaacctggcggcagcgcaaaagatg

SEQ ID NO: 207469 - DNA, 103 bp, Artificial Sequence
  Synthetic Polynucleotide
taatacgactcactatagggccgttggtgtcacctgggagaccggaacataacagaggagaatgttcatgtctcccaggaacctggcggcagcgcaaaagatg

SEQ ID NO: 207470 - DNA, 103 bp, Artificial Sequence
  Synthetic Polynucleotide
taatacgactcactatagggtctgtgggacccgttggtgtcacctgggagaacagaggagactcccaatggacaccaacaacctggcggcagcgcaaaagatg

SEQ ID NO: 207471 - DNA, 103 bp, Artificial Sequence
  Synthetic Polynucleotide
taatacgactcactataggggaggctggtctctgtgggacccgttggtgtaacagaggagaacaccaatgggtcccacaaacctggcggcagcgcaaaagatg

SEQ ID NO: 207472 - DNA, 103 bp, Artificial Sequence
  Synthetic Polynucleotide
taatacgactcactatagggggctctcggagcccttgtcccccgggggccaacagaggagaggccccatggggacaaggaacctggcggcagcgcaaaagatg

SEQ ID NO: 207473 - DNA, 103 bp, Artificial Sequence
  Synthetic Polynucleotide
taatacgactcactatagggggacggagatgaggctggtctctgtgggacaacagaggagagtcccaatgagaccagccaacctggcggcagcgcaaaagatg

SEQ ID NO: 207474 - DNA, 103 bp, Artificial Sequence
  Synthetic Polynucleotide
taatacgactcactataggggcatcagccaggacggagatgaggctggtcaacagaggagagaccagatgcatctccgtaacctggcggcagcgcaaaagatg

SEQ ID NO: 207475 - DNA, 103 bp, Artificial Sequence
  Synthetic Polynucleotide
taatacgactcactatagggcgtggccgtggcatcagccaggacggagataacagaggagaatctccatgctggctgataacctggcggcagcgcaaaagatg

SEQ ID NO: 207476 - DNA, 103 bp, Artificial Sequence
  Synthetic Polynucleotide
taatacgactcactatagggtgttgtagtacgtggccgtggcatcagccaaacagaggagatggctgatgccacggccaaacctggcggcagcgcaaaagatg

SEQ ID NO: 207477 - DNA, 103 bp, Artificial Sequence
  Synthetic Polynucleotide
taatacgactcactatagggacactgtagctgttgtagtacgtggccgtgaacagaggagacacggcatggtactacaaaacctggcggcagcgcaaaagatg

SEQ ID NO: 207478 - DNA, 103 bp, Artificial Sequence
  Synthetic Polynucleotide
taatacgactcactatagggcgccggatacggctctcggagcccttgtccaacagaggagaggacaaatgctccgagagaacctggcggcagcgcaaaagatg

SEQ ID NO: 207479 - DNA, 103 bp, Artificial Sequence
  Synthetic Polynucleotide
taatacgactcactataggggttcatgggccgccggatacggctctcggaaacagaggagatccgagatgcgtatccggaacctggcggcagcgcaaaagatg

SEQ ID NO: 207480 - DNA, 103 bp, Artificial Sequence
  Synthetic Polynucleotide
taatacgactcactatagggccatgaaggcgttcatgggccgccggatacaacagaggagagtatccatgggcccatgaaacctggcggcagcgcaaaagatg

SEQ ID NO: 207481 - DNA, 103 bp, Artificial Sequence
  Synthetic Polynucleotide
taatacgactcactatagggttggcccaaaccatgaaggcgttcatgggcaacagaggagagcccatatgcgccttcataacctggcggcagcgcaaaagatg

SEQ ID NO: 207482 - DNA, 103 bp, Artificial Sequence
  Synthetic Polynucleotide
taatacgactcactatagggcctctcgtccttggcccaaaccatgaaggcaacagaggagagccttcatggtttgggccaacctggcggcagcgcaaaagatg

SEQ ID NO: 207483 - DNA, 103 bp, Artificial Sequence
  Synthetic Polynucleotide
taatacgactcactatagggccagccgtttcctctcgtccttggcccaaaaacagaggagatttgggatgaggacgagaaacctggcggcagcgcaaaagatg

SEQ ID NO: 207484 - DNA, 103 bp, Artificial Sequence
  Synthetic Polynucleotide
taatacgactcactatagggttctgcactgccagccgtttcctctcgtccaacagaggagaggacgaatggaaacggctaacctggcggcagcgcaaaagatg

SEQ ID NO: 207485 - DNA, 103 bp, Artificial Sequence
  Synthetic Polynucleotide
taatacgactcactatagggcaggtccgggttctgcactgccagccgtttaacagaggagaaaacggatggcagtgcagaacctggcggcagcgcaaaagatg

SEQ ID NO: 207486 - DNA, 103 bp, Artificial Sequence
  Synthetic Polynucleotide
taatacgactcactataggggaccctcgggccaagggtaggctcccagcaaacagaggagatgctggatgcctacccttaacctggcggcagcgcaaaagatg

SEQ ID NO: 207487 - DNA, 103 bp, Artificial Sequence
  Synthetic Polynucleotide
taatacgactcactatagggcggcgttgtgcaggtccgggttctgcactgaacagaggagacagtgcatgacccggaccaacctggcggcagcgcaaaagatg

SEQ ID NO: 207488 - DNA, 103 bp, Artificial Sequence
  Synthetic Polynucleotide
taatacgactcactatagggttgctgagctcggcgttgtgcaggtccgggaacagaggagacccggaatggcacaacgcaacctggcggcagcgcaaaagatg

SEQ ID NO: 207489 - DNA, 103 bp, Artificial Sequence
  Synthetic Polynucleotide
taatacgactcactatagggtcccagcatcttgctgagctcggcgttgtgaacagaggagacacaacatggagctcagcaacctggcggcagcgcaaaagatg

SEQ ID NO: 207490 - DNA, 103 bp, Artificial Sequence
  Synthetic Polynucleotide
taatacgactcactatagggtccacgactttcccagcatcttgctgagctaacagaggagaagctcaatgagatgctggaacctggcggcagcgcaaaagatg

SEQ ID NO: 207491 - DNA, 103 bp, Artificial Sequence
  Synthetic Polynucleotide
taatacgactcactataggggtcagcgccttccacgactttcccagcatcaacagaggagagatgctatgaaagtcgtgaacctggcggcagcgcaaaagatg

SEQ ID NO: 207492 - DNA, 103 bp, Artificial Sequence
  Synthetic Polynucleotide
taatacgactcactatagggctgggacagcgtcagcgccttccacgacttaacagaggagaaagtcgatgaaggcgctgaacctggcggcagcgcaaaagatg

SEQ ID NO: 207493 - DNA, 103 bp, Artificial Sequence
  Synthetic Polynucleotide
taatacgactcactatagggacggcctcttctgggacagcgtcagcgcctaacagaggagaaggcgcatgcgctgtcccaacctggcggcagcgcaaaagatg

SEQ ID NO: 207494 - DNA, 103 bp, Artificial Sequence
  Synthetic Polynucleotide
taatacgactcactatagggtcgtccacgtacggcctcttctgggacagcaacagaggagagctgtcatggaagaggccaacctggcggcagcgcaaaagatg

SEQ ID NO: 207495 - DNA, 103 bp, Artificial Sequence
  Synthetic Polynucleotide
taatacgactcactatagggccgctccgcctcgtccacgtacggcctcttaacagaggagaaagaggatgtacgtggacaacctggcggcagcgcaaaagatg

SEQ ID NO: 207496 - DNA, 103 bp, Artificial Sequence
  Synthetic Polynucleotide
taatacgactcactataggggcaggcgcagccgctccgcctcgtccacgtaacagaggagaacgtggatgaggcggagcaacctggcggcagcgcaaaagatg

SEQ ID NO: 207497 - DNA, 103 bp, Artificial Sequence
  Synthetic Polynucleotide
taatacgactcactataggggggcactcgagaccctcgggccaagggtagaacagaggagactacccatggcccgagggaacctggcggcagcgcaaaagatg

SEQ ID NO: 207498 - DNA, 103 bp, Artificial Sequence
  Synthetic Polynucleotide
taatacgactcactatagggtgcatgtgctgcaggcgcagccgctccgccaacagaggagaggcggaatggctgcgcctaacctggcggcagcgcaaaagatg

SEQ ID NO: 207499 - DNA, 103 bp, Artificial Sequence
  Synthetic Polynucleotide
taatacgactcactatagggggggtagtcctgcatgtgctgcaggcgcagaacagaggagactgcgcatgcagcacatgaacctggcggcagcgcaaaagatg

SEQ ID NO: 207500 - DNA, 103 bp, Artificial Sequence
  Synthetic Polynucleotide
taatacgactcactatagggacttgtagttggggtagtcctgcatgtgctaacagaggagaagcacaatgaggactaccaacctggcggcagcgcaaaagatg

SEQ ID NO: 207501 - DNA, 103 bp, Artificial Sequence
  Synthetic Polynucleotide
taatacgactcactatagggcgcggccggtacttgtagttggggtagtccaacagaggagaggactaatgcaactacaaaacctggcggcagcgcaaaagatg

SEQ ID NO: 207502 - DNA, 103 bp, Artificial Sequence
  Synthetic Polynucleotide
taatacgactcactatagggcttcttcctgcgcggccggtacttgtagttaacagaggagaaactacatgtaccggccgaacctggcggcagcgcaaaagatg

SEQ ID NO: 207503 - DNA, 103 bp, Artificial Sequence
  Synthetic Polynucleotide
taatacgactcactataggggcttggcctgcttcttcctgcgcggccggtaacagaggagaaccggcatggcaggaagaaacctggcggcagcgcaaaagatg

SEQ ID NO: 207504 - DNA, 103 bp, Artificial Sequence
  Synthetic Polynucleotide
taatacgactcactatagggttgcacagccgcttggcctgcttcttcctgaacagaggagacaggaaatggcaggccaaaacctggcggcagcgcaaaagatg

SEQ ID NO: 207505 - DNA, 103 bp, Artificial Sequence
  Synthetic Polynucleotide
taatacgactcactataggggtccacgcgcttgcacagccgcttggcctgaacagaggagacaggccatgcggctgtgcaacctggcggcagcgcaaaagatg

SEQ ID NO: 207506 - DNA, 103 bp, Artificial Sequence
  Synthetic Polynucleotide
taatacgactcactatagggggaagcccgggtccacgcgcttgcacagccaacagaggagaggctgtatgagcgcgtggaacctggcggcagcgcaaaagatg

SEQ ID NO: 207507 - DNA, 103 bp, Artificial Sequence
  Synthetic Polynucleotide
taatacgactcactataggggagctcagaaggaagcccgggtccacgcgcaacagaggagagcgcgtatgcccgggcttaacctggcggcagcgcaaaagatg

SEQ ID NO: 207508 - DNA, 103 bp, Artificial Sequence
  Synthetic Polynucleotide
taatacgactcactataggggtccagggccgggcactcgagaccctcgggaacagaggagacccgagatgctcgagtgcaacctggcggcagcgcaaaagatg

SEQ ID NO: 207509 - DNA, 103 bp, Artificial Sequence
  Synthetic Polynucleotide
taatacgactcactatagggccgggagagggagctcagaaggaagcccggaacagaggagaccgggcatgcttctgagcaacctggcggcagcgcaaaagatg

SEQ ID NO: 207510 - DNA, 103 bp, Artificial Sequence
  Synthetic Polynucleotide
taatacgactcactatagggcgttctggtcccgggagagggagctcagaaaacagaggagattctgaatgccctctcccaacctggcggcagcgcaaaagatg

SEQ ID NO: 207511 - DNA, 103 bp, Artificial Sequence
  Synthetic Polynucleotide
taatacgactcactatagggtccggcagggcgttctggtcccgggagaggaacagaggagacctctcatgggaccagaaaacctggcggcagcgcaaaagatg

SEQ ID NO: 207512 - DNA, 103 bp, Artificial Sequence
  Synthetic Polynucleotide
taatacgactcactataggggcttctcttctccggcagggcgttctggtcaacagaggagagaccagatggccctgccgaacctggcggcagcgcaaaagatg

SEQ ID NO: 207513 - DNA, 103 bp, Artificial Sequence
  Synthetic Polynucleotide
taatacgactcactatagggcccggctgccgcttctcttctccggcagggaacagaggagaccctgcatgagaagagaaaacctggcggcagcgcaaaagatg

SEQ ID NO: 207514 - DNA, 103 bp, Artificial Sequence
  Synthetic Polynucleotide
taatacgactcactatagggcccagcgccccccggctgccgcttctcttcaacagaggagagaagagatgcggcagccgaacctggcggcagcgcaaaagatg

SEQ ID NO: 207515 - DNA, 103 bp, Artificial Sequence
  Synthetic Polynucleotide
taatacgactcactatagggctccttctcccccagcgccccccggctgccaacagaggagaggcagcatgggggcgctgaacctggcggcagcgcaaaagatg

SEQ ID NO: 207516 - DNA, 103 bp, Artificial Sequence
  Synthetic Polynucleotide
taatacgactcactatagggcacccctgtcctccttctcccccagcgcccaacagaggagagggcgcatggggagaaggaacctggcggcagcgcaaaagatg

SEQ ID NO: 207517 - DNA, 103 bp, Artificial Sequence
  Synthetic Polynucleotide
taatacgactcactatagggggggagtactcacccctgtcctccttctccaacagaggagaggagaaatgggacaggggaacctggcggcagcgcaaaagatg

SEQ ID NO: 207518 - DNA, 103 bp, Artificial Sequence
  Synthetic Polynucleotide
taatacgactcactatagggggcagtgccgggggagtactcacccctgtcaacagaggagagacaggatggagtactccaacctggcggcagcgcaaaagatg

SEQ ID NO: 207519 - DNA, 103 bp, Artificial Sequence
  Synthetic Polynucleotide
taatacgactcactatagggacagctcggcgtccagggccgggcactcgaaacagaggagatcgagtatgcggccctggaacctggcggcagcgcaaaagatg

SEQ ID NO: 207520 - DNA, 103 bp, Artificial Sequence
  Synthetic Polynucleotide
taatacgactcactatagggggctgggcagggcagtgccgggggagtactaacagaggagaagtactatgccggcactgaacctggcggcagcgcaaaagatg

SEQ ID NO: 207521 - DNA, 103 bp, Artificial Sequence
  Synthetic Polynucleotide
taatacgactcactatagggcagccccggaggctgggcagggcagtgccgaacagaggagacggcacatgcctgcccagaacctggcggcagcgcaaaagatg

SEQ ID NO: 207522 - DNA, 103 bp, Artificial Sequence
  Synthetic Polynucleotide
taatacgactcactatagggctcgtggtagcagccccggaggctgggcagaacagaggagactgcccatgctccggggcaacctggcggcagcgcaaaagatg

SEQ ID NO: 207523 - DNA, 103 bp, Artificial Sequence
  Synthetic Polynucleotide
taatacgactcactatagggcagccggcccctcgtggtagcagccccggaaacagaggagatccgggatggctaccacgaacctggcggcagcgcaaaagatg

SEQ ID NO: 207524 - DNA, 103 bp, Artificial Sequence
  Synthetic Polynucleotide
taatacgactcactatagggccgccaccaccagccggcccctcgtggtagaacagaggagactaccaatgggggccggcaacctggcggcagcgcaaaagatg

SEQ ID NO: 207525 - DNA, 103 bp, Artificial Sequence
  Synthetic Polynucleotide
taatacgactcactatagggggtgccgccgccgccaccaccagccggcccaacagaggagagggccgatgggtggtggcaacctggcggcagcgcaaaagatg

SEQ ID NO: 207526 - DNA, 103 bp, Artificial Sequence
  Synthetic Polynucleotide
taatacgactcactatagggcactgctcggggtgccgccgccgccaccacaacagaggagagtggtgatggcggcggcaaacctggcggcagcgcaaaagatg

SEQ ID NO: 207527 - DNA, 103 bp, Artificial Sequence
  Synthetic Polynucleotide
taatacgactcactatagggtacgtgtccacactgctcggggtgccgccgaacagaggagacggcggatgcccgagcagaacctggcggcagcgcaaaagatg

SEQ ID NO: 207528 - DNA, 103 bp, Artificial Sequence
  Synthetic Polynucleotide
taatacgactcactatagggcccgtacgggtacgtgtccacactgctcggaacagaggagaccgagcatggtggacacgaacctggcggcagcgcaaaagatg

SEQ ID NO: 207529 - DNA, 103 bp, Artificial Sequence
  Synthetic Polynucleotide
taatacgactcactataggggtgtgggcagcccgtacgggtacgtgtccaaacagaggagatggacaatgacccgtacgaacctggcggcagcgcaaaagatg

SEQ ID NO: 207530 - DNA, 103 bp, Artificial Sequence
  Synthetic Polynucleotide
taatacgactcactatagggtgtccatccgacagctcggcgtccagggccaacagaggagaggccctatgcgccgagctaacctggcggcagcgcaaaagatg

SEQ ID NO: 207531 - DNA, 103 bp, Artificial Sequence
  Synthetic Polynucleotide
taatacgactcactatagggatttcaggaggtgtgggcagcccgtacgggaacagaggagacccgtaatggctgcccacaacctggcggcagcgcaaaagatg

SEQ ID NO: 207532 - DNA, 103 bp, Artificial Sequence
  Synthetic Polynucleotide
taatacgactcactatagggcaggggagacatttcaggaggtgtgggcagaacagaggagactgcccatgcctcctgaaaacctggcggcagcgcaaaagatg

SEQ ID NO: 207533 - DNA, 103 bp, Artificial Sequence
  Synthetic Polynucleotide
taatacgactcactatagggccagcacgtccaggggagacatttcaggagaacagaggagactcctgatgtgtctccccaacctggcggcagcgcaaaagatg

SEQ ID NO: 207534 - DNA, 103 bp, Artificial Sequence
  Synthetic Polynucleotide
taatacgactcactatagggtgctccggctccagcacgtccaggggagacaacagaggagagtctccatgggacgtgctaacctggcggcagcgcaaaagatg

SEQ ID NO: 207535 - DNA, 103 bp, Artificial Sequence
  Synthetic Polynucleotide
taatacgactcactataggggaagaaggtctgctccggctccagcacgtcaacagaggagagacgtgatggagccggagaacctggcggcagcgcaaaagatg

SEQ ID NO: 207536 - DNA, 103 bp, Artificial Sequence
  Synthetic Polynucleotide
taatacgactcactatagggagggggaggagaagaaggtctgctccggctaacagaggagaagccggatgagaccttctaacctggcggcagcgcaaaagatg

SEQ ID NO: 207537 - DNA, 103 bp, Artificial Sequence
  Synthetic Polynucleotide
taatacgactcactatagggtcctcctggcagggggaggagaagaaggtcaacagaggagagaccttatgctcctccccaacctggcggcagcgcaaaagatg

SEQ ID NO: 207538 - DNA, 103 bp, Artificial Sequence
  Synthetic Polynucleotide
taatacgactcactatagggatggccatgctcctcctggcagggggaggaaacagaggagatcctccatgtgccaggagaacctggcggcagcgcaaaagatg

SEQ ID NO: 207539 - DNA, 103 bp, Artificial Sequence
  Synthetic Polynucleotide
taatacgactcactatagggtgcggcggggatggccatgctcctcctggcaacagaggagagccaggatgagcatggccaacctggcggcagcgcaaaagatg

SEQ ID NO: 207540 - DNA, 103 bp, Artificial Sequence
  Synthetic Polynucleotide
taatacgactcactatagggaggtgggggatgcggcggggatggccatgcaacagaggagagcatggatgtccccgccgaacctggcggcagcgcaaaagatg

SEQ ID NO: 207541 - DNA, 103 bp, Artificial Sequence
  Synthetic Polynucleotide
taatacgactcactatagggcggcggcgattgtccatccgacagctcggcaacagaggagagccgagatgtcggatggaaacctggcggcagcgcaaaagatg

SEQ ID NO: 207542 - DNA, 103 bp, Artificial Sequence
  Synthetic Polynucleotide
taatacgactcactataggggtgccctggcaggtgggggatgcggcggggaacagaggagaccccgcatgatcccccacaacctggcggcagcgcaaaagatg

SEQ ID NO: 207543 - DNA, 103 bp, Artificial Sequence
  Synthetic Polynucleotide
taatacgactcactataggggtgagtacgggtgccctggcaggtgggggaaacagaggagatcccccatgtgccagggcaacctggcggcagcgcaaaagatg

SEQ ID NO: 207544 - DNA, 103 bp, Artificial Sequence
  Synthetic Polynucleotide
taatacgactcactataggggcgtactccggtgagtacgggtgccctggcaacagaggagagccaggatgcccgtactcaacctggcggcagcgcaaaagatg

SEQ ID NO: 207545 - DNA, 103 bp, Artificial Sequence
  Synthetic Polynucleotide
taatacgactcactatagggagggcttggggcgtactccggtgagtacggaacagaggagaccgtacatgccggagtacaacctggcggcagcgcaaaagatg

SEQ ID NO: 207546 - DNA, 103 bp, Artificial Sequence
  Synthetic Polynucleotide
taatacgactcactatagggtacagtggagagggcttggggcgtactccgaacagaggagacggagtatgccccaagccaacctggcggcagcgcaaaagatg

SEQ ID NO: 207547 - DNA, 103 bp, Artificial Sequence
  Synthetic Polynucleotide
taatacgactcactatagggagggggtggctacagtggagagggcttgggaacagaggagacccaagatgtctccactgaacctggcggcagcgcaaaagatg

SEQ ID NO: 207548 - DNA, 103 bp, Artificial Sequence
  Synthetic Polynucleotide
taatacgactcactatagggcagggagcccagggggtggctacagtggagaacagaggagactccacatgagccaccccaacctggcggcagcgcaaaagatg

SEQ ID NO: 207549 - DNA, 103 bp, Artificial Sequence
  Synthetic Polynucleotide
taatacgactcactatagggggccaagggccagggagcccagggggtggcaacagaggagagccaccatgtgggctcccaacctggcggcagcgcaaaagatg

SEQ ID NO: 207550 - DNA, 103 bp, Artificial Sequence
  Synthetic Polynucleotide
taatacgactcactatagggccgggggactggccaagggccagggagcccaacagaggagagggctcatgggcccttggaacctggcggcagcgcaaaagatg

SEQ ID NO: 207551 - DNA, 103 bp, Artificial Sequence
  Synthetic Polynucleotide
taatacgactcactatagggcatggagacgccgggggactggccaagggcaacagaggagagcccttatgcagtcccccaacctggcggcagcgcaaaagatg

SEQ ID NO: 207552 - DNA, 103 bp, Artificial Sequence
  Synthetic Polynucleotide
taatacgactcactataggggggggacggccggcggcgattgtccatccgaacagaggagacggatgatgaatcgccgcaacctggcggcagcgcaaaagatg

SEQ ID NO: 207553 - DNA, 103 bp, Artificial Sequence
  Synthetic Polynucleotide
taatacgactcactatagggcaggggacatcatggagacgccgggggactaacagaggagaagtcccatggcgtctccaaacctggcggcagcgcaaaagatg

SEQ ID NO: 207554 - DNA, 103 bp, Artificial Sequence
  Synthetic Polynucleotide
taatacgactcactatagggcagccgggtacaggggacatcatggagacgaacagaggagacgtctcatggatgtccccaacctggcggcagcgcaaaagatg

SEQ ID NO: 207555 - DNA, 103 bp, Artificial Sequence
  Synthetic Polynucleotide
taatacgactcactatagggagatgggggacagccgggtacaggggacataacagaggagaatgtccatggtacccggcaacctggcggcagcgcaaaagatg

SEQ ID NO: 207556 - DNA, 103 bp, Artificial Sequence
  Synthetic Polynucleotide
taatacgactcactatagggaataggcaggagatgggggacagccgggtaaacagaggagatacccgatggtcccccataacctggcggcagcgcaaaagatg

SEQ ID NO: 207557 - DNA, 103 bp, Artificial Sequence
  Synthetic Polynucleotide
taatacgactcactataggggccggggagtaataggcaggagatgggggaaacagaggagatcccccatgtcctgcctaaacctggcggcagcgcaaaagatg

SEQ ID NO: 207558 - DNA, 103 bp, Artificial Sequence
  Synthetic Polynucleotide
taatacgactcactataggggtggtaggtggccggggagtaataggcaggaacagaggagacctgccatgtactccccgaacctggcggcagcgcaaaagatg

SEQ ID NO: 207559 - DNA, 103 bp, Artificial Sequence
  Synthetic Polynucleotide
taatacgactcactatagggagtggagtgggtggtaggtggccggggagtaacagaggagaactcccatgccacctaccaacctggcggcagcgcaaaagatg

SEQ ID NO: 207560 - DNA, 103 bp, Artificial Sequence
  Synthetic Polynucleotide
taatacgactcactatagggtggaggttggagtggagtgggtggtaggtgaacagaggagacacctaatgcccactccaaacctggcggcagcgcaaaagatg

SEQ ID NO: 207561 - DNA, 103 bp, Artificial Sequence
  Synthetic Polynucleotide
taatacgactcactatagggcaggtgggcttggaggttggagtggagtggaacagaggagaccactcatgtccaacctcaacctggcggcagcgcaaaagatg

SEQ ID NO: 207562 - DNA, 103 bp, Artificial Sequence
  Synthetic Polynucleotide
taatacgactcactatagggaaagctggcccaggtgggcttggaggttggaacagaggagaccaaccatgaagcccaccaacctggcggcagcgcaaaagatg

SEQ ID NO: 207563 - DNA, 103 bp, Artificial Sequence
  Synthetic Polynucleotide
taatacgactcactatagggcccgggggccgggggacggccggcggcgataacagaggagaatcgccatgggccgtcccaacctggcggcagcgcaaaagatg

SEQ ID NO: 207564 - DNA, 103 bp, Artificial Sequence
  Synthetic Polynucleotide
taatacgactcactatagggggaggcggggaaagctggcccaggtgggctaacagaggagaagcccaatggggccagctaacctggcggcagcgcaaaagatg

SEQ ID NO: 207565 - DNA, 103 bp, Artificial Sequence
  Synthetic Polynucleotide
taatacgactcactatagggagggtgctcaggaggcggggaaagctggccaacagaggagaggccagatgtccccgcctaacctggcggcagcgcaaaagatg

SEQ ID NO: 207566 - DNA, 103 bp, Artificial Sequence
  Synthetic Polynucleotide
taatacgactcactatagggcgtcgaagccagggtgctcaggaggcggggaacagaggagaccccgcatgctgagcaccaacctggcggcagcgcaaaagatg

SEQ ID NO: 207567 - DNA, 103 bp, Artificial Sequence
  Synthetic Polynucleotide
taatacgactcactatagggtgatccagggcgtcgaagccagggtgctcaaacagaggagatgagcaatgtggcttcgaaacctggcggcagcgcaaaagatg

SEQ ID NO: 207568 - DNA, 103 bp, Artificial Sequence
  Synthetic Polynucleotide
taatacgactcactatagggctggctcagttgatccagggcgtcgaagccaacagaggagaggcttcatggccctggataacctggcggcagcgcaaaagatg

SEQ ID NO: 207569 - DNA, 103 bp, Artificial Sequence
  Synthetic Polynucleotide
taatacgactcactatagggggagttccacctggctcagttgatccagggaacagaggagaccctggatgaactgagccaacctggcggcagcgcaaaagatg

SEQ ID NO: 207570 - DNA, 103 bp, Artificial Sequence
  Synthetic Polynucleotide
taatacgactcactatagggatgtcccccaggagttccacctggctcagtaacagaggagaactgagatgggtggaactaacctggcggcagcgcaaaagatg

SEQ ID NO: 207571 - DNA, 103 bp, Artificial Sequence
  Synthetic Polynucleotide
taatacgactcactatagggattgcgatccatgtcccccaggagttccacaacagaggagagtggaaatgctgggggacaacctggcggcagcgcaaaagatg

SEQ ID NO: 207572 - DNA, 103 bp, Artificial Sequence
  Synthetic Polynucleotide
taatacgactcactatagggggtcgaattcattgcgatccatgtcccccaaacagaggagatgggggatgtggatcgcaaacctggcggcagcgcaaaagatg

SEQ ID NO: 207573 - DNA, 103 bp, Artificial Sequence
  Synthetic Polynucleotide
taatacgactcactatagggttcaaatactggtcgaattcattgcgatccaacagaggagaggatcgatgtgaattcgaaacctggcggcagcgcaaaagatg

SEQ ID NO: 207574 - DNA, 103 bp, Artificial Sequence
  Synthetic Polynucleotide
taatacgactcactatagggctgggagcgggcctcgctcatgtccagcataacagaggagaatgctgatgatgagcgagaacctggcggcagcgcaaaagatg

SEQ ID NO: 207575 - DNA, 103 bp, Artificial Sequence
  Synthetic Polynucleotide
taatacgactcactatagggctcggagccggcgggagacggcggcgcgtcaacagaggagagacgcgatgccgtctcccaacctggcggcagcgcaaaagatg

SEQ ID NO: 207576 - DNA, 103 bp, Artificial Sequence
  Synthetic Polynucleotide
taatacgactcactatagggcgtcttgatgtgcggccgtgggggacccgtaacagaggagaacgggtatgccacggccgaacctggcggcagcgcaaaagatg

SEQ ID NO: 207577 - DNA, 103 bp, Artificial Sequence
  Synthetic Polynucleotide
taatacgactcactatagggtcggctgctccgtcttgatgtgcggccgtgaacagaggagacacggcatgacatcaagaaacctggcggcagcgcaaaagatg

SEQ ID NO: 207578 - DNA, 103 bp, Artificial Sequence
  Synthetic Polynucleotide
taatacgactcactatagggtggccggggctcggctgctccgtcttgatgaacagaggagacatcaaatgggagcagccaacctggcggcagcgcaaaagatg

SEQ ID NO: 207579 - DNA, 103 bp, Artificial Sequence
  Synthetic Polynucleotide
taatacgactcactataggggtcgccgtagtggccggggctcggctgctcaacagaggagagagcagatgagccccggcaacctggcggcagcgcaaaagatg

SEQ ID NO: 207580 - DNA, 103 bp, Artificial Sequence
  Synthetic Polynucleotide
taatacgactcactatagggctcggggctggtcgccgtagtggccggggcaacagaggagagccccgatgactacggcgaacctggcggcagcgcaaaagatg

SEQ ID NO: 207581 - DNA, 103 bp, Artificial Sequence
  Synthetic Polynucleotide
taatacgactcactatagggtcgggcgagcctcggggctggtcgccgtagaacagaggagactacggatgccagccccgaacctggcggcagcgcaaaagatg

SEQ ID NO: 207582 - DNA, 103 bp, Artificial Sequence
  Synthetic Polynucleotide
taatacgactcactatagggggaaccgtagtcgggcgagcctcggggctgaacagaggagacagcccatgggctcgcccaacctggcggcagcgcaaaagatg

SEQ ID NO: 207583 - DNA, 103 bp, Artificial Sequence
  Synthetic Polynucleotide
taatacgactcactatagggggccgctgcaggaaccgtagtcgggcgagcaacagaggagagctcgcatgactacggttaacctggcggcagcgcaaaagatg

SEQ ID NO: 207584 - DNA, 103 bp, Artificial Sequence
  Synthetic Polynucleotide
taatacgactcactataggggcgctggactggccgctgcaggaaccgtagaacagaggagactacggatgctgcagcggaacctggcggcagcgcaaaagatg

SEQ ID NO: 207585 - DNA, 103 bp, Artificial Sequence
  Synthetic Polynucleotide
taatacgactcactatagggggccggggtggcgctggactggccgctgcaaacagaggagatgcagcatgcagtccagcaacctggcggcagcgcaaaagatg

SEQ ID NO: 207586 - DNA, 103 bp, Artificial Sequence
  Synthetic Polynucleotide
taatacgactcactatagggggcccaggccctcggagccggcgggagacgaacagaggagacgtctcatgccggctccgaacctggcggcagcgcaaaagatg

SEQ ID NO: 207587 - DNA, 103 bp, Artificial Sequence
  Synthetic Polynucleotide
taatacgactcactatagggcggcgggggcggccggggtggcgctggactaacagaggagaagtccaatgccaccccggaacctggcggcagcgcaaaagatg

SEQ ID NO: 207588 - DNA, 103 bp, Artificial Sequence
  Synthetic Polynucleotide
taatacgactcactataggggcgaaggggccggcgggggcggccggggtgaacagaggagacaccccatgcgcccccgcaacctggcggcagcgcaaaagatg

SEQ ID NO: 207589 - DNA, 103 bp, Artificial Sequence
  Synthetic Polynucleotide
taatacgactcactatagggctgtgagccggcgaaggggccggcgggggcaacagaggagagcccccatgggccccttcaacctggcggcagcgcaaaagatg

SEQ ID NO: 207590 - DNA, 103 bp, Artificial Sequence
  Synthetic Polynucleotide
taatacgactcactatagggcatagtcgccctgtgagccggcgaaggggcaacagaggagagcccctatgccggctcacaacctggcggcagcgcaaaagatg

SEQ ID NO: 207591 - DNA, 103 bp, Artificial Sequence
  Synthetic Polynucleotide
taatacgactcactatagggtgcaggtcgccatagtcgccctgtgagccgaacagaggagacggctcatggggcgactaaacctggcggcagcgcaaaagatg

SEQ ID NO: 207592 - DNA, 103 bp, Artificial Sequence
  Synthetic Polynucleotide
taatacgactcactataggggctggaggcctgcaggtcgccatagtcgccaacagaggagaggcgacatgggcgacctgaacctggcggcagcgcaaaagatg

SEQ ID NO: 207593 - DNA, 103 bp, Artificial Sequence
  Synthetic Polynucleotide
taatacgactcactatagggcaccatagtagctggaggcctgcaggtcgcaacagaggagagcgaccatgaggcctccaaacctggcggcagcgcaaaagatg

SEQ ID NO: 207594 - DNA, 103 bp, Artificial Sequence
  Synthetic Polynucleotide
taatacgactcactatagggccagggtaggcaccatagtagctggaggccaacagaggagaggcctcatgctactatggaacctggcggcagcgcaaaagatg

SEQ ID NO: 207595 - DNA, 103 bp, Artificial Sequence
  Synthetic Polynucleotide
taatacgactcactataggggggtgcgtagccagggtaggcaccatagtaaacagaggagatactatatggcctaccctaacctggcggcagcgcaaaagatg

SEQ ID NO: 207596 - DNA, 103 bp, Artificial Sequence
  Synthetic Polynucleotide
taatacgactcactatagggggtagaggccgggtgcgtagccagggtaggaacagaggagacctaccatggctacgcacaacctggcggcagcgcaaaagatg

SEQ ID NO: 207597 - DNA, 103 bp, Artificial Sequence
  Synthetic Polynucleotide
taatacgactcactatagggacccccgcgcggcccaggccctcggagccgaacagaggagacggctcatggggcctgggaacctggcggcagcgcaaaagatg

SEQ ID NO: 207598 - DNA, 103 bp, Artificial Sequence
  Synthetic Polynucleotide
taatacgactcactatagggcaggggtactggtagaggccgggtgcgtagaacagaggagactacgcatgcggcctctaaacctggcggcagcgcaaaagatg

SEQ ID NO: 207599 - DNA, 103 bp, Artificial Sequence
  Synthetic Polynucleotide
taatacgactcactatagggcgagtggaagcaggggtactggtagaggccaacagaggagaggcctcatgcagtaccccaacctggcggcagcgcaaaagatg

SEQ ID NO: 207600 - DNA, 103 bp, Artificial Sequence
  Synthetic Polynucleotide
taatacgactcactataggggccggcgcggcgagtggaagcaggggtactaacagaggagaagtaccatggcttccactaacctggcggcagcgcaaaagatg

SEQ ID NO: 207601 - DNA, 103 bp, Artificial Sequence
  Synthetic Polynucleotide
taatacgactcactataggggaggcgtagggccggcgcggcgagtggaagaacagaggagacttccaatggccgcgccgaacctggcggcagcgcaaaagatg

SEQ ID NO: 207602 - DNA, 103 bp, Artificial Sequence
  Synthetic Polynucleotide
taatacgactcactataggggagcaggggtgaggcgtagggccggcgcggaacagaggagaccgcgcatgccctacgccaacctggcggcagcgcaaaagatg

SEQ ID NO: 207603 - DNA, 103 bp, Artificial Sequence
  Synthetic Polynucleotide
taatacgactcactatagggccaggccgttgagcaggggtgaggcgtaggaacagaggagacctacgatgcacccctgcaacctggcggcagcgcaaaagatg

SEQ ID NO: 207604 - DNA, 103 bp, Artificial Sequence
  Synthetic Polynucleotide
taatacgactcactatagggggcggcagggccaggccgttgagcaggggtaacagaggagaacccctatgcaacggcctaacctggcggcagcgcaaaagatg

SEQ ID NO: 207605 - DNA, 103 bp, Artificial Sequence
  Synthetic Polynucleotide
taatacgactcactataggggctgtgggcgggcggcagggccaggccgttaacagaggagaaacggcatggccctgccgaacctggcggcagcgcaaaagatg

SEQ ID NO: 207606 - DNA, 103 bp, Artificial Sequence
  Synthetic Polynucleotide
taatacgactcactataggggactggtggggctgtgggcgggcggcagggaacagaggagaccctgcatgccgcccacaaacctggcggcagcgcaaaagatg

SEQ ID NO: 207607 - DNA, 103 bp, Artificial Sequence
  Synthetic Polynucleotide
taatacgactcactatagggtggtcccagtgactggtggggctgtgggcgaacagaggagacgcccaatgccccaccagaacctggcggcagcgcaaaagatg

SEQ ID NO: 207608 - DNA, 103 bp, Artificial Sequence
  Synthetic Polynucleotide
taatacgactcactatagggccccaccgcgacccccgcgcggcccaggccaacagaggagaggcctgatgcgcgcggggaacctggcggcagcgcaaaagatg

SEQ ID NO: 207609 - DNA, 103 bp, Artificial Sequence
  Synthetic Polynucleotide
taatacgactcactataggggtacaccggctggtcccagtgactggtgggaacagaggagacccaccatgcactgggacaacctggcggcagcgcaaaagatg

SEQ ID NO: 207610 - DNA, 103 bp, Artificial Sequence
  Synthetic Polynucleotide
taatacgactcactatagggtcagggtggtgtacaccggctggtcccagtaacagaggagaactgggatgagccggtgtaacctggcggcagcgcaaaagatg

SEQ ID NO: 207611 - DNA, 103 bp, Artificial Sequence
  Synthetic Polynucleotide
taatacgactcactatagggcagggcctggtcagggtggtgtacaccggcaacagaggagagccggtatgcaccaccctaacctggcggcagcgcaaaagatg

SEQ ID NO: 207612 - DNA, 103 bp, Artificial Sequence
  Synthetic Polynucleotide
taatacgactcactatagggcccgggcgccccccaccgcgacccccgcgcaacagaggagagcgcggatgtcgcggtggaacctggcggcagcgcaaaagatg

SEQ ID NO: 207613 - DNA, 103 bp, Artificial Sequence
  Synthetic Polynucleotide
taatacgactcactataggggccgggtcgccccgggcgccccccaccgcgaacagaggagacgcggtatggggcgcccgaacctggcggcagcgcaaaagatg

SEQ ID NO: 207614 - DNA, 103 bp, Artificial Sequence
  Synthetic Polynucleotide
taatacgactcactatagggcgccgcctccgccgggtcgccccgggcgccaacagaggagaggcgccatgggcgacccgaacctggcggcagcgcaaaagatg

SEQ ID NO: 207615 - DNA, 103 bp, Artificial Sequence
  Synthetic Polynucleotide
taatacgactcactatagggagcgctcgtccgccgcctccgccgggtcgcaacagaggagagcgaccatgcggaggcggaacctggcggcagcgcaaaagatg

SEQ ID NO: 207616 - DNA, 103 bp, Artificial Sequence
  Synthetic Polynucleotide
taatacgactcactatagggcaggccgggaagcgctcgtccgccgcctccaacagaggagaggaggcatgggacgagcgaacctggcggcagcgcaaaagatg

SEQ ID NO: 207617 - DNA, 103 bp, Artificial Sequence
  Synthetic Polynucleotide
taatacgactcactataggggtcgcggatgcaggccgggaagcgctcgtcaacagaggagagacgagatgttcccggccaacctggcggcagcgcaaaagatg

SEQ ID NO: 207618 - DNA, 103 bp, Artificial Sequence
  Synthetic Polynucleotide
taatacgactcactatagggtgcagggcggctgggagcgggcctcgctcaaacagaggagatgagcgatgcccgctcccaacctggcggcagcgcaaaagatg

SEQ ID NO: 207619 - DNA, 103 bp, Artificial Sequence
  Synthetic Polynucleotide
taatacgactcactataggggcgacacggcgtcgcggatgcaggccgggaaacagaggagatcccggatggcatccgcgaacctggcggcagcgcaaaagatg

SEQ ID NO: 207620 - DNA, 103 bp, Artificial Sequence
  Synthetic Polynucleotide
taatacgactcactatagggttgagcacctgcgacacggcgtcgcggatgaacagaggagacatccgatgcgccgtgtcaacctggcggcagcgcaaaagatg

SEQ ID NO: 207621 - DNA, 103 bp, Artificial Sequence
  Synthetic Polynucleotide
taatacgactcactataggggtcgtagcccttgagcacctgcgacacggcaacagaggagagccgtgatgcaggtgctcaacctggcggcagcgcaaaagatg

SEQ ID NO: 207622 - DNA, 103 bp, Artificial Sequence
  Synthetic Polynucleotide
taatacgactcactatagggccagactccagtcgtagcccttgagcacctaacagaggagaaggtgcatgagggctacgaacctggcggcagcgcaaaagatg

SEQ ID NO: 207623 - DNA, 103 bp, Artificial Sequence
  Synthetic Polynucleotide
taatacgactcactatagggggcatgggcaccagactccagtcgtagcccaacagaggagagggctaatgctggagtctaacctggcggcagcgcaaaagatg

SEQ ID NO: 207624 - DNA, 103 bp, Artificial Sequence
  Synthetic Polynucleotide
taatacgactcactataggggccgcgcaccggcatgggcaccagactccaaacagaggagatggagtatggtgcccatgaacctggcggcagcgcaaaagatg

SEQ ID NO: 207625 - DNA, 103 bp, Artificial Sequence
  Synthetic Polynucleotide
taatacgactcactatagggcgccgccgccgccgcgcaccggcatgggcaaacagaggagatgcccaatgcggtgcgcgaacctggcggcagcgcaaaagatg

SEQ ID NO: 207626 - DNA, 103 bp, Artificial Sequence
  Synthetic Polynucleotide
taatacgactcactatagggttgagcgcgccgccgccgccgccgcgcaccaacagaggagaggtgcgatgcggcggcggaacctggcggcagcgcaaaagatg

SEQ ID NO: 207627 - DNA, 103 bp, Artificial Sequence
  Synthetic Polynucleotide
taatacgactcactatagggcggcttggctttgagcgcgccgccgccgccaacagaggagaggcggcatgggcgcgctcaacctggcggcagcgcaaaagatg

SEQ ID NO: 207628 - DNA, 103 bp, Artificial Sequence
  Synthetic Polynucleotide
taatacgactcactataggggcttcacatgcggcttggctttgagcgcgcaacagaggagagcgcgcatgaagccaagcaacctggcggcagcgcaaaagatg

SEQ ID NO: 207629 - DNA, 103 bp, Artificial Sequence
  Synthetic Polynucleotide
taatacgactcactatagggccggacgggctgcagggcggctgggagcggaacagaggagaccgctcatggccgccctgaacctggcggcagcgcaaaagatg

SEQ ID NO: 207630 - DNA, 103 bp, Artificial Sequence
  Synthetic Polynucleotide
taatacgactcactatagggttcatgggccgcttcacatgcggcttggctaacagaggagaagccaaatggcatgtgaaaacctggcggcagcgcaaaagatg

SEQ ID NO: 207631 - DNA, 103 bp, Artificial Sequence
  Synthetic Polynucleotide
taatacgactcactatagggcatgaatgcgttcatgggccgcttcacatgaacagaggagacatgtgatgcggcccatgaacctggcggcagcgcaaaagatg

SEQ ID NO: 207632 - DNA, 103 bp, Artificial Sequence
  Synthetic Polynucleotide
taatacgactcactataggggcgcccacaccatgaatgcgttcatgggccaacagaggagaggcccaatgacgcattcaaacctggcggcagcgcaaaagatg

SEQ ID NO: 207633 - DNA, 103 bp, Artificial Sequence
  Synthetic Polynucleotide
taatacgactcactatagggcgcgccgcctgcgcccacaccatgaatgcgaacagaggagacgcattatgggtgtgggcaacctggcggcagcgcaaaagatg

SEQ ID NO: 207634 - DNA, 103 bp, Artificial Sequence
  Synthetic Polynucleotide
taatacgactcactatagggcagcttgcggcgcgccgcctgcgcccacacaacagaggagagtgtggatgcaggcggcgaacctggcggcagcgcaaaagatg

SEQ ID NO: 207635 - DNA, 103 bp, Artificial Sequence
  Synthetic Polynucleotide
taatacgactcactatagggactggtcggccagcttgcggcgcgccgcctaacagaggagaaggcggatggccgcaagcaacctggcggcagcgcaaaagatg

SEQ ID NO: 207636 - DNA, 103 bp, Artificial Sequence
  Synthetic Polynucleotide
taatacgactcactatagggaggtgcgggtactggtcggccagcttgcggaacagaggagaccgcaaatgggccgaccaaacctggcggcagcgcaaaagatg

SEQ ID NO: 207637 - DNA, 103 bp, Artificial Sequence
  Synthetic Polynucleotide
taatacgactcactatagggggcgttgtgcaggtgcgggtactggtcggcaacagaggagagccgacatgtacccgcacaacctggcggcagcgcaaaagatg

SEQ ID NO: 207638 - DNA, 103 bp, Artificial Sequence
  Synthetic Polynucleotide
taatacgactcactatagggtgctgagctcggcgttgtgcaggtgcgggtaacagaggagaacccgcatgtgcacaacgaacctggcggcagcgcaaaagatg

SEQ ID NO: 207639 - DNA, 103 bp, Artificial Sequence
  Synthetic Polynucleotide
taatacgactcactatagggcccagcgtcttgctgagctcggcgttgtgcaacagaggagagcacaaatgcgagctcagaacctggcggcagcgcaaaagatg

SEQ ID NO: 207640 - DNA, 103 bp, Artificial Sequence
  Synthetic Polynucleotide
taatacgactcactataggggctggcggtgccggacgggctgcagggcggaacagaggagaccgcccatgagcccgtccaacctggcggcagcgcaaaagatg

SEQ ID NO: 207641 - DNA, 103 bp, Artificial Sequence
  Synthetic Polynucleotide
taatacgactcactatagggccacagcttgcccagcgtcttgctgagctcaacagaggagagagctcatgaagacgctgaacctggcggcagcgcaaaagatg

SEQ ID NO: 207642 - DNA, 103 bp, Artificial Sequence
  Synthetic Polynucleotide
taatacgactcactatagggtcagcaagcgccacagcttgcccagcgtctaacagaggagaagacgcatggcaagctgtaacctggcggcagcgcaaaagatg

SEQ ID NO: 207643 - DNA, 103 bp, Artificial Sequence
  Synthetic Polynucleotide
taatacgactcactatagggtcgctctcgctcagcaagcgccacagcttgaacagaggagacaagctatggcgcttgctaacctggcggcagcgcaaaagatg

SEQ ID NO: 207644 - DNA, 103 bp, Artificial Sequence
  Synthetic Polynucleotide
taatacgactcactataggggggccgcttctcgctctcgctcagcaagcgaacagaggagacgcttgatgagcgagagcaacctggcggcagcgcaaaagatg

SEQ ID NO: 207645 - DNA, 103 bp, Artificial Sequence
  Synthetic Polynucleotide
taatacgactcactatagggcctccacgaagggccgcttctcgctctcgcaacagaggagagcgagaatgagaagcggcaacctggcggcagcgcaaaagatg

SEQ ID NO: 207646 - DNA, 103 bp, Artificial Sequence
  Synthetic Polynucleotide
taatacgactcactatagggcgctctgcctcctccacgaagggccgcttcaacagaggagagaagcgatgcttcgtggaaacctggcggcagcgcaaaagatg

SEQ ID NO: 207647 - DNA, 103 bp, Artificial Sequence
  Synthetic Polynucleotide
taatacgactcactatagggcacgcgaaggcgctctgcctcctccacgaaaacagaggagattcgtgatggaggcagagaacctggcggcagcgcaaaagatg

SEQ ID NO: 207648 - DNA, 103 bp, Artificial Sequence
  Synthetic Polynucleotide
taatacgactcactatagggtcttgtgctgcacgcgaaggcgctctgcctaacagaggagaaggcagatggccttcgcgaacctggcggcagcgcaaaagatg

SEQ ID NO: 207649 - DNA, 103 bp, Artificial Sequence
  Synthetic Polynucleotide
taatacgactcactataggggggtggtccttcttgtgctgcacgcgaaggaacagaggagaccttcgatggcagcacaaaacctggcggcagcgcaaaagatg

SEQ ID NO: 207650 - DNA, 103 bp, Artificial Sequence
  Synthetic Polynucleotide
taatacgactcactatagggcttgtagtcggggtggtccttcttgtgctgaacagaggagacagcacatgaaggaccacaacctggcggcagcgcaaaagatg

SEQ ID NO: 207651 - DNA, 103 bp, Artificial Sequence
  Synthetic Polynucleotide
taatacgactcactataggggcgacatggagctggcggtgccggacgggcaacagaggagagcccgtatggcaccgccaaacctggcggcagcgcaaaagatg

SEQ ID NO: 207652 - DNA, 103 bp, Artificial Sequence
  Synthetic Polynucleotide
taatacgactcactataggggtggctggtacttgtagtcggggtggtcctaacagaggagaaggaccatgccgactacaaacctggcggcagcgcaaaagatg

SEQ ID NO: 207653 - DNA, 103 bp, Artificial Sequence
  Synthetic Polynucleotide
taatacgactcactatagggttcctgcgccgtggctggtacttgtagtcgaacagaggagacgactaatggtaccagccaacctggcggcagcgcaaaagatg

SEQ ID NO: 207654 - DNA, 103 bp, Artificial Sequence
  Synthetic Polynucleotide
taatacgactcactatagggtttggcgctcttcctgcgccgtggctggtaaacagaggagataccagatgcggcgcaggaacctggcggcagcgcaaaagatg

SEQ ID NO: 207655 - DNA, 103 bp, Artificial Sequence
  Synthetic Polynucleotide
taatacgactcactatagggtgtggccggctttggcgctcttcctgcgccaacagaggagaggcgcaatgagagcgccaaacctggcggcagcgcaaaagatg

SEQ ID NO: 207656 - DNA, 103 bp, Artificial Sequence
  Synthetic Polynucleotide
taatacgactcactatagggtcggagtcgctgtggccggctttggcgctcaacagaggagagagcgcatgagccggccaaacctggcggcagcgcaaaagatg

SEQ ID NO: 207657 - DNA, 103 bp, Artificial Sequence
  Synthetic Polynucleotide
taatacgactcactatagggcgcgcccgagtcggagtcgctgtggccggcaacagaggagagccggcatgagcgactccaacctggcggcagcgcaaaagatg

SEQ ID NO: 207658 - DNA, 103 bp, Artificial Sequence
  Synthetic Polynucleotide
taatacgactcactataggggtcccagctccgcgcccgagtcggagtcgcaacagaggagagcgactatgactcgggcgaacctggcggcagcgcaaaagatg

SEQ ID NO: 207659 - DNA, 103 bp, Artificial Sequence
  Synthetic Polynucleotide
taatacgactcactatagggccagggtggggtcccagctccgcgcccgagaacagaggagactcgggatgggagctgggaacctggcggcagcgcaaaagatg

SEQ ID NO: 207660 - DNA, 103 bp, Artificial Sequence
  Synthetic Polynucleotide
taatacgactcactatagggggcaccgccgccagggtggggtcccagctcaacagaggagagagctgatgccccaccctaacctggcggcagcgcaaaagatg

SEQ ID NO: 207661 - DNA, 103 bp, Artificial Sequence
  Synthetic Polynucleotide
taatacgactcactatagggccttgtacacggcaccgccgccagggtgggaacagaggagacccaccatggcggcggtgaacctggcggcagcgcaaaagatg

SEQ ID NO: 207662 - DNA, 103 bp, Artificial Sequence
  Synthetic Polynucleotide
taatacgactcactatagggtcctccacgtgcgacatggagctggcggtgaacagaggagacaccgcatgctccatgtcaacctggcggcagcgcaaaagatg

SEQ ID NO: 207663 - DNA, 103 bp, Artificial Sequence
  Synthetic Polynucleotide
taatacgactcactatagggcctgcttcagccttgtacacggcaccgccgaacagaggagacggcggatgcgtgtacaaaacctggcggcagcgcaaaagatg

SEQ ID NO: 207664 - DNA, 103 bp, Artificial Sequence
  Synthetic Polynucleotide
taatacgactcactatagggatctccaagccctgcttcagccttgtacacaacagaggagagtgtacatggctgaagcaaacctggcggcagcgcaaaagatg

SEQ ID NO: 207665 - DNA, 103 bp, Artificial Sequence
  Synthetic Polynucleotide
taatacgactcactatagggggtggtgcccatctccaagccctgcttcagaacagaggagactgaagatgggcttggagaacctggcggcagcgcaaaagatg

SEQ ID NO: 207666 - DNA, 103 bp, Artificial Sequence
  Synthetic Polynucleotide
taatacgactcactatagggtggtcgccatggtggtgcccatctccaagcaacagaggagagcttggatgtgggcaccaaacctggcggcagcgcaaaagatg

SEQ ID NO: 207667 - DNA, 103 bp, Artificial Sequence
  Synthetic Polynucleotide
taatacgactcactatagggctgccctgtgtggtcgccatggtggtgcccaacagaggagagggcacatgcatggcgacaacctggcggcagcgcaaaagatg

SEQ ID NO: 207668 - DNA, 103 bp, Artificial Sequence
  Synthetic Polynucleotide
taatacgactcactataggggcccgtgggtctgccctgtgtggtcgccataacagaggagaatggcgatgacacagggcaacctggcggcagcgcaaaagatg

SEQ ID NO: 207669 - DNA, 103 bp, Artificial Sequence
  Synthetic Polynucleotide
taatacgactcactatagggggggtgggcggcccgtgggtctgccctgtgaacagaggagacacaggatggacccacggaacctggcggcagcgcaaaagatg

SEQ ID NO: 207670 - DNA, 103 bp, Artificial Sequence
  Synthetic Polynucleotide
taatacgactcactatagggggtggtgggcggggtgggcggcccgtgggtaacagaggagaacccacatgccgcccaccaacctggcggcagcgcaaaagatg

SEQ ID NO: 207671 - DNA, 103 bp, Artificial Sequence
  Synthetic Polynucleotide
taatacgactcactatagggccgtcttgggggtggtgggcggggtgggcgaacagaggagacgcccaatgcgcccaccaaacctggcggcagcgcaaaagatg

SEQ ID NO: 207672 - DNA, 103 bp, Artificial Sequence
  Synthetic Polynucleotide
taatacgactcactatagggtgctgcagctccgtcttgggggtggtgggcaacagaggagagcccacatgccccaagacaacctggcggcagcgcaaaagatg

SEQ ID NO: 207673 - DNA, 103 bp, Artificial Sequence
  Synthetic Polynucleotide
taatacgactcactatagggcgagtccgagtcctccacgtgcgacatggaaacagaggagatccatgatgcacgtggagaacctggcggcagcgcaaaagatg

SEQ ID NO: 207674 - DNA, 103 bp, Artificial Sequence
  Synthetic Polynucleotide
taatacgactcactatagggggcgcccgcctgctgcagctccgtcttgggaacagaggagacccaagatggagctgcagaacctggcggcagcgcaaaagatg

SEQ ID NO: 207675 - DNA, 103 bp, Artificial Sequence
  Synthetic Polynucleotide
taatacgactcactataggggctccggcttggcgcccgcctgctgcagctaacagaggagaagctgcatgaggcgggcgaacctggcggcagcgcaaaagatg

SEQ ID NO: 207676 - DNA, 103 bp, Artificial Sequence
  Synthetic Polynucleotide
taatacgactcactatagggtccagcttcagctccggcttggcgcccgccaacagaggagaggcgggatgcaagccggaaacctggcggcagcgcaaaagatg

SEQ ID NO: 207677 - DNA, 103 bp, Artificial Sequence
  Synthetic Polynucleotide
taatacgactcactatagggccggcgtccctccagcttcagctccggcttaacagaggagaaagccgatgctgaagctgaacctggcggcagcgcaaaagatg

SEQ ID NO: 207678 - DNA, 103 bp, Artificial Sequence
  Synthetic Polynucleotide
taatacgactcactatagggtgtccaccggccggcgtccctccagcttcaaacagaggagatgaagcatgagggacgccaacctggcggcagcgcaaaagatg

SEQ ID NO: 207679 - DNA, 103 bp, Artificial Sequence
  Synthetic Polynucleotide
taatacgactcactatagggtggcgcccgctgtccaccggccggcgtcccaacagaggagagggacgatggccggtggaaacctggcggcagcgcaaaagatg

SEQ ID NO: 207680 - DNA, 103 bp, Artificial Sequence
  Synthetic Polynucleotide
taatacgactcactataggggtcgatgttctggcgcccgctgtccaccggaacagaggagaccggtgatgagcgggcgcaacctggcggcagcgcaaaagatg

SEQ ID NO: 207681 - DNA, 103 bp, Artificial Sequence
  Synthetic Polynucleotide
taatacgactcactatagggcgttgctgaagtcgatgttctggcgcccgcaacagaggagagcgggcatgagaacatcgaacctggcggcagcgcaaaagatg

SEQ ID NO: 207682 - DNA, 103 bp, Artificial Sequence
  Synthetic Polynucleotide
taatacgactcactataggggagatgtccacgttgctgaagtcgatgttcaacagaggagagaacatatgcttcagcaaaacctggcggcagcgcaaaagatg

SEQ ID NO: 207683 - DNA, 103 bp, Artificial Sequence
  Synthetic Polynucleotide
taatacgactcactataggggctgagctccgagatgtccacgttgctgaaaacagaggagattcagcatggtggacatcaacctggcggcagcgcaaaagatg

SEQ ID NO: 207684 - DNA, 103 bp, Artificial Sequence
  Synthetic Polynucleotide
taatacgactcactataggggcggcgcgtccgagtccgagtcctccacgtaacagaggagaacgtggatgactcggactaacctggcggcagcgcaaaagatg

SEQ ID NO: 207685 - DNA, 103 bp, Artificial Sequence
  Synthetic Polynucleotide
taatacgactcactatagggtgacctcgctgctgagctccgagatgtccaaacagaggagatggacaatgcggagctcaaacctggcggcagcgcaaaagatg

SEQ ID NO: 207686 - DNA, 103 bp, Artificial Sequence
  Synthetic Polynucleotide
taatacgactcactatagggatggtgcccatgacctcgctgctgagctccaacagaggagaggagctatgcagcgaggtaacctggcggcagcgcaaaagatg

SEQ ID NO: 207687 - DNA, 103 bp, Artificial Sequence
  Synthetic Polynucleotide
taatacgactcactataggggaaggcgtccatggtgcccatgacctcgctaacagaggagaagcgagatgatgggcaccaacctggcggcagcgcaaaagatg

SEQ ID NO: 207688 - DNA, 103 bp, Artificial Sequence
  Synthetic Polynucleotide
taatacgactcactatagggcgtggacgtcgaaggcgtccatggtgcccaaacagaggagatgggcaatgtggacgcctaacctggcggcagcgcaaaagatg

SEQ ID NO: 207689 - DNA, 103 bp, Artificial Sequence
  Synthetic Polynucleotide
taatacgactcactatagggtggtcgaactcgtggacgtcgaaggcgtccaacagaggagaggacgcatgcgacgtccaaacctggcggcagcgcaaaagatg

SEQ ID NO: 207690 - DNA, 103 bp, Artificial Sequence
  Synthetic Polynucleotide
taatacgactcactataggggggcaggtactggtcgaactcgtggacgtcaacagaggagagacgtcatggagttcgacaacctggcggcagcgcaaaagatg

SEQ ID NO: 207691 - DNA, 103 bp, Artificial Sequence
  Synthetic Polynucleotide
taatacgactcactatagggggccgcccaggggcaggtactggtcgaactaacagaggagaagttcgatgagtacctgcaacctggcggcagcgcaaaagatg

SEQ ID NO: 207692 - DNA, 103 bp, Artificial Sequence
  Synthetic Polynucleotide
taatacgactcactatagggggtggggcggggccgcccaggggcaggtacaacagaggagagtacctatgcctgggcggaacctggcggcagcgcaaaagatg

SEQ ID NO: 207693 - DNA, 103 bp, Artificial Sequence
  Synthetic Polynucleotide
taatacgactcactataggggcccggctcgggtggggcggggccgcccagaacagaggagactgggcatgcccgccccaaacctggcggcagcgcaaaagatg

SEQ ID NO: 207694 - DNA, 103 bp, Artificial Sequence
  Synthetic Polynucleotide
taatacgactcactatagggcataggcctggcccggctcgggtggggcggaacagaggagaccgcccatgccgagccggaacctggcggcagcgcaaaagatg

SEQ ID NO: 207695 - DNA, 103 bp, Artificial Sequence
  Synthetic Polynucleotide
taatacgactcactataggggcgggagacggcggcgcgtccgagtccgagaacagaggagactcggaatgggacgcgccaacctggcggcagcgcaaaagatg

SEQ ID NO: 207696 - DNA, 103 bp, Artificial Sequence
  Synthetic Polynucleotide
taatacgactcactatagggtaggcgcccccataggcctggcccggctcgaacagaggagacgagccatgccaggcctaaacctggcggcagcgcaaaagatg

SEQ ID NO: 207697 - DNA, 103 bp, Artificial Sequence
  Synthetic Polynucleotide
taatacgactcactatagggggcgtggaagtaggcgcccccataggcctgaacagaggagacaggccatggggggcgccaacctggcggcagcgcaaaagatg

SEQ ID NO: 207698 - DNA, 103 bp, Artificial Sequence
  Synthetic Polynucleotide
taatacgactcactataggggggacgccccggcgtggaagtaggcgccccaacagaggagaggggcgatgacttccacgaacctggcggcagcgcaaaagatg

SEQ ID NO: 207699 - DNA, 103 bp, Artificial Sequence
  Synthetic Polynucleotide
taatacgactcactataggggcccacacgggggacgccccggcgtggaagaacagaggagacttccaatgcggggcgtcaacctggcggcagcgcaaaagatg

SEQ ID NO: 207700 - DNA, 103 bp, Artificial Sequence
  Synthetic Polynucleotide
taatacgactcactatagggactcttgtgggcccacacgggggacgccccaacagaggagaggggcgatgcccgtgtggaacctggcggcagcgcaaaagatg

SEQ ID NO: 207701 - DNA, 103 bp, Artificial Sequence
  Synthetic Polynucleotide
taatacgactcactatagggccgacggggcactcttgtgggcccacacggaacagaggagaccgtgtatgcccacaagaaacctggcggcagcgcaaaagatg

SEQ ID NO: 207702 - DNA, 103 bp, Artificial Sequence
  Synthetic Polynucleotide
taatacgactcactataggggacgcggaggccgacggggcactcttgtggaacagaggagaccacaaatgtgccccgtcaacctggcggcagcgcaaaagatg

SEQ ID NO: 207703 - DNA, 103 bp, Artificial Sequence
  Synthetic Polynucleotide
taatacgactcactatagggctcggtgggcgacgcggaggccgacggggcaacagaggagagccccgatggcctccgcgaacctggcggcagcgcaaaagatg

SEQ ID NO: 207704 - DNA, 103 bp, Artificial Sequence
  Synthetic Polynucleotide
taatacgactcactatagggggggacccgtctcggtgggcgacgcggaggaacagaggagacctccgatgcgcccaccgaacctggcggcagcgcaaaagatg

SEQ ID NO: 207705 - DNA, 103 bp, Artificial Sequence
  Synthetic Polynucleotide
taatacgactcactatagggtgcggccgtgggggacccgtctcggtgggcaacagaggagagcccacatggacgggtccaacctggcggcagcgcaaaagatg

SEQ ID NO: 207706 - DNA, 103 bp, Artificial Sequence
  Synthetic Polynucleotide
taatacgactcactatagggcatcttcatgaaggggtccaggagattcataacagaggagaatgaatatgctggaccccaacctggcggcagcgcaaaagatg

SEQ ID NO: 207707 - DNA, 103 bp, Artificial Sequence
  Synthetic Polynucleotide
taatacgactcactataggggccggagcccgacgggcagggcgagcccgcaacagaggagagcgggcatgccctgcccgaacctggcggcagcgcaaaagatg

SEQ ID NO: 207708 - DNA, 103 bp, Artificial Sequence
  Synthetic Polynucleotide
taatacgactcactatagggctgctgcttggacatccacacgtggcccgcaacagaggagagcgggcatggtgtggatgaacctggcggcagcgcaaaagatg

SEQ ID NO: 207709 - DNA, 103 bp, Artificial Sequence
  Synthetic Polynucleotide
taatacgactcactataggggcggcggcgcctgctgcttggacatccacaaacagaggagatgtggaatgccaagcagcaacctggcggcagcgcaaaagatg

SEQ ID NO: 207710 - DNA, 103 bp, Artificial Sequence
  Synthetic Polynucleotide
taatacgactcactatagggtgcgggggtggcggcggcgcctgctgcttgaacagaggagacaagcaatgggcgccgccaacctggcggcagcgcaaaagatg

SEQ ID NO: 207711 - DNA, 103 bp, Artificial Sequence
  Synthetic Polynucleotide
taatacgactcactatagggtgggggctgctgcgggggtggcggcggcgcaacagaggagagcgccgatgccacccccgaacctggcggcagcgcaaaagatg

SEQ ID NO: 207712 - DNA, 103 bp, Artificial Sequence
  Synthetic Polynucleotide
taatacgactcactataggggcggggcctgtgggggctgctgcgggggtgaacagaggagacaccccatgagcagccccaacctggcggcagcgcaaaagatg

SEQ ID NO: 207713 - DNA, 103 bp, Artificial Sequence
  Synthetic Polynucleotide
taatacgactcactatagggtgcggggccggcggggcctgtgggggctgcaacagaggagagcagccatgacaggccccaacctggcggcagcgcaaaagatg

SEQ ID NO: 207714 - DNA, 103 bp, Artificial Sequence
  Synthetic Polynucleotide
taatacgactcactatagggcgggggcgcctgcggggccggcggggcctgaacagaggagacaggccatgccggccccgaacctggcggcagcgcaaaagatg

SEQ ID NO: 207715 - DNA, 103 bp, Artificial Sequence
  Synthetic Polynucleotide
taatacgactcactatagggcctgcggctgcgggggcgcctgcggggccgaacagaggagacggcccatgaggcgccccaacctggcggcagcgcaaaagatg

SEQ ID NO: 207716 - DNA, 103 bp, Artificial Sequence
  Synthetic Polynucleotide
taatacgactcactataggggggggcgccgcctgcggctgcgggggcgccaacagaggagaggcgccatggcagccgcaaacctggcggcagcgcaaaagatg

SEQ ID NO: 207717 - DNA, 103 bp, Artificial Sequence
  Synthetic Polynucleotide
taatacgactcactatagggcggctgctgtgggggcgccgcctgcggctgaacagaggagacagccgatggcggcgcccaacctggcggcagcgcaaaagatg

SEQ ID NO: 207718 - DNA, 103 bp, Artificial Sequence
  Synthetic Polynucleotide
taatacgactcactatagggcggtgtccgagccggagcccgacgggcaggaacagaggagacctgccatgcgggctccgaacctggcggcagcgcaaaagatg

SEQ ID NO: 207719 - DNA, 103 bp, Artificial Sequence
  Synthetic Polynucleotide
taatacgactcactatagggggggtgccgccggctgctgtgggggcgccgaacagaggagacggcgcatgcacagcagcaacctggcggcagcgcaaaagatg

SEQ ID NO: 207720 - DNA, 103 bp, Artificial Sequence
  Synthetic Polynucleotide
taatacgactcactatagggggctgctgcgggggtgccgccggctgctgtaacagaggagaacagcaatgggcggcaccaacctggcggcagcgcaaaagatg

SEQ ID NO: 207721 - DNA, 103 bp, Artificial Sequence
  Synthetic Polynucleotide
taatacgactcactataggggtgcgcctgtggctgctgcgggggtgccgcaacagaggagagcggcaatgccgcagcagaacctggcggcagcgcaaaagatg

SEQ ID NO: 207722 - DNA, 103 bp, Artificial Sequence
  Synthetic Polynucleotide
taatacgactcactatagggtggtcagcgtgtgcgcctgtggctgctgcgaacagaggagacgcagcatgcacaggcgcaacctggcggcagcgcaaaagatg

SEQ ID NO: 207723 - DNA, 103 bp, Artificial Sequence
  Synthetic Polynucleotide
taatacgactcactatagggctgctcagcgtggtcagcgtgtgcgcctgtaacagaggagaacaggcatgcacgctgacaacctggcggcagcgcaaaagatg

SEQ ID NO: 207724 - DNA, 103 bp, Artificial Sequence
  Synthetic Polynucleotide
taatacgactcactataggggcccggctcgctgctcagcgtggtcagcgtaacagaggagaacgctgatgacgctgagcaacctggcggcagcgcaaaagatg

SEQ ID NO: 207725 - DNA, 103 bp, Artificial Sequence
  Synthetic Polynucleotide
taatacgactcactataggggctgggactggcccggctcgctgctcagcgaacagaggagacgctgaatggcgagccggaacctggcggcagcgcaaaagatg

SEQ ID NO: 207726 - DNA, 103 bp, Artificial Sequence
  Synthetic Polynucleotide
taatacgactcactatagggatgtgcgttcgctgggactggcccggctcgaacagaggagacgagccatgccagtcccaaacctggcggcagcgcaaaagatg

SEQ ID NO: 207727 - DNA, 103 bp, Artificial Sequence
  Synthetic Polynucleotide
taatacgactcactatagggctccgtcttgatgtgcgttcgctgggactgaacagaggagacagtccatgcgaacgcacaacctggcggcagcgcaaaagatg

SEQ ID NO: 207728 - DNA, 103 bp, Artificial Sequence
  Synthetic Polynucleotide
taatacgactcactatagggggctcagctgctccgtcttgatgtgcgttcaacagaggagagaacgcatgtcaagacggaacctggcggcagcgcaaaagatg

SEQ ID NO: 207729 - DNA, 103 bp, Artificial Sequence
  Synthetic Polynucleotide
taatacgactcactatagggcgcgtgttctcggtgtccgagccggagcccaacagaggagagggctcatgctcggacacaacctggcggcagcgcaaaagatg

SEQ ID NO: 207730 - DNA, 103 bp, Artificial Sequence
  Synthetic Polynucleotide
taatacgactcactatagggtagtggctggggctcagctgctccgtcttgaacagaggagacaagacatggcagctgagaacctggcggcagcgcaaaagatg

SEQ ID NO: 207731 - DNA, 103 bp, Artificial Sequence
  Synthetic Polynucleotide
taatacgactcactatagggctgctcgctgtagtggctggggctcagctgaacagaggagacagctgatgcccagccacaacctggcggcagcgcaaaagatg

SEQ ID NO: 207732 - DNA, 103 bp, Artificial Sequence
  Synthetic Polynucleotide
taatacgactcactatagggagtgctgctgctgctcgctgtagtggctggaacagaggagaccagccatgacagcgagcaacctggcggcagcgcaaaagatg

SEQ ID NO: 207733 - DNA, 103 bp, Artificial Sequence
  Synthetic Polynucleotide
taatacgactcactatagggtgttggggcgagtgctgctgctgctcgctgaacagaggagacagcgaatggcagcagcaaacctggcggcagcgcaaaagatg

SEQ ID NO: 207734 - DNA, 103 bp, Artificial Sequence
  Synthetic Polynucleotide
taatacgactcactataggggtaggcgatctgttggggcgagtgctgctgaacagaggagacagcagatgtcgccccaaaacctggcggcagcgcaaaagatg

SEQ ID NO: 207735 - DNA, 103 bp, Artificial Sequence
  Synthetic Polynucleotide
taatacgactcactatagggtgaaggggctgtaggcgatctgttggggcgaacagaggagacgccccatgagatcgcctaacctggcggcagcgcaaaagatg

SEQ ID NO: 207736 - DNA, 103 bp, Artificial Sequence
  Synthetic Polynucleotide
taatacgactcactatagggtgtgggaggttgaaggggctgtaggcgatcaacagaggagagatcgcatgcagccccttaacctggcggcagcgcaaaagatg

SEQ ID NO: 207737 - DNA, 103 bp, Artificial Sequence
  Synthetic Polynucleotide
taatacgactcactatagggggggctgtagtgtgggaggttgaaggggctaacagaggagaagccccatgaacctcccaaacctggcggcagcgcaaaagatg

SEQ ID NO: 207738 - DNA, 103 bp, Artificial Sequence
  Synthetic Polynucleotide
taatacgactcactataggggcgggtaggaggggctgtagtgtgggaggtaacagaggagaacctccatgactacagccaacctggcggcagcgcaaaagatg

SEQ ID NO: 207739 - DNA, 103 bp, Artificial Sequence
  Synthetic Polynucleotide
taatacgactcactatagggcgggtgatgggcgggtaggaggggctgtagaacagaggagactacagatgctcctacccaacctggcggcagcgcaaaagatg

SEQ ID NO: 207740 - DNA, 103 bp, Artificial Sequence
  Synthetic Polynucleotide
taatacgactcactatagggctcctggggccgcgtgttctcggtgtccgaaacagaggagatcggacatggagaacacgaacctggcggcagcgcaaaagatg

SEQ ID NO: 207741 - DNA, 103 bp, Artificial Sequence
  Synthetic Polynucleotide
taatacgactcactataggggtactgtgagcgggtgatgggcgggtaggaaacagaggagatcctacatgcccatcaccaacctggcggcagcgcaaaagatg

SEQ ID NO: 207742 - DNA, 103 bp, Artificial Sequence
  Synthetic Polynucleotide
taatacgactcactatagggcggtgtagtcgtactgtgagcgggtgatggaacagaggagaccatcaatggctcacagtaacctggcggcagcgcaaaagatg

SEQ ID NO: 207743 - DNA, 103 bp, Artificial Sequence
  Synthetic Polynucleotide
taatacgactcactatagggttctggtggtcggtgtagtcgtactgtgagaacagaggagactcacaatgcgactacacaacctggcggcagcgcaaaagatg

SEQ ID NO: 207744 - DNA, 103 bp, Artificial Sequence
  Synthetic Polynucleotide
taatacgactcactatagggggagctggagttctggtggtcggtgtagtcaacagaggagagactacatggaccaccagaacctggcggcagcgcaaaagatg

SEQ ID NO: 207745 - DNA, 103 bp, Artificial Sequence
  Synthetic Polynucleotide
taatacgactcactatagggggctgtagtaggagctggagttctggtggtaacagaggagaaccaccatgactccagctaacctggcggcagcgcaaaagatg

SEQ ID NO: 207746 - DNA, 103 bp, Artificial Sequence
  Synthetic Polynucleotide
taatacgactcactatagggcctgccgcgtggctgtagtaggagctggagaacagaggagactccagatgctactacagaacctggcggcagcgcaaaagatg

SEQ ID NO: 207747 - DNA, 103 bp, Artificial Sequence
  Synthetic Polynucleotide
taatacgactcactatagggggtgccctggcctgccgcgtggctgtagtaaacagaggagatactacatgcacgcggcaaacctggcggcagcgcaaaagatg

SEQ ID NO: 207748 - DNA, 103 bp, Artificial Sequence
  Synthetic Polynucleotide
taatacgactcactatagggagtagaggccggtgccctggcctgccgcgtaacagaggagaacgcggatggccagggcaaacctggcggcagcgcaaaagatg

SEQ ID NO: 207749 - DNA, 103 bp, Artificial Sequence
  Synthetic Polynucleotide
taatacgactcactataggggtgaaggtggagtagaggccggtgccctggaacagaggagaccagggatgcggcctctaaacctggcggcagcgcaaaagatg

SEQ ID NO: 207750 - DNA, 103 bp, Artificial Sequence
  Synthetic Polynucleotide
taatacgactcactataggggttcatgtaggtgaaggtggagtagaggccaacagaggagaggcctcatgtccaccttcaacctggcggcagcgcaaaagatg

SEQ ID NO: 207751 - DNA, 103 bp, Artificial Sequence
  Synthetic Polynucleotide
taatacgactcactatagggggaacgtgttctcctggggccgcgtgttctaacagaggagaagaacaatgggccccaggaacctggcggcagcgcaaaagatg

SEQ ID NO: 207752 - DNA, 103 bp, Artificial Sequence
  Synthetic Polynucleotide
taatacgactcactataggggctgagcggggttcatgtaggtgaaggtggaacagaggagaccacctatgcctacatgaaacctggcggcagcgcaaaagatg

SEQ ID NO: 207753 - DNA, 103 bp, Artificial Sequence
  Synthetic Polynucleotide
taatacgactcactatagggtacatggggcgctgagcggggttcatgtagaacagaggagactacatatgccccgctcaaacctggcggcagcgcaaaagatg

SEQ ID NO: 207754 - DNA, 103 bp, Artificial Sequence
  Synthetic Polynucleotide
taatacgactcactataggggatgggggtgtacatggggcgctgagcgggaacagaggagacccgctatgcgccccatgaacctggcggcagcgcaaaagatg

SEQ ID NO: 207755 - DNA, 103 bp, Artificial Sequence
  Synthetic Polynucleotide
taatacgactcactatagggaggtgtcggcgatgggggtgtacatggggcaacagaggagagccccaatgacacccccaaacctggcggcagcgcaaaagatg

SEQ ID NO: 207756 - DNA, 103 bp, Artificial Sequence
  Synthetic Polynucleotide
taatacgactcactataggggggaccccagaggtgtcggcgatgggggtgaacagaggagacaccccatgcgccgacacaacctggcggcagcgcaaaagatg

SEQ ID NO: 207757 - DNA, 103 bp, Artificial Sequence
  Synthetic Polynucleotide
taatacgactcactatagggcgggatggaagggaccccagaggtgtcggcaacagaggagagccgacatgtctggggtcaacctggcggcagcgcaaaagatg

SEQ ID NO: 207758 - DNA, 103 bp, Artificial Sequence
  Synthetic Polynucleotide
taatacgactcactatagggtgtgggtctgcgggatggaagggaccccagaacagaggagactggggatgcttccatccaacctggcggcagcgcaaaagatg

SEQ ID NO: 207759 - DNA, 103 bp, Artificial Sequence
  Synthetic Polynucleotide
taatacgactcactatagggtgctgggggctgtgggtctgcgggatggaaaacagaggagattccatatggcagacccaaacctggcggcagcgcaaaagatg

SEQ ID NO: 207760 - DNA, 103 bp, Artificial Sequence
  Synthetic Polynucleotide
taatacgactcactatagggttgttcccagtgctgggggctgtgggtctgaacagaggagacagaccatgagcccccagaacctggcggcagcgcaaaagatg

SEQ ID NO: 207761 - DNA, 103 bp, Artificial Sequence
  Synthetic Polynucleotide
taatacgactcactatagggtgtagacgggttgttcccagtgctgggggcaacagaggagagcccccatgactgggaacaacctggcggcagcgcaaaagatg

SEQ ID NO: 207762 - DNA, 103 bp, Artificial Sequence
  Synthetic Polynucleotide
taatacgactcactatagggtcgcccttggggaacgtgttctcctggggcaacagaggagagccccaatggaacacgttaacctggcggcagcgcaaaagatg

SEQ ID NO: 207763 - DNA, 103 bp, Artificial Sequence
  Synthetic Polynucleotide
taatacgactcactataggggtgagctgtgtgtagacgggttgttcccagaacagaggagactgggaatgacccgtctaaacctggcggcagcgcaaaagatg

SEQ ID NO: 207764 - DNA, 103 bp, Artificial Sequence
  Synthetic Polynucleotide
taatacgactcactatagggtcaaggtcgagtgagctgtgtgtagacgggaacagaggagacccgtcatgacacagctcaacctggcggcagcgcaaaagatg

SEQ ID NO: 207765 - DNA, 103 bp, Artificial Sequence
  Synthetic Polynucleotide
taatacgactcactatagggcagatcgggctcgcccttggggaacgtgttaacagaggagaaacacgatgcccaagggcaacctggcggcagcgcaaaagatg

SEQ ID NO: 207766 - DNA, 103 bp, Artificial Sequence
  Synthetic Polynucleotide
taatacgactcactatagggtctccttcttcagatcgggctcgcccttggaacagaggagaccaaggatgagcccgatcaacctggcggcagcgcaaaagatg

SEQ ID NO: 207767 - DNA, 103 bp, Artificial Sequence
  Synthetic Polynucleotide
taatacgactcactatagggtcctcctcgctctccttcttcagatcgggcaacagaggagagcccgaatggaagaaggaaacctggcggcagcgcaaaagatg

SEQ ID NO: 207768 - DNA, 103 bp, Artificial Sequence
  Synthetic Polynucleotide
taatacgactcactatagggggggaacttgtcctcctcgctctccttcttaacagaggagaaagaagatgagcgaggagaacctggcggcagcgcaaaagatg

SEQ ID NO: 207769 - DNA, 103 bp, Artificial Sequence
  Synthetic Polynucleotide
taatacgactcactataggggctcgtcggtcatcttcatgaaggggtccaaacagaggagatggaccatgtcatgaagaaacctggcggcagcgcaaaagatg

SEQ ID NO: 207770 - DNA, 103 bp, Artificial Sequence
  Synthetic Polynucleotide
taatacgactcactatagggggatgcacacggggaacttgtcctcctcgcaacagaggagagcgaggatgacaagttccaacctggcggcagcgcaaaagatg

SEQ ID NO: 207771 - DNA, 103 bp, Artificial Sequence
  Synthetic Polynucleotide
taatacgactcactatagggaccgcctcgcggatgcacacggggaacttgaacagaggagacaagttatgcgtgtgcataacctggcggcagcgcaaaagatg

SEQ ID NO: 207772 - DNA, 103 bp, Artificial Sequence
  Synthetic Polynucleotide
taatacgactcactatagggcacctggctgaccgcctcgcggatgcacacaacagaggagagtgtgcatgcgcgaggcgaacctggcggcagcgcaaaagatg

SEQ ID NO: 207773 - DNA, 103 bp, Artificial Sequence
  Synthetic Polynucleotide
taatacgactcactatagggagcctttgagcacctggctgaccgcctcgcaacagaggagagcgaggatgtcagccaggaacctggcggcagcgcaaaagatg

SEQ ID NO: 207774 - DNA, 103 bp, Artificial Sequence
  Synthetic Polynucleotide
taatacgactcactataggggtccagtcgtagcctttgagcacctggctgaacagaggagacagccaatggctcaaaggaacctggcggcagcgcaaaagatg

SEQ ID NO: 207775 - DNA, 103 bp, Artificial Sequence
  Synthetic Polynucleotide
taatacgactcactataggggggcaccagcgtccagtcgtagcctttgagaacagaggagactcaaaatgtacgactggaacctggcggcagcgcaaaagatg

SEQ ID NO: 207776 - DNA, 103 bp, Artificial Sequence
  Synthetic Polynucleotide
taatacgactcactataggggcaccggcatgggcaccagcgtccagtcgtaacagaggagaacgactatgcgctggtgcaacctggcggcagcgcaaaagatg

SEQ ID NO: 207777 - DNA, 103 bp, Artificial Sequence
  Synthetic Polynucleotide
taatacgactcactatagggccgttgacgcgcaccggcatgggcaccagcaacagaggagagctggtatgcatgccggtaacctggcggcagcgcaaaagatg

SEQ ID NO: 207778 - DNA, 103 bp, Artificial Sequence
  Synthetic Polynucleotide
taatacgactcactatagggcttgctggagccgttgacgcgcaccggcataacagaggagaatgccgatgcgcgtcaacaacctggcggcagcgcaaaagatg

SEQ ID NO: 207779 - DNA, 103 bp, Artificial Sequence
  Synthetic Polynucleotide
taatacgactcactataggggcggcttgttcttgctggagccgttgacgcaacagaggagagcgtcaatggctccagcaaacctggcggcagcgcaaaagatg

SEQ ID NO: 207780 - DNA, 103 bp, Artificial Sequence
  Synthetic Polynucleotide
taatacgactcactatagggcccttctcctgctcgtcggtcatcttcatgaacagaggagacatgaaatggaccgacgaaacctggcggcagcgcaaaagatg

SEQ ID NO: 207781 - DNA, 103 bp, Artificial Sequence
  Synthetic Polynucleotide
taatacgactcactatagggcgcttgacgtgcggcttgttcttgctggagaacagaggagactccagatggaacaagccaacctggcggcagcgcaaaagatg

SEQ ID NO: 207782 - DNA, 103 bp, Artificial Sequence
  Synthetic Polynucleotide
taatacgactcactataggggttcatgggccgcttgacgtgcggcttgttaacagaggagaaacaagatgcacgtcaagaacctggcggcagcgcaaaagatg

SEQ ID NO: 207783 - DNA, 103 bp, Artificial Sequence
  Synthetic Polynucleotide
taatacgactcactatagggccatgaaggcgttcatgggccgcttgacgtaacagaggagaacgtcaatgggcccatgaaacctggcggcagcgcaaaagatg

SEQ ID NO: 207784 - DNA, 103 bp, Artificial Sequence
  Synthetic Polynucleotide
taatacgactcactatagggtgcgcccacaccatgaaggcgttcatgggcaacagaggagagcccatatgcgccttcataacctggcggcagcgcaaaagatg

SEQ ID NO: 207785 - DNA, 103 bp, Artificial Sequence
  Synthetic Polynucleotide
taatacgactcactataggggcgcgccgcctgcgcccacaccatgaaggcaacagaggagagccttcatggtgtgggcgaacctggcggcagcgcaaaagatg

SEQ ID NO: 207786 - DNA, 103 bp, Artificial Sequence
  Synthetic Polynucleotide
taatacgactcactatagggcgagcttcctgcgcgccgcctgcgcccacaaacagaggagatgtgggatgaggcggcgcaacctggcggcagcgcaaaagatg

SEQ ID NO: 207787 - DNA, 103 bp, Artificial Sequence
  Synthetic Polynucleotide
taatacgactcactatagggtactggtccgcgagcttcctgcgcgccgccaacagaggagaggcggcatgcaggaagctaacctggcggcagcgcaaaagatg

SEQ ID NO: 207788 - DNA, 103 bp, Artificial Sequence
  Synthetic Polynucleotide
taatacgactcactatagggcaagtgcgggtactggtccgcgagcttcctaacagaggagaaggaagatggcggaccagaacctggcggcagcgcaaaagatg

SEQ ID NO: 207789 - DNA, 103 bp, Artificial Sequence
  Synthetic Polynucleotide
taatacgactcactatagggcggcgttgtgcaagtgcgggtactggtccgaacagaggagacggaccatgacccgcactaacctggcggcagcgcaaaagatg

SEQ ID NO: 207790 - DNA, 103 bp, Artificial Sequence
  Synthetic Polynucleotide
taatacgactcactatagggttgctgagctcggcgttgtgcaagtgcgggaacagaggagacccgcaatggcacaacgcaacctggcggcagcgcaaaagatg

SEQ ID NO: 207791 - DNA, 103 bp, Artificial Sequence
  Synthetic Polynucleotide
taatacgactcactataggggccggacaggcccttctcctgctcgtcggtaacagaggagaaccgacatgcaggagaagaacctggcggcagcgcaaaagatg

SEQ ID NO: 207792 - DNA, 103 bp, Artificial Sequence
  Synthetic Polynucleotide
taatacgactcactataggggcccagcgtcttgctgagctcggcgttgtgaacagaggagacacaacatggagctcagcaacctggcggcagcgcaaaagatg

SEQ ID NO: 207793 - DNA, 103 bp, Artificial Sequence
  Synthetic Polynucleotide
taatacgactcactatagggtccagagcttgcccagcgtcttgctgagctaacagaggagaagctcaatgagacgctggaacctggcggcagcgcaaaagatg

SEQ ID NO: 207794 - DNA, 103 bp, Artificial Sequence
  Synthetic Polynucleotide
taatacgactcactatagggttcagaagtctccagagcttgcccagcgtcaacagaggagagacgctatgcaagctctgaacctggcggcagcgcaaaagatg

SEQ ID NO: 207795 - DNA, 103 bp, Artificial Sequence
  Synthetic Polynucleotide
taatacgactcactatagggctcgctctcgttcagaagtctccagagcttaacagaggagaaagctcatgagacttctgaacctggcggcagcgcaaaagatg

SEQ ID NO: 207796 - DNA, 103 bp, Artificial Sequence
  Synthetic Polynucleotide
taatacgactcactatagggagggccgcttctcgctctcgttcagaagtcaacagaggagagacttcatgacgagagcgaacctggcggcagcgcaaaagatg

SEQ ID NO: 207797 - DNA, 103 bp, Artificial Sequence
  Synthetic Polynucleotide
taatacgactcactatagggtcctccacgaagggccgcttctcgctctcgaacagaggagacgagagatggaagcggccaacctggcggcagcgcaaaagatg

SEQ ID NO: 207798 - DNA, 103 bp, Artificial Sequence
  Synthetic Polynucleotide
taatacgactcactatagggccgctccgcctcctccacgaagggccgcttaacagaggagaaagcggatgttcgtggagaacctggcggcagcgcaaaagatg

SEQ ID NO: 207799 - DNA, 103 bp, Artificial Sequence
  Synthetic Polynucleotide
taatacgactcactataggggcacgcgcagccgctccgcctcctccacgaaacagaggagatcgtggatgaggcggagcaacctggcggcagcgcaaaagatg

SEQ ID NO: 207800 - DNA, 103 bp, Artificial Sequence
  Synthetic Polynucleotide
taatacgactcactatagggttcttgtgctgcacgcgcagccgctccgccaacagaggagaggcggaatggctgcgcgtaacctggcggcagcgcaaaagatg

SEQ ID NO: 207801 - DNA, 103 bp, Artificial Sequence
  Synthetic Polynucleotide
taatacgactcactatagggcgggtggtccttcttgtgctgcacgcgcagaacagaggagactgcgcatgcagcacaagaacctggcggcagcgcaaaagatg

SEQ ID NO: 207802 - DNA, 103 bp, Artificial Sequence
  Synthetic Polynucleotide
taatacgactcactatagggggctgggggcgccggacaggcccttctcctaacagaggagaaggagaatggcctgtccgaacctggcggcagcgcaaaagatg

SEQ ID NO: 207803 - DNA, 103 bp, Artificial Sequence
  Synthetic Polynucleotide
taatacgactcactatagggacttgtaatccgggtggtccttcttgtgctaacagaggagaagcacaatgaggaccaccaacctggcggcagcgcaaaagatg

SEQ ID NO: 207804 - DNA, 103 bp, Artificial Sequence
  Synthetic Polynucleotide
taatacgactcactatagggcgcggctggtacttgtaatccgggtggtccaacagaggagaggaccaatgggattacaaaacctggcggcagcgcaaaagatg

SEQ ID NO: 207805 - DNA, 103 bp, Artificial Sequence
  Synthetic Polynucleotide
taatacgactcactatagggcttcctccgccgcggctggtacttgtaatcaacagaggagagattacatgtaccagccgaacctggcggcagcgcaaaagatg

SEQ ID NO: 207806 - DNA, 103 bp, Artificial Sequence
  Synthetic Polynucleotide
taatacgactcactatagggtcttcaccgacttcctccgccgcggctggtaacagaggagaaccagcatgggcggaggaaacctggcggcagcgcaaaagatg

SEQ ID NO: 207807 - DNA, 103 bp, Artificial Sequence
  Synthetic Polynucleotide
taatacgactcactataggggcctgcccgttcttcaccgacttcctccgcaacagaggagagcggagatggtcggtgaaaacctggcggcagcgcaaaagatg

SEQ ID NO: 207808 - DNA, 103 bp, Artificial Sequence
  Synthetic Polynucleotide
taatacgactcactatagggctctgcctccgcctgcccgttcttcaccgaaacagaggagatcggtgatgaacgggcagaacctggcggcagcgcaaaagatg

SEQ ID NO: 207809 - DNA, 103 bp, Artificial Sequence
  Synthetic Polynucleotide
taatacgactcactatagggccgtggcctcctctgcctccgcctgcccgtaacagaggagaacgggcatgcggaggcagaacctggcggcagcgcaaaagatg

SEQ ID NO: 207810 - DNA, 103 bp, Artificial Sequence
  Synthetic Polynucleotide
taatacgactcactatagggtgcgtctgctccgtggcctcctctgcctccaacagaggagaggaggcatgggaggccacaacctggcggcagcgcaaaagatg

SEQ ID NO: 207811 - DNA, 103 bp, Artificial Sequence
  Synthetic Polynucleotide
taatacgactcactataggggggggagatgtgcgtctgctccgtggcctcaacagaggagagaggccatggagcagacgaacctggcggcagcgcaaaagatg

SEQ ID NO: 207812 - DNA, 103 bp, Artificial Sequence
  Synthetic Polynucleotide
taatacgactcactatagggagatggcgttgggggagatgtgcgtctgctaacagaggagaagcagaatgacatctcccaacctggcggcagcgcaaaagatg

SEQ ID NO: 207813 - DNA, 103 bp, Artificial Sequence
  Synthetic Polynucleotide
taatacgactcactataggggacatggtggggctgggggcgccggacaggaacagaggagacctgtcatgcgcccccagaacctggcggcagcgcaaaagatg

SEQ ID NO: 207814 - DNA, 103 bp, Artificial Sequence
  Synthetic Polynucleotide
taatacgactcactatagggagcgccttgaagatggcgttgggggagatgaacagaggagacatctcatgcaacgccataacctggcggcagcgcaaaagatg

SEQ ID NO: 207815 - DNA, 103 bp, Artificial Sequence
  Synthetic Polynucleotide
taatacgactcactataggggtcggcctgcagcgccttgaagatggcgttaacagaggagaaacgccatgttcaaggcgaacctggcggcagcgcaaaagatg

SEQ ID NO: 207816 - DNA, 103 bp, Artificial Sequence
  Synthetic Polynucleotide
taatacgactcactatagggagtgtggcgagtcggcctgcagcgccttgaaacagaggagatcaaggatgtgcaggccgaacctggcggcagcgcaaaagatg

SEQ ID NO: 207817 - DNA, 103 bp, Artificial Sequence
  Synthetic Polynucleotide
taatacgactcactatagggccggaggaggagtgtggcgagtcggcctgcaacagaggagagcaggcatgctcgccacaaacctggcggcagcgcaaaagatg

SEQ ID NO: 207818 - DNA, 103 bp, Artificial Sequence
  Synthetic Polynucleotide
taatacgactcactatagggctcgctcatgccggaggaggagtgtggcgaaacagaggagatcgccaatgtcctcctccaacctggcggcagcgcaaaagatg

SEQ ID NO: 207819 - DNA, 103 bp, Artificial Sequence
  Synthetic Polynucleotide
taatacgactcactataggggggagtgcacctcgctcatgccggaggaggaacagaggagacctcctatggcatgagcgaacctggcggcagcgcaaaagatg

SEQ ID NO: 207820 - DNA, 103 bp, Artificial Sequence
  Synthetic Polynucleotide
taatacgactcactatagggtgctcgccgggggagtgcacctcgctcatgaacagaggagacatgagatgggtgcactcaacctggcggcagcgcaaaagatg

SEQ ID NO: 207821 - DNA, 103 bp, Artificial Sequence
  Synthetic Polynucleotide
taatacgactcactatagggttgccccgagtgctcgccgggggagtgcacaacagaggagagtgcacatgcccggcgagaacctggcggcagcgcaaaagatg

SEQ ID NO: 207822 - DNA, 103 bp, Artificial Sequence
  Synthetic Polynucleotide
taatacgactcactatagggggccctgggattgccccgagtgctcgccggaacagaggagaccggcgatgactcggggcaacctggcggcagcgcaaaagatg

SEQ ID NO: 207823 - DNA, 103 bp, Artificial Sequence
  Synthetic Polynucleotide
taatacgactcactatagggggggtcggtgggccctgggattgccccgagaacagaggagactcgggatgatcccagggaacctggcggcagcgcaaaagatg

SEQ ID NO: 207824 - DNA, 103 bp, Artificial Sequence
  Synthetic Polynucleotide
taatacgactcactatagggggagtcctcggacatggtggggctgggggcaacagaggagagcccccatgcccaccatgaacctggcggcagcgcaaaagatg

SEQ ID NO: 207825 - DNA, 103 bp, Artificial Sequence
  Synthetic Polynucleotide
taatacgactcactatagggggtggtgggtggggtcggtgggccctgggaaacagaggagatcccagatgccaccgaccaacctggcggcagcgcaaaagatg

SEQ ID NO: 207826 - DNA, 103 bp, Artificial Sequence
  Synthetic Polynucleotide
taatacgactcactatagggcggttttgggggtggtgggtggggtcggtgaacagaggagacaccgaatgcacccaccaaacctggcggcagcgcaaaagatg

SEQ ID NO: 207827 - DNA, 103 bp, Artificial Sequence
  Synthetic Polynucleotide
taatacgactcactatagggggctgcacgtcggttttgggggtggtgggtaacagaggagaacccacatgccccaaaacaacctggcggcagcgcaaaagatg

SEQ ID NO: 207828 - DNA, 103 bp, Artificial Sequence
  Synthetic Polynucleotide
taatacgactcactatagggagccttgcccggctgcacgtcggttttgggaacagaggagacccaaaatggacgtgcagaacctggcggcagcgcaaaagatg

SEQ ID NO: 207829 - DNA, 103 bp, Artificial Sequence
  Synthetic Polynucleotide
taatacgactcactataggggcttcaggtcagccttgcccggctgcacgtaacagaggagaacgtgcatgcgggcaaggaacctggcggcagcgcaaaagatg

SEQ ID NO: 207830 - DNA, 103 bp, Artificial Sequence
  Synthetic Polynucleotide
taatacgactcactatagggcgcccctctcgcttcaggtcagccttgcccaacagaggagagggcaaatgtgacctgaaaacctggcggcagcgcaaaagatg

SEQ ID NO: 207831 - DNA, 103 bp, Artificial Sequence
  Synthetic Polynucleotide
taatacgactcactatagggtggcaaggggcgcccctctcgcttcaggtcaacagaggagagacctgatgcgagaggggaacctggcggcagcgcaaaagatg

SEQ ID NO: 207832 - DNA, 103 bp, Artificial Sequence
  Synthetic Polynucleotide
taatacgactcactatagggtgcccccctctggcaaggggcgcccctctcaacagaggagagagaggatggccccttgcaacctggcggcagcgcaaaagatg

SEQ ID NO: 207833 - DNA, 103 bp, Artificial Sequence
  Synthetic Polynucleotide
taatacgactcactataggggggggctgtctgcccccctctggcaaggggaacagaggagaccccttatgagaggggggaacctggcggcagcgcaaaagatg

SEQ ID NO: 207834 - DNA, 103 bp, Artificial Sequence
  Synthetic Polynucleotide
taatacgactcactataggggaagtcgatagggggctgtctgcccccctcaacagaggagagaggggatgagacagcccaacctggcggcagcgcaaaagatg

SEQ ID NO: 207835 - DNA, 103 bp, Artificial Sequence
  Synthetic Polynucleotide
taatacgactcactataggggcgagcccgcggagtcctcggacatggtggaacagaggagaccaccaatgccgaggactaacctggcggcagcgcaaaagatg

SEQ ID NO: 207836 - DNA, 103 bp, Artificial Sequence
  Synthetic Polynucleotide
taatacgactcactatagggccacgtcgcggaagtcgatagggggctgtcaacagaggagagacagcatgctatcgactaacctggcggcagcgcaaaagatg

SEQ ID NO: 207837 - DNA, 103 bp, Artificial Sequence
  Synthetic Polynucleotide
taatacgactcactatagggtcgccgatgtccacgtcgcggaagtcgataaacagaggagatatcgaatgccgcgacgtaacctggcggcagcgcaaaagatg

SEQ ID NO: 207838 - DNA, 103 bp, Artificial Sequence
  Synthetic Polynucleotide
taatacgactcactataggggctgctcagctcgccgatgtccacgtcgcgaacagaggagacgcgacatggacatcggcaacctggcggcagcgcaaaagatg

SEQ ID NO: 207839 - DNA, 103 bp, Artificial Sequence
  Synthetic Polynucleotide
taatacgactcactatagggagatgacgtcgctgctcagctcgccgatgtaacagaggagaacatcgatgagctgagcaaacctggcggcagcgcaaaagatg

SEQ ID NO: 207840 - DNA, 103 bp, Artificial Sequence
  Synthetic Polynucleotide
taatacgactcactatagggtcgatgttggagatgacgtcgctgctcagcaacagaggagagctgagatgcgacgtcataacctggcggcagcgcaaaagatg

SEQ ID NO: 207841 - DNA, 103 bp, Artificial Sequence
  Synthetic Polynucleotide
taatacgactcactatagggatcgaaggtctcgatgttggagatgacgtcaacagaggagagacgtcatgtccaacatcaacctggcggcagcgcaaaagatg

SEQ ID NO: 207842 - DNA, 103 bp, Artificial Sequence
  Synthetic Polynucleotide
taatacgactcactatagggactcgttgacatcgaaggtctcgatgttggaacagaggagaccaacaatgagaccttcgaacctggcggcagcgcaaaagatg

SEQ ID NO: 207843 - DNA, 103 bp, Artificial Sequence
  Synthetic Polynucleotide
taatacgactcactatagggtactggtcaaactcgttgacatcgaaggtcaacagaggagagaccttatgtgtcaacgaaacctggcggcagcgcaaaagatg

SEQ ID NO: 207844 - DNA, 103 bp, Artificial Sequence
  Synthetic Polynucleotide
taatacgactcactataggggggcggcaggtactggtcaaactcgttgacaacagaggagagtcaacatgtttgaccagaacctggcggcagcgcaaaagatg

SEQ ID NO: 207845 - DNA, 103 bp, Artificial Sequence
  Synthetic Polynucleotide
taatacgactcactatagggggtggccgttgggcggcaggtactggtcaaaacagaggagattgaccatgacctgccgcaacctggcggcagcgcaaaagatg

SEQ ID NO: 207846 - DNA, 103 bp, Artificial Sequence
  Synthetic Polynucleotide
taatacgactcactataggggacgggcagggcgagcccgcggagtcctcgaacagaggagacgaggaatgcgcgggctcaacctggcggcagcgcaaaagatg

SEQ ID NO: 207847 - DNA, 103 bp, Artificial Sequence
  Synthetic Polynucleotide
taatacgactcactatagggggcacccccgggtggccgttgggcggcaggaacagaggagacctgccatgcaacggccaaacctggcggcagcgcaaaagatg

SEQ ID NO: 207848 - DNA, 103 bp, Artificial Sequence
  Synthetic Polynucleotide
taatacgactcactataggggtgcgtggccggcacccccgggtggccgttaacagaggagaaacggcatgccgggggtgaacctggcggcagcgcaaaagatg

SEQ ID NO: 207849 - DNA, 103 bp, Artificial Sequence
  Synthetic Polynucleotide
taatacgactcactatagggtgacctggccgtgcgtggccggcacccccgaacagaggagacgggggatgcggccacgcaacctggcggcagcgcaaaagatg

SEQ ID NO: 207850 - DNA, 103 bp, Artificial Sequence
  Synthetic Polynucleotide
taatacgactcactatagggcccgtgtaggtgacctggccgtgcgtggccaacagaggagaggccacatgcggccaggtaacctggcggcagcgcaaaagatg

SEQ ID NO: 207851 - DNA, 103 bp, Artificial Sequence
  Synthetic Polynucleotide
taatacgactcactataggggccgtagctgcccgtgtaggtgacctggccaacagaggagaggccagatgacctacacgaacctggcggcagcgcaaaagatg

SEQ ID NO: 207852 - DNA, 103 bp, Artificial Sequence
  Synthetic Polynucleotide
taatacgactcactatagggtgctgctgatgccgtagctgcccgtgtaggaacagaggagacctacaatggcagctacgaacctggcggcagcgcaaaagatg

SEQ ID NO: 207853 - DNA, 103 bp, Artificial Sequence
  Synthetic Polynucleotide
taatacgactcactataggggtggccgcggtgctgctgatgccgtagctgaacagaggagacagctaatgcatcagcagaacctggcggcagcgcaaaagatg

SEQ ID NO: 207854 - DNA, 103 bp, Artificial Sequence
  Synthetic Polynucleotide
taatacgactcactataggggctcgccggggtggccgcggtgctgctgataacagaggagaatcagcatgaccgcggccaacctggcggcagcgcaaaagatg

SEQ ID NO: 207855 - DNA, 103 bp, Artificial Sequence
  Synthetic Polynucleotide
taatacgactcactatagggcgtggcccgcgctcgccggggtggccgcggaacagaggagaccgcggatgccccggcgaaacctggcggcagcgcaaaagatg

SEQ ID NO: 207856 - DNA, 103 bp, Artificial Sequence
  Synthetic Polynucleotide
taatacgactcactataggggacatccacacgtggcccgcgctcgccgggaacagaggagacccggcatgcgcgggccaaacctggcggcagcgcaaaagatg

SEQ ID NO: 207857 - DNA, 103 bp, Artificial Sequence
  Synthetic Polynucleotide
taatacgactcactatagggttcatccatggagtgatcttggtcgctcataacagaggagaatgagcatgcaagatcacaacctggcggcagcgcaaaagatg

SEQ ID NO: 207858 - DNA, 103 bp, Artificial Sequence
  Synthetic Polynucleotide
taatacgactcactatagggacttcgagcctgtgaaaaggcaccaccaccaacagaggagaggtggtatggccttttcaaacctggcggcagcgcaaaagatg

SEQ ID NO: 207859 - DNA, 103 bp, Artificial Sequence
  Synthetic Polynucleotide
taatacgactcactataggggttcataattcccatgttgctggtggtagtaacagaggagaactaccatgagcaacatgaacctggcggcagcgcaaaagatg

SEQ ID NO: 207860 - DNA, 103 bp, Artificial Sequence
  Synthetic Polynucleotide
taatacgactcactatagggtggtagtaaagttcataattcccatgttgcaacagaggagagcaacaatggaattatgaaacctggcggcagcgcaaaagatg

SEQ ID NO: 207861 - DNA, 103 bp, Artificial Sequence
  Synthetic Polynucleotide
taatacgactcactataggggatgatccactggtagtaaagttcataattaacagaggagaaattatatgctttactacaacctggcggcagcgcaaaagatg

SEQ ID NO: 207862 - DNA, 103 bp, Artificial Sequence
  Synthetic Polynucleotide
taatacgactcactataggggttggtccctgatgatccactggtagtaaaaacagaggagatttactatgagtggatcaaacctggcggcagcgcaaaagatg

SEQ ID NO: 207863 - DNA, 103 bp, Artificial Sequence
  Synthetic Polynucleotide
taatacgactcactatagggggccttgagagttggtccctgatgatccacaacagaggagagtggatatgcagggaccaaacctggcggcagcgcaaaagatg

SEQ ID NO: 207864 - DNA, 103 bp, Artificial Sequence
  Synthetic Polynucleotide
taatacgactcactatagggtggggtgtctggccttgagagttggtccctaacagaggagaagggacatgctctcaaggaacctggcggcagcgcaaaagatg

SEQ ID NO: 207865 - DNA, 103 bp, Artificial Sequence
  Synthetic Polynucleotide
taatacgactcactatagggactgaccctctggggtgtctggccttgagaaacagaggagatctcaaatgcagacacccaacctggcggcagcgcaaaagatg

SEQ ID NO: 207866 - DNA, 103 bp, Artificial Sequence
  Synthetic Polynucleotide
taatacgactcactatagggcctgtagcccactgaccctctggggtgtctaacagaggagaagacacatgagagggtcaaacctggcggcagcgcaaaagatg

SEQ ID NO: 207867 - DNA, 103 bp, Artificial Sequence
  Synthetic Polynucleotide
taatacgactcactataggggcatcagacccctgtagcccactgaccctcaacagaggagagagggtatgtgggctacaaacctggcggcagcgcaaaagatg

SEQ ID NO: 207868 - DNA, 103 bp, Artificial Sequence
  Synthetic Polynucleotide
taatacgactcactataggggatgttcagagcatcagacccctgtagcccaacagaggagagggctaatggggtctgataacctggcggcagcgcaaaagatg

SEQ ID NO: 207869 - DNA, 103 bp, Artificial Sequence
  Synthetic Polynucleotide
taatacgactcactatagggctgtgctgctacttcgagcctgtgaaaaggaacagaggagaccttttatgaggctcgaaaacctggcggcagcgcaaaagatg

SEQ ID NO: 207870 - DNA, 103 bp, Artificial Sequence
  Synthetic Polynucleotide
taatacgactcactatagggggttttgctggatgttcagagcatcagaccaacagaggagaggtctgatgctctgaacaaacctggcggcagcgcaaaagatg

SEQ ID NO: 207871 - DNA, 103 bp, Artificial Sequence
  Synthetic Polynucleotide
taatacgactcactatagggccagatgtctggttttgctggatgttcagaaacagaggagatctgaaatgccagcaaaaaacctggcggcagcgcaaaagatg

SEQ ID NO: 207872 - DNA, 103 bp, Artificial Sequence
  Synthetic Polynucleotide
taatacgactcactatagggcaatgagcctccagatgtctggttttgctgaacagaggagacagcaaatgcagacatctaacctggcggcagcgcaaaagatg

SEQ ID NO: 207873 - DNA, 103 bp, Artificial Sequence
  Synthetic Polynucleotide
taatacgactcactatagggggcctgcttgcaatgagcctccagatgtctaacagaggagaagacatatggaggctcataacctggcggcagcgcaaaagatg

SEQ ID NO: 207874 - DNA, 103 bp, Artificial Sequence
  Synthetic Polynucleotide
taatacgactcactatagggtctttttgctggcctgcttgcaatgagcctaacagaggagaaggctcatggcaagcaggaacctggcggcagcgcaaaagatg

SEQ ID NO: 207875 - DNA, 103 bp, Artificial Sequence
  Synthetic Polynucleotide
taatacgactcactatagggttgctctccttctttttgctggcctgcttgaacagaggagacaagcaatgcagcaaaaaaacctggcggcagcgcaaaagatg

SEQ ID NO: 207876 - DNA, 103 bp, Artificial Sequence
  Synthetic Polynucleotide
taatacgactcactatagggtctgctggttttgctctccttctttttgctaacagaggagaagcaaaatgaaggagagcaacctggcggcagcgcaaaagatg

SEQ ID NO: 207877 - DNA, 103 bp, Artificial Sequence
  Synthetic Polynucleotide
taatacgactcactatagggtgctgctgtgtctgctggttttgctctcctaacagaggagaaggagaatgaaaccagcaaacctggcggcagcgcaaaagatg

SEQ ID NO: 207878 - DNA, 103 bp, Artificial Sequence
  Synthetic Polynucleotide
taatacgactcactatagggaagaatttgttgctgctgtgtctgctggttaacagaggagaaaccagatgacacagcagaacctggcggcagcgcaaaagatg

SEQ ID NO: 207879 - DNA, 103 bp, Artificial Sequence
  Synthetic Polynucleotide
taatacgactcactataggggaggctggataagaatttgttgctgctgtgaacagaggagacacagcatgaacaaattcaacctggcggcagcgcaaaagatg

SEQ ID NO: 207880 - DNA, 103 bp, Artificial Sequence
  Synthetic Polynucleotide
taatacgactcactatagggctgctactgcctgtgctgctacttcgagccaacagaggagaggctcgatgtagcagcacaacctggcggcagcgcaaaagatg

SEQ ID NO: 207881 - DNA, 103 bp, Artificial Sequence
  Synthetic Polynucleotide
taatacgactcactatagggtgaactagctgaggctggataagaatttgtaacagaggagaacaaatatgtatccagccaacctggcggcagcgcaaaagatg

SEQ ID NO: 207882 - DNA, 103 bp, Artificial Sequence
  Synthetic Polynucleotide
taatacgactcactatagggctgtcccccttgaactagctgaggctggataacagaggagaatccagatgcagctagttaacctggcggcagcgcaaaagatg

SEQ ID NO: 207883 - DNA, 103 bp, Artificial Sequence
  Synthetic Polynucleotide
taatacgactcactatagggcctggagggcctgtcccccttgaactagctaacagaggagaagctagatgaagggggacaacctggcggcagcgcaaaagatg

SEQ ID NO: 207884 - DNA, 103 bp, Artificial Sequence
  Synthetic Polynucleotide
taatacgactcactataggggcttggagggcctggagggcctgtccccctaacagaggagaagggggatgggccctccaaacctggcggcagcgcaaaagatg

SEQ ID NO: 207885 - DNA, 103 bp, Artificial Sequence
  Synthetic Polynucleotide
taatacgactcactatagggcaatggtgctgcttggagggcctggagggcaacagaggagagccctcatggccctccaaaacctggcggcagcgcaaaagatg

SEQ ID NO: 207886 - DNA, 103 bp, Artificial Sequence
  Synthetic Polynucleotide
taatacgactcactatagggtctgccctgacaatggtgctgcttggagggaacagaggagaccctccatgcagcaccataacctggcggcagcgcaaaagatg

SEQ ID NO: 207887 - DNA, 103 bp, Artificial Sequence
  Synthetic Polynucleotide
taatacgactcactataggggttgtaaaggtctgccctgacaatggtgctaacagaggagaagcaccatggtcagggcaaacctggcggcagcgcaaaagatg

SEQ ID NO: 207888 - DNA, 103 bp, Artificial Sequence
  Synthetic Polynucleotide
taatacgactcactataggggatggcttgagttgtaaaggtctgccctgaaacagaggagatcagggatgacctttacaaacctggcggcagcgcaaaagatg

SEQ ID NO: 207889 - DNA, 103 bp, Artificial Sequence
  Synthetic Polynucleotide
taatacgactcactatagggtttcctgggagatggcttgagttgtaaaggaacagaggagacctttaatgctcaagccaaacctggcggcagcgcaaaagatg

SEQ ID NO: 207890 - DNA, 103 bp, Artificial Sequence
  Synthetic Polynucleotide
taatacgactcactatagggttctggagggtttcctgggagatggcttgaaacagaggagatcaagcatgctcccaggaaacctggcggcagcgcaaaagatg

SEQ ID NO: 207891 - DNA, 103 bp, Artificial Sequence
  Synthetic Polynucleotide
taatacgactcactatagggtccagtgctgctgctactgcctgtgctgctaacagaggagaagcagcatgggcagtagcaacctggcggcagcgcaaaagatg

SEQ ID NO: 207892 - DNA, 103 bp, Artificial Sequence
  Synthetic Polynucleotide
taatacgactcactatagggaagctggaggttctggagggtttcctgggaaacagaggagatcccagatgaccctccagaacctggcggcagcgcaaaagatg

SEQ ID NO: 207893 - DNA, 103 bp, Artificial Sequence
  Synthetic Polynucleotide
taatacgactcactataggggaacagcctgaagctggaggttctggagggaacagaggagaccctccatgacctccagcaacctggcggcagcgcaaaagatg

SEQ ID NO: 207894 - DNA, 103 bp, Artificial Sequence
  Synthetic Polynucleotide
taatacgactcactatagggccagagtttggaacagcctgaagctggaggaacagaggagacctccaatgtcaggctgtaacctggcggcagcgcaaaagatg

SEQ ID NO: 207895 - DNA, 103 bp, Artificial Sequence
  Synthetic Polynucleotide
taatacgactcactataggggatgatgggaccagagtttggaacagcctgaacagaggagacaggctatgccaaactctaacctggcggcagcgcaaaagatg

SEQ ID NO: 207896 - DNA, 103 bp, Artificial Sequence
  Synthetic Polynucleotide
taatacgactcactataggggtgtccggatgatgatgggaccagagtttgaacagaggagacaaactatggtcccatcaaacctggcggcagcgcaaaagatg

SEQ ID NO: 207897 - DNA, 103 bp, Artificial Sequence
  Synthetic Polynucleotide
taatacgactcactatagggcccactgttggtgtccggatgatgatgggaaacagaggagatcccatatgcatccggacaacctggcggcagcgcaaaagatg

SEQ ID NO: 207898 - DNA, 103 bp, Artificial Sequence
  Synthetic Polynucleotide
taatacgactcactatagggtccattgggccccactgttggtgtccggataacagaggagaatccggatgccaacagtgaacctggcggcagcgcaaaagatg

SEQ ID NO: 207899 - DNA, 103 bp, Artificial Sequence
  Synthetic Polynucleotide
taatacgactcactatagggaactgacctgtccattgggccccactgttgaacagaggagacaacagatgggcccaatgaacctggcggcagcgcaaaagatg

SEQ ID NO: 207900 - DNA, 103 bp, Artificial Sequence
  Synthetic Polynucleotide
taatacgactcactatagggagagtctgccaactgacctgtccattgggcaacagaggagagcccaaatgacaggtcagaacctggcggcagcgcaaaagatg

SEQ ID NO: 207901 - DNA, 103 bp, Artificial Sequence
  Synthetic Polynucleotide
taatacgactcactatagggctgcagctgtagagtctgccaactgacctgaacagaggagacaggtcatgtggcagactaacctggcggcagcgcaaaagatg

SEQ ID NO: 207902 - DNA, 103 bp, Artificial Sequence
  Synthetic Polynucleotide
taatacgactcactataggggccctcctcctccagtgctgctgctactgcaacagaggagagcagtaatggcagcactgaacctggcggcagcgcaaaagatg

SEQ ID NO: 207903 - DNA, 103 bp, Artificial Sequence
  Synthetic Polynucleotide
taatacgactcactatagggcttggaggttctgcagctgtagagtctgccaacagaggagaggcagaatgtacagctgcaacctggcggcagcgcaaaagatg

SEQ ID NO: 207904 - DNA, 103 bp, Artificial Sequence
  Synthetic Polynucleotide
taatacgactcactataggggggttctgaacttggaggttctgcagctgtaacagaggagaacagctatggaacctccaaacctggcggcagcgcaaaagatg

SEQ ID NO: 207905 - DNA, 103 bp, Artificial Sequence
  Synthetic Polynucleotide
taatacgactcactatagggttgggcttgtgggttctgaacttggaggttaacagaggagaaacctcatggttcagaacaacctggcggcagcgcaaaagatg

SEQ ID NO: 207906 - DNA, 103 bp, Artificial Sequence
  Synthetic Polynucleotide
taatacgactcactatagggaggtgattgtttgggcttgtgggttctgaaaacagaggagattcagaatgcacaagcccaacctggcggcagcgcaaaagatg

SEQ ID NO: 207907 - DNA, 103 bp, Artificial Sequence
  Synthetic Polynucleotide
taatacgactcactatagggattggggctaaggtgattgtttgggcttgtaacagaggagaacaagcatgaacaatcacaacctggcggcagcgcaaaagatg

SEQ ID NO: 207908 - DNA, 103 bp, Artificial Sequence
  Synthetic Polynucleotide
taatacgactcactatagggaacaccctgcattggggctaaggtgattgtaacagaggagaacaatcatgttagccccaaacctggcggcagcgcaaaagatg

SEQ ID NO: 207909 - DNA, 103 bp, Artificial Sequence
  Synthetic Polynucleotide
taatacgactcactataggggccccaaggaaacaccctgcattggggctaaacagaggagatagcccatgtgcagggtgaacctggcggcagcgcaaaagatg

SEQ ID NO: 207910 - DNA, 103 bp, Artificial Sequence
  Synthetic Polynucleotide
taatacgactcactatagggctgctggtctgccccaaggaaacaccctgcaacagaggagagcagggatgttccttgggaacctggcggcagcgcaaaagatg

SEQ ID NO: 207911 - DNA, 103 bp, Artificial Sequence
  Synthetic Polynucleotide
taatacgactcactatagggggtgttgctgctgctggtctgccccaaggaaacagaggagatccttgatgcagaccagcaacctggcggcagcgcaaaagatg

SEQ ID NO: 207912 - DNA, 103 bp, Artificial Sequence
  Synthetic Polynucleotide
taatacgactcactataggggtgtgagagtggtgttgctgctgctggtctaacagaggagaagaccaatggcagcaacaaacctggcggcagcgcaaaagatg

SEQ ID NO: 207913 - DNA, 103 bp, Artificial Sequence
  Synthetic Polynucleotide
taatacgactcactatagggtgggactcctgccctcctcctccagtgctgaacagaggagacagcacatgaggaggaggaacctggcggcagcgcaaaagatg

SEQ ID NO: 207914 - DNA, 103 bp, Artificial Sequence
  Synthetic Polynucleotide
taatacgactcactataggggaggcaatgggtgtgagagtggtgttgctgaacagaggagacagcaaatgcactctcacaacctggcggcagcgcaaaagatg

SEQ ID NO: 207915 - DNA, 103 bp, Artificial Sequence
  Synthetic Polynucleotide
taatacgactcactatagggggaagcagctgaggcaatgggtgtgagagtaacagaggagaactctcatgcccattgccaacctggcggcagcgcaaaagatg

SEQ ID NO: 207916 - DNA, 103 bp, Artificial Sequence
  Synthetic Polynucleotide
taatacgactcactatagggcagcaggaatggaagcagctgaggcaatggaacagaggagaccattgatgcagctgcttaacctggcggcagcgcaaaagatg

SEQ ID NO: 207917 - DNA, 103 bp, Artificial Sequence
  Synthetic Polynucleotide
taatacgactcactataggggtgactgtgccagcaggaatggaagcagctaacagaggagaagctgcatgcattcctgcaacctggcggcagcgcaaaagatg

SEQ ID NO: 207918 - DNA, 103 bp, Artificial Sequence
  Synthetic Polynucleotide
taatacgactcactatagggagcattcacagtgactgtgccagcaggaataacagaggagaattcctatgggcacagtcaacctggcggcagcgcaaaagatg

SEQ ID NO: 207919 - DNA, 103 bp, Artificial Sequence
  Synthetic Polynucleotide
taatacgactcactatagggagagttgagcagcattcacagtgactgtgcaacagaggagagcacagatgctgtgaatgaacctggcggcagcgcaaaagatg

SEQ ID NO: 207920 - DNA, 103 bp, Artificial Sequence
  Synthetic Polynucleotide
taatacgactcactatagggggcatggaggagagttgagcagcattcacaaacagaggagatgtgaaatgtgctcaactaacctggcggcagcgcaaaagatg

SEQ ID NO: 207921 - DNA, 103 bp, Artificial Sequence
  Synthetic Polynucleotide
taatacgactcactatagggctggaggcctggcatggaggagagttgagcaacagaggagagctcaaatgtcctccatgaacctggcggcagcgcaaaagatg

SEQ ID NO: 207922 - DNA, 103 bp, Artificial Sequence
  Synthetic Polynucleotide
taatacgactcactatagggggttaatggtctggaggcctggcatggaggaacagaggagacctccaatgcaggcctccaacctggcggcagcgcaaaagatg

SEQ ID NO: 207923 - DNA, 103 bp, Artificial Sequence
  Synthetic Polynucleotide
taatacgactcactatagggaatgcactgaggttaatggtctggaggcctaacagaggagaaggcctatggaccattaaaacctggcggcagcgcaaaagatg

SEQ ID NO: 207924 - DNA, 103 bp, Artificial Sequence
  Synthetic Polynucleotide
taatacgactcactatagggaggggatggctgggactcctgccctcctccaacagaggagaggaggaatgcaggagtccaacctggcggcagcgcaaaagatg

SEQ ID NO: 207925 - DNA, 103 bp, Artificial Sequence
  Synthetic Polynucleotide
taatacgactcactatagggtgaagtacccaatgcactgaggttaatggtaacagaggagaaccattatgctcagtgcaaacctggcggcagcgcaaaagatg

SEQ ID NO: 207926 - DNA, 103 bp, Artificial Sequence
  Synthetic Polynucleotide
taatacgactcactatagggcctggattcctgaagtacccaatgcactgaaacagaggagatcagtgatgtgggtacttaacctggcggcagcgcaaaagatg

SEQ ID NO: 207927 - DNA, 103 bp, Artificial Sequence
  Synthetic Polynucleotide
taatacgactcactatagggattgggtgcacctggattcctgaagtacccaacagaggagagggtacatgaggaatccaaacctggcggcagcgcaaaagatg

SEQ ID NO: 207928 - DNA, 103 bp, Artificial Sequence
  Synthetic Polynucleotide
taatacgactcactatagggcaggccttgaattgggtgcacctggattccaacagaggagaggaatcatggtgcacccaaacctggcggcagcgcaaaagatg

SEQ ID NO: 207929 - DNA, 103 bp, Artificial Sequence
  Synthetic Polynucleotide
taatacgactcactatagggtagccaacggcaggccttgaattgggtgcaaacagaggagatgcaccatgttcaaggccaacctggcggcagcgcaaaagatg

SEQ ID NO: 207930 - DNA, 103 bp, Artificial Sequence
  Synthetic Polynucleotide
taatacgactcactataggggcatttgctatagccaacggcaggccttgaaacagaggagatcaaggatggccgttggcaacctggcggcagcgcaaaagatg

SEQ ID NO: 207931 - DNA, 103 bp, Artificial Sequence
  Synthetic Polynucleotide
taatacgactcactatagggatcacctggggcatttgctatagccaacggaacagaggagaccgttgatgatagcaaataacctggcggcagcgcaaaagatg

SEQ ID NO: 207932 - DNA, 103 bp, Artificial Sequence
  Synthetic Polynucleotide
taatacgactcactataggggagctccatgatcacctggggcatttgctaaacagaggagatagcaaatgccccaggtgaacctggcggcagcgcaaaagatg

SEQ ID NO: 207933 - DNA, 103 bp, Artificial Sequence
  Synthetic Polynucleotide
taatacgactcactatagggagaccaagctgagctccatgatcacctgggaacagaggagacccaggatgtcatggagcaacctggcggcagcgcaaaagatg

SEQ ID NO: 207934 - DNA, 103 bp, Artificial Sequence
  Synthetic Polynucleotide
taatacgactcactatagggagccccatggagaccaagctgagctccatgaacagaggagacatggaatgcagcttggtaacctggcggcagcgcaaaagatg

SEQ ID NO: 207935 - DNA, 103 bp, Artificial Sequence
  Synthetic Polynucleotide
taatacgactcactataggggcagagccaaaggggatggctgggactcctaacagaggagaaggagtatgagccatcccaacctggcggcagcgcaaaagatg

SEQ ID NO: 207936 - DNA, 103 bp, Artificial Sequence
  Synthetic Polynucleotide
taatacgactcactatagggcatcaccaccagccccatggagaccaagctaacagaggagaagcttgatgtccatggggaacctggcggcagcgcaaaagatg

SEQ ID NO: 207937 - DNA, 103 bp, Artificial Sequence
  Synthetic Polynucleotide
taatacgactcactatagggtcatgtattccatcaccaccagccccatggaacagaggagaccatggatgtggtggtgaaacctggcggcagcgcaaaagatg

SEQ ID NO: 207938 - DNA, 103 bp, Artificial Sequence
  Synthetic Polynucleotide
taatacgactcactatagggtgctgtgtcatcatgtattccatcaccaccaacagaggagaggtggtatgggaatacataacctggcggcagcgcaaaagatg

SEQ ID NO: 207939 - DNA, 103 bp, Artificial Sequence
  Synthetic Polynucleotide
taatacgactcactatagggcctctccacctgctgtgtcatcatgtattcaacagaggagagaatacatgatgacacagaacctggcggcagcgcaaaagatg

SEQ ID NO: 207940 - DNA, 103 bp, Artificial Sequence
  Synthetic Polynucleotide
taatacgactcactatagggttttctccttcctctccacctgctgtgtcaaacagaggagatgacacatgaggtggagaaacctggcggcagcgcaaaagatg

SEQ ID NO: 207941 - DNA, 103 bp, Artificial Sequence
  Synthetic Polynucleotide
taatacgactcactatagggatctgggctgttttctccttcctctccaccaacagaggagaggtggaatggaaggagaaaacctggcggcagcgcaaaagatg

SEQ ID NO: 207942 - DNA, 103 bp, Artificial Sequence
  Synthetic Polynucleotide
taatacgactcactatagggggggttgggcatctgggctgttttctccttaacagaggagaaaggagatgacagcccagaacctggcggcagcgcaaaagatg

SEQ ID NO: 207943 - DNA, 103 bp, Artificial Sequence
  Synthetic Polynucleotide
taatacgactcactatagggcgaccggcttggggttgggcatctgggctgaacagaggagacagcccatgtgcccaaccaacctggcggcagcgcaaaagatg

SEQ ID NO: 207944 - DNA, 103 bp, Artificial Sequence
  Synthetic Polynucleotide
taatacgactcactatagggccgggtcctccgaccggcttggggttgggcaacagaggagagcccaaatgcaagccggtaacctggcggcagcgcaaaagatg

SEQ ID NO: 207945 - DNA, 103 bp, Artificial Sequence
  Synthetic Polynucleotide
taatacgactcactatagggatgcttcccgccgggtcctccgaccggcttaacagaggagaaagccgatgggaggacccaacctggcggcagcgcaaaagatg

SEQ ID NO: 207946 - DNA, 103 bp, Artificial Sequence
  Synthetic Polynucleotide
taatacgactcactataggggttgctgccagcagagccaaaggggatggcaacagaggagagccatcatgtttggctctaacctggcggcagcgcaaaagatg

SEQ ID NO: 207947 - DNA, 103 bp, Artificial Sequence
  Synthetic Polynucleotide
taatacgactcactataggggggcaggtgcatgcttcccgccgggtcctcaacagaggagagaggacatggcgggaagcaacctggcggcagcgcaaaagatg

SEQ ID NO: 207948 - DNA, 103 bp, Artificial Sequence
  Synthetic Polynucleotide
taatacgactcactatagggtttacagtaggggcaggtgcatgcttcccgaacagaggagacgggaaatgtgcacctgcaacctggcggcagcgcaaaagatg

SEQ ID NO: 207949 - DNA, 103 bp, Artificial Sequence
  Synthetic Polynucleotide
taatacgactcactatagggcttcactgtctttacagtaggggcaggtgcaacagaggagagcacctatgcctactgtaaacctggcggcagcgcaaaagatg

SEQ ID NO: 207950 - DNA, 103 bp, Artificial Sequence
  Synthetic Polynucleotide
taatacgactcactataggggagccccttccttcactgtctttacagtagaacagaggagactactgatgagacagtgaaacctggcggcagcgcaaaagatg

SEQ ID NO: 207951 - DNA, 103 bp, Artificial Sequence
  Synthetic Polynucleotide
taatacgactcactatagggaggatcccccgagccccttccttcactgtcaacagaggagagacagtatgggaaggggcaacctggcggcagcgcaaaagatg

SEQ ID NO: 207952 - DNA, 103 bp, Artificial Sequence
  Synthetic Polynucleotide
taatacgactcactatagggtctttttgccaggatcccccgagccccttcaacagaggagagaagggatgcgggggatcaacctggcggcagcgcaaaagatg

SEQ ID NO: 207953 - DNA, 103 bp, Artificial Sequence
  Synthetic Polynucleotide
taatacgactcactatagggatatgctgtttctttttgccaggatcccccaacagaggagagggggaatgtggcaaaaaaacctggcggcagcgcaaaagatg

SEQ ID NO: 207954 - DNA, 103 bp, Artificial Sequence
  Synthetic Polynucleotide
taatacgactcactataggggatgtggcaaatatgctgtttctttttgccaacagaggagaggcaaaatgaaacagcataacctggcggcagcgcaaaagatg

SEQ ID NO: 207955 - DNA, 103 bp, Artificial Sequence
  Synthetic Polynucleotide
taatacgactcactatagggcacagccttggatgtggcaaatatgctgttaacagaggagaaacagcatgtttgccacaaacctggcggcagcgcaaaagatg

SEQ ID NO: 207956 - DNA, 103 bp, Artificial Sequence
  Synthetic Polynucleotide
taatacgactcactatagggtacactttcccacagccttggatgtggcaaaacagaggagattgccaatgccaaggctgaacctggcggcagcgcaaaagatg

SEQ ID NO: 207957 - DNA, 103 bp, Artificial Sequence
  Synthetic Polynucleotide
taatacgactcactatagggtctgctgcaagttgctgccagcagagccaaaacagaggagattggctatgctggcagcaaacctggcggcagcgcaaaagatg

SEQ ID NO: 207958 - DNA, 103 bp, Artificial Sequence
  Synthetic Polynucleotide
taatacgactcactatagggggtcttgccatacactttcccacagccttgaacagaggagacaaggcatggggaaagtgaacctggcggcagcgcaaaagatg

SEQ ID NO: 207959 - DNA, 103 bp, Artificial Sequence
  Synthetic Polynucleotide
taatacgactcactataggggcaggtgagaggtcttgccatacactttccaacagaggagaggaaagatgatggcaagaaacctggcggcagcgcaaaagatg

SEQ ID NO: 207960 - DNA, 103 bp, Artificial Sequence
  Synthetic Polynucleotide
taatacgactcactatagggaagtgtgcccgcaggtgagaggtcttgccaaacagaggagatggcaaatgctctcacctaacctggcggcagcgcaaaagatg

SEQ ID NO: 207961 - DNA, 103 bp, Artificial Sequence
  Synthetic Polynucleotide
taatacgactcactatagggatgccagcgcaagtgtgcccgcaggtgagaaacagaggagatctcacatgcgggcacacaacctggcggcagcgcaaaagatg

SEQ ID NO: 207962 - DNA, 103 bp, Artificial Sequence
  Synthetic Polynucleotide
taatacgactcactatagggtctcgcctgtatgccagcgcaagtgtgcccaacagaggagagggcacatgtgcgctggcaacctggcggcagcgcaaaagatg

SEQ ID NO: 207963 - DNA, 103 bp, Artificial Sequence
  Synthetic Polynucleotide
taatacgactcactatagggataaatggcctctcgcctgtatgccagcgcaacagaggagagcgctgatgtacaggcgaaacctggcggcagcgcaaaagatg

SEQ ID NO: 207964 - DNA, 103 bp, Artificial Sequence
  Synthetic Polynucleotide
taatacgactcactatagggccaggtacacataaatggcctctcgcctgtaacagaggagaacaggcatgaggccatttaacctggcggcagcgcaaaagatg

SEQ ID NO: 207965 - DNA, 103 bp, Artificial Sequence
  Synthetic Polynucleotide
taatacgactcactatagggcacagtatgaccaggtacacataaatggccaacagaggagaggccatatgtgtgtacctaacctggcggcagcgcaaaagatg

SEQ ID NO: 207966 - DNA, 103 bp, Artificial Sequence
  Synthetic Polynucleotide
taatacgactcactatagggaagcgtttcccacagtatgaccaggtacacaacagaggagagtgtacatggtcatactgaacctggcggcagcgcaaaagatg

SEQ ID NO: 207967 - DNA, 103 bp, Artificial Sequence
  Synthetic Polynucleotide
taatacgactcactatagggcgaacgtgtgaagcgtttcccacagtatgaaacagaggagatcatacatggggaaacgcaacctggcggcagcgcaaaagatg

SEQ ID NO: 207968 - DNA, 103 bp, Artificial Sequence
  Synthetic Polynucleotide
taatacgactcactatagggcagctgtcatttcatccatggagtgatcttaacagaggagaaagatcatgccatggatgaacctggcggcagcgcaaaagatg

SEQ ID NO: 207969 - DNA, 103 bp, Artificial Sequence
  Synthetic Polynucleotide
taatacgactcactataggggtgactcaattctgctgcaagttgctgccaaacagaggagatggcagatgcttgcagcaaacctggcggcagcgcaaaagatg

SEQ ID NO: 207970 - DNA, 103 bp, Artificial Sequence
  Synthetic Polynucleotide
taatacgactcactataggggtagctcatccgaacgtgtgaagcgtttccaacagaggagaggaaacatgtcacacgttaacctggcggcagcgcaaaagatg

SEQ ID NO: 207971 - DNA, 103 bp, Artificial Sequence
  Synthetic Polynucleotide
taatacgactcactatagggttgtgcctctgtagctcatccgaacgtgtgaacagaggagacacacgatgggatgagctaacctggcggcagcgcaaaagatg

SEQ ID NO: 207972 - DNA, 103 bp, Artificial Sequence
  Synthetic Polynucleotide
taatacgactcactataggggtgtgtacgtttgtgcctctgtagctcatcaacagaggagagatgagatgcagaggcacaacctggcggcagcgcaaaagatg

SEQ ID NO: 207973 - DNA, 103 bp, Artificial Sequence
  Synthetic Polynucleotide
taatacgactcactatagggtctcacctgtgtgtgtacgtttgtgcctctaacagaggagaagaggcatgaacgtacacaacctggcggcagcgcaaaagatg

SEQ ID NO: 207974 - DNA, 103 bp, Artificial Sequence
  Synthetic Polynucleotide
taatacgactcactataggggcaaatttcttctcacctgtgtgtgtacgtaacagaggagaacgtacatgcacaggtgaaacctggcggcagcgcaaaagatg

SEQ ID NO: 207975 - DNA, 103 bp, Artificial Sequence
  Synthetic Polynucleotide
taatacgactcactatagggctcagggcaggcaaatttcttctcacctgtaacagaggagaacaggtatgaagaaatttaacctggcggcagcgcaaaagatg

SEQ ID NO: 207976 - DNA, 103 bp, Artificial Sequence
  Synthetic Polynucleotide
taatacgactcactataggggcttaggacactcagggcaggcaaatttctaacagaggagaagaaatatgcctgccctgaacctggcggcagcgcaaaagatg

SEQ ID NO: 207977 - DNA, 103 bp, Artificial Sequence
  Synthetic Polynucleotide
taatacgactcactatagggctcatgaagcgcttaggacactcagggcagaacagaggagactgcccatggtgtcctaaaacctggcggcagcgcaaaagatg

SEQ ID NO: 207978 - DNA, 103 bp, Artificial Sequence
  Synthetic Polynucleotide
taatacgactcactataggggtggtcactcctcatgaagcgcttaggacaaacagaggagatgtcctatgcgcttcatgaacctggcggcagcgcaaaagatg

SEQ ID NO: 207979 - DNA, 103 bp, Artificial Sequence
  Synthetic Polynucleotide
taatacgactcactataggggttttgacaggtggtcactcctcatgaagcaacagaggagagcttcaatgggagtgaccaacctggcggcagcgcaaaagatg

SEQ ID NO: 207980 - DNA, 103 bp, Artificial Sequence
  Synthetic Polynucleotide
taatacgactcactatagggttctcattgggtgactcaattctgctgcaaaacagaggagattgcagatgaattgagtcaacctggcggcagcgcaaaagatg

SEQ ID NO: 207981 - DNA, 103 bp, Artificial Sequence
  Synthetic Polynucleotide
taatacgactcactataggggtcttgatatgttttgacaggtggtcactcaacagaggagagagtgaatgcctgtcaaaaacctggcggcagcgcaaaagatg

SEQ ID NO: 207982 - DNA, 103 bp, Artificial Sequence
  Synthetic Polynucleotide
taatacgactcactatagggattctggtgggtcttgatatgttttgacagaacagaggagactgtcaatgcatatcaagaacctggcggcagcgcaaaagatg

SEQ ID NO: 207983 - DNA, 103 bp, Artificial Sequence
  Synthetic Polynucleotide
taatacgactcactatagggctcccttcttattctggtgggtcttgatataacagaggagaatatcaatgcccaccagaaacctggcggcagcgcaaaagatg

SEQ ID NO: 207984 - DNA, 103 bp, Artificial Sequence
  Synthetic Polynucleotide
taatacgactcactatagggacacctgggcctcccttcttattctggtggaacagaggagaccaccaatgtaagaagggaacctggcggcagcgcaaaagatg

SEQ ID NO: 207985 - DNA, 103 bp, Artificial Sequence
  Synthetic Polynucleotide
taatacgactcactatagggactcagagctacacctgggcctcccttcttaacagaggagaaagaagatgggcccaggtaacctggcggcagcgcaaaagatg

SEQ ID NO: 207986 - DNA, 103 bp, Artificial Sequence
  Synthetic Polynucleotide
taatacgactcactatagggaagtgcccacactcagagctacacctgggcaacagaggagagcccagatgtagctctgaaacctggcggcagcgcaaaagatg

SEQ ID NO: 207987 - DNA, 103 bp, Artificial Sequence
  Synthetic Polynucleotide
taatacgactcactatagggtccaggggcaaagtgcccacactcagagctaacagaggagaagctctatgtgtgggcacaacctggcggcagcgcaaaagatg

SEQ ID NO: 207988 - DNA, 103 bp, Artificial Sequence
  Synthetic Polynucleotide
taatacgactcactatagggtgccccactgtccaggggcaaagtgcccacaacagaggagagtgggcatgttgcccctgaacctggcggcagcgcaaaagatg

SEQ ID NO: 207989 - DNA, 103 bp, Artificial Sequence
  Synthetic Polynucleotide
taatacgactcactatagggcttctgaacctgccccactgtccaggggcaaacagaggagatgccccatgacagtggggaacctggcggcagcgcaaaagatg

SEQ ID NO: 207990 - DNA, 103 bp, Artificial Sequence
  Synthetic Polynucleotide
taatacgactcactataggggtgccactgccttctgaacctgccccactgaacagaggagacagtggatgaggttcagaaacctggcggcagcgcaaaagatg

SEQ ID NO: 207991 - DNA, 103 bp, Artificial Sequence
  Synthetic Polynucleotide
taatacgactcactataggggttgttgctgttctcattgggtgactcaataacagaggagaattgagatgcccaatgagaacctggcggcagcgcaaaagatg

SEQ ID NO: 207992 - DNA, 103 bp, Artificial Sequence
  Synthetic Polynucleotide
taatacgactcactatagggaggagtggcagtgccactgccttctgaaccaacagaggagaggttcaatgggcagtggcaacctggcggcagcgcaaaagatg

SEQ ID NO: 207993 - DNA, 103 bp, Artificial Sequence
  Synthetic Polynucleotide
taatacgactcactatagggtaagggctgaaggagtggcagtgccactgcaacagaggagagcagtgatgctgccactcaacctggcggcagcgcaaaagatg

SEQ ID NO: 207994 - DNA, 103 bp, Artificial Sequence
  Synthetic Polynucleotide
taatacgactcactatagggttggtggtaataagggctgaaggagtggcaaacagaggagatgccacatgttcagccctaacctggcggcagcgcaaaagatg

SEQ ID NO: 207995 - DNA, 103 bp, Artificial Sequence
  Synthetic Polynucleotide
taatacgactcactatagggggctaccatattggtggtaataagggctgaaacagaggagatcagccatgattaccaccaacctggcggcagcgcaaaagatg

SEQ ID NO: 207996 - DNA, 103 bp, Artificial Sequence
  Synthetic Polynucleotide
taatacgactcactatagggtggcctccatggctaccatattggtggtaaaacagaggagattaccaatgatatggtagaacctggcggcagcgcaaaagatg

SEQ ID NO: 207997 - DNA, 103 bp, Artificial Sequence
  Synthetic Polynucleotide
taatacgactcactatagggtctggacagatggcctccatggctaccataaacagaggagatatggtatgcatggaggcaacctggcggcagcgcaaaagatg

SEQ ID NO: 207998 - DNA, 103 bp, Artificial Sequence
  Synthetic Polynucleotide
taatacgactcactatagggggcaatgccctctggacagatggcctccataacagaggagaatggagatgatctgtccaaacctggcggcagcgcaaaagatg

SEQ ID NO: 207999 - DNA, 103 bp, Artificial Sequence
  Synthetic Polynucleotide
taatacgactcactatagggtggcaagacgggcaatgccctctggacagaaacagaggagatctgtcatgagggcattgaacctggcggcagcgcaaaagatg

SEQ ID NO: 208000 - DNA, 103 bp, Artificial Sequence
  Synthetic Polynucleotide
taatacgactcactatagggatgccactgttggcaagacgggcaatgcccaacagaggagagggcatatgccgtcttgcaacctggcggcagcgcaaaagatg

SEQ ID NO: 208001 - DNA, 103 bp, Artificial Sequence
  Synthetic Polynucleotide
taatacgactcactatagggcatgacgttgatgccactgttggcaagacgaacagaggagacgtcttatgaacagtggcaacctggcggcagcgcaaaagatg

SEQ ID NO: 208002 - DNA, 103 bp, Artificial Sequence
  Synthetic Polynucleotide
taatacgactcactatagggggccctgggagttgttgctgttctcattggaacagaggagaccaatgatgacagcaacaaacctggcggcagcgcaaaagatg

SEQ ID NO: 208003 - DNA, 103 bp, Artificial Sequence
  Synthetic Polynucleotide
taatacgactcactatagggctgccacctgcatgacgttgatgccactgtaacagaggagaacagtgatgtcaacgtcaaacctggcggcagcgcaaaagatg

SEQ ID NO: 208004 - DNA, 103 bp, Artificial Sequence
  Synthetic Polynucleotide
taatacgactcactataggggactgcagatctgccacctgcatgacgttgaacagaggagacaacgtatggcaggtggcaacctggcggcagcgcaaaagatg

SEQ ID NO: 208005 - DNA, 103 bp, Artificial Sequence
  Synthetic Polynucleotide
taatacgactcactataggggatattaatggactgcagatctgccacctgaacagaggagacaggtgatggatctgcagaacctggcggcagcgcaaaagatg

SEQ ID NO: 208006 - DNA, 103 bp, Artificial Sequence
  Synthetic Polynucleotide
taatacgactcactatagggcattgccactgatattaatggactgcagataacagaggagaatctgcatgccattaataaacctggcggcagcgcaaaagatg

SEQ ID NO: 208007 - DNA, 103 bp, Artificial Sequence
  Synthetic Polynucleotide
taatacgactcactataggggactgactcgggccctgggagttgttgctgaacagaggagacagcaaatgctcccagggaacctggcggcagcgcaaaagatg

SEQ ID NO: 208008 - DNA, 103 bp, Artificial Sequence
  Synthetic Polynucleotide
taatacgactcactatagggtgttccccctgactgactcgggccctgggaaacagaggagatcccagatgccgagtcagaacctggcggcagcgcaaaagatg

SEQ ID NO: 208009 - DNA, 103 bp, Artificial Sequence
  Synthetic Polynucleotide
taatacgactcactatagggcaagctcacctgttccccctgactgactcgaacagaggagacgagtcatgcagggggaaaacctggcggcagcgcaaaagatg

SEQ ID NO: 208010 - DNA, 103 bp, Artificial Sequence
  Synthetic Polynucleotide
taatacgactcactataggggctgtgaggtcaagctcacctgttccccctaacagaggagaagggggatgaggtgagctaacctggcggcagcgcaaaagatg

SEQ ID NO: 208011 - DNA, 103 bp, Artificial Sequence
  Synthetic Polynucleotide
taatacgactcactatagggaagttgtgtggctgtgaggtcaagctcaccaacagaggagaggtgagatggacctcacaaacctggcggcagcgcaaaagatg

SEQ ID NO: 208012 - DNA, 103 bp, Artificial Sequence
  Synthetic Polynucleotide
taatacgactcactatagggcaccctgtgaaagttgtgtggctgtgaggtaacagaggagaacctcaatgccacacaacaacctggcggcagcgcaaaagatg

SEQ ID NO: 208013 - DNA, 103 bp, Artificial Sequence
  Synthetic Polynucleotide
taatacgactcactatagggattttcaccacagctgtcatttcatccatgaacagaggagacatggaatgaatgacagcaacctggcggcagcgcaaaagatg

SEQ ID NO: 208014 - DNA, 103 bp, Artificial Sequence
  Synthetic Polynucleotide
taatacgactcactatagggcagccattggcaccctgtgaaagttgtgtgaacagaggagacacacaatgttcacagggaacctggcggcagcgcaaaagatg

SEQ ID NO: 208015 - DNA, 103 bp, Artificial Sequence
  Synthetic Polynucleotide
taatacgactcactataggggatgatctgccagccattggcaccctgtgaaacagaggagatcacagatggccaatggcaacctggcggcagcgcaaaagatg

SEQ ID NO: 208016 - DNA, 103 bp, Artificial Sequence
  Synthetic Polynucleotide
taatacgactcactatagggaggaggaagagatgatctgccagccattggaacagaggagaccaatgatgggcagatcaaacctggcggcagcgcaaaagatg

SEQ ID NO: 208017 - DNA, 103 bp, Artificial Sequence
  Synthetic Polynucleotide
taatacgactcactataggggtagccccagaggaggaagagatgatctgcaacagaggagagcagatatgctcttcctcaacctggcggcagcgcaaaagatg

SEQ ID NO: 208018 - DNA, 103 bp, Artificial Sequence
  Synthetic Polynucleotide
taatacgactcactatagggtgaggtaggggtagccccagaggaggaagaaacagaggagatcttccatgtctggggctaacctggcggcagcgcaaaagatg

SEQ ID NO: 208019 - DNA, 103 bp, Artificial Sequence
  Synthetic Polynucleotide
taatacgactcactatagggtctgttcctttgaggtaggggtagccccagaacagaggagactggggatgcccctacctaacctggcggcagcgcaaaagatg

SEQ ID NO: 208020 - DNA, 103 bp, Artificial Sequence
  Synthetic Polynucleotide
taatacgactcactatagggctgctgccactctgttcctttgaggtagggaacagaggagaccctacatgaaaggaacaaacctggcggcagcgcaaaagatg

SEQ ID NO: 208021 - DNA, 103 bp, Artificial Sequence
  Synthetic Polynucleotide
taatacgactcactataggggccattggtactgctgccactctgttccttaacagaggagaaaggaaatgagtggcagcaacctggcggcagcgcaaaagatg

SEQ ID NO: 208022 - DNA, 103 bp, Artificial Sequence
  Synthetic Polynucleotide
taatacgactcactatagggtgccattgctgccattggtactgctgccacaacagaggagagtggcaatggtaccaatgaacctggcggcagcgcaaaagatg

SEQ ID NO: 208023 - DNA, 103 bp, Artificial Sequence
  Synthetic Polynucleotide
taatacgactcactataggggaagactcactgccattgctgccattggtaaacagaggagataccaaatgcagcaatggaacctggcggcagcgcaaaagatg

SEQ ID NO: 208024 - DNA, 103 bp, Artificial Sequence
  Synthetic Polynucleotide
taatacgactcactatagggtcctttttcaattttcaccacagctgtcataacagaggagaatgacaatggtggtgaaaaacctggcggcagcgcaaaagatg

SEQ ID NO: 208025 - DNA, 103 bp, Artificial Sequence
  Synthetic Polynucleotide
taatacgactcactataggggcgattcttggaagactcactgccattgctaacagaggagaagcaatatgagtgagtctaacctggcggcagcgcaaaagatg

SEQ ID NO: 208026 - DNA, 103 bp, Artificial Sequence
  Synthetic Polynucleotide
taatacgactcactatagggcagagactgtgcgattcttggaagactcacaacagaggagagtgagtatgccaagaatcaacctggcggcagcgcaaaagatg

SEQ ID NO: 208027 - DNA, 103 bp, Artificial Sequence
  Synthetic Polynucleotide
taatacgactcactatagggtactgcccaccagagactgtgcgattcttgaacagaggagacaagaaatgcacagtctcaacctggcggcagcgcaaaagatg

SEQ ID NO: 208028 - DNA, 103 bp, Artificial Sequence
  Synthetic Polynucleotide
taatacgactcactatagggagccacaacatactgcccaccagagactgtaacagaggagaacagtcatgggtgggcagaacctggcggcagcgcaaaagatg

SEQ ID NO: 208029 - DNA, 103 bp, Artificial Sequence
  Synthetic Polynucleotide
taatacgactcactatagggtgggagcggcagccacaacatactgcccacaacagaggagagtgggcatgatgttgtggaacctggcggcagcgcaaaagatg

SEQ ID NO: 208030 - DNA, 103 bp, Artificial Sequence
  Synthetic Polynucleotide
taatacgactcactatagggttctgtaagttgggagcggcagccacaacaaacagaggagatgttgtatgtgccgctccaacctggcggcagcgcaaaagatg

SEQ ID NO: 208031 - DNA, 103 bp, Artificial Sequence
  Synthetic Polynucleotide
taatacgactcactatagggaacttgctggttctgtaagttgggagcggcaacagaggagagccgctatgaacttacagaacctggcggcagcgcaaaagatg

SEQ ID NO: 208032 - DNA, 103 bp, Artificial Sequence
  Synthetic Polynucleotide
taatacgactcactataggggtcctgtcagaacttgctggttctgtaagtaacagaggagaacttacatgaccagcaagaacctggcggcagcgcaaaagatg

SEQ ID NO: 208033 - DNA, 103 bp, Artificial Sequence
  Synthetic Polynucleotide
taatacgactcactatagggactccaggtagtcctgtcagaacttgctggaacagaggagaccagcaatgtctgacaggaacctggcggcagcgcaaaagatg

SEQ ID NO: 208034 - DNA, 103 bp, Artificial Sequence
  Synthetic Polynucleotide
taatacgactcactatagggattaggcatcactccaggtagtcctgtcagaacagaggagactgacaatgctacctggaaacctggcggcagcgcaaaagatg

SEQ ID NO: 208035 - DNA, 103 bp, Artificial Sequence
  Synthetic Polynucleotide
taatacgactcactatagggtgccaccaactcctttttcaattttcaccaaacagaggagatggtgaatgttgaaaaagaacctggcggcagcgcaaaagatg

SEQ ID NO: 208036 - DNA, 103 bp, Artificial Sequence
  Synthetic Polynucleotide
taatacgactcactataggggatactgaatattaggcatcactccaggtaaacagaggagatacctgatgtgatgcctaaacctggcggcagcgcaaaagatg

SEQ ID NO: 208037 - DNA, 103 bp, Artificial Sequence
  Synthetic Polynucleotide
taatacgactcactataggggggattacttgatactgaatattaggcatcaacagaggagagatgccatgtattcagtaaacctggcggcagcgcaaaagatg

SEQ ID NO: 208038 - DNA, 103 bp, Artificial Sequence
  Synthetic Polynucleotide
taatacgactcactatagggctggaactgtgggattacttgatactgaataacagaggagaattcagatgcaagtaatcaacctggcggcagcgcaaaagatg

SEQ ID NO: 208039 - DNA, 103 bp, Artificial Sequence
  Synthetic Polynucleotide
taatacgactcactatagggcatcaacggtctggaactgtgggattacttaacagaggagaaagtaaatgcacagttccaacctggcggcagcgcaaaagatg

SEQ ID NO: 208040 - DNA, 103 bp, Artificial Sequence
  Synthetic Polynucleotide
taatacgactcactatagggagctgttgcccatcaacggtctggaactgtaacagaggagaacagttatggaccgttgaaacctggcggcagcgcaaaagatg

SEQ ID NO: 208041 - DNA, 103 bp, Artificial Sequence
  Synthetic Polynucleotide
taatacgactcactatagggagcaaactgcagctgttgcccatcaacggtaacagaggagaaccgttatggggcaacagaacctggcggcagcgcaaaagatg

SEQ ID NO: 208042 - DNA, 103 bp, Artificial Sequence
  Synthetic Polynucleotide
taatacgactcactatagggccccagtggcagcaaactgcagctgttgccaacagaggagaggcaacatgtgcagtttgaacctggcggcagcgcaaaagatg

SEQ ID NO: 208043 - DNA, 103 bp, Artificial Sequence
  Synthetic Polynucleotide
taatacgactcactatagggtgcacttgggccccagtggcagcaaactgcaacagaggagagcagttatgtgccactggaacctggcggcagcgcaaaagatg

SEQ ID NO: 208044 - DNA, 103 bp, Artificial Sequence
  Synthetic Polynucleotide
taatacgactcactatagggaccatcctgctgcacttgggccccagtggcaacagaggagagccactatggcccaagtgaacctggcggcagcgcaaaagatg

SEQ ID NO: 208045 - DNA, 103 bp, Artificial Sequence
  Synthetic Polynucleotide
taatacgactcactatagggtttgaccagaaccatcctgctgcacttgggaacagaggagacccaagatgagcaggatgaacctggcggcagcgcaaaagatg

SEQ ID NO: 208046 - DNA, 103 bp, Artificial Sequence
  Synthetic Polynucleotide
taatacgactcactatagggcccccattattgccaccaactcctttttcaaacagaggagatgaaaaatgagttggtggaacctggcggcagcgcaaaagatg

SEQ ID NO: 208047 - DNA, 103 bp, Artificial Sequence
  Synthetic Polynucleotide
taatacgactcactatagggatgatctgtatttgaccagaaccatcctgcaacagaggagagcaggaatgttctggtcaaacctggcggcagcgcaaaagatg

SEQ ID NO: 208048 - DNA, 103 bp, Artificial Sequence
  Synthetic Polynucleotide
taatacgactcactatagggtgcacctggtatgatctgtatttgaccagaaacagaggagatctggtatgatacagatcaacctggcggcagcgcaaaagatg

SEQ ID NO: 208049 - DNA, 103 bp, Artificial Sequence
  Synthetic Polynucleotide
taatacgactcactatagggtctgttggtttgcacctggtatgatctgtaaacagaggagatacagaatgtaccaggtgaacctggcggcagcgcaaaagatg

SEQ ID NO: 208050 - DNA, 103 bp, Artificial Sequence
  Synthetic Polynucleotide
taatacgactcactatagggtttgtgataatctgttggtttgcacctggtaacagaggagaaccaggatgaaaccaacaaacctggcggcagcgcaaaagatg

SEQ ID NO: 208051 - DNA, 103 bp, Artificial Sequence
  Synthetic Polynucleotide
taatacgactcactatagggacttcctcgatttgtgataatctgttggttaacagaggagaaaccaaatgattatcacaaacctggcggcagcgcaaaagatg

SEQ ID NO: 208052 - DNA, 103 bp, Artificial Sequence
  Synthetic Polynucleotide
taatacgactcactatagggtgttgcctccacttcctcgatttgtgataaaacagaggagattatcaatgatcgaggaaaacctggcggcagcgcaaaagatg

SEQ ID NO: 208053 - DNA, 103 bp, Artificial Sequence
  Synthetic Polynucleotide
taatacgactcactataggggcagcaatgatgttgcctccacttcctcgaaacagaggagatcgaggatgtggaggcaaaacctggcggcagcgcaaaagatg

SEQ ID NO: 208054 - DNA, 103 bp, Artificial Sequence
  Synthetic Polynucleotide
taatacgactcactataggggtttggcatagcagcaatgatgttgcctccaacagaggagaggaggcatgatcattgctaacctggcggcagcgcaaaagatg

SEQ ID NO: 208055 - DNA, 103 bp, Artificial Sequence
  Synthetic Polynucleotide
taatacgactcactataggggctggagtaggtttggcatagcagcaatgaaacagaggagatcattgatgctatgccaaaacctggcggcagcgcaaaagatg

SEQ ID NO: 208056 - DNA, 103 bp, Artificial Sequence
  Synthetic Polynucleotide
taatacgactcactataggggggacagcctgctggagtaggtttggcataaacagaggagatatgccatgcctactccaaacctggcggcagcgcaaaagatg

SEQ ID NO: 208057 - DNA, 103 bp, Artificial Sequence
  Synthetic Polynucleotide
taatacgactcactatagggattaccattgcccccattattgccaccaacaacagaggagagttggtatgaataatgggaacctggcggcagcgcaaaagatg

SEQ ID NO: 208058 - DNA, 103 bp, Artificial Sequence
  Synthetic Polynucleotide
taatacgactcactataggggccttggagggggacagcctgctggagtagaacagaggagactactcatgcaggctgtcaacctggcggcagcgcaaaagatg

SEQ ID NO: 208059 - DNA, 103 bp, Artificial Sequence
  Synthetic Polynucleotide
taatacgactcactatagggtattagccaggccttggagggggacagcctaacagaggagaaggctgatgccctccaagaacctggcggcagcgcaaaagatg

SEQ ID NO: 208060 - DNA, 103 bp, Artificial Sequence
  Synthetic Polynucleotide
taatacgactcactataggggagagtacattattagccaggccttggaggaacagaggagacctccaatgcctggctaaaacctggcggcagcgcaaaagatg

SEQ ID NO: 208061 - DNA, 103 bp, Artificial Sequence
  Synthetic Polynucleotide
taatacgactcactatagggagtctgtcctgagagtacattattagccagaacagaggagactggctatgaatgtactcaacctggcggcagcgcaaaagatg

SEQ ID NO: 208062 - DNA, 103 bp, Artificial Sequence
  Synthetic Polynucleotide
taatacgactcactatagggtcacatactgagtctgtcctgagagtacataacagaggagaatgtacatgcaggacagaaacctggcggcagcgcaaaagatg

SEQ ID NO: 208063 - DNA, 103 bp, Artificial Sequence
  Synthetic Polynucleotide
taatacgactcactatagggggtacattggtcacatactgagtctgtcctaacagaggagaaggacaatgtcagtatgtaacctggcggcagcgcaaaagatg

SEQ ID NO: 208064 - DNA, 103 bp, Artificial Sequence
  Synthetic Polynucleotide
taatacgactcactatagggcagggccactggtacattggtcacatactgaacagaggagacagtatatgaccaatgtaaacctggcggcagcgcaaaagatg

SEQ ID NO: 208065 - DNA, 103 bp, Artificial Sequence
  Synthetic Polynucleotide
taatacgactcactatagggtgttcccattcagggccactggtacattggaacagaggagaccaatgatgcagtggcccaacctggcggcagcgcaaaagatg

SEQ ID NO: 208066 - DNA, 103 bp, Artificial Sequence
  Synthetic Polynucleotide
taatacgactcactatagggagcaaggtgatgttcccattcagggccactaacagaggagaagtggcatggaatgggaaaacctggcggcagcgcaaaagatg

SEQ ID NO: 208067 - DNA, 103 bp, Artificial Sequence
  Synthetic Polynucleotide
taatacgactcactataggggttgacaggtagcaaggtgatgttcccattaacagaggagaaatgggatgatcaccttgaacctggcggcagcgcaaaagatg

SEQ ID NO: 208068 - DNA, 103 bp, Artificial Sequence
  Synthetic Polynucleotide
taatacgactcactatagggcaccaccaccattaccattgcccccattataacagaggagaataatgatggcaatggtaaacctggcggcagcgcaaaagatg

SEQ ID NO: 208069 - DNA, 103 bp, Artificial Sequence
  Synthetic Polynucleotide
taatacgactcactatagggcagaaacgctgttgacaggtagcaaggtgaaacagaggagatcacctatgtacctgtcaaacctggcggcagcgcaaaagatg

SEQ ID NO: 208070 - DNA, 103 bp, Artificial Sequence
  Synthetic Polynucleotide
taatacgactcactatagggaaggtagctgcagaaacgctgttgacaggtaacagaggagaacctgtatgcagcgtttcaacctggcggcagcgcaaaagatg

SEQ ID NO: 208071 - DNA, 103 bp, Artificial Sequence
  Synthetic Polynucleotide
taatacgactcactataggggctgggagtcaaggtagctgcagaaacgctaacagaggagaagcgttatggcagctaccaacctggcggcagcgcaaaagatg

SEQ ID NO: 208072 - DNA, 103 bp, Artificial Sequence
  Synthetic Polynucleotide
taatacgactcactatagggctgcctgagagctgggagtcaaggtagctgaacagaggagacagctaatgtgactcccaaacctggcggcagcgcaaaagatg

SEQ ID NO: 208073 - DNA, 103 bp, Artificial Sequence
  Synthetic Polynucleotide
taatacgactcactatagggctgatcgtgactgcctgagagctgggagtcaacagaggagagactccatgctctcaggcaacctggcggcagcgcaaaagatg

SEQ ID NO: 208074 - DNA, 103 bp, Artificial Sequence
  Synthetic Polynucleotide
taatacgactcactatagggcccagagctgctgatcgtgactgcctgagaaacagaggagatctcagatggtcacgatcaacctggcggcagcgcaaaagatg

SEQ ID NO: 208075 - DNA, 103 bp, Artificial Sequence
  Synthetic Polynucleotide
taatacgactcactatagggtctcctgggacccagagctgctgatcgtgaaacagaggagatcacgaatggcagctctgaacctggcggcagcgcaaaagatg

SEQ ID NO: 208076 - DNA, 103 bp, Artificial Sequence
  Synthetic Polynucleotide
taatacgactcactatagggtgtgagccactctcctgggacccagagctgaacagaggagacagctcatggtcccaggaaacctggcggcagcgcaaaagatg

SEQ ID NO: 208077 - DNA, 103 bp, Artificial Sequence
  Synthetic Polynucleotide
taatacgactcactatagggggtgacaggctgtgagccactctcctgggaaacagaggagatcccagatgagtggctcaaacctggcggcagcgcaaaagatg

SEQ ID NO: 208078 - DNA, 103 bp, Artificial Sequence
  Synthetic Polynucleotide
taatacgactcactatagggtagtccctgaggtgacaggctgtgagccacaacagaggagagtggctatgagcctgtcaaacctggcggcagcgcaaaagatg

SEQ ID NO: 208079 - DNA, 103 bp, Artificial Sequence
  Synthetic Polynucleotide
taatacgactcactatagggtgtgaaaaggcaccaccaccattaccattgaacagaggagacaatggatgtggtggtggaacctggcggcagcgcaaaagatg

SEQ ID NO: 208080 - DNA, 103 bp, Artificial Sequence
  Synthetic Polynucleotide
taatacgactcactataggggaactgatggtagtccctgaggtgacaggcaacagaggagagcctgtatgctcagggacaacctggcggcagcgcaaaagatg

SEQ ID NO: 208081 - DNA, 103 bp, Artificial Sequence
  Synthetic Polynucleotide
taatacgactcactatagggcaagctggcagaactgatggtagtccctgaaacagaggagatcagggatgaccatcagtaacctggcggcagcgcaaaagatg

SEQ ID NO: 208082 - DNA, 103 bp, Artificial Sequence
  Synthetic Polynucleotide
taatacgactcactataggggtgatgataccaagctggcagaactgatggaacagaggagaccatcaatgctgccagctaacctggcggcagcgcaaaagatg

SEQ ID NO: 208083 - DNA, 103 bp, Artificial Sequence
  Synthetic Polynucleotide
taatacgactcactataggggaactggcttgtgatgataccaagctggcaaacagaggagatgccagatgggtatcatcaacctggcggcagcgcaaaagatg

SEQ ID NO: 208084 - DNA, 103 bp, Artificial Sequence
  Synthetic Polynucleotide
taatacgactcactatagggaaaggagctggaactggcttgtgatgatacaacagaggagagtatcaatgcaagccagtaacctggcggcagcgcaaaagatg

SEQ ID NO: 208085 - DNA, 103 bp, Artificial Sequence
  Synthetic Polynucleotide
taatacgactcactatagggcattggtgaaaaaggagctggaactggcttaacagaggagaaagccaatgccagctcctaacctggcggcagcgcaaaagatg

SEQ ID NO: 208086 - DNA, 103 bp, Artificial Sequence
  Synthetic Polynucleotide
taatacgactcactatagggtagctattggcattggtgaaaaaggagctgaacagaggagacagctcatgtttcaccaaaacctggcggcagcgcaaaagatg

SEQ ID NO: 208087 - DNA, 103 bp, Artificial Sequence
  Synthetic Polynucleotide
taatacgactcactatagggagtagttgagtagctattggcattggtgaaaacagaggagattcaccatggccaatagcaacctggcggcagcgcaaaagatg

SEQ ID NO: 208088 - DNA, 103 bp, Artificial Sequence
  Synthetic Polynucleotide
taatacgactcactatagggtggtggtagtagtagttgagtagctattggaacagaggagaccaataatgactcaactaaacctggcggcagcgcaaaagatg

SEQ ID NO: 208089 - DNA, 103 bp, Artificial Sequence
  Synthetic Polynucleotide
taatacgactcactatagggcccatgttgctggtggtagtagtagttgagaacagaggagactcaacatgtactaccacaacctggcggcagcgcaaaagatg

SEQ ID NO: 208090 - DNA, 103 bp, Artificial Sequence
  Synthetic Polynucleotide
taatacgactcactatagggggcagccatgctggtctgtggatcgctcataacagaggagaatgagcatgccacagaccaacctggcggcagcgcaaaagatg

SEQ ID NO: 208091 - DNA, 103 bp, Artificial Sequence
  Synthetic Polynucleotide
taatacgactcactatagggtgcagcaagcagggctaagggagatggctgaacagaggagacagccaatgcccttagccaacctggcggcagcgcaaaagatg

SEQ ID NO: 208092 - DNA, 103 bp, Artificial Sequence
  Synthetic Polynucleotide
taatacgactcactatagggctgggagggcttctggggtacagtggggagaacagaggagactccccatggtaccccagaacctggcggcagcgcaaaagatg

SEQ ID NO: 208093 - DNA, 103 bp, Artificial Sequence
  Synthetic Polynucleotide
taatacgactcactatagggtctgaaagttctgggagggcttctggggtaaacagaggagataccccatgagccctcccaacctggcggcagcgcaaaagatg

SEQ ID NO: 208094 - DNA, 103 bp, Artificial Sequence
  Synthetic Polynucleotide
taatacgactcactataggggctgcctggatctgaaagttctgggagggcaacagaggagagccctcatggaactttcaaacctggcggcagcgcaaaagatg

SEQ ID NO: 208095 - DNA, 103 bp, Artificial Sequence
  Synthetic Polynucleotide
taatacgactcactatagggtgtcggctcagctgcctggatctgaaagttaacagaggagaaactttatgatccaggcaaacctggcggcagcgcaaaagatg

SEQ ID NO: 208096 - DNA, 103 bp, Artificial Sequence
  Synthetic Polynucleotide
taatacgactcactatagggcctgagtaggtgtcggctcagctgcctggaaacagaggagatccaggatgctgagccgaaacctggcggcagcgcaaaagatg

SEQ ID NO: 208097 - DNA, 103 bp, Artificial Sequence
  Synthetic Polynucleotide
taatacgactcactatagggcggatgtagacctgagtaggtgtcggctcaaacagaggagatgagccatgacctactcaaacctggcggcagcgcaaaagatg

SEQ ID NO: 208098 - DNA, 103 bp, Artificial Sequence
  Synthetic Polynucleotide
taatacgactcactatagggggaaggcgtgcggatgtagacctgagtaggaacagaggagacctactatggtctacatcaacctggcggcagcgcaaaagatg

SEQ ID NO: 208099 - DNA, 103 bp, Artificial Sequence
  Synthetic Polynucleotide
taatacgactcactataggggcacctcaccggaaggcgtgcggatgtagaaacagaggagatctacaatggcacgccttaacctggcggcagcgcaaaagatg

SEQ ID NO: 208100 - DNA, 103 bp, Artificial Sequence
  Synthetic Polynucleotide
taatacgactcactatagggaggactgtctgcacctcaccggaaggcgtgaacagaggagacacgccatgcggtgaggtaacctggcggcagcgcaaaagatg

SEQ ID NO: 208101 - DNA, 103 bp, Artificial Sequence
  Synthetic Polynucleotide
taatacgactcactataggggtcctggacaaggactgtctgcacctcaccaacagaggagaggtgagatgcagacagtcaacctggcggcagcgcaaaagatg

SEQ ID NO: 208102 - DNA, 103 bp, Artificial Sequence
  Synthetic Polynucleotide
taatacgactcactatagggtgctacatgttgcagcaagcagggctaaggaacagaggagaccttagatgtgcttgctgaacctggcggcagcgcaaaagatg

SEQ ID NO: 208103 - DNA, 103 bp, Artificial Sequence
  Synthetic Polynucleotide
taatacgactcactatagggctggggggctgtcctggacaaggactgtctaacagaggagaagacagatgttgtccaggaacctggcggcagcgcaaaagatg

SEQ ID NO: 208104 - DNA, 103 bp, Artificial Sequence
  Synthetic Polynucleotide
taatacgactcactataggggcagctgttgctggggggctgtcctggacaaacagaggagatgtccaatgcagccccccaacctggcggcagcgcaaaagatg

SEQ ID NO: 208105 - DNA, 103 bp, Artificial Sequence
  Synthetic Polynucleotide
taatacgactcactatagggagaggtggctgcagctgttgctggggggctaacagaggagaagccccatggcaacagctaacctggcggcagcgcaaaagatg

SEQ ID NO: 208106 - DNA, 103 bp, Artificial Sequence
  Synthetic Polynucleotide
taatacgactcactatagggaggtggtgttagaggtggctgcagctgttgaacagaggagacaacagatgcagccacctaacctggcggcagcgcaaaagatg

SEQ ID NO: 208107 - DNA, 103 bp, Artificial Sequence
  Synthetic Polynucleotide
taatacgactcactataggggggctgctacaggtggtgttagaggtggctaacagaggagaagccacatgtaacaccacaacctggcggcagcgcaaaagatg

SEQ ID NO: 208108 - DNA, 103 bp, Artificial Sequence
  Synthetic Polynucleotide
taatacgactcactatagggacgggatgcagggctgctacaggtggtgttaacagaggagaaacaccatgtgtagcagcaacctggcggcagcgcaaaagatg

SEQ ID NO: 208109 - DNA, 103 bp, Artificial Sequence
  Synthetic Polynucleotide
taatacgactcactataggggatggggagcacgggatgcagggctgctacaacagaggagagtagcaatgctgcatcccaacctggcggcagcgcaaaagatg

SEQ ID NO: 208110 - DNA, 103 bp, Artificial Sequence
  Synthetic Polynucleotide
taatacgactcactataggggtcccactcagatggggagcacgggatgcaaacagaggagatgcatcatgtgctccccaaacctggcggcagcgcaaaagatg

SEQ ID NO: 208111 - DNA, 103 bp, Artificial Sequence
  Synthetic Polynucleotide
taatacgactcactatagggctttttgctggtcccactcagatggggagcaacagaggagagctcccatgctgagtgggaacctggcggcagcgcaaaagatg

SEQ ID NO: 208112 - DNA, 103 bp, Artificial Sequence
  Synthetic Polynucleotide
taatacgactcactatagggcagctgagtgctttttgctggtcccactcaaacagaggagatgagtgatgccagcaaaaaacctggcggcagcgcaaaagatg

SEQ ID NO: 208113 - DNA, 103 bp, Artificial Sequence
  Synthetic Polynucleotide
taatacgactcactataggggggccaattttgctacatgttgcagcaagcaacagaggagagcttgcatgaacatgtagaacctggcggcagcgcaaaagatg

SEQ ID NO: 208114 - DNA, 103 bp, Artificial Sequence
  Synthetic Polynucleotide
taatacgactcactatagggcggagaattgcagctgagtgctttttgctgaacagaggagacagcaaatggcactcagcaacctggcggcagcgcaaaagatg

SEQ ID NO: 208115 - DNA, 103 bp, Artificial Sequence
  Synthetic Polynucleotide
taatacgactcactatagggacgctcttttcggagaattgcagctgagtgaacagaggagacactcaatggcaattctcaacctggcggcagcgcaaaagatg

SEQ ID NO: 208116 - DNA, 103 bp, Artificial Sequence
  Synthetic Polynucleotide
taatacgactcactatagggttggcaggggacgctcttttcggagaattgaacagaggagacaattcatggaaaagagcaacctggcggcagcgcaaaagatg

SEQ ID NO: 208117 - DNA, 103 bp, Artificial Sequence
  Synthetic Polynucleotide
taatacgactcactatagggggggcaatctttggcaggggacgctcttttaacagaggagaaaaagaatgtcccctgccaacctggcggcagcgcaaaagatg

SEQ ID NO: 208118 - DNA, 103 bp, Artificial Sequence
  Synthetic Polynucleotide
taatacgactcactataggggctcccggctggggcaatctttggcaggggaacagaggagacccctgatgaagattgccaacctggcggcagcgcaaaagatg

SEQ ID NO: 208119 - DNA, 103 bp, Artificial Sequence
  Synthetic Polynucleotide
taatacgactcactatagggggctgatgatgctcccggctggggcaatctaacagaggagaagattgatgcagccgggaaacctggcggcagcgcaaaagatg

SEQ ID NO: 208120 - DNA, 103 bp, Artificial Sequence
  Synthetic Polynucleotide
taatacgactcactataggggctgcattcaggctgatgatgctcccggctaacagaggagaagccggatgcatcatcagaacctggcggcagcgcaaaagatg

SEQ ID NO: 208121 - DNA, 103 bp, Artificial Sequence
  Synthetic Polynucleotide
taatacgactcactatagggcgccaactgggctgcattcaggctgatgataacagaggagaatcatcatgctgaatgcaaacctggcggcagcgcaaaagatg

SEQ ID NO: 208122 - DNA, 103 bp, Artificial Sequence
  Synthetic Polynucleotide
taatacgactcactataggggggcagctgccgccaactgggctgcattcaaacagaggagatgaatgatgcccagttggaacctggcggcagcgcaaaagatg

SEQ ID NO: 208123 - DNA, 103 bp, Artificial Sequence
  Synthetic Polynucleotide
taatacgactcactatagggtgcattgcctgggcagctgccgccaactggaacagaggagaccagttatgggcagctgcaacctggcggcagcgcaaaagatg

SEQ ID NO: 208124 - DNA, 103 bp, Artificial Sequence
  Synthetic Polynucleotide
taatacgactcactatagggaactgctggagggccaattttgctacatgtaacagaggagaacatgtatgaaaattggcaacctggcggcagcgcaaaagatg

SEQ ID NO: 208125 - DNA, 103 bp, Artificial Sequence
  Synthetic Polynucleotide
taatacgactcactataggggttgatggtctgcattgcctgggcagctgcaacagaggagagcagctatgcaggcaatgaacctggcggcagcgcaaaagatg

SEQ ID NO: 208126 - DNA, 103 bp, Artificial Sequence
  Synthetic Polynucleotide
taatacgactcactatagggcaccattgatgttgatggtctgcattgcctaacagaggagaaggcaaatgagaccatcaaacctggcggcagcgcaaaagatg

SEQ ID NO: 208127 - DNA, 103 bp, Artificial Sequence
  Synthetic Polynucleotide
taatacgactcactatagggtggacctggacaccattgatgttgatggtcaacagaggagagaccatatgcatcaatggaacctggcggcagcgcaaaagatg

SEQ ID NO: 208128 - DNA, 103 bp, Artificial Sequence
  Synthetic Polynucleotide
taatacgactcactatagggaggcacgccctggacctggacaccattgataacagaggagaatcaatatggtccaggtcaacctggcggcagcgcaaaagatg

SEQ ID NO: 208129 - DNA, 103 bp, Artificial Sequence
  Synthetic Polynucleotide
taatacgactcactatagggtgatggtgacaggcacgccctggacctggaaacagaggagatccaggatgagggcgtgcaacctggcggcagcgcaaaagatg

SEQ ID NO: 208130 - DNA, 103 bp, Artificial Sequence
  Synthetic Polynucleotide
taatacgactcactatagggcctgtgttggtgatggtgacaggcacgcccaacagaggagagggcgtatgtgtcaccataacctggcggcagcgcaaaagatg

SEQ ID NO: 208131 - DNA, 103 bp, Artificial Sequence
  Synthetic Polynucleotide
taatacgactcactatagggctgctgcccgcctgtgttggtgatggtgacaacagaggagagtcaccatgaccaacacaaacctggcggcagcgcaaaagatg

SEQ ID NO: 208132 - DNA, 103 bp, Artificial Sequence
  Synthetic Polynucleotide
taatacgactcactatagggctgtcagctgctgctgcccgcctgtgttggaacagaggagaccaacaatggcgggcagcaacctggcggcagcgcaaaagatg

SEQ ID NO: 208133 - DNA, 103 bp, Artificial Sequence
  Synthetic Polynucleotide
taatacgactcactatagggacattctgcactgtcagctgctgctgcccgaacagaggagacgggcaatggcagctgacaacctggcggcagcgcaaaagatg

SEQ ID NO: 208134 - DNA, 103 bp, Artificial Sequence
  Synthetic Polynucleotide
taatacgactcactataggggttcccagaaacattctgcactgtcagctgaacagaggagacagctgatggtgcagaataacctggcggcagcgcaaaagatg

SEQ ID NO: 208135 - DNA, 103 bp, Artificial Sequence
  Synthetic Polynucleotide
taatacgactcactatagggcagcagcttcaactgctggagggccaatttaacagaggagaaaattgatgctccagcagaacctggcggcagcgcaaaagatg

SEQ ID NO: 208136 - DNA, 103 bp, Artificial Sequence
  Synthetic Polynucleotide
taatacgactcactatagggtggtcaggttgttcccagaaacattctgcaaacagaggagatgcagaatgtttctgggaaacctggcggcagcgcaaaagatg

SEQ ID NO: 208137 - DNA, 103 bp, Artificial Sequence
  Synthetic Polynucleotide
taatacgactcactatagggagcccactgatggtcaggttgttcccagaaaacagaggagattctggatgcaacctgacaacctggcggcagcgcaaaagatg

SEQ ID NO: 208138 - DNA, 103 bp, Artificial Sequence
  Synthetic Polynucleotide
taatacgactcactatagggggtggggctcagcccactgatggtcaggttaacagaggagaaacctgatgatcagtgggaacctggcggcagcgcaaaagatg

SEQ ID NO: 208139 - DNA, 103 bp, Artificial Sequence
  Synthetic Polynucleotide
taatacgactcactataggggctggatctgggtggggctcagcccactgaaacagaggagatcagtgatgtgagccccaaacctggcggcagcgcaaaagatg

SEQ ID NO: 208140 - DNA, 103 bp, Artificial Sequence
  Synthetic Polynucleotide
taatacgactcactatagggtccatttgcagctggatctgggtggggctcaacagaggagagagcccatgccagatccaaacctggcggcagcgcaaaagatg

SEQ ID NO: 208141 - DNA, 103 bp, Artificial Sequence
  Synthetic Polynucleotide
taatacgactcactatagggcagggcttgttccatttgcagctggatctgaacagaggagacagatcatgctgcaaatgaacctggcggcagcgcaaaagatg

SEQ ID NO: 208142 - DNA, 103 bp, Artificial Sequence
  Synthetic Polynucleotide
taatacgactcactatagggtctctccggccagggcttgttccatttgcaaacagaggagatgcaaaatgaacaagcccaacctggcggcagcgcaaaagatg

SEQ ID NO: 208143 - DNA, 103 bp, Artificial Sequence
  Synthetic Polynucleotide
taatacgactcactatagggccgggctgggtctctccggccagggcttgtaacagaggagaacaagcatgggccggagaaacctggcggcagcgcaaaagatg

SEQ ID NO: 208144 - DNA, 103 bp, Artificial Sequence
  Synthetic Polynucleotide
taatacgactcactatagggccgcttctccccgggctgggtctctccggcaacagaggagagccggaatgacccagcccaacctggcggcagcgcaaaagatg

SEQ ID NO: 208145 - DNA, 103 bp, Artificial Sequence
  Synthetic Polynucleotide
taatacgactcactatagggccatgcggcgccgcttctccccgggctgggaacagaggagacccagcatggggagaagcaacctggcggcagcgcaaaagatg

SEQ ID NO: 208146 - DNA, 103 bp, Artificial Sequence
  Synthetic Polynucleotide
taatacgactcactatagggggaggtgtcacagcagcttcaactgctggaaacagaggagatccagcatgtgaagctgcaacctggcggcagcgcaaaagatg

SEQ ID NO: 208147 - DNA, 103 bp, Artificial Sequence
  Synthetic Polynucleotide
taatacgactcactatagggcacgtgcaggccatgcggcgccgcttctccaacagaggagaggagaaatggcgccgcataacctggcggcagcgcaaaagatg

SEQ ID NO: 208148 - DNA, 103 bp, Artificial Sequence
  Synthetic Polynucleotide
taatacgactcactataggggcagttgggacacgtgcaggccatgcggcgaacagaggagacgccgcatggcctgcacgaacctggcggcagcgcaaaagatg

SEQ ID NO: 208149 - DNA, 103 bp, Artificial Sequence
  Synthetic Polynucleotide
taatacgactcactatagggccccatccttgcagttgggacacgtgcaggaacagaggagacctgcaatggtcccaactaacctggcggcagcgcaaaagatg

SEQ ID NO: 208150 - DNA, 103 bp, Artificial Sequence
  Synthetic Polynucleotide
taatacgactcactataggggacctcttctccccatccttgcagttgggaaacagaggagatcccaaatgcaaggatggaacctggcggcagcgcaaaagatg

SEQ ID NO: 208151 - DNA, 103 bp, Artificial Sequence
  Synthetic Polynucleotide
taatacgactcactatagggctgctctccagacctcttctccccatccttaacagaggagaaaggatatggagaagaggaacctggcggcagcgcaaaagatg

SEQ ID NO: 208152 - DNA, 103 bp, Artificial Sequence
  Synthetic Polynucleotide
taatacgactcactatagggtcttcttgccctgctctccagacctcttctaacagaggagaagaagaatgctggagagcaacctggcggcagcgcaaaagatg

SEQ ID NO: 208153 - DNA, 103 bp, Artificial Sequence
  Synthetic Polynucleotide
taatacgactcactatagggcacacgtgcttcttcttgccctgctctccaaacagaggagatggagaatggggcaagaaaacctggcggcagcgcaaaagatg

SEQ ID NO: 208154 - DNA, 103 bp, Artificial Sequence
  Synthetic Polynucleotide
taatacgactcactatagggggggatgtggcacacgtgcttcttcttgccaacagaggagaggcaagatgaagcacgtgaacctggcggcagcgcaaaagatg

SEQ ID NO: 208155 - DNA, 103 bp, Artificial Sequence
  Synthetic Polynucleotide
taatacgactcactatagggtgccacagtcggggatgtggcacacgtgctaacagaggagaagcacgatggccacatccaacctggcggcagcgcaaaagatg

SEQ ID NO: 208156 - DNA, 103 bp, Artificial Sequence
  Synthetic Polynucleotide
taatacgactcactatagggcggaacgtcttgccacagtcggggatgtggaacagaggagaccacatatgcgactgtggaacctggcggcagcgcaaaagatg

SEQ ID NO: 208157 - DNA, 103 bp, Artificial Sequence
  Synthetic Polynucleotide
taatacgactcactatagggtgggggagcaggaggtgtcacagcagcttcaacagaggagagaagctatggtgacacctaacctggcggcagcgcaaaagatg

SEQ ID NO: 208158 - DNA, 103 bp, Artificial Sequence
  Synthetic Polynucleotide
taatacgactcactatagggggacgtcttacggaacgtcttgccacagtcaacagaggagagactgtatgaagacgttcaacctggcggcagcgcaaaagatg

SEQ ID NO: 208159 - DNA, 103 bp, Artificial Sequence
  Synthetic Polynucleotide
taatacgactcactatagggcacgcagcaaggacgtcttacggaacgtctaacagaggagaagacgtatggtaagacgtaacctggcggcagcgcaaaagatg

SEQ ID NO: 208160 - DNA, 103 bp, Artificial Sequence
  Synthetic Polynucleotide
taatacgactcactatagggcgcacatgggcacgcagcaaggacgtcttaaacagaggagataagacatgcttgctgcgaacctggcggcagcgcaaaagatg

SEQ ID NO: 208161 - DNA, 103 bp, Artificial Sequence
  Synthetic Polynucleotide
taatacgactcactatagggagtgtgcaggcgcacatgggcacgcagcaaaacagaggagattgctgatggcccatgtgaacctggcggcagcgcaaaagatg

SEQ ID NO: 208162 - DNA, 103 bp, Artificial Sequence
  Synthetic Polynucleotide
taatacgactcactataggggccgctcgccagtgtgcaggcgcacatgggaacagaggagacccatgatggcctgcacaaacctggcggcagcgcaaaagatg

SEQ ID NO: 208163 - DNA, 103 bp, Artificial Sequence
  Synthetic Polynucleotide
taatacgactcactatagggcagacaaagggccgctcgccagtgtgcaggaacagaggagacctgcaatgtggcgagcgaacctggcggcagcgcaaaagatg

SEQ ID NO: 208164 - DNA, 103 bp, Artificial Sequence
  Synthetic Polynucleotide
taatacgactcactataggggaaccagttgcagacaaagggccgctcgccaacagaggagaggcgagatgccctttgtcaacctggcggcagcgcaaaagatg

SEQ ID NO: 208165 - DNA, 103 bp, Artificial Sequence
  Synthetic Polynucleotide
taatacgactcactatagggtcccacagaagaaccagttgcagacaaaggaacagaggagacctttgatggcaactggtaacctggcggcagcgcaaaagatg

SEQ ID NO: 208166 - DNA, 103 bp, Artificial Sequence
  Synthetic Polynucleotide
taatacgactcactataggggtgaacctcttcccacagaagaaccagttgaacagaggagacaactgatgcttctgtggaacctggcggcagcgcaaaagatg

SEQ ID NO: 208167 - DNA, 103 bp, Artificial Sequence
  Synthetic Polynucleotide
taatacgactcactataggggtcactccgtgtgaacctcttcccacagaaaacagaggagattctgtatgaagaggttcaacctggcggcagcgcaaaagatg

SEQ ID NO: 208168 - DNA, 103 bp, Artificial Sequence
  Synthetic Polynucleotide
taatacgactcactataggggtgtgggctgtgggggagcaggaggtgtcaaacagaggagatgacacatgctgctccccaacctggcggcagcgcaaaagatg

SEQ ID NO: 208169 - DNA, 103 bp, Artificial Sequence
  Synthetic Polynucleotide
taatacgactcactataggggttggagctcgtcactccgtgtgaacctctaacagaggagaagaggtatgcacggagtgaacctggcggcagcgcaaaagatg

SEQ ID NO: 208170 - DNA, 103 bp, Artificial Sequence
  Synthetic Polynucleotide
taatacgactcactatagggcgagcatgccgttggagctcgtcactccgtaacagaggagaacggagatgcgagctccaaacctggcggcagcgcaaaagatg

SEQ ID NO: 208171 - DNA, 103 bp, Artificial Sequence
  Synthetic Polynucleotide
taatacgactcactatagggtgtgtgggtgcgagcatgccgttggagctcaacagaggagagagctcatgcggcatgctaacctggcggcagcgcaaaagatg

SEQ ID NO: 208172 - DNA, 103 bp, Artificial Sequence
  Synthetic Polynucleotide
taatacgactcactataggggtttgtcccctgtgtgggtgcgagcatgccaacagaggagaggcatgatggcacccacaaacctggcggcagcgcaaaagatg

SEQ ID NO: 208173 - DNA, 103 bp, Artificial Sequence
  Synthetic Polynucleotide
taatacgactcactatagggcactcgaagcgtttgtcccctgtgtgggtgaacagaggagacacccaatgaggggacaaaacctggcggcagcgcaaaagatg

SEQ ID NO: 208174 - DNA, 103 bp, Artificial Sequence
  Synthetic Polynucleotide
taatacgactcactatagggacactgggcgcactcgaagcgtttgtccccaacagaggagaggggacatgcgcttcgagaacctggcggcagcgcaaaagatg

SEQ ID NO: 208175 - DNA, 103 bp, Artificial Sequence
  Synthetic Polynucleotide
taatacgactcactatagggagcgcttctgacactgggcgcactcgaagcaacagaggagagcttcgatggcgcccagtaacctggcggcagcgcaaaagatg

SEQ ID NO: 208176 - DNA, 103 bp, Artificial Sequence
  Synthetic Polynucleotide
taatacgactcactatagggctcctcatgaagcgcttctgacactgggcgaacagaggagacgcccaatgtcagaagcgaacctggcggcagcgcaaaagatg

SEQ ID NO: 208177 - DNA, 103 bp, Artificial Sequence
  Synthetic Polynucleotide
taatacgactcactataggggaggtggtcactcctcatgaagcgcttctgaacagaggagacagaagatgttcatgaggaacctggcggcagcgcaaaagatg

SEQ ID NO: 208178 - DNA, 103 bp, Artificial Sequence
  Synthetic Polynucleotide
taatacgactcactatagggaatgcttggtgaggtggtcactcctcatgaaacagaggagatcatgaatggtgaccaccaacctggcggcagcgcaaaagatg

SEQ ID NO: 208179 - DNA, 103 bp, Artificial Sequence
  Synthetic Polynucleotide
taatacgactcactatagggagtttccgcggtgtgggctgtgggggagcaaacagaggagatgctccatgacagcccacaacctggcggcagcgcaaaagatg

SEQ ID NO: 208180 - DNA, 103 bp, Artificial Sequence
  Synthetic Polynucleotide
taatacgactcactatagggtgggtcttgtaatgcttggtgaggtggtcaaacagaggagatgaccaatgcaccaagcaaacctggcggcagcgcaaaagatg

SEQ ID NO: 208181 - DNA, 103 bp, Artificial Sequence
  Synthetic Polynucleotide
taatacgactcactatagggcgtgaccaggtgggtcttgtaatgcttggtaacagaggagaaccaagatgtacaagaccaacctggcggcagcgcaaaagatg

SEQ ID NO: 208182 - DNA, 103 bp, Artificial Sequence
  Synthetic Polynucleotide
taatacgactcactatagggacaagttcttcgtgaccaggtgggtcttgtaacagaggagaacaagaatgacctggtcaaacctggcggcagcgcaaaagatg

SEQ ID NO: 208183 - DNA, 103 bp, Artificial Sequence
  Synthetic Polynucleotide
taatacgactcactataggggatagggacaagtttccgcggtgtgggctgaacagaggagacagcccatgccgcggaaaaacctggcggcagcgcaaaagatg

SEQ ID NO: 208184 - DNA, 103 bp, Artificial Sequence
  Synthetic Polynucleotide
taatacgactcactatagggcagcagcagtggcagccatgctggtctgtgaacagaggagacacagaatggcatggctgaacctggcggcagcgcaaaagatg

SEQ ID NO: 208185 - DNA, 103 bp, Artificial Sequence
  Synthetic Polynucleotide
taatacgactcactataggggggcaggtttgatagggacaagtttccgcgaacagaggagacgcggaatgttgtccctaaacctggcggcagcgcaaaagatg

SEQ ID NO: 208186 - DNA, 103 bp, Artificial Sequence
  Synthetic Polynucleotide
taatacgactcactatagggagagggagaggggcaggtttgatagggacaaacagaggagatgtcccatgcaaacctgcaacctggcggcagcgcaaaagatg

SEQ ID NO: 208187 - DNA, 103 bp, Artificial Sequence
  Synthetic Polynucleotide
taatacgactcactataggggccggggctgagagggagaggggcaggtttaacagaggagaaaacctatgcctctccctaacctggcggcagcgcaaaagatg

SEQ ID NO: 208188 - DNA, 103 bp, Artificial Sequence
  Synthetic Polynucleotide
taatacgactcactatagggagctattcttgccggggctgagagggagagaacagaggagactctccatgtcagccccgaacctggcggcagcgcaaaagatg

SEQ ID NO: 208189 - DNA, 103 bp, Artificial Sequence
  Synthetic Polynucleotide
taatacgactcactatagggaagattccaaagctattcttgccggggctgaacagaggagacagcccatgcaagaatagaacctggcggcagcgcaaaagatg

SEQ ID NO: 208190 - DNA, 103 bp, Artificial Sequence
  Synthetic Polynucleotide
taatacgactcactatagggtttggaggacaagattccaaagctattcttaacagaggagaaagaatatgtttggaatcaacctggcggcagcgcaaaagatg

SEQ ID NO: 208191 - DNA, 103 bp, Artificial Sequence
  Synthetic Polynucleotide
taatacgactcactataggggtatatttcctttggaggacaagattccaaaacagaggagattggaaatgtgtcctccaaacctggcggcagcgcaaaagatg

SEQ ID NO: 208192 - DNA, 103 bp, Artificial Sequence
  Synthetic Polynucleotide
taatacgactcactatagggtgaatctgaagtatatttcctttggaggacaacagaggagagtcctcatgaggaaatataacctggcggcagcgcaaaagatg

SEQ ID NO: 208193 - DNA, 103 bp, Artificial Sequence
  Synthetic Polynucleotide
taatacgactcactatagggttgtgacccctgaatctgaagtatatttccaacagaggagaggaaatatgcttcagattaacctggcggcagcgcaaaagatg

SEQ ID NO: 208194 - DNA, 103 bp, Artificial Sequence
  Synthetic Polynucleotide
taatacgactcactatagggaggcgctcagttgtgacccctgaatctgaaaacagaggagattcagaatgaggggtcacaacctggcggcagcgcaaaagatg

SEQ ID NO: 208195 - DNA, 103 bp, Artificial Sequence
  Synthetic Polynucleotide
taatacgactcactatagggctgggactcacagcagcagtggcagccatgaacagaggagacatggcatgcactgctgcaacctggcggcagcgcaaaagatg

SEQ ID NO: 208196 - DNA, 103 bp, Artificial Sequence
  Synthetic Polynucleotide
taatacgactcactatagggccaggataggaggcgctcagttgtgaccccaacagaggagaggggtcatgactgagcgcaacctggcggcagcgcaaaagatg

SEQ ID NO: 208197 - DNA, 103 bp, Artificial Sequence
  Synthetic Polynucleotide
taatacgactcactatagggcagctgccctccaggataggaggcgctcagaacagaggagactgagcatgtcctatcctaacctggcggcagcgcaaaagatg

SEQ ID NO: 208198 - DNA, 103 bp, Artificial Sequence
  Synthetic Polynucleotide
taatacgactcactatagggtagcgaacaccagctgccctccaggataggaacagaggagacctatcatggagggcagcaacctggcggcagcgcaaaagatg

SEQ ID NO: 208199 - DNA, 103 bp, Artificial Sequence
  Synthetic Polynucleotide
taatacgactcactatagggggattctggatagcgaacaccagctgccctaacagaggagaagggcaatgggtgttcgcaacctggcggcagcgcaaaagatg

SEQ ID NO: 208200 - DNA, 103 bp, Artificial Sequence
  Synthetic Polynucleotide
taatacgactcactataggggatcatggtgggattctggatagcgaacacaacagaggagagtgttcatgatccagaataacctggcggcagcgcaaaagatg

SEQ ID NO: 208201 - DNA, 103 bp, Artificial Sequence
  Synthetic Polynucleotide
taatacgactcactatagggtccctttgttgatcatggtgggattctggaaacagaggagatccagaatgccaccatgaaacctggcggcagcgcaaaagatg

SEQ ID NO: 208202 - DNA, 103 bp, Artificial Sequence
  Synthetic Polynucleotide
taatacgactcactatagggtttgatcgggtccctttgttgatcatggtgaacagaggagacaccatatgcaacaaaggaacctggcggcagcgcaaaagatg

SEQ ID NO: 208203 - DNA, 103 bp, Artificial Sequence
  Synthetic Polynucleotide
taatacgactcactataggggatattggcatttgatcgggtccctttgttaacagaggagaaacaaaatgacccgatcaaacctggcggcagcgcaaaagatg

SEQ ID NO: 208204 - DNA, 103 bp, Artificial Sequence
  Synthetic Polynucleotide
taatacgactcactatagggcctggtactggatattggcatttgatcgggaacagaggagacccgatatgatgccaataaacctggcggcagcgcaaaagatg

SEQ ID NO: 208205 - DNA, 103 bp, Artificial Sequence
  Synthetic Polynucleotide
taatacgactcactatagggtgagggaccgcctggtactggatattggcaaacagaggagatgccaaatgccagtaccaaacctggcggcagcgcaaaagatg

SEQ ID NO: 208206 - DNA, 103 bp, Artificial Sequence
  Synthetic Polynucleotide
taatacgactcactatagggcaggtagtcactgggactcacagcagcagtaacagaggagaactgctatggtgagtcccaacctggcggcagcgcaaaagatg

SEQ ID NO: 208207 - DNA, 103 bp, Artificial Sequence
  Synthetic Polynucleotide
taatacgactcactatagggtgcctgaatctgagggaccgcctggtactgaacagaggagacagtacatggcggtccctaacctggcggcagcgcaaaagatg

SEQ ID NO: 208208 - DNA, 103 bp, Artificial Sequence
  Synthetic Polynucleotide
taatacgactcactataggggggaattgcttgcctgaatctgagggaccgaacagaggagacggtccatgagattcaggaacctggcggcagcgcaaaagatg

SEQ ID NO: 208209 - DNA, 103 bp, Artificial Sequence
  Synthetic Polynucleotide
taatacgactcactatagggtggatggtttgggaattgcttgcctgaatcaacagaggagagattcaatgaagcaattcaacctggcggcagcgcaaaagatg

SEQ ID NO: 208210 - DNA, 103 bp, Artificial Sequence
  Synthetic Polynucleotide
taatacgactcactataggggggctgtacttggatggtttgggaattgctaacagaggagaagcaatatgcaaaccatcaacctggcggcagcgcaaaagatg

SEQ ID NO: 208211 - DNA, 103 bp, Artificial Sequence
  Synthetic Polynucleotide
taatacgactcactatagggtggtgagattgggctgtacttggatggtttaacagaggagaaaaccaatgaagtacagcaacctggcggcagcgcaaaagatg

SEQ ID NO: 208212 - DNA, 103 bp, Artificial Sequence
  Synthetic Polynucleotide
taatacgactcactatagggtggatctggttggtgagattgggctgtactaacagaggagaagtacaatgcaatctcacaacctggcggcagcgcaaaagatg

SEQ ID NO: 208213 - DNA, 103 bp, Artificial Sequence
  Synthetic Polynucleotide
taatacgactcactatagggagggatgatctggatctggttggtgagattaacagaggagaaatctcatgaaccagatcaacctggcggcagcgcaaaagatg

SEQ ID NO: 208214 - DNA, 103 bp, Artificial Sequence
  Synthetic Polynucleotide
taatacgactcactatagggggttggtgccagggatgatctggatctggtaacagaggagaaccagaatgagatcatccaacctggcggcagcgcaaaagatg

SEQ ID NO: 208215 - DNA, 103 bp, Artificial Sequence
  Synthetic Polynucleotide
taatacgactcactatagggatgatggcttggttggtgccagggatgatcaacagaggagagatcatatgtggcaccaaaacctggcggcagcgcaaaagatg

SEQ ID NO: 208216 - DNA, 103 bp, Artificial Sequence
  Synthetic Polynucleotide
taatacgactcactatagggtgagggggtgatgatggcttggttggtgccaacagaggagaggcaccatgcaagccatcaacctggcggcagcgcaaaagatg

SEQ ID NO: 208217 - DNA, 103 bp, Artificial Sequence
  Synthetic Polynucleotide
taatacgactcactatagggcggcaggctgcaggtagtcactgggactcaaacagaggagatgagtcatggtgactaccaacctggcggcagcgcaaaagatg

SEQ ID NO: 208218 - DNA, 103 bp, Artificial Sequence
  Synthetic Polynucleotide
taatacgactcactataggggactggacggtgagggggtgatgatggcttaacagaggagaaagccaatgtcaccccctaacctggcggcagcgcaaaagatg

SEQ ID NO: 208219 - DNA, 103 bp, Artificial Sequence
  Synthetic Polynucleotide
taatacgactcactatagggacaggcttgtgactggacggtgagggggtgaacagaggagacaccccatgaccgtccagaacctggcggcagcgcaaaagatg

SEQ ID NO: 208220 - DNA, 103 bp, Artificial Sequence
  Synthetic Polynucleotide
taatacgactcactatagggcttgatggggacaggcttgtgactggacggaacagaggagaccgtccatgcacaagcctaacctggcggcagcgcaaaagatg

SEQ ID NO: 208221 - DNA, 103 bp, Artificial Sequence
  Synthetic Polynucleotide
taatacgactcactatagggtgggggctggcttgatggggacaggcttgtaacagaggagaacaagcatgtccccatcaaacctggcggcagcgcaaaagatg

SEQ ID NO: 208222 - DNA, 103 bp, Artificial Sequence
  Synthetic Polynucleotide
taatacgactcactataggggacttctggatgggggctggcttgatggggaacagaggagaccccatatggccagccccaacctggcggcagcgcaaaagatg

SEQ ID NO: 208223 - DNA, 103 bp, Artificial Sequence
  Synthetic Polynucleotide
taatacgactcactatagggggtcgtactcgacttctggatgggggctggaacagaggagaccagccatgatccagaagaacctggcggcagcgcaaaagatg

SEQ ID NO: 208224 - DNA, 103 bp, Artificial Sequence
  Synthetic Polynucleotide
taatacgactcactatagggcgggggtggtggtcgtactcgacttctggaaacagaggagatccagaatgcgagtacgaaacctggcggcagcgcaaaagatg

SEQ ID NO: 208225 - DNA, 103 bp, Artificial Sequence
  Synthetic Polynucleotide
taatacgactcactatagggccgctctgcacgggggtggtggtcgtactcaacagaggagagagtacatgcaccaccccaacctggcggcagcgcaaaagatg

SEQ ID NO: 208226 - DNA, 103 bp, Artificial Sequence
  Synthetic Polynucleotide
taatacgactcactatagggcacattggccccgctctgcacgggggtggtaacagaggagaaccaccatggtgcagagcaacctggcggcagcgcaaaagatg

SEQ ID NO: 208227 - DNA, 103 bp, Artificial Sequence
  Synthetic Polynucleotide
taatacgactcactatagggtcagcttcaccacattggccccgctctgcaaacagaggagatgcagaatggggccaatgaacctggcggcagcgcaaaagatg

SEQ ID NO: 208228 - DNA, 103 bp, Artificial Sequence
  Synthetic Polynucleotide
taatacgactcactataggggtggtggaggcggcaggctgcaggtagtcaaacagaggagatgactaatggcagcctgcaacctggcggcagcgcaaaagatg

SEQ ID NO: 208229 - DNA, 103 bp, Artificial Sequence
  Synthetic Polynucleotide
taatacgactcactatagggcccccacctgtcagcttcaccacattggccaacagaggagaggccaaatgggtgaagctaacctggcggcagcgcaaaagatg

SEQ ID NO: 208230 - DNA, 103 bp, Artificial Sequence
  Synthetic Polynucleotide
taatacgactcactatagggcacattgccgcccccacctgtcagcttcacaacagaggagagtgaagatgacaggtgggaacctggcggcagcgcaaaagatg

SEQ ID NO: 208231 - DNA, 103 bp, Artificial Sequence
  Synthetic Polynucleotide
taatacgactcactataggggagtgagcgtcacattgccgcccccacctgaacagaggagacaggtgatggcggcaatgaacctggcggcagcgcaaaagatg

SEQ ID NO: 208232 - DNA, 103 bp, Artificial Sequence
  Synthetic Polynucleotide
taatacgactcactatagggttgacgggcagagtgagcgtcacattgccgaacagaggagacggcaaatggacgctcacaacctggcggcagcgcaaaagatg

SEQ ID NO: 208233 - DNA, 103 bp, Artificial Sequence
  Synthetic Polynucleotide
taatacgactcactatagggcacaaggttgttgacgggcagagtgagcgtaacagaggagaacgctcatgctgcccgtcaacctggcggcagcgcaaaagatg

SEQ ID NO: 208234 - DNA, 103 bp, Artificial Sequence
  Synthetic Polynucleotide
taatacgactcactatagggcactggcgttcacaaggttgttgacgggcaaacagaggagatgcccgatgacaaccttgaacctggcggcagcgcaaaagatg

SEQ ID NO: 208235 - DNA, 103 bp, Artificial Sequence
  Synthetic Polynucleotide
taatacgactcactataggggccccggtgtcactggcgttcacaaggttgaacagaggagacaacctatggaacgccagaacctggcggcagcgcaaaagatg

SEQ ID NO: 208236 - DNA, 103 bp, Artificial Sequence
  Synthetic Polynucleotide
taatacgactcactatagggctgagtaggggccccggtgtcactggcgttaacagaggagaaacgccatggacaccgggaacctggcggcagcgcaaaagatg

SEQ ID NO: 208237 - DNA, 103 bp, Artificial Sequence
  Synthetic Polynucleotide
taatacgactcactatagggcagtgaggagctgagtaggggccccggtgtaacagaggagaacaccgatgcccctactcaacctggcggcagcgcaaaagatg

SEQ ID NO: 208238 - DNA, 103 bp, Artificial Sequence
  Synthetic Polynucleotide
taatacgactcactatagggggggggctttcagtgaggagctgagtagggaacagaggagaccctacatggctcctcacaacctggcggcagcgcaaaagatg

SEQ ID NO: 208239 - DNA, 103 bp, Artificial Sequence
  Synthetic Polynucleotide
taatacgactcactatagggggagtcctgggtggtggaggcggcaggctgaacagaggagacagcctatggcctccaccaacctggcggcagcgcaaaagatg

SEQ ID NO: 208240 - DNA, 103 bp, Artificial Sequence
  Synthetic Polynucleotide
taatacgactcactatagggcagcggggttggggggctttcagtgaggagaacagaggagactcctcatggaaagccccaacctggcggcagcgcaaaagatg

SEQ ID NO: 208241 - DNA, 103 bp, Artificial Sequence
  Synthetic Polynucleotide
taatacgactcactatagggtagtcttagacagcggggttggggggctttaacagaggagaaaagccatgcaaccccgcaacctggcggcagcgcaaaagatg

SEQ ID NO: 208242 - DNA, 103 bp, Artificial Sequence
  Synthetic Polynucleotide
taatacgactcactataggggctttcttgttagtcttagacagcggggttaacagaggagaaaccccatggtctaagacaacctggcggcagcgcaaaagatg

SEQ ID NO: 208243 - DNA, 103 bp, Artificial Sequence
  Synthetic Polynucleotide
taatacgactcactatagggcttcttccttgctttcttgttagtcttagaaacagaggagatctaagatgaacaagaaaaacctggcggcagcgcaaaagatg

SEQ ID NO: 208244 - DNA, 103 bp, Artificial Sequence
  Synthetic Polynucleotide
taatacgactcactatagggcaggaaggctcttcttccttgctttcttgtaacagaggagaacaagaatgcaaggaagaaacctggcggcagcgcaaaagatg

SEQ ID NO: 208245 - DNA, 103 bp, Artificial Sequence
  Synthetic Polynucleotide
taatacgactcactatagggggctgggaggcaggaaggctcttcttccttaacagaggagaaaggaaatggagccttccaacctggcggcagcgcaaaagatg

SEQ ID NO: 208246 - DNA, 103 bp, Artificial Sequence
  Synthetic Polynucleotide
taatacgactcactatagggagccacagggggctgggaggcaggaaggctaacagaggagaagccttatggcctcccagaacctggcggcagcgcaaaagatg

SEQ ID NO: 208247 - DNA, 103 bp, Artificial Sequence
  Synthetic Polynucleotide
taatacgactcactataggggctcagccacagccacagggggctgggaggaacagaggagacctcccatgcccctgtggaacctggcggcagcgcaaaagatg

SEQ ID NO: 208248 - DNA, 103 bp, Artificial Sequence
  Synthetic Polynucleotide
taatacgactcactataggggtctccacctgctcagccacagccacagggaacagaggagaccctgtatgtgtggctgaaacctggcggcagcgcaaaagatg

SEQ ID NO: 208249 - DNA, 103 bp, Artificial Sequence
  Synthetic Polynucleotide
taatacgactcactataggggatcagcaccgtctccacctgctcagccacaacagaggagagtggctatgcaggtggagaacctggcggcagcgcaaaagatg

SEQ ID NO: 208250 - DNA, 103 bp, Artificial Sequence
  Synthetic Polynucleotide
taatacgactcactataggggagatggctgggagtcctgggtggtggaggaacagaggagacctccaatgcccaggactaacctggcggcagcgcaaaagatg

SEQ ID NO: 208251 - DNA, 103 bp, Artificial Sequence
  Synthetic Polynucleotide
taatacgactcactatagggcggtggtctcgatcagcaccgtctccacctaacagaggagaaggtggatgcggtgctgaaacctggcggcagcgcaaaagatg

SEQ ID NO: 208252 - DNA, 103 bp, Artificial Sequence
  Synthetic Polynucleotide
taatacgactcactatagggatgttgtccgcggtggtctcgatcagcaccaacagaggagaggtgctatgcgagaccacaacctggcggcagcgcaaaagatg

SEQ ID NO: 208253 - DNA, 103 bp, Artificial Sequence
  Synthetic Polynucleotide
taatacgactcactatagggtgcctggatgatgttgtccgcggtggtctcaacagaggagagagaccatggcggacaacaacctggcggcagcgcaaaagatg

SEQ ID NO: 208254 - DNA, 103 bp, Artificial Sequence
  Synthetic Polynucleotide
taatacgactcactatagggggttatttcctgcctggatgatgttgtccgaacagaggagacggacaatgtcatccaggaacctggcggcagcgcaaaagatg

SEQ ID NO: 208255 - DNA, 103 bp, Artificial Sequence
  Synthetic Polynucleotide
taatacgactcactatagggacaatgagcaggttatttcctgcctggatgaacagaggagacatccaatgaggaaataaaacctggcggcagcgcaaaagatg

SEQ ID NO: 208256 - DNA, 103 bp, Artificial Sequence
  Synthetic Polynucleotide
taatacgactcactatagggagggctctgaacaatgagcaggttatttccaacagaggagaggaaatatgctgctcattaacctggcggcagcgcaaaagatg

SEQ ID NO: 208257 - DNA, 103 bp, Artificial Sequence
  Synthetic Polynucleotide
taatacgactcactatagggggcccccaccagggctctgaacaatgagcaaacagaggagatgctcaatgttcagagccaacctggcggcagcgcaaaagatg

SEQ ID NO: 208258 - DNA, 103 bp, Artificial Sequence
  Synthetic Polynucleotide
taatacgactcactatagggacagctggctggcccccaccagggctctgaaacagaggagatcagagatgtggtgggggaacctggcggcagcgcaaaagatg

SEQ ID NO: 208259 - DNA, 103 bp, Artificial Sequence
  Synthetic Polynucleotide
taatacgactcactatagggctgctggaccacagctggctggcccccaccaacagaggagaggtgggatgcagccagctaacctggcggcagcgcaaaagatg

SEQ ID NO: 208260 - DNA, 103 bp, Artificial Sequence
  Synthetic Polynucleotide
taatacgactcactatagggccacctggacctgctggaccacagctggctaacagaggagaagccagatgtggtccagcaacctggcggcagcgcaaaagatg

SEQ ID NO: 208261 - DNA, 103 bp, Artificial Sequence
  Synthetic Polynucleotide
taatacgactcactatagggagggctaagggagatggctgggagtcctggaacagaggagaccaggaatgccagccatcaacctggcggcagcgcaaaagatg

SEQ ID NO: 208262 - DNA, 103 bp, Artificial Sequence
  Synthetic Polynucleotide
taatacgactcactatagggttggggggcaccacctggacctgctggaccaacagaggagaggtccaatgggtccaggtaacctggcggcagcgcaaaagatg

SEQ ID NO: 208263 - DNA, 103 bp, Artificial Sequence
  Synthetic Polynucleotide
taatacgactcactatagggctgctcggccttggggggcaccacctggacaacagaggagagtccagatggtgccccccaacctggcggcagcgcaaaagatg

SEQ ID NO: 208264 - DNA, 103 bp, Artificial Sequence
  Synthetic Polynucleotide
taatacgactcactatagggccacctgctgctgctcggccttggggggcaaacagaggagatgccccatgaggccgagcaacctggcggcagcgcaaaagatg

SEQ ID NO: 208265 - DNA, 103 bp, Artificial Sequence
  Synthetic Polynucleotide
taatacgactcactataggggggatctgtaccacctgctgctgctcggccaacagaggagaggccgaatggcagcaggtaacctggcggcagcgcaaaagatg

SEQ ID NO: 208266 - DNA, 103 bp, Artificial Sequence
  Synthetic Polynucleotide
taatacgactcactatagggagcctgctgggggatctgtaccacctgctgaacagaggagacagcagatggtacagatcaacctggcggcagcgcaaaagatg

SEQ ID NO: 208267 - DNA, 103 bp, Artificial Sequence
  Synthetic Polynucleotide
taatacgactcactatagggccacccgcagagcctgctgggggatctgtaaacagaggagatacagaatgcccagcaggaacctggcggcagcgcaaaagatg

SEQ ID NO: 208268 - DNA, 103 bp, Artificial Sequence
  Synthetic Polynucleotide
taatacgactcactataggggccgcctgcaccacccgcagagcctgctggaacagaggagaccagcaatgtctgcgggtaacctggcggcagcgcaaaagatg

SEQ ID NO: 208269 - DNA, 103 bp, Artificial Sequence
  Synthetic Polynucleotide
taatacgactcactatagggggtggcagatgccgcctgcaccacccgcagaacagaggagactgcggatggtgcaggcgaacctggcggcagcgcaaaagatg

SEQ ID NO: 208270 - DNA, 103 bp, Artificial Sequence
  Synthetic Polynucleotide
taatacgactcactatagggcagtggggagggtggcagatgccgcctgcaaacagaggagatgcaggatgcatctgccaaacctggcggcagcgcaaaagatg

SEQ ID NO: 208271 - DNA, 103 bp, Artificial Sequence
  Synthetic Polynucleotide
taatacgactcactatagggttctggggtacagtggggagggtggcagataacagaggagaatctgcatgcctccccacaacctggcggcagcgcaaaagatg

SEQ ID NO: 208272 - DNA, 103 bp, Artificial Sequence
  Synthetic Polynucleotide
taatacgactcactatagggttgtttcacgggcttttcgggagcggtcataacagaggagaatgaccatgcccgaaaagaacctggcggcagcgcaaaagatg

SEQ ID NO: 208273 - DNA, 103 bp, Artificial Sequence
  Synthetic Polynucleotide
taatacgactcactataggggtgctgttgctgctgctgcagatactcgccaacagaggagaggcgagatgctgcagcagaacctggcggcagcgcaaaagatg

SEQ ID NO: 208274 - DNA, 103 bp, Artificial Sequence
  Synthetic Polynucleotide
taatacgactcactatagggaggcaactgtgatgaagaggatgttggcacaacagaggagagtgccaatgtcctcttcaaacctggcggcagcgcaaaagatg

SEQ ID NO: 208275 - DNA, 103 bp, Artificial Sequence
  Synthetic Polynucleotide
taatacgactcactatagggctatcgtaacaggcaactgtgatgaagaggaacagaggagacctcttatgcacagttgcaacctggcggcagcgcaaaagatg

SEQ ID NO: 208276 - DNA, 103 bp, Artificial Sequence
  Synthetic Polynucleotide
taatacgactcactatagggcctgtactatctatcgtaacaggcaactgtaacagaggagaacagttatgtgttacgataacctggcggcagcgcaaaagatg

SEQ ID NO: 208277 - DNA, 103 bp, Artificial Sequence
  Synthetic Polynucleotide
taatacgactcactatagggttgtaatatacctgtactatctatcgtaacaacagaggagagttacgatggatagtacaaacctggcggcagcgcaaaagatg

SEQ ID NO: 208278 - DNA, 103 bp, Artificial Sequence
  Synthetic Polynucleotide
taatacgactcactatagggttgtgttttgttgtaatatacctgtactataacagaggagaatagtaatggtatattacaacctggcggcagcgcaaaagatg

SEQ ID NO: 208279 - DNA, 103 bp, Artificial Sequence
  Synthetic Polynucleotide
taatacgactcactataggggtcaagctatttgtgttttgttgtaatataaacagaggagatatattatgacaaaacacaacctggcggcagcgcaaaagatg

SEQ ID NO: 208280 - DNA, 103 bp, Artificial Sequence
  Synthetic Polynucleotide
taatacgactcactatagggactagatgtagtcaagctatttgtgttttgaacagaggagacaaaacatgaatagcttgaacctggcggcagcgcaaaagatg

SEQ ID NO: 208281 - DNA, 103 bp, Artificial Sequence
  Synthetic Polynucleotide
taatacgactcactataggggaacctgcccactagatgtagtcaagctataacagaggagaatagctatgctacatctaaacctggcggcagcgcaaaagatg

SEQ ID NO: 208282 - DNA, 103 bp, Artificial Sequence
  Synthetic Polynucleotide
taatacgactcactatagggtctgaagaatgaacctgcccactagatgtaaacagaggagatacatcatgtgggcaggtaacctggcggcagcgcaaaagatg

SEQ ID NO: 208283 - DNA, 103 bp, Artificial Sequence
  Synthetic Polynucleotide
taatacgactcactatagggtccctgaagatctgaagaatgaacctgcccaacagaggagagggcagatgcattcttcaaacctggcggcagcgcaaaagatg

SEQ ID NO: 208284 - DNA, 103 bp, Artificial Sequence
  Synthetic Polynucleotide
taatacgactcactatagggcaccgtttccgtgctgttgctgctgctgcaaacagaggagatgcagcatgagcaacagcaacctggcggcagcgcaaaagatg

SEQ ID NO: 208285 - DNA, 103 bp, Artificial Sequence
  Synthetic Polynucleotide
taatacgactcactatagggggatataatttccctgaagatctgaagaataacagaggagaattcttatgatcttcaggaacctggcggcagcgcaaaagatg

SEQ ID NO: 208286 - DNA, 103 bp, Artificial Sequence
  Synthetic Polynucleotide
taatacgactcactatagggacaggcgactggatataatttccctgaagaaacagaggagatcttcaatgaaattatataacctggcggcagcgcaaaagatg

SEQ ID NO: 208287 - DNA, 103 bp, Artificial Sequence
  Synthetic Polynucleotide
taatacgactcactatagggctcttcagaaacaggcgactggatataattaacagaggagaaattatatgcagtcgcctaacctggcggcagcgcaaaagatg

SEQ ID NO: 208288 - DNA, 103 bp, Artificial Sequence
  Synthetic Polynucleotide
taatacgactcactataggggtgcctgtgtctcttcagaaacaggcgactaacagaggagaagtcgcatgtttctgaagaacctggcggcagcgcaaaagatg

SEQ ID NO: 208289 - DNA, 103 bp, Artificial Sequence
  Synthetic Polynucleotide
taatacgactcactatagggtgaatattctgtgcctgtgtctcttcagaaaacagaggagattctgaatggacacaggcaacctggcggcagcgcaaaagatg

SEQ ID NO: 208290 - DNA, 103 bp, Artificial Sequence
  Synthetic Polynucleotide
taatacgactcactatagggtgtagaaacctgaatattctgtgcctgtgtaacagaggagaacacagatgcagaatattaacctggcggcagcgcaaaagatg

SEQ ID NO: 208291 - DNA, 103 bp, Artificial Sequence
  Synthetic Polynucleotide
taatacgactcactatagggcaggctgtgctgtagaaacctgaatattctaacagaggagaagaataatgaggtttctaaacctggcggcagcgcaaaagatg

SEQ ID NO: 208292 - DNA, 103 bp, Artificial Sequence
  Synthetic Polynucleotide
taatacgactcactatagggtgctgtacaacaggctgtgctgtagaaaccaacagaggagaggtttcatgagcacagccaacctggcggcagcgcaaaagatg

SEQ ID NO: 208293 - DNA, 103 bp, Artificial Sequence
  Synthetic Polynucleotide
taatacgactcactatagggaagttgtagatgctgtacaacaggctgtgcaacagaggagagcacagatggttgtacagaacctggcggcagcgcaaaagatg

SEQ ID NO: 208294 - DNA, 103 bp, Artificial Sequence
  Synthetic Polynucleotide
taatacgactcactataggggagactcttgaagttgtagatgctgtacaaaacagaggagattgtacatgatctacaacaacctggcggcagcgcaaaagatg

SEQ ID NO: 208295 - DNA, 103 bp, Artificial Sequence
  Synthetic Polynucleotide
taatacgactcactataggggccgccaccgcaccgtttccgtgctgttgcaacagaggagagcaacaatgcggaaacggaacctggcggcagcgcaaaagatg

SEQ ID NO: 208296 - DNA, 103 bp, Artificial Sequence
  Synthetic Polynucleotide
taatacgactcactataggggttggctgctgagactcttgaagttgtagaaacagaggagatctacaatgtcaagagtcaacctggcggcagcgcaaaagatg

SEQ ID NO: 208297 - DNA, 103 bp, Artificial Sequence
  Synthetic Polynucleotide
taatacgactcactatagggggcttgactggttggctgctgagactcttgaacagaggagacaagagatgcagcagccaaacctggcggcagcgcaaaagatg

SEQ ID NO: 208298 - DNA, 103 bp, Artificial Sequence
  Synthetic Polynucleotide
taatacgactcactataggggcacaatttgggcttgactggttggctgctaacagaggagaagcagcatgccagtcaagaacctggcggcagcgcaaaagatg

SEQ ID NO: 208299 - DNA, 103 bp, Artificial Sequence
  Synthetic Polynucleotide
taatacgactcactataggggtaataccttgcacaatttgggcttgactgaacagaggagacagtcaatgccaaattgtaacctggcggcagcgcaaaagatg

SEQ ID NO: 208300 - DNA, 103 bp, Artificial Sequence
  Synthetic Polynucleotide
taatacgactcactatagggtgtctgtggtgtaataccttgcacaatttgaacagaggagacaaattatgcaaggtattaacctggcggcagcgcaaaagatg

SEQ ID NO: 208301 - DNA, 103 bp, Artificial Sequence
  Synthetic Polynucleotide
taatacgactcactatagggcaccatggattgtctgtggtgtaataccttaacagaggagaaaggtaatgcaccacagaaacctggcggcagcgcaaaagatg

SEQ ID NO: 208302 - DNA, 103 bp, Artificial Sequence
  Synthetic Polynucleotide
taatacgactcactatagggctggcttgcacaccatggattgtctgtggtaacagaggagaaccacaatgaatccatggaacctggcggcagcgcaaaagatg

SEQ ID NO: 208303 - DNA, 103 bp, Artificial Sequence
  Synthetic Polynucleotide
taatacgactcactatagggattttgaccactggcttgcacaccatggataacagaggagaatccatatggtgcaagccaacctggcggcagcgcaaaagatg

SEQ ID NO: 208304 - DNA, 103 bp, Artificial Sequence
  Synthetic Polynucleotide
taatacgactcactataggggttgtgatatattttgaccactggcttgcaaacagaggagatgcaagatggtggtcaaaaacctggcggcagcgcaaaagatg

SEQ ID NO: 208305 - DNA, 103 bp, Artificial Sequence
  Synthetic Polynucleotide
taatacgactcactatagggtgcaaagcctgttgtgatatattttgaccaaacagaggagatggtcaatgtatatcacaaacctggcggcagcgcaaaagatg

SEQ ID NO: 208306 - DNA, 103 bp, Artificial Sequence
  Synthetic Polynucleotide
taatacgactcactatagggcgccgctgccgccgccaccgcaccgtttccaacagaggagaggaaacatggcggtggcgaacctggcggcagcgcaaaagatg

SEQ ID NO: 208307 - DNA, 103 bp, Artificial Sequence
  Synthetic Polynucleotide
taatacgactcactatagggctgaagattttgcaaagcctgttgtgatataacagaggagaatatcaatgcaggctttgaacctggcggcagcgcaaaagatg

SEQ ID NO: 208308 - DNA, 103 bp, Artificial Sequence
  Synthetic Polynucleotide
taatacgactcactatagggtcagctgcaactgaagattttgcaaagcctaacagaggagaaggcttatgaaaatcttcaacctggcggcagcgcaaaagatg

SEQ ID NO: 208309 - DNA, 103 bp, Artificial Sequence
  Synthetic Polynucleotide
taatacgactcactataggggttccaggattcagctgcaactgaagatttaacagaggagaaaatctatggttgcagctaacctggcggcagcgcaaaagatg

SEQ ID NO: 208310 - DNA, 103 bp, Artificial Sequence
  Synthetic Polynucleotide
taatacgactcactatagggaattaaaaaggttccaggattcagctgcaaaacagaggagattgcagatgaatcctggaaacctggcggcagcgcaaaagatg

SEQ ID NO: 208311 - DNA, 103 bp, Artificial Sequence
  Synthetic Polynucleotide
taatacgactcactatagggtctgtgcctgaattaaaaaggttccaggataacagaggagaatcctgatgcctttttaaaacctggcggcagcgcaaaagatg

SEQ ID NO: 208312 - DNA, 103 bp, Artificial Sequence
  Synthetic Polynucleotide
taatacgactcactatagggggggtcactgtctgtgcctgaattaaaaagaacagaggagactttttatgtcaggcacaaacctggcggcagcgcaaaagatg

SEQ ID NO: 208313 - DNA, 103 bp, Artificial Sequence
  Synthetic Polynucleotide
taatacgactcactatagggctgtccagaaggggtcactgtctgtgcctgaacagaggagacaggcaatgacagtgaccaacctggcggcagcgcaaaagatg

SEQ ID NO: 208314 - DNA, 103 bp, Artificial Sequence
  Synthetic Polynucleotide
taatacgactcactataggggccaagttacctgtccagaaggggtcactgaacagaggagacagtgaatgcttctggacaacctggcggcagcgcaaaagatg

SEQ ID NO: 208315 - DNA, 103 bp, Artificial Sequence
  Synthetic Polynucleotide
taatacgactcactatagggtgaaacgtttgccaagttacctgtccagaaaacagaggagattctggatgggtaacttgaacctggcggcagcgcaaaagatg

SEQ ID NO: 208316 - DNA, 103 bp, Artificial Sequence
  Synthetic Polynucleotide
taatacgactcactatagggcccttgtacttgaaacgtttgccaagttacaacagaggagagtaactatgcaaacgtttaacctggcggcagcgcaaaagatg

SEQ ID NO: 208317 - DNA, 103 bp, Artificial Sequence
  Synthetic Polynucleotide
taatacgactcactatagggtgtcctgggccgccgctgccgccgccaccgaacagaggagacggtggatgcggcagcggaacctggcggcagcgcaaaagatg

SEQ ID NO: 208318 - DNA, 103 bp, Artificial Sequence
  Synthetic Polynucleotide
taatacgactcactatagggagttctggaccccttgtacttgaaacgtttaacagaggagaaaacgtatgaagtacaagaacctggcggcagcgcaaaagatg

SEQ ID NO: 208319 - DNA, 103 bp, Artificial Sequence
  Synthetic Polynucleotide
taatacgactcactatagggaaattctgcaagttctggaccccttgtactaacagaggagaagtacaatgggtccagaaaacctggcggcagcgcaaaagatg

SEQ ID NO: 208320 - DNA, 103 bp, Artificial Sequence
  Synthetic Polynucleotide
taatacgactcactatagggctgtatttgcaaattctgcaagttctggacaacagaggagagtccagatgttgcagaataacctggcggcagcgcaaaagatg

SEQ ID NO: 208321 - DNA, 103 bp, Artificial Sequence
  Synthetic Polynucleotide
taatacgactcactatagggcagcagtattctgtatttgcaaattctgcaaacagaggagatgcagaatgtgcaaatacaacctggcggcagcgcaaaagatg

SEQ ID NO: 208322 - DNA, 103 bp, Artificial Sequence
  Synthetic Polynucleotide
taatacgactcactatagggatttgttgggcagcagtattctgtatttgcaacagaggagagcaaatatggaatactgcaacctggcggcagcgcaaaagatg

SEQ ID NO: 208323 - DNA, 103 bp, Artificial Sequence
  Synthetic Polynucleotide
taatacgactcactatagggcgtcaaagttatttgttgggcagcagtattaacagaggagaaatactatggcccaacaaaacctggcggcagcgcaaaagatg

SEQ ID NO: 208324 - DNA, 103 bp, Artificial Sequence
  Synthetic Polynucleotide
taatacgactcactatagggtttgaacaggcgtcaaagttatttgttgggaacagaggagacccaacatgtaactttgaaacctggcggcagcgcaaaagatg

SEQ ID NO: 208325 - DNA, 103 bp, Artificial Sequence
  Synthetic Polynucleotide
taatacgactcactatagggagtgtgagggtttgaacaggcgtcaaagttaacagaggagaaactttatggcctgttcaaacctggcggcagcgcaaaagatg

SEQ ID NO: 208326 - DNA, 103 bp, Artificial Sequence
  Synthetic Polynucleotide
taatacgactcactatagggaacttgaccaagtgtgagggtttgaacaggaacagaggagacctgttatgaccctcacaaacctggcggcagcgcaaaagatg

SEQ ID NO: 208327 - DNA, 103 bp, Artificial Sequence
  Synthetic Polynucleotide
taatacgactcactatagggcacctgccgcaacttgaccaagtgtgagggaacagaggagaccctcaatgttggtcaagaacctggcggcagcgcaaaagatg

SEQ ID NO: 208328 - DNA, 103 bp, Artificial Sequence
  Synthetic Polynucleotide
taatacgactcactataggggacggctgagtgtcctgggccgccgctgccaacagaggagaggcagcatgggcccaggaaacctggcggcagcgcaaaagatg

SEQ ID NO: 208329 - DNA, 103 bp, Artificial Sequence
  Synthetic Polynucleotide
taatacgactcactataggggtgaaggctccacctgccgcaacttgaccaaacagaggagatggtcaatgtgcggcaggaacctggcggcagcgcaaaagatg

SEQ ID NO: 208330 - DNA, 103 bp, Artificial Sequence
  Synthetic Polynucleotide
taatacgactcactatagggtggagttgaagtgaaggctccacctgccgcaacagaggagagcggcaatgggagccttcaacctggcggcagcgcaaaagatg

SEQ ID NO: 208331 - DNA, 103 bp, Artificial Sequence
  Synthetic Polynucleotide
taatacgactcactatagggttagactaactggagttgaagtgaaggctcaacagaggagagagcctatgcttcaactcaacctggcggcagcgcaaaagatg

SEQ ID NO: 208332 - DNA, 103 bp, Artificial Sequence
  Synthetic Polynucleotide
taatacgactcactatagggtgaccagtgcttagactaactggagttgaaaacagaggagattcaacatgagttagtctaacctggcggcagcgcaaaagatg

SEQ ID NO: 208333 - DNA, 103 bp, Artificial Sequence
  Synthetic Polynucleotide
taatacgactcactatagggatttggcaactgaccagtgcttagactaacaacagaggagagttagtatgagcactggtaacctggcggcagcgcaaaagatg

SEQ ID NO: 208334 - DNA, 103 bp, Artificial Sequence
  Synthetic Polynucleotide
taatacgactcactatagggctgtttgtagatttggcaactgaccagtgcaacagaggagagcactgatgagttgccaaaacctggcggcagcgcaaaagatg

SEQ ID NO: 208335 - DNA, 103 bp, Artificial Sequence
  Synthetic Polynucleotide
taatacgactcactatagggttcactgtaactgtttgtagatttggcaacaacagaggagagttgccatgtctacaaacaacctggcggcagcgcaaaagatg

SEQ ID NO: 208336 - DNA, 103 bp, Artificial Sequence
  Synthetic Polynucleotide
taatacgactcactatagggatctatagagttcactgtaactgtttgtagaacagaggagactacaaatggttacagtgaacctggcggcagcgcaaaagatg

SEQ ID NO: 208337 - DNA, 103 bp, Artificial Sequence
  Synthetic Polynucleotide
taatacgactcactatagggtaccagcagaatctatagagttcactgtaaaacagaggagattacagatgactctatagaacctggcggcagcgcaaaagatg

SEQ ID NO: 208338 - DNA, 103 bp, Artificial Sequence
  Synthetic Polynucleotide
taatacgactcactatagggtgtagctgtataccagcagaatctatagagaacagaggagactctatatgttctgctggaacctggcggcagcgcaaaagatg

SEQ ID NO: 208339 - DNA, 103 bp, Artificial Sequence
  Synthetic Polynucleotide
taatacgactcactatagggagcgagcggtgacggctgagtgtcctgggcaacagaggagagcccagatgactcagccgaacctggcggcagcgcaaaagatg

SEQ ID NO: 208340 - DNA, 103 bp, Artificial Sequence
  Synthetic Polynucleotide
taatacgactcactatagggctctcctggatgtagctgtataccagcagaaacagaggagatctgctatgatacagctaaacctggcggcagcgcaaaagatg

SEQ ID NO: 208341 - DNA, 103 bp, Artificial Sequence
  Synthetic Polynucleotide
taatacgactcactatagggtgtcagcattctctcctggatgtagctgtaaacagaggagatacagcatgatccaggagaacctggcggcagcgcaaaagatg

SEQ ID NO: 208342 - DNA, 103 bp, Artificial Sequence
  Synthetic Polynucleotide
taatacgactcactatagggtctgcaggactgtcagcattctctcctggaaacagaggagatccaggatggaatgctgaaacctggcggcagcgcaaaagatg

SEQ ID NO: 208343 - DNA, 103 bp, Artificial Sequence
  Synthetic Polynucleotide
taatacgactcactataggggatcctaatatctgcaggactgtcagcattaacagaggagaaatgctatgagtcctgcaaacctggcggcagcgcaaaagatg

SEQ ID NO: 208344 - DNA, 103 bp, Artificial Sequence
  Synthetic Polynucleotide
taatacgactcactatagggcttcttccttgatcctaatatctgcaggacaacagaggagagtcctgatgatattaggaaacctggcggcagcgcaaaagatg

SEQ ID NO: 208345 - DNA, 103 bp, Artificial Sequence
  Synthetic Polynucleotide
taatacgactcactatagggggatcaggttcttcttccttgatcctaataaacagaggagatattagatgcaaggaagaaacctggcggcagcgcaaaagatg

SEQ ID NO: 208346 - DNA, 103 bp, Artificial Sequence
  Synthetic Polynucleotide
taatacgactcactatagggccactcttcaggatcaggttcttcttccttaacagaggagaaaggaaatggaacctgataacctggcggcagcgcaaaagatg

SEQ ID NO: 208347 - DNA, 103 bp, Artificial Sequence
  Synthetic Polynucleotide
taatacgactcactatagggcactgagctgccactcttcaggatcaggttaacagaggagaaacctgatgctgaagagtaacctggcggcagcgcaaaagatg

SEQ ID NO: 208348 - DNA, 103 bp, Artificial Sequence
  Synthetic Polynucleotide
taatacgactcactataggggtagaatcaccactgagctgccactcttcaaacagaggagatgaagaatggcagctcagaacctggcggcagcgcaaaagatg

SEQ ID NO: 208349 - DNA, 103 bp, Artificial Sequence
  Synthetic Polynucleotide
taatacgactcactatagggggtattcaaggtagaatcaccactgagctgaacagaggagacagctcatgggtgattctaacctggcggcagcgcaaaagatg

SEQ ID NO: 208350 - DNA, 103 bp, Artificial Sequence
  Synthetic Polynucleotide
taatacgactcactatagggcggccagcagagcgagcggtgacggctgagaacagaggagactcagcatgcaccgctcgaacctggcggcagcgcaaaagatg

SEQ ID NO: 208351 - DNA, 103 bp, Artificial Sequence
  Synthetic Polynucleotide
taatacgactcactatagggttaggtcattggtattcaaggtagaatcacaacagaggagagtgattatgccttgaataaacctggcggcagcgcaaaagatg

SEQ ID NO: 208352 - DNA, 103 bp, Artificial Sequence
  Synthetic Polynucleotide
taatacgactcactatagggcttaagtgtgttaggtcattggtattcaagaacagaggagacttgaaatgcaatgacctaacctggcggcagcgcaaaagatg

SEQ ID NO: 208353 - DNA, 103 bp, Artificial Sequence
  Synthetic Polynucleotide
taatacgactcactatagggcacctgtactcttaagtgtgttaggtcattaacagaggagaaatgacatgacacacttaaacctggcggcagcgcaaaagatg

SEQ ID NO: 208354 - DNA, 103 bp, Artificial Sequence
  Synthetic Polynucleotide
taatacgactcactatagggcttcatctaccacctgtactcttaagtgtgaacagaggagacacactatggagtacaggaacctggcggcagcgcaaaagatg

SEQ ID NO: 208355 - DNA, 103 bp, Artificial Sequence
  Synthetic Polynucleotide
taatacgactcactatagggtggtccccttcttcatctaccacctgtactaacagaggagaagtacaatgggtagatgaaacctggcggcagcgcaaaagatg

SEQ ID NO: 208356 - DNA, 103 bp, Artificial Sequence
  Synthetic Polynucleotide
taatacgactcactatagggttgatgttgttggtccccttcttcatctacaacagaggagagtagatatggaaggggacaacctggcggcagcgcaaaagatg

SEQ ID NO: 208357 - DNA, 103 bp, Artificial Sequence
  Synthetic Polynucleotide
taatacgactcactatagggtttttccttcttgatgttgttggtccccttaacagaggagaaaggggatgaacaacatcaacctggcggcagcgcaaaagatg

SEQ ID NO: 208358 - DNA, 103 bp, Artificial Sequence
  Synthetic Polynucleotide
taatacgactcactatagggctccgaagtctttttccttcttgatgttgtaacagaggagaacaacaatgagaaggaaaaacctggcggcagcgcaaaagatg

SEQ ID NO: 208359 - DNA, 103 bp, Artificial Sequence
  Synthetic Polynucleotide
taatacgactcactataggggcaagctaccctccgaagtctttttccttcaacagaggagagaaggaatgagacttcggaacctggcggcagcgcaaaagatg

SEQ ID NO: 208360 - DNA, 103 bp, Artificial Sequence
  Synthetic Polynucleotide
taatacgactcactatagggtgggacaggtgcaagctaccctccgaagtcaacagaggagagacttcatggggtagcttaacctggcggcagcgcaaaagatg

SEQ ID NO: 208361 - DNA, 103 bp, Artificial Sequence
  Synthetic Polynucleotide
taatacgactcactatagggctgcaggtagcggccagcagagcgagcggtaacagaggagaaccgctatgtctgctggcaacctggcggcagcgcaaaagatg

SEQ ID NO: 208362 - DNA, 103 bp, Artificial Sequence
  Synthetic Polynucleotide
taatacgactcactatagggtctttacagttgggacaggtgcaagctaccaacagaggagaggtagcatgcacctgtccaacctggcggcagcgcaaaagatg

SEQ ID NO: 208363 - DNA, 103 bp, Artificial Sequence
  Synthetic Polynucleotide
taatacgactcactatagggtccaccaccttctttacagttgggacaggtaacagaggagaacctgtatgaactgtaaaaacctggcggcagcgcaaaagatg

SEQ ID NO: 208364 - DNA, 103 bp, Artificial Sequence
  Synthetic Polynucleotide
taatacgactcactatagggtggtacctcttccaccaccttctttacagtaacagaggagaactgtaatgaaggtggtgaacctggcggcagcgcaaaagatg

SEQ ID NO: 208365 - DNA, 103 bp, Artificial Sequence
  Synthetic Polynucleotide
taatacgactcactatagggttcccaagattggtacctcttccaccacctaacagaggagaaggtggatgaagaggtacaacctggcggcagcgcaaaagatg

SEQ ID NO: 208366 - DNA, 103 bp, Artificial Sequence
  Synthetic Polynucleotide
taatacgactcactatagggttgcttctttttcccaagattggtacctctaacagaggagaagaggtatgaatcttgggaacctggcggcagcgcaaaagatg

SEQ ID NO: 208367 - DNA, 103 bp, Artificial Sequence
  Synthetic Polynucleotide
taatacgactcactataggggacaaatgtgttgcttctttttcccaagataacagaggagaatcttgatgaaaagaagcaacctggcggcagcgcaaaagatg

SEQ ID NO: 208368 - DNA, 103 bp, Artificial Sequence
  Synthetic Polynucleotide
taatacgactcactatagggcctggtatatgacaaatgtgttgcttctttaacagaggagaaaagaaatgacacatttgaacctggcggcagcgcaaaagatg

SEQ ID NO: 208369 - DNA, 103 bp, Artificial Sequence
  Synthetic Polynucleotide
taatacgactcactatagggtttaccacatcctggtatatgacaaatgtgaacagaggagacacattatgcatataccaaacctggcggcagcgcaaaagatg

SEQ ID NO: 208370 - DNA, 103 bp, Artificial Sequence
  Synthetic Polynucleotide
taatacgactcactatagggtcccatagactttaccacatcctggtatataacagaggagaatatacatggatgtggtaaacctggcggcagcgcaaaagatg

SEQ ID NO: 208371 - DNA, 103 bp, Artificial Sequence
  Synthetic Polynucleotide
taatacgactcactatagggtgtgaggtcttcccatagactttaccacataacagaggagaatgtggatgagtctatggaacctggcggcagcgcaaaagatg

SEQ ID NO: 208372 - DNA, 103 bp, Artificial Sequence
  Synthetic Polynucleotide
taatacgactcactatagggccctatcttgctgcaggtagcggccagcagaacagaggagactgctgatggctacctgcaacctggcggcagcgcaaaagatg

SEQ ID NO: 208373 - DNA, 103 bp, Artificial Sequence
  Synthetic Polynucleotide
taatacgactcactatagggagctctcagatgtgaggtcttcccatagacaacagaggagagtctatatgaagacctcaaacctggcggcagcgcaaaagatg

SEQ ID NO: 208374 - DNA, 103 bp, Artificial Sequence
  Synthetic Polynucleotide
taatacgactcactatagggaacgcagatgagctctcagatgtgaggtctaacagaggagaagacctatgatctgagagaacctggcggcagcgcaaaagatg

SEQ ID NO: 208375 - DNA, 103 bp, Artificial Sequence
  Synthetic Polynucleotide
taatacgactcactatagggccagaatgccaacgcagatgagctctcagaaacagaggagatctgagatgtcatctgcgaacctggcggcagcgcaaaagatg

SEQ ID NO: 208376 - DNA, 103 bp, Artificial Sequence
  Synthetic Polynucleotide
taatacgactcactatagggagggcgttctccagaatgccaacgcagatgaacagaggagacatctgatgtggcattctaacctggcggcagcgcaaaagatg

SEQ ID NO: 208377 - DNA, 103 bp, Artificial Sequence
  Synthetic Polynucleotide
taatacgactcactatagggtacaaacaaaagggcgttctccagaatgccaacagaggagaggcattatggagaacgccaacctggcggcagcgcaaaagatg

SEQ ID NO: 208378 - DNA, 103 bp, Artificial Sequence
  Synthetic Polynucleotide
taatacgactcactatagggtacatccagttacaaacaaaagggcgttctaacagaggagaagaacgatgttttgtttgaacctggcggcagcgcaaaagatg

SEQ ID NO: 208379 - DNA, 103 bp, Artificial Sequence
  Synthetic Polynucleotide
taatacgactcactatagggtttaccacagtacatccagttacaaacaaaaacagaggagatttgttatgaactggatgaacctggcggcagcgcaaaagatg

SEQ ID NO: 208380 - DNA, 103 bp, Artificial Sequence
  Synthetic Polynucleotide
taatacgactcactataggggagtaaatcttttaccacagtacatccagtaacagaggagaactggaatgactgtggtaaacctggcggcagcgcaaaagatg

SEQ ID NO: 208381 - DNA, 103 bp, Artificial Sequence
  Synthetic Polynucleotide
taatacgactcactatagggtcatcacttcgagtaaatcttttaccacagaacagaggagactgtggatgaagatttacaacctggcggcagcgcaaaagatg

SEQ ID NO: 208382 - DNA, 103 bp, Artificial Sequence
  Synthetic Polynucleotide
taatacgactcactatagggcctctgtaattcatcacttcgagtaaatctaacagaggagaagatttatgcgaagtgataacctggcggcagcgcaaaagatg

SEQ ID NO: 208383 - DNA, 103 bp, Artificial Sequence
  Synthetic Polynucleotide
taatacgactcactatagggccatttcctcttgtttcacgggcttttcggaacagaggagaccgaaaatgccgtgaaacaacctggcggcagcgcaaaagatg

SEQ ID NO: 208384 - DNA, 103 bp, Artificial Sequence
  Synthetic Polynucleotide
taatacgactcactataggggcgatggcggccctatcttgctgcaggtagaacagaggagactacctatggcaagatagaacctggcggcagcgcaaaagatg

SEQ ID NO: 208385 - DNA, 103 bp, Artificial Sequence
  Synthetic Polynucleotide
taatacgactcactatagggttcttctgtgcctctgtaattcatcacttcaacagaggagagaagtgatgaattacagaaacctggcggcagcgcaaaagatg

SEQ ID NO: 208386 - DNA, 103 bp, Artificial Sequence
  Synthetic Polynucleotide
taatacgactcactatagggcctgtatgtgttcttctgtgcctctgtaataacagaggagaattacaatggcacagaagaacctggcggcagcgcaaaagatg

SEQ ID NO: 208387 - DNA, 103 bp, Artificial Sequence
  Synthetic Polynucleotide
taatacgactcactatagggtttcttctcacctgtatgtgttcttctgtgaacagaggagacacagaatgacacatacaaacctggcggcagcgcaaaagatg

SEQ ID NO: 208388 - DNA, 103 bp, Artificial Sequence
  Synthetic Polynucleotide
taatacgactcactataggggacaaacaaatttcttctcacctgtatgtgaacagaggagacacataatggtgagaagaaacctggcggcagcgcaaaagatg

SEQ ID NO: 208389 - DNA, 103 bp, Artificial Sequence
  Synthetic Polynucleotide
taatacgactcactataggggaacattctggacaaacaaatttcttctcaaacagaggagatgagaaatgatttgtttgaacctggcggcagcgcaaaagatg

SEQ ID NO: 208390 - DNA, 103 bp, Artificial Sequence
  Synthetic Polynucleotide
taatacgactcactatagggaaagcgttttgaacattctggacaaacaaaaacagaggagatttgttatgccagaatgtaacctggcggcagcgcaaaagatg

SEQ ID NO: 208391 - DNA, 103 bp, Artificial Sequence
  Synthetic Polynucleotide
taatacgactcactatagggcacttctcataaagcgttttgaacattctgaacagaggagacagaatatgcaaaacgctaacctggcggcagcgcaaaagatg

SEQ ID NO: 208392 - DNA, 103 bp, Artificial Sequence
  Synthetic Polynucleotide
taatacgactcactataggggcaaggtggtcacttctcataaagcgttttaacagaggagaaaaacgatgtatgagaagaacctggcggcagcgcaaaagatg

SEQ ID NO: 208393 - DNA, 103 bp, Artificial Sequence
  Synthetic Polynucleotide
taatacgactcactatagggaatatgtttggcaaggtggtcacttctcataacagaggagaatgagaatggaccaccttaacctggcggcagcgcaaaagatg

SEQ ID NO: 208394 - DNA, 103 bp, Artificial Sequence
  Synthetic Polynucleotide
taatacgactcactatagggggtgtgttttaatatgtttggcaaggtggtaacagaggagaaccaccatgccaaacataaacctggcggcagcgcaaaagatg

SEQ ID NO: 208395 - DNA, 103 bp, Artificial Sequence
  Synthetic Polynucleotide
taatacgactcactatagggtcgtcgcccggcgatggcggccctatcttgaacagaggagacaagatatggccgccatcaacctggcggcagcgcaaaagatg

SEQ ID NO: 208396 - DNA, 103 bp, Artificial Sequence
  Synthetic Polynucleotide
taatacgactcactatagggtttttattctggtgtgttttaatatgtttgaacagaggagacaaacaatgtaaaacacaaacctggcggcagcgcaaaagatg

SEQ ID NO: 208397 - DNA, 103 bp, Artificial Sequence
  Synthetic Polynucleotide
taatacgactcactataggggtgaataccttttttattctggtgtgttttaacagaggagaaaaacaatgcagaataaaaacctggcggcagcgcaaaagatg

SEQ ID NO: 208398 - DNA, 103 bp, Artificial Sequence
  Synthetic Polynucleotide
taatacgactcactatagggtactgctagagtgaataccttttttattctaacagaggagaagaataatgaaggtattcaacctggcggcagcgcaaaagatg

SEQ ID NO: 208399 - DNA, 103 bp, Artificial Sequence
  Synthetic Polynucleotide
taatacgactcactataggggccagcactgtactgctagagtgaatacctaacagaggagaaggtatatgctctagcagaacctggcggcagcgcaaaagatg

SEQ ID NO: 208400 - DNA, 103 bp, Artificial Sequence
  Synthetic Polynucleotide
taatacgactcactatagggttccacagatgccagcactgtactgctagaaacagaggagatctagcatgacagtgctgaacctggcggcagcgcaaaagatg

SEQ ID NO: 208401 - DNA, 103 bp, Artificial Sequence
  Synthetic Polynucleotide
taatacgactcactatagggctcgcgcagcttccacagatgccagcactgaacagaggagacagtgcatgcatctgtggaacctggcggcagcgcaaaagatg

SEQ ID NO: 208402 - DNA, 103 bp, Artificial Sequence
  Synthetic Polynucleotide
taatacgactcactatagggaaagtatcatctcgcgcagcttccacagataacagaggagaatctgtatgagctgcgcgaacctggcggcagcgcaaaagatg

SEQ ID NO: 208403 - DNA, 103 bp, Artificial Sequence
  Synthetic Polynucleotide
taatacgactcactatagggtgcagtaatcaaagtatcatctcgcgcagcaacagaggagagctgcgatggatgatactaacctggcggcagcgcaaaagatg

SEQ ID NO: 208404 - DNA, 103 bp, Artificial Sequence
  Synthetic Polynucleotide
taatacgactcactatagggttgttcctcctgcagtaatcaaagtatcataacagaggagaatgataatgtgattactgaacctggcggcagcgcaaaagatg

SEQ ID NO: 208405 - DNA, 103 bp, Artificial Sequence
  Synthetic Polynucleotide
taatacgactcactatagggaggataagcgttgttcctcctgcagtaatcaacagaggagagattacatgaggaggaacaacctggcggcagcgcaaaagatg

SEQ ID NO: 208406 - DNA, 103 bp, Artificial Sequence
  Synthetic Polynucleotide
taatacgactcactatagggctcctcctcgtcgtcgcccggcgatggcggaacagaggagaccgccaatgccgggcgacaacctggcggcagcgcaaaagatg

SEQ ID NO: 208407 - DNA, 103 bp, Artificial Sequence
  Synthetic Polynucleotide
taatacgactcactatagggaatatttgcaaggataagcgttgttcctccaacagaggagaggaggaatgacgcttatcaacctggcggcagcgcaaaagatg

SEQ ID NO: 208408 - DNA, 103 bp, Artificial Sequence
  Synthetic Polynucleotide
taatacgactcactatagggaaccttgttgaatatttgcaaggataagcgaacagaggagacgcttaatgttgcaaataaacctggcggcagcgcaaaagatg

SEQ ID NO: 208409 - DNA, 103 bp, Artificial Sequence
  Synthetic Polynucleotide
taatacgactcactatagggcctgaaacagaaccttgttgaatatttgcaaacagaggagatgcaaaatgtcaacaaggaacctggcggcagcgcaaaagatg

SEQ ID NO: 208410 - DNA, 103 bp, Artificial Sequence
  Synthetic Polynucleotide
taatacgactcactatagggagttcctatccctgaaacagaaccttgttgaacagaggagacaacaaatgtctgtttcaaacctggcggcagcgcaaaagatg

SEQ ID NO: 208411 - DNA, 103 bp, Artificial Sequence
  Synthetic Polynucleotide
taatacgactcactatagggaagtattaacagttcctatccctgaaacagaacagaggagactgtttatgggataggaaaacctggcggcagcgcaaaagatg

SEQ ID NO: 208412 - DNA, 103 bp, Artificial Sequence
  Synthetic Polynucleotide
taatacgactcactatagggctggtggcggaagtattaacagttcctatcaacagaggagagataggatgtgttaatacaacctggcggcagcgcaaaagatg

SEQ ID NO: 208413 - DNA, 103 bp, Artificial Sequence
  Synthetic Polynucleotide
taatacgactcactatagggatcttgattgctggtggcggaagtattaacaacagaggagagttaatatgtccgccaccaacctggcggcagcgcaaaagatg

SEQ ID NO: 208414 - DNA, 103 bp, Artificial Sequence
  Synthetic Polynucleotide
taatacgactcactatagggtggtaaggatatcttgattgctggtggcggaacagaggagaccgccaatggcaatcaagaacctggcggcagcgcaaaagatg

SEQ ID NO: 208415 - DNA, 103 bp, Artificial Sequence
  Synthetic Polynucleotide
taatacgactcactatagggatttcagtgttggtaaggatatcttgattgaacagaggagacaatcaatgtatccttacaacctggcggcagcgcaaaagatg

SEQ ID NO: 208416 - DNA, 103 bp, Artificial Sequence
  Synthetic Polynucleotide
taatacgactcactatagggctgtaaaggtatttcagtgttggtaaggataacagaggagaatccttatgaacactgaaaacctggcggcagcgcaaaagatg

SEQ ID NO: 208417 - DNA, 103 bp, Artificial Sequence
  Synthetic Polynucleotide
taatacgactcactatagggcggcggccgcctcctcctcgtcgtcgcccgaacagaggagacgggcgatgacgaggaggaacctggcggcagcgcaaaagatg

SEQ ID NO: 208418 - DNA, 103 bp, Artificial Sequence
  Synthetic Polynucleotide
taatacgactcactatagggctgtgacaagctgtaaaggtatttcagtgtaacagaggagaacactgatgtacctttacaacctggcggcagcgcaaaagatg

SEQ ID NO: 208419 - DNA, 103 bp, Artificial Sequence
  Synthetic Polynucleotide
taatacgactcactatagggtttccagaaactgtgacaagctgtaaaggtaacagaggagaacctttatggcttgtcacaacctggcggcagcgcaaaagatg

SEQ ID NO: 208420 - DNA, 103 bp, Artificial Sequence
  Synthetic Polynucleotide
taatacgactcactatagggcattgtctcatttccagaaactgtgacaagaacagaggagacttgtcatggtttctggaaacctggcggcagcgcaaaagatg

SEQ ID NO: 208421 - DNA, 103 bp, Artificial Sequence
  Synthetic Polynucleotide
taatacgactcactataggggccccggctgcggcggccgcctcctcctcgaacagaggagacgaggaatgggcggccgcaacctggcggcagcgcaaaagatg

SEQ ID NO: 208422 - DNA, 103 bp, Artificial Sequence
  Synthetic Polynucleotide
taatacgactcactatagggggcggcgggggccccggctgcggcggccgcaacagaggagagcggccatggcagccgggaacctggcggcagcgcaaaagatg

SEQ ID NO: 208423 - DNA, 103 bp, Artificial Sequence
  Synthetic Polynucleotide
taatacgactcactatagggtcgctccggcggcggcgggggccccggctgaacagaggagacagccgatgcccccgccgaacctggcggcagcgcaaaagatg

SEQ ID NO: 208424 - DNA, 103 bp, Artificial Sequence
  Synthetic Polynucleotide
taatacgactcactatagggaaatcacctgtcgctccggcggcggcggggaacagaggagaccccgcatgcgccggagcaacctggcggcagcgcaaaagatg

SEQ ID NO: 208425 - DNA, 103 bp, Artificial Sequence
  Synthetic Polynucleotide
taatacgactcactatagggtgcagaagccaaatcacctgtcgctccggcaacagaggagagccggaatgacaggtgataacctggcggcagcgcaaaagatg

SEQ ID NO: 208426 - DNA, 103 bp, Artificial Sequence
  Synthetic Polynucleotide
taatacgactcactatagggctcctaactgtgcagaagccaaatcacctgaacagaggagacaggtgatgtggcttctgaacctggcggcagcgcaaaagatg

SEQ ID NO: 208427 - DNA, 103 bp, Artificial Sequence
  Synthetic Polynucleotide
taatacgactcactatagggtccaaggcagccatttcctcttgtttcacgaacagaggagacgtgaaatgagaggaaataacctggcggcagcgcaaaagatg

SEQ ID NO: 208428 - DNA, 103 bp, Artificial Sequence
  Synthetic Polynucleotide
taatacgactcactatagggtttggtgctcctcctaactgtgcagaagccaacagaggagaggcttcatgacagttaggaacctggcggcagcgcaaaagatg

SEQ ID NO: 208429 - DNA, 103 bp, Artificial Sequence
  Synthetic Polynucleotide
taatacgactcactatagggctcccatcggtttggtgctcctcctaactgaacagaggagacagttaatgggagcaccaaacctggcggcagcgcaaaagatg

SEQ ID NO: 208430 - DNA, 103 bp, Artificial Sequence
  Synthetic Polynucleotide
taatacgactcactatagggctgacaaaacctcccatcggtttggtgctcaacagaggagagagcacatgaccgatgggaacctggcggcagcgcaaaagatg

SEQ ID NO: 208431 - DNA, 103 bp, Artificial Sequence
  Synthetic Polynucleotide
taatacgactcactataggggtaggtgtggctgacaaaacctcccatcggaacagaggagaccgatgatgggttttgtcaacctggcggcagcgcaaaagatg

SEQ ID NO: 208432 - DNA, 103 bp, Artificial Sequence
  Synthetic Polynucleotide
taatacgactcactatagggttttatagttgtaggtgtggctgacaaaacaacagaggagagttttgatggccacacctaacctggcggcagcgcaaaagatg

SEQ ID NO: 208433 - DNA, 103 bp, Artificial Sequence
  Synthetic Polynucleotide
taatacgactcactatagggcagcttcatcttttatagttgtaggtgtggaacagaggagaccacacatgcaactataaaacctggcggcagcgcaaaagatg

SEQ ID NO: 208434 - DNA, 103 bp, Artificial Sequence
  Synthetic Polynucleotide
taatacgactcactatagggactagattaccagcttcatcttttatagttaacagaggagaaactatatgagatgaagcaacctggcggcagcgcaaaagatg

SEQ ID NO: 208435 - DNA, 103 bp, Artificial Sequence
  Synthetic Polynucleotide
taatacgactcactatagggtggaatctggactagattaccagcttcatcaacagaggagagatgaaatgggtaatctaaacctggcggcagcgcaaaagatg

SEQ ID NO: 208436 - DNA, 103 bp, Artificial Sequence
  Synthetic Polynucleotide
taatacgactcactatagggtagcagcacttggaatctggactagattacaacagaggagagtaatcatgtccagattcaacctggcggcagcgcaaaagatg

SEQ ID NO: 208437 - DNA, 103 bp, Artificial Sequence
  Synthetic Polynucleotide
taatacgactcactatagggccacttgaagtagcagcacttggaatctggaacagaggagaccagatatgaagtgctgcaacctggcggcagcgcaaaagatg

SEQ ID NO: 208438 - DNA, 103 bp, Artificial Sequence
  Synthetic Polynucleotide
taatacgactcactataggggctatccacgtccaaggcagccatttcctcaacagaggagagaggaaatggctgccttgaacctggcggcagcgcaaaagatg

SEQ ID NO: 208439 - DNA, 103 bp, Artificial Sequence
  Synthetic Polynucleotide
taatacgactcactatagggaacatactgcccacttgaagtagcagcactaacagaggagaagtgctatgacttcaagtaacctggcggcagcgcaaaagatg

SEQ ID NO: 208440 - DNA, 103 bp, Artificial Sequence
  Synthetic Polynucleotide
taatacgactcactataggggaaggggaagaacatactgcccacttgaagaacagaggagacttcaaatgggcagtatgaacctggcggcagcgcaaaagatg

SEQ ID NO: 208441 - DNA, 103 bp, Artificial Sequence
  Synthetic Polynucleotide
taatacgactcactatagggtgcaaattctgaaggggaagaacatactgcaacagaggagagcagtaatgtcttcccctaacctggcggcagcgcaaaagatg

SEQ ID NO: 208442 - DNA, 103 bp, Artificial Sequence
  Synthetic Polynucleotide
taatacgactcactatagggttgttgattctgcaaattctgaaggggaagaacagaggagacttcccatgcagaatttgaacctggcggcagcgcaaaagatg

SEQ ID NO: 208443 - DNA, 103 bp, Artificial Sequence
  Synthetic Polynucleotide
taatacgactcactatagggcggaaaatatttgttgattctgcaaattctaacagaggagaagaattatgagaatcaacaacctggcggcagcgcaaaagatg

SEQ ID NO: 208444 - DNA, 103 bp, Artificial Sequence
  Synthetic Polynucleotide
taatacgactcactatagggcctggtgcaacggaaaatatttgttgattcaacagaggagagaatcaatgaatattttcaacctggcggcagcgcaaaagatg

SEQ ID NO: 208445 - DNA, 103 bp, Artificial Sequence
  Synthetic Polynucleotide
taatacgactcactatagggtgaatctgatcctggtgcaacggaaaatataacagaggagaatatttatggttgcaccaaacctggcggcagcgcaaaagatg

SEQ ID NO: 208446 - DNA, 103 bp, Artificial Sequence
  Synthetic Polynucleotide
taatacgactcactatagggtaccatttgatgaatctgatcctggtgcaaaacagaggagattgcacatggatcagattaacctggcggcagcgcaaaagatg

SEQ ID NO: 208447 - DNA, 103 bp, Artificial Sequence
  Synthetic Polynucleotide
taatacgactcactatagggctggacactgtaccatttgatgaatctgataacagaggagaatcagaatgatcaaatggaacctggcggcagcgcaaaagatg

SEQ ID NO: 208448 - DNA, 103 bp, Artificial Sequence
  Synthetic Polynucleotide
taatacgactcactatagggatattgaacactggacactgtaccatttgaaacagaggagatcaaatatgacagtgtccaacctggcggcagcgcaaaagatg

SEQ ID NO: 208449 - DNA, 103 bp, Artificial Sequence
  Synthetic Polynucleotide
taatacgactcactatagggcgccgccgccgctatccacgtccaaggcagaacagaggagactgcctatgacgtggataaacctggcggcagcgcaaaagatg

SEQ ID NO: 208450 - DNA, 103 bp, Artificial Sequence
  Synthetic Polynucleotide
taatacgactcactataggggtatcacttgatattgaacactggacactgaacagaggagacagtgtatggtgttcaataacctggcggcagcgcaaaagatg

SEQ ID NO: 208451 - DNA, 103 bp, Artificial Sequence
  Synthetic Polynucleotide
taatacgactcactatagggtggatctgtggtatcacttgatattgaacaaacagaggagatgttcaatgtcaagtgataacctggcggcagcgcaaaagatg

SEQ ID NO: 208452 - DNA, 103 bp, Artificial Sequence
  Synthetic Polynucleotide
taatacgactcactatagggatctgctgactggatctgtggtatcacttgaacagaggagacaagtgatgccacagatcaacctggcggcagcgcaaaagatg

SEQ ID NO: 208453 - DNA, 103 bp, Artificial Sequence
  Synthetic Polynucleotide
taatacgactcactatagggcctgctgaccatctgctgactggatctgtgaacagaggagacacagaatgagtcagcagaacctggcggcagcgcaaaagatg

SEQ ID NO: 208454 - DNA, 103 bp, Artificial Sequence
  Synthetic Polynucleotide
taatacgactcactatagggccaatttgaacctgctgaccatctgctgacaacagaggagagtcagcatgtggtcagcaaacctggcggcagcgcaaaagatg

SEQ ID NO: 208455 - DNA, 103 bp, Artificial Sequence
  Synthetic Polynucleotide
taatacgactcactataggggcctgtgaaaccaatttgaacctgctgaccaacagaggagaggtcagatggttcaaattaacctggcggcagcgcaaaagatg

SEQ ID NO: 208456 - DNA, 103 bp, Artificial Sequence
  Synthetic Polynucleotide
taatacgactcactatagggtatctgaagagcctgtgaaaccaatttgaaaacagaggagattcaaaatggtttcacagaacctggcggcagcgcaaaagatg

SEQ ID NO: 208457 - DNA, 103 bp, Artificial Sequence
  Synthetic Polynucleotide
taatacgactcactatagggatacccccattatctgaagagcctgtgaaaaacagaggagatttcacatgctcttcagaaacctggcggcagcgcaaaagatg

SEQ ID NO: 208458 - DNA, 103 bp, Artificial Sequence
  Synthetic Polynucleotide
taatacgactcactatagggttcttgatttatacccccattatctgaagaaacagaggagatcttcaatgaatgggggtaacctggcggcagcgcaaaagatg

SEQ ID NO: 208459 - DNA, 103 bp, Artificial Sequence
  Synthetic Polynucleotide
taatacgactcactatagggtttgactgctttcttgatttatacccccataacagaggagaatggggatgtaaatcaagaacctggcggcagcgcaaaagatg

SEQ ID NO: 208460 - DNA, 103 bp, Artificial Sequence
  Synthetic Polynucleotide
taatacgactcactatagggccgccgccaccgccgccgccgctatccacgaacagaggagacgtggaatgcggcggcggaacctggcggcagcgcaaaagatg

SEQ ID NO: 208461 - DNA, 103 bp, Artificial Sequence
  Synthetic Polynucleotide
taatacgactcactatagggatgatctgaatttgactgctttcttgatttaacagaggagaaaatcaatgaagcagtcaaacctggcggcagcgcaaaagatg

SEQ ID NO: 208462 - DNA, 103 bp, Artificial Sequence
  Synthetic Polynucleotide
taatacgactcactatagggagagccaggaatgatctgaatttgactgctaacagaggagaagcagtatgattcagatcaacctggcggcagcgcaaaagatg

SEQ ID NO: 208463 - DNA, 103 bp, Artificial Sequence
  Synthetic Polynucleotide
taatacgactcactatagggaggtttgattagagccaggaatgatctgaaaacagaggagattcagaatgttcctggctaacctggcggcagcgcaaaagatg

SEQ ID NO: 208464 - DNA, 103 bp, Artificial Sequence
  Synthetic Polynucleotide
taatacgactcactataggggaggcaagtaaggtttgattagagccaggaaacagaggagatcctggatgtaatcaaacaacctggcggcagcgcaaaagatg

SEQ ID NO: 208465 - DNA, 103 bp, Artificial Sequence
  Synthetic Polynucleotide
taatacgactcactatagggaggtgttccagaggcaagtaaggtttgattaacagaggagaaatcaaatgttacttgccaacctggcggcagcgcaaaagatg

SEQ ID NO: 208466 - DNA, 103 bp, Artificial Sequence
  Synthetic Polynucleotide
taatacgactcactatagggtgttagcagaaggtgttccagaggcaagtaaacagaggagatacttgatgctggaacacaacctggcggcagcgcaaaagatg

SEQ ID NO: 208467 - DNA, 103 bp, Artificial Sequence
  Synthetic Polynucleotide
taatacgactcactatagggagattctggatgttagcagaaggtgttccaaacagaggagatggaacatgttctgctaaaacctggcggcagcgcaaaagatg

SEQ ID NO: 208468 - DNA, 103 bp, Artificial Sequence
  Synthetic Polynucleotide
taatacgactcactatagggctgtggtatgagattctggatgttagcagaaacagaggagatctgctatgatccagaataacctggcggcagcgcaaaagatg

SEQ ID NO: 208469 - DNA, 103 bp, Artificial Sequence
  Synthetic Polynucleotide
taatacgactcactatagggcttgaccagtctgtggtatgagattctggaaacagaggagatccagaatgtcataccacaacctggcggcagcgcaaaagatg

SEQ ID NO: 208470 - DNA, 103 bp, Artificial Sequence
  Synthetic Polynucleotide
taatacgactcactatagggtgaacctggacttgaccagtctgtggtatgaacagaggagacataccatggactggtcaaacctggcggcagcgcaaaagatg

SEQ ID NO: 208471 - DNA, 103 bp, Artificial Sequence
  Synthetic Polynucleotide
taatacgactcactataggggtggccgccgccgccgccaccgccgccgccaacagaggagaggcggcatgggtggcggcaacctggcggcagcgcaaaagatg

SEQ ID NO: 208472 - DNA, 103 bp, Artificial Sequence
  Synthetic Polynucleotide
taatacgactcactatagggtgcaactccctgaacctggacttgaccagtaacagaggagaactggtatggtccaggttaacctggcggcagcgcaaaagatg

SEQ ID NO: 208473 - DNA, 103 bp, Artificial Sequence
  Synthetic Polynucleotide
taatacgactcactatagggaaccaccaattgcaactccctgaacctggaaacagaggagatccaggatgagggagttgaacctggcggcagcgcaaaagatg

SEQ ID NO: 208474 - DNA, 103 bp, Artificial Sequence
  Synthetic Polynucleotide
taatacgactcactatagggggaaaagatgaaccaccaattgcaactcccaacagaggagagggagtatgaattggtggaacctggcggcagcgcaaaagatg

SEQ ID NO: 208475 - DNA, 103 bp, Artificial Sequence
  Synthetic Polynucleotide
taatacgactcactatagggggtttgaccaggaaaagatgaaccaccaataacagaggagaattggtatgtcatcttttaacctggcggcagcgcaaaagatg

SEQ ID NO: 208476 - DNA, 103 bp, Artificial Sequence
  Synthetic Polynucleotide
taatacgactcactatagggcaactacttgggtttgaccaggaaaagatgaacagaggagacatcttatgctggtcaaaaacctggcggcagcgcaaaagatg

SEQ ID NO: 208477 - DNA, 103 bp, Artificial Sequence
  Synthetic Polynucleotide
taatacgactcactatagggggcacattagcaactacttgggtttgaccaaacagaggagatggtcaatgccaagtagtaacctggcggcagcgcaaaagatg

SEQ ID NO: 208478 - DNA, 103 bp, Artificial Sequence
  Synthetic Polynucleotide
taatacgactcactatagggcagaccaagaggcacattagcaactacttgaacagaggagacaagtaatggctaatgtgaacctggcggcagcgcaaaagatg

SEQ ID NO: 208479 - DNA, 103 bp, Artificial Sequence
  Synthetic Polynucleotide
taatacgactcactatagggtatttcctggcagaccaagaggcacattagaacagaggagactaatgatgctcttggtcaacctggcggcagcgcaaaagatg

SEQ ID NO: 208480 - DNA, 103 bp, Artificial Sequence
  Synthetic Polynucleotide
taatacgactcactatagggacaaacgtaatatttcctggcagaccaagaaacagaggagatcttggatggccaggaaaaacctggcggcagcgcaaaagatg

SEQ ID NO: 208481 - DNA, 103 bp, Artificial Sequence
  Synthetic Polynucleotide
taatacgactcactatagggattgattggtacaaacgtaatatttcctggaacagaggagaccaggaatgattacgtttaacctggcggcagcgcaaaagatg

SEQ ID NO: 208482 - DNA, 103 bp, Artificial Sequence
  Synthetic Polynucleotide
taatacgactcactataggggatactcgccgtggccgccgccgccgccacaacagaggagagtggcgatggcggcggccaacctggcggcagcgcaaaagatg

SEQ ID NO: 208483 - DNA, 103 bp, Artificial Sequence
  Synthetic Polynucleotide
taatacgactcactataggggatcgacactattgattggtacaaacgtaaaacagaggagattacgtatgtaccaatcaaacctggcggcagcgcaaaagatg

SEQ ID NO: 208484 - DNA, 103 bp, Artificial Sequence
  Synthetic Polynucleotide
taatacgactcactatagggaaagaatctagatcgacactattgattggtaacagaggagaaccaatatgtagtgtcgaaacctggcggcagcgcaaaagatg

SEQ ID NO: 208485 - DNA, 103 bp, Artificial Sequence
  Synthetic Polynucleotide
taatacgactcactatagggcgagagtcccaaagaatctagatcgacactaacagaggagaagtgtcatgctagattctaacctggcggcagcgcaaaagatg

SEQ ID NO: 208486 - DNA, 103 bp, Artificial Sequence
  Synthetic Polynucleotide
taatacgactcactataggggagaactgcccgagagtcccaaagaatctaaacagaggagatagattatgtgggactctaacctggcggcagcgcaaaagatg

SEQ ID NO: 208487 - DNA, 103 bp, Artificial Sequence
  Synthetic Polynucleotide
taatacgactcactataggggtcattgtctgagaactgcccgagagtcccaacagaggagagggactatggggcagttcaacctggcggcagcgcaaaagatg

SEQ ID NO: 208488 - DNA, 103 bp, Artificial Sequence
  Synthetic Polynucleotide
taatacgactcactatagggaatgcctgcagtcattgtctgagaactgccaacagaggagaggcagtatgcagacaatgaacctggcggcagcgcaaaagatg

SEQ ID NO: 208489 - DNA, 103 bp, Artificial Sequence
  Synthetic Polynucleotide
taatacgactcactatagggcgtcggcattaatgcctgcagtcattgtctaacagaggagaagacaaatgctgcaggcaaacctggcggcagcgcaaaagatg

SEQ ID NO: 208490 - DNA, 103 bp, Artificial Sequence
  Synthetic Polynucleotide
taatacgactcactatagggatcaaatgtccgtcggcattaatgcctgcaaacagaggagatgcaggatgtaatgccgaaacctggcggcagcgcaaaagatg

SEQ ID NO: 208491 - DNA, 103 bp, Artificial Sequence
  Synthetic Polynucleotide
taatacgactcactatagggtcctgtgtttatcaaatgtccgtcggcattaacagaggagaaatgccatgggacatttgaacctggcggcagcgcaaaagatg

SEQ ID NO: 208492 - DNA, 103 bp, Artificial Sequence
  Synthetic Polynucleotide
taatacgactcactatagggccatagcttgtcctgtgtttatcaaatgtcaacagaggagagacattatgtaaacacagaacctggcggcagcgcaaaagatg

SEQ ID NO: 208493 - DNA, 103 bp, Artificial Sequence
  Synthetic Polynucleotide
taatacgactcactatagggtgctgctgcagatactcgccgtggccgccgaacagaggagacggcggatgcggcgagtaaacctggcggcagcgcaaaagatg

SEQ ID NO: 208494 - DNA, 103 bp, Artificial Sequence
  Synthetic Polynucleotide
taatacgactcactatagggtctgaactatccatagcttgtcctgtgtttaacagaggagaaaacacatgacaagctataacctggcggcagcgcaaaagatg

SEQ ID NO: 208495 - DNA, 103 bp, Artificial Sequence
  Synthetic Polynucleotide
taatacgactcactatagggttctgaattgtctgaactatccatagcttgaacagaggagacaagctatggatagttcaaacctggcggcagcgcaaaagatg

SEQ ID NO: 208496 - DNA, 103 bp, Artificial Sequence
  Synthetic Polynucleotide
taatacgactcactatagggcaccagtcctttctgaattgtctgaactataacagaggagaatagttatgacaattcagaacctggcggcagcgcaaaagatg

SEQ ID NO: 208497 - DNA, 103 bp, Artificial Sequence
  Synthetic Polynucleotide
taatacgactcactataggggaaacccgctcaccagtcctttctgaattgaacagaggagacaattcatgaaggactggaacctggcggcagcgcaaaagatg

SEQ ID NO: 208498 - DNA, 103 bp, Artificial Sequence
  Synthetic Polynucleotide
taatacgactcactatagggaatatcaggagaaacccgctcaccagtcctaacagaggagaaggactatggagcgggttaacctggcggcagcgcaaaagatg

SEQ ID NO: 208499 - DNA, 103 bp, Artificial Sequence
  Synthetic Polynucleotide
taatacgactcactatagggtagtttcattaatatcaggagaaacccgctaacagaggagaagcgggatgctcctgataaacctggcggcagcgcaaaagatg

SEQ ID NO: 208500 - DNA, 103 bp, Artificial Sequence
  Synthetic Polynucleotide
taatacgactcactataggggtatcagtattagtttcattaatatcaggaaacagaggagatcctgaatgtaatgaaacaacctggcggcagcgcaaaagatg

SEQ ID NO: 208501 - DNA, 103 bp, Artificial Sequence
  Synthetic Polynucleotide
taatacgactcactatagggaaataaatctgtatcagtattagtttcattaacagaggagaaatgaaatgaatactgataacctggcggcagcgcaaaagatg

SEQ ID NO: 208502 - DNA, 103 bp, Artificial Sequence
  Synthetic Polynucleotide
taatacgactcactatagggatgttggcacaaataaatctgtatcagtataacagaggagaatactgatgcagatttataacctggcggcagcgcaaaagatg

SEQ ID NO: 208503 - DNA, 103 bp, Artificial Sequence
  Synthetic Polynucleotide
taatacgactcactataggggatgaagaggatgttggcacaaataaatctaacagaggagaagatttatgtgtgccaacaacctggcggcagcgcaaaagatg

SEQ ID NO: 208504 - DNA, 103 bp, Artificial Sequence
  Synthetic Polynucleotide
taatacgactcactataggggtcgttccggaggacggccaccgcggccataacagaggagaatggccatggtggccgtcaacctggcggcagcgcaaaagatg

SEQ ID NO: 208505 - DNA, 103 bp, Artificial Sequence
  Synthetic Polynucleotide
taatacgactcactatagggacaggtggcggccagcaatgccaggggcgaaacagaggagatcgcccatggcattgctgaacctggcggcagcgcaaaagatg

SEQ ID NO: 208506 - DNA, 103 bp, Artificial Sequence
  Synthetic Polynucleotide
taatacgactcactatagggcgagcgcgtgaagctcttcccgcagaagagaacagaggagactcttcatggggaagagcaacctggcggcagcgcaaaagatg

SEQ ID NO: 208507 - DNA, 103 bp, Artificial Sequence
  Synthetic Polynucleotide
taatacgactcactataggggcagctcgtccgagcgcgtgaagctcttccaacagaggagaggaagaatgtcacgcgctaacctggcggcagcgcaaaagatg

SEQ ID NO: 208508 - DNA, 103 bp, Artificial Sequence
  Synthetic Polynucleotide
taatacgactcactatagggaggtgccgctgcagctcgtccgagcgcgtgaacagaggagacacgcgatgggacgagctaacctggcggcagcgcaaaagatg

SEQ ID NO: 208509 - DNA, 103 bp, Artificial Sequence
  Synthetic Polynucleotide
taatacgactcactataggggtgagtccgcaggtgccgctgcagctcgtcaacagaggagagacgagatgcagcggcacaacctggcggcagcgcaaaagatg

SEQ ID NO: 208510 - DNA, 103 bp, Artificial Sequence
  Synthetic Polynucleotide
taatacgactcactatagggtctcgcccgtgtgagtccgcaggtgccgctaacagaggagaagcggcatgtgcggactcaacctggcggcagcgcaaaagatg

SEQ ID NO: 208511 - DNA, 103 bp, Artificial Sequence
  Synthetic Polynucleotide
taatacgactcactataggggcaaagcgcttctcgcccgtgtgagtccgcaacagaggagagcggacatgcacgggcgaaacctggcggcagcgcaaaagatg

SEQ ID NO: 208512 - DNA, 103 bp, Artificial Sequence
  Synthetic Polynucleotide
taatacgactcactatagggctcgggacaggcaaagcgcttctcgcccgtaacagaggagaacgggcatgaagcgctttaacctggcggcagcgcaaaagatg

SEQ ID NO: 208513 - DNA, 103 bp, Artificial Sequence
  Synthetic Polynucleotide
taatacgactcactataggggcttgccgcactcgggacaggcaaagcgctaacagaggagaagcgctatgcctgtcccgaacctggcggcagcgcaaaagatg

SEQ ID NO: 208514 - DNA, 103 bp, Artificial Sequence
  Synthetic Polynucleotide
taatacgactcactatagggcgcatgaagcgcttgccgcactcgggacagaacagaggagactgtccatggtgcggcaaaacctggcggcagcgcaaaagatg

SEQ ID NO: 208515 - DNA, 103 bp, Artificial Sequence
  Synthetic Polynucleotide
taatacgactcactataggggtggtcgctgcgcatgaagcgcttgccgcaaacagaggagatgcggcatgcgcttcatgaacctggcggcagcgcaaaagatg

SEQ ID NO: 208516 - DNA, 103 bp, Artificial Sequence
  Synthetic Polynucleotide
taatacgactcactatagggcgatgcggctacaggtggcggccagcaatgaacagaggagacattgcatgccgccacctaacctggcggcagcgcaaaagatg

SEQ ID NO: 208517 - DNA, 103 bp, Artificial Sequence
  Synthetic Polynucleotide
taatacgactcactataggggcttcgcgaggtggtcgctgcgcatgaagcaacagaggagagcttcaatggcagcgaccaacctggcggcagcgcaaaagatg

SEQ ID NO: 208518 - DNA, 103 bp, Artificial Sequence
  Synthetic Polynucleotide
taatacgactcactataggggtcttgacgtgcttcgcgaggtggtcgctgaacagaggagacagcgaatgcctcgcgaaaacctggcggcagcgcaaaagatg

SEQ ID NO: 208519 - DNA, 103 bp, Artificial Sequence
  Synthetic Polynucleotide
taatacgactcactatagggattctggtgagtcttgacgtgcttcgcgagaacagaggagactcgcgatgcacgtcaagaacctggcggcagcgcaaaagatg

SEQ ID NO: 208520 - DNA, 103 bp, Artificial Sequence
  Synthetic Polynucleotide
taatacgactcactatagggtgagcttcttattctggtgagtcttgacgtaacagaggagaacgtcaatgctcaccagaaacctggcggcagcgcaaaagatg

SEQ ID NO: 208521 - DNA, 103 bp, Artificial Sequence
  Synthetic Polynucleotide
taatacgactcactatagggtcagcgactttgagcttcttattctggtgaaacagaggagatcaccaatgtaagaagctaacctggcggcagcgcaaaagatg

SEQ ID NO: 208522 - DNA, 103 bp, Artificial Sequence
  Synthetic Polynucleotide
taatacgactcactatagggaaccccggcctcagcgactttgagcttcttaacagaggagaaagaagatgaaagtcgctaacctggcggcagcgcaaaagatg

SEQ ID NO: 208523 - DNA, 103 bp, Artificial Sequence
  Synthetic Polynucleotide
taatacgactcactatagggcctcccgcttaaccccggcctcagcgacttaacagaggagaaagtcgatgaggccggggaacctggcggcagcgcaaaagatg

SEQ ID NO: 208524 - DNA, 103 bp, Artificial Sequence
  Synthetic Polynucleotide
taatacgactcactatagggtcccgcgcgtcctcccgcttaaccccggccaacagaggagaggccggatgtaagcgggaaacctggcggcagcgcaaaagatg

SEQ ID NO: 208525 - DNA, 103 bp, Artificial Sequence
  Synthetic Polynucleotide
taatacgactcactatagggcccggctggccgatgcggctacaggtggcgaacagaggagacgccacatgtagccgcataacctggcggcagcgcaaaagatg

SEQ ID NO: 208526 - DNA, 103 bp, Artificial Sequence
  Synthetic Polynucleotide
taatacgactcactatagggcgccgccgcgcccggctggccgatgcggctaacagaggagaagccgcatgggccagccgaacctggcggcagcgcaaaagatg

SEQ ID NO: 208527 - DNA, 103 bp, Artificial Sequence
  Synthetic Polynucleotide
taatacgactcactatagggagtccgggggcgccgccgcgcccggctggcaacagaggagagccagcatggcgcggcggaacctggcggcagcgcaaaagatg

SEQ ID NO: 208528 - DNA, 103 bp, Artificial Sequence
  Synthetic Polynucleotide
taatacgactcactatagggacctgcaggaagtccgggggcgccgccgcgaacagaggagacgcggcatggcccccggaaacctggcggcagcgcaaaagatg

SEQ ID NO: 208529 - DNA, 103 bp, Artificial Sequence
  Synthetic Polynucleotide
taatacgactcactataggggtcgtagggcacctgcaggaagtccgggggaacagaggagacccccgatgttcctgcagaacctggcggcagcgcaaaagatg

SEQ ID NO: 208530 - DNA, 103 bp, Artificial Sequence
  Synthetic Polynucleotide
taatacgactcactatagggccagcgcggggtcgtagggcacctgcaggaaacagaggagatcctgcatgtgccctacgaacctggcggcagcgcaaaagatg

SEQ ID NO: 208531 - DNA, 103 bp, Artificial Sequence
  Synthetic Polynucleotide
taatacgactcactataggggagggtgagcccagcgcggggtcgtagggcaacagaggagagccctaatgccccgcgctaacctggcggcagcgcaaaagatg

SEQ ID NO: 208532 - DNA, 103 bp, Artificial Sequence
  Synthetic Polynucleotide
taatacgactcactataggggaagagcctggagggtgagcccagcgcgggaacagaggagacccgcgatgggctcacccaacctggcggcagcgcaaaagatg

SEQ ID NO: 208533 - DNA, 103 bp, Artificial Sequence
  Synthetic Polynucleotide
taatacgactcactatagggcctgcagcgagtcgttccggaggacggccaaacagaggagatggccgatgtccggaacgaacctggcggcagcgcaaaagatg

SEQ ID NO: 208534 - DNA, 103 bp, Artificial Sequence
  Synthetic Polynucleotide
taatacgactcactatagggtccacgggtggaagagcctggagggtgagcaacagaggagagctcacatgccaggctctaacctggcggcagcgcaaaagatg

SEQ ID NO: 208535 - DNA, 103 bp, Artificial Sequence
  Synthetic Polynucleotide
taatacgactcactatagggatgtcggcggtccacgggtggaagagcctgaacagaggagacaggctatgccacccgtgaacctggcggcagcgcaaaagatg

SEQ ID NO: 208536 - DNA, 103 bp, Artificial Sequence
  Synthetic Polynucleotide
taatacgactcactataggggtgcgccggcatgtcggcggtccacgggtgaacagaggagacacccgatgaccgccgacaacctggcggcagcgcaaaagatg

SEQ ID NO: 208537 - DNA, 103 bp, Artificial Sequence
  Synthetic Polynucleotide
taatacgactcactatagggcgcctggcgagtgcgccggcatgtcggcggaacagaggagaccgccgatgtgccggcgcaacctggcggcagcgcaaaagatg

SEQ ID NO: 208538 - DNA, 103 bp, Artificial Sequence
  Synthetic Polynucleotide
taatacgactcactatagggggcggcagtgcgcctggcgagtgcgccggcaacagaggagagccggcatgctcgccaggaacctggcggcagcgcaaaagatg

SEQ ID NO: 208539 - DNA, 103 bp, Artificial Sequence
  Synthetic Polynucleotide
taatacgactcactataggggggatgcgggggcggcagtgcgcctggcgaaacagaggagatcgccaatggcactgccgaacctggcggcagcgcaaaagatg

SEQ ID NO: 208540 - DNA, 103 bp, Artificial Sequence
  Synthetic Polynucleotide
taatacgactcactataggggccccaagctgggatgcgggggcggcagtgaacagaggagacactgcatgccccgcatcaacctggcggcagcgcaaaagatg

SEQ ID NO: 208541 - DNA, 103 bp, Artificial Sequence
  Synthetic Polynucleotide
taatacgactcactatagggtgcggcgtcagccccaagctgggatgcgggaacagaggagacccgcaatgcagcttgggaacctggcggcagcgcaaaagatg

SEQ ID NO: 208542 - DNA, 103 bp, Artificial Sequence
  Synthetic Polynucleotide
taatacgactcactataggggtgcgtcttctgcggcgtcagccccaagctaacagaggagaagcttgatgctgacgccgaacctggcggcagcgcaaaagatg

SEQ ID NO: 208543 - DNA, 103 bp, Artificial Sequence
  Synthetic Polynucleotide
taatacgactcactatagggacggctgcaggtgcgtcttctgcggcgtcaaacagaggagatgacgcatgagaagacgcaacctggcggcagcgcaaaagatg

SEQ ID NO: 208544 - DNA, 103 bp, Artificial Sequence
  Synthetic Polynucleotide
taatacgactcactatagggtggagaaaggcctgcagcgagtcgttccggaacagaggagaccggaaatgctcgctgcaaacctggcggcagcgcaaaagatg

SEQ ID NO: 208545 - DNA, 103 bp, Artificial Sequence
  Synthetic Polynucleotide
taatacgactcactataggggccccgaaggacggctgcaggtgcgtcttcaacagaggagagaagacatgcctgcagccaacctggcggcagcgcaaaagatg

SEQ ID NO: 208546 - DNA, 103 bp, Artificial Sequence
  Synthetic Polynucleotide
taatacgactcactatagggctcgtgcgcagccccgaaggacggctgcagaacagaggagactgcagatgtccttcgggaacctggcggcagcgcaaaagatg

SEQ ID NO: 208547 - DNA, 103 bp, Artificial Sequence
  Synthetic Polynucleotide
taatacgactcactatagggtaaggggaagctcgtgcgcagccccgaaggaacagaggagaccttcgatgctgcgcacgaacctggcggcagcgcaaaagatg

SEQ ID NO: 208548 - DNA, 103 bp, Artificial Sequence
  Synthetic Polynucleotide
taatacgactcactataggggcggggggtgtaaggggaagctcgtgcgcaaacagaggagatgcgcaatggcttcccctaacctggcggcagcgcaaaagatg

SEQ ID NO: 208549 - DNA, 103 bp, Artificial Sequence
  Synthetic Polynucleotide
taatacgactcactatagggcgaggggtcggcggggggtgtaaggggaagaacagaggagacttcccatgacaccccccaacctggcggcagcgcaaaagatg

SEQ ID NO: 208550 - DNA, 103 bp, Artificial Sequence
  Synthetic Polynucleotide
taatacgactcactatagggcgtaggggtacgaggggtcggcggggggtgaacagaggagacaccccatgccgacccctaacctggcggcagcgcaaaagatg

SEQ ID NO: 208551 - DNA, 103 bp, Artificial Sequence
  Synthetic Polynucleotide
taatacgactcactatagggggcgagaactcgtaggggtacgaggggtcgaacagaggagacgacccatggtacccctaaacctggcggcagcgcaaaagatg

SEQ ID NO: 208552 - DNA, 103 bp, Artificial Sequence
  Synthetic Polynucleotide
taatacgactcactatagggcatcttgaccggcgagaactcgtaggggtaaacagaggagataccccatggagttctcgaacctggcggcagcgcaaaagatg

SEQ ID NO: 208553 - DNA, 103 bp, Artificial Sequence
  Synthetic Polynucleotide
taatacgactcactatagggtcgagggcagcatcttgaccggcgagaactaacagaggagaagttctatgcggtcaagaaacctggcggcagcgcaaaagatg

SEQ ID NO: 208554 - DNA, 103 bp, Artificial Sequence
  Synthetic Polynucleotide
taatacgactcactataggggccgccatgctcgagggcagcatcttgaccaacagaggagaggtcaaatggctgccctcaacctggcggcagcgcaaaagatg

SEQ ID NO: 208555 - DNA, 103 bp, Artificial Sequence
  Synthetic Polynucleotide
taatacgactcactatagggggtgcggtcctggagaaaggcctgcagcgaaacagaggagatcgctgatggcctttctcaacctggcggcagcgcaaaagatg

SEQ ID NO: 208556 - DNA, 103 bp, Artificial Sequence
  Synthetic Polynucleotide
taatacgactcactatagggggcgggcagagccgccatgctcgagggcagaacagaggagactgcccatgagcatggcgaacctggcggcagcgcaaaagatg

SEQ ID NO: 208557 - DNA, 103 bp, Artificial Sequence
  Synthetic Polynucleotide
taatacgactcactataggggcgcgcagctggcgggcagagccgccatgcaacagaggagagcatggatgctctgcccgaacctggcggcagcgcaaaagatg

SEQ ID NO: 208558 - DNA, 103 bp, Artificial Sequence
  Synthetic Polynucleotide
taatacgactcactatagggacgtaggcgggcgcgcagctggcgggcagaaacagaggagatctgccatgcagctgcgcaacctggcggcagcgcaaaagatg

SEQ ID NO: 208559 - DNA, 103 bp, Artificial Sequence
  Synthetic Polynucleotide
taatacgactcactatagggcgcgtagggcacgtaggcgggcgcgcagctaacagaggagaagctgcatgcccgcctacaacctggcggcagcgcaaaagatg

SEQ ID NO: 208560 - DNA, 103 bp, Artificial Sequence
  Synthetic Polynucleotide
taatacgactcactatagggcggcctgcgccgcgtagggcacgtaggcggaacagaggagaccgcctatgtgccctacgaacctggcggcagcgcaaaagatg

SEQ ID NO: 208561 - DNA, 103 bp, Artificial Sequence
  Synthetic Polynucleotide
taatacgactcactatagggggcggcagcgcggcctgcgccgcgtagggcaacagaggagagccctaatgggcgcaggcaacctggcggcagcgcaaaagatg

SEQ ID NO: 208562 - DNA, 103 bp, Artificial Sequence
  Synthetic Polynucleotide
taatacgactcactatagggggagtagcctggcggcagcgcggcctgcgcaacagaggagagcgcagatggcgctgccgaacctggcggcagcgcaaaagatg

SEQ ID NO: 208563 - DNA, 103 bp, Artificial Sequence
  Synthetic Polynucleotide
taatacgactcactataggggcagcaggttggagtagcctggcggcagcgaacagaggagacgctgcatgcaggctactaacctggcggcagcgcaaaagatg

SEQ ID NO: 208564 - DNA, 103 bp, Artificial Sequence
  Synthetic Polynucleotide
taatacgactcactatagggggcggcggaggcagcaggttggagtagcctaacagaggagaaggctaatgcaacctgctaacctggcggcagcgcaaaagatg

SEQ ID NO: 208565 - DNA, 103 bp, Artificial Sequence
  Synthetic Polynucleotide
taatacgactcactataggggggcggtggcggcggcggaggcagcaggttaacagaggagaaacctgatgcctccgccgaacctggcggcagcgcaaaagatg

SEQ ID NO: 208566 - DNA, 103 bp, Artificial Sequence
  Synthetic Polynucleotide
taatacgactcactatagggaggcgctgggggtgcggtcctggagaaaggaacagaggagacctttcatgaggaccgcaaacctggcggcagcgcaaaagatg

SEQ ID NO: 208567 - DNA, 103 bp, Artificial Sequence
  Synthetic Polynucleotide
taatacgactcactatagggtgggcggcgggggcggtggcggcggcggagaacagaggagactccgcatgcgccaccgcaacctggcggcagcgcaaaagatg

SEQ ID NO: 208568 - DNA, 103 bp, Artificial Sequence
  Synthetic Polynucleotide
taatacgactcactatagggtggcggcaggtgggcggcgggggcggtggcaacagaggagagccaccatgcccgccgccaacctggcggcagcgcaaaagatg

SEQ ID NO: 208569 - DNA, 103 bp, Artificial Sequence
  Synthetic Polynucleotide
taatacgactcactataggggggtgacaactggcggcaggtgggcggcggaacagaggagaccgccgatgacctgccgcaacctggcggcagcgcaaaagatg

SEQ ID NO: 208570 - DNA, 103 bp, Artificial Sequence
  Synthetic Polynucleotide
taatacgactcactataggggggccgggttgggtgacaactggcggcaggaacagaggagacctgccatgagttgtcacaacctggcggcagcgcaaaagatg

SEQ ID NO: 208571 - DNA, 103 bp, Artificial Sequence
  Synthetic Polynucleotide
taatacgactcactatagggaggtcgtcgggggccgggttgggtgacaacaacagaggagagttgtcatgcaacccggcaacctggcggcagcgcaaaagatg

SEQ ID NO: 208572 - DNA, 103 bp, Artificial Sequence
  Synthetic Polynucleotide
taatacgactcactatagggccaccacgggaggtcgtcgggggccgggttaacagaggagaaacccgatgcccgacgacaacctggcggcagcgcaaaagatg

SEQ ID NO: 208573 - DNA, 103 bp, Artificial Sequence
  Synthetic Polynucleotide
taatacgactcactataggggcgggatgctccaccacgggaggtcgtcggaacagaggagaccgacgatgtcccgtggtaacctggcggcagcgcaaaagatg

SEQ ID NO: 208574 - DNA, 103 bp, Artificial Sequence
  Synthetic Polynucleotide
taatacgactcactataggggcgcccgcctgcgggatgctccaccacgggaacagaggagacccgtgatggagcatcccaacctggcggcagcgcaaaagatg

SEQ ID NO: 208575 - DNA, 103 bp, Artificial Sequence
  Synthetic Polynucleotide
taatacgactcactatagggccccggcccggcgcccgcctgcgggatgctaacagaggagaagcatcatgcaggcgggcaacctggcggcagcgcaaaagatg

SEQ ID NO: 208576 - DNA, 103 bp, Artificial Sequence
  Synthetic Polynucleotide
taatacgactcactatagggccccggaggcccccggcccggcgcccgcctaacagaggagaaggcggatgccgggccggaacctggcggcagcgcaaaagatg

SEQ ID NO: 208577 - DNA, 103 bp, Artificial Sequence
  Synthetic Polynucleotide
taatacgactcactatagggaggtccggggaggcgctgggggtgcggtccaacagaggagaggaccgatgccccagcgcaacctggcggcagcgcaaaagatg

SEQ ID NO: 208578 - DNA, 103 bp, Artificial Sequence
  Synthetic Polynucleotide
taatacgactcactatagggcttcccggaaccccggaggcccccggcccgaacagaggagacgggccatgggcctccggaacctggcggcagcgcaaaagatg

SEQ ID NO: 208579 - DNA, 103 bp, Artificial Sequence
  Synthetic Polynucleotide
taatacgactcactatagggggagaggccgcttcccggaaccccggaggcaacagaggagagcctccatggttccgggaaacctggcggcagcgcaaaagatg

SEQ ID NO: 208580 - DNA, 103 bp, Artificial Sequence
  Synthetic Polynucleotide
taatacgactcactatagggcacaggcgccggagaggccgcttcccggaaaacagaggagattccggatggcggcctctaacctggcggcagcgcaaaagatg

SEQ ID NO: 208581 - DNA, 103 bp, Artificial Sequence
  Synthetic Polynucleotide
taatacgactcactatagggggggccccggcacaggcgccggagaggccgaacagaggagacggcctatgcggcgcctgaacctggcggcagcgcaaaagatg

SEQ ID NO: 208582 - DNA, 103 bp, Artificial Sequence
  Synthetic Polynucleotide
taatacgactcactataggggggcgcgtggggggccccggcacaggcgccaacagaggagaggcgccatggccggggccaacctggcggcagcgcaaaagatg

SEQ ID NO: 208583 - DNA, 103 bp, Artificial Sequence
  Synthetic Polynucleotide
taatacgactcactatagggcggggaagcggggcgcgtggggggccccggaacagaggagaccggggatgcccacgcgcaacctggcggcagcgcaaaagatg

SEQ ID NO: 208584 - DNA, 103 bp, Artificial Sequence
  Synthetic Polynucleotide
taatacgactcactataggggccgcagaggcggggaagcggggcgcgtggaacagaggagaccacgcatgccgcttcccaacctggcggcagcgcaaaagatg

SEQ ID NO: 208585 - DNA, 103 bp, Artificial Sequence
  Synthetic Polynucleotide
taatacgactcactatagggagcagcagcggccgcagaggcggggaagcgaacagaggagacgcttcatggcctctgcgaacctggcggcagcgcaaaagatg

SEQ ID NO: 208586 - DNA, 103 bp, Artificial Sequence
  Synthetic Polynucleotide
taatacgactcactatagggcggcggccgcagcagcagcggccgcagaggaacagaggagacctctgatgccgctgctgaacctggcggcagcgcaaaagatg

SEQ ID NO: 208587 - DNA, 103 bp, Artificial Sequence
  Synthetic Polynucleotide
taatacgactcactatagggtgtagggcggcggcggccgcagcagcagcgaacagaggagacgctgcatgtgcggccgcaacctggcggcagcgcaaaagatg

SEQ ID NO: 208588 - DNA, 103 bp, Artificial Sequence
  Synthetic Polynucleotide
taatacgactcactataggggtgcttgcccaggtccggggaggcgctgggaacagaggagacccagcatgtccccggacaacctggcggcagcgcaaaagatg

SEQ ID NO: 208589 - DNA, 103 bp, Artificial Sequence
  Synthetic Polynucleotide
taatacgactcactatagggcaggcctctttgtagggcggcggcggccgcaacagaggagagcggccatggccgccctaaacctggcggcagcgcaaaagatg

SEQ ID NO: 208590 - DNA, 103 bp, Artificial Sequence
  Synthetic Polynucleotide
taatacgactcactatagggggcccaacaccaggcctctttgtagggcggaacagaggagaccgcccatgaaagaggccaacctggcggcagcgcaaaagatg

SEQ ID NO: 208591 - DNA, 103 bp, Artificial Sequence
  Synthetic Polynucleotide
taatacgactcactatagggaagtccgacgggcccaacaccaggcctcttaacagaggagaaagaggatgggtgttgggaacctggcggcagcgcaaaagatg

SEQ ID NO: 208592 - DNA, 103 bp, Artificial Sequence
  Synthetic Polynucleotide
taatacgactcactataggggtactgcgcaaagtccgacgggcccaacacaacagaggagagtgttgatgccgtcggacaacctggcggcagcgcaaaagatg

SEQ ID NO: 208593 - DNA, 103 bp, Artificial Sequence
  Synthetic Polynucleotide
taatacgactcactatagggtctggctctggtactgcgcaaagtccgacgaacagaggagacgtcggatgttgcgcagtaacctggcggcagcgcaaaagatg

SEQ ID NO: 208594 - DNA, 103 bp, Artificial Sequence
  Synthetic Polynucleotide
taatacgactcactatagggagcgcggcgatctggctctggtactgcgcaaacagaggagatgcgcaatgccagagccaaacctggcggcagcgcaaaagatg

SEQ ID NO: 208595 - DNA, 103 bp, Artificial Sequence
  Synthetic Polynucleotide
taatacgactcactatagggggtctgcagcagcgcggcgatctggctctgaacagaggagacagagcatgatcgccgcgaacctggcggcagcgcaaaagatg

SEQ ID NO: 208596 - DNA, 103 bp, Artificial Sequence
  Synthetic Polynucleotide
taatacgactcactatagggggggggccttggtctgcagcagcgcggcgaaacagaggagatcgccgatgtgctgcagaaacctggcggcagcgcaaaagatg

SEQ ID NO: 208597 - DNA, 103 bp, Artificial Sequence
  Synthetic Polynucleotide
taatacgactcactataggggtggccgccaggggggccttggtctgcagcaacagaggagagctgcaatgcaaggccccaacctggcggcagcgcaaaagatg

SEQ ID NO: 208598 - DNA, 103 bp, Artificial Sequence
  Synthetic Polynucleotide
taatacgactcactatagggcctcctggccgtggccgccaggggggccttaacagaggagaaaggccatgctggcggccaacctggcggcagcgcaaaagatg

SEQ ID NO: 208599 - DNA, 103 bp, Artificial Sequence
  Synthetic Polynucleotide
taatacgactcactatagggccaggggcgagtgcttgcccaggtccggggaacagaggagaccccggatgtgggcaagcaacctggcggcagcgcaaaagatg

SEQ ID NO: 208600 - DNA, 103 bp, Artificial Sequence
  Synthetic Polynucleotide
taatacgactcactatagggagcggcggcacctcctggccgtggccgccaaacagaggagatggcggatgcggccaggaaacctggcggcagcgcaaaagatg

SEQ ID NO: 208601 - DNA, 103 bp, Artificial Sequence
  Synthetic Polynucleotide
taatacgactcactatagggggacagcggcagcggcggcacctcctggccaacagaggagaggccagatggtgccgccgaacctggcggcagcgcaaaagatg

SEQ ID NO: 208602 - DNA, 103 bp, Artificial Sequence
  Synthetic Polynucleotide
taatacgactcactatagggctggcagttgggacagcggcagcggcggcaaacagaggagatgccgcatgtgccgctgtaacctggcggcagcgcaaaagatg

SEQ ID NO: 208603 - DNA, 103 bp, Artificial Sequence
  Synthetic Polynucleotide
taatacgactcactatagggcgcccgccgcctggcagttgggacagcggcaacagaggagagccgctatgccaactgccaacctggcggcagcgcaaaagatg

SEQ ID NO: 208604 - DNA, 103 bp, Artificial Sequence
  Synthetic Polynucleotide
taatacgactcactatagggtcgggggcgccgcccgccgcctggcagttgaacagaggagacaactgatgggcggcgggaacctggcggcagcgcaaaagatg

SEQ ID NO: 208605 - DNA, 103 bp, Artificial Sequence
  Synthetic Polynucleotide
taatacgactcactatagggcggctccgcctcgggggcgccgcccgccgcaacagaggagagcggcgatgggcgcccccaacctggcggcagcgcaaaagatg

SEQ ID NO: 208606 - DNA, 103 bp, Artificial Sequence
  Synthetic Polynucleotide
taatacgactcactatagggtcttcttccccggctccgcctcgggggcgcaacagaggagagcgcccatgaggcggagcaacctggcggcagcgcaaaagatg

SEQ ID NO: 208607 - DNA, 103 bp, Artificial Sequence
  Synthetic Polynucleotide
taatacgactcactatagggacgtgctgcttcttcttccccggctccgccaacagaggagaggcggaatgggggaagaaaacctggcggcagcgcaaaagatg

SEQ ID NO: 208608 - DNA, 103 bp, Artificial Sequence
  Synthetic Polynucleotide
taatacgactcactatagggcacgtggcacacgtgctgcttcttcttcccaacagaggagagggaagatgaagcagcacaacctggcggcagcgcaaaagatg

SEQ ID NO: 208609 - DNA, 103 bp, Artificial Sequence
  Synthetic Polynucleotide
taatacgactcactatagggcgcagcccggcacgtggcacacgtgctgctaacagaggagaagcagcatgtgtgccacgaacctggcggcagcgcaaaagatg

SEQ ID NO: 208610 - DNA, 103 bp, Artificial Sequence
  Synthetic Polynucleotide
taatacgactcactataggggccagcaatgccaggggcgagtgcttgcccaacagaggagagggcaaatgctcgcccctaacctggcggcagcgcaaaagatg

SEQ ID NO: 208611 - DNA, 103 bp, Artificial Sequence
  Synthetic Polynucleotide
taatacgactcactatagggtacaccttgccgcagcccggcacgtggcacaacagaggagagtgccaatggccgggctgaacctggcggcagcgcaaaagatg

SEQ ID NO: 208612 - DNA, 103 bp, Artificial Sequence
  Synthetic Polynucleotide
taatacgactcactatagggcgtcttcccgtacaccttgccgcagcccggaacagaggagaccgggcatgggcaaggtgaacctggcggcagcgcaaaagatg

SEQ ID NO: 208613 - DNA, 103 bp, Artificial Sequence
  Synthetic Polynucleotide
taatacgactcactatagggtcaggtgcgacgtcttcccgtacaccttgcaacagaggagagcaaggatgacgggaagaaacctggcggcagcgcaaaagatg

SEQ ID NO: 208614 - DNA, 103 bp, Artificial Sequence
  Synthetic Polynucleotide
taatacgactcactatagggaggtgcgccttcaggtgcgacgtcttcccgaacagaggagacgggaaatggtcgcacctaacctggcggcagcgcaaaagatg

SEQ ID NO: 208615 - DNA, 103 bp, Artificial Sequence
  Synthetic Polynucleotide
taatacgactcactataggggtgccagcgcaggtgcgccttcaggtgcgaaacagaggagatcgcacatgaaggcgcacaacctggcggcagcgcaaaagatg

SEQ ID NO: 208616 - DNA, 103 bp, Artificial Sequence
  Synthetic Polynucleotide
taatacgactcactataggggctcgcccgtgtgccagcgcaggtgcgcctaacagaggagaaggcgcatgtgcgctggcaacctggcggcagcgcaaaagatg

SEQ ID NO: 208617 - DNA, 103 bp, Artificial Sequence
  Synthetic Polynucleotide
taatacgactcactatagggacgaagggtcgctcgcccgtgtgccagcgcaacagaggagagcgctgatgcacgggcgaaacctggcggcagcgcaaaagatg

SEQ ID NO: 208618 - DNA, 103 bp, Artificial Sequence
  Synthetic Polynucleotide
taatacgactcactatagggccagttgcacacgaagggtcgctcgcccgtaacagaggagaacgggcatgcgacccttcaacctggcggcagcgcaaaagatg

SEQ ID NO: 208619 - DNA, 103 bp, Artificial Sequence
  Synthetic Polynucleotide
taatacgactcactatagggcgcagaagagccagttgcacacgaagggtcaacagaggagagaccctatgtgtgcaactaacctggcggcagcgcaaaagatg

SEQ ID NO: 208620 - DNA, 103 bp, Artificial Sequence
  Synthetic Polynucleotide
taatacgactcactatagggaagctcttcccgcagaagagccagttgcacaacagaggagagtgcaaatggctcttctgaacctggcggcagcgcaaaagatg

SEQ ID NO: 208621 - DNA, 103 bp, Artificial Sequence
  Synthetic Polynucleotide
taatacgactcactatagggaacttcctcctcaagcagggaggacgccataacagaggagaatggcgatgtccctgcttaacctggcggcagcgcaaaagatg

SEQ ID NO: 208622 - DNA, 103 bp, Artificial Sequence
  Synthetic Polynucleotide
taatacgactcactataggggcccagagttgttgagtcccgcagagggctaacagaggagaagccctatgcgggactcaaacctggcggcagcgcaaaagatg

SEQ ID NO: 208623 - DNA, 103 bp, Artificial Sequence
  Synthetic Polynucleotide
taatacgactcactatagggctcatccgaacgagtgaacctcttgccgcaaacagaggagatgcggcatgaggttcactaacctggcggcagcgcaaaagatg

SEQ ID NO: 208624 - DNA, 103 bp, Artificial Sequence
  Synthetic Polynucleotide
taatacgactcactataggggacgctccagctcatccgaacgagtgaaccaacagaggagaggttcaatggttcggatgaacctggcggcagcgcaaaagatg

SEQ ID NO: 208625 - DNA, 103 bp, Artificial Sequence
  Synthetic Polynucleotide
taatacgactcactataggggtgcgcacatgacgctccagctcatccgaaaacagaggagattcggaatggctggagcgaacctggcggcagcgcaaaagatg

SEQ ID NO: 208626 - DNA, 103 bp, Artificial Sequence
  Synthetic Polynucleotide
taatacgactcactatagggccgggtgtgagtgcgcacatgacgctccagaacagaggagactggagatgcatgtgcgcaacctggcggcagcgcaaaagatg

SEQ ID NO: 208627 - DNA, 103 bp, Artificial Sequence
  Synthetic Polynucleotide
taatacgactcactatagggacttcttctcccgggtgtgagtgcgcacataacagaggagaatgtgcatgctcacacccaacctggcggcagcgcaaaagatg

SEQ ID NO: 208628 - DNA, 103 bp, Artificial Sequence
  Synthetic Polynucleotide
taatacgactcactatagggaggcaggtgaacttcttctcccgggtgtgaaacagaggagatcacacatgggagaagaaaacctggcggcagcgcaaaagatg

SEQ ID NO: 208629 - DNA, 103 bp, Artificial Sequence
  Synthetic Polynucleotide
taatacgactcactatagggggagcagagcaggcaggtgaacttcttctcaacagaggagagagaagatgttcacctgcaacctggcggcagcgcaaaagatg

SEQ ID NO: 208630 - DNA, 103 bp, Artificial Sequence
  Synthetic Polynucleotide
taatacgactcactatagggtaaagcgcttggagcagagcaggcaggtgaaacagaggagatcacctatgtgctctgctaacctggcggcagcgcaaaagatg

SEQ ID NO: 208631 - DNA, 103 bp, Artificial Sequence
  Synthetic Polynucleotide
taatacgactcactatagggtcgcttcgggtaaagcgcttggagcagagcaacagaggagagctctgatgcaagcgcttaacctggcggcagcgcaaaagatg

SEQ ID NO: 208632 - DNA, 103 bp, Artificial Sequence
  Synthetic Polynucleotide
taatacgactcactataggggctcaggtggtcgcttcgggtaaagcgcttaacagaggagaaagcgcatgacccgaagcaacctggcggcagcgcaaaagatg

SEQ ID NO: 208633 - DNA, 103 bp, Artificial Sequence
  Synthetic Polynucleotide
taatacgactcactatagggtgcctgctttgcccagagttgttgagtcccaacagaggagagggactatgcaactctggaacctggcggcagcgcaaaagatg

SEQ ID NO: 208634 - DNA, 103 bp, Artificial Sequence
  Synthetic Polynucleotide
taatacgactcactataggggctggtgtttgctcaggtggtcgcttcgggaacagaggagacccgaaatgaccacctgaaacctggcggcagcgcaaaagatg

SEQ ID NO: 208635 - DNA, 103 bp, Artificial Sequence
  Synthetic Polynucleotide
taatacgactcactatagggccatgggtgcgctggtgtttgctcaggtggaacagaggagaccacctatgcaaacaccaaacctggcggcagcgcaaaagatg

SEQ ID NO: 208636 - DNA, 103 bp, Artificial Sequence
  Synthetic Polynucleotide
taatacgactcactataggggcctggttctccatgggtgcgctggtgtttaacagaggagaaaacacatgcgcacccataacctggcggcagcgcaaaagatg

SEQ ID NO: 208637 - DNA, 103 bp, Artificial Sequence
  Synthetic Polynucleotide
taatacgactcactatagggggggacccgggcctggttctccatgggtgcaacagaggagagcacccatggagaaccagaacctggcggcagcgcaaaagatg

SEQ ID NO: 208638 - DNA, 103 bp, Artificial Sequence
  Synthetic Polynucleotide
taatacgactcactatagggccactgggagggggacccgggcctggttctaacagaggagaagaaccatgcccgggtccaacctggcggcagcgcaaaagatg

SEQ ID NO: 208639 - DNA, 103 bp, Artificial Sequence
  Synthetic Polynucleotide
taatacgactcactatagggctccttggggccactgggagggggacccggaacagaggagaccgggtatgcctcccagtaacctggcggcagcgcaaaagatg

SEQ ID NO: 208640 - DNA, 103 bp, Artificial Sequence
  Synthetic Polynucleotide
taatacgactcactatagggcctcccccagctccttggggccactgggagaacagaggagactcccaatggccccaaggaacctggcggcagcgcaaaagatg

SEQ ID NO: 208641 - DNA, 103 bp, Artificial Sequence
  Synthetic Polynucleotide
taatacgactcactataggggtgctgcggccctcccccagctccttggggaacagaggagaccccaaatggctgggggaaacctggcggcagcgcaaaagatg

SEQ ID NO: 208642 - DNA, 103 bp, Artificial Sequence
  Synthetic Polynucleotide
taatacgactcactatagggctcttcccccgtgctgcggccctcccccagaacagaggagactggggatgggccgcagcaacctggcggcagcgcaaaagatg

SEQ ID NO: 208643 - DNA, 103 bp, Artificial Sequence
  Synthetic Polynucleotide
taatacgactcactataggggactggcctcctcttcccccgtgctgcggcaacagaggagagccgcaatgcgggggaagaacctggcggcagcgcaaaagatg

SEQ ID NO: 208644 - DNA, 103 bp, Artificial Sequence
  Synthetic Polynucleotide
taatacgactcactatagggggcttctttgtgcctgctttgcccagagttaacagaggagaaactctatgcaaagcaggaacctggcggcagcgcaaaagatg

SEQ ID NO: 208645 - DNA, 103 bp, Artificial Sequence
  Synthetic Polynucleotide
taatacgactcactatagggcggggcgtctgactggcctcctcttcccccaacagaggagagggggaatgggaggccagaacctggcggcagcgcaaaagatg

SEQ ID NO: 208646 - DNA, 103 bp, Artificial Sequence
  Synthetic Polynucleotide
taatacgactcactatagggggcagaaggtcggggcgtctgactggcctcaacagaggagagaggccatgcagacgcccaacctggcggcagcgcaaaagatg

SEQ ID NO: 208647 - DNA, 103 bp, Artificial Sequence
  Synthetic Polynucleotide
taatacgactcactatagggttgctggcgaggcagaaggtcggggcgtctaacagaggagaagacgcatggaccttctgaacctggcggcagcgcaaaagatg

SEQ ID NO: 208648 - DNA, 103 bp, Artificial Sequence
  Synthetic Polynucleotide
taatacgactcactatagggttctctggggttgctggcgaggcagaaggtaacagaggagaaccttcatgctcgccagcaacctggcggcagcgcaaaagatg

SEQ ID NO: 208649 - DNA, 103 bp, Artificial Sequence
  Synthetic Polynucleotide
taatacgactcactatagggtccaggggctttctctggggttgctggcgaaacagaggagatcgccaatgaccccagagaacctggcggcagcgcaaaagatg

SEQ ID NO: 208650 - DNA, 103 bp, Artificial Sequence
  Synthetic Polynucleotide
taatacgactcactatagggcagggctgcctccaggggctttctctggggaacagaggagaccccagatgaagcccctgaacctggcggcagcgcaaaagatg

SEQ ID NO: 208651 - DNA, 103 bp, Artificial Sequence
  Synthetic Polynucleotide
taatacgactcactatagggttgctctgctcagggctgcctccaggggctaacagaggagaagccccatgaggcagcccaacctggcggcagcgcaaaagatg

SEQ ID NO: 208652 - DNA, 103 bp, Artificial Sequence
  Synthetic Polynucleotide
taatacgactcactatagggctccagcaagttgctctgctcagggctgccaacagaggagaggcagcatggagcagagcaacctggcggcagcgcaaaagatg

SEQ ID NO: 208653 - DNA, 103 bp, Artificial Sequence
  Synthetic Polynucleotide
taatacgactcactatagggcacagagtacggcttctttgtgcctgctttaacagaggagaaaagcaatgacaaagaagaacctggcggcagcgcaaaagatg

SEQ ID NO: 208654 - DNA, 103 bp, Artificial Sequence
  Synthetic Polynucleotide
taatacgactcactatagggggtcactgcccacagagtacggcttctttgaacagaggagacaaagaatgcgtactctgaacctggcggcagcgcaaaagatg

SEQ ID NO: 208655 - DNA, 103 bp, Artificial Sequence
  Synthetic Polynucleotide
taatacgactcactataggggaggctgaaaggtcactgcccacagagtacaacagaggagagtactcatggggcagtgaaacctggcggcagcgcaaaagatg

SEQ ID NO: 208656 - DNA, 103 bp, Artificial Sequence
  Synthetic Polynucleotide
taatacgactcactatagggcatggttttggaggctgaaaggtcactgccaacagaggagaggcagtatgctttcagccaacctggcggcagcgcaaaagatg

SEQ ID NO: 208657 - DNA, 103 bp, Artificial Sequence
  Synthetic Polynucleotide
taatacgactcactatagggaagcatcccccatggttttggaggctgaaaaacagaggagatttcagatgccaaaaccaaacctggcggcagcgcaaaagatg

SEQ ID NO: 208658 - DNA, 103 bp, Artificial Sequence
  Synthetic Polynucleotide
taatacgactcactatagggggggctggataagcatcccccatggttttgaacagaggagacaaaacatggggggatgcaacctggcggcagcgcaaaagatg

SEQ ID NO: 208659 - DNA, 103 bp, Artificial Sequence
  Synthetic Polynucleotide
taatacgactcactataggggcttgtaaagggggctggataagcatccccaacagaggagaggggatatgtatccagccaacctggcggcagcgcaaaagatg

SEQ ID NO: 208660 - DNA, 103 bp, Artificial Sequence
  Synthetic Polynucleotide
taatacgactcactatagggagccatagtgaacttcctcctcaagcagggaacagaggagaccctgcatgaggaggaagaacctggcggcagcgcaaaagatg

SEQ ID NO: 208661 - DNA, 103 bp, Artificial Sequence
  Synthetic Polynucleotide
taatacgactcactataggggcccattagtgcttgtaaagggggctggataacagaggagaatccagatgcctttacaaaacctggcggcagcgcaaaagatg

SEQ ID NO: 208662 - DNA, 103 bp, Artificial Sequence
  Synthetic Polynucleotide
taatacgactcactatagggggtgaaaggagcccattagtgcttgtaaagaacagaggagactttacatgcactaatggaacctggcggcagcgcaaaagatg

SEQ ID NO: 208663 - DNA, 103 bp, Artificial Sequence
  Synthetic Polynucleotide
taatacgactcactatagggactgcctgcaggtgaaaggagcccattagtaacagaggagaactaatatgctcctttcaaacctggcggcagcgcaaaagatg

SEQ ID NO: 208664 - DNA, 103 bp, Artificial Sequence
  Synthetic Polynucleotide
taatacgactcactataggggtgctggaggactgcctgcaggtgaaaggaaacagaggagatcctttatgctgcaggcaaacctggcggcagcgcaaaagatg

SEQ ID NO: 208665 - DNA, 103 bp, Artificial Sequence
  Synthetic Polynucleotide
taatacgactcactatagggcctgaggtgggtgctggaggactgcctgcaaacagaggagatgcaggatgtcctccagcaacctggcggcagcgcaaaagatg

SEQ ID NO: 208666 - DNA, 103 bp, Artificial Sequence
  Synthetic Polynucleotide
taatacgactcactatagggattagcatagcctgaggtgggtgctggaggaacagaggagacctccaatgcccacctcaaacctggcggcagcgcaaaagatg

SEQ ID NO: 208667 - DNA, 103 bp, Artificial Sequence
  Synthetic Polynucleotide
taatacgactcactataggggagggtaatcattagcatagcctgaggtggaacagaggagaccacctatggctatgctaaacctggcggcagcgcaaaagatg

SEQ ID NO: 208668 - DNA, 103 bp, Artificial Sequence
  Synthetic Polynucleotide
taatacgactcactatagggtgggaaaagggagggtaatcattagcatagaacagaggagactatgcatgtgattacccaacctggcggcagcgcaaaagatg

SEQ ID NO: 208669 - DNA, 103 bp, Artificial Sequence
  Synthetic Polynucleotide
taatacgactcactatagggagggaatgagtgggaaaagggagggtaatcaacagaggagagattacatgcccttttccaacctggcggcagcgcaaaagatg

SEQ ID NO: 208670 - DNA, 103 bp, Artificial Sequence
  Synthetic Polynucleotide
taatacgactcactatagggctgtgggcccagggaatgagtgggaaaaggaacagaggagaccttttatgactcattccaacctggcggcagcgcaaaagatg

SEQ ID NO: 208671 - DNA, 103 bp, Artificial Sequence
  Synthetic Polynucleotide
taatacgactcactatagggaggggactggagccatagtgaacttcctccaacagaggagaggaggaatgtcactatggaacctggcggcagcgcaaaagatg

SEQ ID NO: 208672 - DNA, 103 bp, Artificial Sequence
  Synthetic Polynucleotide
taatacgactcactatagggtcctgggtgcctgtgggcccagggaatgagaacagaggagactcattatgtgggcccacaacctggcggcagcgcaaaagatg

SEQ ID NO: 208673 - DNA, 103 bp, Artificial Sequence
  Synthetic Polynucleotide
taatacgactcactatagggtagcccagggtcctgggtgcctgtgggcccaacagaggagagggcccatgggcacccagaacctggcggcagcgcaaaagatg

SEQ ID NO: 208674 - DNA, 103 bp, Artificial Sequence
  Synthetic Polynucleotide
taatacgactcactatagggtgggcactagtagcccagggtcctgggtgcaacagaggagagcacccatgaccctgggcaacctggcggcagcgcaaaagatg

SEQ ID NO: 208675 - DNA, 103 bp, Artificial Sequence
  Synthetic Polynucleotide
taatacgactcactatagggctgtgccccttgggcactagtagcccagggaacagaggagaccctggatgactagtgccaacctggcggcagcgcaaaagatg

SEQ ID NO: 208676 - DNA, 103 bp, Artificial Sequence
  Synthetic Polynucleotide
taatacgactcactataggggtcagaagagctgtgccccttgggcactagaacagaggagactagtgatgaaggggcacaacctggcggcagcgcaaaagatg

SEQ ID NO: 208677 - DNA, 103 bp, Artificial Sequence
  Synthetic Polynucleotide
taatacgactcactatagggtgggcagacagtcagaagagctgtgcccctaacagaggagaaggggcatggctcttctgaacctggcggcagcgcaaaagatg

SEQ ID NO: 208678 - DNA, 103 bp, Artificial Sequence
  Synthetic Polynucleotide
taatacgactcactataggggtgtagacactgggcagacagtcagaagagaacagaggagactcttcatgctgtctgccaacctggcggcagcgcaaaagatg

SEQ ID NO: 208679 - DNA, 103 bp, Artificial Sequence
  Synthetic Polynucleotide
taatacgactcactataggggtccagagaggtgtagacactgggcagacaaacagaggagatgtctgatgagtgtctacaacctggcggcagcgcaaaagatg

SEQ ID NO: 208680 - DNA, 103 bp, Artificial Sequence
  Synthetic Polynucleotide
taatacgactcactatagggggtgtgtcatgtccagagaggtgtagacacaacagaggagagtgtctatgcctctctggaacctggcggcagcgcaaaagatg

SEQ ID NO: 208681 - DNA, 103 bp, Artificial Sequence
  Synthetic Polynucleotide
taatacgactcactataggggagccataggggtgtgtcatgtccagagagaacagaggagactctctatgcatgacacaaacctggcggcagcgcaaaagatg

SEQ ID NO: 208682 - DNA, 103 bp, Artificial Sequence
  Synthetic Polynucleotide
taatacgactcactatagggcagcatggccaggggactggagccatagtgaacagaggagacactatatgtccagtcccaacctggcggcagcgcaaaagatg

SEQ ID NO: 208683 - DNA, 103 bp, Artificial Sequence
  Synthetic Polynucleotide
taatacgactcactatagggcttgtaccaggagccataggggtgtgtcataacagaggagaatgacaatgccctatggcaacctggcggcagcgcaaaagatg

SEQ ID NO: 208684 - DNA, 103 bp, Artificial Sequence
  Synthetic Polynucleotide
taatacgactcactatagggggatgcctgccttgtaccaggagccataggaacagaggagacctatgatgcctggtacaaacctggcggcagcgcaaaagatg

SEQ ID NO: 208685 - DNA, 103 bp, Artificial Sequence
  Synthetic Polynucleotide
taatacgactcactatagggatgcctgcatggatgcctgccttgtaccagaacagaggagactggtaatgggcaggcataacctggcggcagcgcaaaagatg

SEQ ID NO: 208686 - DNA, 103 bp, Artificial Sequence
  Synthetic Polynucleotide
taatacgactcactataggggcctggtgaaatgcctgcatggatgcctgcaacagaggagagcaggcatgcatgcaggcaacctggcggcagcgcaaaagatg

SEQ ID NO: 208687 - DNA, 103 bp, Artificial Sequence
  Synthetic Polynucleotide
taatacgactcactatagggtgttgcctgggcctggtgaaatgcctgcataacagaggagaatgcagatgtttcaccagaacctggcggcagcgcaaaagatg

SEQ ID NO: 208688 - DNA, 103 bp, Artificial Sequence
  Synthetic Polynucleotide
taatacgactcactatagggggagtaggagtgttgcctgggcctggtgaaaacagaggagattcaccatgcccaggcaaaacctggcggcagcgcaaaagatg

SEQ ID NO: 208689 - DNA, 103 bp, Artificial Sequence
  Synthetic Polynucleotide
taatacgactcactatagggatcccaccatggagtaggagtgttgcctggaacagaggagaccaggcatgactcctactaacctggcggcagcgcaaaagatg

SEQ ID NO: 208690 - DNA, 103 bp, Artificial Sequence
  Synthetic Polynucleotide
taatacgactcactatagggcagggtgcatatcccaccatggagtaggagaacagaggagactcctaatgcatggtgggaacctggcggcagcgcaaaagatg

SEQ ID NO: 208691 - DNA, 103 bp, Artificial Sequence
  Synthetic Polynucleotide
taatacgactcactatagggcagttgcctccagggtgcatatcccaccataacagaggagaatggtgatgtatgcacccaacctggcggcagcgcaaaagatg

SEQ ID NO: 208692 - DNA, 103 bp, Artificial Sequence
  Synthetic Polynucleotide
taatacgactcactatagggaccacctagccagttgcctccagggtgcataacagaggagaatgcacatgggaggcaacaacctggcggcagcgcaaaagatg

SEQ ID NO: 208693 - DNA, 103 bp, Artificial Sequence
  Synthetic Polynucleotide
taatacgactcactatagggacgctgccgtcagcatggccaggggactggaacagaggagaccagtcatgtggccatgcaacctggcggcagcgcaaaagatg

SEQ ID NO: 208694 - DNA, 103 bp, Artificial Sequence
  Synthetic Polynucleotide
taatacgactcactatagggggccctgcccaccacctagccagttgcctcaacagaggagagaggcaatgggctaggtgaacctggcggcagcgcaaaagatg

SEQ ID NO: 208695 - DNA, 103 bp, Artificial Sequence
  Synthetic Polynucleotide
taatacgactcactatagggccatcaccctggccctgcccaccacctagcaacagaggagagctaggatgtgggcagggaacctggcggcagcgcaaaagatg

SEQ ID NO: 208696 - DNA, 103 bp, Artificial Sequence
  Synthetic Polynucleotide
taatacgactcactatagggcccttgcagcccatcaccctggccctgcccaacagaggagagggcagatgcagggtgataacctggcggcagcgcaaaagatg

SEQ ID NO: 208697 - DNA, 103 bp, Artificial Sequence
  Synthetic Polynucleotide
taatacgactcactatagggtgggcagtgtcccttgcagcccatcaccctaacagaggagaagggtgatgggctgcaagaacctggcggcagcgcaaaagatg

SEQ ID NO: 208698 - DNA, 103 bp, Artificial Sequence
  Synthetic Polynucleotide
taatacgactcactataggggctggacctgtgggcagtgtcccttgcagcaacagaggagagctgcaatggacactgccaacctggcggcagcgcaaaagatg

SEQ ID NO: 208699 - DNA, 103 bp, Artificial Sequence
  Synthetic Polynucleotide
taatacgactcactatagggtggaggctgagctggacctgtgggcagtgtaacagaggagaacactgatgacaggtccaaacctggcggcagcgcaaaagatg

SEQ ID NO: 208700 - DNA, 103 bp, Artificial Sequence
  Synthetic Polynucleotide
taatacgactcactataggggggggttcagtggaggctgagctggacctgaacagaggagacaggtcatgctcagcctcaacctggcggcagcgcaaaagatg

SEQ ID NO: 208701 - DNA, 103 bp, Artificial Sequence
  Synthetic Polynucleotide
taatacgactcactataggggtgggcagctgggggttcagtggaggctgaaacagaggagatcagccatgactgaacccaacctggcggcagcgcaaaagatg

SEQ ID NO: 208702 - DNA, 103 bp, Artificial Sequence
  Synthetic Polynucleotide
taatacgactcactatagggagatgggtaggtgggcagctgggggttcagaacagaggagactgaacatgcagctgcccaacctggcggcagcgcaaaagatg

SEQ ID NO: 208703 - DNA, 103 bp, Artificial Sequence
  Synthetic Polynucleotide
taatacgactcactataggggagcaaagtcagatgggtaggtgggcagctaacagaggagaagctgcatgcctacccataacctggcggcagcgcaaaagatg

SEQ ID NO: 208704 - DNA, 103 bp, Artificial Sequence
  Synthetic Polynucleotide
taatacgactcactatagggaatttgctgcacgctgccgtcagcatggccaacagaggagaggccatatggacggcagcaacctggcggcagcgcaaaagatg

SEQ ID NO: 208705 - DNA, 103 bp, Artificial Sequence
  Synthetic Polynucleotide
taatacgactcactatagggggattaaggggagcaaagtcagatgggtagaacagaggagactacccatgtgactttgcaacctggcggcagcgcaaaagatg

SEQ ID NO: 208706 - DNA, 103 bp, Artificial Sequence
  Synthetic Polynucleotide
taatacgactcactataggggtagggggctggattaaggggagcaaagtcaacagaggagagactttatgccccttaataacctggcggcagcgcaaaagatg

SEQ ID NO: 208707 - DNA, 103 bp, Artificial Sequence
  Synthetic Polynucleotide
taatacgactcactatagggggggagctgggtagggggctggattaagggaacagaggagacccttaatgcagccccctaacctggcggcagcgcaaaagatg

SEQ ID NO: 208708 - DNA, 103 bp, Artificial Sequence
  Synthetic Polynucleotide
taatacgactcactatagggtgcaagaggtggggagctgggtagggggctaacagaggagaagccccatgcccagctccaacctggcggcagcgcaaaagatg

SEQ ID NO: 208709 - DNA, 103 bp, Artificial Sequence
  Synthetic Polynucleotide
taatacgactcactataggggggccctggttgcaagaggtggggagctggaacagaggagaccagctatgcacctcttgaacctggcggcagcgcaaaagatg

SEQ ID NO: 208710 - DNA, 103 bp, Artificial Sequence
  Synthetic Polynucleotide
taatacgactcactatagggagacatgctggggccctggttgcaagaggtaacagaggagaacctctatgaaccagggcaacctggcggcagcgcaaaagatg

SEQ ID NO: 208711 - DNA, 103 bp, Artificial Sequence
  Synthetic Polynucleotide
taatacgactcactatagggtcttggggcaagacatgctggggccctggtaacagaggagaaccaggatgccagcatgtaacctggcggcagcgcaaaagatg

SEQ ID NO: 208712 - DNA, 103 bp, Artificial Sequence
  Synthetic Polynucleotide
taatacgactcactatagggtttatagacatcttggggcaagacatgctgaacagaggagacagcatatgttgccccaaaacctggcggcagcgcaaaagatg

SEQ ID NO: 208713 - DNA, 103 bp, Artificial Sequence
  Synthetic Polynucleotide
taatacgactcactatagggctgccttgggtttatagacatcttggggcaaacagaggagatgccccatgatgtctataaacctggcggcagcgcaaaagatg

SEQ ID NO: 208714 - DNA, 103 bp, Artificial Sequence
  Synthetic Polynucleotide
taatacgactcactatagggctatttcccactgccttgggtttatagacaaacagaggagatgtctaatgacccaaggcaacctggcggcagcgcaaaagatg

SEQ ID NO: 208715 - DNA, 103 bp, Artificial Sequence
  Synthetic Polynucleotide
taatacgactcactatagggagagccaccaaatttgctgcacgctgccgtaacagaggagaacggcaatgtgcagcaaaaacctggcggcagcgcaaaagatg

SEQ ID NO: 208716 - DNA, 103 bp, Artificial Sequence
  Synthetic Polynucleotide
taatacgactcactatagggtagctgcccactatttcccactgccttgggaacagaggagacccaagatggtgggaaataacctggcggcagcgcaaaagatg

SEQ ID NO: 208717 - DNA, 103 bp, Artificial Sequence
  Synthetic Polynucleotide
taatacgactcactatagggcactcccttctagctgcccactatttcccaaacagaggagatgggaaatggtgggcagcaacctggcggcagcgcaaaagatg

SEQ ID NO: 208718 - DNA, 103 bp, Artificial Sequence
  Synthetic Polynucleotide
taatacgactcactatagggttggctccaccactcccttctagctgcccaaacagaggagatgggcaatgagaagggagaacctggcggcagcgcaaaagatg

SEQ ID NO: 208719 - DNA, 103 bp, Artificial Sequence
  Synthetic Polynucleotide
taatacgactcactatagggccgtgggggtttggctccaccactcccttcaacagaggagagaagggatgggtggagccaacctggcggcagcgcaaaagatg

SEQ ID NO: 208720 - DNA, 103 bp, Artificial Sequence
  Synthetic Polynucleotide
taatacgactcactatagggtgcttgcaccccgtgggggtttggctccacaacagaggagagtggagatgaacccccacaacctggcggcagcgcaaaagatg

SEQ ID NO: 208721 - DNA, 103 bp, Artificial Sequence
  Synthetic Polynucleotide
taatacgactcactatagggctacccccagtgcttgcaccccgtgggggtaacagaggagaacccccatggggtgcaagaacctggcggcagcgcaaaagatg

SEQ ID NO: 208722 - DNA, 103 bp, Artificial Sequence
  Synthetic Polynucleotide
taatacgactcactatagggatatccaccactacccccagtgcttgcaccaacagaggagaggtgcaatgactgggggtaacctggcggcagcgcaaaagatg

SEQ ID NO: 208723 - DNA, 103 bp, Artificial Sequence
  Synthetic Polynucleotide
taatacgactcactatagggcactgcccccatatccaccactacccccagaacagaggagactggggatggtggtggataacctggcggcagcgcaaaagatg

SEQ ID NO: 208724 - DNA, 103 bp, Artificial Sequence
  Synthetic Polynucleotide
taatacgactcactatagggcgccctgccccactgcccccatatccaccaaacagaggagatggtggatgtgggggcagaacctggcggcagcgcaaaagatg

SEQ ID NO: 208725 - DNA, 103 bp, Artificial Sequence
  Synthetic Polynucleotide
taatacgactcactataggggcaggaggagcgccctgccccactgcccccaacagaggagagggggcatgggggcagggaacctggcggcagcgcaaaagatg

SEQ ID NO: 208726 - DNA, 103 bp, Artificial Sequence
  Synthetic Polynucleotide
taatacgactcactataggggcagagggctagagccaccaaatttgctgcaacagaggagagcagcaatgttggtggctaacctggcggcagcgcaaaagatg

SEQ ID NO: 208727 - DNA, 103 bp, Artificial Sequence
  Synthetic Polynucleotide
taatacgactcactatagggtagggcagtcgcaggaggagcgccctgcccaacagaggagagggcagatggctcctcctaacctggcggcagcgcaaaagatg

SEQ ID NO: 208728 - DNA, 103 bp, Artificial Sequence
  Synthetic Polynucleotide
taatacgactcactatagggtcctggcaattagggcagtcgcaggaggagaacagaggagactcctcatgcgactgcccaacctggcggcagcgcaaaagatg

SEQ ID NO: 208729 - DNA, 103 bp, Artificial Sequence
  Synthetic Polynucleotide
taatacgactcactatagggccgctctagctcctggcaattagggcagtcaacagaggagagactgcatgaattgccagaacctggcggcagcgcaaaagatg

SEQ ID NO: 208730 - DNA, 103 bp, Artificial Sequence
  Synthetic Polynucleotide
taatacgactcactatagggctgctcccagccgctctagctcctggcaataacagaggagaattgccatgagctagagcaacctggcggcagcgcaaaagatg

SEQ ID NO: 208731 - DNA, 103 bp, Artificial Sequence
  Synthetic Polynucleotide
taatacgactcactatagggccagccgctgctgctcccagccgctctagcaacagaggagagctagaatggctgggagcaacctggcggcagcgcaaaagatg

SEQ ID NO: 208732 - DNA, 103 bp, Artificial Sequence
  Synthetic Polynucleotide
taatacgactcactatagggcttccgcagcccagccgctgctgctcccagaacagaggagactgggaatggcagcggctaacctggcggcagcgcaaaagatg

SEQ ID NO: 208733 - DNA, 103 bp, Artificial Sequence
  Synthetic Polynucleotide
taatacgactcactatagggggatgggcttcttccgcagcccagccgctgaacagaggagacagcggatgggctgcggaaacctggcggcagcgcaaaagatg

SEQ ID NO: 208734 - DNA, 103 bp, Artificial Sequence
  Synthetic Polynucleotide
taatacgactcactatagggtggcagctgtggatgggcttcttccgcagcaacagaggagagctgcgatggaagcccataacctggcggcagcgcaaaagatg

SEQ ID NO: 208735 - DNA, 103 bp, Artificial Sequence
  Synthetic Polynucleotide
taatacgactcactataggggccagggatgtggcagctgtggatgggcttaacagaggagaaagcccatgcacagctgcaacctggcggcagcgcaaaagatg

SEQ ID NO: 208736 - DNA, 103 bp, Artificial Sequence
  Synthetic Polynucleotide
taatacgactcactatagggccttgccgcagccagggatgtggcagctgtaacagaggagaacagctatgacatccctgaacctggcggcagcgcaaaagatg

SEQ ID NO: 208737 - DNA, 103 bp, Artificial Sequence
  Synthetic Polynucleotide
taatacgactcactataggggttgagtcccgcagagggctagagccaccaaacagaggagatggtggatgtagccctctaacctggcggcagcgcaaaagatg

SEQ ID NO: 208738 - DNA, 103 bp, Artificial Sequence
  Synthetic Polynucleotide
taatacgactcactatagggttgccatacaccttgccgcagccagggatgaacagaggagacatcccatgctgcggcaaaacctggcggcagcgcaaaagatg

SEQ ID NO: 208739 - DNA, 103 bp, Artificial Sequence
  Synthetic Polynucleotide
taatacgactcactataggggtgcgaagccttgccatacaccttgccgcaaacagaggagatgcggcatggtgtatggcaacctggcggcagcgcaaaagatg

SEQ ID NO: 208740 - DNA, 103 bp, Artificial Sequence
  Synthetic Polynucleotide
taatacgactcactataggggggccttcaggtgcgaagccttgccatacaaacagaggagatgtatgatgaggcttcgcaacctggcggcagcgcaaaagatg

SEQ ID NO: 208741 - DNA, 103 bp, Artificial Sequence
  Synthetic Polynucleotide
taatacgactcactatagggcagcgcaagtgggccttcaggtgcgaagccaacagaggagaggcttcatgcctgaaggcaacctggcggcagcgcaaaagatg

SEQ ID NO: 208742 - DNA, 103 bp, Artificial Sequence
  Synthetic Polynucleotide
taatacgactcactataggggcctgtgtgccagcgcaagtgggccttcagaacagaggagactgaagatgcacttgcgcaacctggcggcagcgcaaaagatg

SEQ ID NO: 208743 - DNA, 103 bp, Artificial Sequence
  Synthetic Polynucleotide
taatacgactcactatagggagggcctctcgcctgtgtgccagcgcaagtaacagaggagaacttgcatgggcacacagaacctggcggcagcgcaaaagatg

SEQ ID NO: 208744 - DNA, 103 bp, Artificial Sequence
  Synthetic Polynucleotide
taatacgactcactatagggttgcagacgaagggcctctcgcctgtgtgcaacagaggagagcacacatgcgagaggccaacctggcggcagcgcaaaagatg

SEQ ID NO: 208745 - DNA, 103 bp, Artificial Sequence
  Synthetic Polynucleotide
taatacgactcactataggggaagagccagttgcagacgaagggcctctcaacagaggagagagaggatgttcgtctgcaacctggcggcagcgcaaaagatg

SEQ ID NO: 208746 - DNA, 103 bp, Artificial Sequence
  Synthetic Polynucleotide
taatacgactcactatagggtcttgccgcagaagagccagttgcagacgaaacagaggagatcgtctatgactggctctaacctggcggcagcgcaaaagatg

SEQ ID NO: 208747 - DNA, 103 bp, Artificial Sequence
  Synthetic Polynucleotide
taatacgactcactatagggcgagtgaacctcttgccgcagaagagccagaacagaggagactggctatgctgcggcaaaacctggcggcagcgcaaaagatg

SEQ ID NO: 208748 - DNA, 103 bp, Artificial Sequence
  Synthetic Polynucleotide
taatacgactcactatagggaaacccttccattttgcacgcctgtaacataacagaggagaatgttaatggcgtgcaaaaacctggcggcagcgcaaaagatg

SEQ ID NO: 208749 - DNA, 103 bp, Artificial Sequence
  Synthetic Polynucleotide
taatacgactcactataggggagataggggtaatactcgtgcgtttggcgaacagaggagacgccaaatgcacgagtataacctggcggcagcgcaaaagatg

SEQ ID NO: 208750 - DNA, 103 bp, Artificial Sequence
  Synthetic Polynucleotide
taatacgactcactatagggcatcactgctgagataggggtaatactcgtaacagaggagaacgagtatgacccctatcaacctggcggcagcgcaaaagatg

SEQ ID NO: 208751 - DNA, 103 bp, Artificial Sequence
  Synthetic Polynucleotide
taatacgactcactatagggtggctctccccatcactgctgagataggggaacagaggagacccctaatgcagcagtgaaacctggcggcagcgcaaaagatg

SEQ ID NO: 208752 - DNA, 103 bp, Artificial Sequence
  Synthetic Polynucleotide
taatacgactcactatagggatggtcgctatggctctccccatcactgctaacagaggagaagcagtatgggggagagcaacctggcggcagcgcaaaagatg

SEQ ID NO: 208753 - DNA, 103 bp, Artificial Sequence
  Synthetic Polynucleotide
taatacgactcactatagggagtcccagtaatggtcgctatggctctcccaacagaggagagggagaatgatagcgaccaacctggcggcagcgcaaaagatg

SEQ ID NO: 208754 - DNA, 103 bp, Artificial Sequence
  Synthetic Polynucleotide
taatacgactcactatagggtgggggtggaagtcccagtaatggtcgctaaacagaggagatagcgaatgttactgggaaacctggcggcagcgcaaaagatg

SEQ ID NO: 208755 - DNA, 103 bp, Artificial Sequence
  Synthetic Polynucleotide
taatacgactcactataggggtgcacgtggtgggggtggaagtcccagtaaacagaggagatactggatgttccaccccaacctggcggcagcgcaaaagatg

SEQ ID NO: 208756 - DNA, 103 bp, Artificial Sequence
  Synthetic Polynucleotide
taatacgactcactatagggcgaactcgctgtgcacgtggtgggggtggaaacagaggagatccaccatgaccacgtgcaacctggcggcagcgcaaaagatg

SEQ ID NO: 208757 - DNA, 103 bp, Artificial Sequence
  Synthetic Polynucleotide
taatacgactcactataggggcgaagctctcgaactcgctgtgcacgtggaacagaggagaccacgtatgcagcgagttaacctggcggcagcgcaaaagatg

SEQ ID NO: 208758 - DNA, 103 bp, Artificial Sequence
  Synthetic Polynucleotide
taatacgactcactataggggttgttctcggcgaagctctcgaactcgctaacagaggagaagcgagatggagagcttcaacctggcggcagcgcaaaagatg

SEQ ID NO: 208759 - DNA, 103 bp, Artificial Sequence
  Synthetic Polynucleotide
taatacgactcactatagggggacgaggggaaacccttccattttgcacgaacagaggagacgtgcaatgtggaagggtaacctggcggcagcgcaaaagatg

SEQ ID NO: 208760 - DNA, 103 bp, Artificial Sequence
  Synthetic Polynucleotide
taatacgactcactataggggctccgtgaagttgttctcggcgaagctctaacagaggagaagagctatgccgagaacaaacctggcggcagcgcaaaagatg

SEQ ID NO: 208761 - DNA, 103 bp, Artificial Sequence
  Synthetic Polynucleotide
taatacgactcactatagggacgctctggagctccgtgaagttgttctcgaacagaggagacgagaaatgcttcacggaaacctggcggcagcgcaaaagatg

SEQ ID NO: 208762 - DNA, 103 bp, Artificial Sequence
  Synthetic Polynucleotide
taatacgactcactatagggcgggggctgcacgctctggagctccgtgaaaacagaggagattcacgatgctccagagcaacctggcggcagcgcaaaagatg

SEQ ID NO: 208763 - DNA, 103 bp, Artificial Sequence
  Synthetic Polynucleotide
taatacgactcactataggggctgcagctgcgggggctgcacgctctggaaacagaggagatccagaatgtgcagccccaacctggcggcagcgcaaaagatg

SEQ ID NO: 208764 - DNA, 103 bp, Artificial Sequence
  Synthetic Polynucleotide
taatacgactcactatagggcggtagagctgctgcagctgcgggggctgcaacagaggagagcagccatggcagctgcaaacctggcggcagcgcaaaagatg

SEQ ID NO: 208765 - DNA, 103 bp, Artificial Sequence
  Synthetic Polynucleotide
taatacgactcactatagggctccatgtggcggtagagctgctgcagctgaacagaggagacagctgatgcagctctacaacctggcggcagcgcaaaagatg

SEQ ID NO: 208766 - DNA, 103 bp, Artificial Sequence
  Synthetic Polynucleotide
taatacgactcactatagggtctgctccagctccatgtggcggtagagctaacagaggagaagctctatggccacatggaacctggcggcagcgcaaaagatg

SEQ ID NO: 208767 - DNA, 103 bp, Artificial Sequence
  Synthetic Polynucleotide
taatacgactcactatagggaggacgtgcatctgctccagctccatgtggaacagaggagaccacatatggctggagcaaacctggcggcagcgcaaaagatg

SEQ ID NO: 208768 - DNA, 103 bp, Artificial Sequence
  Synthetic Polynucleotide
taatacgactcactataggggggggtatcgaggacgtgcatctgctccagaacagaggagactggagatgatgcacgtcaacctggcggcagcgcaaaagatg

SEQ ID NO: 208769 - DNA, 103 bp, Artificial Sequence
  Synthetic Polynucleotide
taatacgactcactataggggtggcaccatgggggtatcgaggacgtgcaaacagaggagatgcacgatgtcgatacccaacctggcggcagcgcaaaagatg

SEQ ID NO: 208770 - DNA, 103 bp, Artificial Sequence
  Synthetic Polynucleotide
taatacgactcactatagggggctgaggggggacgaggggaaacccttccaacagaggagaggaaggatgtcccctcgtaacctggcggcagcgcaaaagatg

SEQ ID NO: 208771 - DNA, 103 bp, Artificial Sequence
  Synthetic Polynucleotide
taatacgactcactatagggctgggatggggtggcaccatgggggtatcgaacagaggagacgatacatgcatggtgccaacctggcggcagcgcaaaagatg

SEQ ID NO: 208772 - DNA, 103 bp, Artificial Sequence
  Synthetic Polynucleotide
taatacgactcactataggggtggccaagactgggatggggtggcaccataacagaggagaatggtgatgccccatcccaacctggcggcagcgcaaaagatg

SEQ ID NO: 208773 - DNA, 103 bp, Artificial Sequence
  Synthetic Polynucleotide
taatacgactcactatagggaggagacctggtggccaagactgggatgggaacagaggagacccatcatggtcttggccaacctggcggcagcgcaaaagatg

SEQ ID NO: 208774 - DNA, 103 bp, Artificial Sequence
  Synthetic Polynucleotide
taatacgactcactatagggcggggcaggtaggagacctggtggccaagaaacagaggagatcttggatgccaggtctcaacctggcggcagcgcaaaagatg

SEQ ID NO: 208775 - DNA, 103 bp, Artificial Sequence
  Synthetic Polynucleotide
taatacgactcactataggggaggcacatccggggcaggtaggagacctgaacagaggagacaggtcatgtacctgcccaacctggcggcagcgcaaaagatg

SEQ ID NO: 208776 - DNA, 103 bp, Artificial Sequence
  Synthetic Polynucleotide
taatacgactcactatagggatgggtactggaggcacatccggggcaggtaacagaggagaacctgcatgggatgtgccaacctggcggcagcgcaaaagatg

SEQ ID NO: 208777 - DNA, 103 bp, Artificial Sequence
  Synthetic Polynucleotide
taatacgactcactatagggggggacagggatgggtactggaggcacatcaacagaggagagatgtgatgccagtacccaacctggcggcagcgcaaaagatg

SEQ ID NO: 208778 - DNA, 103 bp, Artificial Sequence
  Synthetic Polynucleotide
taatacgactcactataggggggctgggctggggacagggatgggtactgaacagaggagacagtacatgtccctgtccaacctggcggcagcgcaaaagatg

SEQ ID NO: 208779 - DNA, 103 bp, Artificial Sequence
  Synthetic Polynucleotide
taatacgactcactatagggcatctgagctgggctgggctggggacagggaacagaggagaccctgtatgcagcccagcaacctggcggcagcgcaaaagatg

SEQ ID NO: 208780 - DNA, 103 bp, Artificial Sequence
  Synthetic Polynucleotide
taatacgactcactatagggccctcctcctcatctgagctgggctgggctaacagaggagaagcccaatgcagctcagaaacctggcggcagcgcaaaagatg

SEQ ID NO: 208781 - DNA, 103 bp, Artificial Sequence
  Synthetic Polynucleotide
taatacgactcactataggggtcttctgatggctgaggggggacgaggggaacagaggagacccctcatgccccctcagaacctggcggcagcgcaaaagatg

SEQ ID NO: 208782 - DNA, 103 bp, Artificial Sequence
  Synthetic Polynucleotide
taatacgactcactatagggctgccgctcgccctcctcctcatctgagctaacagaggagaagctcaatggaggaggagaacctggcggcagcgcaaaagatg

SEQ ID NO: 208783 - DNA, 103 bp, Artificial Sequence
  Synthetic Polynucleotide
taatacgactcactataggggtggggggctctgccgctcgccctcctcctaacagaggagaaggaggatggcgagcggcaacctggcggcagcgcaaaagatg

SEQ ID NO: 208784 - DNA, 103 bp, Artificial Sequence
  Synthetic Polynucleotide
taatacgactcactataggggacacctccagtggggggctctgccgctcgaacagaggagacgagcgatggagccccccaacctggcggcagcgcaaaagatg

SEQ ID NO: 208785 - DNA, 103 bp, Artificial Sequence
  Synthetic Polynucleotide
taatacgactcactatagggctcgccgtcagacacctccagtggggggctaacagaggagaagccccatgctggaggtgaacctggcggcagcgcaaaagatg

SEQ ID NO: 208786 - DNA, 103 bp, Artificial Sequence
  Synthetic Polynucleotide
taatacgactcactatagggggccatccgcctcgccgtcagacacctccaaacagaggagatggaggatgctgacggcgaacctggcggcagcgcaaaagatg

SEQ ID NO: 208787 - DNA, 103 bp, Artificial Sequence
  Synthetic Polynucleotide
taatacgactcactatagggccgggctccaggccatccgcctcgccgtcaaacagaggagatgacggatgggcggatggaacctggcggcagcgcaaaagatg

SEQ ID NO: 208788 - DNA, 103 bp, Artificial Sequence
  Synthetic Polynucleotide
taatacgactcactataggggagcccaggcccgggctccaggccatccgcaacagaggagagcggatatgctggagcccaacctggcggcagcgcaaaagatg

SEQ ID NO: 208789 - DNA, 103 bp, Artificial Sequence
  Synthetic Polynucleotide
taatacgactcactatagggccccaggcaggagcccaggcccgggctccaaacagaggagatggagcatgggcctgggcaacctggcggcagcgcaaaagatg

SEQ ID NO: 208790 - DNA, 103 bp, Artificial Sequence
  Synthetic Polynucleotide
taatacgactcactatagggctgcctgtctccccaggcaggagcccaggcaacagaggagagcctggatgcctgcctggaacctggcggcagcgcaaaagatg

SEQ ID NO: 208791 - DNA, 103 bp, Artificial Sequence
  Synthetic Polynucleotide
taatacgactcactatagggcttcttcttgctgcctgtctccccaggcagaacagaggagactgcctatggagacaggcaacctggcggcagcgcaaaagatg

SEQ ID NO: 208792 - DNA, 103 bp, Artificial Sequence
  Synthetic Polynucleotide
taatacgactcactatagggagggcaccaggtcttctgatggctgaggggaacagaggagacccctcatgcatcagaagaacctggcggcagcgcaaaagatg

SEQ ID NO: 208793 - DNA, 103 bp, Artificial Sequence
  Synthetic Polynucleotide
taatacgactcactatagggacaggcggatcttcttcttgctgcctgtctaacagaggagaagacagatggcaagaagaaacctggcggcagcgcaaaagatg

SEQ ID NO: 208794 - DNA, 103 bp, Artificial Sequence
  Synthetic Polynucleotide
taatacgactcactatagggaggaactggtacaggcggatcttcttcttgaacagaggagacaagaaatggatccgcctaacctggcggcagcgcaaaagatg

SEQ ID NO: 208795 - DNA, 103 bp, Artificial Sequence
  Synthetic Polynucleotide
taatacgactcactatagggcaggtccaacaggaactggtacaggcggataacagaggagaatccgcatgtaccagttcaacctggcggcagcgcaaaagatg

SEQ ID NO: 208796 - DNA, 103 bp, Artificial Sequence
  Synthetic Polynucleotide
taatacgactcactatagggcgctgcggagcaggtccaacaggaactggtaacagaggagaaccagtatgtgttggaccaacctggcggcagcgcaaaagatg

SEQ ID NO: 208797 - DNA, 103 bp, Artificial Sequence
  Synthetic Polynucleotide
taatacgactcactatagggttcatgtcgccgctgcggagcaggtccaacaacagaggagagttggaatggctccgcagaacctggcggcagcgcaaaagatg

SEQ ID NO: 208798 - DNA, 103 bp, Artificial Sequence
  Synthetic Polynucleotide
taatacgactcactataggggatgctgtccttcatgtcgccgctgcggagaacagaggagactccgcatgggcgacatgaacctggcggcagcgcaaaagatg

SEQ ID NO: 208799 - DNA, 103 bp, Artificial Sequence
  Synthetic Polynucleotide
taatacgactcactatagggccacccaccagatgctgtccttcatgtcgcaacagaggagagcgacaatgaggacagcaaacctggcggcagcgcaaaagatg

SEQ ID NO: 208800 - DNA, 103 bp, Artificial Sequence
  Synthetic Polynucleotide
taatacgactcactatagggttgtccttgtccacccaccagatgctgtccaacagaggagaggacagatgctggtgggtaacctggcggcagcgcaaaagatg

SEQ ID NO: 208801 - DNA, 103 bp, Artificial Sequence
  Synthetic Polynucleotide
taatacgactcactataggggaaggtgcccttgtccttgtccacccaccaaacagaggagatggtggatggacaaggacaacctggcggcagcgcaaaagatg

SEQ ID NO: 208802 - DNA, 103 bp, Artificial Sequence
  Synthetic Polynucleotide
taatacgactcactatagggacgagaactggaaggtgcccttgtccttgtaacagaggagaacaaggatgagggcacctaacctggcggcagcgcaaaagatg

SEQ ID NO: 208803 - DNA, 103 bp, Artificial Sequence
  Synthetic Polynucleotide
taatacgactcactatagggtccgtgtcatagggcaccaggtcttctgataacagaggagaatcagaatgcctggtgccaacctggcggcagcgcaaaagatg

SEQ ID NO: 208804 - DNA, 103 bp, Artificial Sequence
  Synthetic Polynucleotide
taatacgactcactatagggttgtgcttggacgagaactggaaggtgcccaacagaggagagggcacatgccagttctcaacctggcggcagcgcaaaagatg

SEQ ID NO: 208805 - DNA, 103 bp, Artificial Sequence
  Synthetic Polynucleotide
taatacgactcactatagggcagcgcctccttgtgcttggacgagaactgaacagaggagacagttcatgtccaagcacaacctggcggcagcgcaaaagatg

SEQ ID NO: 208806 - DNA, 103 bp, Artificial Sequence
  Synthetic Polynucleotide
taatacgactcactatagggagcggtgcgccagcgcctccttgtgcttggaacagaggagaccaagcatgaggaggcgcaacctggcggcagcgcaaaagatg

SEQ ID NO: 208807 - DNA, 103 bp, Artificial Sequence
  Synthetic Polynucleotide
taatacgactcactatagggtggatgccccagcggtgcgccagcgcctccaacagaggagaggaggcatgggcgcaccgaacctggcggcagcgcaaaagatg

SEQ ID NO: 208808 - DNA, 103 bp, Artificial Sequence
  Synthetic Polynucleotide
taatacgactcactataggggttgcccttctggatgccccagcggtgcgcaacagaggagagcgcacatgtggggcatcaacctggcggcagcgcaaaagatg

SEQ ID NO: 208809 - DNA, 103 bp, Artificial Sequence
  Synthetic Polynucleotide
taatacgactcactatagggtcttcttgcggttgcccttctggatgccccaacagaggagaggggcaatgagaagggcaaacctggcggcagcgcaaaagatg

SEQ ID NO: 208810 - DNA, 103 bp, Artificial Sequence
  Synthetic Polynucleotide
taatacgactcactatagggtggtaggtcatcttcttgcggttgcccttcaacagaggagagaagggatgccgcaagaaaacctggcggcagcgcaaaagatg

SEQ ID NO: 208811 - DNA, 103 bp, Artificial Sequence
  Synthetic Polynucleotide
taatacgactcactatagggcgccatcttctggtaggtcatcttcttgcgaacagaggagacgcaagatgatgacctacaacctggcggcagcgcaaaagatg

SEQ ID NO: 208812 - DNA, 103 bp, Artificial Sequence
  Synthetic Polynucleotide
taatacgactcactataggggcagcgcgcgcgccatcttctggtaggtcaaacagaggagatgacctatgagaagatggaacctggcggcagcgcaaaagatg

SEQ ID NO: 208813 - DNA, 103 bp, Artificial Sequence
  Synthetic Polynucleotide
taatacgactcactatagggccgtagttgcgcagcgcgcgcgccatcttcaacagaggagagaagatatggcgcgcgctaacctggcggcagcgcaaaagatg

SEQ ID NO: 208814 - DNA, 103 bp, Artificial Sequence
  Synthetic Polynucleotide
taatacgactcactatagggttggtatagatccgtgtcatagggcaccagaacagaggagactggtgatgtatgacacgaacctggcggcagcgcaaaagatg

SEQ ID NO: 208815 - DNA, 103 bp, Artificial Sequence
  Synthetic Polynucleotide
taatacgactcactataggggcccgtcttgccgtagttgcgcagcgcgcgaacagaggagacgcgcgatgcgcaactacaacctggcggcagcgcaaaagatg

SEQ ID NO: 208816 - DNA, 103 bp, Artificial Sequence
  Synthetic Polynucleotide
taatacgactcactatagggtcttgacctcgcccgtcttgccgtagttgcaacagaggagagcaactatggcaagacggaacctggcggcagcgcaaaagatg

SEQ ID NO: 208817 - DNA, 103 bp, Artificial Sequence
  Synthetic Polynucleotide
taatacgactcactatagggttcttcaccttcttgacctcgcccgtcttgaacagaggagacaagacatgcgaggtcaaaacctggcggcagcgcaaaagatg

SEQ ID NO: 208818 - DNA, 103 bp, Artificial Sequence
  Synthetic Polynucleotide
taatacgactcactatagggggtgagcttcttcttcaccttcttgacctcaacagaggagagaggtcatgaaggtgaagaacctggcggcagcgcaaaagatg

SEQ ID NO: 208819 - DNA, 103 bp, Artificial Sequence
  Synthetic Polynucleotide
taatacgactcactatagggtgaactggtaggtgagcttcttcttcacctaacagaggagaaggtgaatgagaagctcaaacctggcggcagcgcaaaagatg

SEQ ID NO: 208820 - DNA, 103 bp, Artificial Sequence
  Synthetic Polynucleotide
taatacgactcactatagggacttcgccgctgaactggtaggtgagcttcaacagaggagagaagctatgctaccagttaacctggcggcagcgcaaaagatg

SEQ ID NO: 208821 - DNA, 103 bp, Artificial Sequence
  Synthetic Polynucleotide
taatacgactcactataggggcggcccagcacttcgccgctgaactggtaaacagaggagataccagatgagcggcgaaaacctggcggcagcgcaaaagatg

SEQ ID NO: 208822 - DNA, 103 bp, Artificial Sequence
  Synthetic Polynucleotide
taatacgactcactatagggccaggcccccgcggcccagcacttcgccgcaacagaggagagcggcgatgtgctgggccaacctggcggcagcgcaaaagatg

SEQ ID NO: 208823 - DNA, 103 bp, Artificial Sequence
  Synthetic Polynucleotide
taatacgactcactatagggcgccgctcggccaggcccccgcggcccagcaacagaggagagctgggatgcgggggcctaacctggcggcagcgcaaaagatg

SEQ ID NO: 208824 - DNA, 103 bp, Artificial Sequence
  Synthetic Polynucleotide
taatacgactcactataggggggcgggtggcgccgctcggccaggcccccaacagaggagagggggcatggccgagcggaacctggcggcagcgcaaaagatg

SEQ ID NO: 208825 - DNA, 103 bp, Artificial Sequence
  Synthetic Polynucleotide
taatacgactcactataggggcgtttggcgttggtatagatccgtgtcataacagaggagaatgacaatgatctataccaacctggcggcagcgcaaaagatg

SEQ ID NO: 208826 - DNA, 103 bp, Artificial Sequence
  Synthetic Polynucleotide
taatacgactcactatagggtaatactcgtgcgtttggcgttggtatagaaacagaggagatctataatgacgccaaacaacctggcggcagcgcaaaagatg

SEQ ID NO: 208827 - DNA, 103 bp, Artificial Sequence
  Synthetic Polynucleotide
taatacgactcactataggggtcgagctgtgcagcctccagggcgagcataacagaggagaatgctcatgctggaggctaacctggcggcagcgcaaaagatg

SEQ ID NO: 208828 - DNA, 103 bp, Artificial Sequence
  Synthetic Polynucleotide
taatacgactcactatagggagccccctctgaatcagggtagctggaatgaacagaggagacattccatgtaccctgataacctggcggcagcgcaaaagatg

SEQ ID NO: 208829 - DNA, 103 bp, Artificial Sequence
  Synthetic Polynucleotide
taatacgactcactataggggggagtcaggagccccctctgaatcagggtaacagaggagaaccctgatgcagagggggaacctggcggcagcgcaaaagatg

SEQ ID NO: 208830 - DNA, 103 bp, Artificial Sequence
  Synthetic Polynucleotide
taatacgactcactatagggcagtcccacagggagtcaggagccccctctaacagaggagaagagggatgtcctgactcaacctggcggcagcgcaaaagatg

SEQ ID NO: 208831 - DNA, 103 bp, Artificial Sequence
  Synthetic Polynucleotide
taatacgactcactatagggggccacagtccagtcccacagggagtcaggaacagaggagacctgacatgctgtgggacaacctggcggcagcgcaaaagatg

SEQ ID NO: 208832 - DNA, 103 bp, Artificial Sequence
  Synthetic Polynucleotide
taatacgactcactatagggggacaggtggggccacagtccagtcccacaaacagaggagatgtgggatgggactgtggaacctggcggcagcgcaaaagatg

SEQ ID NO: 208833 - DNA, 103 bp, Artificial Sequence
  Synthetic Polynucleotide
taatacgactcactatagggggggtggctgggacaggtggggccacagtcaacagaggagagactgtatgcccacctgtaacctggcggcagcgcaaaagatg

SEQ ID NO: 208834 - DNA, 103 bp, Artificial Sequence
  Synthetic Polynucleotide
taatacgactcactatagggggcttcatagggggtggctgggacaggtggaacagaggagaccacctatgccagccaccaacctggcggcagcgcaaaagatg

SEQ ID NO: 208835 - DNA, 103 bp, Artificial Sequence
  Synthetic Polynucleotide
taatacgactcactatagggccgggtcgaaggcttcatagggggtggctgaacagaggagacagccaatgcctatgaagaacctggcggcagcgcaaaagatg

SEQ ID NO: 208836 - DNA, 103 bp, Artificial Sequence
  Synthetic Polynucleotide
taatacgactcactataggggcggctgctgccgggtcgaaggcttcatagaacagaggagactatgaatgcttcgacccaacctggcggcagcgcaaaagatg

SEQ ID NO: 208837 - DNA, 103 bp, Artificial Sequence
  Synthetic Polynucleotide
taatacgactcactataggggtggctaaaagcggctgctgccgggtcgaaaacagaggagattcgacatggcagcagccaacctggcggcagcgcaaaagatg

SEQ ID NO: 208838 - DNA, 103 bp, Artificial Sequence
  Synthetic Polynucleotide
taatacgactcactatagggagtgtggcccgtcgagctgtgcagcctccaaacagaggagatggaggatgcacagctcgaacctggcggcagcgcaaaagatg

SEQ ID NO: 208839 - DNA, 103 bp, Artificial Sequence
  Synthetic Polynucleotide
taatacgactcactatagggcagcctgggggtggctaaaagcggctgctgaacagaggagacagcagatgcttttagccaacctggcggcagcgcaaaagatg

SEQ ID NO: 208840 - DNA, 103 bp, Artificial Sequence
  Synthetic Polynucleotide
taatacgactcactatagggcagagctgggcagcctgggggtggctaaaaaacagaggagattttagatgcccccaggcaacctggcggcagcgcaaaagatg

SEQ ID NO: 208841 - DNA, 103 bp, Artificial Sequence
  Synthetic Polynucleotide
taatacgactcactataggggggttcgtagcagagctgggcagcctggggaacagaggagaccccagatggcccagctcaacctggcggcagcgcaaaagatg

SEQ ID NO: 208842 - DNA, 103 bp, Artificial Sequence
  Synthetic Polynucleotide
taatacgactcactatagggtgtaggtggggggttcgtagcagagctgggaacagaggagacccagcatggctacgaacaacctggcggcagcgcaaaagatg

SEQ ID NO: 208843 - DNA, 103 bp, Artificial Sequence
  Synthetic Polynucleotide
taatacgactcactatagggcctgcagggctgtaggtggggggttcgtagaacagaggagactacgaatgccccacctaaacctggcggcagcgcaaaagatg

SEQ ID NO: 208844 - DNA, 103 bp, Artificial Sequence
  Synthetic Polynucleotide
taatacgactcactatagggttcgaggttccctgcagggctgtaggtgggaacagaggagacccaccatgagccctgcaaacctggcggcagcgcaaaagatg

SEQ ID NO: 208845 - DNA, 103 bp, Artificial Sequence
  Synthetic Polynucleotide
taatacgactcactatagggtgggggccagttcgaggttccctgcagggcaacagaggagagccctgatgggaacctcgaacctggcggcagcgcaaaagatg

SEQ ID NO: 208846 - DNA, 103 bp, Artificial Sequence
  Synthetic Polynucleotide
taatacgactcactataggggcctccaggctgggggccagttcgaggttcaacagaggagagaacctatgactggccccaacctggcggcagcgcaaaagatg

SEQ ID NO: 208847 - DNA, 103 bp, Artificial Sequence
  Synthetic Polynucleotide
taatacgactcactatagggaggccccggggcctccaggctgggggccagaacagaggagactggccatgagcctggagaacctggcggcagcgcaaaagatg

SEQ ID NO: 208848 - DNA, 103 bp, Artificial Sequence
  Synthetic Polynucleotide
taatacgactcactatagggcagggaggccaggccccggggcctccaggcaacagaggagagcctggatgccccggggcaacctggcggcagcgcaaaagatg

SEQ ID NO: 208849 - DNA, 103 bp, Artificial Sequence
  Synthetic Polynucleotide
taatacgactcactatagggagacagctgaagtgtggcccgtcgagctgtaacagaggagaacagctatgcgggccacaaacctggcggcagcgcaaaagatg

SEQ ID NO: 208850 - DNA, 103 bp, Artificial Sequence
  Synthetic Polynucleotide
taatacgactcactataggggtggggtatgcagggaggccaggccccgggaacagaggagacccgggatgtggcctcccaacctggcggcagcgcaaaagatg

SEQ ID NO: 208851 - DNA, 103 bp, Artificial Sequence
  Synthetic Polynucleotide
taatacgactcactataggggaagttctccgtggggtatgcagggaggccaacagaggagaggcctcatggcataccccaacctggcggcagcgcaaaagatg

SEQ ID NO: 208852 - DNA, 103 bp, Artificial Sequence
  Synthetic Polynucleotide
taatacgactcactatagggtctggctagcgaagttctccgtggggtatgaacagaggagacataccatgcggagaactaacctggcggcagcgcaaaagatg

SEQ ID NO: 208853 - DNA, 103 bp, Artificial Sequence
  Synthetic Polynucleotide
taatacgactcactatagggggaaccagggtctggctagcgaagttctccaacagaggagaggagaaatgcgctagccaaacctggcggcagcgcaaaagatg

SEQ ID NO: 208854 - DNA, 103 bp, Artificial Sequence
  Synthetic Polynucleotide
taatacgactcactatagggatatgccgggggaaccagggtctggctagcaacagaggagagctagcatgaccctggttaacctggcggcagcgcaaaagatg

SEQ ID NO: 208855 - DNA, 103 bp, Artificial Sequence
  Synthetic Polynucleotide
taatacgactcactatagggggtacggggcatatgccgggggaaccagggaacagaggagaccctggatgccccggcataacctggcggcagcgcaaaagatg

SEQ ID NO: 208856 - DNA, 103 bp, Artificial Sequence
  Synthetic Polynucleotide
taatacgactcactatagggacagggctggggtacggggcatatgccgggaacagaggagacccggcatgtgccccgtaaacctggcggcagcgcaaaagatg

SEQ ID NO: 208857 - DNA, 103 bp, Artificial Sequence
  Synthetic Polynucleotide
taatacgactcactatagggctctgatagcacagggctggggtacggggcaacagaggagagccccgatgcccagccctaacctggcggcagcgcaaaagatg

SEQ ID NO: 208858 - DNA, 103 bp, Artificial Sequence
  Synthetic Polynucleotide
taatacgactcactatagggagtcttcctcctctgatagcacagggctggaacagaggagaccagccatgtgctatcagaacctggcggcagcgcaaaagatg

SEQ ID NO: 208859 - DNA, 103 bp, Artificial Sequence
  Synthetic Polynucleotide
taatacgactcactatagggtccaacggtaagtcttcctcctctgatagcaacagaggagagctatcatgggaggaagaaacctggcggcagcgcaaaagatg

SEQ ID NO: 208860 - DNA, 103 bp, Artificial Sequence
  Synthetic Polynucleotide
taatacgactcactatagggatctgggtacagacagctgaagtgtggcccaacagaggagagggccaatgttcagctgtaacctggcggcagcgcaaaagatg

SEQ ID NO: 208861 - DNA, 103 bp, Artificial Sequence
  Synthetic Polynucleotide
taatacgactcactatagggggcagggctgtccaacggtaagtcttcctcaacagaggagagaggaaatgttaccgttgaacctggcggcagcgcaaaagatg

SEQ ID NO: 208862 - DNA, 103 bp, Artificial Sequence
  Synthetic Polynucleotide
taatacgactcactatagggagacctccagggcagggctgtccaacggtaaacagaggagataccgtatgacagccctgaacctggcggcagcgcaaaagatg

SEQ ID NO: 208863 - DNA, 103 bp, Artificial Sequence
  Synthetic Polynucleotide
taatacgactcactatagggtcgctgtccgagacctccagggcagggctgaacagaggagacagcccatgcctggaggtaacctggcggcagcgcaaaagatg

SEQ ID NO: 208864 - DNA, 103 bp, Artificial Sequence
  Synthetic Polynucleotide
taatacgactcactatagggctcatccgactcgctgtccgagacctccagaacagaggagactggagatgtcggacagcaacctggcggcagcgcaaaagatg

SEQ ID NO: 208865 - DNA, 103 bp, Artificial Sequence
  Synthetic Polynucleotide
taatacgactcactatagggccacgagggcctcatccgactcgctgtccgaacagaggagacggacaatgagtcggatgaacctggcggcagcgcaaaagatg

SEQ ID NO: 208866 - DNA, 103 bp, Artificial Sequence
  Synthetic Polynucleotide
taatacgactcactatagggtcggggccagccacgagggcctcatccgacaacagaggagagtcggaatgggccctcgtaacctggcggcagcgcaaaagatg

SEQ ID NO: 208867 - DNA, 103 bp, Artificial Sequence
  Synthetic Polynucleotide
taatacgactcactatagggtcccttcccctcggggccagccacgagggcaacagaggagagccctcatggctggccccaacctggcggcagcgcaaaagatg

SEQ ID NO: 208868 - DNA, 103 bp, Artificial Sequence
  Synthetic Polynucleotide
taatacgactcactataggggtccctcggatcccttcccctcggggccagaacagaggagactggccatgaggggaaggaacctggcggcagcgcaaaagatg

SEQ ID NO: 208869 - DNA, 103 bp, Artificial Sequence
  Synthetic Polynucleotide
taatacgactcactatagggcttcttgcgagtccctcggatcccttccccaacagaggagaggggaaatgatccgagggaacctggcggcagcgcaaaagatg

SEQ ID NO: 208870 - DNA, 103 bp, Artificial Sequence
  Synthetic Polynucleotide
taatacgactcactatagggacaggcgcagcttcttgcgagtccctcggaaacagaggagatccgagatgctcgcaagaaacctggcggcagcgcaaaagatg

SEQ ID NO: 208871 - DNA, 103 bp, Artificial Sequence
  Synthetic Polynucleotide
taatacgactcactatagggagaagacgccatctgggtacagacagctgaaacagaggagatcagctatgtgtacccagaacctggcggcagcgcaaaagatg

SEQ ID NO: 208872 - DNA, 103 bp, Artificial Sequence
  Synthetic Polynucleotide
taatacgactcactatagggaggaactggtacaggcgcagcttcttgcgaaacagaggagatcgcaaatggctgcgcctaacctggcggcagcgcaaaagatg

SEQ ID NO: 208873 - DNA, 103 bp, Artificial Sequence
  Synthetic Polynucleotide
taatacgactcactatagggtagccccagcaggaactggtacaggcgcagaacagaggagactgcgcatgtaccagttcaacctggcggcagcgcaaaagatg

SEQ ID NO: 208874 - DNA, 103 bp, Artificial Sequence
  Synthetic Polynucleotide
taatacgactcactatagggtccaggtcatagaagacgccatctgggtacaacagaggagagtacccatgtggcgtcttaacctggcggcagcgcaaaagatg

SEQ ID NO: 208875 - DNA, 103 bp, Artificial Sequence
  Synthetic Polynucleotide
taatacgactcactatagggcttgcagctgtccaggtcatagaagacgccaacagaggagaggcgtcatgtatgacctgaacctggcggcagcgcaaaagatg

SEQ ID NO: 208876 - DNA, 103 bp, Artificial Sequence
  Synthetic Polynucleotide
taatacgactcactatagggagctggaatgcttgcagctgtccaggtcataacagaggagaatgaccatgacagctgcaaacctggcggcagcgcaaaagatg

SEQ ID NO: 208877 - DNA, 103 bp, Artificial Sequence
  Synthetic Polynucleotide
taatacgactcactataggggaatcagggtagctggaatgcttgcagctgaacagaggagacagctgatggcattccagaacctggcggcagcgcaaaagatg

SEQ ID NO: 208878 - DNA, 103 bp, Artificial Sequence
  Synthetic Polynucleotide
taatacgactcactatagggacccagcttgtcttgttcaacacacgtcataacagaggagaatgacgatggttgaacaaaacctggcggcagcgcaaaagatg

SEQ ID NO: 208879 - DNA, 103 bp, Artificial Sequence
  Synthetic Polynucleotide
taatacgactcactatagggtaaagccaggtaatttctgtaatctggcgaaacagaggagatcgccaatgtacagaaataacctggcggcagcgcaaaagatg

SEQ ID NO: 208880 - DNA, 103 bp, Artificial Sequence
  Synthetic Polynucleotide
taatacgactcactataggggatggttgattaaagccaggtaatttctgtaacagaggagaacagaaatgacctggcttaacctggcggcagcgcaaaagatg

SEQ ID NO: 208881 - DNA, 103 bp, Artificial Sequence
  Synthetic Polynucleotide
taatacgactcactatagggacatgaggacgatggttgattaaagccaggaacagaggagacctggcatgaatcaaccaaacctggcggcagcgcaaaagatg

SEQ ID NO: 208882 - DNA, 103 bp, Artificial Sequence
  Synthetic Polynucleotide
taatacgactcactatagggatttcctttgacatgaggacgatggttgataacagaggagaatcaacatgcgtcctcataacctggcggcagcgcaaaagatg

SEQ ID NO: 208883 - DNA, 103 bp, Artificial Sequence
  Synthetic Polynucleotide
taatacgactcactatagggagcagctggaatttcctttgacatgaggacaacagaggagagtcctcatgtcaaaggaaaacctggcggcagcgcaaaagatg

SEQ ID NO: 208884 - DNA, 103 bp, Artificial Sequence
  Synthetic Polynucleotide
taatacgactcactatagggaacactccatagcagctggaatttcctttgaacagaggagacaaaggatgttccagctgaacctggcggcagcgcaaaagatg

SEQ ID NO: 208885 - DNA, 103 bp, Artificial Sequence
  Synthetic Polynucleotide
taatacgactcactatagggctctgtaggcaacactccatagcagctggaaacagaggagatccagcatgtatggagtgaacctggcggcagcgcaaaagatg

SEQ ID NO: 208886 - DNA, 103 bp, Artificial Sequence
  Synthetic Polynucleotide
taatacgactcactatagggagacaggctcctctgtaggcaacactccataacagaggagaatggagatgtgcctacagaacctggcggcagcgcaaaagatg

SEQ ID NO: 208887 - DNA, 103 bp, Artificial Sequence
  Synthetic Polynucleotide
taatacgactcactatagggctccaattatagacaggctcctctgtaggcaacagaggagagcctacatgggagcctgtaacctggcggcagcgcaaaagatg

SEQ ID NO: 208888 - DNA, 103 bp, Artificial Sequence
  Synthetic Polynucleotide
taatacgactcactatagggaattaccgttctccaattatagacaggctcaacagaggagagagcctatgtataattggaacctggcggcagcgcaaaagatg

SEQ ID NO: 208889 - DNA, 103 bp, Artificial Sequence
  Synthetic Polynucleotide
taatacgactcactatagggcaaatgcttgacccagcttgtcttgttcaaaacagaggagattgaacatgacaagctggaacctggcggcagcgcaaaagatg

SEQ ID NO: 208890 - DNA, 103 bp, Artificial Sequence
  Synthetic Polynucleotide
taatacgactcactatagggcagcactgttaattaccgttctccaattataacagaggagaataattatggaacggtaaaacctggcggcagcgcaaaagatg

SEQ ID NO: 208891 - DNA, 103 bp, Artificial Sequence
  Synthetic Polynucleotide
taatacgactcactatagggtagaagtccgcagcactgttaattaccgttaacagaggagaaacggtatgtaacagtgcaacctggcggcagcgcaaaagatg

SEQ ID NO: 208892 - DNA, 103 bp, Artificial Sequence
  Synthetic Polynucleotide
taatacgactcactatagggtccttcaaaatagaagtccgcagcactgttaacagaggagaaacagtatggcggacttcaacctggcggcagcgcaaaagatg

SEQ ID NO: 208893 - DNA, 103 bp, Artificial Sequence
  Synthetic Polynucleotide
taatacgactcactataggggatgaatatttccttcaaaatagaagtccgaacagaggagacggactatgattttgaagaacctggcggcagcgcaaaagatg

SEQ ID NO: 208894 - DNA, 103 bp, Artificial Sequence
  Synthetic Polynucleotide
taatacgactcactatagggtgcagagattgatgaatatttccttcaaaaaacagaggagattttgaatgaaatattcaaacctggcggcagcgcaaaagatg

SEQ ID NO: 208895 - DNA, 103 bp, Artificial Sequence
  Synthetic Polynucleotide
taatacgactcactatagggagttatgttctgcagagattgatgaatattaacagaggagaaatattatgcaatctctgaacctggcggcagcgcaaaagatg

SEQ ID NO: 208896 - DNA, 103 bp, Artificial Sequence
  Synthetic Polynucleotide
taatacgactcactataggggctggttttcagttatgttctgcagagattaacagaggagaaatctcatgagaacataaaacctggcggcagcgcaaaagatg

SEQ ID NO: 208897 - DNA, 103 bp, Artificial Sequence
  Synthetic Polynucleotide
taatacgactcactatagggggttgtaccagctggttttcagttatgttcaacagaggagagaacatatgtgaaaaccaaacctggcggcagcgcaaaagatg

SEQ ID NO: 208898 - DNA, 103 bp, Artificial Sequence
  Synthetic Polynucleotide
taatacgactcactataggggagaagagtgggttgtaccagctggttttcaacagaggagagaaaacatgctggtacaaaacctggcggcagcgcaaaagatg

SEQ ID NO: 208899 - DNA, 103 bp, Artificial Sequence
  Synthetic Polynucleotide
taatacgactcactatagggccttttgctggagaagagtgggttgtaccaaacagaggagatggtacatgccactcttcaacctggcggcagcgcaaaagatg

SEQ ID NO: 208900 - DNA, 103 bp, Artificial Sequence
  Synthetic Polynucleotide
taatacgactcactatagggaaagcatcttcaaatgcttgacccagcttgaacagaggagacaagctatgtcaagcattaacctggcggcagcgcaaaagatg

SEQ ID NO: 208901 - DNA, 103 bp, Artificial Sequence
  Synthetic Polynucleotide
taatacgactcactatagggccttttccccccttttgctggagaagagtgaacagaggagacactctatgccagcaaaaaacctggcggcagcgcaaaagatg

SEQ ID NO: 208902 - DNA, 103 bp, Artificial Sequence
  Synthetic Polynucleotide
taatacgactcactatagggcttcttcctgccttttccccccttttgctgaacagaggagacagcaaatggggggaaaaaacctggcggcagcgcaaaagatg

SEQ ID NO: 208903 - DNA, 103 bp, Artificial Sequence
  Synthetic Polynucleotide
taatacgactcactatagggacagtcggagcttcttcctgccttttccccaacagaggagaggggaaatggcaggaagaaacctggcggcagcgcaaaagatg

SEQ ID NO: 208904 - DNA, 103 bp, Artificial Sequence
  Synthetic Polynucleotide
taatacgactcactatagggaggtattcaaacagtcggagcttcttcctgaacagaggagacaggaaatggctccgactaacctggcggcagcgcaaaagatg

SEQ ID NO: 208905 - DNA, 103 bp, Artificial Sequence
  Synthetic Polynucleotide
taatacgactcactatagggggattcgtgaaggtattcaaacagtcggagaacagaggagactccgaatgtttgaatacaacctggcggcagcgcaaaagatg

SEQ ID NO: 208906 - DNA, 103 bp, Artificial Sequence
  Synthetic Polynucleotide
taatacgactcactataggggattatacagggattcgtgaaggtattcaaaacagaggagattgaatatgttcacgaataacctggcggcagcgcaaaagatg

SEQ ID NO: 208907 - DNA, 103 bp, Artificial Sequence
  Synthetic Polynucleotide
taatacgactcactataggggccatctccggattatacagggattcgtgaaacagaggagatcacgaatgcctgtataaaacctggcggcagcgcaaaagatg

SEQ ID NO: 208908 - DNA, 103 bp, Artificial Sequence
  Synthetic Polynucleotide
taatacgactcactatagggaatacaagatgccatctccggattatacagaacagaggagactgtatatgccggagatgaacctggcggcagcgcaaaagatg

SEQ ID NO: 208909 - DNA, 103 bp, Artificial Sequence
  Synthetic Polynucleotide
taatacgactcactatagggctacccactgaatacaagatgccatctccgaacagaggagacggagaatgcatcttgtaaacctggcggcagcgcaaaagatg

SEQ ID NO: 208910 - DNA, 103 bp, Artificial Sequence
  Synthetic Polynucleotide
taatacgactcactatagggttggttttatctacccactgaatacaagataacagaggagaatcttgatgtcagtgggtaacctggcggcagcgcaaaagatg

SEQ ID NO: 208911 - DNA, 103 bp, Artificial Sequence
  Synthetic Polynucleotide
taatacgactcactatagggcagaacctcaaaagcatcttcaaatgcttgaacagaggagacaagcaatggaagatgctaacctggcggcagcgcaaaagatg

SEQ ID NO: 208912 - DNA, 103 bp, Artificial Sequence
  Synthetic Polynucleotide
taatacgactcactatagggaaagatgcctttggttttatctacccactgaacagaggagacagtggatggataaaaccaacctggcggcagcgcaaaagatg

SEQ ID NO: 208913 - DNA, 103 bp, Artificial Sequence
  Synthetic Polynucleotide
taatacgactcactatagggatacaaactgaaagatgcctttggttttataacagaggagaataaaaatgaaggcatctaacctggcggcagcgcaaaagatg

SEQ ID NO: 208914 - DNA, 103 bp, Artificial Sequence
  Synthetic Polynucleotide
taatacgactcactatagggttgttttttgatacaaactgaaagatgcctaacagaggagaaggcatatgtcagtttgtaacctggcggcagcgcaaaagatg

SEQ ID NO: 208915 - DNA, 103 bp, Artificial Sequence
  Synthetic Polynucleotide
taatacgactcactatagggaagtttttctttgttttttgatacaaactgaacagaggagacagtttatgtcaaaaaacaacctggcggcagcgcaaaagatg

SEQ ID NO: 208916 - DNA, 103 bp, Artificial Sequence
  Synthetic Polynucleotide
taatacgactcactatagggaaagctcggcaagtttttctttgttttttgaacagaggagacaaaaaatgaagaaaaacaacctggcggcagcgcaaaagatg

SEQ ID NO: 208917 - DNA, 103 bp, Artificial Sequence
  Synthetic Polynucleotide
taatacgactcactatagggcttttcccccaaagctcggcaagtttttctaacagaggagaagaaaaatgtgccgagctaacctggcggcagcgcaaaagatg

SEQ ID NO: 208918 - DNA, 103 bp, Artificial Sequence
  Synthetic Polynucleotide
taatacgactcactataggggttgccttttcttttcccccaaagctcggcaacagaggagagccgagatgtgggggaaaaacctggcggcagcgcaaaagatg

SEQ ID NO: 208919 - DNA, 103 bp, Artificial Sequence
  Synthetic Polynucleotide
taatacgactcactatagggtggtcttcctgttgccttttcttttcccccaacagaggagagggggaatggaaaaggcaaacctggcggcagcgcaaaagatg

SEQ ID NO: 208920 - DNA, 103 bp, Artificial Sequence
  Synthetic Polynucleotide
taatacgactcactatagggtggtaagtcatggtcttcctgttgccttttaacagaggagaaaaaggatgcaggaagacaacctggcggcagcgcaaaagatg

SEQ ID NO: 208921 - DNA, 103 bp, Artificial Sequence
  Synthetic Polynucleotide
taatacgactcactatagggggccattttctggtaagtcatggtcttcctaacagaggagaaggaagatgatgacttacaacctggcggcagcgcaaaagatg

SEQ ID NO: 208922 - DNA, 103 bp, Artificial Sequence
  Synthetic Polynucleotide
taatacgactcactatagggaatgttgcctcagaacctcaaaagcatcttaacagaggagaaagatgatgttgaggttcaacctggcggcagcgcaaaagatg

SEQ ID NO: 208923 - DNA, 103 bp, Artificial Sequence
  Synthetic Polynucleotide
taatacgactcactatagggtgagtgccctggccattttctggtaagtcaaacagaggagatgacttatgagaaaatggaacctggcggcagcgcaaaagatg

SEQ ID NO: 208924 - DNA, 103 bp, Artificial Sequence
  Synthetic Polynucleotide
taatacgactcactatagggccgtaatttctgagtgccctggccattttcaacagaggagagaaaatatgcagggcactaacctggcggcagcgcaaaagatg

SEQ ID NO: 208925 - DNA, 103 bp, Artificial Sequence
  Synthetic Polynucleotide
taatacgactcactatagggcccacttcttccgtaatttctgagtgccctaacagaggagaagggcaatgagaaattacaacctggcggcagcgcaaaagatg

SEQ ID NO: 208926 - DNA, 103 bp, Artificial Sequence
  Synthetic Polynucleotide
taatacgactcactatagggtggtaatttccccacttcttccgtaatttcaacagaggagagaaattatggaagaagtgaacctggcggcagcgcaaaagatg

SEQ ID NO: 208927 - DNA, 103 bp, Artificial Sequence
  Synthetic Polynucleotide
taatacgactcactatagggctccggattttggtaatttccccacttcttaacagaggagaaagaagatgggaaattacaacctggcggcagcgcaaaagatg

SEQ ID NO: 208928 - DNA, 103 bp, Artificial Sequence
  Synthetic Polynucleotide
taatacgactcactatagggagtcagcttcctccggattttggtaatttcaacagaggagagaaattatgaaaatccggaacctggcggcagcgcaaaagatg

SEQ ID NO: 208929 - DNA, 103 bp, Artificial Sequence
  Synthetic Polynucleotide
taatacgactcactatagggtgaactggtaagtcagcttcctccggatttaacagaggagaaaatccatgggaagctgaaacctggcggcagcgcaaaagatg

SEQ ID NO: 208930 - DNA, 103 bp, Artificial Sequence
  Synthetic Polynucleotide
taatacgactcactatagggatggcctcactgaactggtaagtcagcttcaacagaggagagaagctatgttaccagttaacctggcggcagcgcaaaagatg

SEQ ID NO: 208931 - DNA, 103 bp, Artificial Sequence
  Synthetic Polynucleotide
taatacgactcactatagggtctttggagaatggcctcactgaactggtaaacagaggagataccagatgagtgaggccaacctggcggcagcgcaaaagatg

SEQ ID NO: 208932 - DNA, 103 bp, Artificial Sequence
  Synthetic Polynucleotide
taatacgactcactatagggatggagagagtctttggagaatggcctcacaacagaggagagtgaggatgttctccaaaaacctggcggcagcgcaaaagatg

SEQ ID NO: 208933 - DNA, 103 bp, Artificial Sequence
  Synthetic Polynucleotide
taatacgactcactatagggtctccagttgaatgttgcctcagaacctcaaacagaggagatgaggtatggaggcaacaaacctggcggcagcgcaaaagatg

SEQ ID NO: 208934 - DNA, 103 bp, Artificial Sequence
  Synthetic Polynucleotide
taatacgactcactatagggaggaaataggatggagagagtctttggagaaacagaggagatctccaatgactctctccaacctggcggcagcgcaaaagatg

SEQ ID NO: 208935 - DNA, 103 bp, Artificial Sequence
  Synthetic Polynucleotide
taatacgactcactatagggctctttccccaggaaataggatggagagagaacagaggagactctctatgtcctatttcaacctggcggcagcgcaaaagatg

SEQ ID NO: 208936 - DNA, 103 bp, Artificial Sequence
  Synthetic Polynucleotide
taatacgactcactatagggaatagaagatctctttccccaggaaataggaacagaggagacctattatgtggggaaagaacctggcggcagcgcaaaagatg

SEQ ID NO: 208937 - DNA, 103 bp, Artificial Sequence
  Synthetic Polynucleotide
taatacgactcactatagggacacactgtgaatagaagatctctttccccaacagaggagaggggaaatggatcttctaaacctggcggcagcgcaaaagatg

SEQ ID NO: 208938 - DNA, 103 bp, Artificial Sequence
  Synthetic Polynucleotide
taatacgactcactatagggatcaggttgaacacactgtgaatagaagataacagaggagaatcttcatgtcacagtgtaacctggcggcagcgcaaaagatg

SEQ ID NO: 208939 - DNA, 103 bp, Artificial Sequence
  Synthetic Polynucleotide
taatacgactcactataggggatattcttgatcaggttgaacacactgtgaacagaggagacacagtatgttcaacctgaacctggcggcagcgcaaaagatg

SEQ ID NO: 208940 - DNA, 103 bp, Artificial Sequence
  Synthetic Polynucleotide
taatacgactcactatagggtttaaactgagatattcttgatcaggttgaaacagaggagatcaaccatgtcaagaataaacctggcggcagcgcaaaagatg

SEQ ID NO: 208941 - DNA, 103 bp, Artificial Sequence
  Synthetic Polynucleotide
taatacgactcactatagggattccagttatttaaactgagatattcttgaacagaggagacaagaaatgctcagtttaaacctggcggcagcgcaaaagatg

SEQ ID NO: 208942 - DNA, 103 bp, Artificial Sequence
  Synthetic Polynucleotide
taatacgactcactatagggtataatttgcattccagttatttaaactgaaacagaggagatcagttatgataactggaaacctggcggcagcgcaaaagatg

SEQ ID NO: 208943 - DNA, 103 bp, Artificial Sequence
  Synthetic Polynucleotide
taatacgactcactatagggtatgtataattataatttgcattccagttaaacagaggagataactgatgtgcaaattaaacctggcggcagcgcaaaagatg

SEQ ID NO: 208944 - DNA, 103 bp, Artificial Sequence
  Synthetic Polynucleotide
taatacgactcactataggggtactgaagatctccagttgaatgttgcctaacagaggagaaggcaaatgtcaactggaaacctggcggcagcgcaaaagatg

SEQ ID NO: 208945 - DNA, 103 bp, Artificial Sequence
  Synthetic Polynucleotide
taatacgactcactataggggtaattggcatatgtataattataatttgcaacagaggagagcaaatatgaattatacaaacctggcggcagcgcaaaagatg

SEQ ID NO: 208946 - DNA, 103 bp, Artificial Sequence
  Synthetic Polynucleotide
taatacgactcactatagggttagctcatggtaattggcatatgtataataacagaggagaattataatgatgccaattaacctggcggcagcgcaaaagatg

SEQ ID NO: 208947 - DNA, 103 bp, Artificial Sequence
  Synthetic Polynucleotide
taatacgactcactatagggtcatggtgatttagctcatggtaattggcaaacagaggagatgccaaatgccatgagctaacctggcggcagcgcaaaagatg

SEQ ID NO: 208948 - DNA, 103 bp, Artificial Sequence
  Synthetic Polynucleotide
taatacgactcactatagggaatctggcgagtactgaagatctccagttgaacagaggagacaactgatgatcttcagtaacctggcggcagcgcaaaagatg

SEQ ID NO: 208949 - DNA, 103 bp, Artificial Sequence
  Synthetic Polynucleotide
taatacgactcactatagggtaatttctgtaatctggcgagtactgaagaaacagaggagatcttcaatgctcgccagaaacctggcggcagcgcaaaagatg

SEQ ID NO: 208950 - DNA, 103 bp, Artificial Sequence
  Synthetic Polynucleotide
taatacgactcactatagggagccgcctcgctgaagggtggctcgtccataacagaggagaatggacatgccacccttcaacctggcggcagcgcaaaagatg

SEQ ID NO: 208951 - DNA, 103 bp, Artificial Sequence
  Synthetic Polynucleotide
taatacgactcactataggggtcttggttgttgataagctgaagcatgtcaacagaggagagacatgatgcagcttatcaacctggcggcagcgcaaaagatg

SEQ ID NO: 208952 - DNA, 103 bp, Artificial Sequence
  Synthetic Polynucleotide
taatacgactcactatagggattgatggaggagcggtagcgcttctcaataacagaggagaattgagatgcgctaccgcaacctggcggcagcgcaaaagatg

SEQ ID NO: 208953 - DNA, 103 bp, Artificial Sequence
  Synthetic Polynucleotide
taatacgactcactatagggtgattttgtcattgatggaggagcggtagcaacagaggagagctaccatgcctccatcaaacctggcggcagcgcaaaagatg

SEQ ID NO: 208954 - DNA, 103 bp, Artificial Sequence
  Synthetic Polynucleotide
taatacgactcactatagggttgagctcaatgattttgtcattgatggagaacagaggagactccatatgtgacaaaataacctggcggcagcgcaaaagatg

SEQ ID NO: 208955 - DNA, 103 bp, Artificial Sequence
  Synthetic Polynucleotide
taatacgactcactatagggcaccagatccttgagctcaatgattttgtcaacagaggagagacaaaatgattgagctcaacctggcggcagcgcaaaagatg

SEQ ID NO: 208956 - DNA, 103 bp, Artificial Sequence
  Synthetic Polynucleotide
taatacgactcactatagggcagtgcccaccaccagatccttgagctcaaaacagaggagattgagcatgaggatctggaacctggcggcagcgcaaaagatg

SEQ ID NO: 208957 - DNA, 103 bp, Artificial Sequence
  Synthetic Polynucleotide
taatacgactcactatagggagctttgcctcagtgcccaccaccagatccaacagaggagaggatctatgggtgggcacaacctggcggcagcgcaaaagatg

SEQ ID NO: 208958 - DNA, 103 bp, Artificial Sequence
  Synthetic Polynucleotide
taatacgactcactatagggagatttattcagctttgcctcagtgcccacaacagaggagagtgggcatggaggcaaagaacctggcggcagcgcaaaagatg

SEQ ID NO: 208959 - DNA, 103 bp, Artificial Sequence
  Synthetic Polynucleotide
taatacgactcactataggggcaagacagcagatttattcagctttgcctaacagaggagaaggcaaatgtgaataaataacctggcggcagcgcaaaagatg

SEQ ID NO: 208960 - DNA, 103 bp, Artificial Sequence
  Synthetic Polynucleotide
taatacgactcactatagggatggccttgcgcaagacagcagatttattcaacagaggagagaataaatgtgctgtcttaacctggcggcagcgcaaaagatg

SEQ ID NO: 208961 - DNA, 103 bp, Artificial Sequence
  Synthetic Polynucleotide
taatacgactcactatagggaatgtagtcgatggccttgcgcaagacagcaacagaggagagctgtcatgcgcaaggccaacctggcggcagcgcaaaagatg

SEQ ID NO: 208962 - DNA, 103 bp, Artificial Sequence
  Synthetic Polynucleotide
taatacgactcactatagggggaagtcactgtcttggttgttgataagctaacagaggagaagcttaatgacaaccaagaacctggcggcagcgcaaaagatg

SEQ ID NO: 208963 - DNA, 103 bp, Artificial Sequence
  Synthetic Polynucleotide
taatacgactcactataggggcagaaagcgaatgtagtcgatggccttgcaacagaggagagcaaggatgtcgactacaaacctggcggcagcgcaaaagatg

SEQ ID NO: 208964 - DNA, 103 bp, Artificial Sequence
  Synthetic Polynucleotide
taatacgactcactatagggttgctgtgttgcagaaagcgaatgtagtcgaacagaggagacgactaatgtcgctttctaacctggcggcagcgcaaaagatg

SEQ ID NO: 208965 - DNA, 103 bp, Artificial Sequence
  Synthetic Polynucleotide
taatacgactcactataggggagtttctggttgctgtgttgcagaaagcgaacagaggagacgctttatgcaacacagcaacctggcggcagcgcaaaagatg

SEQ ID NO: 208966 - DNA, 103 bp, Artificial Sequence
  Synthetic Polynucleotide
taatacgactcactatagggtctcctgcttgagtttctggttgctgtgttaacagaggagaaacacaatgaccagaaacaacctggcggcagcgcaaaagatg

SEQ ID NO: 208967 - DNA, 103 bp, Artificial Sequence
  Synthetic Polynucleotide
taatacgactcactatagggagacttaggttctcctgcttgagtttctggaacagaggagaccagaaatgcaagcaggaaacctggcggcagcgcaaaagatg

SEQ ID NO: 208968 - DNA, 103 bp, Artificial Sequence
  Synthetic Polynucleotide
taatacgactcactatagggagcagtgcgcagacttaggttctcctgcttaacagaggagaaagcagatgaacctaagtaacctggcggcagcgcaaaagatg

SEQ ID NO: 208969 - DNA, 103 bp, Artificial Sequence
  Synthetic Polynucleotide
taatacgactcactatagggttttgtggacagcagtgcgcagacttaggtaacagaggagaacctaaatgtgcgcactgaacctggcggcagcgcaaaagatg

SEQ ID NO: 208970 - DNA, 103 bp, Artificial Sequence
  Synthetic Polynucleotide
taatacgactcactatagggagagatttgcttttgtggacagcagtgcgcaacagaggagagcgcacatgtgtccacaaaacctggcggcagcgcaaaagatg

SEQ ID NO: 208971 - DNA, 103 bp, Artificial Sequence
  Synthetic Polynucleotide
taatacgactcactatagggcagatccttcagagatttgcttttgtggacaacagaggagagtccacatgagcaaatctaacctggcggcagcgcaaaagatg

SEQ ID NO: 208972 - DNA, 103 bp, Artificial Sequence
  Synthetic Polynucleotide
taatacgactcactatagggaggccgacaccagatccttcagagatttgcaacagaggagagcaaatatgtgaaggatcaacctggcggcagcgcaaaagatg

SEQ ID NO: 208973 - DNA, 103 bp, Artificial Sequence
  Synthetic Polynucleotide
taatacgactcactatagggaataggccagggaagtcactgtcttggttgaacagaggagacaaccaatgcagtgacttaacctggcggcagcgcaaaagatg

SEQ ID NO: 208974 - DNA, 103 bp, Artificial Sequence
  Synthetic Polynucleotide
taatacgactcactatagggccactgccacaggccgacaccagatccttcaacagaggagagaaggaatgggtgtcggcaacctggcggcagcgcaaaagatg

SEQ ID NO: 208975 - DNA, 103 bp, Artificial Sequence
  Synthetic Polynucleotide
taatacgactcactatagggtgtgttccctccactgccacaggccgacacaacagaggagagtgtcgatgtgtggcagtaacctggcggcagcgcaaaagatg

SEQ ID NO: 208976 - DNA, 103 bp, Artificial Sequence
  Synthetic Polynucleotide
taatacgactcactatagggtgagcacgtctgtgttccctccactgccacaacagaggagagtggcaatggagggaacaaacctggcggcagcgcaaaagatg

SEQ ID NO: 208977 - DNA, 103 bp, Artificial Sequence
  Synthetic Polynucleotide
taatacgactcactatagggacgccctccatgagcacgtctgtgttccctaacagaggagaagggaaatgagacgtgctaacctggcggcagcgcaaaagatg

SEQ ID NO: 208978 - DNA, 103 bp, Artificial Sequence
  Synthetic Polynucleotide
taatacgactcactatagggctcagtcttcacgccctccatgagcacgtcaacagaggagagacgtgatgatggagggcaacctggcggcagcgcaaaagatg

SEQ ID NO: 208979 - DNA, 103 bp, Artificial Sequence
  Synthetic Polynucleotide
taatacgactcactatagggtgtcctccacctcagtcttcacgccctccaaacagaggagatggaggatgtgaagactgaacctggcggcagcgcaaaagatg

SEQ ID NO: 208980 - DNA, 103 bp, Artificial Sequence
  Synthetic Polynucleotide
taatacgactcactatagggggggtcagtgtgtcctccacctcagtcttcaacagaggagagaagacatgggtggaggaaacctggcggcagcgcaaaagatg

SEQ ID NO: 208981 - DNA, 103 bp, Artificial Sequence
  Synthetic Polynucleotide
taatacgactcactatagggcgaggggggtggggtcagtgtgtcctccacaacagaggagagtggagatgacactgaccaacctggcggcagcgcaaaagatg

SEQ ID NO: 208982 - DNA, 103 bp, Artificial Sequence
  Synthetic Polynucleotide
taatacgactcactatagggagccagcatccgaggggggtggggtcagtgaacagaggagacactgaatgcacccccctaacctggcggcagcgcaaaagatg

SEQ ID NO: 208983 - DNA, 103 bp, Artificial Sequence
  Synthetic Polynucleotide
taatacgactcactatagggtggaaaggtgagccagcatccgaggggggtaacagaggagaacccccatgggatgctggaacctggcggcagcgcaaaagatg

SEQ ID NO: 208984 - DNA, 103 bp, Artificial Sequence
  Synthetic Polynucleotide
taatacgactcactataggggggtgggtcaaataggccagggaagtcactaacagaggagaagtgacatgcctggcctaaacctggcggcagcgcaaaagatg

SEQ ID NO: 208985 - DNA, 103 bp, Artificial Sequence
  Synthetic Polynucleotide
taatacgactcactatagggggggctgctctggaaaggtgagccagcatcaacagaggagagatgctatgtcacctttcaacctggcggcagcgcaaaagatg

SEQ ID NO: 208986 - DNA, 103 bp, Artificial Sequence
  Synthetic Polynucleotide
taatacgactcactatagggcaagggacaaggggctgctctggaaaggtgaacagaggagacaccttatgagagcagccaacctggcggcagcgcaaaagatg

SEQ ID NO: 208987 - DNA, 103 bp, Artificial Sequence
  Synthetic Polynucleotide
taatacgactcactatagggcccctgctgccaagggacaaggggctgctcaacagaggagagagcagatgcttgtccctaacctggcggcagcgcaaaagatg

SEQ ID NO: 208988 - DNA, 103 bp, Artificial Sequence
  Synthetic Polynucleotide
taatacgactcactataggggctgccactgcccctgctgccaagggacaaaacagaggagattgtccatgggcagcaggaacctggcggcagcgcaaaagatg

SEQ ID NO: 208989 - DNA, 103 bp, Artificial Sequence
  Synthetic Polynucleotide
taatacgactcactatagggcactgccaccgctgccactgcccctgctgcaacagaggagagcagcaatggcagtggcaaacctggcggcagcgcaaaagatg

SEQ ID NO: 208990 - DNA, 103 bp, Artificial Sequence
  Synthetic Polynucleotide
taatacgactcactataggggagtcactgccactgccaccgctgccactgaacagaggagacagtggatgcggtggcagaacctggcggcagcgcaaaagatg

SEQ ID NO: 208991 - DNA, 103 bp, Artificial Sequence
  Synthetic Polynucleotide
taatacgactcactataggggtcaggctccgagtcactgccactgccaccaacagaggagaggtggcatgggcagtgacaacctggcggcagcgcaaaagatg

SEQ ID NO: 208992 - DNA, 103 bp, Artificial Sequence
  Synthetic Polynucleotide
taatacgactcactatagggagactgggctgtcaggctccgagtcactgcaacagaggagagcagtgatgcggagcctgaacctggcggcagcgcaaaagatg

SEQ ID NO: 208993 - DNA, 103 bp, Artificial Sequence
  Synthetic Polynucleotide
taatacgactcactatagggctgtcctcaaagactgggctgtcaggctccaacagaggagaggagccatgcagcccagtaacctggcggcagcgcaaaagatg

SEQ ID NO: 208994 - DNA, 103 bp, Artificial Sequence
  Synthetic Polynucleotide
taatacgactcactatagggctttgccttgctgtcctcaaagactgggctaacagaggagaagcccaatgtttgaggacaacctggcggcagcgcaaaagatg

SEQ ID NO: 208995 - DNA, 103 bp, Artificial Sequence
  Synthetic Polynucleotide
taatacgactcactatagggtcccagcatagggtgggtcaaataggccagaacagaggagactggccatgttgacccacaacctggcggcagcgcaaaagatg

SEQ ID NO: 208996 - DNA, 103 bp, Artificial Sequence
  Synthetic Polynucleotide
taatacgactcactataggggctgctctggctttgccttgctgtcctcaaaacagaggagattgaggatggcaaggcaaaacctggcggcagcgcaaaagatg

SEQ ID NO: 208997 - DNA, 103 bp, Artificial Sequence
  Synthetic Polynucleotide
taatacgactcactatagggagagacggccgctgctctggctttgccttgaacagaggagacaaggcatggccagagcaaacctggcggcagcgcaaaagatg

SEQ ID NO: 208998 - DNA, 103 bp, Artificial Sequence
  Synthetic Polynucleotide
taatacgactcactatagggccggctgtgcagagacggccgctgctctggaacagaggagaccagagatgcggccgtctaacctggcggcagcgcaaaagatg

SEQ ID NO: 208999 - DNA, 103 bp, Artificial Sequence
  Synthetic Polynucleotide
taatacgactcactatagggccagcatgccccggctgtgcagagacggccaacagaggagaggccgtatgtgcacagccaacctggcggcagcgcaaaagatg

SEQ ID NO: 209000 - DNA, 103 bp, Artificial Sequence
  Synthetic Polynucleotide
taatacgactcactatagggcgggagcggtccagcatgccccggctgtgcaacagaggagagcacagatggggcatgctaacctggcggcagcgcaaaagatg

SEQ ID NO: 209001 - DNA, 103 bp, Artificial Sequence
  Synthetic Polynucleotide
taatacgactcactatagggcagggccaggcgggagcggtccagcatgccaacagaggagaggcatgatggaccgctccaacctggcggcagcgcaaaagatg

SEQ ID NO: 209002 - DNA, 103 bp, Artificial Sequence
  Synthetic Polynucleotide
taatacgactcactatagggcgagcgtgcacagggccaggcgggagcggtaacagaggagaaccgctatggcctggcccaacctggcggcagcgcaaaagatg

SEQ ID NO: 209003 - DNA, 103 bp, Artificial Sequence
  Synthetic Polynucleotide
taatacgactcactatagggcagaggaagacgagcgtgcacagggccaggaacagaggagacctggcatggtgcacgctaacctggcggcagcgcaaaagatg

SEQ ID NO: 209004 - DNA, 103 bp, Artificial Sequence
  Synthetic Polynucleotide
taatacgactcactataggggcaggacaggcagaggaagacgagcgtgcaaacagaggagatgcacgatggtcttcctcaacctggcggcagcgcaaaagatg

SEQ ID NO: 209005 - DNA, 103 bp, Artificial Sequence
  Synthetic Polynucleotide
taatacgactcactatagggccaaggggttgcaggacaggcagaggaagaaacagaggagatcttccatggcctgtcctaacctggcggcagcgcaaaagatg

SEQ ID NO: 209006 - DNA, 103 bp, Artificial Sequence
  Synthetic Polynucleotide
taatacgactcactatagggcctgccccactcccagcatagggtgggtcaaacagaggagatgacccatgctatgctggaacctggcggcagcgcaaaagatg

SEQ ID NO: 209007 - DNA, 103 bp, Artificial Sequence
  Synthetic Polynucleotide
taatacgactcactatagggagcaaggaggccaaggggttgcaggacaggaacagaggagacctgtcatgcaaccccttaacctggcggcagcgcaaaagatg

SEQ ID NO: 209008 - DNA, 103 bp, Artificial Sequence
  Synthetic Polynucleotide
taatacgactcactatagggccgggcccccagcaaggaggccaaggggttaacagaggagaaaccccatggcctccttgaacctggcggcagcgcaaaagatg

SEQ ID NO: 209009 - DNA, 103 bp, Artificial Sequence
  Synthetic Polynucleotide
taatacgactcactatagggtgggaagcccccgggcccccagcaaggaggaacagaggagacctcctatgtgggggcccaacctggcggcagcgcaaaagatg

SEQ ID NO: 209010 - DNA, 103 bp, Artificial Sequence
  Synthetic Polynucleotide
taatacgactcactatagggtctgaggggctgggaagcccccgggcccccaacagaggagagggggcatgggggcttccaacctggcggcagcgcaaaagatg

SEQ ID NO: 209011 - DNA, 103 bp, Artificial Sequence
  Synthetic Polynucleotide
taatacgactcactataggggctggtggtatctgaggggctgggaagcccaacagaggagagggcttatgagcccctcaaacctggcggcagcgcaaaagatg

SEQ ID NO: 209012 - DNA, 103 bp, Artificial Sequence
  Synthetic Polynucleotide
taatacgactcactatagggtatggtagacgctggtggtatctgaggggcaacagaggagagcccctatgataccaccaaacctggcggcagcgcaaaagatg

SEQ ID NO: 209013 - DNA, 103 bp, Artificial Sequence
  Synthetic Polynucleotide
taatacgactcactatagggcgcccagggctatggtagacgctggtggtaaacagaggagataccacatgcgtctaccaaacctggcggcagcgcaaaagatg

SEQ ID NO: 209014 - DNA, 103 bp, Artificial Sequence
  Synthetic Polynucleotide
taatacgactcactatagggcagcacgttgcgcccagggctatggtagacaacagaggagagtctacatgagccctgggaacctggcggcagcgcaaaagatg

SEQ ID NO: 209015 - DNA, 103 bp, Artificial Sequence
  Synthetic Polynucleotide
taatacgactcactatagggtctcggtgcccagcacgttgcgcccagggcaacagaggagagccctgatggcaacgtgcaacctggcggcagcgcaaaagatg

SEQ ID NO: 209016 - DNA, 103 bp, Artificial Sequence
  Synthetic Polynucleotide
taatacgactcactatagggccatctctgctctcggtgcccagcacgttgaacagaggagacaacgtatggggcaccgaaacctggcggcagcgcaaaagatg

SEQ ID NO: 209017 - DNA, 103 bp, Artificial Sequence
  Synthetic Polynucleotide
taatacgactcactataggggtctgtgccccctgccccactcccagcataaacagaggagatatgctatgagtggggcaaacctggcggcagcgcaaaagatg

SEQ ID NO: 209018 - DNA, 103 bp, Artificial Sequence
  Synthetic Polynucleotide
taatacgactcactatagggccagccagggccatctctgctctcggtgccaacagaggagaggcaccatgagcagagataacctggcggcagcgcaaaagatg

SEQ ID NO: 209019 - DNA, 103 bp, Artificial Sequence
  Synthetic Polynucleotide
taatacgactcactataggggccactgggcccagccagggccatctctgcaacagaggagagcagagatggccctggctaacctggcggcagcgcaaaagatg

SEQ ID NO: 209020 - DNA, 103 bp, Artificial Sequence
  Synthetic Polynucleotide
taatacgactcactataggggggggcagcagccactgggcccagccagggaacagaggagaccctggatgggcccagtgaacctggcggcagcgcaaaagatg

SEQ ID NO: 209021 - DNA, 103 bp, Artificial Sequence
  Synthetic Polynucleotide
taatacgactcactatagggccagaccactgggggcagcagccactgggcaacagaggagagcccagatgctgctgcccaacctggcggcagcgcaaaagatg

SEQ ID NO: 209022 - DNA, 103 bp, Artificial Sequence
  Synthetic Polynucleotide
taatacgactcactatagggcattgagcagccagaccactgggggcagcaaacagaggagatgctgcatgcagtggtctaacctggcggcagcgcaaaagatg

SEQ ID NO: 209023 - DNA, 103 bp, Artificial Sequence
  Synthetic Polynucleotide
taatacgactcactatagggaccaacagcccattgagcagccagaccactaacagaggagaagtggtatggctgctcaaaacctggcggcagcgcaaaagatg

SEQ ID NO: 209024 - DNA, 103 bp, Artificial Sequence
  Synthetic Polynucleotide
taatacgactcactatagggggagacgagcaccaacagcccattgagcagaacagaggagactgctcatggggctgttgaacctggcggcagcgcaaaagatg

SEQ ID NO: 209025 - DNA, 103 bp, Artificial Sequence
  Synthetic Polynucleotide
taatacgactcactataggggaagcaccaaggagacgagcaccaacagccaacagaggagaggctgtatgtgctcgtctaacctggcggcagcgcaaaagatg

SEQ ID NO: 209026 - DNA, 103 bp, Artificial Sequence
  Synthetic Polynucleotide
taatacgactcactatagggtagacaaagagaagcaccaaggagacgagcaacagaggagagctcgtatgcttggtgctaacctggcggcagcgcaaaagatg

SEQ ID NO: 209027 - DNA, 103 bp, Artificial Sequence
  Synthetic Polynucleotide
taatacgactcactatagggtggctcaccgtagacaaagagaagcaccaaaacagaggagattggtgatgctctttgtcaacctggcggcagcgcaaaagatg

SEQ ID NO: 209028 - DNA, 103 bp, Artificial Sequence
  Synthetic Polynucleotide
taatacgactcactatagggggctggcagggtctgtgccccctgccccacaacagaggagagtggggatgggggcacagaacctggcggcagcgcaaaagatg

SEQ ID NO: 209029 - DNA, 103 bp, Artificial Sequence
  Synthetic Polynucleotide
taatacgactcactataggggccgtgtgactggctcaccgtagacaaagaaacagaggagatctttgatgacggtgagcaacctggcggcagcgcaaaagatg

SEQ ID NO: 209030 - DNA, 103 bp, Artificial Sequence
  Synthetic Polynucleotide
taatacgactcactatagggcctgagtggggccgtgtgactggctcaccgaacagaggagacggtgaatgagtcacacgaacctggcggcagcgcaaaagatg

SEQ ID NO: 209031 - DNA, 103 bp, Artificial Sequence
  Synthetic Polynucleotide
taatacgactcactatagggcacggcggggcctgagtggggccgtgtgacaacagaggagagtcacaatgccccactcaaacctggcggcagcgcaaaagatg

SEQ ID NO: 209032 - DNA, 103 bp, Artificial Sequence
  Synthetic Polynucleotide
taatacgactcactatagggtccagaagtacacggcggggcctgagtgggaacagaggagacccactatggccccgccgaacctggcggcagcgcaaaagatg

SEQ ID NO: 209033 - DNA, 103 bp, Artificial Sequence
  Synthetic Polynucleotide
taatacgactcactatagggttgcgatgcctccagaagtacacggcggggaacagaggagaccccgcatggtacttctgaacctggcggcagcgcaaaagatg

SEQ ID NO: 209034 - DNA, 103 bp, Artificial Sequence
  Synthetic Polynucleotide
taatacgactcactataggggtcagcctgcttgcgatgcctccagaagtaaacagaggagatacttcatgaggcatcgcaacctggcggcagcgcaaaagatg

SEQ ID NO: 209035 - DNA, 103 bp, Artificial Sequence
  Synthetic Polynucleotide
taatacgactcactatagggccaggtccaggtcagcctgcttgcgatgccaacagaggagaggcatcatgagcaggctgaacctggcggcagcgcaaaagatg

SEQ ID NO: 209036 - DNA, 103 bp, Artificial Sequence
  Synthetic Polynucleotide
taatacgactcactatagggtctccccgggccaggtccaggtcagcctgcaacagaggagagcaggcatgcctggacctaacctggcggcagcgcaaaagatg

SEQ ID NO: 209037 - DNA, 103 bp, Artificial Sequence
  Synthetic Polynucleotide
taatacgactcactatagggctgggcaaagtctccccgggccaggtccagaacagaggagactggacatggcccggggaaacctggcggcagcgcaaaagatg

SEQ ID NO: 209038 - DNA, 103 bp, Artificial Sequence
  Synthetic Polynucleotide
taatacgactcactataggggctgggcagcctgggcaaagtctccccgggaacagaggagacccgggatgactttgcccaacctggcggcagcgcaaaagatg

SEQ ID NO: 209039 - DNA, 103 bp, Artificial Sequence
  Synthetic Polynucleotide
taatacgactcactatagggctggtatcggggctggcagggtctgtgcccaacagaggagagggcacatgccctgccagaacctggcggcagcgcaaaagatg

SEQ ID NO: 209040 - DNA, 103 bp, Artificial Sequence
  Synthetic Polynucleotide
taatacgactcactatagggagccacagctgctgggcagcctgggcaaagaacagaggagactttgcatgggctgcccaaacctggcggcagcgcaaaagatg

SEQ ID NO: 209041 - DNA, 103 bp, Artificial Sequence
  Synthetic Polynucleotide
taatacgactcactatagggccgcagggccagccacagctgctgggcagcaacagaggagagctgccatgcagctgtggaacctggcggcagcgcaaaagatg

SEQ ID NO: 209042 - DNA, 103 bp, Artificial Sequence
  Synthetic Polynucleotide
taatacgactcactatagggggcccagtgcccgcagggccagccacagctaacagaggagaagctgtatgtggccctgcaacctggcggcagcgcaaaagatg

SEQ ID NO: 209043 - DNA, 103 bp, Artificial Sequence
  Synthetic Polynucleotide
taatacgactcactatagggggcaggggccggcccagtgcccgcagggccaacagaggagaggccctatgggcactgggaacctggcggcagcgcaaaagatg

SEQ ID NO: 209044 - DNA, 103 bp, Artificial Sequence
  Synthetic Polynucleotide
taatacgactcactataggggtgggaggtgggcaggggccggcccagtgcaacagaggagagcactgatgcggcccctgaacctggcggcagcgcaaaagatg

SEQ ID NO: 209045 - DNA, 103 bp, Artificial Sequence
  Synthetic Polynucleotide
taatacgactcactatagggccaggtccaggtgggaggtgggcaggggccaacagaggagaggccccatgccacctcccaacctggcggcagcgcaaaagatg

SEQ ID NO: 209046 - DNA, 103 bp, Artificial Sequence
  Synthetic Polynucleotide
taatacgactcactatagggaggctacaagccaggtccaggtgggaggtgaacagaggagacacctcatgcctggacctaacctggcggcagcgcaaaagatg

SEQ ID NO: 209047 - DNA, 103 bp, Artificial Sequence
  Synthetic Polynucleotide
taatacgactcactataggggttccagaggaggctacaagccaggtccagaacagaggagactggacatggcttgtagcaacctggcggcagcgcaaaagatg

SEQ ID NO: 209048 - DNA, 103 bp, Artificial Sequence
  Synthetic Polynucleotide
taatacgactcactataggggacggatgaggttccagaggaggctacaagaacagaggagacttgtaatgtcctctggaaacctggcggcagcgcaaaagatg

SEQ ID NO: 209049 - DNA, 103 bp, Artificial Sequence
  Synthetic Polynucleotide
taatacgactcactatagggtgcagcaggtgacggatgaggttccagaggaacagaggagacctctgatgcctcatccgaacctggcggcagcgcaaaagatg

SEQ ID NO: 209050 - DNA, 103 bp, Artificial Sequence
  Synthetic Polynucleotide
taatacgactcactataggggcctggggagctggtatcggggctggcaggaacagaggagacctgccatgcccgataccaacctggcggcagcgcaaaagatg

SEQ ID NO: 209051 - DNA, 103 bp, Artificial Sequence
  Synthetic Polynucleotide
taatacgactcactatagggccagagacgctgcagcaggtgacggatgagaacagaggagactcatcatgcacctgctgaacctggcggcagcgcaaaagatg

SEQ ID NO: 209052 - DNA, 103 bp, Artificial Sequence
  Synthetic Polynucleotide
taatacgactcactatagggagcggcccacccagagacgctgcagcaggtaacagaggagaacctgcatgagcgtctctaacctggcggcagcgcaaaagatg

SEQ ID NO: 209053 - DNA, 103 bp, Artificial Sequence
  Synthetic Polynucleotide
taatacgactcactatagggcctgccagccagcggcccacccagagacgcaacagaggagagcgtctatgggtgggccgaacctggcggcagcgcaaaagatg

SEQ ID NO: 209054 - DNA, 103 bp, Artificial Sequence
  Synthetic Polynucleotide
taatacgactcactatagggccctgcccggcctgccagccagcggcccacaacagaggagagtgggcatgtggctggcaaacctggcggcagcgcaaaagatg

SEQ ID NO: 209055 - DNA, 103 bp, Artificial Sequence
  Synthetic Polynucleotide
taatacgactcactataggggctgcaggccccctgcccggcctgccagccaacagaggagaggctggatggccgggcagaacctggcggcagcgcaaaagatg

SEQ ID NO: 209056 - DNA, 103 bp, Artificial Sequence
  Synthetic Polynucleotide
taatacgactcactataggggcacagtcctgctgcaggccccctgcccggaacagaggagaccgggcatggggcctgcaaacctggcggcagcgcaaaagatg

SEQ ID NO: 209057 - DNA, 103 bp, Artificial Sequence
  Synthetic Polynucleotide
taatacgactcactatagggcactcgcagagcacagtcctgctgcaggccaacagaggagaggcctgatgcaggactgtaacctggcggcagcgcaaaagatg

SEQ ID NO: 209058 - DNA, 103 bp, Artificial Sequence
  Synthetic Polynucleotide
taatacgactcactatagggcgctagcatccactcgcagagcacagtcctaacagaggagaaggactatgctctgcgagaacctggcggcagcgcaaaagatg

SEQ ID NO: 209059 - DNA, 103 bp, Artificial Sequence
  Synthetic Polynucleotide
taatacgactcactatagggcgggcgctggcgctagcatccactcgcagaaacagaggagatctgcgatgggatgctagaacctggcggcagcgcaaaagatg

SEQ ID NO: 209060 - DNA, 103 bp, Artificial Sequence
  Synthetic Polynucleotide
taatacgactcactatagggggctgcgtctcgggcgctggcgctagcatcaacagaggagagatgctatggccagcgccaacctggcggcagcgcaaaagatg

SEQ ID NO: 209061 - DNA, 103 bp, Artificial Sequence
  Synthetic Polynucleotide
taatacgactcactatagggcctgctccaaagccgcctcgctgaagggtgaacagaggagacaccctatggcgaggcggaacctggcggcagcgcaaaagatg

SEQ ID NO: 209062 - DNA, 103 bp, Artificial Sequence
  Synthetic Polynucleotide
taatacgactcactataggggagacaagctgcctggggagctggtatcggaacagaggagaccgataatggctccccagaacctggcggcagcgcaaaagatg

SEQ ID NO: 209063 - DNA, 103 bp, Artificial Sequence
  Synthetic Polynucleotide
taatacgactcactatagggggtagaccagggctgcgtctcgggcgctggaacagaggagaccagcgatggagacgcagaacctggcggcagcgcaaaagatg

SEQ ID NO: 209064 - DNA, 103 bp, Artificial Sequence
  Synthetic Polynucleotide
taatacgactcactatagggtgcagcttatggtagaccagggctgcgtctaacagaggagaagacgcatgcctggtctaaacctggcggcagcgcaaaagatg

SEQ ID NO: 209065 - DNA, 103 bp, Artificial Sequence
  Synthetic Polynucleotide
taatacgactcactataggggtgcagctggtgcagcttatggtagaccagaacagaggagactggtcatgcataagctgaacctggcggcagcgcaaaagatg

SEQ ID NO: 209066 - DNA, 103 bp, Artificial Sequence
  Synthetic Polynucleotide
taatacgactcactatagggtccccatggtgtgcagctggtgcagcttataacagaggagaataagcatgaccagctgcaacctggcggcagcgcaaaagatg

SEQ ID NO: 209067 - DNA, 103 bp, Artificial Sequence
  Synthetic Polynucleotide
taatacgactcactatagggcctgtgtgcttccccatggtgtgcagctggaacagaggagaccagctatgcaccatgggaacctggcggcagcgcaaaagatg

SEQ ID NO: 209068 - DNA, 103 bp, Artificial Sequence
  Synthetic Polynucleotide
taatacgactcactataggggaggtgcccgcctgtgtgcttccccatggtaacagaggagaaccatgatgaagcacacaaacctggcggcagcgcaaaagatg

SEQ ID NO: 209069 - DNA, 103 bp, Artificial Sequence
  Synthetic Polynucleotide
taatacgactcactatagggtggtggcagtgaggtgcccgcctgtgtgctaacagaggagaagcacaatggcgggcaccaacctggcggcagcgcaaaagatg

SEQ ID NO: 209070 - DNA, 103 bp, Artificial Sequence
  Synthetic Polynucleotide
taatacgactcactatagggagcgccaggttggtggcagtgaggtgcccgaacagaggagacgggcaatgcactgccacaacctggcggcagcgcaaaagatg

SEQ ID NO: 209071 - DNA, 103 bp, Artificial Sequence
  Synthetic Polynucleotide
taatacgactcactatagggcagggcactcagcgccaggttggtggcagtaacagaggagaactgccatgaacctggcgaacctggcggcagcgcaaaagatg

SEQ ID NO: 209072 - DNA, 103 bp, Artificial Sequence
  Synthetic Polynucleotide
taatacgactcactatagggctgccaggttcagggcactcagcgccaggtaacagaggagaacctggatgtgagtgcccaacctggcggcagcgcaaaagatg

SEQ ID NO: 209073 - DNA, 103 bp, Artificial Sequence
  Synthetic Polynucleotide
taatacgactcactataggggcaggaggtggagacaagctgcctggggagaacagaggagactccccatgcagcttgtcaacctggcggcagcgcaaaagatg

SEQ ID NO: 209074 - DNA, 103 bp, Artificial Sequence
  Synthetic Polynucleotide
taatacgactcactatagggcctgcacactctgccaggttcagggcactcaacagaggagagagtgcatggaacctggcaacctggcggcagcgcaaaagatg

SEQ ID NO: 209075 - DNA, 103 bp, Artificial Sequence
  Synthetic Polynucleotide
taatacgactcactatagggcacggcatcccctgcacactctgccaggttaacagaggagaaacctgatggagtgtgcaaacctggcggcagcgcaaaagatg

SEQ ID NO: 209076 - DNA, 103 bp, Artificial Sequence
  Synthetic Polynucleotide
taatacgactcactatagggtcgccacagacacggcatcccctgcacactaacagaggagaagtgtgatggggatgccgaacctggcggcagcgcaaaagatg

SEQ ID NO: 209077 - DNA, 103 bp, Artificial Sequence
  Synthetic Polynucleotide
taatacgactcactatagggtcggccagcgtcgccacagacacggcatccaacagaggagaggatgcatggtctgtggcaacctggcggcagcgcaaaagatg

SEQ ID NO: 209078 - DNA, 103 bp, Artificial Sequence
  Synthetic Polynucleotide
taatacgactcactatagggcacatagatctcggccagcgtcgccacagaaacagaggagatctgtgatgacgctggccaacctggcggcagcgcaaaagatg

SEQ ID NO: 209079 - DNA, 103 bp, Artificial Sequence
  Synthetic Polynucleotide
taatacgactcactatagggatgcagccgccacatagatctcggccagcgaacagaggagacgctggatgagatctatgaacctggcggcagcgcaaaagatg

SEQ ID NO: 209080 - DNA, 103 bp, Artificial Sequence
  Synthetic Polynucleotide
taatacgactcactatagggttcactctcaatgcagccgccacatagatcaacagaggagagatctaatgggcggctgcaacctggcggcagcgcaaaagatg

SEQ ID NO: 209081 - DNA, 103 bp, Artificial Sequence
  Synthetic Polynucleotide
taatacgactcactataggggagactggtcttcactctcaatgcagccgcaacagaggagagcggctatgttgagagtgaacctggcggcagcgcaaaagatg

SEQ ID NO: 209082 - DNA, 103 bp, Artificial Sequence
  Synthetic Polynucleotide
taatacgactcactatagggaggcccgtgggagactggtcttcactctcaaacagaggagatgagagatgagaccagtcaacctggcggcagcgcaaaagatg

SEQ ID NO: 209083 - DNA, 103 bp, Artificial Sequence
  Synthetic Polynucleotide
taatacgactcactatagggagaaaatgcaaggcccgtgggagactggtcaacagaggagagaccagatgcccacgggcaacctggcggcagcgcaaaagatg

SEQ ID NO: 209084 - DNA, 103 bp, Artificial Sequence
  Synthetic Polynucleotide
taatacgactcactataggggctcaatgtggcaggaggtggagacaagctaacagaggagaagcttgatgccacctcctaacctggcggcagcgcaaaagatg

SEQ ID NO: 209085 - DNA, 103 bp, Artificial Sequence
  Synthetic Polynucleotide
taatacgactcactataggggaagcgtgtcagaaaatgcaaggcccgtggaacagaggagaccacggatgttgcattttaacctggcggcagcgcaaaagatg

SEQ ID NO: 209086 - DNA, 103 bp, Artificial Sequence
  Synthetic Polynucleotide
taatacgactcactatagggtgctcaggaagaagcgtgtcagaaaatgcaaacagaggagatgcattatgtgacacgctaacctggcggcagcgcaaaagatg

SEQ ID NO: 209087 - DNA, 103 bp, Artificial Sequence
  Synthetic Polynucleotide
taatacgactcactatagggtggcgggcactgctcaggaagaagcgtgtcaacagaggagagacacgatgcttcctgagaacctggcggcagcgcaaaagatg

SEQ ID NO: 209088 - DNA, 103 bp, Artificial Sequence
  Synthetic Polynucleotide
taatacgactcactatagggcaggcaggcctggcgggcactgctcaggaaaacagaggagattcctgatgagtgcccgcaacctggcggcagcgcaaaagatg

SEQ ID NO: 209089 - DNA, 103 bp, Artificial Sequence
  Synthetic Polynucleotide
taatacgactcactatagggcactctgtgccaggcaggcctggcgggcacaacagaggagagtgcccatgaggcctgccaacctggcggcagcgcaaaagatg

SEQ ID NO: 209090 - DNA, 103 bp, Artificial Sequence
  Synthetic Polynucleotide
taatacgactcactatagggggcactgagccactctgtgccaggcaggccaacagaggagaggcctgatgggcacagagaacctggcggcagcgcaaaagatg

SEQ ID NO: 209091 - DNA, 103 bp, Artificial Sequence
  Synthetic Polynucleotide
taatacgactcactatagggcatggcaggaggcactgagccactctgtgcaacagaggagagcacagatgggctcagtgaacctggcggcagcgcaaaagatg

SEQ ID NO: 209092 - DNA, 103 bp, Artificial Sequence
  Synthetic Polynucleotide
taatacgactcactatagggagagccactgcatggcaggaggcactgagcaacagaggagagctcagatgctcctgccaaacctggcggcagcgcaaaagatg

SEQ ID NO: 209093 - DNA, 103 bp, Artificial Sequence
  Synthetic Polynucleotide
taatacgactcactatagggacggggtggcagagccactgcatggcaggaaacagaggagatcctgcatggcagtggctaacctggcggcagcgcaaaagatg

SEQ ID NO: 209094 - DNA, 103 bp, Artificial Sequence
  Synthetic Polynucleotide
taatacgactcactatagggacggtggcccacggggtggcagagccactgaacagaggagacagtggatgtgccaccccaacctggcggcagcgcaaaagatg

SEQ ID NO: 209095 - DNA, 103 bp, Artificial Sequence
  Synthetic Polynucleotide
taatacgactcactatagggcaagagaggagctcaatgtggcaggaggtgaacagaggagacacctcatgccacattgaaacctggcggcagcgcaaaagatg

SEQ ID NO: 209096 - DNA, 103 bp, Artificial Sequence
  Synthetic Polynucleotide
taatacgactcactatagggccacgaagaaacggtggcccacggggtggcaacagaggagagccaccatgtgggccaccaacctggcggcagcgcaaaagatg

SEQ ID NO: 209097 - DNA, 103 bp, Artificial Sequence
  Synthetic Polynucleotide
taatacgactcactatagggcagtccccatccacgaagaaacggtggcccaacagaggagagggccaatgtttcttcgtaacctggcggcagcgcaaaagatg

SEQ ID NO: 209098 - DNA, 103 bp, Artificial Sequence
  Synthetic Polynucleotide
taatacgactcactataggggagcacggaccagtccccatccacgaagaaaacagaggagattcttcatggatggggacaacctggcggcagcgcaaaagatg

SEQ ID NO: 209099 - DNA, 103 bp, Artificial Sequence
  Synthetic Polynucleotide
taatacgactcactatagggatggggtactgagcacggaccagtccccataacagaggagaatggggatgggtccgtgcaacctggcggcagcgcaaaagatg

SEQ ID NO: 209100 - DNA, 103 bp, Artificial Sequence
  Synthetic Polynucleotide
taatacgactcactatagggaggctctcccatggggtactgagcacggacaacagaggagagtccgtatgcagtaccccaacctggcggcagcgcaaaagatg

SEQ ID NO: 209101 - DNA, 103 bp, Artificial Sequence
  Synthetic Polynucleotide
taatacgactcactatagggcaagctgtacaggctctcccatggggtactaacagaggagaagtaccatgtgggagagcaacctggcggcagcgcaaaagatg

SEQ ID NO: 209102 - DNA, 103 bp, Artificial Sequence
  Synthetic Polynucleotide
taatacgactcactatagggggttcccggccaagctgtacaggctctcccaacagaggagagggagaatgtgtacagctaacctggcggcagcgcaaaagatg

SEQ ID NO: 209103 - DNA, 103 bp, Artificial Sequence
  Synthetic Polynucleotide
taatacgactcactataggggggtccactgggttcccggccaagctgtacaacagaggagagtacagatgggccgggaaaacctggcggcagcgcaaaagatg

SEQ ID NO: 209104 - DNA, 103 bp, Artificial Sequence
  Synthetic Polynucleotide
taatacgactcactatagggctgggccagggggtccactgggttcccggcaacagaggagagccgggatgccagtggacaacctggcggcagcgcaaaagatg

SEQ ID NO: 209105 - DNA, 103 bp, Artificial Sequence
  Synthetic Polynucleotide
taatacgactcactataggggctgagtcacctgggccagggggtccactgaacagaggagacagtggatgccctggcccaacctggcggcagcgcaaaagatg

SEQ ID NO: 209106 - DNA, 103 bp, Artificial Sequence
  Synthetic Polynucleotide
taatacgactcactatagggaggaaggcttcaagagaggagctcaatgtgaacagaggagacacattatgctcctctctaacctggcggcagcgcaaaagatg

SEQ ID NO: 209107 - DNA, 103 bp, Artificial Sequence
  Synthetic Polynucleotide
taatacgactcactatagggtcccggaatagctgagtcacctgggccaggaacagaggagacctggcatgggtgactcaaacctggcggcagcgcaaaagatg

SEQ ID NO: 209108 - DNA, 103 bp, Artificial Sequence
  Synthetic Polynucleotide
taatacgactcactatagggtaagagatgttcccggaatagctgagtcacaacagaggagagtgactatgctattccggaacctggcggcagcgcaaaagatg

SEQ ID NO: 209109 - DNA, 103 bp, Artificial Sequence
  Synthetic Polynucleotide
taatacgactcactataggggtgctcgctctaagagatgttcccggaataaacagaggagatattccatgaacatctctaacctggcggcagcgcaaaagatg

SEQ ID NO: 209110 - DNA, 103 bp, Artificial Sequence
  Synthetic Polynucleotide
taatacgactcactatagggacacagttcagtgctcgctctaagagatgtaacagaggagaacatctatgagagcgagcaacctggcggcagcgcaaaagatg

SEQ ID NO: 209111 - DNA, 103 bp, Artificial Sequence
  Synthetic Polynucleotide
taatacgactcactataggggggctgggtcacacagttcagtgctcgctcaacagaggagagagcgaatgctgaactgtaacctggcggcagcgcaaaagatg

SEQ ID NO: 209112 - DNA, 103 bp, Artificial Sequence
  Synthetic Polynucleotide
taatacgactcactatagggggctggggttgggctgggtcacacagttcaaacagaggagatgaactatgtgacccagcaacctggcggcagcgcaaaagatg

SEQ ID NO: 209113 - DNA, 103 bp, Artificial Sequence
  Synthetic Polynucleotide
taatacgactcactataggggctgacccagggctggggttgggctgggtcaacagaggagagacccaatgcaaccccagaacctggcggcagcgcaaaagatg

SEQ ID NO: 209114 - DNA, 103 bp, Artificial Sequence
  Synthetic Polynucleotide
taatacgactcactataggggtccccatcagctgacccagggctggggttaacagaggagaaaccccatgcctgggtcaaacctggcggcagcgcaaaagatg

SEQ ID NO: 209115 - DNA, 103 bp, Artificial Sequence
  Synthetic Polynucleotide
taatacgactcactatagggagaattccttgtccccatcagctgacccagaacagaggagactgggtatgctgatggggaacctggcggcagcgcaaaagatg

SEQ ID NO: 209116 - DNA, 103 bp, Artificial Sequence
  Synthetic Polynucleotide
taatacgactcactatagggagggcatccgagaattccttgtccccatcaaacagaggagatgatggatgcaaggaattaacctggcggcagcgcaaaagatg

SEQ ID NO: 209117 - DNA, 103 bp, Artificial Sequence
  Synthetic Polynucleotide
taatacgactcactatagggcggcccgctcaggaaggcttcaagagaggaaacagaggagatcctctatggaagccttcaacctggcggcagcgcaaaagatg

SEQ ID NO: 209118 - DNA, 103 bp, Artificial Sequence
  Synthetic Polynucleotide
taatacgactcactatagggcaggtacccgagggcatccgagaattccttaacagaggagaaaggaaatgtcggatgccaacctggcggcagcgcaaaagatg

SEQ ID NO: 209119 - DNA, 103 bp, Artificial Sequence
  Synthetic Polynucleotide
taatacgactcactatagggtcagcagctgcaggtacccgagggcatccgaacagaggagacggatgatgtcgggtaccaacctggcggcagcgcaaaagatg

SEQ ID NO: 209120 - DNA, 103 bp, Artificial Sequence
  Synthetic Polynucleotide
taatacgactcactataggggaacagctgttcagcagctgcaggtacccgaacagaggagacgggtaatggcagctgctaacctggcggcagcgcaaaagatg

SEQ ID NO: 209121 - DNA, 103 bp, Artificial Sequence
  Synthetic Polynucleotide
taatacgactcactatagggcgcagcatcagaacagctgttcagcagctgaacagaggagacagctgatgaacagctgtaacctggcggcagcgcaaaagatg

SEQ ID NO: 209122 - DNA, 103 bp, Artificial Sequence
  Synthetic Polynucleotide
taatacgactcactatagggcaggagcccccgcagcatcagaacagctgtaacagaggagaacagctatgctgatgctgaacctggcggcagcgcaaaagatg

SEQ ID NO: 209123 - DNA, 103 bp, Artificial Sequence
  Synthetic Polynucleotide
taatacgactcactatagggaagctgtaggcaggagcccccgcagcatcaaacagaggagatgatgcatggggggctccaacctggcggcagcgcaaaagatg

SEQ ID NO: 209124 - DNA, 103 bp, Artificial Sequence
  Synthetic Polynucleotide
taatacgactcactatagggactgatggagaagctgtaggcaggagccccaacagaggagaggggctatggcctacagcaacctggcggcagcgcaaaagatg

SEQ ID NO: 209125 - DNA, 103 bp, Artificial Sequence
  Synthetic Polynucleotide
taatacgactcactatagggccatgctggaactgatggagaagctgtaggaacagaggagacctacaatgtctccatcaaacctggcggcagcgcaaaagatg

SEQ ID NO: 209126 - DNA, 103 bp, Artificial Sequence
  Synthetic Polynucleotide
taatacgactcactataggggtggtggtggccatgctggaactgatggagaacagaggagactccatatgttccagcataacctggcggcagcgcaaaagatg

SEQ ID NO: 209127 - DNA, 103 bp, Artificial Sequence
  Synthetic Polynucleotide
taatacgactcactataggggtctacgccggtggtggtggccatgctggaaacagaggagatccagcatggccaccaccaacctggcggcagcgcaaaagatg

SEQ ID NO: 209128 - DNA, 103 bp, Artificial Sequence
  Synthetic Polynucleotide
taatacgactcactataggggcgctgcctgcggcccgctcaggaaggcttaacagaggagaaagcctatgtgagcgggcaacctggcggcagcgcaaaagatg

SEQ ID NO: 209129 - DNA, 103 bp, Artificial Sequence
  Synthetic Polynucleotide
taatacgactcactatagggtggccaccgggtctacgccggtggtggtggaacagaggagaccaccaatgccggcgtagaacctggcggcagcgcaaaagatg

SEQ ID NO: 209130 - DNA, 103 bp, Artificial Sequence
  Synthetic Polynucleotide
taatacgactcactataggggcccaccacttggccaccgggtctacgccgaacagaggagacggcgtatgcccggtggcaacctggcggcagcgcaaaagatg

SEQ ID NO: 209131 - DNA, 103 bp, Artificial Sequence
  Synthetic Polynucleotide
taatacgactcactatagggtgtcagagaggcccaccacttggccaccggaacagaggagaccggtgatgaagtggtggaacctggcggcagcgcaaaagatg

SEQ ID NO: 209132 - DNA, 103 bp, Artificial Sequence
  Synthetic Polynucleotide
taatacgactcactatagggtcaccacagctgtcagagaggcccaccactaacagaggagaagtggtatgcctctctgaaacctggcggcagcgcaaaagatg

SEQ ID NO: 209133 - DNA, 103 bp, Artificial Sequence
  Synthetic Polynucleotide
taatacgactcactatagggagccagtggatcaccacagctgtcagagagaacagaggagactctctatgagctgtggtaacctggcggcagcgcaaaagatg

SEQ ID NO: 209134 - DNA, 103 bp, Artificial Sequence
  Synthetic Polynucleotide
taatacgactcactatagggatcccgccgcagccagtggatcaccacagcaacagaggagagctgtgatgatccactggaacctggcggcagcgcaaaagatg

SEQ ID NO: 209135 - DNA, 103 bp, Artificial Sequence
  Synthetic Polynucleotide
taatacgactcactatagggccgcctcctcatcccgccgcagccagtggaaacagaggagatccactatgtgcggcgggaacctggcggcagcgcaaaagatg

SEQ ID NO: 209136 - DNA, 103 bp, Artificial Sequence
  Synthetic Polynucleotide
taatacgactcactatagggagccgctcagccgcctcctcatcccgccgcaacagaggagagcggcgatgtgaggaggcaacctggcggcagcgcaaaagatg

SEQ ID NO: 209137 - DNA, 103 bp, Artificial Sequence
  Synthetic Polynucleotide
taatacgactcactatagggcagcgggcacagccgctcagccgcctcctcaacagaggagagaggagatggctgagcggaacctggcggcagcgcaaaagatg

SEQ ID NO: 209138 - DNA, 103 bp, Artificial Sequence
  Synthetic Polynucleotide
taatacgactcactatagggggtgctccaccagcgggcacagccgctcagaacagaggagactgagcatgtgtgcccgcaacctggcggcagcgcaaaagatg

SEQ ID NO: 209139 - DNA, 103 bp, Artificial Sequence
  Synthetic Polynucleotide
taatacgactcactatagggaggggtgagggcgctgcctgcggcccgctcaacagaggagagagcggatggcaggcagcaacctggcggcagcgcaaaagatg

SEQ ID NO: 209140 - DNA, 103 bp, Artificial Sequence
  Synthetic Polynucleotide
taatacgactcactatagggacccggggcaggtgctccaccagcgggcacaacagaggagagtgcccatgggtggagcaaacctggcggcagcgcaaaagatg

SEQ ID NO: 209141 - DNA, 103 bp, Artificial Sequence
  Synthetic Polynucleotide
taatacgactcactatagggctcctgcagcacccggggcaggtgctccacaacagaggagagtggagatgctgccccggaacctggcggcagcgcaaaagatg

SEQ ID NO: 209142 - DNA, 103 bp, Artificial Sequence
  Synthetic Polynucleotide
taatacgactcactataggggtctctcagactcctgcagcacccggggcaaacagaggagatgccccatgtgctgcaggaacctggcggcagcgcaaaagatg

SEQ ID NO: 209143 - DNA, 103 bp, Artificial Sequence
  Synthetic Polynucleotide
taatacgactcactatagggctgggcaggggtctctcagactcctgcagcaacagaggagagctgcaatggtctgagagaacctggcggcagcgcaaaagatg

SEQ ID NO: 209144 - DNA, 103 bp, Artificial Sequence
  Synthetic Polynucleotide
taatacgactcactatagggcagagctgccctgggcaggggtctctcagaaacagaggagatctgagatgcccctgcccaacctggcggcagcgcaaaagatg

SEQ ID NO: 209145 - DNA, 103 bp, Artificial Sequence
  Synthetic Polynucleotide
taatacgactcactatagggtgaaggagtgcagagctgccctgggcagggaacagaggagaccctgcatggggcagctcaacctggcggcagcgcaaaagatg

SEQ ID NO: 209146 - DNA, 103 bp, Artificial Sequence
  Synthetic Polynucleotide
taatacgactcactatagggcgggcagccttgaaggagtgcagagctgccaacagaggagaggcagcatggcactccttaacctggcggcagcgcaaaagatg

SEQ ID NO: 209147 - DNA, 103 bp, Artificial Sequence
  Synthetic Polynucleotide
taatacgactcactatagggcagcagggcccgggcagccttgaaggagtgaacagaggagacactccatgaaggctgccaacctggcggcagcgcaaaagatg

SEQ ID NO: 209148 - DNA, 103 bp, Artificial Sequence
  Synthetic Polynucleotide
taatacgactcactatagggtggcacagcccagcagggcccgggcagcctaacagaggagaaggctgatggggccctgcaacctggcggcagcgcaaaagatg

SEQ ID NO: 209149 - DNA, 103 bp, Artificial Sequence
  Synthetic Polynucleotide
taatacgactcactataggggactctgccttggcacagcccagcagggccaacagaggagaggccctatggggctgtgcaacctggcggcagcgcaaaagatg

SEQ ID NO: 209150 - DNA, 103 bp, Artificial Sequence
  Synthetic Polynucleotide
taatacgactcactataggggggaggggacaggggtgagggcgctgcctgaacagaggagacaggcaatgccctcacccaacctggcggcagcgcaaaagatg

SEQ ID NO: 209151 - DNA, 103 bp, Artificial Sequence
  Synthetic Polynucleotide
taatacgactcactatagggggctggaccagactctgccttggcacagccaacagaggagaggctgtatgaaggcagagaacctggcggcagcgcaaaagatg

SEQ ID NO: 209152 - DNA, 103 bp, Artificial Sequence
  Synthetic Polynucleotide
taatacgactcactatagggtggtcaggctggctggaccagactctgcctaacagaggagaaggcagatgctggtccagaacctggcggcagcgcaaaagatg

SEQ ID NO: 209153 - DNA, 103 bp, Artificial Sequence
  Synthetic Polynucleotide
taatacgactcactatagggttctcacagatggtcaggctggctggaccaaacagaggagatggtccatgcagcctgacaacctggcggcagcgcaaaagatg

SEQ ID NO: 209154 - DNA, 103 bp, Artificial Sequence
  Synthetic Polynucleotide
taatacgactcactatagggcccactggccttctcacagatggtcaggctaacagaggagaagcctgatgatctgtgagaacctggcggcagcgcaaaagatg

SEQ ID NO: 209155 - DNA, 103 bp, Artificial Sequence
  Synthetic Polynucleotide
taatacgactcactatagggcctgcaggtacccactggccttctcacagaaacagaggagatctgtgatgaggccagtgaacctggcggcagcgcaaaagatg

SEQ ID NO: 209156 - DNA, 103 bp, Artificial Sequence
  Synthetic Polynucleotide
taatacgactcactataggggccaggctgtcctgcaggtacccactggccaacagaggagaggccagatggtacctgcaaacctggcggcagcgcaaaagatg

SEQ ID NO: 209157 - DNA, 103 bp, Artificial Sequence
  Synthetic Polynucleotide
taatacgactcactatagggtggtgtggtagccaggctgtcctgcaggtaaacagaggagatacctgatggacagcctgaacctggcggcagcgcaaaagatg

SEQ ID NO: 209158 - DNA, 103 bp, Artificial Sequence
  Synthetic Polynucleotide
taatacgactcactatagggagctgctggctggtgtggtagccaggctgtaacagaggagaacagccatgctaccacacaacctggcggcagcgcaaaagatg

SEQ ID NO: 209159 - DNA, 103 bp, Artificial Sequence
  Synthetic Polynucleotide
taatacgactcactatagggttgtcaatggagctgctggctggtgtggtaaacagaggagataccacatgagccagcagaacctggcggcagcgcaaaagatg

SEQ ID NO: 209160 - DNA, 103 bp, Artificial Sequence
  Synthetic Polynucleotide
taatacgactcactatagggctgcacggccttgtcaatggagctgctggcaacagaggagagccagcatgtccattgacaacctggcggcagcgcaaaagatg

SEQ ID NO: 209161 - DNA, 103 bp, Artificial Sequence
  Synthetic Polynucleotide
taatacgactcactataggggtgcaggctggggaggggacaggggtgaggaacagaggagacctcacatgtgtcccctcaacctggcggcagcgcaaaagatg

SEQ ID NO: 209162 - DNA, 103 bp, Artificial Sequence
  Synthetic Polynucleotide
taatacgactcactatagggacaggaacagctgcacggccttgtcaatggaacagaggagaccattgatgaggccgtgcaacctggcggcagcgcaaaagatg

SEQ ID NO: 209163 - DNA, 103 bp, Artificial Sequence
  Synthetic Polynucleotide
taatacgactcactatagggagcaggtcacacaggaacagctgcacggccaacagaggagaggccgtatggctgttcctaacctggcggcagcgcaaaagatg

SEQ ID NO: 209164 - DNA, 103 bp, Artificial Sequence
  Synthetic Polynucleotide
taatacgactcactatagggcaccacaagaagcaggtcacacaggaacagaacagaggagactgttcatgtgtgacctgaacctggcggcagcgcaaaagatg

SEQ ID NO: 209165 - DNA, 103 bp, Artificial Sequence
  Synthetic Polynucleotide
taatacgactcactatagggggctggtgcgcaccacaagaagcaggtcacaacagaggagagtgaccatgttcttgtggaacctggcggcagcgcaaaagatg

SEQ ID NO: 209166 - DNA, 103 bp, Artificial Sequence
  Synthetic Polynucleotide
taatacgactcactatagggtgccgccacaggctggtgcgcaccacaagaaacagaggagatcttgtatggcgcaccagaacctggcggcagcgcaaaagatg

SEQ ID NO: 209167 - DNA, 103 bp, Artificial Sequence
  Synthetic Polynucleotide
taatacgactcactataggggggctgctgctgccgccacaggctggtgcgaacagaggagacgcaccatgctgtggcggaacctggcggcagcgcaaaagatg

SEQ ID NO: 209168 - DNA, 103 bp, Artificial Sequence
  Synthetic Polynucleotide
taatacgactcactatagggccggggccgggggctgctgctgccgccacaaacagaggagatgtggcatgagcagcagcaacctggcggcagcgcaaaagatg

SEQ ID NO: 209169 - DNA, 103 bp, Artificial Sequence
  Synthetic Polynucleotide
taatacgactcactataggggctgctggggccggggccgggggctgctgcaacagaggagagcagcaatgcccggccccaacctggcggcagcgcaaaagatg

SEQ ID NO: 209170 - DNA, 103 bp, Artificial Sequence
  Synthetic Polynucleotide
taatacgactcactatagggggtgccctgggctgctggggccggggccggaacagaggagaccggccatggccccagcaaacctggcggcagcgcaaaagatg

SEQ ID NO: 209171 - DNA, 103 bp, Artificial Sequence
  Synthetic Polynucleotide
taatacgactcactataggggcctgctgctggtgccctgggctgctggggaacagaggagaccccagatgcccagggcaaacctggcggcagcgcaaaagatg

SEQ ID NO: 209172 - DNA, 103 bp, Artificial Sequence
  Synthetic Polynucleotide
taatacgactcactatagggtcgcccagcgcctgctccaaagccgcctcgaacagaggagacgaggcatgtttggagcaaacctggcggcagcgcaaaagatg

SEQ ID NO: 209173 - DNA, 103 bp, Artificial Sequence
  Synthetic Polynucleotide
taatacgactcactatagggaatggagtgggtgcaggctggggaggggacaacagaggagagtccccatgccagcctgcaacctggcggcagcgcaaaagatg

SEQ ID NO: 209174 - DNA, 103 bp, Artificial Sequence
  Synthetic Polynucleotide
taatacgactcactataggggaagcctggggcctgctgctggtgccctggaacagaggagaccagggatgcagcagcagaacctggcggcagcgcaaaagatg

SEQ ID NO: 209175 - DNA, 103 bp, Artificial Sequence
  Synthetic Polynucleotide
taatacgactcactatagggctcaagggcggaagcctggggcctgctgctaacagaggagaagcagcatgccccaggctaacctggcggcagcgcaaaagatg

SEQ ID NO: 209176 - DNA, 103 bp, Artificial Sequence
  Synthetic Polynucleotide
taatacgactcactatagggagccacgcagctcaagggcggaagcctgggaacagaggagacccaggatgccgcccttgaacctggcggcagcgcaaaagatg

SEQ ID NO: 209177 - DNA, 103 bp, Artificial Sequence
  Synthetic Polynucleotide
taatacgactcactatagggtcccgttggaagccacgcagctcaagggcgaacagaggagacgccctatggctgcgtggaacctggcggcagcgcaaaagatg

SEQ ID NO: 209178 - DNA, 103 bp, Artificial Sequence
  Synthetic Polynucleotide
taatacgactcactataggggctgctcaggtcccgttggaagccacgcagaacagaggagactgcgtatgttccaacggaacctggcggcagcgcaaaagatg

SEQ ID NO: 209179 - DNA, 103 bp, Artificial Sequence
  Synthetic Polynucleotide
taatacgactcactataggggccgcctcaggctgctcaggtcccgttggaaacagaggagatccaacatgacctgagcaaacctggcggcagcgcaaaagatg

SEQ ID NO: 209180 - DNA, 103 bp, Artificial Sequence
  Synthetic Polynucleotide
taatacgactcactatagggctctgtgccagccgcctcaggctgctcaggaacagaggagacctgagatgcctgaggcgaacctggcggcagcgcaaaagatg

SEQ ID NO: 209181 - DNA, 103 bp, Artificial Sequence
  Synthetic Polynucleotide
taatacgactcactataggggggccggaagctctgtgccagccgcctcagaacagaggagactgaggatgctggcacagaacctggcggcagcgcaaaagatg

SEQ ID NO: 209182 - DNA, 103 bp, Artificial Sequence
  Synthetic Polynucleotide
taatacgactcactatagggtccgcatggcgggccggaagctctgtgccaaacagaggagatggcacatggcttccggcaacctggcggcagcgcaaaagatg

SEQ ID NO: 209183 - DNA, 103 bp, Artificial Sequence
  Synthetic Polynucleotide
taatacgactcactatagggaggaacaccctccgcatggcgggccggaagaacagaggagacttccgatgcgccatgcgaacctggcggcagcgcaaaagatg

SEQ ID NO: 209184 - DNA, 103 bp, Artificial Sequence
  Synthetic Polynucleotide
taatacgactcactataggggtacatcttcaatggagtgggtgcaggctgaacagaggagacagcctatgcccactccaaacctggcggcagcgcaaaagatg

SEQ ID NO: 209185 - DNA, 103 bp, Artificial Sequence
  Synthetic Polynucleotide
taatacgactcactatagggggcctcatgtaggaacaccctccgcatggcaacagaggagagccatgatgagggtgttcaacctggcggcagcgcaaaagatg

SEQ ID NO: 209186 - DNA, 103 bp, Artificial Sequence
  Synthetic Polynucleotide
taatacgactcactataggggccgggccgtggcctcatgtaggaacacccaacagaggagagggtgtatgtacatgaggaacctggcggcagcgcaaaagatg

SEQ ID NO: 209187 - DNA, 103 bp, Artificial Sequence
  Synthetic Polynucleotide
taatacgactcactatagggcccgccatcagccgggccgtggcctcatgtaacagaggagaacatgaatgcacggcccgaacctggcggcagcgcaaaagatg

SEQ ID NO: 209188 - DNA, 103 bp, Artificial Sequence
  Synthetic Polynucleotide
taatacgactcactatagggggggctggcccccgccatcagccgggccgtaacagaggagaacggccatgctgatggcgaacctggcggcagcgcaaaagatg

SEQ ID NO: 209189 - DNA, 103 bp, Artificial Sequence
  Synthetic Polynucleotide
taatacgactcactataggggtgtccgtgtggggctggcccccgccatcaaacagaggagatgatggatggggccagccaacctggcggcagcgcaaaagatg

SEQ ID NO: 209190 - DNA, 103 bp, Artificial Sequence
  Synthetic Polynucleotide
taatacgactcactatagggaggagctggtgtgtccgtgtggggctggccaacagaggagaggccagatgcacacggacaacctggcggcagcgcaaaagatg

SEQ ID NO: 209191 - DNA, 103 bp, Artificial Sequence
  Synthetic Polynucleotide
taatacgactcactatagggactgcggtcgaggagctggtgtgtccgtgtaacagaggagaacacggatgcaccagctcaacctggcggcagcgcaaaagatg

SEQ ID NO: 209192 - DNA, 103 bp, Artificial Sequence
  Synthetic Polynucleotide
taatacgactcactataggggccgcctcagactgcggtcgaggagctggtaacagaggagaaccagcatgtcgaccgcaaacctggcggcagcgcaaaagatg

SEQ ID NO: 209193 - DNA, 103 bp, Artificial Sequence
  Synthetic Polynucleotide
taatacgactcactataggggggcctgcccgccgcctcagactgcggtcgaacagaggagacgaccgatgtctgaggcgaacctggcggcagcgcaaaagatg

SEQ ID NO: 209194 - DNA, 103 bp, Artificial Sequence
  Synthetic Polynucleotide
taatacgactcactatagggtttgccaccggggcctgcccgccgcctcagaacagaggagactgaggatgcgggcaggcaacctggcggcagcgcaaaagatg

SEQ ID NO: 209195 - DNA, 103 bp, Artificial Sequence
  Synthetic Polynucleotide
taatacgactcactataggggcatggacgggtacatcttcaatggagtggaacagaggagaccactcatgtgaagatgtaacctggcggcagcgcaaaagatg

SEQ ID NO: 209196 - DNA, 103 bp, Artificial Sequence
  Synthetic Polynucleotide
taatacgactcactatagggccgcgcctcctttgccaccggggcctgcccaacagaggagagggcagatgccggtggcaaacctggcggcagcgcaaaagatg

SEQ ID NO: 209197 - DNA, 103 bp, Artificial Sequence
  Synthetic Polynucleotide
taatacgactcactatagggagctccgccaccgcgcctcctttgccaccgaacagaggagacggtggatgaggaggcgcaacctggcggcagcgcaaaagatg

SEQ ID NO: 209198 - DNA, 103 bp, Artificial Sequence
  Synthetic Polynucleotide
taatacgactcactatagggccgcggctccagctccgccaccgcgcctccaacagaggagaggaggcatggtggcggagaacctggcggcagcgcaaaagatg

SEQ ID NO: 209199 - DNA, 103 bp, Artificial Sequence
  Synthetic Polynucleotide
taatacgactcactataggggccgcgtgggccgcggctccagctccgccaaacagaggagatggcggatgtggagccgcaacctggcggcagcgcaaaagatg

SEQ ID NO: 209200 - DNA, 103 bp, Artificial Sequence
  Synthetic Polynucleotide
taatacgactcactataggggcgtgctcccgccgcgtgggccgcggctccaacagaggagaggagccatggcccacgcgaacctggcggcagcgcaaaagatg

SEQ ID NO: 209201 - DNA, 103 bp, Artificial Sequence
  Synthetic Polynucleotide
taatacgactcactatagggcaaggcctccgcgtgctcccgccgcgtgggaacagaggagacccacgatgcgggagcacaacctggcggcagcgcaaaagatg

SEQ ID NO: 209202 - DNA, 103 bp, Artificial Sequence
  Synthetic Polynucleotide
taatacgactcactatagggaggccagcagcaaggcctccgcgtgctcccaacagaggagagggagcatgcggaggcctaacctggcggcagcgcaaaagatg

SEQ ID NO: 209203 - DNA, 103 bp, Artificial Sequence
  Synthetic Polynucleotide
taatacgactcactatagggaggtagcaggaggccagcagcaaggcctccaacagaggagaggaggcatggctgctggcaacctggcggcagcgcaaaagatg

SEQ ID NO: 209204 - DNA, 103 bp, Artificial Sequence
  Synthetic Polynucleotide
taatacgactcactataggggccggggggcaggtagcaggaggccagcagaacagaggagactgctgatgtcctgctacaacctggcggcagcgcaaaagatg

SEQ ID NO: 209205 - DNA, 103 bp, Artificial Sequence
  Synthetic Polynucleotide
taatacgactcactatagggccgacaggaagccggggggcaggtagcaggaacagaggagacctgctatgtgccccccgaacctggcggcagcgcaaaagatg

SEQ ID NO: 209206 - DNA, 103 bp, Artificial Sequence
  Synthetic Polynucleotide
taatacgactcactataggggagaaagcgggcatggacgggtacatcttcaacagaggagagaagatatgcccgtccataacctggcggcagcgcaaaagatg

SEQ ID NO: 209207 - DNA, 103 bp, Artificial Sequence
  Synthetic Polynucleotide
taatacgactcactatagggtgcccgggcgccgacaggaagccggggggcaacagaggagagcccccatgcttcctgtcaacctggcggcagcgcaaaagatg

SEQ ID NO: 209208 - DNA, 103 bp, Artificial Sequence
  Synthetic Polynucleotide
taatacgactcactataggggcccacgcgctgcccgggcgccgacaggaaaacagaggagattcctgatggcgcccgggaacctggcggcagcgcaaaagatg

SEQ ID NO: 209209 - DNA, 103 bp, Artificial Sequence
  Synthetic Polynucleotide
taatacgactcactatagggcagccagcatgcccacgcgctgcccgggcgaacagaggagacgcccgatgagcgcgtggaacctggcggcagcgcaaaagatg

SEQ ID NO: 209210 - DNA, 103 bp, Artificial Sequence
  Synthetic Polynucleotide
taatacgactcactatagggcgcgccgcctcagccagcatgcccacgcgcaacagaggagagcgcgtatgcatgctggcaacctggcggcagcgcaaaagatg

SEQ ID NO: 209211 - DNA, 103 bp, Artificial Sequence
  Synthetic Polynucleotide
taatacgactcactatagggctcgagtgtgcgcgccgcctcagccagcataacagaggagaatgctgatggaggcggcgaacctggcggcagcgcaaaagatg

SEQ ID NO: 209212 - DNA, 103 bp, Artificial Sequence
  Synthetic Polynucleotide
taatacgactcactatagggcgccaagcttctcgagtgtgcgcgccgcctaacagaggagaaggcggatggcacactcgaacctggcggcagcgcaaaagatg

SEQ ID NO: 209213 - DNA, 103 bp, Artificial Sequence
  Synthetic Polynucleotide
taatacgactcactatagggagccggcgatcgccaagcttctcgagtgtgaacagaggagacacactatggaagcttggaacctggcggcagcgcaaaagatg

SEQ ID NO: 209214 - DNA, 103 bp, Artificial Sequence
  Synthetic Polynucleotide
taatacgactcactataggggtcgtgcagcagccggcgatcgccaagcttaacagaggagaaagcttatggatcgccggaacctggcggcagcgcaaaagatg

SEQ ID NO: 209215 - DNA, 103 bp, Artificial Sequence
  Synthetic Polynucleotide
taatacgactcactatagggtctgctgacagtcgtgcagcagccggcgataacagaggagaatcgccatgtgctgcacgaacctggcggcagcgcaaaagatg

SEQ ID NO: 209216 - DNA, 103 bp, Artificial Sequence
  Synthetic Polynucleotide
taatacgactcactatagggcgcatgagcatctgctgacagtcgtgcagcaacagaggagagctgcaatgctgtcagcaaacctggcggcagcgcaaaagatg

SEQ ID NO: 209217 - DNA, 103 bp, Artificial Sequence
  Synthetic Polynucleotide
taatacgactcactatagggaggcccaggggagaaagcgggcatggacggaacagaggagaccgtccatgcccgctttcaacctggcggcagcgcaaaagatg

SEQ ID NO: 209218 - DNA, 103 bp, Artificial Sequence
  Synthetic Polynucleotide
taatacgactcactatagggaccgcccaggcgcatgagcatctgctgacaaacagaggagatgtcagatgatgctcatgaacctggcggcagcgcaaaagatg

SEQ ID NO: 209219 - DNA, 103 bp, Artificial Sequence
  Synthetic Polynucleotide
taatacgactcactatagggcagtggtcccaccgcccaggcgcatgagcaaacagaggagatgctcaatggcctgggcgaacctggcggcagcgcaaaagatg

SEQ ID NO: 209220 - DNA, 103 bp, Artificial Sequence
  Synthetic Polynucleotide
taatacgactcactatagggctggaagtgacagtggtcccaccgcccaggaacagaggagacctgggatgtgggaccacaacctggcggcagcgcaaaagatg

SEQ ID NO: 209221 - DNA, 103 bp, Artificial Sequence
  Synthetic Polynucleotide
taatacgactcactatagggccttgataccaggcccaggggagaaagcggaacagaggagaccgcttatgcccctgggcaacctggcggcagcgcaaaagatg

SEQ ID NO: 209222 - DNA, 103 bp, Artificial Sequence
  Synthetic Polynucleotide
taatacgactcactatagggactgactcttccttgataccaggcccagggaacagaggagaccctggatgtggtatcaaaacctggcggcagcgcaaaagatg

SEQ ID NO: 209223 - DNA, 103 bp, Artificial Sequence
  Synthetic Polynucleotide
taatacgactcactataggggctcagtggcactgactcttccttgataccaacagaggagaggtatcatggaagagtcaaacctggcggcagcgcaaaagatg

SEQ ID NO: 209224 - DNA, 103 bp, Artificial Sequence
  Synthetic Polynucleotide
taatacgactcactatagggtctgcaggatgctcagtggcactgactcttaacagaggagaaagagtatgtgccactgaaacctggcggcagcgcaaaagatg

SEQ ID NO: 209225 - DNA, 103 bp, Artificial Sequence
  Synthetic Polynucleotide
taatacgactcactatagggggggtgggggtctgcaggatgctcagtggcaacagaggagagccactatgcatcctgcaaacctggcggcagcgcaaaagatg

SEQ ID NO: 209226 - DNA, 103 bp, Artificial Sequence
  Synthetic Polynucleotide
taatacgactcactatagggatcgcacggctcgcccagcgcctgctccaaaacagaggagattggagatggcgctgggcaacctggcggcagcgcaaaagatg

SEQ ID NO: 209227 - DNA, 103 bp, Artificial Sequence
  Synthetic Polynucleotide
taatacgactcactatagggcaggggctgtggggtgggggtctgcaggataacagaggagaatcctgatgacccccaccaacctggcggcagcgcaaaagatg

SEQ ID NO: 209228 - DNA, 103 bp, Artificial Sequence
  Synthetic Polynucleotide
taatacgactcactataggggggcccctggcaggggctgtggggtgggggaacagaggagacccccaatgcacagccccaacctggcggcagcgcaaaagatg

SEQ ID NO: 209229 - DNA, 103 bp, Artificial Sequence
  Synthetic Polynucleotide
taatacgactcactatagggtgtggcaggagggcccctggcaggggctgtaacagaggagaacagccatggccaggggcaacctggcggcagcgcaaaagatg

SEQ ID NO: 209230 - DNA, 103 bp, Artificial Sequence
  Synthetic Polynucleotide
taatacgactcactatagggtgggaagctctgtggcaggagggcccctggaacagaggagaccagggatgctcctgccaaacctggcggcagcgcaaaagatg

SEQ ID NO: 209231 - DNA, 103 bp, Artificial Sequence
  Synthetic Polynucleotide
taatacgactcactataggggggctggggctgggaagctctgtggcaggaaacagaggagatcctgcatgagagcttccaacctggcggcagcgcaaaagatg

SEQ ID NO: 209232 - DNA, 103 bp, Artificial Sequence
  Synthetic Polynucleotide
taatacgactcactatagggaactgcggtggggctggggctgggaagctcaacagaggagagagcttatgagccccagcaacctggcggcagcgcaaaagatg

SEQ ID NO: 209233 - DNA, 103 bp, Artificial Sequence
  Synthetic Polynucleotide
taatacgactcactatagggggtggagctgaactgcggtggggctggggcaacagaggagagccccaatgccaccgcagaacctggcggcagcgcaaaagatg

SEQ ID NO: 209234 - DNA, 103 bp, Artificial Sequence
  Synthetic Polynucleotide
taatacgactcactatagggctaacacaggggtggagctgaactgcggtgaacagaggagacaccgcatgtcagctccaaacctggcggcagcgcaaaagatg

SEQ ID NO: 209235 - DNA, 103 bp, Artificial Sequence
  Synthetic Polynucleotide
taatacgactcactatagggctggggtagcctaacacaggggtggagctgaacagaggagacagctcatgccctgtgttaacctggcggcagcgcaaaagatg

SEQ ID NO: 209236 - DNA, 103 bp, Artificial Sequence
  Synthetic Polynucleotide
taatacgactcactatagggtcccggagggctggggtagcctaacacaggaacagaggagacctgtgatgggctaccccaacctggcggcagcgcaaaagatg

SEQ ID NO: 209237 - DNA, 103 bp, Artificial Sequence
  Synthetic Polynucleotide
taatacgactcactatagggccgcgtccagatcgcacggctcgcccagcgaacagaggagacgctggatgagccgtgcgaacctggcggcagcgcaaaagatg

SEQ ID NO: 209238 - DNA, 103 bp, Artificial Sequence
  Synthetic Polynucleotide
taatacgactcactatagggtagagaagcctcccggagggctggggtagcaacagaggagagctaccatggccctccggaacctggcggcagcgcaaaagatg

SEQ ID NO: 209239 - DNA, 103 bp, Artificial Sequence
  Synthetic Polynucleotide
taatacgactcactataggggggcttcctgtagagaagcctcccggagggaacagaggagaccctccatgaggcttctcaacctggcggcagcgcaaaagatg

SEQ ID NO: 209240 - DNA, 103 bp, Artificial Sequence
  Synthetic Polynucleotide
taatacgactcactataggggttcccgggagggcttcctgtagagaagccaacagaggagaggcttcatgacaggaagcaacctggcggcagcgcaaaagatg

SEQ ID NO: 209241 - DNA, 103 bp, Artificial Sequence
  Synthetic Polynucleotide
taatacgactcactataggggctgctgggtgttcccgggagggcttcctgaacagaggagacaggaaatgctcccgggaaacctggcggcagcgcaaaagatg

SEQ ID NO: 209242 - DNA, 103 bp, Artificial Sequence
  Synthetic Polynucleotide
taatacgactcactatagggccaggcagcggctgctgggtgttcccgggaaacagaggagatcccggatgcacccagcaaacctggcggcagcgcaaaagatg

SEQ ID NO: 209243 - DNA, 103 bp, Artificial Sequence
  Synthetic Polynucleotide
taatacgactcactatagggcagtggcaggccaggcagcggctgctgggtaacagaggagaacccagatgccgctgcctaacctggcggcagcgcaaaagatg

SEQ ID NO: 209244 - DNA, 103 bp, Artificial Sequence
  Synthetic Polynucleotide
taatacgactcactataggggcggggaagccagtggcaggccaggcagcgaacagaggagacgctgcatggcctgccacaacctggcggcagcgcaaaagatg

SEQ ID NO: 209245 - DNA, 103 bp, Artificial Sequence
  Synthetic Polynucleotide
taatacgactcactataggggggacccctggcggggaagccagtggcaggaacagaggagacctgccatgggcttccccaacctggcggcagcgcaaaagatg

SEQ ID NO: 209246 - DNA, 103 bp, Artificial Sequence
  Synthetic Polynucleotide
taatacgactcactatagggggagacgggcgggacccctggcggggaagcaacagaggagagcttccatgccaggggtcaacctggcggcagcgcaaaagatg

SEQ ID NO: 209247 - DNA, 103 bp, Artificial Sequence
  Synthetic Polynucleotide
taatacgactcactataggggggtgtgcaaggagacgggcgggacccctgaacagaggagacaggggatgcgcccgtctaacctggcggcagcgcaaaagatg

SEQ ID NO: 209248 - DNA, 103 bp, Artificial Sequence
  Synthetic Polynucleotide
taatacgactcactataggggtcagcagcgccgcgtccagatcgcacggcaacagaggagagccgtgatgtctggacgcaacctggcggcagcgcaaaagatg

SEQ ID NO: 209249 - DNA, 103 bp, Artificial Sequence
  Synthetic Polynucleotide
taatacgactcactatagggctctggacctgggtgtgcaaggagacgggcaacagaggagagcccgtatgcttgcacacaacctggcggcagcgcaaaagatg

SEQ ID NO: 209250 - DNA, 103 bp, Artificial Sequence
  Synthetic Polynucleotide
taatacgactcactatagggggggaccacactctggacctgggtgtgcaaaacagaggagattgcacatgcaggtccagaacctggcggcagcgcaaaagatg

SEQ ID NO: 209251 - DNA, 103 bp, Artificial Sequence
  Synthetic Polynucleotide
taatacgactcactataggggtagctgctgggggaccacactctggacctaacagaggagaaggtccatggtgtggtccaacctggcggcagcgcaaaagatg

SEQ ID NO: 209252 - DNA, 103 bp, Artificial Sequence
  Synthetic Polynucleotide
taatacgactcactataggggtgactgtcagtagctgctgggggaccacaaacagaggagatgtggtatgccagcagctaacctggcggcagcgcaaaagatg

SEQ ID NO: 209253 - DNA, 103 bp, Artificial Sequence
  Synthetic Polynucleotide
taatacgactcactataggggggggcagctgtgactgtcagtagctgctgaacagaggagacagcagatgctgacagtcaacctggcggcagcgcaaaagatg

SEQ ID NO: 209254 - DNA, 103 bp, Artificial Sequence
  Synthetic Polynucleotide
taatacgactcactataggggggctgccgtgggggcagctgtgactgtcaaacagaggagatgacagatgcagctgcccaacctggcggcagcgcaaaagatg

SEQ ID NO: 209255 - DNA, 103 bp, Artificial Sequence
  Synthetic Polynucleotide
taatacgactcactataggggtcgttacaggggctgccgtgggggcagctaacagaggagaagctgcatgcacggcagcaacctggcggcagcgcaaaagatg

SEQ ID NO: 209256 - DNA, 103 bp, Artificial Sequence
  Synthetic Polynucleotide
taatacgactcactatagggggtcacagtggtcgttacaggggctgccgtaacagaggagaacggcaatgcctgtaacgaacctggcggcagcgcaaaagatg

SEQ ID NO: 209257 - DNA, 103 bp, Artificial Sequence
  Synthetic Polynucleotide
taatacgactcactatagggggatctgcgaggtcacagtggtcgttacagaacagaggagactgtaaatgccactgtgaaacctggcggcagcgcaaaagatg

SEQ ID NO: 209258 - DNA, 103 bp, Artificial Sequence
  Synthetic Polynucleotide
taatacgactcactataggggggacctgctggatctgcgaggtcacagtgaacagaggagacactgtatgctcgcagataacctggcggcagcgcaaaagatg

SEQ ID NO: 209259 - DNA, 103 bp, Artificial Sequence
  Synthetic Polynucleotide
taatacgactcactatagggttcgatgtcggtcagcagcgccgcgtccagaacagaggagactggacatggcgctgctgaacctggcggcagcgcaaaagatg

SEQ ID NO: 209260 - DNA, 103 bp, Artificial Sequence
  Synthetic Polynucleotide
taatacgactcactatagggcagcaggaccgggacctgctggatctgcgaaacagaggagatcgcagatgcagcaggtcaacctggcggcagcgcaaaagatg

SEQ ID NO: 209261 - DNA, 103 bp, Artificial Sequence
  Synthetic Polynucleotide
taatacgactcactatagggagtggggctgcagcaggaccgggacctgctaacagaggagaagcaggatgcggtcctgcaacctggcggcagcgcaaaagatg

SEQ ID NO: 209262 - DNA, 103 bp, Artificial Sequence
  Synthetic Polynucleotide
taatacgactcactataggggccttgatgaagtggggctgcagcaggaccaacagaggagaggtcctatggcagccccaaacctggcggcagcgcaaaagatg

SEQ ID NO: 209263 - DNA, 103 bp, Artificial Sequence
  Synthetic Polynucleotide
taatacgactcactatagggcagcgagtctgccttgatgaagtggggctgaacagaggagacagcccatgttcatcaagaacctggcggcagcgcaaaagatg

SEQ ID NO: 209264 - DNA, 103 bp, Artificial Sequence
  Synthetic Polynucleotide
taatacgactcactatagggctgtcagaagcagcgagtctgccttgatgaaacagaggagatcatcaatgcagactcgcaacctggcggcagcgcaaaagatg

SEQ ID NO: 209265 - DNA, 103 bp, Artificial Sequence
  Synthetic Polynucleotide
taatacgactcactataggggtcttcatggctgtcagaagcagcgagtctaacagaggagaagactcatggcttctgacaacctggcggcagcgcaaaagatg

SEQ ID NO: 209266 - DNA, 103 bp, Artificial Sequence
  Synthetic Polynucleotide
taatacgactcactatagggggctccgtctgtcttcatggctgtcagaagaacagaggagacttctgatggccatgaagaacctggcggcagcgcaaaagatg

SEQ ID NO: 209267 - DNA, 103 bp, Artificial Sequence
  Synthetic Polynucleotide
taatacgactcactatagggccttcacagtggctccgtctgtcttcatggaacagaggagaccatgaatgcagacggagaacctggcggcagcgcaaaagatg

SEQ ID NO: 209268 - DNA, 103 bp, Artificial Sequence
  Synthetic Polynucleotide
taatacgactcactatagggagacctgccgccttcacagtggctccgtctaacagaggagaagacggatgcactgtgaaaacctggcggcagcgcaaaagatg

SEQ ID NO: 209269 - DNA, 103 bp, Artificial Sequence
  Synthetic Polynucleotide
taatacgactcactatagggcaggggactgagacctgccgccttcacagtaacagaggagaactgtgatggcggcaggtaacctggcggcagcgcaaaagatg

SEQ ID NO: 209270 - DNA, 103 bp, Artificial Sequence
  Synthetic Polynucleotide
taatacgactcactataggggaagcatgtcttcgatgtcggtcagcagcgaacagaggagacgctgcatgccgacatcgaacctggcggcagcgcaaaagatg

SEQ ID NO: 209271 - DNA, 103 bp, Artificial Sequence
  Synthetic Polynucleotide
taatacgactcactatagggtgccagagaccaggggactgagacctgccgaacagaggagacggcagatgtcagtccccaacctggcggcagcgcaaaagatg

SEQ ID NO: 209272 - DNA, 103 bp, Artificial Sequence
  Synthetic Polynucleotide
taatacgactcactatagggtgcacagtggtgccagagaccaggggactgaacagaggagacagtccatgggtctctggaacctggcggcagcgcaaaagatg

SEQ ID NO: 209273 - DNA, 103 bp, Artificial Sequence
  Synthetic Polynucleotide
taatacgactcactatagggaggccctgtctgcacagtggtgccagagacaacagaggagagtctctatgaccactgtgaacctggcggcagcgcaaaagatg

SEQ ID NO: 209274 - DNA, 103 bp, Artificial Sequence
  Synthetic Polynucleotide
taatacgactcactataggggggtcggcaaaggccctgtctgcacagtggaacagaggagaccactgatgagacagggcaacctggcggcagcgcaaaagatg

SEQ ID NO: 209275 - DNA, 103 bp, Artificial Sequence
  Synthetic Polynucleotide
taatacgactcactatagggccactcaccagggtcggcaaaggccctgtcaacagaggagagacaggatgtttgccgacaacctggcggcagcgcaaaagatg

SEQ ID NO: 209276 - DNA, 103 bp, Artificial Sequence
  Synthetic Polynucleotide
taatacgactcactataggggatggttccgccactcaccagggtcggcaaaacagaggagattgccgatgctggtgagtaacctggcggcagcgcaaaagatg

SEQ ID NO: 209277 - DNA, 103 bp, Artificial Sequence
  Synthetic Polynucleotide
taatacgactcactatagggctgttgccaagatggttccgccactcaccaaacagaggagatggtgaatggcggaaccaaacctggcggcagcgcaaaagatg

SEQ ID NO: 209278 - DNA, 103 bp, Artificial Sequence
  Synthetic Polynucleotide
taatacgactcactatagggaccagtgggactgttgccaagatggttccgaacagaggagacggaacatgcttggcaacaacctggcggcagcgcaaaagatg

SEQ ID NO: 209279 - DNA, 103 bp, Artificial Sequence
  Synthetic Polynucleotide
taatacgactcactatagggcgcatctacgaccagtgggactgttgccaaaacagaggagattggcaatggtcccactgaacctggcggcagcgcaaaagatg

SEQ ID NO: 209280 - DNA, 103 bp, Artificial Sequence
  Synthetic Polynucleotide
taatacgactcactataggggcagcttctccgcatctacgaccagtgggaaacagaggagatcccacatgtcgtagatgaacctggcggcagcgcaaaagatg

SEQ ID NO: 209281 - DNA, 103 bp, Artificial Sequence
  Synthetic Polynucleotide
taatacgactcactatagggttgataagctgaagcatgtcttcgatgtcgaacagaggagacgacatatgagacatgctaacctggcggcagcgcaaaagatg

SEQ ID NO: 209282 - DNA, 103 bp, Artificial Sequence
  Synthetic Polynucleotide
taatacgactcactatagggcggttgataggcagcttctccgcatctacgaacagaggagacgtagaatgggagaagctaacctggcggcagcgcaaaagatg

SEQ ID NO: 209283 - DNA, 103 bp, Artificial Sequence
  Synthetic Polynucleotide
taatacgactcactatagggagctgcgagccggttgataggcagcttctcaacagaggagagagaagatgcctatcaacaacctggcggcagcgcaaaagatg

SEQ ID NO: 209284 - DNA, 103 bp, Artificial Sequence
  Synthetic Polynucleotide
taatacgactcactatagggccttgctgccagctgcgagccggttgatagaacagaggagactatcaatgggctcgcagaacctggcggcagcgcaaaagatg

SEQ ID NO: 209285 - DNA, 103 bp, Artificial Sequence
  Synthetic Polynucleotide
taatacgactcactataggggaggccggggccttgctgccagctgcgagcaacagaggagagctcgcatgtggcagcaaaacctggcggcagcgcaaaagatg

SEQ ID NO: 209286 - DNA, 103 bp, Artificial Sequence
  Synthetic Polynucleotide
taatacgactcactataggggctctgggcagaggccggggccttgctgccaacagaggagaggcagcatggccccggccaacctggcggcagcgcaaaagatg

SEQ ID NO: 209287 - DNA, 103 bp, Artificial Sequence
  Synthetic Polynucleotide
taatacgactcactatagggtctctccacggctctgggcagaggccggggaacagaggagaccccggatgctgcccagaaacctggcggcagcgcaaaagatg

SEQ ID NO: 209288 - DNA, 103 bp, Artificial Sequence
  Synthetic Polynucleotide
taatacgactcactataggggctgtgcgcttctctccacggctctgggcaaacagaggagatgcccaatgccgtggagaaacctggcggcagcgcaaaagatg

SEQ ID NO: 209289 - DNA, 103 bp, Artificial Sequence
  Synthetic Polynucleotide
taatacgactcactatagggggcgttgtgggctgtgcgcttctctccacgaacagaggagacgtggaatgaagcgcacaaacctggcggcagcgcaaaagatg

SEQ ID NO: 209290 - DNA, 103 bp, Artificial Sequence
  Synthetic Polynucleotide
taatacgactcactataggggcttctcaatggcgttgtgggctgtgcgctaacagaggagaagcgcaatgcccacaacgaacctggcggcagcgcaaaagatg

SEQ ID NO: 209291 - DNA, 103 bp, Artificial Sequence
  Synthetic Polynucleotide
taatacgactcactataggggagcggtagcgcttctcaatggcgttgtggaacagaggagaccacaaatgcattgagaaaacctggcggcagcgcaaaagatg

SEQ ID NO: 209292 - DNA, 103 bp, Artificial Sequence
  Synthetic Polynucleotide
taatacgactcactatagggcagaccacccagctcgccgctgtcgtccataacagaggagaatggacatgagcggcgagaacctggcggcagcgcaaaagatg

SEQ ID NO: 209293 - DNA, 103 bp, Artificial Sequence
  Synthetic Polynucleotide
taatacgactcactatagggtcccacttgattactgacaaattgcagcataacagaggagaatgctgatgtttgtcagtaacctggcggcagcgcaaaagatg

SEQ ID NO: 209294 - DNA, 103 bp, Artificial Sequence
  Synthetic Polynucleotide
taatacgactcactatagggtttctcaatgatattatgggttgtccgcctaacagaggagaaggcggatgacccataataacctggcggcagcgcaaaagatg

SEQ ID NO: 209295 - DNA, 103 bp, Artificial Sequence
  Synthetic Polynucleotide
taatacgactcactatagggagcgatatcgtttctcaatgatattatgggaacagaggagacccataatgtcattgagaaacctggcggcagcgcaaaagatg

SEQ ID NO: 209296 - DNA, 103 bp, Artificial Sequence
  Synthetic Polynucleotide
taatacgactcactatagggttgatggaggagcgatatcgtttctcaatgaacagaggagacattgaatgacgatatcgaacctggcggcagcgcaaaagatg

SEQ ID NO: 209297 - DNA, 103 bp, Artificial Sequence
  Synthetic Polynucleotide
taatacgactcactataggggattttgtcattgatggaggagcgatatcgaacagaggagacgatatatgtcctccatcaacctggcggcagcgcaaaagatg

SEQ ID NO: 209298 - DNA, 103 bp, Artificial Sequence
  Synthetic Polynucleotide
taatacgactcactatagggtcaattcgatgattttgtcattgatggaggaacagaggagacctccaatgatgacaaaaaacctggcggcagcgcaaaagatg

SEQ ID NO: 209299 - DNA, 103 bp, Artificial Sequence
  Synthetic Polynucleotide
taatacgactcactatagggaccaggtctttcaattcgatgattttgtcaaacagaggagatgacaaatgcatcgaattaacctggcggcagcgcaaaagatg

SEQ ID NO: 209300 - DNA, 103 bp, Artificial Sequence
  Synthetic Polynucleotide
taatacgactcactatagggtgtccccatgaccaggtctttcaattcgataacagaggagaatcgaaatgaaagacctgaacctggcggcagcgcaaaagatg

SEQ ID NO: 209301 - DNA, 103 bp, Artificial Sequence
  Synthetic Polynucleotide
taatacgactcactatagggtcttggcgtctgtccccatgaccaggtcttaacagaggagaaagaccatgtcatggggaaacctggcggcagcgcaaaagatg

SEQ ID NO: 209302 - DNA, 103 bp, Artificial Sequence
  Synthetic Polynucleotide
taatacgactcactataggggacttgtgcatcttggcgtctgtccccatgaacagaggagacatgggatgagacgccaaaacctggcggcagcgcaaaagatg

SEQ ID NO: 209303 - DNA, 103 bp, Artificial Sequence
  Synthetic Polynucleotide
taatacgactcactatagggcagaacgccagacttgtgcatcttggcgtcaacagaggagagacgccatgatgcacaagaacctggcggcagcgcaaaagatg

SEQ ID NO: 209304 - DNA, 103 bp, Artificial Sequence
  Synthetic Polynucleotide
taatacgactcactatagggcagggaactctcccacttgattactgacaaaacagaggagattgtcaatgatcaagtggaacctggcggcagcgcaaaagatg

SEQ ID NO: 209305 - DNA, 103 bp, Artificial Sequence
  Synthetic Polynucleotide
taatacgactcactatagggtggccttcctcagaacgccagacttgtgcaaacagaggagatgcacaatgctggcgttcaacctggcggcagcgcaaaagatg

SEQ ID NO: 209306 - DNA, 103 bp, Artificial Sequence
  Synthetic Polynucleotide
taatacgactcactatagggatgtaatcaatggccttcctcagaacgccaaacagaggagatggcgtatggaggaaggcaacctggcggcagcgcaaaagatg

SEQ ID NO: 209307 - DNA, 103 bp, Artificial Sequence
  Synthetic Polynucleotide
taatacgactcactatagggcaagtatttgatgtaatcaatggccttcctaacagaggagaaggaagatgattgattacaacctggcggcagcgcaaaagatg

SEQ ID NO: 209308 - DNA, 103 bp, Artificial Sequence
  Synthetic Polynucleotide
taatacgactcactatagggtgacctgctgcaagtatttgatgtaatcaaaacagaggagattgattatgtcaaatactaacctggcggcagcgcaaaagatg

SEQ ID NO: 209309 - DNA, 103 bp, Artificial Sequence
  Synthetic Polynucleotide
taatacgactcactatagggagtttatgattgacctgctgcaagtatttgaacagaggagacaaataatggcagcaggtaacctggcggcagcgcaaaagatg

SEQ ID NO: 209310 - DNA, 103 bp, Artificial Sequence
  Synthetic Polynucleotide
taatacgactcactatagggctcctggcgcagtttatgattgacctgctgaacagaggagacagcagatgaatcataaaaacctggcggcagcgcaaaagatg

SEQ ID NO: 209311 - DNA, 103 bp, Artificial Sequence
  Synthetic Polynucleotide
taatacgactcactataggggcaccatgttctcctggcgcagtttatgataacagaggagaatcataatgtgcgccaggaacctggcggcagcgcaaaagatg

SEQ ID NO: 209312 - DNA, 103 bp, Artificial Sequence
  Synthetic Polynucleotide
taatacgactcactataggggccagcttcagcaccatgttctcctggcgcaacagaggagagcgccaatggaacatggtaacctggcggcagcgcaaaagatg

SEQ ID NO: 209313 - DNA, 103 bp, Artificial Sequence
  Synthetic Polynucleotide
taatacgactcactatagggcttttgatttgccagcttcagcaccatgttaacagaggagaaacatgatgctgaagctgaacctggcggcagcgcaaaagatg

SEQ ID NO: 209314 - DNA, 103 bp, Artificial Sequence
  Synthetic Polynucleotide
taatacgactcactataggggaagcttgttcttttgatttgccagcttcaaacagaggagatgaagcatgcaaatcaaaaacctggcggcagcgcaaaagatg

SEQ ID NO: 209315 - DNA, 103 bp, Artificial Sequence
  Synthetic Polynucleotide
taatacgactcactataggggaaaacaagtcagggaactctcccacttgaaacagaggagatcaagtatgagagttcccaacctggcggcagcgcaaaagatg

SEQ ID NO: 209316 - DNA, 103 bp, Artificial Sequence
  Synthetic Polynucleotide
taatacgactcactatagggatgccctttagaagcttgttcttttgatttaacagaggagaaaatcaatggaacaagctaacctggcggcagcgcaaaagatg

SEQ ID NO: 209317 - DNA, 103 bp, Artificial Sequence
  Synthetic Polynucleotide
taatacgactcactataggggcctaggtcgatgccctttagaagcttgttaacagaggagaaacaagatgctaaagggcaacctggcggcagcgcaaaagatg

SEQ ID NO: 209318 - DNA, 103 bp, Artificial Sequence
  Synthetic Polynucleotide
taatacgactcactatagggccaccagactgcctaggtcgatgccctttaaacagaggagataaaggatgtcgacctagaacctggcggcagcgcaaaagatg

SEQ ID NO: 209319 - DNA, 103 bp, Artificial Sequence
  Synthetic Polynucleotide
taatacgactcactatagggacctcattgtccaccagactgcctaggtcgaacagaggagacgacctatgcagtctggtaacctggcggcagcgcaaaagatg

SEQ ID NO: 209320 - DNA, 103 bp, Artificial Sequence
  Synthetic Polynucleotide
taatacgactcactatagggcttcaggtccacctcattgtccaccagactaacagaggagaagtctgatggacaatgagaacctggcggcagcgcaaaagatg

SEQ ID NO: 209321 - DNA, 103 bp, Artificial Sequence
  Synthetic Polynucleotide
taatacgactcactatagggagtcctcgatcttcaggtccacctcattgtaacagaggagaacaatgatgtggacctgaaacctggcggcagcgcaaaagatg

SEQ ID NO: 209322 - DNA, 103 bp, Artificial Sequence
  Synthetic Polynucleotide
taatacgactcactatagggttctgattaaagtcctcgatcttcaggtccaacagaggagaggacctatggatcgaggaaacctggcggcagcgcaaaagatg

SEQ ID NO: 209323 - DNA, 103 bp, Artificial Sequence
  Synthetic Polynucleotide
taatacgactcactatagggcagaaggacattctgattaaagtcctcgataacagaggagaatcgagatgtttaatcagaacctggcggcagcgcaaaagatg

SEQ ID NO: 209324 - DNA, 103 bp, Artificial Sequence
  Synthetic Polynucleotide
taatacgactcactatagggggggggacatcagaaggacattctgattaaaacagaggagattaatcatgatgtccttcaacctggcggcagcgcaaaagatg

SEQ ID NO: 209325 - DNA, 103 bp, Artificial Sequence
  Synthetic Polynucleotide
taatacgactcactatagggtcagaggctgggggggacatcagaaggacaaacagaggagatgtcctatggatgtccccaacctggcggcagcgcaaaagatg

SEQ ID NO: 209326 - DNA, 103 bp, Artificial Sequence
  Synthetic Polynucleotide
taatacgactcactatagggcagctgttctgaaaacaagtcagggaactcaacagaggagagagttcatggacttgtttaacctggcggcagcgcaaaagatg

SEQ ID NO: 209327 - DNA, 103 bp, Artificial Sequence
  Synthetic Polynucleotide
taatacgactcactatagggggaccctgagtcagaggctgggggggacataacagaggagaatgtccatgccagcctctaacctggcggcagcgcaaaagatg

SEQ ID NO: 209328 - DNA, 103 bp, Artificial Sequence
  Synthetic Polynucleotide
taatacgactcactatagggagccagcctgggaccctgagtcagaggctgaacagaggagacagcctatgactcagggtaacctggcggcagcgcaaaagatg

SEQ ID NO: 209329 - DNA, 103 bp, Artificial Sequence
  Synthetic Polynucleotide
taatacgactcactatagggtagggagagaagccagcctgggaccctgagaacagaggagactcaggatgccaggctggaacctggcggcagcgcaaaagatg

SEQ ID NO: 209330 - DNA, 103 bp, Artificial Sequence
  Synthetic Polynucleotide
taatacgactcactataggggtcaatggagtagggagagaagccagcctgaacagaggagacaggctatgttctctcccaacctggcggcagcgcaaaagatg

SEQ ID NO: 209331 - DNA, 103 bp, Artificial Sequence
  Synthetic Polynucleotide
taatacgactcactatagggctggctcagagtcaatggagtagggagagaaacagaggagatctctcatgactccattgaacctggcggcagcgcaaaagatg

SEQ ID NO: 209332 - DNA, 103 bp, Artificial Sequence
  Synthetic Polynucleotide
taatacgactcactatagggagagggcttcctggctcagagtcaatggagaacagaggagactccatatgctctgagccaacctggcggcagcgcaaaagatg

SEQ ID NO: 209333 - DNA, 103 bp, Artificial Sequence
  Synthetic Polynucleotide
taatacgactcactatagggatcatccaatagagggcttcctggctcagaaacagaggagatctgagatgggaagccctaacctggcggcagcgcaaaagatg

SEQ ID NO: 209334 - DNA, 103 bp, Artificial Sequence
  Synthetic Polynucleotide
taatacgactcactatagggtgacctttgcatcatccaatagagggcttcaacagaggagagaagccatgtattggatgaacctggcggcagcgcaaaagatg

SEQ ID NO: 209335 - DNA, 103 bp, Artificial Sequence
  Synthetic Polynucleotide
taatacgactcactatagggggctcatctttgacctttgcatcatccaataacagaggagaattggaatgtgcaaaggtaacctggcggcagcgcaaaagatg

SEQ ID NO: 209336 - DNA, 103 bp, Artificial Sequence
  Synthetic Polynucleotide
taatacgactcactatagggaggagagtctggctcatctttgacctttgcaacagaggagagcaaagatgaaagatgagaacctggcggcagcgcaaaagatg

SEQ ID NO: 209337 - DNA, 103 bp, Artificial Sequence
  Synthetic Polynucleotide
taatacgactcactatagggaggagctacacagctgttctgaaaacaagtaacagaggagaacttgtatgcagaacagcaacctggcggcagcgcaaaagatg

SEQ ID NO: 209338 - DNA, 103 bp, Artificial Sequence
  Synthetic Polynucleotide
taatacgactcactataggggcgccacaggaggagagtctggctcatcttaacagaggagaaagatgatgcagactctcaacctggcggcagcgcaaaagatg

SEQ ID NO: 209339 - DNA, 103 bp, Artificial Sequence
  Synthetic Polynucleotide
taatacgactcactatagggaccatgcccagcgccacaggaggagagtctaacagaggagaagactcatgtcctgtggcaacctggcggcagcgcaaaagatg

SEQ ID NO: 209340 - DNA, 103 bp, Artificial Sequence
  Synthetic Polynucleotide
taatacgactcactatagggtgagcggtctaccatgcccagcgccacaggaacagaggagacctgtgatgctgggcatgaacctggcggcagcgcaaaagatg

SEQ ID NO: 209341 - DNA, 103 bp, Artificial Sequence
  Synthetic Polynucleotide
taatacgactcactataggggaagaatccgtgagcggtctaccatgcccaaacagaggagatgggcaatgtagaccgctaacctggcggcagcgcaaaagatg

SEQ ID NO: 209342 - DNA, 103 bp, Artificial Sequence
  Synthetic Polynucleotide
taatacgactcactatagggaggacacacagaagaatccgtgagcggtctaacagaggagaagaccgatgacggattctaacctggcggcagcgcaaaagatg

SEQ ID NO: 209343 - DNA, 103 bp, Artificial Sequence
  Synthetic Polynucleotide
taatacgactcactatagggcaggaaggtgaggacacacagaagaatccgaacagaggagacggattatgctgtgtgtcaacctggcggcagcgcaaaagatg

SEQ ID NO: 209344 - DNA, 103 bp, Artificial Sequence
  Synthetic Polynucleotide
taatacgactcactatagggaggagaggcacaggaaggtgaggacacacaaacagaggagatgtgtgatgtcaccttccaacctggcggcagcgcaaaagatg

SEQ ID NO: 209345 - DNA, 103 bp, Artificial Sequence
  Synthetic Polynucleotide
taatacgactcactatagggagggggttaaaggagaggcacaggaaggtgaacagaggagacaccttatggtgcctctcaacctggcggcagcgcaaaagatg

SEQ ID NO: 209346 - DNA, 103 bp, Artificial Sequence
  Synthetic Polynucleotide
taatacgactcactatagggcagggaagtcagggggttaaaggagaggcaaacagaggagatgcctcatgtttaaccccaacctggcggcagcgcaaaagatg

SEQ ID NO: 209347 - DNA, 103 bp, Artificial Sequence
  Synthetic Polynucleotide
taatacgactcactatagggcccactgcagcagggaagtcagggggttaaaacagaggagattaaccatgtgacttcccaacctggcggcagcgcaaaagatg

SEQ ID NO: 209348 - DNA, 103 bp, Artificial Sequence
  Synthetic Polynucleotide
taatacgactcactatagggctgccaggaaaggagctacacagctgttctaacagaggagaagaacaatggtgtagctcaacctggcggcagcgcaaaagatg

SEQ ID NO: 209349 - DNA, 103 bp, Artificial Sequence
  Synthetic Polynucleotide
taatacgactcactatagggtgggcccctccccactgcagcagggaagtcaacagaggagagacttcatggctgcagtgaacctggcggcagcgcaaaagatg

SEQ ID NO: 209350 - DNA, 103 bp, Artificial Sequence
  Synthetic Polynucleotide
taatacgactcactataggggtcagagtcgtgggcccctccccactgcagaacagaggagactgcagatgggaggggccaacctggcggcagcgcaaaagatg

SEQ ID NO: 209351 - DNA, 103 bp, Artificial Sequence
  Synthetic Polynucleotide
taatacgactcactataggggtgggtgctggtcagagtcgtgggcccctcaacagaggagagaggggatgacgactctgaacctggcggcagcgcaaaagatg

SEQ ID NO: 209352 - DNA, 103 bp, Artificial Sequence
  Synthetic Polynucleotide
taatacgactcactataggggagcctgagtgtgggtgctggtcagagtcgaacagaggagacgactcatgccagcacccaacctggcggcagcgcaaaagatg

SEQ ID NO: 209353 - DNA, 103 bp, Artificial Sequence
  Synthetic Polynucleotide
taatacgactcactatagggactgcggccagagcctgagtgtgggtgctgaacagaggagacagcacatgcactcaggcaacctggcggcagcgcaaaagatg

SEQ ID NO: 209354 - DNA, 103 bp, Artificial Sequence
  Synthetic Polynucleotide
taatacgactcactatagggatgacaggacactgcggccagagcctgagtaacagaggagaactcagatgctggccgcaaacctggcggcagcgcaaaagatg

SEQ ID NO: 209355 - DNA, 103 bp, Artificial Sequence
  Synthetic Polynucleotide
taatacgactcactatagggcctgactcgaatgacaggacactgcggccaaacagaggagatggccgatgtgtcctgtcaacctggcggcagcgcaaaagatg

SEQ ID NO: 209356 - DNA, 103 bp, Artificial Sequence
  Synthetic Polynucleotide
taatacgactcactataggggcccccagaacctgactcgaatgacaggacaacagaggagagtcctgatgttcgagtcaaacctggcggcagcgcaaaagatg

SEQ ID NO: 209357 - DNA, 103 bp, Artificial Sequence
  Synthetic Polynucleotide
taatacgactcactatagggagtcaaaccagcccccagaacctgactcgaaacagaggagatcgagtatggttctggggaacctggcggcagcgcaaaagatg

SEQ ID NO: 209358 - DNA, 103 bp, Artificial Sequence
  Synthetic Polynucleotide
taatacgactcactatagggggcatcatccagtcaaaccagcccccagaaaacagaggagattctggatgctggtttgaaacctggcggcagcgcaaaagatg

SEQ ID NO: 209359 - DNA, 103 bp, Artificial Sequence
  Synthetic Polynucleotide
taatacgactcactatagggactaccaccactgccaggaaaggagctacaaacagaggagatgtagcatgtttcctggcaacctggcggcagcgcaaaagatg

SEQ ID NO: 209360 - DNA, 103 bp, Artificial Sequence
  Synthetic Polynucleotide
taatacgactcactataggggagaagagtaggcatcatccagtcaaaccaaacagaggagatggtttatgtggatgatgaacctggcggcagcgcaaaagatg

SEQ ID NO: 209361 - DNA, 103 bp, Artificial Sequence
  Synthetic Polynucleotide
taatacgactcactatagggccagccataagagaagagtaggcatcatccaacagaggagaggatgaatgctactcttcaacctggcggcagcgcaaaagatg

SEQ ID NO: 209362 - DNA, 103 bp, Artificial Sequence
  Synthetic Polynucleotide
taatacgactcactatagggacaccatttaccagccataagagaagagtaaacagaggagatactctatgcttatggctaacctggcggcagcgcaaaagatg

SEQ ID NO: 209363 - DNA, 103 bp, Artificial Sequence
  Synthetic Polynucleotide
taatacgactcactatagggcaggacaatcacaccatttaccagccataaaacagaggagattatggatggtaaatggtaacctggcggcagcgcaaaagatg

SEQ ID NO: 209364 - DNA, 103 bp, Artificial Sequence
  Synthetic Polynucleotide
taatacgactcactatagggcaaagacgctcaggacaatcacaccatttaaacagaggagataaatgatgtgattgtccaacctggcggcagcgcaaaagatg

SEQ ID NO: 209365 - DNA, 103 bp, Artificial Sequence
  Synthetic Polynucleotide
taatacgactcactatagggagcagcttcacaaagacgctcaggacaatcaacagaggagagattgtatggagcgtcttaacctggcggcagcgcaaaagatg

SEQ ID NO: 209366 - DNA, 103 bp, Artificial Sequence
  Synthetic Polynucleotide
taatacgactcactatagggcccatgaaccagcagcttcacaaagacgctaacagaggagaagcgtcatggtgaagctgaacctggcggcagcgcaaaagatg

SEQ ID NO: 209367 - DNA, 103 bp, Artificial Sequence
  Synthetic Polynucleotide
taatacgactcactatagggtcactggctccccatgaaccagcagcttcaaacagaggagatgaagcatgtggttcatgaacctggcggcagcgcaaaagatg

SEQ ID NO: 209368 - DNA, 103 bp, Artificial Sequence
  Synthetic Polynucleotide
taatacgactcactatagggtgtggccggatcactggctccccatgaaccaacagaggagaggttcaatgggagccagtaacctggcggcagcgcaaaagatg

SEQ ID NO: 209369 - DNA, 103 bp, Artificial Sequence
  Synthetic Polynucleotide
taatacgactcactatagggggagcgcgagtgtggccggatcactggctcaacagaggagagagccaatgatccggccaaacctggcggcagcgcaaaagatg

SEQ ID NO: 209370 - DNA, 103 bp, Artificial Sequence
  Synthetic Polynucleotide
taatacgactcactatagggtgctgctaccactaccaccactgccaggaaaacagaggagattcctgatggtggtggtaaacctggcggcagcgcaaaagatg

SEQ ID NO: 209371 - DNA, 103 bp, Artificial Sequence
  Synthetic Polynucleotide
taatacgactcactatagggaggtgaccgaggagcgcgagtgtggccggaaacagaggagatccggcatgactcgcgctaacctggcggcagcgcaaaagatg

SEQ ID NO: 209372 - DNA, 103 bp, Artificial Sequence
  Synthetic Polynucleotide
taatacgactcactatagggtgcctccagaaggtgaccgaggagcgcgagaacagaggagactcgcgatgctcggtcacaacctggcggcagcgcaaaagatg

SEQ ID NO: 209373 - DNA, 103 bp, Artificial Sequence
  Synthetic Polynucleotide
taatacgactcactatagggctgtttccggtgcctccagaaggtgaccgaaacagaggagatcggtcatgttctggaggaacctggcggcagcgcaaaagatg

SEQ ID NO: 209374 - DNA, 103 bp, Artificial Sequence
  Synthetic Polynucleotide
taatacgactcactatagggccagatctgcctgtttccggtgcctccagaaacagaggagatctggaatgaccggaaacaacctggcggcagcgcaaaagatg

SEQ ID NO: 209375 - DNA, 103 bp, Artificial Sequence
  Synthetic Polynucleotide
taatacgactcactatagggctggcgagatccagatctgcctgtttccggaacagaggagaccggaaatgggcagatctaacctggcggcagcgcaaaagatg

SEQ ID NO: 209376 - DNA, 103 bp, Artificial Sequence
  Synthetic Polynucleotide
taatacgactcactatagggaaaatctcctctggcgagatccagatctgcaacagaggagagcagatatggatctcgccaacctggcggcagcgcaaaagatg

SEQ ID NO: 209377 - DNA, 103 bp, Artificial Sequence
  Synthetic Polynucleotide
taatacgactcactatagggcagcagctgcaaaatctcctctggcgagataacagaggagaatctcgatggaggagattaacctggcggcagcgcaaaagatg

SEQ ID NO: 209378 - DNA, 103 bp, Artificial Sequence
  Synthetic Polynucleotide
taatacgactcactatagggaggttgccggcagcagctgcaaaatctcctaacagaggagaaggagaatgtgcagctgcaacctggcggcagcgcaaaagatg

SEQ ID NO: 209379 - DNA, 103 bp, Artificial Sequence
  Synthetic Polynucleotide
taatacgactcactataggggcaggtttgtaggttgccggcagcagctgcaacagaggagagcagctatggccggcaacaacctggcggcagcgcaaaagatg

SEQ ID NO: 209380 - DNA, 103 bp, Artificial Sequence
  Synthetic Polynucleotide
taatacgactcactatagggaaactgccaggcaggtttgtaggttgccggaacagaggagaccggcaatgtacaaacctaacctggcggcagcgcaaaagatg

SEQ ID NO: 209381 - DNA, 103 bp, Artificial Sequence
  Synthetic Polynucleotide
taatacgactcactatagggctgctgccgctgctgctaccactaccaccaaacagaggagatggtggatgtggtagcagaacctggcggcagcgcaaaagatg

SEQ ID NO: 209382 - DNA, 103 bp, Artificial Sequence
  Synthetic Polynucleotide
taatacgactcactataggggcccggcccaaaactgccaggcaggtttgtaacagaggagaacaaacatgcctggcagtaacctggcggcagcgcaaaagatg

SEQ ID NO: 209383 - DNA, 103 bp, Artificial Sequence
  Synthetic Polynucleotide
taatacgactcactatagggggtgggcagtgcccggcccaaaactgccagaacagaggagactggcaatgttgggccggaacctggcggcagcgcaaaagatg

SEQ ID NO: 209384 - DNA, 103 bp, Artificial Sequence
  Synthetic Polynucleotide
taatacgactcactatagggccaggcgggaggtgggcagtgcccggcccaaacagaggagatgggccatgcactgcccaaacctggcggcagcgcaaaagatg

SEQ ID NO: 209385 - DNA, 103 bp, Artificial Sequence
  Synthetic Polynucleotide
taatacgactcactatagggcaggccaggtccaggcgggaggtgggcagtaacagaggagaactgccatgctcccgcctaacctggcggcagcgcaaaagatg

SEQ ID NO: 209386 - DNA, 103 bp, Artificial Sequence
  Synthetic Polynucleotide
taatacgactcactatagggggagaggctgcaggccaggtccaggcgggaaacagaggagatcccgcatggacctggccaacctggcggcagcgcaaaagatg

SEQ ID NO: 209387 - DNA, 103 bp, Artificial Sequence
  Synthetic Polynucleotide
taatacgactcactatagggtcacgttccaggagaggctgcaggccaggtaacagaggagaacctggatggcagcctctaacctggcggcagcgcaaaagatg

SEQ ID NO: 209388 - DNA, 103 bp, Artificial Sequence
  Synthetic Polynucleotide
taatacgactcactatagggctgtagcggatcacgttccaggagaggctgaacagaggagacagcctatgctggaacgtaacctggcggcagcgcaaaagatg

SEQ ID NO: 209389 - DNA, 103 bp, Artificial Sequence
  Synthetic Polynucleotide
taatacgactcactatagggcttctgcaggctgtagcggatcacgttccaaacagaggagatggaacatgatccgctacaacctggcggcagcgcaaaagatg

SEQ ID NO: 209390 - DNA, 103 bp, Artificial Sequence
  Synthetic Polynucleotide
taatacgactcactatagggccaggcgtagcttctgcaggctgtagcggaaacagaggagatccgctatggcctgcagaaacctggcggcagcgcaaaagatg

SEQ ID NO: 209391 - DNA, 103 bp, Artificial Sequence
  Synthetic Polynucleotide
taatacgactcactatagggagccagcgcaccaggcgtagcttctgcaggaacagaggagacctgcaatggctacgcctaacctggcggcagcgcaaaagatg

SEQ ID NO: 209392 - DNA, 103 bp, Artificial Sequence
  Synthetic Polynucleotide
taatacgactcactataggggctgctgccactgctgccgctgctgctaccaacagaggagaggtagcatgagcggcagcaacctggcggcagcgcaaaagatg

SEQ ID NO: 209393 - DNA, 103 bp, Artificial Sequence
  Synthetic Polynucleotide
taatacgactcactatagggtttcttgagcagccagcgcaccaggcgtagaacagaggagactacgcatggtgcgctggaacctggcggcagcgcaaaagatg

SEQ ID NO: 209394 - DNA, 103 bp, Artificial Sequence
  Synthetic Polynucleotide
taatacgactcactatagggactggaagactttcttgagcagccagcgcaaacagaggagatgcgctatgtgctcaagaaacctggcggcagcgcaaaagatg

SEQ ID NO: 209395 - DNA, 103 bp, Artificial Sequence
  Synthetic Polynucleotide
taatacgactcactataggggcccgccggcactggaagactttcttgagcaacagaggagagctcaaatgagtcttccaaacctggcggcagcgcaaaagatg

SEQ ID NO: 209396 - DNA, 103 bp, Artificial Sequence
  Synthetic Polynucleotide
taatacgactcactatagggggctggcgtggcccgccggcactggaagacaacagaggagagtcttcatgtgccggcggaacctggcggcagcgcaaaagatg

SEQ ID NO: 209397 - DNA, 103 bp, Artificial Sequence
  Synthetic Polynucleotide
taatacgactcactatagggctgcctcagtggctggcgtggcccgccggcaacagaggagagccggcatgccacgccagaacctggcggcagcgcaaaagatg

SEQ ID NO: 209398 - DNA, 103 bp, Artificial Sequence
  Synthetic Polynucleotide
taatacgactcactatagggtcttcaaagcctgcctcagtggctggcgtgaacagaggagacacgccatgcactgaggcaacctggcggcagcgcaaaagatg

SEQ ID NO: 209399 - DNA, 103 bp, Artificial Sequence
  Synthetic Polynucleotide
taatacgactcactatagggcttagcttcgtcttcaaagcctgcctcagtaacagaggagaactgagatgggctttgaaaacctggcggcagcgcaaaagatg

SEQ ID NO: 209400 - DNA, 103 bp, Artificial Sequence
  Synthetic Polynucleotide
taatacgactcactataggggggcgctggtcttagcttcgtcttcaaagcaacagaggagagctttgatgacgaagctaaacctggcggcagcgcaaaagatg

SEQ ID NO: 209401 - DNA, 103 bp, Artificial Sequence
  Synthetic Polynucleotide
taatacgactcactataggggccgcatcccgggcgctggtcttagcttcgaacagaggagacgaagcatggaccagcgcaacctggcggcagcgcaaaagatg

SEQ ID NO: 209402 - DNA, 103 bp, Artificial Sequence
  Synthetic Polynucleotide
taatacgactcactatagggataggccagagccgcatcccgggcgctggtaacagaggagaaccagcatgcgggatgcgaacctggcggcagcgcaaaagatg

SEQ ID NO: 209403 - DNA, 103 bp, Artificial Sequence
  Synthetic Polynucleotide
taatacgactcactatagggccatggtctccagaccacccagctcgccgcaacagaggagagcggcgatgtgggtggtcaacctggcggcagcgcaaaagatg

SEQ ID NO: 209404 - DNA, 103 bp, Artificial Sequence
  Synthetic Polynucleotide
taatacgactcactatagggtgctgctgctgctgctgccactgctgccgcaacagaggagagcggcaatggtggcagcaaacctggcggcagcgcaaaagatg

SEQ ID NO: 209405 - DNA, 103 bp, Artificial Sequence
  Synthetic Polynucleotide
taatacgactcactataggggcagccggtgataggccagagccgcatcccaacagaggagagggatgatgctctggcctaacctggcggcagcgcaaaagatg

SEQ ID NO: 209406 - DNA, 103 bp, Artificial Sequence
  Synthetic Polynucleotide
taatacgactcactatagggtgcagctggtgcagccggtgataggccagaaacagaggagatctggcatgtcaccggctaacctggcggcagcgcaaaagatg

SEQ ID NO: 209407 - DNA, 103 bp, Artificial Sequence
  Synthetic Polynucleotide
taatacgactcactatagggccctgtgatgtgcagctggtgcagccggtgaacagaggagacaccggatgcaccagctgaacctggcggcagcgcaaaagatg

SEQ ID NO: 209408 - DNA, 103 bp, Artificial Sequence
  Synthetic Polynucleotide
taatacgactcactatagggcaggaagcttccctgtgatgtgcagctggtaacagaggagaaccagcatgacatcacagaacctggcggcagcgcaaaagatg

SEQ ID NO: 209409 - DNA, 103 bp, Artificial Sequence
  Synthetic Polynucleotide
taatacgactcactataggggcggatcctgcaggaagcttccctgtgatgaacagaggagacatcacatggaagcttccaacctggcggcagcgcaaaagatg

SEQ ID NO: 209410 - DNA, 103 bp, Artificial Sequence
  Synthetic Polynucleotide
taatacgactcactatagggatcggaacaggcggatcctgcaggaagcttaacagaggagaaagcttatggcaggatccaacctggcggcagcgcaaaagatg

SEQ ID NO: 209411 - DNA, 103 bp, Artificial Sequence
  Synthetic Polynucleotide
taatacgactcactatagggccatgtgtacatcggaacaggcggatcctgaacagaggagacaggatatgcctgttccgaacctggcggcagcgcaaaagatg

SEQ ID NO: 209412 - DNA, 103 bp, Artificial Sequence
  Synthetic Polynucleotide
taatacgactcactataggggcacacaacgccatgtgtacatcggaacagaacagaggagactgttcatgtgtacacataacctggcggcagcgcaaaagatg

SEQ ID NO: 209413 - DNA, 103 bp, Artificial Sequence
  Synthetic Polynucleotide
taatacgactcactatagggcaggttcacggcacacaacgccatgtgtacaacagaggagagtacacatggcgttgtgtaacctggcggcagcgcaaaagatg

SEQ ID NO: 209414 - DNA, 103 bp, Artificial Sequence
  Synthetic Polynucleotide
taatacgactcactatagggcacattcagccaggttcacggcacacaacgaacagaggagacgttgtatgccgtgaaccaacctggcggcagcgcaaaagatg

SEQ ID NO: 209415 - DNA, 103 bp, Artificial Sequence
  Synthetic Polynucleotide
taatacgactcactatagggctgccattgctgctgctgctgctgctgccaaacagaggagatggcagatgcagcagcagaacctggcggcagcgcaaaagatg

SEQ ID NO: 209416 - DNA, 103 bp, Artificial Sequence
  Synthetic Polynucleotide
taatacgactcactatagggttctcctctgcacattcagccaggttcacgaacagaggagacgtgaaatgggctgaatgaacctggcggcagcgcaaaagatg

SEQ ID NO: 209417 - DNA, 103 bp, Artificial Sequence
  Synthetic Polynucleotide
taatacgactcactatagggcggtgggatcttctcctctgcacattcagcaacagaggagagctgaaatggcagaggagaacctggcggcagcgcaaaagatg

SEQ ID NO: 209418 - DNA, 103 bp, Artificial Sequence
  Synthetic Polynucleotide
taatacgactcactatagggccagtgtgctcggtgggatcttctcctctgaacagaggagacagaggatgagatcccacaacctggcggcagcgcaaaagatg

SEQ ID NO: 209419 - DNA, 103 bp, Artificial Sequence
  Synthetic Polynucleotide
taatacgactcactatagggtggatctcaaccagtgtgctcggtgggatcaacagaggagagatcccatggagcacactaacctggcggcagcgcaaaagatg

SEQ ID NO: 209420 - DNA, 103 bp, Artificial Sequence
  Synthetic Polynucleotide
taatacgactcactatagggagcagtcagatggatctcaaccagtgtgctaacagaggagaagcacaatggttgagatcaacctggcggcagcgcaaaagatg

SEQ ID NO: 209421 - DNA, 103 bp, Artificial Sequence
  Synthetic Polynucleotide
taatacgactcactataggggccccatggcagcagtcagatggatctcaaaacagaggagattgagaatgatctgactgaacctggcggcagcgcaaaagatg

SEQ ID NO: 209422 - DNA, 103 bp, Artificial Sequence
  Synthetic Polynucleotide
taatacgactcactatagggcgggtcttgagccccatggcagcagtcagaaacagaggagatctgacatgtgccatgggaacctggcggcagcgcaaaagatg

SEQ ID NO: 209423 - DNA, 103 bp, Artificial Sequence
  Synthetic Polynucleotide
taatacgactcactataggggcctccacaccgggtcttgagccccatggcaacagaggagagccatgatgctcaagaccaacctggcggcagcgcaaaagatg

SEQ ID NO: 209424 - DNA, 103 bp, Artificial Sequence
  Synthetic Polynucleotide
taatacgactcactatagggagcccagcttgcctccacaccgggtcttgaaacagaggagatcaagaatgggtgtggagaacctggcggcagcgcaaaagatg

SEQ ID NO: 209425 - DNA, 103 bp, Artificial Sequence
  Synthetic Polynucleotide
taatacgactcactatagggctggccaggaagcccagcttgcctccacacaacagaggagagtgtggatgcaagctgggaacctggcggcagcgcaaaagatg

SEQ ID NO: 209426 - DNA, 103 bp, Artificial Sequence
  Synthetic Polynucleotide
taatacgactcactataggggctgctgcccctgccattgctgctgctgctaacagaggagaagcagcatgagcaatggcaacctggcggcagcgcaaaagatg

SEQ ID NO: 209427 - DNA, 103 bp, Artificial Sequence
  Synthetic Polynucleotide
taatacgactcactataggggaggaagtagctggccaggaagcccagcttaacagaggagaaagctgatgttcctggccaacctggcggcagcgcaaaagatg

SEQ ID NO: 209428 - DNA, 103 bp, Artificial Sequence
  Synthetic Polynucleotide
taatacgactcactataggggggctcggctgaggaagtagctggccaggaaacagaggagatcctggatggctacttccaacctggcggcagcgcaaaagatg

SEQ ID NO: 209429 - DNA, 103 bp, Artificial Sequence
  Synthetic Polynucleotide
taatacgactcactatagggcacaggctctgggctcggctgaggaagtagaacagaggagactacttatgcagccgagcaacctggcggcagcgcaaaagatg

SEQ ID NO: 209430 - DNA, 103 bp, Artificial Sequence
  Synthetic Polynucleotide
taatacgactcactatagggctcggggccacacaggctctgggctcggctaacagaggagaagccgaatgcagagcctgaacctggcggcagcgcaaaagatg

SEQ ID NO: 209431 - DNA, 103 bp, Artificial Sequence
  Synthetic Polynucleotide
taatacgactcactatagggcagcactgtgctcggggccacacaggctctaacagaggagaagagccatggtggccccgaacctggcggcagcgcaaaagatg

SEQ ID NO: 209432 - DNA, 103 bp, Artificial Sequence
  Synthetic Polynucleotide
taatacgactcactataggggagtcaggaacagcactgtgctcggggccaaacagaggagatggcccatggcacagtgcaacctggcggcagcgcaaaagatg

SEQ ID NO: 209433 - DNA, 103 bp, Artificial Sequence
  Synthetic Polynucleotide
taatacgactcactatagggccagcgcagggagtcaggaacagcactgtgaacagaggagacacagtatggttcctgacaacctggcggcagcgcaaaagatg

SEQ ID NO: 209434 - DNA, 103 bp, Artificial Sequence
  Synthetic Polynucleotide
taatacgactcactatagggggtggcagagccagcgcagggagtcaggaaaacagaggagattcctgatgccctgcgctaacctggcggcagcgcaaaagatg

SEQ ID NO: 209435 - DNA, 103 bp, Artificial Sequence
  Synthetic Polynucleotide
taatacgactcactatagggtggcccagggggtggcagagccagcgcaggaacagaggagacctgcgatggctctgccaaacctggcggcagcgcaaaagatg

SEQ ID NO: 209436 - DNA, 103 bp, Artificial Sequence
  Synthetic Polynucleotide
taatacgactcactataggggaaaaacttctggcccagggggtggcagagaacagaggagactctgcatgcccctgggcaacctggcggcagcgcaaaagatg

SEQ ID NO: 209437 - DNA, 103 bp, Artificial Sequence
  Synthetic Polynucleotide
taatacgactcactatagggcagctccgctgctgctgcccctgccattgcaacagaggagagcaatgatgggggcagcaaacctggcggcagcgcaaaagatg

SEQ ID NO: 209438 - DNA, 103 bp, Artificial Sequence
  Synthetic Polynucleotide
taatacgactcactatagggtccgctccatgaaaaacttctggcccagggaacagaggagaccctggatgagaagttttaacctggcggcagcgcaaaagatg

SEQ ID NO: 209439 - DNA, 103 bp, Artificial Sequence
  Synthetic Polynucleotide
taatacgactcactatagggacagaccagctccgctccatgaaaaacttcaacagaggagagaagttatgcatggagcgaacctggcggcagcgcaaaagatg

SEQ ID NO: 209440 - DNA, 103 bp, Artificial Sequence
  Synthetic Polynucleotide
taatacgactcactatagggagctgacttcacagaccagctccgctccataacagaggagaatggagatgagctggtctaacctggcggcagcgcaaaagatg

SEQ ID NO: 209441 - DNA, 103 bp, Artificial Sequence
  Synthetic Polynucleotide
taatacgactcactatagggtctccttggcagctgacttcacagaccagcaacagaggagagctggtatgtgaagtcagaacctggcggcagcgcaaaagatg

SEQ ID NO: 209442 - DNA, 103 bp, Artificial Sequence
  Synthetic Polynucleotide
taatacgactcactatagggcagtatagactctccttggcagctgacttcaacagaggagagaagtcatgtgccaaggaaacctggcggcagcgcaaaagatg

SEQ ID NO: 209443 - DNA, 103 bp, Artificial Sequence
  Synthetic Polynucleotide
taatacgactcactatagggcctctgggcacagtatagactctccttggcaacagaggagagccaagatgagtctatacaacctggcggcagcgcaaaagatg

SEQ ID NO: 209444 - DNA, 103 bp, Artificial Sequence
  Synthetic Polynucleotide
taatacgactcactatagggcagctgggttcctctgggcacagtatagacaacagaggagagtctatatggtgcccagaaacctggcggcagcgcaaaagatg

SEQ ID NO: 209445 - DNA, 103 bp, Artificial Sequence
  Synthetic Polynucleotide
taatacgactcactataggggcaatggggtcagctgggttcctctgggcaaacagaggagatgcccaatggaacccagcaacctggcggcagcgcaaaagatg

SEQ ID NO: 209446 - DNA, 103 bp, Artificial Sequence
  Synthetic Polynucleotide
taatacgactcactataggggtggacctgcgcaatggggtcagctgggttaacagaggagaaacccaatggaccccattaacctggcggcagcgcaaaagatg

SEQ ID NO: 209447 - DNA, 103 bp, Artificial Sequence
  Synthetic Polynucleotide
taatacgactcactatagggagaaggcctggtggacctgcgcaatggggtaacagaggagaaccccaatgcgcaggtccaacctggcggcagcgcaaaagatg

SEQ ID NO: 209448 - DNA, 103 bp, Artificial Sequence
  Synthetic Polynucleotide
taatacgactcactataggggaagggtccacagctccgctgctgctgcccaacagaggagagggcagatgcagcggagcaacctggcggcagcgcaaaagatg

SEQ ID NO: 209449 - DNA, 103 bp, Artificial Sequence
  Synthetic Polynucleotide
taatacgactcactatagggaggttcttgcagaaggcctggtggacctgcaacagaggagagcaggtatgccaggccttaacctggcggcagcgcaaaagatg

SEQ ID NO: 209450 - DNA, 103 bp, Artificial Sequence
  Synthetic Polynucleotide
taatacgactcactatagggtcgctccagcaggttcttgcagaaggcctgaacagaggagacaggccatgtgcaagaacaacctggcggcagcgcaaaagatg

SEQ ID NO: 209451 - DNA, 103 bp, Artificial Sequence
  Synthetic Polynucleotide
taatacgactcactatagggactctatagctcgctccagcaggttcttgcaacagaggagagcaagaatgtgctggagcaacctggcggcagcgcaaaagatg

SEQ ID NO: 209452 - DNA, 103 bp, Artificial Sequence
  Synthetic Polynucleotide
taatacgactcactatagggttcaccaaggactctatagctcgctccagcaacagaggagagctggaatgagctatagaaacctggcggcagcgcaaaagatg

SEQ ID NO: 209453 - DNA, 103 bp, Artificial Sequence
  Synthetic Polynucleotide
taatacgactcactatagggggcctgaggtttcaccaaggactctatagcaacagaggagagctataatgtccttggtgaacctggcggcagcgcaaaagatg

SEQ ID NO: 209454 - DNA, 103 bp, Artificial Sequence
  Synthetic Polynucleotide
taatacgactcactatagggccttcttcttggcctgaggtttcaccaaggaacagaggagaccttggatgaacctcaggaacctggcggcagcgcaaaagatg

SEQ ID NO: 209455 - DNA, 103 bp, Artificial Sequence
  Synthetic Polynucleotide
taatacgactcactatagggtggtctccagccttcttcttggcctgaggtaacagaggagaacctcaatgcaagaagaaaacctggcggcagcgcaaaagatg

SEQ ID NO: 209456 - DNA, 103 bp, Artificial Sequence
  Synthetic Polynucleotide
taatacgactcactatagggctcttcttcctggtctccagccttcttcttaacagaggagaaagaagatggctggagacaacctggcggcagcgcaaaagatg

SEQ ID NO: 209457 - DNA, 103 bp, Artificial Sequence
  Synthetic Polynucleotide
taatacgactcactatagggattcacagctctcttcttcctggtctccagaacagaggagactggagatgaggaagaagaacctggcggcagcgcaaaagatg

SEQ ID NO: 209458 - DNA, 103 bp, Artificial Sequence
  Synthetic Polynucleotide
taatacgactcactataggggcactggagaattcacagctctcttcttccaacagaggagaggaagaatggagctgtgaaacctggcggcagcgcaaaagatg

SEQ ID NO: 209459 - DNA, 103 bp, Artificial Sequence
  Synthetic Polynucleotide
taatacgactcactatagggccgttgcactgaagggtccacagctccgctaacagaggagaagcggaatggtggaccctaacctggcggcagcgcaaaagatg

SEQ ID NO: 209460 - DNA, 103 bp, Artificial Sequence
  Synthetic Polynucleotide
taatacgactcactataggggtactccagagcactggagaattcacagctaacagaggagaagctgtatgttctccagtaacctggcggcagcgcaaaagatg

SEQ ID NO: 209461 - DNA, 103 bp, Artificial Sequence
  Synthetic Polynucleotide
taatacgactcactataggggtaatttcaagtactccagagcactggagaaacagaggagatctccaatgctctggagtaacctggcggcagcgcaaaagatg

SEQ ID NO: 209462 - DNA, 103 bp, Artificial Sequence
  Synthetic Polynucleotide
taatacgactcactatagggaaagaatgaagtaatttcaagtactccagaaacagaggagatctggaatgcttgaaattaacctggcggcagcgcaaaagatg

SEQ ID NO: 209463 - DNA, 103 bp, Artificial Sequence
  Synthetic Polynucleotide
taatacgactcactatagggagagtccacaaaagaatgaagtaatttcaaaacagaggagattgaaaatgcttcattctaacctggcggcagcgcaaaagatg

SEQ ID NO: 209464 - DNA, 103 bp, Artificial Sequence
  Synthetic Polynucleotide
taatacgactcactatagggtaacccccacagagtccacaaaagaatgaaaacagaggagattcattatgttgtggactaacctggcggcagcgcaaaagatg

SEQ ID NO: 209465 - DNA, 103 bp, Artificial Sequence
  Synthetic Polynucleotide
taatacgactcactatagggggggggctcataacccccacagagtccacaaacagaggagatgtggaatgtgtgggggtaacctggcggcagcgcaaaagatg

SEQ ID NO: 209466 - DNA, 103 bp, Artificial Sequence
  Synthetic Polynucleotide
taatacgactcactatagggcctggagagtggggggctcataacccccacaacagaggagagtggggatgatgagccccaacctggcggcagcgcaaaagatg

SEQ ID NO: 209467 - DNA, 103 bp, Artificial Sequence
  Synthetic Polynucleotide
taatacgactcactataggggcacggagctcctggagagtggggggctcaaacagaggagatgagccatgcactctccaaacctggcggcagcgcaaaagatg

SEQ ID NO: 209468 - DNA, 103 bp, Artificial Sequence
  Synthetic Polynucleotide
taatacgactcactataggggcggacttgagcacggagctcctggagagtaacagaggagaactctcatggagctccgtaacctggcggcagcgcaaaagatg

SEQ ID NO: 209469 - DNA, 103 bp, Artificial Sequence
  Synthetic Polynucleotide
taatacgactcactatagggtggacccagggcggacttgagcacggagctaacagaggagaagctccatgctcaagtccaacctggcggcagcgcaaaagatg

SEQ ID NO: 209470 - DNA, 103 bp, Artificial Sequence
  Synthetic Polynucleotide
taatacgactcactataggggggtgaatgaccgttgcactgaagggtccaaacagaggagatggaccatgcagtgcaacaacctggcggcagcgcaaaagatg

SEQ ID NO: 209471 - DNA, 103 bp, Artificial Sequence
  Synthetic Polynucleotide
taatacgactcactatagggagatgatgtctggacccagggcggacttgaaacagaggagatcaagtatgccctgggtcaacctggcggcagcgcaaaagatg

SEQ ID NO: 209472 - DNA, 103 bp, Artificial Sequence
  Synthetic Polynucleotide
taatacgactcactatagggcaccaccgacagatgatgtctggacccaggaacagaggagacctgggatgagacatcataacctggcggcagcgcaaaagatg

SEQ ID NO: 209473 - DNA, 103 bp, Artificial Sequence
  Synthetic Polynucleotide
taatacgactcactatagggtgcagacgtccaccaccgacagatgatgtcaacagaggagagacatcatgtgtcggtggaacctggcggcagcgcaaaagatg

SEQ ID NO: 209474 - DNA, 103 bp, Artificial Sequence
  Synthetic Polynucleotide
taatacgactcactatagggccacagtgattgcagacgtccaccaccgacaacagaggagagtcggtatgggacgtctgaacctggcggcagcgcaaaagatg

SEQ ID NO: 209475 - DNA, 103 bp, Artificial Sequence
  Synthetic Polynucleotide
taatacgactcactatagggcagctgatggccacagtgattgcagacgtcaacagaggagagacgtcatgaatcactgtaacctggcggcagcgcaaaagatg

SEQ ID NO: 209476 - DNA, 103 bp, Artificial Sequence
  Synthetic Polynucleotide
taatacgactcactatagggtccctggagccagctgatggccacagtgataacagaggagaatcactatggccatcagcaacctggcggcagcgcaaaagatg

SEQ ID NO: 209477 - DNA, 103 bp, Artificial Sequence
  Synthetic Polynucleotide
taatacgactcactatagggctgcatcgtctccctggagccagctgatggaacagaggagaccatcaatgggctccaggaacctggcggcagcgcaaaagatg

SEQ ID NO: 209478 - DNA, 103 bp, Artificial Sequence
  Synthetic Polynucleotide
taatacgactcactataggggagcgcacagctgcatcgtctccctggagcaacagaggagagctccaatgagacgatgcaacctggcggcagcgcaaaagatg

SEQ ID NO: 209479 - DNA, 103 bp, Artificial Sequence
  Synthetic Polynucleotide
taatacgactcactatagggggtaaaatgagagcgcacagctgcatcgtcaacagaggagagacgatatggctgtgcgcaacctggcggcagcgcaaaagatg

SEQ ID NO: 209480 - DNA, 103 bp, Artificial Sequence
  Synthetic Polynucleotide
taatacgactcactataggggttccactttggtaaaatgagagcgcacagaacagaggagactgtgcatgctcattttaaacctggcggcagcgcaaaagatg

SEQ ID NO: 209481 - DNA, 103 bp, Artificial Sequence
  Synthetic Polynucleotide
taatacgactcactatagggaatgtgacctgggtgaatgaccgttgcactaacagaggagaagtgcaatggtcattcacaacctggcggcagcgcaaaagatg

SEQ ID NO: 209482 - DNA, 103 bp, Artificial Sequence
  Synthetic Polynucleotide
taatacgactcactatagggttggggatgcgttccactttggtaaaatgaaacagaggagatcatttatgcaaagtggaaacctggcggcagcgcaaaagatg

SEQ ID NO: 209483 - DNA, 103 bp, Artificial Sequence
  Synthetic Polynucleotide
taatacgactcactatagggttccagggccttggggatgcgttccactttaacagaggagaaaagtgatgcgcatccccaacctggcggcagcgcaaaagatg

SEQ ID NO: 209484 - DNA, 103 bp, Artificial Sequence
  Synthetic Polynucleotide
taatacgactcactatagggtctctgtcacttccagggccttggggatgcaacagaggagagcatccatgaggccctggaacctggcggcagcgcaaaagatg

SEQ ID NO: 209485 - DNA, 103 bp, Artificial Sequence
  Synthetic Polynucleotide
taatacgactcactatagggaccagggggctctctgtcacttccagggccaacagaggagaggccctatgagtgacagaaacctggcggcagcgcaaaagatg

SEQ ID NO: 209486 - DNA, 103 bp, Artificial Sequence
  Synthetic Polynucleotide
taatacgactcactataggggatggccttcaccagggggctctctgtcacaacagaggagagtgacaatgagccccctgaacctggcggcagcgcaaaagatg

SEQ ID NO: 209487 - DNA, 103 bp, Artificial Sequence
  Synthetic Polynucleotide
taatacgactcactatagggaggcatggaagatggccttcaccagggggcaacagaggagagcccccatgtgaaggccaaacctggcggcagcgcaaaagatg

SEQ ID NO: 209488 - DNA, 103 bp, Artificial Sequence
  Synthetic Polynucleotide
taatacgactcactatagggatggctctgcaggcatggaagatggccttcaacagaggagagaaggcatgcttccatgcaacctggcggcagcgcaaaagatg

SEQ ID NO: 209489 - DNA, 103 bp, Artificial Sequence
  Synthetic Polynucleotide
taatacgactcactatagggtgaggcatgcatggctctgcaggcatggaaaacagaggagattccatatgtgcagagccaacctggcggcagcgcaaaagatg

SEQ ID NO: 209490 - DNA, 103 bp, Artificial Sequence
  Synthetic Polynucleotide
taatacgactcactatagggtcccagggagtgaggcatgcatggctctgcaacagaggagagcagagatgtgcatgcctaacctggcggcagcgcaaaagatg

SEQ ID NO: 209491 - DNA, 103 bp, Artificial Sequence
  Synthetic Polynucleotide
taatacgactcactatagggccatctgctttcccagggagtgaggcatgcaacagaggagagcatgcatgactccctggaacctggcggcagcgcaaaagatg

SEQ ID NO: 209492 - DNA, 103 bp, Artificial Sequence
  Synthetic Polynucleotide
taatacgactcactataggggaaggaaggtaatgtgacctgggtgaatgaaacagaggagatcattcatgcaggtcacaaacctggcggcagcgcaaaagatg

SEQ ID NO: 209493 - DNA, 103 bp, Artificial Sequence
  Synthetic Polynucleotide
taatacgactcactatagggactctgctgcccatctgctttcccagggagaacagaggagactccctatgaaagcagataacctggcggcagcgcaaaagatg

SEQ ID NO: 209494 - DNA, 103 bp, Artificial Sequence
  Synthetic Polynucleotide
taatacgactcactatagggggcagaaggaactctgctgcccatctgcttaacagaggagaaagcagatgggcagcagaaacctggcggcagcgcaaaagatg

SEQ ID NO: 209495 - DNA, 103 bp, Artificial Sequence
  Synthetic Polynucleotide
taatacgactcactatagggctctcgcaatggcagaaggaactctgctgcaacagaggagagcagcaatgttccttctgaacctggcggcagcgcaaaagatg

SEQ ID NO: 209496 - DNA, 103 bp, Artificial Sequence
  Synthetic Polynucleotide
taatacgactcactataggggccactggccctctcgcaatggcagaaggaaacagaggagatccttcatgcattgcgagaacctggcggcagcgcaaaagatg

SEQ ID NO: 209497 - DNA, 103 bp, Artificial Sequence
  Synthetic Polynucleotide
taatacgactcactatagggtccataggtggccactggccctctcgcaataacagaggagaattgcgatggggccagtgaacctggcggcagcgcaaaagatg

SEQ ID NO: 209498 - DNA, 103 bp, Artificial Sequence
  Synthetic Polynucleotide
taatacgactcactatagggttgaggctgctccataggtggccactggccaacagaggagaggccagatgccacctatgaacctggcggcagcgcaaaagatg

SEQ ID NO: 209499 - DNA, 103 bp, Artificial Sequence
  Synthetic Polynucleotide
taatacgactcactatagggcccactgacgttgaggctgctccataggtgaacagaggagacacctaatgagcagcctcaacctggcggcagcgcaaaagatg

SEQ ID NO: 209500 - DNA, 103 bp, Artificial Sequence
  Synthetic Polynucleotide
taatacgactcactatagggcagaggtggccccactgacgttgaggctgcaacagaggagagcagccatgacgtcagtgaacctggcggcagcgcaaaagatg

SEQ ID NO: 209501 - DNA, 103 bp, Artificial Sequence
  Synthetic Polynucleotide
taatacgactcactatagggagggcagggtcagaggtggccccactgacgaacagaggagacgtcagatgggccacctcaacctggcggcagcgcaaaagatg

SEQ ID NO: 209502 - DNA, 103 bp, Artificial Sequence
  Synthetic Polynucleotide
taatacgactcactatagggcacgtggttgagggcagggtcagaggtggcaacagaggagagccaccatggaccctgccaacctggcggcagcgcaaaagatg

SEQ ID NO: 209503 - DNA, 103 bp, Artificial Sequence
  Synthetic Polynucleotide
taatacgactcactatagggccgagggagagaaggaaggtaatgtgacctaacagaggagaaggtcaatgtaccttcctaacctggcggcagcgcaaaagatg

SEQ ID NO: 209504 - DNA, 103 bp, Artificial Sequence
  Synthetic Polynucleotide
taatacgactcactataggggcagctggaccacgtggttgagggcagggtaacagaggagaaccctgatgtcaaccacgaacctggcggcagcgcaaaagatg

SEQ ID NO: 209505 - DNA, 103 bp, Artificial Sequence
  Synthetic Polynucleotide
taatacgactcactatagggtcacaggtgagcagctggaccacgtggttgaacagaggagacaaccaatgggtccagctaacctggcggcagcgcaaaagatg

SEQ ID NO: 209506 - DNA, 103 bp, Artificial Sequence
  Synthetic Polynucleotide
taatacgactcactatagggcagtagcaggtcacaggtgagcagctggacaacagaggagagtccagatgctcacctgtaacctggcggcagcgcaaaagatg

SEQ ID NO: 209507 - DNA, 103 bp, Artificial Sequence
  Synthetic Polynucleotide
taatacgactcactatagggtccgtagcgacagtagcaggtcacaggtgaaacagaggagatcacctatgacctgctacaacctggcggcagcgcaaaagatg

SEQ ID NO: 209508 - DNA, 103 bp, Artificial Sequence
  Synthetic Polynucleotide
taatacgactcactatagggcagagcgctgtccgtagcgacagtagcaggaacagaggagacctgctatggtcgctacgaacctggcggcagcgcaaaagatg

SEQ ID NO: 209509 - DNA, 103 bp, Artificial Sequence
  Synthetic Polynucleotide
taatacgactcactatagggctgtttttgccagagcgctgtccgtagcgaaacagaggagatcgctaatgacagcgctcaacctggcggcagcgcaaaagatg

SEQ ID NO: 209510 - DNA, 103 bp, Artificial Sequence
  Synthetic Polynucleotide
taatacgactcactatagggtggcactggcctgtttttgccagagcgctgaacagaggagacagcgcatgggcaaaaacaacctggcggcagcgcaaaagatg

SEQ ID NO: 209511 - DNA, 103 bp, Artificial Sequence
  Synthetic Polynucleotide
taatacgactcactatagggacagcctggctggcactggcctgtttttgcaacagaggagagcaaaaatgggccagtgcaacctggcggcagcgcaaaagatg

SEQ ID NO: 209512 - DNA, 103 bp, Artificial Sequence
  Synthetic Polynucleotide
taatacgactcactatagggggtctcccccacagcctggctggcactggcaacagaggagagccagtatgagccaggctaacctggcggcagcgcaaaagatg

SEQ ID NO: 209513 - DNA, 103 bp, Artificial Sequence
  Synthetic Polynucleotide
taatacgactcactatagggacgcgtggtaggtctcccccacagcctggcaacagaggagagccaggatgtgggggagaaacctggcggcagcgcaaaagatg

SEQ ID NO: 209514 - DNA, 103 bp, Artificial Sequence
  Synthetic Polynucleotide
taatacgactcactataggggtgagggtctccatggtctccagaccacccaacagaggagagggtggatgggagaccataacctggcggcagcgcaaaagatg

SEQ ID NO: 209515 - DNA, 103 bp, Artificial Sequence
  Synthetic Polynucleotide
taatacgactcactatagggggggaggccgccgagggagagaaggaaggtaacagaggagaaccttcatgctctccctcaacctggcggcagcgcaaaagatg

SEQ ID NO: 209516 - DNA, 103 bp, Artificial Sequence
  Synthetic Polynucleotide
taatacgactcactatagggtcagcgcctgacgcgtggtaggtctcccccaacagaggagagggggaatgctaccacgcaacctggcggcagcgcaaaagatg

SEQ ID NO: 209517 - DNA, 103 bp, Artificial Sequence
  Synthetic Polynucleotide
taatacgactcactataggggcccgccagttcagcgcctgacgcgtggtaaacagaggagataccacatgtcaggcgctaacctggcggcagcgcaaaagatg

SEQ ID NO: 209518 - DNA, 103 bp, Artificial Sequence
  Synthetic Polynucleotide
taatacgactcactatagggcccgttggaagcccgccagttcagcgcctgaacagaggagacaggcgatgaactggcggaacctggcggcagcgcaaaagatg

SEQ ID NO: 209519 - DNA, 103 bp, Artificial Sequence
  Synthetic Polynucleotide
taatacgactcactatagggctgcccaggtcccgttggaagcccgccagtaacagaggagaactggcatgcttccaacgaacctggcggcagcgcaaaagatg

SEQ ID NO: 209520 - DNA, 103 bp, Artificial Sequence
  Synthetic Polynucleotide
taatacgactcactatagggcctgcgcaggctgcccaggtcccgttggaaaacagaggagattccaaatggacctgggcaacctggcggcagcgcaaaagatg

SEQ ID NO: 209521 - DNA, 103 bp, Artificial Sequence
  Synthetic Polynucleotide
taatacgactcactatagggtgtgtgccagcctgcgcaggctgcccaggtaacagaggagaacctggatggcctgcgcaaacctggcggcagcgcaaaagatg

SEQ ID NO: 209522 - DNA, 103 bp, Artificial Sequence
  Synthetic Polynucleotide
taatacgactcactataggggggcggaagctgtgtgccagcctgcgcaggaacagaggagacctgcgatggctggcacaaacctggcggcagcgcaaaagatg

SEQ ID NO: 209523 - DNA, 103 bp, Artificial Sequence
  Synthetic Polynucleotide
taatacgactcactataggggcggtatgctgggcggaagctgtgtgccagaacagaggagactggcaatgagcttccgcaacctggcggcagcgcaaaagatg

SEQ ID NO: 209524 - DNA, 103 bp, Artificial Sequence
  Synthetic Polynucleotide
taatacgactcactatagggggaacaccttgcggtatgctgggcggaagcaacagaggagagcttccatgcagcataccaacctggcggcagcgcaaaagatg

SEQ ID NO: 209525 - DNA, 103 bp, Artificial Sequence
  Synthetic Polynucleotide
taatacgactcactataggggcttcatgcaggaacaccttgcggtatgctaacagaggagaagcataatgcaaggtgttaacctggcggcagcgcaaaagatg

SEQ ID NO: 209526 - DNA, 103 bp, Artificial Sequence
  Synthetic Polynucleotide
taatacgactcactatagggtggagcctgtggggaggccgccgagggagaaacagaggagatctcccatggcggcctccaacctggcggcagcgcaaaagatg

SEQ ID NO: 209527 - DNA, 103 bp, Artificial Sequence
  Synthetic Polynucleotide
taatacgactcactataggggcgcacggtggcttcatgcaggaacaccttaacagaggagaaaggtgatgctgcatgaaaacctggcggcagcgcaaaagatg

SEQ ID NO: 209528 - DNA, 103 bp, Artificial Sequence
  Synthetic Polynucleotide
taatacgactcactatagggctgccatcaggcgcacggtggcttcatgcaaacagaggagatgcatgatgccaccgtgcaacctggcggcagcgcaaaagatg

SEQ ID NO: 209529 - DNA, 103 bp, Artificial Sequence
  Synthetic Polynucleotide
taatacgactcactataggggggctggctcctgccatcaggcgcacggtgaacagaggagacaccgtatgcctgatggcaacctggcggcagcgcaaaagatg

SEQ ID NO: 209530 - DNA, 103 bp, Artificial Sequence
  Synthetic Polynucleotide
taatacgactcactatagggggtgcgggtggggctggctcctgccatcagaacagaggagactgatgatgggagccagcaacctggcggcagcgcaaaagatg

SEQ ID NO: 209531 - DNA, 103 bp, Artificial Sequence
  Synthetic Polynucleotide
taatacgactcactataggggcagctggtgggtgcgggtggggctggctcaacagaggagagagccaatgccacccgcaaacctggcggcagcgcaaaagatg

SEQ ID NO: 209532 - DNA, 103 bp, Artificial Sequence
  Synthetic Polynucleotide
taatacgactcactatagggctgtgttccagcagctggtgggtgcgggtgaacagaggagacacccgatgccaccagctaacctggcggcagcgcaaaagatg

SEQ ID NO: 209533 - DNA, 103 bp, Artificial Sequence
  Synthetic Polynucleotide
taatacgactcactatagggccgccgcaggctgtgttccagcagctggtgaacagaggagacaccagatgctggaacacaacctggcggcagcgcaaaagatg

SEQ ID NO: 209534 - DNA, 103 bp, Artificial Sequence
  Synthetic Polynucleotide
taatacgactcactataggggcgtggtgcgccgccgcaggctgtgttccaaacagaggagatggaacatggcctgcggcaacctggcggcagcgcaaaagatg

SEQ ID NO: 209535 - DNA, 103 bp, Artificial Sequence
  Synthetic Polynucleotide
taatacgactcactatagggttggtgctctgcgtggtgcgccgccgcaggaacagaggagacctgcgatggcgcaccacaacctggcggcagcgcaaaagatg

SEQ ID NO: 209536 - DNA, 103 bp, Artificial Sequence
  Synthetic Polynucleotide
taatacgactcactatagggctctccgtgcttggtgctctgcgtggtgcgaacagaggagacgcaccatgcagagcaccaacctggcggcagcgcaaaagatg

SEQ ID NO: 209537 - DNA, 103 bp, Artificial Sequence
  Synthetic Polynucleotide
taatacgactcactatagggcttgcagagttggagcctgtggggaggccgaacagaggagacggcctatgcacaggctcaacctggcggcagcgcaaaagatg

SEQ ID NO: 209538 - DNA, 103 bp, Artificial Sequence
  Synthetic Polynucleotide
taatacgactcactatagggaggcatccacctctccgtgcttggtgctctaacagaggagaagagcaatgagcacggagaacctggcggcagcgcaaaagatg

SEQ ID NO: 209539 - DNA, 103 bp, Artificial Sequence
  Synthetic Polynucleotide
taatacgactcactatagggtggccgggccaggcatccacctctccgtgcaacagaggagagcacggatgggtggatgcaacctggcggcagcgcaaaagatg

SEQ ID NO: 209540 - DNA, 103 bp, Artificial Sequence
  Synthetic Polynucleotide
taatacgactcactatagggccgctctcgctggccgggccaggcatccacaacagaggagagtggatatgtggcccggcaacctggcggcagcgcaaaagatg

SEQ ID NO: 209541 - DNA, 103 bp, Artificial Sequence
  Synthetic Polynucleotide
taatacgactcactatagggtggcggtggcccgctctcgctggccgggccaacagaggagaggcccgatgagcgagagcaacctggcggcagcgcaaaagatg

SEQ ID NO: 209542 - DNA, 103 bp, Artificial Sequence
  Synthetic Polynucleotide
taatacgactcactataggggccagcaggatggcggtggcccgctctcgcaacagaggagagcgagaatgggccaccgcaacctggcggcagcgcaaaagatg

SEQ ID NO: 209543 - DNA, 103 bp, Artificial Sequence
  Synthetic Polynucleotide
taatacgactcactataggggtggcggcaggccagcaggatggcggtggcaacagaggagagccaccatgatcctgctgaacctggcggcagcgcaaaagatg

SEQ ID NO: 209544 - DNA, 103 bp, Artificial Sequence
  Synthetic Polynucleotide
taatacgactcactatagggagaggggcaggtggcggcaggccagcaggaaacagaggagatcctgcatgcctgccgccaacctggcggcagcgcaaaagatg

SEQ ID NO: 209545 - DNA, 103 bp, Artificial Sequence
  Synthetic Polynucleotide
taatacgactcactataggggagaggaaggagaggggcaggtggcggcagaacagaggagactgccgatgcctgcccctaacctggcggcagcgcaaaagatg

SEQ ID NO: 209546 - DNA, 103 bp, Artificial Sequence
  Synthetic Polynucleotide
taatacgactcactataggggcccggggaggagaggaaggagaggggcagaacagaggagactgcccatgtccttcctcaacctggcggcagcgcaaaagatg

SEQ ID NO: 209547 - DNA, 103 bp, Artificial Sequence
  Synthetic Polynucleotide
taatacgactcactatagggctgcccgctggcccggggaggagaggaaggaacagaggagaccttccatgcctccccggaacctggcggcagcgcaaaagatg

SEQ ID NO: 209548 - DNA, 103 bp, Artificial Sequence
  Synthetic Polynucleotide
taatacgactcactataggggaaaccttgacttgcagagttggagcctgtaacagaggagaacaggcatgaactctgcaaacctggcggcagcgcaaaagatg

SEQ ID NO: 209549 - DNA, 103 bp, Artificial Sequence
  Synthetic Polynucleotide
taatacgactcactataggggccagcagcactgcccgctggcccggggagaacagaggagactccccatgccagcgggcaacctggcggcagcgcaaaagatg

SEQ ID NO: 209550 - DNA, 103 bp, Artificial Sequence
  Synthetic Polynucleotide
taatacgactcactatagggggcagcttcggccagcagcactgcccgctgaacagaggagacagcggatggtgctgctgaacctggcggcagcgcaaaagatg

SEQ ID NO: 209551 - DNA, 103 bp, Artificial Sequence
  Synthetic Polynucleotide
taatacgactcactatagggccagggtgcgggcagcttcggccagcagcaaacagaggagatgctgcatgccgaagctgaacctggcggcagcgcaaaagatg

SEQ ID NO: 209552 - DNA, 103 bp, Artificial Sequence
  Synthetic Polynucleotide
taatacgactcactatagggcccaccttctccagggtgcgggcagcttcgaacagaggagacgaagcatgccgcaccctaacctggcggcagcgcaaaagatg

SEQ ID NO: 209553 - DNA, 103 bp, Artificial Sequence
  Synthetic Polynucleotide
taatacgactcactataggggcgccggtcgcccaccttctccagggtgcgaacagaggagacgcaccatggagaaggtgaacctggcggcagcgcaaaagatg

SEQ ID NO: 209554 - DNA, 103 bp, Artificial Sequence
  Synthetic Polynucleotide
taatacgactcactatagggcgttgcaggagcgccggtcgcccaccttctaacagaggagaagaaggatggcgaccggcaacctggcggcagcgcaaaagatg

SEQ ID NO: 209555 - DNA, 103 bp, Artificial Sequence
  Synthetic Polynucleotide
taatacgactcactatagggtgctggcagtcgttgcaggagcgccggtcgaacagaggagacgaccgatgctcctgcaaaacctggcggcagcgcaaaagatg

SEQ ID NO: 209556 - DNA, 103 bp, Artificial Sequence
  Synthetic Polynucleotide
taatacgactcactatagggaacaatcatctgctggcagtcgttgcaggaaacagaggagatcctgcatggactgccagaacctggcggcagcgcaaaagatg

SEQ ID NO: 209557 - DNA, 103 bp, Artificial Sequence
  Synthetic Polynucleotide
taatacgactcactatagggcacccagcttaacaatcatctgctggcagtaacagaggagaactgccatgagatgattgaacctggcggcagcgcaaaagatg

SEQ ID NO: 209558 - DNA, 103 bp, Artificial Sequence
  Synthetic Polynucleotide
taatacgactcactataggggcagtgccaccacccagcttaacaatcatcaacagaggagagatgatatgtaagctgggaacctggcggcagcgcaaaagatg

SEQ ID NO: 209559 - DNA, 103 bp, Artificial Sequence
  Synthetic Polynucleotide
taatacgactcactatagggtgaggtgggagaaaccttgacttgcagagtaacagaggagaactctgatggtcaaggttaacctggcggcagcgcaaaagatg

SEQ ID NO: 209560 - DNA, 103 bp, Artificial Sequence
  Synthetic Polynucleotide
taatacgactcactatagggggcggcaatggcagtgccaccacccagcttaacagaggagaaagctgatgggtggcactaacctggcggcagcgcaaaagatg

SEQ ID NO: 209561 - DNA, 103 bp, Artificial Sequence
  Synthetic Polynucleotide
taatacgactcactatagggtggtgggaactgaggtgggagaaaccttgaaacagaggagatcaaggatgctcccacctaacctggcggcagcgcaaaagatg

SEQ ID NO: 209562 - DNA, 103 bp, Artificial Sequence
  Synthetic Polynucleotide
taatacgactcactataggggccctgggtgtggtgggaactgaggtgggaaacagaggagatcccacatgagttcccacaacctggcggcagcgcaaaagatg

SEQ ID NO: 209563 - DNA, 103 bp, Artificial Sequence
  Synthetic Polynucleotide
taatacgactcactatagggaataggagttgccctgggtgtggtgggaacaacagaggagagttcccatgacacccaggaacctggcggcagcgcaaaagatg

SEQ ID NO: 209564 - DNA, 103 bp, Artificial Sequence
  Synthetic Polynucleotide
taatacgactcactatagggggggctgaagaataggagttgccctgggtgaacagaggagacacccaatgcaactcctaaacctggcggcagcgcaaaagatg

SEQ ID NO: 209565 - DNA, 103 bp, Artificial Sequence
  Synthetic Polynucleotide
taatacgactcactatagggggctgggggcggggctgaagaataggagttaacagaggagaaactccatgtcttcagccaacctggcggcagcgcaaaagatg

SEQ ID NO: 209566 - DNA, 103 bp, Artificial Sequence
  Synthetic Polynucleotide
taatacgactcactataggggcccagctccgtgagggtctccatggtctcaacagaggagagagaccatggagaccctcaacctggcggcagcgcaaaagatg

SEQ ID NO: 209567 - DNA, 103 bp, Artificial Sequence
  Synthetic Polynucleotide
taatacgactcactatagggttgaggctggggctgggggcggggctgaagaacagaggagacttcagatgcgcccccagaacctggcggcagcgcaaaagatg

SEQ ID NO: 209568 - DNA, 103 bp, Artificial Sequence
  Synthetic Polynucleotide
taatacgactcactataggggagtttgaggttgaggctggggctgggggcaacagaggagagcccccatgcccagcctcaacctggcggcagcgcaaaagatg

SEQ ID NO: 209569 - DNA, 103 bp, Artificial Sequence
  Synthetic Polynucleotide
taatacgactcactatagggtgttgcagctgagtttgaggttgaggctggaacagaggagaccagccatgacctcaaacaacctggcggcagcgcaaaagatg

SEQ ID NO: 209570 - DNA, 103 bp, Artificial Sequence
  Synthetic Polynucleotide
taatacgactcactatagggtaccgtctgttgttgcagctgagtttgaggaacagaggagacctcaaatgcagctgcaaaacctggcggcagcgcaaaagatg

SEQ ID NO: 209571 - DNA, 103 bp, Artificial Sequence
  Synthetic Polynucleotide
taatacgactcactataggggcgtgatcattaccgtctgttgttgcagctaacagaggagaagctgcatgaacagacggaacctggcggcagcgcaaaagatg

SEQ ID NO: 209572 - DNA, 103 bp, Artificial Sequence
  Synthetic Polynucleotide
taatacgactcactatagggctgaatgttggcgtgatcattaccgtctgtaacagaggagaacagacatgaatgatcacaacctggcggcagcgcaaaagatg

SEQ ID NO: 209573 - DNA, 103 bp, Artificial Sequence
  Synthetic Polynucleotide
taatacgactcactatagggcggagtggtgctgaatgttggcgtgatcataacagaggagaatgatcatgccaacattcaacctggcggcagcgcaaaagatg

SEQ ID NO: 209574 - DNA, 103 bp, Artificial Sequence
  Synthetic Polynucleotide
taatacgactcactatagggtcctcgtctgcggagtggtgctgaatgttgaacagaggagacaacatatggcaccactcaacctggcggcagcgcaaaagatg

SEQ ID NO: 209575 - DNA, 103 bp, Artificial Sequence
  Synthetic Polynucleotide
taatacgactcactatagggtgctggatgatcctcgtctgcggagtggtgaacagaggagacaccacatggcagacgagaacctggcggcagcgcaaaagatg

SEQ ID NO: 209576 - DNA, 103 bp, Artificial Sequence
  Synthetic Polynucleotide
taatacgactcactatagggtatcaaaggctgctggatgatcctcgtctgaacagaggagacagacgatgatcatccagaacctggcggcagcgcaaaagatg

SEQ ID NO: 209577 - DNA, 103 bp, Artificial Sequence
  Synthetic Polynucleotide
taatacgactcactatagggtcagctcgtcgcccagctccgtgagggtctaacagaggagaagacccatgcggagctggaacctggcggcagcgcaaaagatg

SEQ ID NO: 209578 - DNA, 103 bp, Artificial Sequence
  Synthetic Polynucleotide
taatacgactcactatagggcattctggtatatcaaaggctgctggatgaaacagaggagatcatccatgagcctttgaaacctggcggcagcgcaaaagatg

SEQ ID NO: 209579 - DNA, 103 bp, Artificial Sequence
  Synthetic Polynucleotide
taatacgactcactatagggctagtagctgcattctggtatatcaaaggcaacagaggagagcctttatgataccagaaaacctggcggcagcgcaaaagatg

SEQ ID NO: 209580 - DNA, 103 bp, Artificial Sequence
  Synthetic Polynucleotide
taatacgactcactataggggacttgaaagctagtagctgcattctggtaaacagaggagataccagatggcagctactaacctggcggcagcgcaaaagatg

SEQ ID NO: 209581 - DNA, 103 bp, Artificial Sequence
  Synthetic Polynucleotide
taatacgactcactataggggaggctgaaggacttgaaagctagtagctgaacagaggagacagctaatggctttcaagaacctggcggcagcgcaaaagatg

SEQ ID NO: 209582 - DNA, 103 bp, Artificial Sequence
  Synthetic Polynucleotide
taatacgactcactatagggctttggacttgaggctgaaggacttgaaagaacagaggagactttcaatgccttcagccaacctggcggcagcgcaaaagatg

SEQ ID NO: 209583 - DNA, 103 bp, Artificial Sequence
  Synthetic Polynucleotide
taatacgactcactatagggtgtcaccaggctttggacttgaggctgaagaacagaggagacttcagatgcaagtccaaaacctggcggcagcgcaaaagatg

SEQ ID NO: 209584 - DNA, 103 bp, Artificial Sequence
  Synthetic Polynucleotide
taatacgactcactatagggcctgggaggatgtcaccaggctttggacttaacagaggagaaagtccatggcctggtgaaacctggcggcagcgcaaaagatg

SEQ ID NO: 209585 - DNA, 103 bp, Artificial Sequence
  Synthetic Polynucleotide
taatacgactcactatagggaccggctgtacctgggaggatgtcaccaggaacagaggagacctggtatgatcctcccaaacctggcggcagcgcaaaagatg

SEQ ID NO: 209586 - DNA, 103 bp, Artificial Sequence
  Synthetic Polynucleotide
taatacgactcactatagggctgaatggtgaccggctgtacctgggaggaaacagaggagatcctccatggtacagccgaacctggcggcagcgcaaaagatg

SEQ ID NO: 209587 - DNA, 103 bp, Artificial Sequence
  Synthetic Polynucleotide
taatacgactcactataggggcacctgctgctgaatggtgaccggctgtaaacagaggagatacagcatgtcaccattcaacctggcggcagcgcaaaagatg

SEQ ID NO: 209588 - DNA, 103 bp, Artificial Sequence
  Synthetic Polynucleotide
taatacgactcactatagggtctcccagggtcagctcgtcgcccagctccaacagaggagaggagctatgcgacgagctaacctggcggcagcgcaaaagatg

SEQ ID NO: 209589 - DNA, 103 bp, Artificial Sequence
  Synthetic Polynucleotide
taatacgactcactatagggtgtactgtctgcacctgctgctgaatggtgaacagaggagacaccatatggcagcaggtaacctggcggcagcgcaaaagatg

SEQ ID NO: 209590 - DNA, 103 bp, Artificial Sequence
  Synthetic Polynucleotide
taatacgactcactatagggccgctgggcctgtactgtctgcacctgctgaacagaggagacagcagatgcagacagtaaacctggcggcagcgcaaaagatg

SEQ ID NO: 209591 - DNA, 103 bp, Artificial Sequence
  Synthetic Polynucleotide
taatacgactcactataggggtgtcagcacccgctgggcctgtactgtctaacagaggagaagacagatgaggcccagcaacctggcggcagcgcaaaagatg

SEQ ID NO: 209592 - DNA, 103 bp, Artificial Sequence
  Synthetic Polynucleotide
taatacgactcactatagggttggccgtttgtgtcagcacccgctgggccaacagaggagaggcccaatgggtgctgacaacctggcggcagcgcaaaagatg

SEQ ID NO: 209593 - DNA, 103 bp, Artificial Sequence
  Synthetic Polynucleotide
taatacgactcactatagggcagcgtgccattggccgtttgtgtcagcacaacagaggagagtgctgatgcaaacggccaacctggcggcagcgcaaaagatg

SEQ ID NO: 209594 - DNA, 103 bp, Artificial Sequence
  Synthetic Polynucleotide
taatacgactcactatagggcaagggtctgcagcgtgccattggccgtttaacagaggagaaaacggatgatggcacgcaacctggcggcagcgcaaaagatg

SEQ ID NO: 209595 - DNA, 103 bp, Artificial Sequence
  Synthetic Polynucleotide
taatacgactcactataggggtagccggggcaagggtctgcagcgtgccaaacagaggagatggcacatggcagaccctaacctggcggcagcgcaaaagatg

SEQ ID NO: 209596 - DNA, 103 bp, Artificial Sequence
  Synthetic Polynucleotide
taatacgactcactatagggtgtctgcaccgtagccggggcaagggtctgaacagaggagacagaccatggccccggctaacctggcggcagcgcaaaagatg

SEQ ID NO: 209597 - DNA, 103 bp, Artificial Sequence
  Synthetic Polynucleotide
taatacgactcactataggggcgcagcaactgtctgcaccgtagccggggaacagaggagaccccggatgcggtgcagaaacctggcggcagcgcaaaagatg

SEQ ID NO: 209598 - DNA, 103 bp, Artificial Sequence
  Synthetic Polynucleotide
taatacgactcactatagggtgcacctgtggcgcagcaactgtctgcaccaacagaggagaggtgcaatgagttgctgcaacctggcggcagcgcaaaagatg

SEQ ID NO: 209599 - DNA, 103 bp, Artificial Sequence
  Synthetic Polynucleotide
taatacgactcactatagggctcgtcgatgtctcccagggtcagctcgtcaacagaggagagacgagatgaccctgggaaacctggcggcagcgcaaaagatg

SEQ ID NO: 209600 - DNA, 103 bp, Artificial Sequence
  Synthetic Polynucleotide
taatacgactcactatagggcgggacctgctgcacctgtggcgcagcaacaacagaggagagttgctatgccacaggtgaacctggcggcagcgcaaaagatg

SEQ ID NO: 209601 - DNA, 103 bp, Artificial Sequence
  Synthetic Polynucleotide
taatacgactcactatagggggaccaggaccgggacctgctgcacctgtgaacagaggagacacaggatgagcaggtccaacctggcggcagcgcaaaagatg

SEQ ID NO: 209602 - DNA, 103 bp, Artificial Sequence
  Synthetic Polynucleotide
taatacgactcactatagggatctgaggctggaccaggaccgggacctgcaacagaggagagcaggtatgggtcctggtaacctggcggcagcgcaaaagatg

SEQ ID NO: 209603 - DNA, 103 bp, Artificial Sequence
  Synthetic Polynucleotide
taatacgactcactatagggtgtcttgatgatctgaggctggaccaggacaacagaggagagtcctgatgcagcctcagaacctggcggcagcgcaaaagatg

SEQ ID NO: 209604 - DNA, 103 bp, Artificial Sequence
  Synthetic Polynucleotide
taatacgactcactatagggcaagggaatctgtcttgatgatctgaggctaacagaggagaagcctcatgtcatcaagaaacctggcggcagcgcaaaagatg

SEQ ID NO: 209605 - DNA, 103 bp, Artificial Sequence
  Synthetic Polynucleotide
taatacgactcactataggggtggtcaaaacaagggaatctgtcttgatgaacagaggagacatcaaatgagattccctaacctggcggcagcgcaaaagatg

SEQ ID NO: 209606 - DNA, 103 bp, Artificial Sequence
  Synthetic Polynucleotide
taatacgactcactatagggtgtcttcagtgtggtcaaaacaagggaatcaacagaggagagattccatggttttgaccaacctggcggcagcgcaaaagatg

SEQ ID NO: 209607 - DNA, 103 bp, Artificial Sequence
  Synthetic Polynucleotide
taatacgactcactatagggggctgccatctgtcttcagtgtggtcaaaaaacagaggagattttgaatgcactgaagaaacctggcggcagcgcaaaagatg

SEQ ID NO: 209608 - DNA, 103 bp, Artificial Sequence
  Synthetic Polynucleotide
taatacgactcactataggggccataacagggctgccatctgtcttcagtaacagaggagaactgaaatgagatggcagaacctggcggcagcgcaaaagatg

SEQ ID NO: 209609 - DNA, 103 bp, Artificial Sequence
  Synthetic Polynucleotide
taatacgactcactatagggctggaccgcagccataacagggctgccatcaacagaggagagatggcatgcctgttatgaacctggcggcagcgcaaaagatg

SEQ ID NO: 209610 - DNA, 103 bp, Artificial Sequence
  Synthetic Polynucleotide
taatacgactcactatagggattgcagcatctcgtcgatgtctcccagggaacagaggagaccctggatgacatcgacgaacctggcggcagcgcaaaagatg

SEQ ID NO: 209611 - DNA, 103 bp, Artificial Sequence
  Synthetic Polynucleotide
taatacgactcactataggggggccgggttctggaccgcagccataacagaacagaggagactgttaatgctgcggtccaacctggcggcagcgcaaaagatg

SEQ ID NO: 209612 - DNA, 103 bp, Artificial Sequence
  Synthetic Polynucleotide
taatacgactcactatagggagggcggtgagggccgggttctggaccgcaaacagaggagatgcggtatggaacccggcaacctggcggcagcgcaaaagatg

SEQ ID NO: 209613 - DNA, 103 bp, Artificial Sequence
  Synthetic Polynucleotide
taatacgactcactatagggaggggtggtgagggcggtgagggccgggttaacagaggagaaacccgatgctcaccgccaacctggcggcagcgcaaaagatg

SEQ ID NO: 209614 - DNA, 103 bp, Artificial Sequence
  Synthetic Polynucleotide
taatacgactcactatagggccgtctggataggggtggtgagggcggtgaaacagaggagatcaccgatgtcaccacccaacctggcggcagcgcaaaagatg

SEQ ID NO: 209615 - DNA, 103 bp, Artificial Sequence
  Synthetic Polynucleotide
taatacgactcactatagggtgaagggcagccgtctggataggggtggtgaacagaggagacaccacatgtatccagacaacctggcggcagcgcaaaagatg

SEQ ID NO: 209616 - DNA, 103 bp, Artificial Sequence
  Synthetic Polynucleotide
taatacgactcactatagggggttggtacttgaagggcagccgtctggataacagaggagaatccagatggctgcccttaacctggcggcagcgcaaaagatg

SEQ ID NO: 209617 - DNA, 103 bp, Artificial Sequence
  Synthetic Polynucleotide
taatacgactcactatagggtgcccaccagggttggtacttgaagggcagaacagaggagactgcccatgaagtaccaaaacctggcggcagcgcaaaagatg

SEQ ID NO: 209618 - DNA, 103 bp, Artificial Sequence
  Synthetic Polynucleotide
taatacgactcactataggggtcccactgctgcccaccagggttggtactaacagaggagaagtaccatgcctggtgggaacctggcggcagcgcaaaagatg

SEQ ID NO: 209619 - DNA, 103 bp, Artificial Sequence
  Synthetic Polynucleotide
taatacgactcactatagggggtcagaatggtcccactgctgcccaccagaacagaggagactggtgatgagcagtgggaacctggcggcagcgcaaaagatg

SEQ ID NO: 209620 - DNA, 103 bp, Artificial Sequence
  Synthetic Polynucleotide
taatacgactcactatagggcaggcattgtggtcagaatggtcccactgcaacagaggagagcagtgatgccattctgaaacctggcggcagcgcaaaagatg

SEQ ID NO: 209621 - DNA, 103 bp, Artificial Sequence
  Synthetic Polynucleotide
taatacgactcactatagggttactgacaaattgcagcatctcgtcgatgaacagaggagacatcgaatggatgctgcaaacctggcggcagcgcaaaagatg

SEQ ID NO: 209622 - DNA, 103 bp, Artificial Sequence
  Synthetic Polynucleotide
taatacgactcactatagggcccatcattacaggcattgtggtcagaatgaacagaggagacattctatgcacaatgccaacctggcggcagcgcaaaagatg

SEQ ID NO: 209623 - DNA, 103 bp, Artificial Sequence
  Synthetic Polynucleotide
taatacgactcactatagggtttctcttgccccatcattacaggcattgtaacagaggagaacaatgatggtaatgatgaacctggcggcagcgcaaaagatg

SEQ ID NO: 209624 - DNA, 103 bp, Artificial Sequence
  Synthetic Polynucleotide
taatacgactcactatagggtaatgggcactttctcttgccccatcattaaacagaggagataatgaatgggcaagagaaacctggcggcagcgcaaaagatg

SEQ ID NO: 209625 - DNA, 103 bp, Artificial Sequence
  Synthetic Polynucleotide
taatacgactcactatagggggtacctgcttaatgggcactttctcttgcaacagaggagagcaagaatgagtgcccataacctggcggcagcgcaaaagatg

SEQ ID NO: 209626 - DNA, 103 bp, Artificial Sequence
  Synthetic Polynucleotide
taatacgactcactataggggactcccccaggtacctgcttaatgggcacaacagaggagagtgcccatgaagcaggtaaacctggcggcagcgcaaaagatg

SEQ ID NO: 209627 - DNA, 103 bp, Artificial Sequence
  Synthetic Polynucleotide
taatacgactcactatagggcaagctgcttgactcccccaggtacctgctaacagaggagaagcaggatgctgggggagaacctggcggcagcgcaaaagatg

SEQ ID NO: 209628 - DNA, 103 bp, Artificial Sequence
  Synthetic Polynucleotide
taatacgactcactatagggttggggggctcaagctgcttgactcccccaaacagaggagatgggggatgcaagcagctaacctggcggcagcgcaaaagatg

SEQ ID NO: 209629 - DNA, 103 bp, Artificial Sequence
  Synthetic Polynucleotide
taatacgactcactatagggttctccttctttggggggctcaagctgcttaacagaggagaaagcagatggagccccccaacctggcggcagcgcaaaagatg

SEQ ID NO: 209630 - DNA, 103 bp, Artificial Sequence
  Synthetic Polynucleotide
taatacgactcactatagggttgtccgcctttctccttctttggggggctaacagaggagaagccccatgaagaaggagaacctggcggcagcgcaaaagatg

SEQ ID NO: 209631 - DNA, 103 bp, Artificial Sequence
  Synthetic Polynucleotide
taatacgactcactatagggatattatgggttgtccgcctttctccttctaacagaggagaagaaggatgaaggcggacaacctggcggcagcgcaaaagatg

SEQ ID NO: 209632 - DNA, 103 bp, Artificial Sequence
  Synthetic Polynucleotide
taatacgactcactatagggcgccgcggccccagcttgggtcggtaacataacagaggagaatgttaatgacccaagctaacctggcggcagcgcaaaagatg

SEQ ID NO: 209633 - DNA, 103 bp, Artificial Sequence
  Synthetic Polynucleotide
taatacgactcactataggggttagccccgcgtgtcccgccgccgccgccaacagaggagaggcggcatgggcgggacaaacctggcggcagcgcaaaagatg

SEQ ID NO: 209634 - DNA, 103 bp, Artificial Sequence
  Synthetic Polynucleotide
taatacgactcactatagggaggcagctgcataaggcccccagaggagacaacagaggagagtctccatggggggccttaacctggcggcagcgcaaaagatg

SEQ ID NO: 209635 - DNA, 103 bp, Artificial Sequence
  Synthetic Polynucleotide
taatacgactcactatagggtgaagctggtaggcagctgcataaggccccaacagaggagaggggccatgtgcagctgcaacctggcggcagcgcaaaagatg

SEQ ID NO: 209636 - DNA, 103 bp, Artificial Sequence
  Synthetic Polynucleotide
taatacgactcactatagggggcatgagggtgaagctggtaggcagctgcaacagaggagagcagctatgtaccagcttaacctggcggcagcgcaaaagatg

SEQ ID NO: 209637 - DNA, 103 bp, Artificial Sequence
  Synthetic Polynucleotide
taatacgactcactatagggtgccccaccaggcatgagggtgaagctggtaacagaggagaaccagcatgaccctcatgaacctggcggcagcgcaaaagatg

SEQ ID NO: 209638 - DNA, 103 bp, Artificial Sequence
  Synthetic Polynucleotide
taatacgactcactataggggctgggccactgccccaccaggcatgagggaacagaggagaccctcaatgctggtggggaacctggcggcagcgcaaaagatg

SEQ ID NO: 209639 - DNA, 103 bp, Artificial Sequence
  Synthetic Polynucleotide
taatacgactcactatagggactgggacctgctgggccactgccccaccaaacagaggagatggtggatgagtggcccaaacctggcggcagcgcaaaagatg

SEQ ID NO: 209640 - DNA, 103 bp, Artificial Sequence
  Synthetic Polynucleotide
taatacgactcactatagggaatggcctgcactgggacctgctgggccacaacagaggagagtggccatgcaggtcccaaacctggcggcagcgcaaaagatg

SEQ ID NO: 209641 - DNA, 103 bp, Artificial Sequence
  Synthetic Polynucleotide
taatacgactcactatagggggtgcacttgaatggcctgcactgggacctaacagaggagaaggtccatgtgcaggccaaacctggcggcagcgcaaaagatg

SEQ ID NO: 209642 - DNA, 103 bp, Artificial Sequence
  Synthetic Polynucleotide
taatacgactcactatagggtgtggggcctggtgcacttgaatggcctgcaacagaggagagcaggcatgtcaagtgcaaacctggcggcagcgcaaaagatg

SEQ ID NO: 209643 - DNA, 103 bp, Artificial Sequence
  Synthetic Polynucleotide
taatacgactcactatagggagacgcttgctgtggggcctggtgcacttgaacagaggagacaagtgatgcaggccccaaacctggcggcagcgcaaaagatg

SEQ ID NO: 209644 - DNA, 103 bp, Artificial Sequence
  Synthetic Polynucleotide
taatacgactcactatagggcccggcccccgttagccccgcgtgtcccgcaacagaggagagcgggaatggcggggctaaacctggcggcagcgcaaaagatg

SEQ ID NO: 209645 - DNA, 103 bp, Artificial Sequence
  Synthetic Polynucleotide
taatacgactcactatagggcacgggagggagacgcttgctgtggggcctaacagaggagaaggcccatgagcaagcgtaacctggcggcagcgcaaaagatg

SEQ ID NO: 209646 - DNA, 103 bp, Artificial Sequence
  Synthetic Polynucleotide
taatacgactcactataggggtgctgctgtcacgggagggagacgcttgcaacagaggagagcaagcatgtccctcccgaacctggcggcagcgcaaaagatg

SEQ ID NO: 209647 - DNA, 103 bp, Artificial Sequence
  Synthetic Polynucleotide
taatacgactcactatagggcgtgaggtctgtgctgctgtcacgggagggaacagaggagaccctccatggacagcagcaacctggcggcagcgcaaaagatg

SEQ ID NO: 209648 - DNA, 103 bp, Artificial Sequence
  Synthetic Polynucleotide
taatacgactcactatagggaggaggtctgcgtgaggtctgtgctgctgtaacagaggagaacagcaatgcagacctcaaacctggcggcagcgcaaaagatg

SEQ ID NO: 209649 - DNA, 103 bp, Artificial Sequence
  Synthetic Polynucleotide
taatacgactcactataggggtcccgctggaggaggtctgcgtgaggtctaacagaggagaagacctatggcagacctcaacctggcggcagcgcaaaagatg

SEQ ID NO: 209650 - DNA, 103 bp, Artificial Sequence
  Synthetic Polynucleotide
taatacgactcactatagggcagcgtcactgtcccgctggaggaggtctgaacagaggagacagaccatgtccagcgggaacctggcggcagcgcaaaagatg

SEQ ID NO: 209651 - DNA, 103 bp, Artificial Sequence
  Synthetic Polynucleotide
taatacgactcactatagggtggtggcgggcagcgtcactgtcccgctggaacagaggagaccagcgatgcagtgacgcaacctggcggcagcgcaaaagatg

SEQ ID NO: 209652 - DNA, 103 bp, Artificial Sequence
  Synthetic Polynucleotide
taatacgactcactataggggacgtcatgatggtggcgggcagcgtcactaacagaggagaagtgacatggcccgccacaacctggcggcagcgcaaaagatg

SEQ ID NO: 209653 - DNA, 103 bp, Artificial Sequence
  Synthetic Polynucleotide
taatacgactcactataggggggcacggatgacgtcatgatggtggcgggaacagaggagacccgccatgatcatgacgaacctggcggcagcgcaaaagatg

SEQ ID NO: 209654 - DNA, 103 bp, Artificial Sequence
  Synthetic Polynucleotide
taatacgactcactatagggccacagttgtgggcacggatgacgtcatgaaacagaggagatcatgaatgcatccgtgcaacctggcggcagcgcaaaagatg

SEQ ID NO: 209655 - DNA, 103 bp, Artificial Sequence
  Synthetic Polynucleotide
taatacgactcactatagggttcccggggacccggcccccgttagccccgaacagaggagacggggcatgcgggggccgaacctggcggcagcgcaaaagatg

SEQ ID NO: 209656 - DNA, 103 bp, Artificial Sequence
  Synthetic Polynucleotide
taatacgactcactatagggatgtggccacccacagttgtgggcacggataacagaggagaatccgtatgcacaactgtaacctggcggcagcgcaaaagatg

SEQ ID NO: 209657 - DNA, 103 bp, Artificial Sequence
  Synthetic Polynucleotide
taatacgactcactatagggagggtacatcatgtggccacccacagttgtaacagaggagaacaactatgggtggccacaacctggcggcagcgcaaaagatg

SEQ ID NO: 209658 - DNA, 103 bp, Artificial Sequence
  Synthetic Polynucleotide
taatacgactcactatagggcatgcgggctagggtacatcatgtggccacaacagaggagagtggccatgtgatgtaccaacctggcggcagcgcaaaagatg

SEQ ID NO: 209659 - DNA, 103 bp, Artificial Sequence
  Synthetic Polynucleotide
taatacgactcactatagggtacatcaccgcatgcgggctagggtacatcaacagaggagagatgtaatgtagcccgcaaacctggcggcagcgcaaaagatg

SEQ ID NO: 209660 - DNA, 103 bp, Artificial Sequence
  Synthetic Polynucleotide
taatacgactcactatagggggtgggggcatacatcaccgcatgcgggctaacagaggagaagcccgatggcggtgatgaacctggcggcagcgcaaaagatg

SEQ ID NO: 209661 - DNA, 103 bp, Artificial Sequence
  Synthetic Polynucleotide
taatacgactcactatagggccaggcccgaggtgggggcatacatcaccgaacagaggagacggtgaatgatgcccccaaacctggcggcagcgcaaaagatg

SEQ ID NO: 209662 - DNA, 103 bp, Artificial Sequence
  Synthetic Polynucleotide
taatacgactcactatagggctgccatcacccaggcccgaggtgggggcaaacagaggagatgccccatgctcgggcctaacctggcggcagcgcaaaagatg

SEQ ID NO: 209663 - DNA, 103 bp, Artificial Sequence
  Synthetic Polynucleotide
taatacgactcactatagggcacggtgaggctgccatcacccaggcccgaaacagaggagatcgggcatgggtgatggcaacctggcggcagcgcaaaagatg

SEQ ID NO: 209664 - DNA, 103 bp, Artificial Sequence
  Synthetic Polynucleotide
taatacgactcactatagggaggcattcagcacggtgaggctgccatcacaacagaggagagtgatgatggcctcaccgaacctggcggcagcgcaaaagatg

SEQ ID NO: 209665 - DNA, 103 bp, Artificial Sequence
  Synthetic Polynucleotide
taatacgactcactataggggcctgggagaaggcattcagcacggtgaggaacagaggagacctcacatggctgaatgcaacctggcggcagcgcaaaagatg

SEQ ID NO: 209666 - DNA, 103 bp, Artificial Sequence
  Synthetic Polynucleotide
taatacgactcactatagggccccgcgccattcccggggacccggcccccaacagaggagagggggcatggtccccgggaacctggcggcagcgcaaaagatg

SEQ ID NO: 209667 - DNA, 103 bp, Artificial Sequence
  Synthetic Polynucleotide
taatacgactcactatagggggtggatggtgcctgggagaaggcattcagaacagaggagactgaatatgttctcccagaacctggcggcagcgcaaaagatg

SEQ ID NO: 209668 - DNA, 103 bp, Artificial Sequence
  Synthetic Polynucleotide
taatacgactcactatagggacacctgcatggtggatggtgcctgggagaaacagaggagatctcccatgcaccatccaaacctggcggcagcgcaaaagatg

SEQ ID NO: 209669 - DNA, 103 bp, Artificial Sequence
  Synthetic Polynucleotide
taatacgactcactatagggtggctgtgtgacacctgcatggtggatggtaacagaggagaaccatcatgcatgcaggtaacctggcggcagcgcaaaagatg

SEQ ID NO: 209670 - DNA, 103 bp, Artificial Sequence
  Synthetic Polynucleotide
taatacgactcactatagggctcctggacctggctgtgtgacacctgcataacagaggagaatgcagatgtcacacagcaacctggcggcagcgcaaaagatg

SEQ ID NO: 209671 - DNA, 103 bp, Artificial Sequence
  Synthetic Polynucleotide
taatacgactcactatagggcgccacctggctcctggacctggctgtgtgaacagaggagacacacaatgaggtccaggaacctggcggcagcgcaaaagatg

SEQ ID NO: 209672 - DNA, 103 bp, Artificial Sequence
  Synthetic Polynucleotide
taatacgactcactatagggacctgggggacgccacctggctcctggaccaacagaggagaggtccaatggccaggtggaacctggcggcagcgcaaaagatg

SEQ ID NO: 209673 - DNA, 103 bp, Artificial Sequence
  Synthetic Polynucleotide
taatacgactcactatagggtgtcaggaacacctgggggacgccacctggaacagaggagaccaggtatggtcccccagaacctggcggcagcgcaaaagatg

SEQ ID NO: 209674 - DNA, 103 bp, Artificial Sequence
  Synthetic Polynucleotide
taatacgactcactatagggcagatgatgctgtcaggaacacctgggggaaacagaggagatcccccatgtgttcctgaaacctggcggcagcgcaaaagatg

SEQ ID NO: 209675 - DNA, 103 bp, Artificial Sequence
  Synthetic Polynucleotide
taatacgactcactatagggtgcactgtcccagatgatgctgtcaggaacaacagaggagagttcctatgagcatcatcaacctggcggcagcgcaaaagatg

SEQ ID NO: 209676 - DNA, 103 bp, Artificial Sequence
  Synthetic Polynucleotide
taatacgactcactatagggaacagggatctgcactgtcccagatgatgcaacagaggagagcatcaatggggacagtgaacctggcggcagcgcaaaagatg

SEQ ID NO: 209677 - DNA, 103 bp, Artificial Sequence
  Synthetic Polynucleotide
taatacgactcactatagggcgggcccgagccccgcgccattcccggggaaacagaggagatccccgatgatggcgcggaacctggcggcagcgcaaaagatg

SEQ ID NO: 209678 - DNA, 103 bp, Artificial Sequence
  Synthetic Polynucleotide
taatacgactcactataggggaactgctgaaacagggatctgcactgtccaacagaggagaggacagatgagatccctgaacctggcggcagcgcaaaagatg

SEQ ID NO: 209679 - DNA, 103 bp, Artificial Sequence
  Synthetic Polynucleotide
taatacgactcactatagggtggtggagctgaactgctgaaacagggatcaacagaggagagatcccatgttcagcagtaacctggcggcagcgcaaaagatg

SEQ ID NO: 209680 - DNA, 103 bp, Artificial Sequence
  Synthetic Polynucleotide
taatacgactcactatagggcacagccatctggtggagctgaactgctgaaacagaggagatcagcaatgcagctccacaacctggcggcagcgcaaaagatg

SEQ ID NO: 209681 - DNA, 103 bp, Artificial Sequence
  Synthetic Polynucleotide
taatacgactcactataggggctgccctatcacagccatctggtggagctaacagaggagaagctccatgagatggctgaacctggcggcagcgcaaaagatg

SEQ ID NO: 209682 - DNA, 103 bp, Artificial Sequence
  Synthetic Polynucleotide
taatacgactcactatagggctcccggcctgctgccctatcacagccatcaacagaggagagatggcatggatagggcaaacctggcggcagcgcaaaagatg

SEQ ID NO: 209683 - DNA, 103 bp, Artificial Sequence
  Synthetic Polynucleotide
taatacgactcactataggggttgctgctgctcccggcctgctgccctataacagaggagaatagggatgcaggccgggaacctggcggcagcgcaaaagatg

SEQ ID NO: 209684 - DNA, 103 bp, Artificial Sequence
  Synthetic Polynucleotide
taatacgactcactataggggctcggtgaggttgctgctgctcccggcctaacagaggagaaggccgatggcagcagcaaacctggcggcagcgcaaaagatg

SEQ ID NO: 209685 - DNA, 103 bp, Artificial Sequence
  Synthetic Polynucleotide
taatacgactcactatagggaccacctgtagctcggtgaggttgctgctgaacagaggagacagcagatgcctcaccgaaacctggcggcagcgcaaaagatg

SEQ ID NO: 209686 - DNA, 103 bp, Artificial Sequence
  Synthetic Polynucleotide
taatacgactcactataggggtccaggttcaccacctgtagctcggtgagaacagaggagactcaccatgctacaggtgaacctggcggcagcgcaaaagatg

SEQ ID NO: 209687 - DNA, 103 bp, Artificial Sequence
  Synthetic Polynucleotide
taatacgactcactatagggtgtgggcggtgtccaggttcaccacctgtaaacagaggagatacaggatgtgaacctggaacctggcggcagcgcaaaagatg

SEQ ID NO: 209688 - DNA, 103 bp, Artificial Sequence
  Synthetic Polynucleotide
taatacgactcactatagggtccaggcggccgggcccgagccccgcgccaaacagaggagatggcgcatggctcgggccaacctggcggcagcgcaaaagatg

SEQ ID NO: 209689 - DNA, 103 bp, Artificial Sequence
  Synthetic Polynucleotide
taatacgactcactatagggctcttggtgctgtgggcggtgtccaggttcaacagaggagagaacctatgcaccgcccaaacctggcggcagcgcaaaagatg

SEQ ID NO: 209690 - DNA, 103 bp, Artificial Sequence
  Synthetic Polynucleotide
taatacgactcactatagggagcctcccgctccaggcggccgggcccgagaacagaggagactcgggatgggccgcctgaacctggcggcagcgcaaaagatg

SEQ ID NO: 209691 - DNA, 103 bp, Artificial Sequence
  Synthetic Polynucleotide
taatacgactcactatagggccgctgccgcagcctcccgctccaggcggcaacagaggagagccgccatgagcgggaggaacctggcggcagcgcaaaagatg

SEQ ID NO: 209692 - DNA, 103 bp, Artificial Sequence
  Synthetic Polynucleotide
taatacgactcactataggggtggttgccgccgctgccgcagcctcccgcaacagaggagagcgggaatgtgcggcagcaacctggcggcagcgcaaaagatg

SEQ ID NO: 209693 - DNA, 103 bp, Artificial Sequence
  Synthetic Polynucleotide
taatacgactcactataggggggcgccggggtggttgccgccgctgccgcaacagaggagagcggcaatggcggcaaccaacctggcggcagcgcaaaagatg

SEQ ID NO: 209694 - DNA, 103 bp, Artificial Sequence
  Synthetic Polynucleotide
taatacgactcactatagggggcccagagccgccgcggccccagcttgggaacagaggagacccaagatggggccgcggaacctggcggcagcgcaaaagatg

SEQ ID NO: 209695 - DNA, 103 bp, Artificial Sequence
  Synthetic Polynucleotide
taatacgactcactatagggcccccgcggtgggcgccggggtggttgccgaacagaggagacggcaaatgccccggcgcaacctggcggcagcgcaaaagatg

SEQ ID NO: 209696 - DNA, 103 bp, Artificial Sequence
  Synthetic Polynucleotide
taatacgactcactatagggctgtagagggcccccgcggtgggcgccgggaacagaggagacccggcatgcaccgcgggaacctggcggcagcgcaaaagatg

SEQ ID NO: 209697 - DNA, 103 bp, Artificial Sequence
  Synthetic Polynucleotide
taatacgactcactatagggctcgctgccgctgtagagggcccccgcggtaacagaggagaaccgcgatggccctctacaacctggcggcagcgcaaaagatg

SEQ ID NO: 209698 - DNA, 103 bp, Artificial Sequence
  Synthetic Polynucleotide
taatacgactcactatagggccgagtcgccctcgctgccgctgtagagggaacagaggagaccctctatggcggcagcgaacctggcggcagcgcaaaagatg

SEQ ID NO: 209699 - DNA, 103 bp, Artificial Sequence
  Synthetic Polynucleotide
taatacgactcactatagggtcgcccgactccgagtcgccctcgctgccgaacagaggagacggcagatggggcgactcaacctggcggcagcgcaaaagatg

SEQ ID NO: 209700 - DNA, 103 bp, Artificial Sequence
  Synthetic Polynucleotide
taatacgactcactatagggctcctcctcctcgcccgactccgagtcgccaacagaggagaggcgacatggagtcgggcaacctggcggcagcgcaaaagatg

SEQ ID NO: 209701 - DNA, 103 bp, Artificial Sequence
  Synthetic Polynucleotide
taatacgactcactatagggcggcgcccagctcctcctcctcgcccgactaacagaggagaagtcggatgaggaggaggaacctggcggcagcgcaaaagatg

SEQ ID NO: 209702 - DNA, 103 bp, Artificial Sequence
  Synthetic Polynucleotide
taatacgactcactatagggccgcgccgctcggcgcccagctcctcctccaacagaggagaggaggaatggctgggcgcaacctggcggcagcgcaaaagatg

SEQ ID NO: 209703 - DNA, 103 bp, Artificial Sequence
  Synthetic Polynucleotide
taatacgactcactatagggccgcttcaggccgcgccgctcggcgcccagaacagaggagactgggcatggagcggcgcaacctggcggcagcgcaaaagatg

SEQ ID NO: 209704 - DNA, 103 bp, Artificial Sequence
  Synthetic Polynucleotide
taatacgactcactatagggcgctcaggctccgcttcaggccgcgccgctaacagaggagaagcggcatggcctgaagcaacctggcggcagcgcaaaagatg

SEQ ID NO: 209705 - DNA, 103 bp, Artificial Sequence
  Synthetic Polynucleotide
taatacgactcactataggggccgagccccggcccagagccgccgcggccaacagaggagaggccgcatgggctctgggaacctggcggcagcgcaaaagatg

SEQ ID NO: 209706 - DNA, 103 bp, Artificial Sequence
  Synthetic Polynucleotide
taatacgactcactatagggatctccatctcgctcaggctccgcttcaggaacagaggagacctgaaatggagcctgagaacctggcggcagcgcaaaagatg

SEQ ID NO: 209707 - DNA, 103 bp, Artificial Sequence
  Synthetic Polynucleotide
taatacgactcactatagggcaccataccgatctccatctcgctcaggctaacagaggagaagcctgatggagatggagaacctggcggcagcgcaaaagatg

SEQ ID NO: 209708 - DNA, 103 bp, Artificial Sequence
  Synthetic Polynucleotide
taatacgactcactataggggcccaccgaccaccataccgatctccatctaacagaggagaagatggatgtcggtatggaacctggcggcagcgcaaaagatg

SEQ ID NO: 209709 - DNA, 103 bp, Artificial Sequence
  Synthetic Polynucleotide
taatacgactcactataggggacgcctcgggcccaccgaccaccataccgaacagaggagacggtatatgggtcggtggaacctggcggcagcgcaaaagatg

SEQ ID NO: 209710 - DNA, 103 bp, Artificial Sequence
  Synthetic Polynucleotide
taatacgactcactatagggggccgctgccgacgcctcgggcccaccgacaacagaggagagtcggtatgcccgaggcgaacctggcggcagcgcaaaagatg

SEQ ID NO: 209711 - DNA, 103 bp, Artificial Sequence
  Synthetic Polynucleotide
taatacgactcactatagggagcccccggtggccgctgccgacgcctcggaacagaggagaccgaggatgcggcagcggaacctggcggcagcgcaaaagatg

SEQ ID NO: 209712 - DNA, 103 bp, Artificial Sequence
  Synthetic Polynucleotide
taatacgactcactatagggaccggcccgtagcccccggtggccgctgccaacagaggagaggcagcatgcaccgggggaacctggcggcagcgcaaaagatg

SEQ ID NO: 209713 - DNA, 103 bp, Artificial Sequence
  Synthetic Polynucleotide
taatacgactcactatagggcgcgccgctcaccggcccgtagcccccggtaacagaggagaaccgggatgtacgggccgaacctggcggcagcgcaaaagatg

SEQ ID NO: 209714 - DNA, 103 bp, Artificial Sequence
  Synthetic Polynucleotide
taatacgactcactatagggccccgctcaccgcgccgctcaccggcccgtaacagaggagaacgggcatgtgagcggcgaacctggcggcagcgcaaaagatg

SEQ ID NO: 209715 - DNA, 103 bp, Artificial Sequence
  Synthetic Polynucleotide
taatacgactcactatagggcccggcttggccccgctcaccgcgccgctcaacagaggagagagcggatgggtgagcggaacctggcggcagcgcaaaagatg

SEQ ID NO: 209716 - DNA, 103 bp, Artificial Sequence
  Synthetic Polynucleotide
taatacgactcactataggggccccccagggccgagccccggcccagagcaacagaggagagctctgatgcggggctcgaacctggcggcagcgcaaaagatg

SEQ ID NO: 209717 - DNA, 103 bp, Artificial Sequence
  Synthetic Polynucleotide
taatacgactcactatagggggtcttcttacccggcttggccccgctcacaacagaggagagtgagcatggccaagccgaacctggcggcagcgcaaaagatg

SEQ ID NO: 209718 - DNA, 103 bp, Artificial Sequence
  Synthetic Polynucleotide
taatacgactcactatagggcgcggccccgggtcttcttacccggcttggaacagaggagaccaagcatggtaagaagaaacctggcggcagcgcaaaagatg

SEQ ID NO: 209719 - DNA, 103 bp, Artificial Sequence
  Synthetic Polynucleotide
taatacgactcactatagggttgatcttcacgcggccccgggtcttcttaaacagaggagataagaaatgccggggccgaacctggcggcagcgcaaaagatg

SEQ ID NO: 209720 - DNA, 103 bp, Artificial Sequence
  Synthetic Polynucleotide
taatacgactcactataggggaactccatcttgatcttcacgcggccccgaacagaggagacggggcatggtgaagatcaacctggcggcagcgcaaaagatg

SEQ ID NO: 209721 - DNA, 103 bp, Artificial Sequence
  Synthetic Polynucleotide
taatacgactcactatagggtgttgtcgatgaactccatcttgatcttcaaacagaggagatgaagaatgagatggagtaacctggcggcagcgcaaaagatg

SEQ ID NO: 209722 - DNA, 103 bp, Artificial Sequence
  Synthetic Polynucleotide
taatacgactcactatagggcgccgcagcttgttgtcgatgaactccatcaacagaggagagatggaatgcatcgacaaaacctggcggcagcgcaaaagatg

SEQ ID NO: 209723 - DNA, 103 bp, Artificial Sequence
  Synthetic Polynucleotide
taatacgactcactatagggggtcgtgtagcgccgcagcttgttgtcgataacagaggagaatcgacatgaagctgcggaacctggcggcagcgcaaaagatg

SEQ ID NO: 209724 - DNA, 103 bp, Artificial Sequence
  Synthetic Polynucleotide
taatacgactcactatagggtcttgctgaaggtcgtgtagcgccgcagctaacagaggagaagctgcatggctacacgaaacctggcggcagcgcaaaagatg

SEQ ID NO: 209725 - DNA, 103 bp, Artificial Sequence
  Synthetic Polynucleotide
taatacgactcactatagggcccgtcttcctcttgctgaaggtcgtgtagaacagaggagactacacatgcttcagcaaaacctggcggcagcgcaaaagatg

SEQ ID NO: 209726 - DNA, 103 bp, Artificial Sequence
  Synthetic Polynucleotide
taatacgactcactatagggcttcatgatgcccgtcttcctcttgctgaaaacagaggagattcagcatgaggaagacgaacctggcggcagcgcaaaagatg

SEQ ID NO: 209727 - DNA, 103 bp, Artificial Sequence
  Synthetic Polynucleotide
taatacgactcactatagggggttcaggctgccccccagggccgagccccaacagaggagaggggctatgccctgggggaacctggcggcagcgcaaaagatg

SEQ ID NO: 209728 - DNA, 103 bp, Artificial Sequence
  Synthetic Polynucleotide
taatacgactcactatagggcataggccttcttcatgatgcccgtcttccaacagaggagaggaagaatggcatcatgaaacctggcggcagcgcaaaagatg

SEQ ID NO: 209729 - DNA, 103 bp, Artificial Sequence
  Synthetic Polynucleotide
taatacgactcactataggggtggacagctcataggccttcttcatgatgaacagaggagacatcatatggaaggcctaaacctggcggcagcgcaaaagatg

SEQ ID NO: 209730 - DNA, 103 bp, Artificial Sequence
  Synthetic Polynucleotide
taatacgactcactatagggccctgtcagcgtggacagctcataggccttaacagaggagaaaggccatggagctgtccaacctggcggcagcgcaaaagatg

SEQ ID NO: 209731 - DNA, 103 bp, Artificial Sequence
  Synthetic Polynucleotide
taatacgactcactataggggcacctgtgtccctgtcagcgtggacagctaacagaggagaagctgtatgcgctgacagaacctggcggcagcgcaaaagatg

SEQ ID NO: 209732 - DNA, 103 bp, Artificial Sequence
  Synthetic Polynucleotide
taatacgactcactatagggaccagcaacagcacctgtgtccctgtcagcaacagaggagagctgacatggacacaggtaacctggcggcagcgcaaaagatg

SEQ ID NO: 209733 - DNA, 103 bp, Artificial Sequence
  Synthetic Polynucleotide
taatacgactcactatagggctcactggccaccagcaacagcacctgtgtaacagaggagaacacagatgctgttgctgaacctggcggcagcgcaaaagatg

SEQ ID NO: 209734 - DNA, 103 bp, Artificial Sequence
  Synthetic Polynucleotide
taatacgactcactatagggcatggcctgtctcactggccaccagcaacaaacagaggagatgttgcatgtggccagtgaacctggcggcagcgcaaaagatg

SEQ ID NO: 209735 - DNA, 103 bp, Artificial Sequence
  Synthetic Polynucleotide
taatacgactcactatagggaaggtatacacatggcctgtctcactggccaacagaggagaggccagatggacaggccaaacctggcggcagcgcaaaagatg

SEQ ID NO: 209736 - DNA, 103 bp, Artificial Sequence
  Synthetic Polynucleotide
taatacgactcactatagggtcgggtggcaaaggtatacacatggcctgtaacagaggagaacaggcatggtgtataccaacctggcggcagcgcaaaagatg

SEQ ID NO: 209737 - DNA, 103 bp, Artificial Sequence
  Synthetic Polynucleotide
taatacgactcactataggggctgcagttttcgggtggcaaaggtatacaaacagaggagatgtataatgttgccacccaacctggcggcagcgcaaaagatg

SEQ ID NO: 209738 - DNA, 103 bp, Artificial Sequence
  Synthetic Polynucleotide
taatacgactcactataggggtcggggtccggttcaggctgccccccaggaacagaggagacctgggatgcagcctgaaaacctggcggcagcgcaaaagatg

SEQ ID NO: 209739 - DNA, 103 bp, Artificial Sequence
  Synthetic Polynucleotide
taatacgactcactataggggtgatcatgggctgcagttttcgggtggcaaacagaggagatgccacatgaaaactgcaaacctggcggcagcgcaaaagatg

SEQ ID NO: 209740 - DNA, 103 bp, Artificial Sequence
  Synthetic Polynucleotide
taatacgactcactatagggggtctcactggtgatcatgggctgcagtttaacagaggagaaaactgatgcccatgatcaacctggcggcagcgcaaaagatg

SEQ ID NO: 209741 - DNA, 103 bp, Artificial Sequence
  Synthetic Polynucleotide
taatacgactcactataggggtgccttgccggtctcactggtgatcatggaacagaggagaccatgaatgccagtgagaaacctggcggcagcgcaaaagatg

SEQ ID NO: 209742 - DNA, 103 bp, Artificial Sequence
  Synthetic Polynucleotide
taatacgactcactataggggtctgaatcagtgccttgccggtctcactgaacagaggagacagtgaatgcggcaaggcaacctggcggcagcgcaaaagatg

SEQ ID NO: 209743 - DNA, 103 bp, Artificial Sequence
  Synthetic Polynucleotide
taatacgactcactataggggttgaggcaggtctgaatcagtgccttgccaacagaggagaggcaagatgctgattcagaacctggcggcagcgcaaaagatg

SEQ ID NO: 209744 - DNA, 103 bp, Artificial Sequence
  Synthetic Polynucleotide
taatacgactcactatagggagtctggcgagttgaggcaggtctgaatcaaacagaggagatgattcatgcctgcctcaaacctggcggcagcgcaaaagatg

SEQ ID NO: 209745 - DNA, 103 bp, Artificial Sequence
  Synthetic Polynucleotide
taatacgactcactatagggcggggtggagagtctggcgagttgaggcagaacagaggagactgcctatgctcgccagaaacctggcggcagcgcaaaagatg

SEQ ID NO: 209746 - DNA, 103 bp, Artificial Sequence
  Synthetic Polynucleotide
taatacgactcactatagggggggtctgaacggggtggagagtctggcgaaacagaggagatcgccaatgtctccacccaacctggcggcagcgcaaaagatg

SEQ ID NO: 209747 - DNA, 103 bp, Artificial Sequence
  Synthetic Polynucleotide
taatacgactcactatagggggtctgttgtggggtctgaacggggtggagaacagaggagactccacatggttcagaccaacctggcggcagcgcaaaagatg

SEQ ID NO: 209748 - DNA, 103 bp, Artificial Sequence
  Synthetic Polynucleotide
taatacgactcactatagggctcattctctggtctgttgtggggtctgaaaacagaggagattcagaatgcacaacagaaacctggcggcagcgcaaaagatg

SEQ ID NO: 209749 - DNA, 103 bp, Artificial Sequence
  Synthetic Polynucleotide
taatacgactcactatagggcggccgccccgtcggggtccggttcaggctaacagaggagaagcctgatgcggaccccgaacctggcggcagcgcaaaagatg

SEQ ID NO: 209750 - DNA, 103 bp, Artificial Sequence
  Synthetic Polynucleotide
taatacgactcactataggggccagtggcactcattctctggtctgttgtaacagaggagaacaacaatgcagagaatgaacctggcggcagcgcaaaagatg

SEQ ID NO: 209751 - DNA, 103 bp, Artificial Sequence
  Synthetic Polynucleotide
taatacgactcactatagggtctcttcaaagccagtggcactcattctctaacagaggagaagagaaatggtgccactgaacctggcggcagcgcaaaagatg

SEQ ID NO: 209752 - DNA, 103 bp, Artificial Sequence
  Synthetic Polynucleotide
taatacgactcactataggggtgagatctgtctcttcaaagccagtggcaaacagaggagatgccacatgctttgaagaaacctggcggcagcgcaaaagatg

SEQ ID NO: 209753 - DNA, 103 bp, Artificial Sequence
  Synthetic Polynucleotide
taatacgactcactatagggcacctggtaggtgagatctgtctcttcaaaaacagaggagatttgaaatgacagatctcaacctggcggcagcgcaaaagatg

SEQ ID NO: 209754 - DNA, 103 bp, Artificial Sequence
  Synthetic Polynucleotide
taatacgactcactatagggcagactccgacacctggtaggtgagatctgaacagaggagacagatcatgcctaccaggaacctggcggcagcgcaaaagatg

SEQ ID NO: 209755 - DNA, 103 bp, Artificial Sequence
  Synthetic Polynucleotide
taatacgactcactatagggccactgctgtcagactccgacacctggtagaacagaggagactaccaatggtcggagtcaacctggcggcagcgcaaaagatg

SEQ ID NO: 209756 - DNA, 103 bp, Artificial Sequence
  Synthetic Polynucleotide
taatacgactcactatagggcttggtctccccactgctgtcagactccgaaacagaggagatcggagatggacagcagtaacctggcggcagcgcaaaagatg

SEQ ID NO: 209757 - DNA, 103 bp, Artificial Sequence
  Synthetic Polynucleotide
taatacgactcactatagggtcagtgtgtccttggtctccccactgctgtaacagaggagaacagcaatggggagaccaaacctggcggcagcgcaaaagatg

SEQ ID NO: 209758 - DNA, 103 bp, Artificial Sequence
  Synthetic Polynucleotide
taatacgactcactatagggaacgccggcttcagtgtgtccttggtctccaacagaggagaggagacatgggacacactaacctggcggcagcgcaaaagatg

SEQ ID NO: 209759 - DNA, 103 bp, Artificial Sequence
  Synthetic Polynucleotide
taatacgactcactatagggggtgactgtgaacgccggcttcagtgtgtcaacagaggagagacacaatgaagccggcgaacctggcggcagcgcaaaagatg

SEQ ID NO: 209760 - DNA, 103 bp, Artificial Sequence
  Synthetic Polynucleotide
taatacgactcactatagggcgccgccgcccggccgccccgtcggggtccaacagaggagaggacccatgcggggcggcaacctggcggcagcgcaaaagatg

SEQ ID NO: 209761 - DNA, 103 bp, Artificial Sequence
  Synthetic Polynucleotide
taatacgactcactatagggccggcaggttggtgactgtgaacgccggctaacagaggagaagccggatgtcacagtcaaacctggcggcagcgcaaaagatg

SEQ ID NO: 209762 - DNA, 103 bp, Artificial Sequence
  Synthetic Polynucleotide
taatacgactcactataggggaggttgtacccggcaggttggtgactgtgaacagaggagacacagtatgcaacctgccaacctggcggcagcgcaaaagatg

SEQ ID NO: 209763 - DNA, 103 bp, Artificial Sequence
  Synthetic Polynucleotide
taatacgactcactatagggttggatggtggaggttgtacccggcaggttaacagaggagaaacctgatgggtacaaccaacctggcggcagcgcaaaagatg

SEQ ID NO: 209764 - DNA, 103 bp, Artificial Sequence
  Synthetic Polynucleotide
taatacgactcactatagggtaggtgctgtttggatggtggaggttgtacaacagaggagagtacaaatgccaccatccaacctggcggcagcgcaaaagatg

SEQ ID NO: 209765 - DNA, 103 bp, Artificial Sequence
  Synthetic Polynucleotide
taatacgactcactataggggtagaggtgctaggtgctgtttggatggtgaacagaggagacaccatatgaacagcaccaacctggcggcagcgcaaaagatg

SEQ ID NO: 209766 - DNA, 103 bp, Artificial Sequence
  Synthetic Polynucleotide
taatacgactcactatagggttgcatggtggtagaggtgctaggtgctgtaacagaggagaacagcaatgagcacctctaacctggcggcagcgcaaaagatg

SEQ ID NO: 209767 - DNA, 103 bp, Artificial Sequence
  Synthetic Polynucleotide
taatacgactcactatagggcgctgctgacttgcatggtggtagaggtgcaacagaggagagcacctatgccaccatgcaacctggcggcagcgcaaaagatg

SEQ ID NO: 209768 - DNA, 103 bp, Artificial Sequence
  Synthetic Polynucleotide
taatacgactcactatagggaaggaggggccgctgctgacttgcatggtgaacagaggagacaccatatgagtcagcagaacctggcggcagcgcaaaagatg

SEQ ID NO: 209769 - DNA, 103 bp, Artificial Sequence
  Synthetic Polynucleotide
taatacgactcactatagggggtgatgggaaaggaggggccgctgctgacaacagaggagagtcagcatgggcccctccaacctggcggcagcgcaaaagatg

SEQ ID NO: 209770 - DNA, 103 bp, Artificial Sequence
  Synthetic Polynucleotide
taatacgactcactatagggccaggtagttggtgatgggaaaggaggggcaacagaggagagcccctatgttcccatcaaacctggcggcagcgcaaaagatg

SEQ ID NO: 209771 - DNA, 103 bp, Artificial Sequence
  Synthetic Polynucleotide
taatacgactcactatagggcgtgtcccgccgccgccgcccggccgccccaacagaggagaggggcgatggggcggcggaacctggcggcagcgcaaaagatg

SEQ ID NO: 209772 - DNA, 103 bp, Artificial Sequence
  Synthetic Polynucleotide
taatacgactcactataggggacactggtgccaggtagttggtgatgggaaacagaggagatcccatatgcaactacctaacctggcggcagcgcaaaagatg

SEQ ID NO: 209773 - DNA, 103 bp, Artificial Sequence
  Synthetic Polynucleotide
taatacgactcactataggggacactagcagacactggtgccaggtagttaacagaggagaaactacatggcaccagtgaacctggcggcagcgcaaaagatg

SEQ ID NO: 209774 - DNA, 103 bp, Artificial Sequence
  Synthetic Polynucleotide
taatacgactcactatagggcactggggctgacactagcagacactggtgaacagaggagacaccagatgctgctagtgaacctggcggcagcgcaaaagatg

SEQ ID NO: 209775 - DNA, 103 bp, Artificial Sequence
  Synthetic Polynucleotide
taatacgactcactatagggctgctgacagcactggggctgacactagcaaacagaggagatgctagatgcagccccagaacctggcggcagcgcaaaagatg

SEQ ID NO: 209776 - DNA, 103 bp, Artificial Sequence
  Synthetic Polynucleotide
taatacgactcactatagggcccattggcactgctgacagcactggggctaacagaggagaagccccatggctgtcagcaacctggcggcagcgcaaaagatg

SEQ ID NO: 209777 - DNA, 103 bp, Artificial Sequence
  Synthetic Polynucleotide
taatacgactcactatagggtcagcacagtcccattggcactgctgacagaacagaggagactgtcaatggtgccaatgaacctggcggcagcgcaaaagatg

SEQ ID NO: 209778 - DNA, 103 bp, Artificial Sequence
  Synthetic Polynucleotide
taatacgactcactatagggcctgtactcttcagcacagtcccattggcaaacagaggagatgccaaatggactgtgctaacctggcggcagcgcaaaagatg

SEQ ID NO: 209779 - DNA, 103 bp, Artificial Sequence
  Synthetic Polynucleotide
taatacgactcactatagggagggccgctgcctgtactcttcagcacagtaacagaggagaactgtgatgaagagtacaaacctggcggcagcgcaaaagatg

SEQ ID NO: 209780 - DNA, 103 bp, Artificial Sequence
  Synthetic Polynucleotide
taatacgactcactatagggcagaggagacagggccgctgcctgtactctaacagaggagaagagtaatggcagcggccaacctggcggcagcgcaaaagatg

SEQ ID NO: 209781 - DNA, 103 bp, Artificial Sequence
  Synthetic Polynucleotide
taatacgactcactatagggataaggcccccagaggagacagggccgctgaacagaggagacagcggatgtgtctcctcaacctggcggcagcgcaaaagatg

SEQ ID NO: 209782 - DNA, 103 bp, Artificial Sequence
  Synthetic Polynucleotide
taatacgactcactataggggctgctgttactcttgcctttgccgtacataacagaggagaatgtacatgaaaggcaagaacctggcggcagcgcaaaagatg

SEQ ID NO: 209783 - DNA, 103 bp, Artificial Sequence
  Synthetic Polynucleotide
taatacgactcactatagggttgagctgatttctgagctcctacatggagaacagaggagactccatatgggagctcagaacctggcggcagcgcaaaagatg

SEQ ID NO: 209784 - DNA, 103 bp, Artificial Sequence
  Synthetic Polynucleotide
taatacgactcactatagggcatttcgccatcatcccttggagtgcccggaacagaggagaccgggcatgccaagggataacctggcggcagcgcaaaagatg

SEQ ID NO: 209785 - DNA, 103 bp, Artificial Sequence
  Synthetic Polynucleotide
taatacgactcactatagggaatttccccccatttcgccatcatcccttgaacagaggagacaagggatgatggcgaaaaacctggcggcagcgcaaaagatg

SEQ ID NO: 209786 - DNA, 103 bp, Artificial Sequence
  Synthetic Polynucleotide
taatacgactcactatagggggatttaagaaatttccccccatttcgccaaacagaggagatggcgaatgggggggaaaaacctggcggcagcgcaaaagatg

SEQ ID NO: 209787 - DNA, 103 bp, Artificial Sequence
  Synthetic Polynucleotide
taatacgactcactatagggactctgaaaaggatttaagaaatttcccccaacagaggagagggggaatgttcttaaataacctggcggcagcgcaaaagatg

SEQ ID NO: 209788 - DNA, 103 bp, Artificial Sequence
  Synthetic Polynucleotide
taatacgactcactatagggagtaactctcactctgaaaaggatttaagaaacagaggagatcttaaatgcttttcagaaacctggcggcagcgcaaaagatg

SEQ ID NO: 209789 - DNA, 103 bp, Artificial Sequence
  Synthetic Polynucleotide
taatacgactcactatagggatgctaggggagtaactctcactctgaaaaaacagaggagattttcaatgtgagagttaaacctggcggcagcgcaaaagatg

SEQ ID NO: 209790 - DNA, 103 bp, Artificial Sequence
  Synthetic Polynucleotide
taatacgactcactataggggctcattgtcatgctaggggagtaactctcaacagaggagagagagtatgtcccctagcaacctggcggcagcgcaaaagatg

SEQ ID NO: 209791 - DNA, 103 bp, Artificial Sequence
  Synthetic Polynucleotide
taatacgactcactatagggataaaaatgtttgagctgatttctgagctcaacagaggagagagctcatgaatcagctcaacctggcggcagcgcaaaagatg

SEQ ID NO: 209792 - DNA, 103 bp, Artificial Sequence
  Synthetic Polynucleotide
taatacgactcactatagggcttatctctgataaaaatgtttgagctgataacagaggagaatcagcatgaacatttttaacctggcggcagcgcaaaagatg

SEQ ID NO: 209793 - DNA, 103 bp, Artificial Sequence
  Synthetic Polynucleotide
taatacgactcactatagggtttttcccatcttatctctgataaaaatgtaacagaggagaacatttatgtcagagataaacctggcggcagcgcaaaagatg

SEQ ID NO: 209794 - DNA, 103 bp, Artificial Sequence
  Synthetic Polynucleotide
taatacgactcactatagggatgtgatgtttttttcccatcttatctctgaacagaggagacagagaatggatgggaaaaacctggcggcagcgcaaaagatg

SEQ ID NO: 209795 - DNA, 103 bp, Artificial Sequence
  Synthetic Polynucleotide
taatacgactcactatagggggttcccccaatgtgatgtttttttcccataacagaggagaatgggaatgaaacatcacaacctggcggcagcgcaaaagatg

SEQ ID NO: 209796 - DNA, 103 bp, Artificial Sequence
  Synthetic Polynucleotide
taatacgactcactataggggaatcctggtggttcccccaatgtgatgttaacagaggagaaacatcatgttgggggaaaacctggcggcagcgcaaaagatg

SEQ ID NO: 209797 - DNA, 103 bp, Artificial Sequence
  Synthetic Polynucleotide
taatacgactcactatagggaagaatgtaagaatcctggtggttcccccaaacagaggagatgggggatgcaccaggataacctggcggcagcgcaaaagatg

SEQ ID NO: 209798 - DNA, 103 bp, Artificial Sequence
  Synthetic Polynucleotide
taatacgactcactatagggacacaccaccaagaatgtaagaatcctggtaacagaggagaaccaggatgcttacattcaacctggcggcagcgcaaaagatg

SEQ ID NO: 209799 - DNA, 103 bp, Artificial Sequence
  Synthetic Polynucleotide
taatacgactcactatagggatcccaaaatacacaccaccaagaatgtaaaacagaggagattacatatgtggtggtgtaacctggcggcagcgcaaaagatg

SEQ ID NO: 209800 - DNA, 103 bp, Artificial Sequence
  Synthetic Polynucleotide
taatacgactcactatagggacgggacggcgctgctgttactcttgccttaacagaggagaaaggcaatggtaacagcaaacctggcggcagcgcaaaagatg

SEQ ID NO: 209801 - DNA, 103 bp, Artificial Sequence
  Synthetic Polynucleotide
taatacgactcactatagggcacagtagagatcccaaaatacacaccaccaacagaggagaggtggtatgtattttgggaacctggcggcagcgcaaaagatg

SEQ ID NO: 209802 - DNA, 103 bp, Artificial Sequence
  Synthetic Polynucleotide
taatacgactcactatagggtctggagctgcacagtagagatcccaaaataacagaggagaattttgatgtctctactgaacctggcggcagcgcaaaagatg

SEQ ID NO: 209803 - DNA, 103 bp, Artificial Sequence
  Synthetic Polynucleotide
taatacgactcactatagggttcacgtctctctggagctgcacagtagagaacagaggagactctacatggcagctccaaacctggcggcagcgcaaaagatg

SEQ ID NO: 209804 - DNA, 103 bp, Artificial Sequence
  Synthetic Polynucleotide
taatacgactcactataggggttcacatgtttcacgtctctctggagctgaacagaggagacagctcatgagagacgtgaacctggcggcagcgcaaaagatg

SEQ ID NO: 209805 - DNA, 103 bp, Artificial Sequence
  Synthetic Polynucleotide
taatacgactcactatagggtcacttgagtgttcacatgtttcacgtctcaacagaggagagagacgatgaacatgtgaaacctggcggcagcgcaaaagatg

SEQ ID NO: 209806 - DNA, 103 bp, Artificial Sequence
  Synthetic Polynucleotide
taatacgactcactatagggggcttttgcttcacttgagtgttcacatgtaacagaggagaacatgtatgcactcaagtaacctggcggcagcgcaaaagatg

SEQ ID NO: 209807 - DNA, 103 bp, Artificial Sequence
  Synthetic Polynucleotide
taatacgactcactatagggaatcatggaaggcttttgcttcacttgagtaacagaggagaactcaaatgaagcaaaagaacctggcggcagcgcaaaagatg

SEQ ID NO: 209808 - DNA, 103 bp, Artificial Sequence
  Synthetic Polynucleotide
taatacgactcactataggggcagcactgtaatcatggaaggcttttgctaacagaggagaagcaaaatgcttccatgaaacctggcggcagcgcaaaagatg

SEQ ID NO: 209809 - DNA, 103 bp, Artificial Sequence
  Synthetic Polynucleotide
taatacgactcactataggggggagctgctgcagcactgtaatcatggaaaacagaggagattccatatgtacagtgctaacctggcggcagcgcaaaagatg

SEQ ID NO: 209810 - DNA, 103 bp, Artificial Sequence
  Synthetic Polynucleotide
taatacgactcactataggggcactggactgggagctgctgcagcactgtaacagaggagaacagtgatgcagcagctcaacctggcggcagcgcaaaagatg

SEQ ID NO: 209811 - DNA, 103 bp, Artificial Sequence
  Synthetic Polynucleotide
taatacgactcactatagggtggctgtcggacgggacggcgctgctgttaaacagaggagataacagatgcgccgtcccaacctggcggcagcgcaaaagatg

SEQ ID NO: 209812 - DNA, 103 bp, Artificial Sequence
  Synthetic Polynucleotide
taatacgactcactatagggatgtttcctagcactggactgggagctgctaacagaggagaagcagcatgcagtccagtaacctggcggcagcgcaaaagatg

SEQ ID NO: 209813 - DNA, 103 bp, Artificial Sequence
  Synthetic Polynucleotide
taatacgactcactatagggtcctgggggaatgtttcctagcactggactaacagaggagaagtccaatgctaggaaacaacctggcggcagcgcaaaagatg

SEQ ID NO: 209814 - DNA, 103 bp, Artificial Sequence
  Synthetic Polynucleotide
taatacgactcactataggggcatgccatctcctgggggaatgtttcctaaacagaggagataggaaatgttcccccagaacctggcggcagcgcaaaagatg

SEQ ID NO: 209815 - DNA, 103 bp, Artificial Sequence
  Synthetic Polynucleotide
taatacgactcactatagggggacctactggcatgccatctcctgggggaaacagaggagatcccccatgagatggcataacctggcggcagcgcaaaagatg

SEQ ID NO: 209816 - DNA, 103 bp, Artificial Sequence
  Synthetic Polynucleotide
taatacgactcactatagggtggtggtacaggacctactggcatgccatcaacagaggagagatggcatgccagtaggtaacctggcggcagcgcaaaagatg

SEQ ID NO: 209817 - DNA, 103 bp, Artificial Sequence
  Synthetic Polynucleotide
taatacgactcactataggggaaagaaccctggtggtacaggacctactgaacagaggagacagtagatgctgtaccacaacctggcggcagcgcaaaagatg

SEQ ID NO: 209818 - DNA, 103 bp, Artificial Sequence
  Synthetic Polynucleotide
taatacgactcactatagggataaaaggctgaaagaaccctggtggtacaaacagaggagatgtaccatgagggttcttaacctggcggcagcgcaaaagatg

SEQ ID NO: 209819 - DNA, 103 bp, Artificial Sequence
  Synthetic Polynucleotide
taatacgactcactatagggccgaggtgacataaaaggctgaaagaacccaacagaggagagggttcatgcagccttttaacctggcggcagcgcaaaagatg

SEQ ID NO: 209820 - DNA, 103 bp, Artificial Sequence
  Synthetic Polynucleotide
taatacgactcactatagggctccagggtaccgaggtgacataaaaggctaacagaggagaagccttatgtgtcacctcaacctggcggcagcgcaaaagatg

SEQ ID NO: 209821 - DNA, 103 bp, Artificial Sequence
  Synthetic Polynucleotide
taatacgactcactatagggggccttggacctccagggtaccgaggtgacaacagaggagagtcaccatggtaccctggaacctggcggcagcgcaaaagatg

SEQ ID NO: 209822 - DNA, 103 bp, Artificial Sequence
  Synthetic Polynucleotide
taatacgactcactatagggctcccgggcctggctgtcggacgggacggcaacagaggagagccgtcatgtccgacagcaacctggcggcagcgcaaaagatg

SEQ ID NO: 209823 - DNA, 103 bp, Artificial Sequence
  Synthetic Polynucleotide
taatacgactcactatagggcctcaatgggggccttggacctccagggtaaacagaggagataccctatgggtccaaggaacctggcggcagcgcaaaagatg

SEQ ID NO: 209824 - DNA, 103 bp, Artificial Sequence
  Synthetic Polynucleotide
taatacgactcactataggggattaggtatcctcaatgggggccttggacaacagaggagagtccaaatgccccattgaaacctggcggcagcgcaaaagatg

SEQ ID NO: 209825 - DNA, 103 bp, Artificial Sequence
  Synthetic Polynucleotide
taatacgactcactatagggccaagtgcctgattaggtatcctcaatgggaacagaggagacccattatggatacctaaaacctggcggcagcgcaaaagatg

SEQ ID NO: 209826 - DNA, 103 bp, Artificial Sequence
  Synthetic Polynucleotide
taatacgactcactatagggtgggacacctccaagtgcctgattaggtataacagaggagaatacctatgcaggcacttaacctggcggcagcgcaaaagatg

SEQ ID NO: 209827 - DNA, 103 bp, Artificial Sequence
  Synthetic Polynucleotide
taatacgactcactataggggctgacttcctgggacacctccaagtgcctaacagaggagaaggcacatggaggtgtccaacctggcggcagcgcaaaagatg

SEQ ID NO: 209828 - DNA, 103 bp, Artificial Sequence
  Synthetic Polynucleotide
taatacgactcactataggggggagtaatggctgacttcctgggacacctaacagaggagaaggtgtatgaggaagtcaaacctggcggcagcgcaaaagatg

SEQ ID NO: 209829 - DNA, 103 bp, Artificial Sequence
  Synthetic Polynucleotide
taatacgactcactatagggcattccactggggagtaatggctgacttccaacagaggagaggaagtatgccattactcaacctggcggcagcgcaaaagatg

SEQ ID NO: 209830 - DNA, 103 bp, Artificial Sequence
  Synthetic Polynucleotide
taatacgactcactataggggagttggatccattccactggggagtaatgaacagaggagacattacatgccagtggaaaacctggcggcagcgcaaaagatg

SEQ ID NO: 209831 - DNA, 103 bp, Artificial Sequence
  Synthetic Polynucleotide
taatacgactcactatagggccttgttgtcgagttggatccattccactgaacagaggagacagtggatgggatccaacaacctggcggcagcgcaaaagatg

SEQ ID NO: 209832 - DNA, 103 bp, Artificial Sequence
  Synthetic Polynucleotide
taatacgactcactatagggatttggatgtccttgttgtcgagttggatcaacagaggagagatccaatgcgacaacaaaacctggcggcagcgcaaaagatg

SEQ ID NO: 209833 - DNA, 103 bp, Artificial Sequence
  Synthetic Polynucleotide
taatacgactcactataggggtgctaacttctcccgggcctggctgtcggaacagaggagaccgacaatgaggcccgggaacctggcggcagcgcaaaagatg

SEQ ID NO: 209834 - DNA, 103 bp, Artificial Sequence
  Synthetic Polynucleotide
taatacgactcactataggggcccacccatatttggatgtccttgttgtcaacagaggagagacaacatggacatccaaaacctggcggcagcgcaaaagatg

SEQ ID NO: 209835 - DNA, 103 bp, Artificial Sequence
  Synthetic Polynucleotide
taatacgactcactatagggctctgcattggcccacccatatttggatgtaacagaggagaacatccatgtatgggtggaacctggcggcagcgcaaaagatg

SEQ ID NO: 209836 - DNA, 103 bp, Artificial Sequence
  Synthetic Polynucleotide
taatacgactcactatagggaggagtcattctctgcattggcccacccataacagaggagaatgggtatgccaatgcagaacctggcggcagcgcaaaagatg

SEQ ID NO: 209837 - DNA, 103 bp, Artificial Sequence
  Synthetic Polynucleotide
taatacgactcactatagggttcctcttggaggagtcattctctgcattgaacagaggagacaatgcatggaatgactcaacctggcggcagcgcaaaagatg

SEQ ID NO: 209838 - DNA, 103 bp, Artificial Sequence
  Synthetic Polynucleotide
taatacgactcactatagggaagggcaccattcctcttggaggagtcattaacagaggagaaatgacatgtccaagaggaacctggcggcagcgcaaaagatg

SEQ ID NO: 209839 - DNA, 103 bp, Artificial Sequence
  Synthetic Polynucleotide
taatacgactcactatagggctgtggtcctaagggcaccattcctcttggaacagaggagaccaagaatgatggtgcccaacctggcggcagcgcaaaagatg

SEQ ID NO: 209840 - DNA, 103 bp, Artificial Sequence
  Synthetic Polynucleotide
taatacgactcactatagggctccatagttctgtggtcctaagggcaccaaacagaggagatggtgcatgtaggaccacaacctggcggcagcgcaaaagatg

SEQ ID NO: 209841 - DNA, 103 bp, Artificial Sequence
  Synthetic Polynucleotide
taatacgactcactatagggctcattgcacctccatagttctgtggtcctaacagaggagaaggaccatggaactatggaacctggcggcagcgcaaaagatg

SEQ ID NO: 209842 - DNA, 103 bp, Artificial Sequence
  Synthetic Polynucleotide
taatacgactcactatagggcagtgggggtctcattgcacctccatagttaacagaggagaaactatatgggtgcaatgaacctggcggcagcgcaaaagatg

SEQ ID NO: 209843 - DNA, 103 bp, Artificial Sequence
  Synthetic Polynucleotide
taatacgactcactatagggctaaagcattcagtgggggtctcattgcacaacagaggagagtgcaaatggacccccacaacctggcggcagcgcaaaagatg

SEQ ID NO: 209844 - DNA, 103 bp, Artificial Sequence
  Synthetic Polynucleotide
taatacgactcactatagggtatacgtagagtgctaacttctcccgggccaacagaggagaggcccgatggaagttagcaacctggcggcagcgcaaaagatg

SEQ ID NO: 209845 - DNA, 103 bp, Artificial Sequence
  Synthetic Polynucleotide
taatacgactcactatagggccagggccacctaaagcattcagtgggggtaacagaggagaacccccatggaatgctttaacctggcggcagcgcaaaagatg

SEQ ID NO: 209846 - DNA, 103 bp, Artificial Sequence
  Synthetic Polynucleotide
taatacgactcactatagggtccaggcattccagggccacctaaagcattaacagaggagaaatgctatgggtggccctaacctggcggcagcgcaaaagatg

SEQ ID NO: 209847 - DNA, 103 bp, Artificial Sequence
  Synthetic Polynucleotide
taatacgactcactatagggccatgttcattccaggcattccagggccacaacagaggagagtggccatggaatgcctgaacctggcggcagcgcaaaagatg

SEQ ID NO: 209848 - DNA, 103 bp, Artificial Sequence
  Synthetic Polynucleotide
taatacgactcactatagggccacctggacccatgttcattccaggcattaacagaggagaaatgccatgaatgaacataacctggcggcagcgcaaaagatg

SEQ ID NO: 209849 - DNA, 103 bp, Artificial Sequence
  Synthetic Polynucleotide
taatacgactcactatagggaggtctaccaccacctggacccatgttcataacagaggagaatgaacatgggtccaggtaacctggcggcagcgcaaaagatg

SEQ ID NO: 209850 - DNA, 103 bp, Artificial Sequence
  Synthetic Polynucleotide
taatacgactcactatagggggtttggccaaggtctaccaccacctggacaacagaggagagtccagatggtggtagacaacctggcggcagcgcaaaagatg

SEQ ID NO: 209851 - DNA, 103 bp, Artificial Sequence
  Synthetic Polynucleotide
taatacgactcactataggggcatttgttgggtttggccaaggtctaccaaacagaggagatggtagatgttggccaaaaacctggcggcagcgcaaaagatg

SEQ ID NO: 209852 - DNA, 103 bp, Artificial Sequence
  Synthetic Polynucleotide
taatacgactcactatagggtattgaattggcatttgttgggtttggccaaacagaggagatggccaatgccaacaaataacctggcggcagcgcaaaagatg

SEQ ID NO: 209853 - DNA, 103 bp, Artificial Sequence
  Synthetic Polynucleotide
taatacgactcactatagggaggagtatggtattgaattggcatttgttgaacagaggagacaacaaatgccaattcaaaacctggcggcagcgcaaaagatg

SEQ ID NO: 209854 - DNA, 103 bp, Artificial Sequence
  Synthetic Polynucleotide
taatacgactcactatagggggagatgctgaggagtatggtattgaattgaacagaggagacaattcatgaccatactcaacctggcggcagcgcaaaagatg

SEQ ID NO: 209855 - DNA, 103 bp, Artificial Sequence
  Synthetic Polynucleotide
taatacgactcactatagggcagatattcatatacgtagagtgctaacttaacagaggagaaagttaatgctctacgtaaacctggcggcagcgcaaaagatg

SEQ ID NO: 209856 - DNA, 103 bp, Artificial Sequence
  Synthetic Polynucleotide
taatacgactcactatagggataattcccaggagatgctgaggagtatggaacagaggagaccatacatgtcagcatctaacctggcggcagcgcaaaagatg

SEQ ID NO: 209857 - DNA, 103 bp, Artificial Sequence
  Synthetic Polynucleotide
taatacgactcactataggggaggacctacataattcccaggagatgctgaacagaggagacagcatatgctgggaattaacctggcggcagcgcaaaagatg

SEQ ID NO: 209858 - DNA, 103 bp, Artificial Sequence
  Synthetic Polynucleotide
taatacgactcactatagggccacctcctggaggacctacataattcccaaacagaggagatgggaaatgtgtaggtccaacctggcggcagcgcaaaagatg

SEQ ID NO: 209859 - DNA, 103 bp, Artificial Sequence
  Synthetic Polynucleotide
taatacgactcactatagggtggtggccctccacctcctggaggacctacaacagaggagagtaggtatgccaggaggtaacctggcggcagcgcaaaagatg

SEQ ID NO: 209860 - DNA, 103 bp, Artificial Sequence
  Synthetic Polynucleotide
taatacgactcactatagggtgggtgttcctggtggccctccacctcctgaacagaggagacaggagatggagggccacaacctggcggcagcgcaaaagatg

SEQ ID NO: 209861 - DNA, 103 bp, Artificial Sequence
  Synthetic Polynucleotide
taatacgactcactatagggctaggcatgatgggtgttcctggtggccctaacagaggagaagggccatgaggaacaccaacctggcggcagcgcaaaagatg

SEQ ID NO: 209862 - DNA, 103 bp, Artificial Sequence
  Synthetic Polynucleotide
taatacgactcactatagggatctgctggactaggcatgatgggtgttccaacagaggagaggaacaatgatcatgcctaacctggcggcagcgcaaaagatg

SEQ ID NO: 209863 - DNA, 103 bp, Artificial Sequence
  Synthetic Polynucleotide
taatacgactcactatagggagttggttgaatctgctggactaggcatgaaacagaggagatcatgcatggtccagcagaacctggcggcagcgcaaaagatg

SEQ ID NO: 209864 - DNA, 103 bp, Artificial Sequence
  Synthetic Polynucleotide
taatacgactcactatagggttatcaccagagttggttgaatctgctggaaacagaggagatccagcatgttcaaccaaaacctggcggcagcgcaaaagatg

SEQ ID NO: 209865 - DNA, 103 bp, Artificial Sequence
  Synthetic Polynucleotide
taatacgactcactatagggagtatacatgttatcaccagagttggttgaaacagaggagatcaaccatgtctggtgataacctggcggcagcgcaaaagatg

SEQ ID NO: 209866 - DNA, 103 bp, Artificial Sequence
  Synthetic Polynucleotide
taatacgactcactatagggctacatggagcagatattcatatacgtagaaacagaggagatctacgatgatgaatatcaacctggcggcagcgcaaaagatg

SEQ ID NO: 209867 - DNA, 103 bp, Artificial Sequence
  Synthetic Polynucleotide
taatacgactcactatagggcattcattaaagtatacatgttatcaccagaacagaggagactggtgatgacatgtataaacctggcggcagcgcaaaagatg

SEQ ID NO: 209868 - DNA, 103 bp, Artificial Sequence
  Synthetic Polynucleotide
taatacgactcactatagggggaggtactgcattcattaaagtatacatgaacagaggagacatgtaatgtttaatgaaaacctggcggcagcgcaaaagatg

SEQ ID NO: 209869 - DNA, 103 bp, Artificial Sequence
  Synthetic Polynucleotide
taatacgactcactataggggttaggtccaggaggtactgcattcattaaaacagaggagattaatgatggcagtacctaacctggcggcagcgcaaaagatg

SEQ ID NO: 209870 - DNA, 103 bp, Artificial Sequence
  Synthetic Polynucleotide
taatacgactcactatagggaattaggtctgttaggtccaggaggtactgaacagaggagacagtacatgctggacctaaacctggcggcagcgcaaaagatg

SEQ ID NO: 209871 - DNA, 103 bp, Artificial Sequence
  Synthetic Polynucleotide
taatacgactcactatagggcccattggaaaattaggtctgttaggtccaaacagaggagatggaccatgcagacctaaaacctggcggcagcgcaaaagatg

SEQ ID NO: 209872 - DNA, 103 bp, Artificial Sequence
  Synthetic Polynucleotide
taatacgactcactatagggtgacccaggacccattggaaaattaggtctaacagaggagaagacctatgtttccaatgaacctggcggcagcgcaaaagatg

SEQ ID NO: 209873 - DNA, 103 bp, Artificial Sequence
  Synthetic Polynucleotide
taatacgactcactatagggtgggaccatctgacccaggacccattggaaaacagaggagattccaaatggtcctgggtaacctggcggcagcgcaaaagatg

SEQ ID NO: 209874 - DNA, 103 bp, Artificial Sequence
  Synthetic Polynucleotide
taatacgactcactatagggaatccacccatgggaccatctgacccaggaaacagaggagatcctggatgagatggtccaacctggcggcagcgcaaaagatg

SEQ ID NO: 209875 - DNA, 103 bp, Artificial Sequence
  Synthetic Polynucleotide
taatacgactcactatagggcattcctcctaatccacccatgggaccatcaacagaggagagatggtatgatgggtggaaacctggcggcagcgcaaaagatg

SEQ ID NO: 209876 - DNA, 103 bp, Artificial Sequence
  Synthetic Polynucleotide
taatacgactcactataggggatgtgactccattcctcctaatccacccaaacagaggagatgggtgatgtaggaggaaaacctggcggcagcgcaaaagatg

SEQ ID NO: 209877 - DNA, 103 bp, Artificial Sequence
  Synthetic Polynucleotide
taatacgactcactatagggttctgagctcctacatggagcagatattcaaacagaggagatgaataatggctccatgtaacctggcggcagcgcaaaagatg

SEQ ID NO: 209878 - DNA, 103 bp, Artificial Sequence
  Synthetic Polynucleotide
taatacgactcactatagggccattcatgtgatgtgactccattcctcctaacagaggagaaggaggatgggagtcacaaacctggcggcagcgcaaaagatg

SEQ ID NO: 209879 - DNA, 103 bp, Artificial Sequence
  Synthetic Polynucleotide
taatacgactcactataggggcctaaagagccattcatgtgatgtgactcaacagaggagagagtcaatgcacatgaataacctggcggcagcgcaaaagatg

SEQ ID NO: 209880 - DNA, 103 bp, Artificial Sequence
  Synthetic Polynucleotide
taatacgactcactatagggtatctcctgagcctaaagagccattcatgtaacagaggagaacatgaatggctctttagaacctggcggcagcgcaaaagatg

SEQ ID NO: 209881 - DNA, 103 bp, Artificial Sequence
  Synthetic Polynucleotide
taatacgactcactatagggatactgtccatatctcctgagcctaaagagaacagaggagactctttatgctcaggagaaacctggcggcagcgcaaaagatg

SEQ ID NO: 209882 - DNA, 103 bp, Artificial Sequence
  Synthetic Polynucleotide
taatacgactcactatagggattcttggaaatactgtccatatctcctgaaacagaggagatcaggaatgatggacagtaacctggcggcagcgcaaaagatg

SEQ ID NO: 209883 - DNA, 103 bp, Artificial Sequence
  Synthetic Polynucleotide
taatacgactcactatagggtattgggagaattcttggaaatactgtccaaacagaggagatggacaatgtttccaagaaacctggcggcagcgcaaaagatg

SEQ ID NO: 209884 - DNA, 103 bp, Artificial Sequence
  Synthetic Polynucleotide
taatacgactcactatagggaggctcatattattgggagaattcttggaaaacagaggagattccaaatgttctcccaaaacctggcggcagcgcaaaagatg

SEQ ID NO: 209885 - DNA, 103 bp, Artificial Sequence
  Synthetic Polynucleotide
taatacgactcactatagggttgattactcaggctcatattattgggagaaacagaggagatctcccatgaatatgagcaacctggcggcagcgcaaaagatg

SEQ ID NO: 209886 - DNA, 103 bp, Artificial Sequence
  Synthetic Polynucleotide
taatacgactcactataggggagtgcccggttgattactcaggctcatataacagaggagaatatgaatgtgagtaatcaacctggcggcagcgcaaaagatg

SEQ ID NO: 209887 - DNA, 103 bp, Artificial Sequence
  Synthetic Polynucleotide
taatacgactcactatagggtcatcccttggagtgcccggttgattactcaacagaggagagagtaaatgaccgggcacaacctggcggcagcgcaaaagatg

SEQ ID NO: 209888 - DNA, 103 bp, Artificial Sequence
  Synthetic Polynucleotide
taatacgactcactatagggcaccgccgagcctttgcctttggcaaacataacagaggagaatgtttatgaaaggcaaaaacctggcggcagcgcaaaagatg

SEQ ID NO: 209889 - DNA, 103 bp, Artificial Sequence
  Synthetic Polynucleotide
taatacgactcactataggggaaggtctgtgcagatttctgtgctcctacaacagaggagagtaggaatgcagaaatctaacctggcggcagcgcaaaagatg

SEQ ID NO: 209890 - DNA, 103 bp, Artificial Sequence
  Synthetic Polynucleotide
taatacgactcactatagggggtgcctggaggattgctaatgccacttataacagaggagaataagtatgattagcaataacctggcggcagcgcaaaagatg

SEQ ID NO: 209891 - DNA, 103 bp, Artificial Sequence
  Synthetic Polynucleotide
taatacgactcactatagggcatctcgaggggtgcctggaggattgctaaaacagaggagattagcaatgctccaggcaaacctggcggcagcgcaaaagatg

SEQ ID NO: 209892 - DNA, 103 bp, Artificial Sequence
  Synthetic Polynucleotide
taatacgactcactatagggagctcgccgtcatctcgaggggtgcctggaaacagaggagatccaggatgccctcgagaaacctggcggcagcgcaaaagatg

SEQ ID NO: 209893 - DNA, 103 bp, Artificial Sequence
  Synthetic Polynucleotide
taatacgactcactataggggttccctcctagctcgccgtcatctcgaggaacagaggagacctcgaatggacggcgagaacctggcggcagcgcaaaagatg

SEQ ID NO: 209894 - DNA, 103 bp, Artificial Sequence
  Synthetic Polynucleotide
taatacgactcactatagggagtggaggaagttccctcctagctcgccgtaacagaggagaacggcgatgtaggagggaaacctggcggcagcgcaaaagatg

SEQ ID NO: 209895 - DNA, 103 bp, Artificial Sequence
  Synthetic Polynucleotide
taatacgactcactatagggttctgaaaggagtggaggaagttccctcctaacagaggagaaggaggatgcttcctccaaacctggcggcagcgcaaaagatg

SEQ ID NO: 209896 - DNA, 103 bp, Artificial Sequence
  Synthetic Polynucleotide
taatacgactcactatagggataattgtcgttctgaaaggagtggaggaaaacagaggagattcctcatgtcctttcagaacctggcggcagcgcaaaagatg

SEQ ID NO: 209897 - DNA, 103 bp, Artificial Sequence
  Synthetic Polynucleotide
taatacgactcactatagggtgcttggagaataattgtcgttctgaaaggaacagaggagacctttcatgacgacaattaacctggcggcagcgcaaaagatg

SEQ ID NO: 209898 - DNA, 103 bp, Artificial Sequence
  Synthetic Polynucleotide
taatacgactcactatagggctcatcgtcatgcttggagaataattgtcgaacagaggagacgacaaatgttctccaagaacctggcggcagcgcaaaagatg

SEQ ID NO: 209899 - DNA, 103 bp, Artificial Sequence
  Synthetic Polynucleotide
taatacgactcactatagggtctccgataagaaggtctgtgcagatttctaacagaggagaagaaatatgcacagacctaacctggcggcagcgcaaaagatg

SEQ ID NO: 209900 - DNA, 103 bp, Artificial Sequence
  Synthetic Polynucleotide
taatacgactcactatagggtcccatcgaatctccgataagaaggtctgtaacagaggagaacagacatgcttatcggaaacctggcggcagcgcaaaagatg

SEQ ID NO: 209901 - DNA, 103 bp, Artificial Sequence
  Synthetic Polynucleotide
taatacgactcactataggggatgtttttttcccatcgaatctccgataaaacagaggagattatcgatgattcgatggaacctggcggcagcgcaaaagatg

SEQ ID NO: 209902 - DNA, 103 bp, Artificial Sequence
  Synthetic Polynucleotide
taatacgactcactatagggctcccaacgtgatgtttttttcccatcgaaaacagaggagattcgatatgaaaaaaacaaacctggcggcagcgcaaaagatg

SEQ ID NO: 209903 - DNA, 103 bp, Artificial Sequence
  Synthetic Polynucleotide
taatacgactcactatagggccaggcggttctcccaacgtgatgttttttaacagaggagaaaaaaaatgcacgttgggaacctggcggcagcgcaaaagatg

SEQ ID NO: 209904 - DNA, 103 bp, Artificial Sequence
  Synthetic Polynucleotide
taatacgactcactataggggtgcaaaaacccaggcggttctcccaacgtaacagaggagaacgttgatggaaccgcctaacctggcggcagcgcaaaagatg

SEQ ID NO: 209905 - DNA, 103 bp, Artificial Sequence
  Synthetic Polynucleotide
taatacgactcactatagggaccaccacgagtgcaaaaacccaggcggttaacagaggagaaaccgcatgggtttttgcaacctggcggcagcgcaaaagatg

SEQ ID NO: 209906 - DNA, 103 bp, Artificial Sequence
  Synthetic Polynucleotide
taatacgactcactatagggcaaaatacacaccaccacgagtgcaaaaacaacagaggagagtttttatgctcgtggtgaacctggcggcagcgcaaaagatg

SEQ ID NO: 209907 - DNA, 103 bp, Artificial Sequence
  Synthetic Polynucleotide
taatacgactcactataggggtaaaggtcccaaaatacacaccaccacgaaacagaggagatcgtggatgtgtgtatttaacctggcggcagcgcaaaagatg

SEQ ID NO: 209908 - DNA, 103 bp, Artificial Sequence
  Synthetic Polynucleotide
taatacgactcactatagggcatccgagggcaccgccgagcctttgccttaacagaggagaaaggcaatggctcggcggaacctggcggcagcgcaaaagatg

SEQ ID NO: 209909 - DNA, 103 bp, Artificial Sequence
  Synthetic Polynucleotide
taatacgactcactataggggagctgcacagtaaaggtcccaaaatacacaacagaggagagtgtatatggggacctttaacctggcggcagcgcaaaagatg

SEQ ID NO: 209910 - DNA, 103 bp, Artificial Sequence
  Synthetic Polynucleotide
taatacgactcactatagggctcctttcaggagctgcacagtaaaggtccaacagaggagaggacctatgctgtgcagcaacctggcggcagcgcaaaagatg

SEQ ID NO: 209911 - DNA, 103 bp, Artificial Sequence
  Synthetic Polynucleotide
taatacgactcactatagggacaagtgtctctcctttcaggagctgcacaaacagaggagatgtgcaatgcctgaaaggaacctggcggcagcgcaaaagatg

SEQ ID NO: 209912 - DNA, 103 bp, Artificial Sequence
  Synthetic Polynucleotide
taatacgactcactatagggttgaatgttcacaagtgtctctcctttcagaacagaggagactgaaaatggagacacttaacctggcggcagcgcaaaagatg

SEQ ID NO: 209913 - DNA, 103 bp, Artificial Sequence
  Synthetic Polynucleotide
taatacgactcactatagggtttgcttcacttgaatgttcacaagtgtctaacagaggagaagacacatgtgaacattcaacctggcggcagcgcaaaagatg

SEQ ID NO: 209914 - DNA, 103 bp, Artificial Sequence
  Synthetic Polynucleotide
taatacgactcactatagggatgaaaggcttttgcttcacttgaatgttcaacagaggagagaacatatgagtgaagcaaacctggcggcagcgcaaaagatg

SEQ ID NO: 209915 - DNA, 103 bp, Artificial Sequence
  Synthetic Polynucleotide
taatacgactcactatagggcactataatcatgaaaggcttttgcttcacaacagaggagagtgaagatgaagcctttcaacctggcggcagcgcaaaagatg

SEQ ID NO: 209916 - DNA, 103 bp, Artificial Sequence
  Synthetic Polynucleotide
taatacgactcactataggggcagctgctgcactataatcatgaaaggctaacagaggagaagccttatgtgattatagaacctggcggcagcgcaaaagatg

SEQ ID NO: 209917 - DNA, 103 bp, Artificial Sequence
  Synthetic Polynucleotide
taatacgactcactatagggggggctcggggcagctgctgcactataatcaacagaggagagattatatggcagcagctaacctggcggcagcgcaaaagatg

SEQ ID NO: 209918 - DNA, 103 bp, Artificial Sequence
  Synthetic Polynucleotide
taatacgactcactatagggtgccaagcacggggctcggggcagctgctgaacagaggagacagcagatgccccgagccaacctggcggcagcgcaaaagatg

SEQ ID NO: 209919 - DNA, 103 bp, Artificial Sequence
  Synthetic Polynucleotide
taatacgactcactatagggcgagcctgcccatccgagggcaccgccgagaacagaggagactcggcatggccctcggaaacctggcggcagcgcaaaagatg

SEQ ID NO: 209920 - DNA, 103 bp, Artificial Sequence
  Synthetic Polynucleotide
taatacgactcactataggggggggaatgttgccaagcacggggctcgggaacagaggagacccgagatgcgtgcttggaacctggcggcagcgcaaaagatg

SEQ ID NO: 209921 - DNA, 103 bp, Artificial Sequence
  Synthetic Polynucleotide
taatacgactcactatagggcccatcgttggggggaatgttgccaagcacaacagaggagagtgcttatgaacattcccaacctggcggcagcgcaaaagatg

SEQ ID NO: 209922 - DNA, 103 bp, Artificial Sequence
  Synthetic Polynucleotide
taatacgactcactatagggctcccggcatcccatcgttggggggaatgtaacagaggagaacattcatgccaacgatgaacctggcggcagcgcaaaagatg

SEQ ID NO: 209923 - DNA, 103 bp, Artificial Sequence
  Synthetic Polynucleotide
taatacgactcactataggggggatggggcctcccggcatcccatcgttgaacagaggagacaacgaatggatgccgggaacctggcggcagcgcaaaagatg

SEQ ID NO: 209924 - DNA, 103 bp, Artificial Sequence
  Synthetic Polynucleotide
taatacgactcactataggggaaacctggcgggatggggcctcccggcataacagaggagaatgccgatgggccccatcaacctggcggcagcgcaaaagatg

SEQ ID NO: 209925 - DNA, 103 bp, Artificial Sequence
  Synthetic Polynucleotide
taatacgactcactataggggaccctgaaagaaacctggcgggatggggcaacagaggagagccccaatgcgccaggttaacctggcggcagcgcaaaagatg

SEQ ID NO: 209926 - DNA, 103 bp, Artificial Sequence
  Synthetic Polynucleotide
taatacgactcactataggggaccccggaggaccctgaaagaaacctggcaacagaggagagccaggatgctttcagggaacctggcggcagcgcaaaagatg

SEQ ID NO: 209927 - DNA, 103 bp, Artificial Sequence
  Synthetic Polynucleotide
taatacgactcactatagggcgagggctgtgaccccggaggaccctgaaaaacagaggagatttcagatgcctccggggaacctggcggcagcgcaaaagatg

SEQ ID NO: 209928 - DNA, 103 bp, Artificial Sequence
  Synthetic Polynucleotide
taatacgactcactataggggtgcgtgcggcgagggctgtgaccccggagaacagaggagactccggatgcacagccctaacctggcggcagcgcaaaagatg

SEQ ID NO: 209929 - DNA, 103 bp, Artificial Sequence
  Synthetic Polynucleotide
taatacgactcactatagggggtggaggctgtgcgtgcggcgagggctgtaacagaggagaacagccatggccgcacgcaacctggcggcagcgcaaaagatg

SEQ ID NO: 209930 - DNA, 103 bp, Artificial Sequence
  Synthetic Polynucleotide
taatacgactcactatagggtaacttttcccgagcctgcccatccgagggaacagaggagaccctcgatggggcaggctaacctggcggcagcgcaaaagatg

SEQ ID NO: 209931 - DNA, 103 bp, Artificial Sequence
  Synthetic Polynucleotide
taatacgactcactatagggaggattgtgaggtggaggctgtgcgtgcggaacagaggagaccgcacatgcagcctccaaacctggcggcagcgcaaaagatg

SEQ ID NO: 209932 - DNA, 103 bp, Artificial Sequence
  Synthetic Polynucleotide
taatacgactcactatagggtcatgctgctaggattgtgaggtggaggctaacagaggagaagcctcatgctcacaatcaacctggcggcagcgcaaaagatg

SEQ ID NO: 209933 - DNA, 103 bp, Artificial Sequence
  Synthetic Polynucleotide
taatacgactcactatagggtggggtcccatcatgctgctaggattgtgaaacagaggagatcacaaatgtagcagcataacctggcggcagcgcaaaagatg

SEQ ID NO: 209934 - DNA, 103 bp, Artificial Sequence
  Synthetic Polynucleotide
taatacgactcactatagggaggctgactgtggggtcccatcatgctgctaacagaggagaagcagcatgatgggacccaacctggcggcagcgcaaaagatg

SEQ ID NO: 209935 - DNA, 103 bp, Artificial Sequence
  Synthetic Polynucleotide
taatacgactcactatagggctcctcccggaggctgactgtggggtcccaaacagaggagatgggacatgacagtcagcaacctggcggcagcgcaaaagatg

SEQ ID NO: 209936 - DNA, 103 bp, Artificial Sequence
  Synthetic Polynucleotide
taatacgactcactataggggtcccaggaactcctcccggaggctgactgaacagaggagacagtcaatgtccgggaggaacctggcggcagcgcaaaagatg

SEQ ID NO: 209937 - DNA, 103 bp, Artificial Sequence
  Synthetic Polynucleotide
taatacgactcactatagggcaatggctgtgtcccaggaactcctcccggaacagaggagaccgggaatggttcctgggaacctggcggcagcgcaaaagatg

SEQ ID NO: 209938 - DNA, 103 bp, Artificial Sequence
  Synthetic Polynucleotide
taatacgactcactatagggaattgggcagcaatggctgtgtcccaggaaaacagaggagattcctgatgcacagccataacctggcggcagcgcaaaagatg

SEQ ID NO: 209939 - DNA, 103 bp, Artificial Sequence
  Synthetic Polynucleotide
taatacgactcactatagggggatccatagaattgggcagcaatggctgtaacagaggagaacagccatggctgcccaaaacctggcggcagcgcaaaagatg

SEQ ID NO: 209940 - DNA, 103 bp, Artificial Sequence
  Synthetic Polynucleotide
taatacgactcactatagggttgtcgtgtgggatccatagaattgggcagaacagaggagactgcccatgtctatggataacctggcggcagcgcaaaagatg

SEQ ID NO: 209941 - DNA, 103 bp, Artificial Sequence
  Synthetic Polynucleotide
taatacgactcactatagggcgtataaagctaacttttcccgagcctgccaacagaggagaggcaggatggggaaaagtaacctggcggcagcgcaaaagatg

SEQ ID NO: 209942 - DNA, 103 bp, Artificial Sequence
  Synthetic Polynucleotide
taatacgactcactatagggggtggccttgttgtcgtgtgggatccatagaacagaggagactatggatgccacacgacaacctggcggcagcgcaaaagatg

SEQ ID NO: 209943 - DNA, 103 bp, Artificial Sequence
  Synthetic Polynucleotide
taatacgactcactatagggcccatgttggggtggccttgttgtcgtgtgaacagaggagacacacgatgacaaggccaaacctggcggcagcgcaaaagatg

SEQ ID NO: 209944 - DNA, 103 bp, Artificial Sequence
  Synthetic Polynucleotide
taatacgactcactatagggcattgatcctcccatgttggggtggccttgaacagaggagacaaggcatgcccaacatgaacctggcggcagcgcaaaagatg

SEQ ID NO: 209945 - DNA, 103 bp, Artificial Sequence
  Synthetic Polynucleotide
taatacgactcactatagggtcattctctgcattgatcctcccatgttggaacagaggagaccaacaatggaggatcaaaacctggcggcagcgcaaaagatg

SEQ ID NO: 209946 - DNA, 103 bp, Artificial Sequence
  Synthetic Polynucleotide
taatacgactcactatagggcggggagggttcattctctgcattgatcctaacagaggagaaggatcatggcagagaataacctggcggcagcgcaaaagatg

SEQ ID NO: 209947 - DNA, 103 bp, Artificial Sequence
  Synthetic Polynucleotide
taatacgactcactatagggccccatgcctcggggagggttcattctctgaacagaggagacagagaatgaaccctcccaacctggcggcagcgcaaaagatg

SEQ ID NO: 209948 - DNA, 103 bp, Artificial Sequence
  Synthetic Polynucleotide
taatacgactcactataggggacccatgggccccatgcctcggggagggtaacagaggagaaccctcatggaggcatggaacctggcggcagcgcaaaagatg

SEQ ID NO: 209949 - DNA, 103 bp, Artificial Sequence
  Synthetic Polynucleotide
taatacgactcactatagggtgtgggccgggacccatgggccccatgcctaacagaggagaaggcatatggcccatgggaacctggcggcagcgcaaaagatg

SEQ ID NO: 209950 - DNA, 103 bp, Artificial Sequence
  Synthetic Polynucleotide
taatacgactcactataggggccgtaattctgtgggccgggacccatgggaacagaggagacccatgatgcccggcccaaacctggcggcagcgcaaaagatg

SEQ ID NO: 209951 - DNA, 103 bp, Artificial Sequence
  Synthetic Polynucleotide
taatacgactcactatagggtcatgccgctgccgtaattctgtgggccggaacagaggagaccggccatgagaattacgaacctggcggcagcgcaaaagatg

SEQ ID NO: 209952 - DNA, 103 bp, Artificial Sequence
  Synthetic Polynucleotide
taatacgactcactatagggtattcgtagacgtataaagctaacttttccaacagaggagaggaaaaatgagctttataaacctggcggcagcgcaaaagatg

SEQ ID NO: 209953 - DNA, 103 bp, Artificial Sequence
  Synthetic Polynucleotide
taatacgactcactatagggggtggtggtctcatgccgctgccgtaattcaacagaggagagaattaatgcagcggcataacctggcggcagcgcaaaagatg

SEQ ID NO: 209954 - DNA, 103 bp, Artificial Sequence
  Synthetic Polynucleotide
taatacgactcactataggggagggagttgggtggtggtctcatgccgctaacagaggagaagcggcatgagaccaccaaacctggcggcagcgcaaaagatg

SEQ ID NO: 209955 - DNA, 103 bp, Artificial Sequence
  Synthetic Polynucleotide
taatacgactcactatagggtggcggggccgagggagttgggtggtggtcaacagaggagagaccacatgccaactcccaacctggcggcagcgcaaaagatg

SEQ ID NO: 209956 - DNA, 103 bp, Artificial Sequence
  Synthetic Polynucleotide
taatacgactcactatagggatcccgggcatggcggggccgagggagttgaacagaggagacaactcatgcggccccgcaacctggcggcagcgcaaaagatg

SEQ ID NO: 209957 - DNA, 103 bp, Artificial Sequence
  Synthetic Polynucleotide
taatacgactcactataggggcccatgttaatcccgggcatggcggggccaacagaggagaggccccatgatgcccgggaacctggcggcagcgcaaaagatg

SEQ ID NO: 209958 - DNA, 103 bp, Artificial Sequence
  Synthetic Polynucleotide
taatacgactcactatagggcagctcccgggcccatgttaatcccgggcaaacagaggagatgcccgatgttaacatggaacctggcggcagcgcaaaagatg

SEQ ID NO: 209959 - DNA, 103 bp, Artificial Sequence
  Synthetic Polynucleotide
taatacgactcactatagggcagggtctgccagctcccgggcccatgttaaacagaggagataacatatgcccgggagcaacctggcggcagcgcaaaagatg

SEQ ID NO: 209960 - DNA, 103 bp, Artificial Sequence
  Synthetic Polynucleotide
taatacgactcactatagggaggattgggccagggtctgccagctcccggaacagaggagaccgggaatgggcagacccaacctggcggcagcgcaaaagatg

SEQ ID NO: 209961 - DNA, 103 bp, Artificial Sequence
  Synthetic Polynucleotide
taatacgactcactatagggtagcactgttaggattgggccagggtctgcaacagaggagagcagacatgggcccaatcaacctggcggcagcgcaaaagatg

SEQ ID NO: 209962 - DNA, 103 bp, Artificial Sequence
  Synthetic Polynucleotide
taatacgactcactatagggggaattgagttagcactgttaggattgggcaacagaggagagcccaaatgtaacagtgcaacctggcggcagcgcaaaagatg

SEQ ID NO: 209963 - DNA, 103 bp, Artificial Sequence
  Synthetic Polynucleotide
taatacgactcactataggggtgcagtaaatattcgtagacgtataaagcaacagaggagagctttaatggtctacgaaaacctggcggcagcgcaaaagatg

SEQ ID NO: 209964 - DNA, 103 bp, Artificial Sequence
  Synthetic Polynucleotide
taatacgactcactatagggggaggagtatggaattgagttagcactgttaacagaggagaaacagtatgaactcaattaacctggcggcagcgcaaaagatg

SEQ ID NO: 209965 - DNA, 103 bp, Artificial Sequence
  Synthetic Polynucleotide
taatacgactcactatagggcaggtgatgaggaggagtatggaattgagtaacagaggagaactcaaatgcatactcctaacctggcggcagcgcaaaagatg

SEQ ID NO: 209966 - DNA, 103 bp, Artificial Sequence
  Synthetic Polynucleotide
taatacgactcactatagggacataggtaccaggtgatgaggaggagtataacagaggagaatactcatgctcatcaccaacctggcggcagcgcaaaagatg

SEQ ID NO: 209967 - DNA, 103 bp, Artificial Sequence
  Synthetic Polynucleotide
taatacgactcactatagggagggggtcccacataggtaccaggtgatgaaacagaggagatcatcaatgggtacctataacctggcggcagcgcaaaagatg

SEQ ID NO: 209968 - DNA, 103 bp, Artificial Sequence
  Synthetic Polynucleotide
taatacgactcactatagggcgccaccaccagggggtcccacataggtacaacagaggagagtacctatgtgggaccccaacctggcggcagcgcaaaagatg

SEQ ID NO: 209969 - DNA, 103 bp, Artificial Sequence
  Synthetic Polynucleotide
taatacgactcactatagggcctggaggaccgccaccaccagggggtcccaacagaggagagggaccatgtggtggtggaacctggcggcagcgcaaaagatg

SEQ ID NO: 209970 - DNA, 103 bp, Artificial Sequence
  Synthetic Polynucleotide
taatacgactcactatagggaatgggtgttcctggaggaccgccaccaccaacagaggagaggtggtatgggtcctccaaacctggcggcagcgcaaaagatg

SEQ ID NO: 209971 - DNA, 103 bp, Artificial Sequence
  Synthetic Polynucleotide
taatacgactcactataggggactgggcataatgggtgttcctggaggacaacagaggagagtcctcatggaacacccaaacctggcggcagcgcaaaagatg

SEQ ID NO: 209972 - DNA, 103 bp, Artificial Sequence
  Synthetic Polynucleotide
taatacgactcactataggggaatctgcgggactgggcataatgggtgttaacagaggagaaacaccatgtatgcccagaacctggcggcagcgcaaaagatg

SEQ ID NO: 209973 - DNA, 103 bp, Artificial Sequence
  Synthetic Polynucleotide
taatacgactcactatagggggaatttgttgaatctgcgggactgggcataacagaggagaatgcccatgcccgcagataacctggcggcagcgcaaaagatg

SEQ ID NO: 209974 - DNA, 103 bp, Artificial Sequence
  Synthetic Polynucleotide
taatacgactcactataggggtgctcctacgtgcagtaaatattcgtagaaacagaggagatctacgatgatttactgcaacctggcggcagcgcaaaagatg

SEQ ID NO: 209975 - DNA, 103 bp, Artificial Sequence
  Synthetic Polynucleotide
taatacgactcactatagggtgttgtcactggaatttgttgaatctgcggaacagaggagaccgcagatgcaacaaattaacctggcggcagcgcaaaagatg

SEQ ID NO: 209976 - DNA, 103 bp, Artificial Sequence
  Synthetic Polynucleotide
taatacgactcactatagggattgtgtagatgttgtcactggaatttgttaacagaggagaaacaaaatgcagtgacaaaacctggcggcagcgcaaaagatg

SEQ ID NO: 209977 - DNA, 103 bp, Artificial Sequence
  Synthetic Polynucleotide
taatacgactcactatagggtggattaatcattgtgtagatgttgtcactaacagaggagaagtgacatgatctacacaaacctggcggcagcgcaaaagatg

SEQ ID NO: 209978 - DNA, 103 bp, Artificial Sequence
  Synthetic Polynucleotide
taatacgactcactatagggcaggcggcactggattaatcattgtgtagaaacagaggagatctacaatgtgattaatcaacctggcggcagcgcaaaagatg

SEQ ID NO: 209979 - DNA, 103 bp, Artificial Sequence
  Synthetic Polynucleotide
taatacgactcactatagggcggctgcctccaggcggcactggattaatcaacagaggagagattaaatgagtgccgccaacctggcggcagcgcaaaagatg

SEQ ID NO: 209980 - DNA, 103 bp, Artificial Sequence
  Synthetic Polynucleotide
taatacgactcactataggggaagttggaccggctgcctccaggcggcacaacagaggagagtgccgatgggaggcagcaacctggcggcagcgcaaaagatg

SEQ ID NO: 209981 - DNA, 103 bp, Artificial Sequence
  Synthetic Polynucleotide
taatacgactcactataggggacccatcgggaagttggaccggctgcctcaacagaggagagaggcaatgggtccaactaacctggcggcagcgcaaaagatg

SEQ ID NO: 209982 - DNA, 103 bp, Artificial Sequence
  Synthetic Polynucleotide
taatacgactcactatagggtccgagccgggacccatcgggaagttggacaacagaggagagtccaaatgcccgatgggaacctggcggcagcgcaaaagatg

SEQ ID NO: 209983 - DNA, 103 bp, Artificial Sequence
  Synthetic Polynucleotide
taatacgactcactatagggcatcggaccgtccgagccgggacccatcggaacagaggagaccgatgatgcccggctcgaacctggcggcagcgcaaaagatg

SEQ ID NO: 209984 - DNA, 103 bp, Artificial Sequence
  Synthetic Polynucleotide
taatacgactcactatagggccatgccgcccatcggaccgtccgagccggaacagaggagaccggctatgacggtccgaaacctggcggcagcgcaaaagatg

SEQ ID NO: 209985 - DNA, 103 bp, Artificial Sequence
  Synthetic Polynucleotide
taatacgactcactataggggcagatttctgtgctcctacgtgcagtaaaaacagaggagatttactatgcgtaggagcaacctggcggcagcgcaaaagatg

SEQ ID NO: 209986 - DNA, 103 bp, Artificial Sequence
  Synthetic Polynucleotide
taatacgactcactatagggtccatgccacccatgccgcccatcggaccgaacagaggagacggtccatggggcggcataacctggcggcagcgcaaaagatg

SEQ ID NO: 209987 - DNA, 103 bp, Artificial Sequence
  Synthetic Polynucleotide
taatacgactcactataggggtggtgtggctccatgccacccatgccgccaacagaggagaggcggcatgggtggcatgaacctggcggcagcgcaaaagatg

SEQ ID NO: 209988 - DNA, 103 bp, Artificial Sequence
  Synthetic Polynucleotide
taatacgactcactatagggatccattcatgtggtgtggctccatgccacaacagaggagagtggcaatgagccacaccaacctggcggcagcgcaaaagatg

SEQ ID NO: 209989 - DNA, 103 bp, Artificial Sequence
  Synthetic Polynucleotide
taatacgactcactataggggaccctaatgatccattcatgtggtgtggcaacagaggagagccacaatgcatgaatggaacctggcggcagcgcaaaagatg

SEQ ID NO: 209990 - DNA, 103 bp, Artificial Sequence
  Synthetic Polynucleotide
taatacgactcactatagggtatgtcgcctgaccctaatgatccattcataacagaggagaatgaatatgtcattagggaacctggcggcagcgcaaaagatg

SEQ ID NO: 209991 - DNA, 103 bp, Artificial Sequence
  Synthetic Polynucleotide
taatacgactcactataggggaagtccgtctatgtcgcctgaccctaatgaacagaggagacattagatgcaggcgacaaacctggcggcagcgcaaaagatg

SEQ ID NO: 209992 - DNA, 103 bp, Artificial Sequence
  Synthetic Polynucleotide
taatacgactcactataggggaattttttggaagtccgtctatgtcgcctaacagaggagaaggcgaatgagacggactaacctggcggcagcgcaaaagatg

SEQ ID NO: 209993 - DNA, 103 bp, Artificial Sequence
  Synthetic Polynucleotide
taatacgactcactataggggttgttaggagaattttttggaagtccgtcaacagaggagagacggaatgccaaaaaataacctggcggcagcgcaaaagatg

SEQ ID NO: 209994 - DNA, 103 bp, Artificial Sequence
  Synthetic Polynucleotide
taatacgactcactatagggtgccacttatgttgttaggagaattttttgaacagaggagacaaaaaatgctcctaacaaacctggcggcagcgcaaaagatg

SEQ ID NO: 209995 - DNA, 103 bp, Artificial Sequence
  Synthetic Polynucleotide
taatacgactcactatagggggattgctaatgccacttatgttgttaggaaacagaggagatcctaaatgcataagtggaacctggcggcagcgcaaaagatg

SEQ ID NO: 209996 - DNA, 103 bp, Artificial Sequence
  Synthetic Polynucleotide
taatacgactcactatagggggccgaacccttgccccccttggcgtacataacagaggagaatgtacatgaaggggggcaacctggcggcagcgcaaaagatg

SEQ ID NO: 209997 - DNA, 103 bp, Artificial Sequence
  Synthetic Polynucleotide
taatacgactcactatagggggtctgggctgacttctgggcaccgatgtgaacagaggagacacatcatggcccagaagaacctggcggcagcgcaaaagatg

SEQ ID NO: 209998 - DNA, 103 bp, Artificial Sequence
  Synthetic Polynucleotide
taatacgactcactatagggcttcggcaacccgtccatgtcgcccgagccaacagaggagaggctcgatggacatggacaacctggcggcagcgcaaaagatg

SEQ ID NO: 209999 - DNA, 103 bp, Artificial Sequence
  Synthetic Polynucleotide
taatacgactcactatagggcgggggaactcttcggcaacccgtccatgtaacagaggagaacatggatgggttgccgaaacctggcggcagcgcaaaagatg

SEQ ID NO: 210000 - DNA, 103 bp, Artificial Sequence
  Synthetic Polynucleotide
taatacgactcactataggggccacggcgccgggggaactcttcggcaacaacagaggagagttgccatggagttccccaacctggcggcagcgcaaaagatg

SEQ ID NO: 210001 - DNA, 103 bp, Artificial Sequence
  Synthetic Polynucleotide
taatacgactcactataggggctcaggccggccacggcgccgggggaactaacagaggagaagttccatgggcgccgtgaacctggcggcagcgcaaaagatg

SEQ ID NO: 210002 - DNA, 103 bp, Artificial Sequence
  Synthetic Polynucleotide
taatacgactcactatagggccggggcgttgctcaggccggccacggcgcaacagaggagagcgccgatgccggcctgaaacctggcggcagcgcaaaagatg

SEQ ID NO: 210003 - DNA, 103 bp, Artificial Sequence
  Synthetic Polynucleotide
taatacgactcactatagggcgcggggtgcccggggcgttgctcaggccgaacagaggagacggcctatgcaacgccccaacctggcggcagcgcaaaagatg

SEQ ID NO: 210004 - DNA, 103 bp, Artificial Sequence
  Synthetic Polynucleotide
taatacgactcactataggggccgtcgtcccgcggggtgcccggggcgttaacagaggagaaacgccatgggcaccccgaacctggcggcagcgcaaaagatg

SEQ ID NO: 210005 - DNA, 103 bp, Artificial Sequence
  Synthetic Polynucleotide
taatacgactcactatagggccgccatctcgccgtcgtcccgcggggtgcaacagaggagagcacccatggggacgacgaacctggcggcagcgcaaaagatg

SEQ ID NO: 210006 - DNA, 103 bp, Artificial Sequence
  Synthetic Polynucleotide
taatacgactcactataggggtcccggcggccgccatctcgccgtcgtccaacagaggagaggacgaatgcgagatggcaacctggcggcagcgcaaaagatg

SEQ ID NO: 210007 - DNA, 103 bp, Artificial Sequence
  Synthetic Polynucleotide
taatacgactcactataggggtgcaggaaggtcccggcggccgccatctcaacagaggagagagatgatggccgccgggaacctggcggcagcgcaaaagatg

SEQ ID NO: 210008 - DNA, 103 bp, Artificial Sequence
  Synthetic Polynucleotide
taatacgactcactatagggcagacaggaaggtctgggctgacttctgggaacagaggagacccagaatgcagcccagaaacctggcggcagcgcaaaagatg

SEQ ID NO: 210009 - DNA, 103 bp, Artificial Sequence
  Synthetic Polynucleotide
taatacgactcactatagggtcgggaacgggtgcaggaaggtcccggcggaacagaggagaccgccgatgccttcctgcaacctggcggcagcgcaaaagatg

SEQ ID NO: 210010 - DNA, 103 bp, Artificial Sequence
  Synthetic Polynucleotide
taatacgactcactatagggtagctttcgctcgggaacgggtgcaggaagaacagaggagacttcctatgcccgttcccaacctggcggcagcgcaaaagatg

SEQ ID NO: 210011 - DNA, 103 bp, Artificial Sequence
  Synthetic Polynucleotide
taatacgactcactatagggccctggcgagtagctttcgctcgggaacggaacagaggagaccgttcatgagcgaaagcaacctggcggcagcgcaaaagatg

SEQ ID NO: 210012 - DNA, 103 bp, Artificial Sequence
  Synthetic Polynucleotide
taatacgactcactatagggtcatggtcatccctggcgagtagctttcgcaacagaggagagcgaaaatgactcgccagaacctggcggcagcgcaaaagatg

SEQ ID NO: 210013 - DNA, 103 bp, Artificial Sequence
  Synthetic Polynucleotide
taatacgactcactatagggcatcggatctcagacaggaaggtctgggctaacagaggagaagcccaatgcttcctgtcaacctggcggcagcgcaaaagatg

SEQ ID NO: 210014 - DNA, 103 bp, Artificial Sequence
  Synthetic Polynucleotide
taatacgactcactataggggttcttctcccatcggatctcagacaggaaaacagaggagattcctgatggagatccgaaacctggcggcagcgcaaaagatg

SEQ ID NO: 210015 - DNA, 103 bp, Artificial Sequence
  Synthetic Polynucleotide
taatacgactcactatagggccagcgtgatgttcttctcccatcggatctaacagaggagaagatccatggggagaagaaacctggcggcagcgcaaaagatg

SEQ ID NO: 210016 - DNA, 103 bp, Artificial Sequence
  Synthetic Polynucleotide
taatacgactcactataggggggggctcccccagcgtgatgttcttctccaacagaggagaggagaaatgcatcacgctaacctggcggcagcgcaaaagatg

SEQ ID NO: 210017 - DNA, 103 bp, Artificial Sequence
  Synthetic Polynucleotide
taatacgactcactatagggcaggaacccagggggctcccccagcgtgataacagaggagaatcacgatgggggagcccaacctggcggcagcgcaaaagatg

SEQ ID NO: 210018 - DNA, 103 bp, Artificial Sequence
  Synthetic Polynucleotide
taatacgactcactatagggaccaggagtgcaggaacccagggggctcccaacagaggagagggagcatgctgggttccaacctggcggcagcgcaaaagatg

SEQ ID NO: 210019 - DNA, 103 bp, Artificial Sequence
  Synthetic Polynucleotide
taatacgactcactatagggaagacgcaccaccaggagtgcaggaacccaaacagaggagatgggttatggcactcctgaacctggcggcagcgcaaaagatg

SEQ ID NO: 210020 - DNA, 103 bp, Artificial Sequence
  Synthetic Polynucleotide
taatacgactcactatagggcaggtcccagaagacgcaccaccaggagtgaacagaggagacactccatgtggtgcgtcaacctggcggcagcgcaaaagatg

SEQ ID NO: 210021 - DNA, 103 bp, Artificial Sequence
  Synthetic Polynucleotide
taatacgactcactatagggcggagggcacggccgaacccttgcccccctaacagaggagaagggggatgagggttcggaacctggcggcagcgcaaaagatg

SEQ ID NO: 210022 - DNA, 103 bp, Artificial Sequence
  Synthetic Polynucleotide
taatacgactcactatagggccgcgcagtacaggtcccagaagacgcaccaacagaggagaggtgcgatgtctgggaccaacctggcggcagcgcaaaagatg

SEQ ID NO: 210023 - DNA, 103 bp, Artificial Sequence
  Synthetic Polynucleotide
taatacgactcactatagggctgtcaggcgccgcgcagtacaggtcccagaacagaggagactgggaatggtactgcgcaacctggcggcagcgcaaaagatg

SEQ ID NO: 210024 - DNA, 103 bp, Artificial Sequence
  Synthetic Polynucleotide
taatacgactcactatagggggcctctcttctgtcaggcgccgcgcagtaaacagaggagatactgcatggcgcctgacaacctggcggcagcgcaaaagatg

SEQ ID NO: 210025 - DNA, 103 bp, Artificial Sequence
  Synthetic Polynucleotide
taatacgactcactatagggagtgctcgcaggcctctcttctgtcaggcgaacagaggagacgcctgatggaagagaggaacctggcggcagcgcaaaagatg

SEQ ID NO: 210026 - DNA, 103 bp, Artificial Sequence
  Synthetic Polynucleotide
taatacgactcactataggggcctcgccggagtgctcgcaggcctctcttaacagaggagaaagagaatgctgcgagcaaacctggcggcagcgcaaaagatg

SEQ ID NO: 210027 - DNA, 103 bp, Artificial Sequence
  Synthetic Polynucleotide
taatacgactcactataggggaaggccttggcctcgccggagtgctcgcaaacagaggagatgcgagatgtccggcgagaacctggcggcagcgcaaaagatg

SEQ ID NO: 210028 - DNA, 103 bp, Artificial Sequence
  Synthetic Polynucleotide
taatacgactcactatagggtatagtcctggaaggccttggcctcgccggaacagaggagaccggcgatgccaaggcctaacctggcggcagcgcaaaagatg

SEQ ID NO: 210029 - DNA, 103 bp, Artificial Sequence
  Synthetic Polynucleotide
taatacgactcactataggggctgcagcactatagtcctggaaggccttgaacagaggagacaaggcatgccaggactaaacctggcggcagcgcaaaagatg

SEQ ID NO: 210030 - DNA, 103 bp, Artificial Sequence
  Synthetic Polynucleotide
taatacgactcactataggggctgggggcggctgcagcactatagtcctgaacagaggagacaggacatgagtgctgcaaacctggcggcagcgcaaaagatg

SEQ ID NO: 210031 - DNA, 103 bp, Artificial Sequence
  Synthetic Polynucleotide
taatacgactcactatagggccataacggggctgggggcggctgcagcacaacagaggagagtgctgatgccgcccccaaacctggcggcagcgcaaaagatg

SEQ ID NO: 210032 - DNA, 103 bp, Artificial Sequence
  Synthetic Polynucleotide
taatacgactcactataggggcctggctgtcggagggcacggccgaacccaacagaggagagggttcatgcgtgccctcaacctggcggcagcgcaaaagatg

SEQ ID NO: 210033 - DNA, 103 bp, Artificial Sequence
  Synthetic Polynucleotide
taatacgactcactataggggccatactccccataacggggctgggggcgaacagaggagacgccccatgccccgttataacctggcggcagcgcaaaagatg

SEQ ID NO: 210034 - DNA, 103 bp, Artificial Sequence
  Synthetic Polynucleotide
taatacgactcactataggggtcacctggggccatactccccataacgggaacagaggagacccgttatggggagtatgaacctggcggcagcgcaaaagatg

SEQ ID NO: 210035 - DNA, 103 bp, Artificial Sequence
  Synthetic Polynucleotide
taatacgactcactatagggcggccattgtgtcacctggggccatactccaacagaggagaggagtaatgccccaggtgaacctggcggcagcgcaaaagatg

SEQ ID NO: 210036 - DNA, 103 bp, Artificial Sequence
  Synthetic Polynucleotide
taatacgactcactatagggatggagcctgcggccattgtgtcacctgggaacagaggagacccaggatgcacaatggcaacctggcggcagcgcaaaagatg

SEQ ID NO: 210037 - DNA, 103 bp, Artificial Sequence
  Synthetic Polynucleotide
taatacgactcactataggggccagccgccatggagcctgcggccattgtaacagaggagaacaatgatggcaggctccaacctggcggcagcgcaaaagatg

SEQ ID NO: 210038 - DNA, 103 bp, Artificial Sequence
  Synthetic Polynucleotide
taatacgactcactatagggcctggaagaagccagccgccatggagcctgaacagaggagacaggctatgtggcggctgaacctggcggcagcgcaaaagatg

SEQ ID NO: 210039 - DNA, 103 bp, Artificial Sequence
  Synthetic Polynucleotide
taatacgactcactatagggccgggggggccctggaagaagccagccgccaacagaggagaggcggcatgcttcttccaaacctggcggcagcgcaaaagatg

SEQ ID NO: 210040 - DNA, 103 bp, Artificial Sequence
  Synthetic Polynucleotide
taatacgactcactatagggcggctgggagccgggggggccctggaagaaaacagaggagattcttcatgggcccccccaacctggcggcagcgcaaaagatg

SEQ ID NO: 210041 - DNA, 103 bp, Artificial Sequence
  Synthetic Polynucleotide
taatacgactcactatagggtgtggggggacggctgggagccgggggggcaacagaggagagcccccatggctcccagcaacctggcggcagcgcaaaagatg

SEQ ID NO: 210042 - DNA, 103 bp, Artificial Sequence
  Synthetic Polynucleotide
taatacgactcactataggggcgttggggttgtggggggacggctgggagaacagaggagactcccaatggtccccccaaacctggcggcagcgcaaaagatg

SEQ ID NO: 210043 - DNA, 103 bp, Artificial Sequence
  Synthetic Polynucleotide
taatacgactcactatagggcttctcgcgggcctggctgtcggagggcacaacagaggagagtgcccatggacagccagaacctggcggcagcgcaaaagatg

SEQ ID NO: 210044 - DNA, 103 bp, Artificial Sequence
  Synthetic Polynucleotide
taatacgactcactatagggcatcatgggggcgttggggttgtggggggaaacagaggagatcccccatgaaccccaacaacctggcggcagcgcaaaagatg

SEQ ID NO: 210045 - DNA, 103 bp, Artificial Sequence
  Synthetic Polynucleotide
taatacgactcactatagggcgtgaggccccatcatgggggcgttggggtaacagaggagaaccccaatgcccccatgaaacctggcggcagcgcaaaagatg

SEQ ID NO: 210046 - DNA, 103 bp, Artificial Sequence
  Synthetic Polynucleotide
taatacgactcactatagggaagggctgaccgtgaggccccatcatggggaacagaggagaccccatatgggggcctcaaacctggcggcagcgcaaaagatg

SEQ ID NO: 210047 - DNA, 103 bp, Artificial Sequence
  Synthetic Polynucleotide
taatacgactcactatagggcggtgacatgaagggctgaccgtgaggcccaacagaggagagggcctatgggtcagcccaacctggcggcagcgcaaaagatg

SEQ ID NO: 210048 - DNA, 103 bp, Artificial Sequence
  Synthetic Polynucleotide
taatacgactcactatagggctgggaagcgcggtgacatgaagggctgacaacagaggagagtcagcatgtcatgtcacaacctggcggcagcgcaaaagatg

SEQ ID NO: 210049 - DNA, 103 bp, Artificial Sequence
  Synthetic Polynucleotide
taatacgactcactatagggcgggggccccctgggaagcgcggtgacatgaacagaggagacatgtcatggcgcttcccaacctggcggcagcgcaaaagatg

SEQ ID NO: 210050 - DNA, 103 bp, Artificial Sequence
  Synthetic Polynucleotide
taatacgactcactatagggcagggtgggccgggggccccctgggaagcgaacagaggagacgcttcatggggggccccaacctggcggcagcgcaaaagatg

SEQ ID NO: 210051 - DNA, 103 bp, Artificial Sequence
  Synthetic Polynucleotide
taatacgactcactatagggtcggcatccgcagggtgggccgggggccccaacagaggagaggggccatgggcccacccaacctggcggcagcgcaaaagatg

SEQ ID NO: 210052 - DNA, 103 bp, Artificial Sequence
  Synthetic Polynucleotide
taatacgactcactatagggggaggctgactcggcatccgcagggtgggcaacagaggagagcccacatggcggatgccaacctggcggcagcgcaaaagatg

SEQ ID NO: 210053 - DNA, 103 bp, Artificial Sequence
  Synthetic Polynucleotide
taatacgactcactataggggaggcctgcgggaggctgactcggcatccgaacagaggagacggatgatgagtcagcctaacctggcggcagcgcaaaagatg

SEQ ID NO: 210054 - DNA, 103 bp, Artificial Sequence
  Synthetic Polynucleotide
taatacgactcactatagggacagcgccaacttctcgcgggcctggctgtaacagaggagaacagccatgcccgcgagaaacctggcggcagcgcaaaagatg

SEQ ID NO: 210055 - DNA, 103 bp, Artificial Sequence
  Synthetic Polynucleotide
taatacgactcactataggggggagccagggaggcctgcgggaggctgacaacagaggagagtcagcatgccgcaggccaacctggcggcagcgcaaaagatg

SEQ ID NO: 210056 - DNA, 103 bp, Artificial Sequence
  Synthetic Polynucleotide
taatacgactcactatagggaggaggggctgggagccagggaggcctgcgaacagaggagacgcaggatgccctggctcaacctggcggcagcgcaaaagatg

SEQ ID NO: 210057 - DNA, 103 bp, Artificial Sequence
  Synthetic Polynucleotide
taatacgactcactatagggggcgccagggaggaggggctgggagccaggaacagaggagacctggcatgcagcccctcaacctggcggcagcgcaaaagatg

SEQ ID NO: 210058 - DNA, 103 bp, Artificial Sequence
  Synthetic Polynucleotide
taatacgactcactatagggagggctccatggcgccagggaggaggggctaacagaggagaagccccatgtccctggcgaacctggcggcagcgcaaaagatg

SEQ ID NO: 210059 - DNA, 103 bp, Artificial Sequence
  Synthetic Polynucleotide
taatacgactcactataggggctcgtggggagggctccatggcgccagggaacagaggagaccctggatgcatggagccaacctggcggcagcgcaaaagatg

SEQ ID NO: 210060 - DNA, 103 bp, Artificial Sequence
  Synthetic Polynucleotide
taatacgactcactatagggatgcccctgggctcgtggggagggctccataacagaggagaatggagatgtccccacgaaacctggcggcagcgcaaaagatg

SEQ ID NO: 210061 - DNA, 103 bp, Artificial Sequence
  Synthetic Polynucleotide
taatacgactcactatagggccatgctcggatgcccctgggctcgtggggaacagaggagaccccacatgcccaggggcaacctggcggcagcgcaaaagatg

SEQ ID NO: 210062 - DNA, 103 bp, Artificial Sequence
  Synthetic Polynucleotide
taatacgactcactatagggattgggccgcccatgctcggatgcccctggaacagaggagaccagggatgtccgagcataacctggcggcagcgcaaaagatg

SEQ ID NO: 210063 - DNA, 103 bp, Artificial Sequence
  Synthetic Polynucleotide
taatacgactcactatagggcaccctctgcattgggccgcccatgctcggaacagaggagaccgagcatgggcggcccaaacctggcggcagcgcaaaagatg

SEQ ID NO: 210064 - DNA, 103 bp, Artificial Sequence
  Synthetic Polynucleotide
taatacgactcactataggggaggaggcgtcaccctctgcattgggccgcaacagaggagagcggccatgtgcagagggaacctggcggcagcgcaaaagatg

SEQ ID NO: 210065 - DNA, 103 bp, Artificial Sequence
  Synthetic Polynucleotide
taatacgactcactatagggtcataaacgtacagcgccaacttctcgcggaacagaggagaccgcgaatggttggcgctaacctggcggcagcgcaaaagatg

SEQ ID NO: 210066 - DNA, 103 bp, Artificial Sequence
  Synthetic Polynucleotide
taatacgactcactataggggccatgccacgaggaggcgtcaccctctgcaacagaggagagcagagatggacgcctccaacctggcggcagcgcaaaagatg

SEQ ID NO: 210067 - DNA, 103 bp, Artificial Sequence
  Synthetic Polynucleotide
taatacgactcactatagggccccacgctggccatgccacgaggaggcgtaacagaggagaacgcctatgcgtggcatgaacctggcggcagcgcaaaagatg

SEQ ID NO: 210068 - DNA, 103 bp, Artificial Sequence
  Synthetic Polynucleotide
taatacgactcactatagggagctctggggccccacgctggccatgccacaacagaggagagtggcaatgccagcgtggaacctggcggcagcgcaaaagatg

SEQ ID NO: 210069 - DNA, 103 bp, Artificial Sequence
  Synthetic Polynucleotide
taatacgactcactatagggccacctccatagctctggggccccacgctgaacagaggagacagcgtatggccccagagaacctggcggcagcgcaaaagatg

SEQ ID NO: 210070 - DNA, 103 bp, Artificial Sequence
  Synthetic Polynucleotide
taatacgactcactataggggggtcgcatgccacctccatagctctggggaacagaggagaccccagatgtatggaggtaacctggcggcagcgcaaaagatg

SEQ ID NO: 210071 - DNA, 103 bp, Artificial Sequence
  Synthetic Polynucleotide
taatacgactcactatagggagttgggtgggggtcgcatgccacctccataacagaggagaatggagatggcatgcgacaacctggcggcagcgcaaaagatg

SEQ ID NO: 210072 - DNA, 103 bp, Artificial Sequence
  Synthetic Polynucleotide
taatacgactcactatagggccggcgagggagttgggtgggggtcgcatgaacagaggagacatgcgatgcccacccaaaacctggcggcagcgcaaaagatg

SEQ ID NO: 210073 - DNA, 103 bp, Artificial Sequence
  Synthetic Polynucleotide
taatacgactcactatagggcaggcctgggccggcgagggagttgggtggaacagaggagaccacccatgtccctcgccaacctggcggcagcgcaaaagatg

SEQ ID NO: 210074 - DNA, 103 bp, Artificial Sequence
  Synthetic Polynucleotide
taatacgactcactatagggtcatggcaggcaggcctgggccggcgagggaacagaggagaccctcgatggcccaggccaacctggcggcagcgcaaaagatg

SEQ ID NO: 210075 - DNA, 103 bp, Artificial Sequence
  Synthetic Polynucleotide
taatacgactcactataggggggcccatgttcatggcaggcaggcctgggaacagaggagacccaggatggcctgccataacctggcggcagcgcaaaagatg

SEQ ID NO: 210076 - DNA, 103 bp, Artificial Sequence
  Synthetic Polynucleotide
taatacgactcactatagggcagcaggtactcataaacgtacagcgccaaaacagaggagattggcgatgtacgtttataacctggcggcagcgcaaaagatg

SEQ ID NO: 210077 - DNA, 103 bp, Artificial Sequence
  Synthetic Polynucleotide
taatacgactcactatagggacgaactcctgggcccatgttcatggcaggaacagaggagacctgccatgaacatgggcaacctggcggcagcgcaaaagatg

SEQ ID NO: 210078 - DNA, 103 bp, Artificial Sequence
  Synthetic Polynucleotide
taatacgactcactatagggcccacgggccacgaactcctgggcccatgtaacagaggagaacatggatgcaggagttcaacctggcggcagcgcaaaagatg

SEQ ID NO: 210079 - DNA, 103 bp, Artificial Sequence
  Synthetic Polynucleotide
taatacgactcactatagggctggggctggcccacgggccacgaactcctaacagaggagaaggagtatgtggcccgtgaacctggcggcagcgcaaaagatg

SEQ ID NO: 210080 - DNA, 103 bp, Artificial Sequence
  Synthetic Polynucleotide
taatacgactcactatagggcgagtttccactggggctggcccacgggccaacagaggagaggcccgatggccagccccaacctggcggcagcgcaaaagatg

SEQ ID NO: 210081 - DNA, 103 bp, Artificial Sequence
  Synthetic Polynucleotide
taatacgactcactatagggagtaggggatcgagtttccactggggctggaacagaggagaccagccatggtggaaactaacctggcggcagcgcaaaagatg

SEQ ID NO: 210082 - DNA, 103 bp, Artificial Sequence
  Synthetic Polynucleotide
taatacgactcactataggggatgaggaggagtaggggatcgagtttccaaacagaggagatggaaaatggatcccctaaacctggcggcagcgcaaaagatg

SEQ ID NO: 210083 - DNA, 103 bp, Artificial Sequence
  Synthetic Polynucleotide
taatacgactcactataggggctgccgggggatgaggaggagtaggggataacagaggagaatccccatgtcctcctcaaacctggcggcagcgcaaaagatg

SEQ ID NO: 210084 - DNA, 103 bp, Artificial Sequence
  Synthetic Polynucleotide
taatacgactcactataggggtccggtgtagctgccgggggatgaggaggaacagaggagacctcctatgcccccggcaaacctggcggcagcgcaaaagatg

SEQ ID NO: 210085 - DNA, 103 bp, Artificial Sequence
  Synthetic Polynucleotide
taatacgactcactatagggcctcctgggggtccggtgtagctgccggggaacagaggagaccccggatgctacaccggaacctggcggcagcgcaaaagatg

SEQ ID NO: 210086 - DNA, 103 bp, Artificial Sequence
  Synthetic Polynucleotide
taatacgactcactataggggggcccacctcctcctgggggtccggtgtaaacagaggagatacaccatgcccccaggaaacctggcggcagcgcaaaagatg

SEQ ID NO: 210087 - DNA, 103 bp, Artificial Sequence
  Synthetic Polynucleotide
taatacgactcactatagggcaccgatgtgcagcaggtactcataaacgtaacagaggagaacgtttatgagtacctgcaacctggcggcagcgcaaaagatg

SEQ ID NO: 210088 - DNA, 103 bp, Artificial Sequence
  Synthetic Polynucleotide
taatacgactcactataggggtgttccagggggcccacctcctcctggggaacagaggagaccccagatggaggtgggcaacctggcggcagcgcaaaagatg

SEQ ID NO: 210089 - DNA, 103 bp, Artificial Sequence
  Synthetic Polynucleotide
taatacgactcactatagggggcatgatgggtgttccagggggcccacctaacagaggagaaggtggatgccctggaacaacctggcggcagcgcaaaagatg

SEQ ID NO: 210090 - DNA, 103 bp, Artificial Sequence
  Synthetic Polynucleotide
taatacgactcactatagggtccagggctaggcatgatgggtgttccaggaacagaggagacctggaatgcccatcatgaacctggcggcagcgcaaaagatg

SEQ ID NO: 210091 - DNA, 103 bp, Artificial Sequence
  Synthetic Polynucleotide
taatacgactcactatagggtggtggaatctccagggctaggcatgatggaacagaggagaccatcaatgctagccctgaacctggcggcagcgcaaaagatg

SEQ ID NO: 210092 - DNA, 103 bp, Artificial Sequence
  Synthetic Polynucleotide
taatacgactcactatagggtcgctggagttggtggaatctccagggctaaacagaggagatagcccatgagattccacaacctggcggcagcgcaaaagatg

SEQ ID NO: 210093 - DNA, 103 bp, Artificial Sequence
  Synthetic Polynucleotide
taatacgactcactataggggtacatgttttcgctggagttggtggaatcaacagaggagagattccatgaactccagcaacctggcggcagcgcaaaagatg

SEQ ID NO: 210094 - DNA, 103 bp, Artificial Sequence
  Synthetic Polynucleotide
taatacgactcactatagggtcatgatagtgtacatgttttcgctggagtaacagaggagaactccaatgaaaacatgtaacctggcggcagcgcaaaagatg

SEQ ID NO: 210095 - DNA, 103 bp, Artificial Sequence
  Synthetic Polynucleotide
taatacgactcactatagggccgatggggttcatgatagtgtacatgtttaacagaggagaaaacatatgcactatcataacctggcggcagcgcaaaagatg

SEQ ID NO: 210096 - DNA, 103 bp, Artificial Sequence
  Synthetic Polynucleotide
taatacgactcactatagggggcgccctgcccgatggggttcatgatagtaacagaggagaactatcatgaaccccatcaacctggcggcagcgcaaaagatg

SEQ ID NO: 210097 - DNA, 103 bp, Artificial Sequence
  Synthetic Polynucleotide
taatacgactcactatagggtagccctgccggcgccctgcccgatggggtaacagaggagaaccccaatgggcagggcgaacctggcggcagcgcaaaagatg

SEQ ID NO: 210098 - DNA, 103 bp, Artificial Sequence
  Synthetic Polynucleotide
taatacgactcactataggggacttctgggcaccgatgtgcagcaggtacaacagaggagagtacctatggcacatcggaacctggcggcagcgcaaaagatg

SEQ ID NO: 210099 - DNA, 103 bp, Artificial Sequence
  Synthetic Polynucleotide
taatacgactcactatagggagcgggaaattagccctgccggcgccctgcaacagaggagagcagggatgcggcagggcaacctggcggcagcgcaaaagatg

SEQ ID NO: 210100 - DNA, 103 bp, Artificial Sequence
  Synthetic Polynucleotide
taatacgactcactataggggccagggccgagcgggaaattagccctgccaacagaggagaggcaggatgaatttcccgaacctggcggcagcgcaaaagatg

SEQ ID NO: 210101 - DNA, 103 bp, Artificial Sequence
  Synthetic Polynucleotide
taatacgactcactatagggggccctccgggccagggccgagcgggaaataacagaggagaatttccatgtcggccctgaacctggcggcagcgcaaaagatg

SEQ ID NO: 210102 - DNA, 103 bp, Artificial Sequence
  Synthetic Polynucleotide
taatacgactcactataggggcggccatggggccctccgggccagggccgaacagaggagacggcccatgcccggagggaacctggcggcagcgcaaaagatg

SEQ ID NO: 210103 - DNA, 103 bp, Artificial Sequence
  Synthetic Polynucleotide
taatacgactcactatagggcgcgctcatggcggccatggggccctccggaacagaggagaccggagatgcccatggccaacctggcggcagcgcaaaagatg

SEQ ID NO: 210104 - DNA, 103 bp, Artificial Sequence
  Synthetic Polynucleotide
taatacgactcactataggggaggctccatcgcgctcatggcggccatggaacagaggagaccatggatgccatgagcgaacctggcggcagcgcaaaagatg

SEQ ID NO: 210105 - DNA, 103 bp, Artificial Sequence
  Synthetic Polynucleotide
taatacgactcactatagggttcacgtggtgaggctccatcgcgctcatgaacagaggagacatgagatggatggagccaacctggcggcagcgcaaaagatg

SEQ ID NO: 210106 - DNA, 103 bp, Artificial Sequence
  Synthetic Polynucleotide
taatacgactcactatagggcagggatccgttcacgtggtgaggctccataacagaggagaatggagatgcaccacgtgaacctggcggcagcgcaaaagatg

SEQ ID NO: 210107 - DNA, 103 bp, Artificial Sequence
  Synthetic Polynucleotide
taatacgactcactatagggcgcccgagcccagggatccgttcacgtggtaacagaggagaaccacgatgacggatcccaacctggcggcagcgcaaaagatg

SEQ ID NO: 210108 - DNA, 103 bp, Artificial Sequence
  Synthetic Polynucleotide
taatacgactcactatagggccgtccatgtcgcccgagcccagggatccgaacagaggagacggatcatggggctcgggaacctggcggcagcgcaaaagatg

SEQ ID NO: 210109 - DNA, 103 bp, Artificial Sequence
  Synthetic Polynucleotide
taatacgactcactatagggcagcgttttatcttcagcctctgcatccataacagaggagaatggatatggaggctgaaaacctggcggcagcgcaaaagatg

SEQ ID NO: 210110 - DNA, 103 bp, Artificial Sequence
  Synthetic Polynucleotide
taatacgactcactatagggtctcttctttgccatggagcaatcataggcaacagaggagagcctatatgtgctccatgaacctggcggcagcgcaaaagatg

SEQ ID NO: 210111 - DNA, 103 bp, Artificial Sequence
  Synthetic Polynucleotide
taatacgactcactatagggcctcctttcccctgctaggtgctccagcagaacagaggagactgctgatgcacctagcaaacctggcggcagcgcaaaagatg

SEQ ID NO: 210112 - DNA, 103 bp, Artificial Sequence
  Synthetic Polynucleotide
taatacgactcactatagggctttggtttgcctcctttcccctgctaggtaacagaggagaacctagatggggaaaggaaacctggcggcagcgcaaaagatg

SEQ ID NO: 210113 - DNA, 103 bp, Artificial Sequence
  Synthetic Polynucleotide
taatacgactcactatagggatgtcgataactttggtttgcctcctttccaacagaggagaggaaagatggcaaaccaaaacctggcggcagcgcaaaagatg

SEQ ID NO: 210114 - DNA, 103 bp, Artificial Sequence
  Synthetic Polynucleotide
taatacgactcactatagggtcttccacccatgtcgataactttggtttgaacagaggagacaaaccatggttatcgacaacctggcggcagcgcaaaagatg

SEQ ID NO: 210115 - DNA, 103 bp, Artificial Sequence
  Synthetic Polynucleotide
taatacgactcactatagggtaaagatttgtcttccacccatgtcgataaaacagaggagattatcgatgtgggtggaaaacctggcggcagcgcaaaagatg

SEQ ID NO: 210116 - DNA, 103 bp, Artificial Sequence
  Synthetic Polynucleotide
taatacgactcactatagggtgtttattgttaaagatttgtcttccacccaacagaggagagggtggatgacaaatcttaacctggcggcagcgcaaaagatg

SEQ ID NO: 210117 - DNA, 103 bp, Artificial Sequence
  Synthetic Polynucleotide
taatacgactcactatagggccttggtgaatgtttattgttaaagatttgaacagaggagacaaatcatgaacaataaaaacctggcggcagcgcaaaagatg

SEQ ID NO: 210118 - DNA, 103 bp, Artificial Sequence
  Synthetic Polynucleotide
taatacgactcactatagggtcttttcaggccttggtgaatgtttattgtaacagaggagaacaataatgattcaccaaaacctggcggcagcgcaaaagatg

SEQ ID NO: 210119 - DNA, 103 bp, Artificial Sequence
  Synthetic Polynucleotide
taatacgactcactatagggttggtctccctcttttcaggccttggtgaaaacagaggagattcaccatggcctgaaaaaacctggcggcagcgcaaaagatg

SEQ ID NO: 210120 - DNA, 103 bp, Artificial Sequence
  Synthetic Polynucleotide
taatacgactcactataggggatcgggcacttggtctccctcttttcaggaacagaggagacctgaaatgagggagaccaacctggcggcagcgcaaaagatg

SEQ ID NO: 210121 - DNA, 103 bp, Artificial Sequence
  Synthetic Polynucleotide
taatacgactcactatagggcttcagctgttctcttctttgccatggagcaacagaggagagctccaatgcaaagaagaaacctggcggcagcgcaaaagatg

SEQ ID NO: 210122 - DNA, 103 bp, Artificial Sequence
  Synthetic Polynucleotide
taatacgactcactatagggcacatccagggatcgggcacttggtctcccaacagaggagagggagaatgagtgcccgaaacctggcggcagcgcaaaagatg

SEQ ID NO: 210123 - DNA, 103 bp, Artificial Sequence
  Synthetic Polynucleotide
taatacgactcactatagggcccgtgccatcacatccagggatcgggcacaacagaggagagtgcccatgccctggatgaacctggcggcagcgcaaaagatg

SEQ ID NO: 210124 - DNA, 103 bp, Artificial Sequence
  Synthetic Polynucleotide
taatacgactcactatagggtgtcacgtgtcccgtgccatcacatccaggaacagaggagacctggaatggatggcacgaacctggcggcagcgcaaaagatg

SEQ ID NO: 210125 - DNA, 103 bp, Artificial Sequence
  Synthetic Polynucleotide
taatacgactcactatagggggtagagccctgtcacgtgtcccgtgccataacagaggagaatggcaatggacacgtgaaacctggcggcagcgcaaaagatg

SEQ ID NO: 210126 - DNA, 103 bp, Artificial Sequence
  Synthetic Polynucleotide
taatacgactcactatagggcggtggtgcgggtagagccctgtcacgtgtaacagaggagaacacgtatgagggctctaaacctggcggcagcgcaaaagatg

SEQ ID NO: 210127 - DNA, 103 bp, Artificial Sequence
  Synthetic Polynucleotide
taatacgactcactatagggcgaaaggctgcggtggtgcgggtagagcccaacagaggagagggctcatgccgcaccacaacctggcggcagcgcaaaagatg

SEQ ID NO: 210128 - DNA, 103 bp, Artificial Sequence
  Synthetic Polynucleotide
taatacgactcactataggggggggcaccccgaaaggctgcggtggtgcgaacagaggagacgcaccatggcagcctttaacctggcggcagcgcaaaagatg

SEQ ID NO: 210129 - DNA, 103 bp, Artificial Sequence
  Synthetic Polynucleotide
taatacgactcactatagggcgcactttgtgggggcaccccgaaaggctgaacagaggagacagcctatgggggtgcccaacctggcggcagcgcaaaagatg

SEQ ID NO: 210130 - DNA, 103 bp, Artificial Sequence
  Synthetic Polynucleotide
taatacgactcactatagggcaggggaacccgcactttgtgggggcacccaacagaggagagggtgcatgcacaaagtgaacctggcggcagcgcaaaagatg

SEQ ID NO: 210131 - DNA, 103 bp, Artificial Sequence
  Synthetic Polynucleotide
taatacgactcactatagggcaagaatttccaggggaacccgcactttgtaacagaggagaacaaagatggggttccccaacctggcggcagcgcaaaagatg

SEQ ID NO: 210132 - DNA, 103 bp, Artificial Sequence
  Synthetic Polynucleotide
taatacgactcactatagggaaagcctgatcttcagctgttctcttctttaacagaggagaaaagaaatgaacagctgaaacctggcggcagcgcaaaagatg

SEQ ID NO: 210133 - DNA, 103 bp, Artificial Sequence
  Synthetic Polynucleotide
taatacgactcactatagggtcatgcatggcaagaatttccaggggaaccaacagaggagaggttccatgggaaattctaacctggcggcagcgcaaaagatg

SEQ ID NO: 210134 - DNA, 103 bp, Artificial Sequence
  Synthetic Polynucleotide
taatacgactcactataggggagcacattttcatgcatggcaagaatttcaacagaggagagaaattatggccatgcataacctggcggcagcgcaaaagatg

SEQ ID NO: 210135 - DNA, 103 bp, Artificial Sequence
  Synthetic Polynucleotide
taatacgactcactatagggtgggacacttgagcacattttcatgcatggaacagaggagaccatgcatgaaaatgtgcaacctggcggcagcgcaaaagatg

SEQ ID NO: 210136 - DNA, 103 bp, Artificial Sequence
  Synthetic Polynucleotide
taatacgactcactatagggcatcccggcgtgggacacttgagcacatttaacagaggagaaaatgtatgcaagtgtccaacctggcggcagcgcaaaagatg

SEQ ID NO: 210137 - DNA, 103 bp, Artificial Sequence
  Synthetic Polynucleotide
taatacgactcactatagggccttcctgtgcatcccggcgtgggacacttaacagaggagaaagtgtatgacgccgggaaacctggcggcagcgcaaaagatg

SEQ ID NO: 210138 - DNA, 103 bp, Artificial Sequence
  Synthetic Polynucleotide
taatacgactcactatagggtcacatgaccccttcctgtgcatcccggcgaacagaggagacgccggatggcacaggaaaacctggcggcagcgcaaaagatg

SEQ ID NO: 210139 - DNA, 103 bp, Artificial Sequence
  Synthetic Polynucleotide
taatacgactcactatagggcggttgctgttcacatgaccccttcctgtgaacagaggagacacaggatggggtcatgtaacctggcggcagcgcaaaagatg

SEQ ID NO: 210140 - DNA, 103 bp, Artificial Sequence
  Synthetic Polynucleotide
taatacgactcactataggggtgggtgttgcggttgctgttcacatgaccaacagaggagaggtcatatgaacagcaacaacctggcggcagcgcaaaagatg

SEQ ID NO: 210141 - DNA, 103 bp, Artificial Sequence
  Synthetic Polynucleotide
taatacgactcactatagggaaagactcctgtgggtgttgcggttgctgtaacagaggagaacagcaatggcaacacccaacctggcggcagcgcaaaagatg

SEQ ID NO: 210142 - DNA, 103 bp, Artificial Sequence
  Synthetic Polynucleotide
taatacgactcactatagggggacaaccagaaagactcctgtgggtgttgaacagaggagacaacacatgcaggagtctaacctggcggcagcgcaaaagatg

SEQ ID NO: 210143 - DNA, 103 bp, Artificial Sequence
  Synthetic Polynucleotide
taatacgactcactatagggtggaacccccaaagcctgatcttcagctgtaacagaggagaacagctatggatcaggctaacctggcggcagcgcaaaagatg

SEQ ID NO: 210144 - DNA, 103 bp, Artificial Sequence
  Synthetic Polynucleotide
taatacgactcactatagggtgcagcaattggacaaccagaaagactcctaacagaggagaaggagtatgtctggttgtaacctggcggcagcgcaaaagatg

SEQ ID NO: 210145 - DNA, 103 bp, Artificial Sequence
  Synthetic Polynucleotide
taatacgactcactatagggatttttcagctgcagcaattggacaaccagaacagaggagactggttatgcaattgctgaacctggcggcagcgcaaaagatg

SEQ ID NO: 210146 - DNA, 103 bp, Artificial Sequence
  Synthetic Polynucleotide
taatacgactcactataggggacattgccaatttttcagctgcagcaattaacagaggagaaattgcatgagctgaaaaaacctggcggcagcgcaaaagatg

SEQ ID NO: 210147 - DNA, 103 bp, Artificial Sequence
  Synthetic Polynucleotide
taatacgactcactatagggtttatcctgggacattgccaatttttcagcaacagaggagagctgaaatgttggcaatgaacctggcggcagcgcaaaagatg

SEQ ID NO: 210148 - DNA, 103 bp, Artificial Sequence
  Synthetic Polynucleotide
taatacgactcactatagggcaagctgatttttatcctgggacattgccaaacagaggagatggcaaatgcccaggataaacctggcggcagcgcaaaagatg

SEQ ID NO: 210149 - DNA, 103 bp, Artificial Sequence
  Synthetic Polynucleotide
taatacgactcactatagggtggggagaatcaagctgatttttatcctggaacagaggagaccaggaatgaaatcagctaacctggcggcagcgcaaaagatg

SEQ ID NO: 210150 - DNA, 103 bp, Artificial Sequence
  Synthetic Polynucleotide
taatacgactcactatagggctgcccagtttggggagaatcaagctgattaacagaggagaaatcagatggattctcccaacctggcggcagcgcaaaagatg

SEQ ID NO: 210151 - DNA, 103 bp, Artificial Sequence
  Synthetic Polynucleotide
taatacgactcactatagggggtcaggacactgcccagtttggggagaataacagaggagaattctcatgaaactgggcaacctggcggcagcgcaaaagatg

SEQ ID NO: 210152 - DNA, 103 bp, Artificial Sequence
  Synthetic Polynucleotide
taatacgactcactatagggctgtgggcctggtcaggacactgcccagttaacagaggagaaactggatggtgtcctgaaacctggcggcagcgcaaaagatg

SEQ ID NO: 210153 - DNA, 103 bp, Artificial Sequence
  Synthetic Polynucleotide
taatacgactcactatagggcaaacttgtcctgtgggcctggtcaggacaaacagaggagatgtcctatgcaggcccacaacctggcggcagcgcaaaagatg

SEQ ID NO: 210154 - DNA, 103 bp, Artificial Sequence
  Synthetic Polynucleotide
taatacgactcactatagggttttgttgactggaacccccaaagcctgataacagaggagaatcaggatgtgggggttcaacctggcggcagcgcaaaagatg

SEQ ID NO: 210155 - DNA, 103 bp, Artificial Sequence
  Synthetic Polynucleotide
taatacgactcactatagggtttgcttcaccaaacttgtcctgtgggcctaacagaggagaaggcccatgggacaagttaacctggcggcagcgcaaaagatg

SEQ ID NO: 210156 - DNA, 103 bp, Artificial Sequence
  Synthetic Polynucleotide
taatacgactcactatagggttgaattcaatttgcttcaccaaacttgtcaacagaggagagacaagatgggtgaagcaaacctggcggcagcgcaaaagatg

SEQ ID NO: 210157 - DNA, 103 bp, Artificial Sequence
  Synthetic Polynucleotide
taatacgactcactatagggtgacgggaaattgaattcaatttgcttcacaacagaggagagtgaagatgattgaattcaacctggcggcagcgcaaaagatg

SEQ ID NO: 210158 - DNA, 103 bp, Artificial Sequence
  Synthetic Polynucleotide
taatacgactcactatagggtgatggcttgtgacgggaaattgaattcaaaacagaggagattgaatatgatttcccgtaacctggcggcagcgcaaaagatg

SEQ ID NO: 210159 - DNA, 103 bp, Artificial Sequence
  Synthetic Polynucleotide
taatacgactcactatagggctgggagaggtgatggcttgtgacgggaaaaacagaggagatttcccatgacaagccataacctggcggcagcgcaaaagatg

SEQ ID NO: 210160 - DNA, 103 bp, Artificial Sequence
  Synthetic Polynucleotide
taatacgactcactatagggcactgtggctctgggagaggtgatggcttgaacagaggagacaagccatgacctctcccaacctggcggcagcgcaaaagatg

SEQ ID NO: 210161 - DNA, 103 bp, Artificial Sequence
  Synthetic Polynucleotide
taatacgactcactataggggttcttttgacactgtggctctgggagaggaacagaggagacctctcatggagccacagaacctggcggcagcgcaaaagatg

SEQ ID NO: 210162 - DNA, 103 bp, Artificial Sequence
  Synthetic Polynucleotide
taatacgactcactatagggaacttctcttgttcttttgacactgtggctaacagaggagaagccacatggtcaaaagaaacctggcggcagcgcaaaagatg

SEQ ID NO: 210163 - DNA, 103 bp, Artificial Sequence
  Synthetic Polynucleotide
taatacgactcactatagggtacttttccaaacttctcttgttcttttgaaacagaggagatcaaaaatgcaagagaagaacctggcggcagcgcaaaagatg

SEQ ID NO: 210164 - DNA, 103 bp, Artificial Sequence
  Synthetic Polynucleotide
taatacgactcactatagggaatcaaatggtacttttccaaacttctcttaacagaggagaaagagaatgttggaaaagaacctggcggcagcgcaaaagatg

SEQ ID NO: 210165 - DNA, 103 bp, Artificial Sequence
  Synthetic Polynucleotide
taatacgactcactatagggagggatttccttttgttgactggaacccccaacagaggagagggggtatgagtcaacaaaacctggcggcagcgcaaaagatg

SEQ ID NO: 210166 - DNA, 103 bp, Artificial Sequence
  Synthetic Polynucleotide
taatacgactcactatagggaaactggcataatcaaatggtacttttccaaacagaggagatggaaaatgaccatttgaaacctggcggcagcgcaaaagatg

SEQ ID NO: 210167 - DNA, 103 bp, Artificial Sequence
  Synthetic Polynucleotide
taatacgactcactatagggttgggcatcaaaactggcataatcaaatggaacagaggagaccatttatgtatgccagtaacctggcggcagcgcaaaagatg

SEQ ID NO: 210168 - DNA, 103 bp, Artificial Sequence
  Synthetic Polynucleotide
taatacgactcactatagggtaccgaaaacttgggcatcaaaactggcataacagaggagaatgccaatgttgatgcccaacctggcggcagcgcaaaagatg

SEQ ID NO: 210169 - DNA, 103 bp, Artificial Sequence
  Synthetic Polynucleotide
taatacgactcactatagggagagggcgtttaccgaaaacttgggcatcaaacagaggagatgatgcatgagttttcggaacctggcggcagcgcaaaagatg

SEQ ID NO: 210170 - DNA, 103 bp, Artificial Sequence
  Synthetic Polynucleotide
taatacgactcactatagggtgtttgtatgagagggcgtttaccgaaaacaacagaggagagttttcatgaaacgccctaacctggcggcagcgcaaaagatg

SEQ ID NO: 210171 - DNA, 103 bp, Artificial Sequence
  Synthetic Polynucleotide
taatacgactcactataggggtccttgcactgtttgtatgagagggcgttaacagaggagaaacgccatgtcatacaaaaacctggcggcagcgcaaaagatg

SEQ ID NO: 210172 - DNA, 103 bp, Artificial Sequence
  Synthetic Polynucleotide
taatacgactcactatagggggtgtttttcgtccttgcactgtttgtatgaacagaggagacatacaatgagtgcaaggaacctggcggcagcgcaaaagatg

SEQ ID NO: 210173 - DNA, 103 bp, Artificial Sequence
  Synthetic Polynucleotide
taatacgactcactatagggaggaaatggtggtgtttttcgtccttgcacaacagaggagagtgcaaatgcgaaaaacaaacctggcggcagcgcaaaagatg

SEQ ID NO: 210174 - DNA, 103 bp, Artificial Sequence
  Synthetic Polynucleotide
taatacgactcactataggggctttgattcaggaaatggtggtgtttttcaacagaggagagaaaaaatgcaccatttcaacctggcggcagcgcaaaagatg

SEQ ID NO: 210175 - DNA, 103 bp, Artificial Sequence
  Synthetic Polynucleotide
taatacgactcactatagggtttggaaaatgctttgattcaggaaatggtaacagaggagaaccattatgtgaatcaaaaacctggcggcagcgcaaaagatg

SEQ ID NO: 210176 - DNA, 103 bp, Artificial Sequence
  Synthetic Polynucleotide
taatacgactcactatagggcttcattagcagggatttccttttgttgacaacagaggagagtcaacatgaggaaatccaacctggcggcagcgcaaaagatg

SEQ ID NO: 210177 - DNA, 103 bp, Artificial Sequence
  Synthetic Polynucleotide
taatacgactcactatagggtttcactggatttggaaaatgctttgattcaacagaggagagaatcaatgcattttccaaacctggcggcagcgcaaaagatg

SEQ ID NO: 210178 - DNA, 103 bp, Artificial Sequence
  Synthetic Polynucleotide
taatacgactcactataggggattaggaaatttcactggatttggaaaataacagaggagaattttcatgatccagtgaaacctggcggcagcgcaaaagatg

SEQ ID NO: 210179 - DNA, 103 bp, Artificial Sequence
  Synthetic Polynucleotide
taatacgactcactatagggctaggcagtcgattaggaaatttcactggaaacagaggagatccagtatgatttcctaaaacctggcggcagcgcaaaagatg

SEQ ID NO: 210180 - DNA, 103 bp, Artificial Sequence
  Synthetic Polynucleotide
taatacgactcactatagggggcgcctgcactaggcagtcgattaggaaaaacagaggagatttcctatgcgactgcctaacctggcggcagcgcaaaagatg

SEQ ID NO: 210181 - DNA, 103 bp, Artificial Sequence
  Synthetic Polynucleotide
taatacgactcactatagggtctgggtgtgggcgcctgcactaggcagtcaacagaggagagactgcatggtgcaggcgaacctggcggcagcgcaaaagatg

SEQ ID NO: 210182 - DNA, 103 bp, Artificial Sequence
  Synthetic Polynucleotide
taatacgactcactatagggcggccagggctctgggtgtgggcgcctgcaaacagaggagatgcaggatgccacacccaaacctggcggcagcgcaaaagatg

SEQ ID NO: 210183 - DNA, 103 bp, Artificial Sequence
  Synthetic Polynucleotide
taatacgactcactatagggagagctggcacggccagggctctgggtgtgaacagaggagacacaccatgagccctggcaacctggcggcagcgcaaaagatg

SEQ ID NO: 210184 - DNA, 103 bp, Artificial Sequence
  Synthetic Polynucleotide
taatacgactcactatagggcgtagctataagagctggcacggccagggcaacagaggagagccctgatggtgccagctaacctggcggcagcgcaaaagatg

SEQ ID NO: 210185 - DNA, 103 bp, Artificial Sequence
  Synthetic Polynucleotide
taatacgactcactatagggctacattgaccgtagctataagagctggcaaacagaggagatgccagatgttatagctaaacctggcggcagcgcaaaagatg

SEQ ID NO: 210186 - DNA, 103 bp, Artificial Sequence
  Synthetic Polynucleotide
taatacgactcactatagggggtgtcttcactacattgaccgtagctataaacagaggagatatagcatgggtcaatgtaacctggcggcagcgcaaaagatg

SEQ ID NO: 210187 - DNA, 103 bp, Artificial Sequence
  Synthetic Polynucleotide
taatacgactcactatagggagtgtcggggcttcattagcagggatttccaacagaggagaggaaatatgtgctaatgaaacctggcggcagcgcaaaagatg

SEQ ID NO: 210188 - DNA, 103 bp, Artificial Sequence
  Synthetic Polynucleotide
taatacgactcactatagggctgctatgtgggtgtcttcactacattgacaacagaggagagtcaatatggtgaagacaaacctggcggcagcgcaaaagatg

SEQ ID NO: 210189 - DNA, 103 bp, Artificial Sequence
  Synthetic Polynucleotide
taatacgactcactataggggcagcagctgctgctatgtgggtgtcttcaaacagaggagatgaagaatgccacatagcaacctggcggcagcgcaaaagatg

SEQ ID NO: 210190 - DNA, 103 bp, Artificial Sequence
  Synthetic Polynucleotide
taatacgactcactataggggttcaggatggcagcagctgctgctatgtgaacagaggagacacataatggcagctgctaacctggcggcagcgcaaaagatg

SEQ ID NO: 210191 - DNA, 103 bp, Artificial Sequence
  Synthetic Polynucleotide
taatacgactcactataggggggtggaaaggttcaggatggcagcagctgaacagaggagacagctgatgccatcctgaaacctggcggcagcgcaaaagatg

SEQ ID NO: 210192 - DNA, 103 bp, Artificial Sequence
  Synthetic Polynucleotide
taatacgactcactatagggtccctgcagcgggtggaaaggttcaggatgaacagaggagacatcctatgcctttccacaacctggcggcagcgcaaaagatg

SEQ ID NO: 210193 - DNA, 103 bp, Artificial Sequence
  Synthetic Polynucleotide
taatacgactcactataggggtctgtggcttccctgcagcgggtggaaagaacagaggagactttccatgcgctgcaggaacctggcggcagcgcaaaagatg

SEQ ID NO: 210194 - DNA, 103 bp, Artificial Sequence
  Synthetic Polynucleotide
taatacgactcactatagggtggagaggatgtctgtggcttccctgcagcaacagaggagagctgcaatgaagccacagaacctggcggcagcgcaaaagatg

SEQ ID NO: 210195 - DNA, 103 bp, Artificial Sequence
  Synthetic Polynucleotide
taatacgactcactatagggtgtggcttgttggagaggatgtctgtggctaacagaggagaagccacatgcatcctctcaacctggcggcagcgcaaaagatg

SEQ ID NO: 210196 - DNA, 103 bp, Artificial Sequence
  Synthetic Polynucleotide
taatacgactcactatagggatgcagactctgtggcttgttggagaggataacagaggagaatcctcatgaacaagccaaacctggcggcagcgcaaaagatg

SEQ ID NO: 210197 - DNA, 103 bp, Artificial Sequence
  Synthetic Polynucleotide
taatacgactcactatagggctcccttggcatgcagactctgtggcttgtaacagaggagaacaagcatgagagtctgcaacctggcggcagcgcaaaagatg

SEQ ID NO: 210198 - DNA, 103 bp, Artificial Sequence
  Synthetic Polynucleotide
taatacgactcactatagggtttgggctgtagtgtcggggcttcattagcaacagaggagagctaatatggccccgacaaacctggcggcagcgcaaaagatg

SEQ ID NO: 210199 - DNA, 103 bp, Artificial Sequence
  Synthetic Polynucleotide
taatacgactcactatagggtctatttcggctcccttggcatgcagactcaacagaggagagagtctatgtgccaagggaacctggcggcagcgcaaaagatg

SEQ ID NO: 210200 - DNA, 103 bp, Artificial Sequence
  Synthetic Polynucleotide
taatacgactcactatagggttcatccacttctatttcggctcccttggcaacagaggagagccaagatggccgaaataaacctggcggcagcgcaaaagatg

SEQ ID NO: 210201 - DNA, 103 bp, Artificial Sequence
  Synthetic Polynucleotide
taatacgactcactatagggatgtgccattttcatccacttctatttcggaacagaggagaccgaaaatgaagtggatgaacctggcggcagcgcaaaagatg

SEQ ID NO: 210202 - DNA, 103 bp, Artificial Sequence
  Synthetic Polynucleotide
taatacgactcactatagggcttaagtccaatgtgccattttcatccactaacagaggagaagtggaatgaaatggcacaacctggcggcagcgcaaaagatg

SEQ ID NO: 210203 - DNA, 103 bp, Artificial Sequence
  Synthetic Polynucleotide
taatacgactcactatagggttttttcatgcttaagtccaatgtgccattaacagaggagaaatggcatgttggacttaaacctggcggcagcgcaaaagatg

SEQ ID NO: 210204 - DNA, 103 bp, Artificial Sequence
  Synthetic Polynucleotide
taatacgactcactatagggggattcgattttttttcatgcttaagtccaaacagaggagatggactatggcatgaaaaaacctggcggcagcgcaaaagatg

SEQ ID NO: 210205 - DNA, 103 bp, Artificial Sequence
  Synthetic Polynucleotide
taatacgactcactataggggacttgtccaggattcgattttttttcatgaacagaggagacatgaaatgaaatcgaataacctggcggcagcgcaaaagatg

SEQ ID NO: 210206 - DNA, 103 bp, Artificial Sequence
  Synthetic Polynucleotide
taatacgactcactatagggtaggggtgcagacttgtccaggattcgattaacagaggagaaatcgaatgctggacaagaacctggcggcagcgcaaaagatg

SEQ ID NO: 210207 - DNA, 103 bp, Artificial Sequence
  Synthetic Polynucleotide
taatacgactcactatagggtagaggaagttaggggtgcagacttgtccaaacagaggagatggacaatgctgcaccccaacctggcggcagcgcaaaagatg

SEQ ID NO: 210208 - DNA, 103 bp, Artificial Sequence
  Synthetic Polynucleotide
taatacgactcactatagggatagaagtgttagaggaagttaggggtgcaaacagaggagatgcaccatgaacttcctcaacctggcggcagcgcaaaagatg

SEQ ID NO: 210209 - DNA, 103 bp, Artificial Sequence
  Synthetic Polynucleotide
taatacgactcactataggggcagtctgcttttgggctgtagtgtcggggaacagaggagaccccgaatgtacagcccaaacctggcggcagcgcaaaagatg

SEQ ID NO: 210210 - DNA, 103 bp, Artificial Sequence
  Synthetic Polynucleotide
taatacgactcactatagggaggagttggaatagaagtgttagaggaagtaacagaggagaacttccatgaacacttctaacctggcggcagcgcaaaagatg

SEQ ID NO: 210211 - DNA, 103 bp, Artificial Sequence
  Synthetic Polynucleotide
taatacgactcactataggggggaagaggaaggagttggaatagaagtgtaacagaggagaacacttatgttccaactcaacctggcggcagcgcaaaagatg

SEQ ID NO: 210212 - DNA, 103 bp, Artificial Sequence
  Synthetic Polynucleotide
taatacgactcactataggggttttgaatggggaagaggaaggagttggaaacagaggagatccaacatgttcctcttcaacctggcggcagcgcaaaagatg

SEQ ID NO: 210213 - DNA, 103 bp, Artificial Sequence
  Synthetic Polynucleotide
taatacgactcactatagggaatgctgcttgttttgaatggggaagaggaaacagaggagatcctctatgccattcaaaaacctggcggcagcgcaaaagatg

SEQ ID NO: 210214 - DNA, 103 bp, Artificial Sequence
  Synthetic Polynucleotide
taatacgactcactatagggcattgaccagaatgctgcttgttttgaatgaacagaggagacattcaatgcaagcagcaaacctggcggcagcgcaaaagatg

SEQ ID NO: 210215 - DNA, 103 bp, Artificial Sequence
  Synthetic Polynucleotide
taatacgactcactatagggtagaatgctgcattgaccagaatgctgcttaacagaggagaaagcagatgtctggtcaaaacctggcggcagcgcaaaagatg

SEQ ID NO: 210216 - DNA, 103 bp, Artificial Sequence
  Synthetic Polynucleotide
taatacgactcactatagggaagagcctgatagaatgctgcattgaccagaacagaggagactggtcatggcagcattcaacctggcggcagcgcaaaagatg

SEQ ID NO: 210217 - DNA, 103 bp, Artificial Sequence
  Synthetic Polynucleotide
taatacgactcactatagggcttggtcacaaagagcctgatagaatgctgaacagaggagacagcatatgatcaggctcaacctggcggcagcgcaaaagatg

SEQ ID NO: 210218 - DNA, 103 bp, Artificial Sequence
  Synthetic Polynucleotide
taatacgactcactatagggtcccagccctcttggtcacaaagagcctgaaacagaggagatcaggcatgttgtgaccaaacctggcggcagcgcaaaagatg

SEQ ID NO: 210219 - DNA, 103 bp, Artificial Sequence
  Synthetic Polynucleotide
taatacgactcactataggggataggagtgtcccagccctcttggtcacaaacagaggagatgtgacatggagggctggaacctggcggcagcgcaaaagatg

SEQ ID NO: 210220 - DNA, 103 bp, Artificial Sequence
  Synthetic Polynucleotide
taatacgactcactatagggagcgagtacgcagcgttttatcttcagcctaacagaggagaaggctgatgataaaacgcaacctggcggcagcgcaaaagatg

SEQ ID NO: 210221 - DNA, 103 bp, Artificial Sequence
  Synthetic Polynucleotide
taatacgactcactatagggggtcttcttggcagtctgcttttgggctgtaacagaggagaacagccatgaagcagactaacctggcggcagcgcaaaagatg

SEQ ID NO: 210222 - DNA, 103 bp, Artificial Sequence
  Synthetic Polynucleotide
taatacgactcactatagggtgctatagttgataggagtgtcccagccctaacagaggagaagggctatgacactcctaaacctggcggcagcgcaaaagatg

SEQ ID NO: 210223 - DNA, 103 bp, Artificial Sequence
  Synthetic Polynucleotide
taatacgactcactatagggccgtgagttttgctatagttgataggagtgaacagaggagacactccatgcaactatagaacctggcggcagcgcaaaagatg

SEQ ID NO: 210224 - DNA, 103 bp, Artificial Sequence
  Synthetic Polynucleotide
taatacgactcactatagggctctgtcttcccgtgagttttgctatagttaacagaggagaaactatatgaaaactcacaacctggcggcagcgcaaaagatg

SEQ ID NO: 210225 - DNA, 103 bp, Artificial Sequence
  Synthetic Polynucleotide
taatacgactcactatagggctttctcctcctctgtcttcccgtgagtttaacagaggagaaaactcatgggaagacagaacctggcggcagcgcaaaagatg

SEQ ID NO: 210226 - DNA, 103 bp, Artificial Sequence
  Synthetic Polynucleotide
taatacgactcactataggggggtctttctctttctcctcctctgtcttcaacagaggagagaagacatgggaggagaaaacctggcggcagcgcaaaagatg

SEQ ID NO: 210227 - DNA, 103 bp, Artificial Sequence
  Synthetic Polynucleotide
taatacgactcactatagggagagctcactgggtctttctctttctcctcaacagaggagagaggagatggagaaagacaacctggcggcagcgcaaaagatg

SEQ ID NO: 210228 - DNA, 103 bp, Artificial Sequence
  Synthetic Polynucleotide
taatacgactcactatagggaattttctagagagctcactgggtctttctaacagaggagaagaaagatgcagtgagctaacctggcggcagcgcaaaagatg

SEQ ID NO: 210229 - DNA, 103 bp, Artificial Sequence
  Synthetic Polynucleotide
taatacgactcactatagggttttcctctaaattttctagagagctcactaacagaggagaagtgagatgtctagaaaaaacctggcggcagcgcaaaagatg

SEQ ID NO: 210230 - DNA, 103 bp, Artificial Sequence
  Synthetic Polynucleotide
taatacgactcactatagggaggaaactttttttcctctaaattttctagaacagaggagactagaaatgttagaggaaaacctggcggcagcgcaaaagatg

SEQ ID NO: 210231 - DNA, 103 bp, Artificial Sequence
  Synthetic Polynucleotide
taatacgactcactatagggaggcctctccaggaaactttttttcctctaaacagaggagatagaggatgaaaagtttcaacctggcggcagcgcaaaagatg

SEQ ID NO: 210232 - DNA, 103 bp, Artificial Sequence
  Synthetic Polynucleotide
taatacgactcactatagggctgtcactgcggtcttcttggcagtctgctaacagaggagaagcagaatgccaagaagaaacctggcggcagcgcaaaagatg

SEQ ID NO: 210233 - DNA, 103 bp, Artificial Sequence
  Synthetic Polynucleotide
taatacgactcactatagggcttggtatagaggcctctccaggaaactttaacagaggagaaaagttatgtggagaggcaacctggcggcagcgcaaaagatg

SEQ ID NO: 210234 - DNA, 103 bp, Artificial Sequence
  Synthetic Polynucleotide
taatacgactcactataggggggtttagggcttggtatagaggcctctccaacagaggagaggagagatgtctataccaaacctggcggcagcgcaaaagatg

SEQ ID NO: 210235 - DNA, 103 bp, Artificial Sequence
  Synthetic Polynucleotide
taatacgactcactatagggcatgaagcttgggtttagggcttggtatagaacagaggagactatacatggccctaaacaacctggcggcagcgcaaaagatg

SEQ ID NO: 210236 - DNA, 103 bp, Artificial Sequence
  Synthetic Polynucleotide
taatacgactcactatagggagatctcttgcatgaagcttgggtttagggaacagaggagaccctaaatgcaagcttcaaacctggcggcagcgcaaaagatg

SEQ ID NO: 210237 - DNA, 103 bp, Artificial Sequence
  Synthetic Polynucleotide
taatacgactcactatagggttcctttttgagatctcttgcatgaagcttaacagaggagaaagcttatggcaagagataacctggcggcagcgcaaaagatg

SEQ ID NO: 210238 - DNA, 103 bp, Artificial Sequence
  Synthetic Polynucleotide
taatacgactcactatagggaggtgattagttcctttttgagatctcttgaacagaggagacaagagatgtcaaaaaggaacctggcggcagcgcaaaagatg

SEQ ID NO: 210239 - DNA, 103 bp, Artificial Sequence
  Synthetic Polynucleotide
taatacgactcactatagggggtgttggacaggtgattagttcctttttgaacagaggagacaaaaaatgactaatcacaacctggcggcagcgcaaaagatg

SEQ ID NO: 210240 - DNA, 103 bp, Artificial Sequence
  Synthetic Polynucleotide
taatacgactcactatagggatcacatcctggtgttggacaggtgattagaacagaggagactaatcatgtgtccaacaaacctggcggcagcgcaaaagatg

SEQ ID NO: 210241 - DNA, 103 bp, Artificial Sequence
  Synthetic Polynucleotide
taatacgactcactatagggggccacttccatcacatcctggtgttggacaacagaggagagtccaaatgcaggatgtgaacctggcggcagcgcaaaagatg

SEQ ID NO: 210242 - DNA, 103 bp, Artificial Sequence
  Synthetic Polynucleotide
taatacgactcactatagggcctgtcacgtggccacttccatcacatcctaacagaggagaaggatgatgtggaagtggaacctggcggcagcgcaaaagatg

SEQ ID NO: 210243 - DNA, 103 bp, Artificial Sequence
  Synthetic Polynucleotide
taatacgactcactataggggtcctctgtcctgtcactgcggtcttcttgaacagaggagacaagaaatgcgcagtgacaacctggcggcagcgcaaaagatg

SEQ ID NO: 210244 - DNA, 103 bp, Artificial Sequence
  Synthetic Polynucleotide
taatacgactcactatagggtgcatagtttcctgtcacgtggccacttccaacagaggagaggaagtatgcacgtgacaaacctggcggcagcgcaaaagatg

SEQ ID NO: 210245 - DNA, 103 bp, Artificial Sequence
  Synthetic Polynucleotide
taatacgactcactatagggtgcgatgagatgcatagtttcctgtcacgtaacagaggagaacgtgaatggaaactatgaacctggcggcagcgcaaaagatg

SEQ ID NO: 210246 - DNA, 103 bp, Artificial Sequence
  Synthetic Polynucleotide
taatacgactcactatagggccagaaacactgcgatgagatgcatagtttaacagaggagaaaactaatgatctcatcgaacctggcggcagcgcaaaagatg

SEQ ID NO: 210247 - DNA, 103 bp, Artificial Sequence
  Synthetic Polynucleotide
taatacgactcactatagggtaaaggacatccagaaacactgcgatgagaaacagaggagatctcatatgagtgtttctaacctggcggcagcgcaaaagatg

SEQ ID NO: 210248 - DNA, 103 bp, Artificial Sequence
  Synthetic Polynucleotide
taatacgactcactatagggtcttatctgctaaaggacatccagaaacacaacagaggagagtgtttatggatgtccttaacctggcggcagcgcaaaagatg

SEQ ID NO: 210249 - DNA, 103 bp, Artificial Sequence
  Synthetic Polynucleotide
taatacgactcactataggggattttagagtcttatctgctaaaggacataacagaggagaatgtccatgagcagataaaacctggcggcagcgcaaaagatg

SEQ ID NO: 210250 - DNA, 103 bp, Artificial Sequence
  Synthetic Polynucleotide
taatacgactcactatagggagccatgagggattttagagtcttatctgcaacagaggagagcagatatgactctaaaaaacctggcggcagcgcaaaagatg

SEQ ID NO: 210251 - DNA, 103 bp, Artificial Sequence
  Synthetic Polynucleotide
taatacgactcactataggggagagttggcagccatgagggattttagagaacagaggagactctaaatgccctcatggaacctggcggcagcgcaaaagatg

SEQ ID NO: 210252 - DNA, 103 bp, Artificial Sequence
  Synthetic Polynucleotide
taatacgactcactatagggttaagctcctgagagttggcagccatgaggaacagaggagacctcatatgtgccaactcaacctggcggcagcgcaaaagatg

SEQ ID NO: 210253 - DNA, 103 bp, Artificial Sequence
  Synthetic Polynucleotide
taatacgactcactatagggggttggacacttaagctcctgagagttggcaacagaggagagccaacatgcaggagcttaacctggcggcagcgcaaaagatg

SEQ ID NO: 210254 - DNA, 103 bp, Artificial Sequence
  Synthetic Polynucleotide
taatacgactcactatagggaggggccatcgtcctctgtcctgtcactgcaacagaggagagcagtgatgggacagaggaacctggcggcagcgcaaaagatg

SEQ ID NO: 210255 - DNA, 103 bp, Artificial Sequence
  Synthetic Polynucleotide
taatacgactcactatagggcgcagcctggggttggacacttaagctcctaacagaggagaaggagcatgagtgtccaaaacctggcggcagcgcaaaagatg

SEQ ID NO: 210256 - DNA, 103 bp, Artificial Sequence
  Synthetic Polynucleotide
taatacgactcactatagggcccgagccatcgcagcctggggttggacacaacagaggagagtgtccatgcccaggctgaacctggcggcagcgcaaaagatg

SEQ ID NO: 210257 - DNA, 103 bp, Artificial Sequence
  Synthetic Polynucleotide
taatacgactcactatagggagtcacgtgccccgagccatcgcagcctggaacagaggagaccaggcatggatggctcgaacctggcggcagcgcaaaagatg

SEQ ID NO: 210258 - DNA, 103 bp, Artificial Sequence
  Synthetic Polynucleotide
taatacgactcactatagggcatagtttccagtcacgtgccccgagccataacagaggagaatggctatgggcacgtgaaacctggcggcagcgcaaaagatg

SEQ ID NO: 210259 - DNA, 103 bp, Artificial Sequence
  Synthetic Polynucleotide
taatacgactcactatagggctgtgggaagcatagtttccagtcacgtgcaacagaggagagcacgtatgtggaaactaaacctggcggcagcgcaaaagatg

SEQ ID NO: 210260 - DNA, 103 bp, Artificial Sequence
  Synthetic Polynucleotide
taatacgactcactatagggggacaagcttctgtgggaagcatagtttccaacagaggagaggaaacatggcttcccacaacctggcggcagcgcaaaagatg

SEQ ID NO: 210261 - DNA, 103 bp, Artificial Sequence
  Synthetic Polynucleotide
taatacgactcactataggggagggcatccggacaagcttctgtgggaagaacagaggagacttcccatggaagcttgtaacctggcggcagcgcaaaagatg

SEQ ID NO: 210262 - DNA, 103 bp, Artificial Sequence
  Synthetic Polynucleotide
taatacgactcactatagggttccttgcacgagggcatccggacaagcttaacagaggagaaagcttatgcggatgcccaacctggcggcagcgcaaaagatg

SEQ ID NO: 210263 - DNA, 103 bp, Artificial Sequence
  Synthetic Polynucleotide
taatacgactcactataggggacaccacctttccttgcacgagggcatccaacagaggagaggatgcatgcgtgcaaggaacctggcggcagcgcaaaagatg

SEQ ID NO: 210264 - DNA, 103 bp, Artificial Sequence
  Synthetic Polynucleotide
taatacgactcactataggggggtcattttgacaccacctttccttgcacaacagaggagagtgcaaatgaaggtggtgaacctggcggcagcgcaaaagatg

SEQ ID NO: 210265 - DNA, 103 bp, Artificial Sequence
  Synthetic Polynucleotide
taatacgactcactatagggtgtgtttccaaggggccatcgtcctctgtcaacagaggagagacagaatgcgatggcccaacctggcggcagcgcaaaagatg

SEQ ID NO: 210266 - DNA, 103 bp, Artificial Sequence
  Synthetic Polynucleotide
taatacgactcactatagggtccttggtaggggtcattttgacaccacctaacagaggagaaggtggatgcaaaatgacaacctggcggcagcgcaaaagatg

SEQ ID NO: 210267 - DNA, 103 bp, Artificial Sequence
  Synthetic Polynucleotide
taatacgactcactatagggttctttttcttccttggtaggggtcattttaacagaggagaaaaatgatgcctaccaagaacctggcggcagcgcaaaagatg

SEQ ID NO: 210268 - DNA, 103 bp, Artificial Sequence
  Synthetic Polynucleotide
taatacgactcactataggggttcagggtcttctttttcttccttggtagaacagaggagactaccaatgaagaaaaagaacctggcggcagcgcaaaagatg

SEQ ID NO: 210269 - DNA, 103 bp, Artificial Sequence
  Synthetic Polynucleotide
taatacgactcactatagggggacatttcagttcagggtcttctttttctaacagaggagaagaaaaatgagaccctgaaacctggcggcagcgcaaaagatg

SEQ ID NO: 210270 - DNA, 103 bp, Artificial Sequence
  Synthetic Polynucleotide
taatacgactcactatagggccctatcacaggacatttcagttcagggtcaacagaggagagaccctatgctgaaatgtaacctggcggcagcgcaaaagatg

SEQ ID NO: 210271 - DNA, 103 bp, Artificial Sequence
  Synthetic Polynucleotide
taatacgactcactatagggggccatcacaccctatcacaggacatttcaaacagaggagatgaaatatgctgtgatagaacctggcggcagcgcaaaagatg

SEQ ID NO: 210272 - DNA, 103 bp, Artificial Sequence
  Synthetic Polynucleotide
taatacgactcactatagggatgtgaccttggccatcacaccctatcacaaacagaggagatgtgatatggtgtgatggaacctggcggcagcgcaaaagatg

SEQ ID NO: 210273 - DNA, 103 bp, Artificial Sequence
  Synthetic Polynucleotide
taatacgactcactatagggtttacctgatatgtgaccttggccatcacaaacagaggagatgtgatatgcaaggtcacaacctggcggcagcgcaaaagatg

SEQ ID NO: 210274 - DNA, 103 bp, Artificial Sequence
  Synthetic Polynucleotide
taatacgactcactataggggtgatgtgtatttacctgatatgtgaccttaacagaggagaaaggtcatgtatcaggtaaacctggcggcagcgcaaaagatg

SEQ ID NO: 210275 - DNA, 103 bp, Artificial Sequence
  Synthetic Polynucleotide
taatacgactcactataggggctgtgcggtgtgatgtgtatttacctgataacagaggagaatcaggatgatacacatcaacctggcggcagcgcaaaagatg

SEQ ID NO: 210276 - DNA, 103 bp, Artificial Sequence
  Synthetic Polynucleotide
taatacgactcactatagggagagtgaccatgtgtttccaaggggccatcaacagaggagagatggcatgttggaaacaaacctggcggcagcgcaaaagatg

SEQ ID NO: 210277 - DNA, 103 bp, Artificial Sequence
  Synthetic Polynucleotide
taatacgactcactatagggacagccagaagctgtgcggtgtgatgtgtaaacagaggagatacacaatgcaccgcacaaacctggcggcagcgcaaaagatg

SEQ ID NO: 210278 - DNA, 103 bp, Artificial Sequence
  Synthetic Polynucleotide
taatacgactcactatagggcagccagaggacagccagaagctgtgcggtaacagaggagaaccgcaatgcttctggctaacctggcggcagcgcaaaagatg

SEQ ID NO: 210279 - DNA, 103 bp, Artificial Sequence
  Synthetic Polynucleotide
taatacgactcactatagggtgtctcttggcagccagaggacagccagaaaacagaggagattctggatgtcctctggcaacctggcggcagcgcaaaagatg

SEQ ID NO: 210280 - DNA, 103 bp, Artificial Sequence
  Synthetic Polynucleotide
taatacgactcactatagggattctccttctgtctcttggcagccagaggaacagaggagacctctgatggccaagagaaacctggcggcagcgcaaaagatg

SEQ ID NO: 210281 - DNA, 103 bp, Artificial Sequence
  Synthetic Polynucleotide
taatacgactcactatagggcattgagaggattctccttctgtctcttggaacagaggagaccaagaatgagaaggagaaacctggcggcagcgcaaaagatg

SEQ ID NO: 210282 - DNA, 103 bp, Artificial Sequence
  Synthetic Polynucleotide
taatacgactcactatagggagggaggctccattgagaggattctccttcaacagaggagagaaggaatgtcctctcaaaacctggcggcagcgcaaaagatg

SEQ ID NO: 210283 - DNA, 103 bp, Artificial Sequence
  Synthetic Polynucleotide
taatacgactcactatagggtttccaggagagggaggctccattgagaggaacagaggagacctctcatgggagcctccaacctggcggcagcgcaaaagatg

SEQ ID NO: 210284 - DNA, 103 bp, Artificial Sequence
  Synthetic Polynucleotide
taatacgactcactataggggtttgttcagtttccaggagagggaggctcaacagaggagagagcctatgtctcctggaaacctggcggcagcgcaaaagatg

SEQ ID NO: 210285 - DNA, 103 bp, Artificial Sequence
  Synthetic Polynucleotide
taatacgactcactatagggggtagctcttgtttgttcagtttccaggagaacagaggagactcctgatgactgaacaaaacctggcggcagcgcaaaagatg

SEQ ID NO: 210286 - DNA, 103 bp, Artificial Sequence
  Synthetic Polynucleotide
taatacgactcactataggggggacaatgtggtagctcttgtttgttcagaacagaggagactgaacatgcaagagctaaacctggcggcagcgcaaaagatg

SEQ ID NO: 210287 - DNA, 103 bp, Artificial Sequence
  Synthetic Polynucleotide
taatacgactcactatagggcctctgcggtagagtgaccatgtgtttccaaacagaggagatggaaaatgatggtcactaacctggcggcagcgcaaaagatg

SEQ ID NO: 210288 - DNA, 103 bp, Artificial Sequence
  Synthetic Polynucleotide
taatacgactcactatagggagcctggcaagggacaatgtggtagctcttaacagaggagaaagagcatgcacattgtcaacctggcggcagcgcaaaagatg

SEQ ID NO: 210289 - DNA, 103 bp, Artificial Sequence
  Synthetic Polynucleotide
taatacgactcactatagggagcccattgcagcctggcaagggacaatgtaacagaggagaacattgatgcttgccaggaacctggcggcagcgcaaaagatg

SEQ ID NO: 210290 - DNA, 103 bp, Artificial Sequence
  Synthetic Polynucleotide
taatacgactcactatagggtacatggcccagcccattgcagcctggcaaaacagaggagattgccaatgtgcaatgggaacctggcggcagcgcaaaagatg

SEQ ID NO: 210291 - DNA, 103 bp, Artificial Sequence
  Synthetic Polynucleotide
taatacgactcactatagggaaacattatttacatggcccagcccattgcaacagaggagagcaatgatgtgggccatgaacctggcggcagcgcaaaagatg

SEQ ID NO: 210292 - DNA, 103 bp, Artificial Sequence
  Synthetic Polynucleotide
taatacgactcactatagggtgggtgacaaaaacattatttacatggcccaacagaggagagggccaatgaaataatgtaacctggcggcagcgcaaaagatg

SEQ ID NO: 210293 - DNA, 103 bp, Artificial Sequence
  Synthetic Polynucleotide
taatacgactcactatagggtaagcttcggtgggtgacaaaaacattattaacagaggagaaataatatgtttgtcaccaacctggcggcagcgcaaaagatg

SEQ ID NO: 210294 - DNA, 103 bp, Artificial Sequence
  Synthetic Polynucleotide
taatacgactcactataggggacatccagataagcttcggtgggtgacaaaacagaggagattgtcaatgaccgaagctaacctggcggcagcgcaaaagatg

SEQ ID NO: 210295 - DNA, 103 bp, Artificial Sequence
  Synthetic Polynucleotide
taatacgactcactataggggcattgagaggacatccagataagcttcggaacagaggagaccgaagatgatctggatgaacctggcggcagcgcaaaagatg

SEQ ID NO: 210296 - DNA, 103 bp, Artificial Sequence
  Synthetic Polynucleotide
taatacgactcactataggggataacttgtgcattgagaggacatccagaaacagaggagatctggaatgcctctcaataacctggcggcagcgcaaaagatg

SEQ ID NO: 210297 - DNA, 103 bp, Artificial Sequence
  Synthetic Polynucleotide
taatacgactcactatagggtgccctttttgataacttgtgcattgagagaacagaggagactctcaatgcacaagttaaacctggcggcagcgcaaaagatg

SEQ ID NO: 210298 - DNA, 103 bp, Artificial Sequence
  Synthetic Polynucleotide
taatacgactcactatagggatcatgatttcctctgcggtagagtgaccaaacagaggagatggtcaatgtaccgcagaaacctggcggcagcgcaaaagatg

SEQ ID NO: 210299 - DNA, 103 bp, Artificial Sequence
  Synthetic Polynucleotide
taatacgactcactatagggtcagaaaccttgccctttttgataacttgtaacagaggagaacaagtatgcaaaaagggaacctggcggcagcgcaaaagatg

SEQ ID NO: 210300 - DNA, 103 bp, Artificial Sequence
  Synthetic Polynucleotide
taatacgactcactatagggcatgagttcttcagaaaccttgccctttttaacagaggagaaaaaagatgaaggtttctaacctggcggcagcgcaaaagatg

SEQ ID NO: 210301 - DNA, 103 bp, Artificial Sequence
  Synthetic Polynucleotide
taatacgactcactataggggcttgatggtcatgagttcttcagaaacctaacagaggagaaggtttatgaagaactcaaacctggcggcagcgcaaaagatg

SEQ ID NO: 210302 - DNA, 103 bp, Artificial Sequence
  Synthetic Polynucleotide
taatacgactcactataggggttgctttgagcttgatggtcatgagttctaacagaggagaagaactatggaccatcaaaacctggcggcagcgcaaaagatg

SEQ ID NO: 210303 - DNA, 103 bp, Artificial Sequence
  Synthetic Polynucleotide
taatacgactcactatagggtattcccccagttgctttgagcttgatggtaacagaggagaaccatcatgctcaaagcaaacctggcggcagcgcaaaagatg

SEQ ID NO: 210304 - DNA, 103 bp, Artificial Sequence
  Synthetic Polynucleotide
taatacgactcactatagggcatcactctctattcccccagttgctttgaaacagaggagatcaaagatgctgggggaaaacctggcggcagcgcaaaagatg

SEQ ID NO: 210305 - DNA, 103 bp, Artificial Sequence
  Synthetic Polynucleotide
taatacgactcactatagggctaatttcttcatcactctctattcccccaaacagaggagatgggggatgagagagtgaaacctggcggcagcgcaaaagatg

SEQ ID NO: 210306 - DNA, 103 bp, Artificial Sequence
  Synthetic Polynucleotide
taatacgactcactatagggatccaaatgcctaatttcttcatcactctcaacagaggagagagagtatggaagaaattaacctggcggcagcgcaaaagatg

SEQ ID NO: 210307 - DNA, 103 bp, Artificial Sequence
  Synthetic Polynucleotide
taatacgactcactatagggttatttcttcatccaaatgcctaatttcttaacagaggagaaagaaaatgggcatttggaacctggcggcagcgcaaaagatg

SEQ ID NO: 210308 - DNA, 103 bp, Artificial Sequence
  Synthetic Polynucleotide
taatacgactcactatagggttcagttcctttatttcttcatccaaatgcaacagaggagagcatttatgtgaagaaataacctggcggcagcgcaaaagatg

SEQ ID NO: 210309 - DNA, 103 bp, Artificial Sequence
  Synthetic Polynucleotide
taatacgactcactatagggcataggttttatcatgatttcctctgcggtaacagaggagaaccgcaatggaaatcatgaacctggcggcagcgcaaaagatg

SEQ ID NO: 210310 - DNA, 103 bp, Artificial Sequence
  Synthetic Polynucleotide
taatacgactcactataggggttggattcattcagttcctttatttcttcaacagaggagagaagaaatgaaggaactgaacctggcggcagcgcaaaagatg

SEQ ID NO: 210311 - DNA, 103 bp, Artificial Sequence
  Synthetic Polynucleotide
taatacgactcactatagggcaattttaaggttggattcattcagttcctaacagaggagaaggaacatgatgaatccaaacctggcggcagcgcaaaagatg

SEQ ID NO: 210312 - DNA, 103 bp, Artificial Sequence
  Synthetic Polynucleotide
taatacgactcactatagggatatctgcttcaattttaaggttggattcaaacagaggagatgaatcatgccttaaaataacctggcggcagcgcaaaagatg

SEQ ID NO: 210313 - DNA, 103 bp, Artificial Sequence
  Synthetic Polynucleotide
taatacgactcactatagggaagtttcatcatatctgcttcaattttaagaacagaggagacttaaaatggaagcagataacctggcggcagcgcaaaagatg

SEQ ID NO: 210314 - DNA, 103 bp, Artificial Sequence
  Synthetic Polynucleotide
taatacgactcactatagggtctgggtctgaagtttcatcatatctgcttaacagaggagaaagcagatgtgatgaaacaacctggcggcagcgcaaaagatg

SEQ ID NO: 210315 - DNA, 103 bp, Artificial Sequence
  Synthetic Polynucleotide
taatacgactcactatagggatagatgtgatctgggtctgaagtttcatcaacagaggagagatgaaatgtcagacccaaacctggcggcagcgcaaaagatg

SEQ ID NO: 210316 - DNA, 103 bp, Artificial Sequence
  Synthetic Polynucleotide
taatacgactcactataggggttgctctccatagatgtgatctgggtctgaacagaggagacagaccatgatcacatctaacctggcggcagcgcaaaagatg

SEQ ID NO: 210317 - DNA, 103 bp, Artificial Sequence
  Synthetic Polynucleotide
taatacgactcactatagggtcgtctttaagttgctctccatagatgtgaaacagaggagatcacatatgtggagagcaaacctggcggcagcgcaaaagatg

SEQ ID NO: 210318 - DNA, 103 bp, Artificial Sequence
  Synthetic Polynucleotide
taatacgactcactatagggtcctcctctatcgtctttaagttgctctccaacagaggagaggagagatgcttaaagacaacctggcggcagcgcaaaagatg

SEQ ID NO: 210319 - DNA, 103 bp, Artificial Sequence
  Synthetic Polynucleotide
taatacgactcactataggggagtttgttctcctcctctatcgtctttaaaacagaggagattaaagatgatagaggagaacctggcggcagcgcaaaagatg

SEQ ID NO: 210320 - DNA, 103 bp, Artificial Sequence
  Synthetic Polynucleotide
taatacgactcactataggggactttcatccataggttttatcatgatttaacagaggagaaaatcaatgtaaaacctaaacctggcggcagcgcaaaagatg

SEQ ID NO: 210321 - DNA, 103 bp, Artificial Sequence
  Synthetic Polynucleotide
taatacgactcactatagggtctgttctatgagtttgttctcctcctctaaacagaggagatagaggatgagaacaaacaacctggcggcagcgcaaaagatg

SEQ ID NO: 210322 - DNA, 103 bp, Artificial Sequence
  Synthetic Polynucleotide
taatacgactcactatagggctttcattgttctgttctatgagtttgttcaacagaggagagaacaaatgcatagaacaaacctggcggcagcgcaaaagatg

SEQ ID NO: 210323 - DNA, 103 bp, Artificial Sequence
  Synthetic Polynucleotide
taatacgactcactatagggtttcagcagactttcattgttctgttctataacagaggagaatagaaatgaacaatgaaaacctggcggcagcgcaaaagatg

SEQ ID NO: 210324 - DNA, 103 bp, Artificial Sequence
  Synthetic Polynucleotide
taatacgactcactatagggctgccagctctttcagcagactttcattgtaacagaggagaacaatgatggtctgctgaaacctggcggcagcgcaaaagatg

SEQ ID NO: 210325 - DNA, 103 bp, Artificial Sequence
  Synthetic Polynucleotide
taatacgactcactatagggtggcttagacctgccagctctttcagcagaaacagaggagatctgctatgagagctggcaacctggcggcagcgcaaaagatg

SEQ ID NO: 210326 - DNA, 103 bp, Artificial Sequence
  Synthetic Polynucleotide
taatacgactcactatagggaatgagagcttggcttagacctgccagctcaacagaggagagagctgatgggtctaagcaacctggcggcagcgcaaaagatg

SEQ ID NO: 210327 - DNA, 103 bp, Artificial Sequence
  Synthetic Polynucleotide
taatacgactcactatagggcaaggcttgaaatgagagcttggcttagacaacagaggagagtctaaatgaagctctcaaacctggcggcagcgcaaaagatg

SEQ ID NO: 210328 - DNA, 103 bp, Artificial Sequence
  Synthetic Polynucleotide
taatacgactcactatagggtggatgtcagcaaggcttgaaatgagagctaacagaggagaagctctatgttcaagcctaacctggcggcagcgcaaaagatg

SEQ ID NO: 210329 - DNA, 103 bp, Artificial Sequence
  Synthetic Polynucleotide
taatacgactcactatagggctgtggaagctggatgtcagcaaggcttgaaacagaggagatcaagcatggctgacatcaacctggcggcagcgcaaaagatg

SEQ ID NO: 210330 - DNA, 103 bp, Artificial Sequence
  Synthetic Polynucleotide
taatacgactcactatagggtaggtcccatctgtggaagctggatgtcagaacagaggagactgacaatgagcttccacaacctggcggcagcgcaaaagatg

SEQ ID NO: 210331 - DNA, 103 bp, Artificial Sequence
  Synthetic Polynucleotide
taatacgactcactataggggttcctttagagcgagtacgcagcgttttaaacagaggagataaaacatggcgtactcgaacctggcggcagcgcaaaagatg

SEQ ID NO: 210332 - DNA, 103 bp, Artificial Sequence
  Synthetic Polynucleotide
taatacgactcactataggggttgaaagaagactttcatccataggttttaacagaggagaaaaaccatgggatgaaagaacctggcggcagcgcaaaagatg

SEQ ID NO: 210333 - DNA, 103 bp, Artificial Sequence
  Synthetic Polynucleotide
taatacgactcactatagggtgctcactgataggtcccatctgtggaagcaacagaggagagcttccatggatgggaccaacctggcggcagcgcaaaagatg

SEQ ID NO: 210334 - DNA, 103 bp, Artificial Sequence
  Synthetic Polynucleotide
taatacgactcactatagggttcaaaattctgctcactgataggtcccataacagaggagaatgggaatgatcagtgagaacctggcggcagcgcaaaagatg

SEQ ID NO: 210335 - DNA, 103 bp, Artificial Sequence
  Synthetic Polynucleotide
taatacgactcactatagggttacatatgcttcaaaattctgctcactgaaacagaggagatcagtgatgagaattttgaacctggcggcagcgcaaaagatg

SEQ ID NO: 210336 - DNA, 103 bp, Artificial Sequence
  Synthetic Polynucleotide
taatacgactcactataggggtgagtgtatttacatatgcttcaaaattcaacagaggagagaatttatgagcatatgtaacctggcggcagcgcaaaagatg

SEQ ID NO: 210337 - DNA, 103 bp, Artificial Sequence
  Synthetic Polynucleotide
taatacgactcactataggggtacatatctgtgagtgtatttacatatgcaacagaggagagcatatatgaatacactcaacctggcggcagcgcaaaagatg

SEQ ID NO: 210338 - DNA, 103 bp, Artificial Sequence
  Synthetic Polynucleotide
taatacgactcactatagggccagattgctgtacatatctgtgagtgtataacagaggagaatacacatgcagatatgtaacctggcggcagcgcaaaagatg

SEQ ID NO: 210339 - DNA, 103 bp, Artificial Sequence
  Synthetic Polynucleotide
taatacgactcactatagggtagtcccgttccagattgctgtacatatctaacagaggagaagatatatgcagcaatctaacctggcggcagcgcaaaagatg

SEQ ID NO: 210340 - DNA, 103 bp, Artificial Sequence
  Synthetic Polynucleotide
taatacgactcactatagggttccggggaatagtcccgttccagattgctaacagaggagaagcaatatggaacgggacaacctggcggcagcgcaaaagatg

SEQ ID NO: 210341 - DNA, 103 bp, Artificial Sequence
  Synthetic Polynucleotide
taatacgactcactataggggagctttgcattccggggaatagtcccgttaacagaggagaaacgggatgattccccggaacctggcggcagcgcaaaagatg

SEQ ID NO: 210342 - DNA, 103 bp, Artificial Sequence
  Synthetic Polynucleotide
taatacgactcactatagggctttccagtagagctttgcattccggggaaaacagaggagattccccatgatgcaaagcaacctggcggcagcgcaaaagatg

SEQ ID NO: 210343 - DNA, 103 bp, Artificial Sequence
  Synthetic Polynucleotide
taatacgactcactatagggttcttgtgcagttgaaagaagactttcatcaacagaggagagatgaaatgcttctttcaaacctggcggcagcgcaaaagatg

SEQ ID NO: 210344 - DNA, 103 bp, Artificial Sequence
  Synthetic Polynucleotide
taatacgactcactatagggctgtttgatactttccagtagagctttgcaaacagaggagatgcaaaatgctactggaaaacctggcggcagcgcaaaagatg

SEQ ID NO: 210345 - DNA, 103 bp, Artificial Sequence
  Synthetic Polynucleotide
taatacgactcactatagggccttcactgcctgtttgatactttccagtaaacagaggagatactggatggtatcaaacaacctggcggcagcgcaaaagatg

SEQ ID NO: 210346 - DNA, 103 bp, Artificial Sequence
  Synthetic Polynucleotide
taatacgactcactatagggacatggatacccttcactgcctgtttgataaacagaggagatatcaaatgggcagtgaaaacctggcggcagcgcaaaagatg

SEQ ID NO: 210347 - DNA, 103 bp, Artificial Sequence
  Synthetic Polynucleotide
taatacgactcactatagggtactggagttttcttgtgcagttgaaagaaaacagaggagattctttatgctgcacaagaacctggcggcagcgcaaaagatg

SEQ ID NO: 210348 - DNA, 103 bp, Artificial Sequence
  Synthetic Polynucleotide
taatacgactcactatagggtcttccttcctactggagttttcttgtgcaaacagaggagatgcacaatgaaactccagaacctggcggcagcgcaaaagatg

SEQ ID NO: 210349 - DNA, 103 bp, Artificial Sequence
  Synthetic Polynucleotide
taatacgactcactatagggagagtatctgtcttccttcctactggagttaacagaggagaaactccatgaggaaggaaaacctggcggcagcgcaaaagatg

SEQ ID NO: 210350 - DNA, 103 bp, Artificial Sequence
  Synthetic Polynucleotide
taatacgactcactatagggcttgataacaagagtatctgtcttccttccaacagaggagaggaaggatgacagatactaacctggcggcagcgcaaaagatg

SEQ ID NO: 210351 - DNA, 103 bp, Artificial Sequence
  Synthetic Polynucleotide
taatacgactcactatagggaccatgagctcttgataacaagagtatctgaacagaggagacagataatgttgttatcaaacctggcggcagcgcaaaagatg

SEQ ID NO: 210352 - DNA, 103 bp, Artificial Sequence
  Synthetic Polynucleotide
taatacgactcactatagggtaaagacttgaccatgagctcttgataacaaacagaggagatgttatatggagctcatgaacctggcggcagcgcaaaagatg

SEQ ID NO: 210353 - DNA, 103 bp, Artificial Sequence
  Synthetic Polynucleotide
taatacgactcactatagggccaagtgcattaaagacttgaccatgagctaacagaggagaagctcaatgtcaagtcttaacctggcggcagcgcaaaagatg

SEQ ID NO: 210354 - DNA, 103 bp, Artificial Sequence
  Synthetic Polynucleotide
taatacgactcactatagggtcaaatttccccaagtgcattaaagacttgaacagaggagacaagtcatgaatgcacttaacctggcggcagcgcaaaagatg

SEQ ID NO: 210355 - DNA, 103 bp, Artificial Sequence
  Synthetic Polynucleotide
taatacgactcactatagggtggcacctcggttcctttagagcgagtacgaacagaggagacgtactatgtctaaaggaaacctggcggcagcgcaaaagatg

SEQ ID NO: 210356 - DNA, 103 bp, Artificial Sequence
  Synthetic Polynucleotide
taatacgactcactatagggtacatttttttcaaatttccccaagtgcataacagaggagaatgcacatggggaaatttaacctggcggcagcgcaaaagatg

SEQ ID NO: 210357 - DNA, 103 bp, Artificial Sequence
  Synthetic Polynucleotide
taatacgactcactatagggtctgaacagatacatttttttcaaatttccaacagaggagaggaaatatgaaaaaaatgaacctggcggcagcgcaaaagatg

SEQ ID NO: 210358 - DNA, 103 bp, Artificial Sequence
  Synthetic Polynucleotide
taatacgactcactatagggtcacttacagtctgaacagatacattttttaacagaggagaaaaaaaatgatctgttcaaacctggcggcagcgcaaaagatg

SEQ ID NO: 210359 - DNA, 103 bp, Artificial Sequence
  Synthetic Polynucleotide
taatacgactcactatagggatttaaattttcacttacagtctgaacagaaacagaggagatctgttatgactgtaagtaacctggcggcagcgcaaaagatg

SEQ ID NO: 210360 - DNA, 103 bp, Artificial Sequence
  Synthetic Polynucleotide
taatacgactcactatagggtgccactgtcatttaaattttcacttacagaacagaggagactgtaaatgaaaatttaaaacctggcggcagcgcaaaagatg

SEQ ID NO: 210361 - DNA, 103 bp, Artificial Sequence
  Synthetic Polynucleotide
taatacgactcactatagggaaagactggatgccactgtcatttaaatttaacagaggagaaaatttatgtgacagtggaacctggcggcagcgcaaaagatg

SEQ ID NO: 210362 - DNA, 103 bp, Artificial Sequence
  Synthetic Polynucleotide
taatacgactcactatagggctctgcttttaaagactggatgccactgtcaacagaggagagacagtatgatccagtctaacctggcggcagcgcaaaagatg

SEQ ID NO: 210363 - DNA, 103 bp, Artificial Sequence
  Synthetic Polynucleotide
taatacgactcactatagggcttcatcgctctctgcttttaaagactggaaacagaggagatccagtatgtaaaagcagaacctggcggcagcgcaaaagatg

SEQ ID NO: 210364 - DNA, 103 bp, Artificial Sequence
  Synthetic Polynucleotide
taatacgactcactatagggcactcgtctgcttcatcgctctctgcttttaacagaggagaaaaagcatggagcgatgaaacctggcggcagcgcaaaagatg

SEQ ID NO: 210365 - DNA, 103 bp, Artificial Sequence
  Synthetic Polynucleotide
taatacgactcactatagggaatcagaaagcactcgtctgcttcatcgctaacagaggagaagcgatatggcagacgagaacctggcggcagcgcaaaagatg

SEQ ID NO: 210366 - DNA, 103 bp, Artificial Sequence
  Synthetic Polynucleotide
taatacgactcactataggggtgaatccattggcacctcggttcctttagaacagaggagactaaagatgccgaggtgcaacctggcggcagcgcaaaagatg

SEQ ID NO: 210367 - DNA, 103 bp, Artificial Sequence
  Synthetic Polynucleotide
taatacgactcactatagggcatcagaatgaatcagaaagcactcgtctgaacagaggagacagacgatggctttctgaaacctggcggcagcgcaaaagatg

SEQ ID NO: 210368 - DNA, 103 bp, Artificial Sequence
  Synthetic Polynucleotide
taatacgactcactatagggtctcttccatcatcagaatgaatcagaaagaacagaggagactttctatgtcattctgaaacctggcggcagcgcaaaagatg

SEQ ID NO: 210369 - DNA, 103 bp, Artificial Sequence
  Synthetic Polynucleotide
taatacgactcactatagggatcaatcttgtctcttccatcatcagaatgaacagaggagacattctatggatggaagaaacctggcggcagcgcaaaagatg

SEQ ID NO: 210370 - DNA, 103 bp, Artificial Sequence
  Synthetic Polynucleotide
taatacgactcactataggggctgagaatcatcaatcttgtctcttccataacagaggagaatggaaatgacaagattgaacctggcggcagcgcaaaagatg

SEQ ID NO: 210371 - DNA, 103 bp, Artificial Sequence
  Synthetic Polynucleotide
taatacgactcactatagggcagaagggtggctgagaatcatcaatcttgaacagaggagacaagatatgtgattctcaaacctggcggcagcgcaaaagatg

SEQ ID NO: 210372 - DNA, 103 bp, Artificial Sequence
  Synthetic Polynucleotide
taatacgactcactatagggatcagaggagcagaagggtggctgagaatcaacagaggagagattctatgccacccttcaacctggcggcagcgcaaaagatg

SEQ ID NO: 210373 - DNA, 103 bp, Artificial Sequence
  Synthetic Polynucleotide
taatacgactcactatagggtttcattgtcatcagaggagcagaagggtgaacagaggagacaccctatggctcctctgaacctggcggcagcgcaaaagatg

SEQ ID NO: 210374 - DNA, 103 bp, Artificial Sequence
  Synthetic Polynucleotide
taatacgactcactatagggtcagagttactttcattgtcatcagaggagaacagaggagactcctcatgtgacaatgaaacctggcggcagcgcaaaagatg

SEQ ID NO: 210375 - DNA, 103 bp, Artificial Sequence
  Synthetic Polynucleotide
taatacgactcactatagggttctgcactttcagagttactttcattgtcaacagaggagagacaatatgagtaactctaacctggcggcagcgcaaaagatg

SEQ ID NO: 210376 - DNA, 103 bp, Artificial Sequence
  Synthetic Polynucleotide
taatacgactcactatagggcccagccattttctgcactttcagagttacaacagaggagagtaactatgaaagtgcagaacctggcggcagcgcaaaagatg

SEQ ID NO: 210377 - DNA, 103 bp, Artificial Sequence
  Synthetic Polynucleotide
taatacgactcactatagggtcctggattagtgaatccattggcacctcgaacagaggagacgaggtatgaatggattcaacctggcggcagcgcaaaagatg

SEQ ID NO: 210378 - DNA, 103 bp, Artificial Sequence
  Synthetic Polynucleotide
taatacgactcactataggggagccactgtcccagccattttctgcacttaacagaggagaaagtgcatgaaatggctgaacctggcggcagcgcaaaagatg

SEQ ID NO: 210379 - DNA, 103 bp, Artificial Sequence
  Synthetic Polynucleotide
taatacgactcactatagggtgagaagttggagccactgtcccagccattaacagaggagaaatggcatggacagtggcaacctggcggcagcgcaaaagatg

SEQ ID NO: 210380 - DNA, 103 bp, Artificial Sequence
  Synthetic Polynucleotide
taatacgactcactatagggtggtttcttctgagaagttggagccactgtaacagaggagaacagtgatgccaacttctaacctggcggcagcgcaaaagatg

SEQ ID NO: 210381 - DNA, 103 bp, Artificial Sequence
  Synthetic Polynucleotide
taatacgactcactatagggctaggtggtttggtttcttctgagaagttgaacagaggagacaacttatgagaagaaacaacctggcggcagcgcaaaagatg

SEQ ID NO: 210382 - DNA, 103 bp, Artificial Sequence
  Synthetic Polynucleotide
taatacgactcactatagggctttgggactctaggtggtttggtttcttcaacagaggagagaagaaatgaaaccacctaacctggcggcagcgcaaaagatg

SEQ ID NO: 210383 - DNA, 103 bp, Artificial Sequence
  Synthetic Polynucleotide
taatacgactcactatagggttaaaacatactttgggactctaggtggttaacagaggagaaaccacatggagtcccaaaacctggcggcagcgcaaaagatg

SEQ ID NO: 210384 - DNA, 103 bp, Artificial Sequence
  Synthetic Polynucleotide
taatacgactcactatagggttatgatctgttaaaacatactttgggactaacagaggagaagtcccatggtatgttttaacctggcggcagcgcaaaagatg

SEQ ID NO: 210385 - DNA, 103 bp, Artificial Sequence
  Synthetic Polynucleotide
taatacgactcactatagggtaggtcttttttatgatctgttaaaacataaacagaggagatatgttatgacagatcataacctggcggcagcgcaaaagatg

SEQ ID NO: 210386 - DNA, 103 bp, Artificial Sequence
  Synthetic Polynucleotide
taatacgactcactataggggaacttccaataggtcttttttatgatctgaacagaggagacagatcatgaaaaagaccaacctggcggcagcgcaaaagatg

SEQ ID NO: 210387 - DNA, 103 bp, Artificial Sequence
  Synthetic Polynucleotide
taatacgactcactatagggtttatttcaggaacttccaataggtcttttaacagaggagaaaaagaatgattggaagtaacctggcggcagcgcaaaagatg

SEQ ID NO: 210388 - DNA, 103 bp, Artificial Sequence
  Synthetic Polynucleotide
taatacgactcactatagggaacactgagctcctggattagtgaatccataacagaggagaatggatatgctaatccagaacctggcggcagcgcaaaagatg

SEQ ID NO: 210389 - DNA, 103 bp, Artificial Sequence
  Synthetic Polynucleotide
taatacgactcactatagggaccttcagtttttatttcaggaacttccaaaacagaggagattggaaatgcctgaaataaacctggcggcagcgcaaaagatg

SEQ ID NO: 210390 - DNA, 103 bp, Artificial Sequence
  Synthetic Polynucleotide
taatacgactcactatagggtaaatttgtcaccttcagtttttatttcagaacagaggagactgaaaatgaaactgaagaacctggcggcagcgcaaaagatg

SEQ ID NO: 210391 - DNA, 103 bp, Artificial Sequence
  Synthetic Polynucleotide
taatacgactcactatagggtcacaagggataaatttgtcaccttcagttaacagaggagaaactgaatgtgacaaattaacctggcggcagcgcaaaagatg

SEQ ID NO: 210392 - DNA, 103 bp, Artificial Sequence
  Synthetic Polynucleotide
taatacgactcactatagggacacctgttctcacaagggataaatttgtcaacagaggagagacaaaatgatcccttgtaacctggcggcagcgcaaaagatg

SEQ ID NO: 210393 - DNA, 103 bp, Artificial Sequence
  Synthetic Polynucleotide
taatacgactcactatagggtttcagaatcacacctgttctcacaagggaaacagaggagatcccttatgagaacaggtaacctggcggcagcgcaaaagatg

SEQ ID NO: 210394 - DNA, 103 bp, Artificial Sequence
  Synthetic Polynucleotide
taatacgactcactatagggttcctttctgtttcagaatcacacctgttcaacagaggagagaacagatgtgattctgaaacctggcggcagcgcaaaagatg

SEQ ID NO: 210395 - DNA, 103 bp, Artificial Sequence
  Synthetic Polynucleotide
taatacgactcactatagggctgcgggtctttcctttctgtttcagaatcaacagaggagagattctatgacagaaaggaacctggcggcagcgcaaaagatg

SEQ ID NO: 210396 - DNA, 103 bp, Artificial Sequence
  Synthetic Polynucleotide
taatacgactcactatagggcgagagcattctgcgggtctttcctttctgaacagaggagacagaaaatgaagacccgcaacctggcggcagcgcaaaagatg

SEQ ID NO: 210397 - DNA, 103 bp, Artificial Sequence
  Synthetic Polynucleotide
taatacgactcactatagggaggggttctgcgagagcattctgcgggtctaacagaggagaagacccatggaatgctctaacctggcggcagcgcaaaagatg

SEQ ID NO: 210398 - DNA, 103 bp, Artificial Sequence
  Synthetic Polynucleotide
taatacgactcactatagggattgccatccaggggttctgcgagagcattaacagaggagaaatgctatggcagaacccaacctggcggcagcgcaaaagatg

SEQ ID NO: 210399 - DNA, 103 bp, Artificial Sequence
  Synthetic Polynucleotide
taatacgactcactatagggaatcataggcaacactgagctcctggattaaacagaggagataatccatgagctcagtgaacctggcggcagcgcaaaagatg

SEQ ID NO: 210400 - DNA, 103 bp, Artificial Sequence
  Synthetic Polynucleotide
taatacgactcactatagggagggctgggcattgccatccaggggttctgaacagaggagacagaacatgtggatggcaaacctggcggcagcgcaaaagatg

SEQ ID NO: 210401 - DNA, 103 bp, Artificial Sequence
  Synthetic Polynucleotide
taatacgactcactatagggtcagggaatgagggctgggcattgccatccaacagaggagaggatggatgtgcccagccaacctggcggcagcgcaaaagatg

SEQ ID NO: 210402 - DNA, 103 bp, Artificial Sequence
  Synthetic Polynucleotide
taatacgactcactatagggctcctcaacgtcagggaatgagggctgggcaacagaggagagcccagatgtcattccctaacctggcggcagcgcaaaagatg

SEQ ID NO: 210403 - DNA, 103 bp, Artificial Sequence
  Synthetic Polynucleotide
taatacgactcactatagggcgctatcttcctcctcaacgtcagggaatgaacagaggagacattccatgacgttgaggaacctggcggcagcgcaaaagatg

SEQ ID NO: 210404 - DNA, 103 bp, Artificial Sequence
  Synthetic Polynucleotide
taatacgactcactataggggccaggctctcgctatcttcctcctcaacgaacagaggagacgttgaatgggaagatagaacctggcggcagcgcaaaagatg

SEQ ID NO: 210405 - DNA, 103 bp, Artificial Sequence
  Synthetic Polynucleotide
taatacgactcactatagggcgtcattactgccaggctctcgctatcttcaacagaggagagaagatatggagagcctgaacctggcggcagcgcaaaagatg

SEQ ID NO: 210406 - DNA, 103 bp, Artificial Sequence
  Synthetic Polynucleotide
taatacgactcactatagggtaccctcttccgtcattactgccaggctctaacagaggagaagagccatgcagtaatgaaacctggcggcagcgcaaaagatg

SEQ ID NO: 210407 - DNA, 103 bp, Artificial Sequence
  Synthetic Polynucleotide
taatacgactcactatagggtccaggtcactaccctcttccgtcattactaacagaggagaagtaatatgggaagagggaacctggcggcagcgcaaaagatg

SEQ ID NO: 210408 - DNA, 103 bp, Artificial Sequence
  Synthetic Polynucleotide
taatacgactcactatagggcttggccttttccaggtcactaccctcttcaacagaggagagaagagatgagtgacctgaacctggcggcagcgcaaaagatg

SEQ ID NO: 210409 - DNA, 103 bp, Artificial Sequence
  Synthetic Polynucleotide
taatacgactcactatagggttaaattccccttggccttttccaggtcacaacagaggagagtgaccatgaaaaggccaaacctggcggcagcgcaaaagatg

SEQ ID NO: 210410 - DNA, 103 bp, Artificial Sequence
  Synthetic Polynucleotide
taatacgactcactataggggccatggagcaatcataggcaacactgagcaacagaggagagctcagatgtgcctatgaaacctggcggcagcgcaaaagatg

SEQ ID NO: 210411 - DNA, 103 bp, Artificial Sequence
  Synthetic Polynucleotide
taatacgactcactatagggtccagcaaacttaaattccccttggcctttaacagaggagaaaaggcatgggggaatttaacctggcggcagcgcaaaagatg

SEQ ID NO: 210412 - DNA, 103 bp, Artificial Sequence
  Synthetic Polynucleotide
taatacgactcactatagggaattgcctgctccagcaaacttaaattcccaacagaggagagggaatatgagtttgctgaacctggcggcagcgcaaaagatg

SEQ ID NO: 210413 - DNA, 103 bp, Artificial Sequence
  Synthetic Polynucleotide
taatacgactcactatagggcctgcagagcaattgcctgctccagcaaacaacagaggagagtttgcatgagcaggcaaaacctggcggcagcgcaaaagatg

SEQ ID NO: 210414 - DNA, 103 bp, Artificial Sequence
  Synthetic Polynucleotide
taatacgactcactatagggcctcgctcagcctgcagagcaattgcctgcaacagaggagagcaggcatgtgctctgcaaacctggcggcagcgcaaaagatg

SEQ ID NO: 210415 - DNA, 103 bp, Artificial Sequence
  Synthetic Polynucleotide
taatacgactcactataggggaaaacacaacctcgctcagcctgcagagcaacagaggagagctctgatggctgagcgaaacctggcggcagcgcaaaagatg

SEQ ID NO: 210416 - DNA, 103 bp, Artificial Sequence
  Synthetic Polynucleotide
taatacgactcactatagggaggtgttatggaaaacacaacctcgctcagaacagaggagactgagcatggttgtgtttaacctggcggcagcgcaaaagatg

SEQ ID NO: 210417 - DNA, 103 bp, Artificial Sequence
  Synthetic Polynucleotide
taatacgactcactatagggagctctttgtaggtgttatggaaaacacaaaacagaggagattgtgtatgccataacacaacctggcggcagcgcaaaagatg

SEQ ID NO: 210418 - DNA, 103 bp, Artificial Sequence
  Synthetic Polynucleotide
taatacgactcactataggggaacctatccagctctttgtaggtgttatgaacagaggagacataacatgtacaaagagaacctggcggcagcgcaaaagatg

SEQ ID NO: 210419 - DNA, 103 bp, Artificial Sequence
  Synthetic Polynucleotide
taatacgactcactataggggctccagcaggaacctatccagctctttgtaacagaggagaacaaagatgtggataggtaacctggcggcagcgcaaaagatg

SEQ ID NO: 210420 - DNA, 103 bp, Artificial Sequence
  Synthetic Polynucleotide
taatacgactcactatagggcctgctaggtgctccagcaggaacctatccaacagaggagaggatagatgcctgctggaaacctggcggcagcgcaaaagatg

SEQ ID NO: 210421 - DNA, 103 bp, Artificial Sequence
  Synthetic Polynucleotide
taatacgactcactatagggaagctgctgaagttcgtaccactgagacataacagaggagaatgtctatgtggtacgaaaacctggcggcagcgcaaaagatg

SEQ ID NO: 210422 - DNA, 103 bp, Artificial Sequence
  Synthetic Polynucleotide
taatacgactcactatagggcttttctaaccactgtgccaggtactgtctaacagaggagaagacagatgctggcacagaacctggcggcagcgcaaaagatg

SEQ ID NO: 210423 - DNA, 103 bp, Artificial Sequence
  Synthetic Polynucleotide
taatacgactcactatagggctggacccctgtcttcaagaccagcggcctaacagaggagaaggccgatggtcttgaagaacctggcggcagcgcaaaagatg

SEQ ID NO: 210424 - DNA, 103 bp, Artificial Sequence
  Synthetic Polynucleotide
taatacgactcactatagggtcacagtgaactggacccctgtcttcaagaaacagaggagatcttgaatgcaggggtccaacctggcggcagcgcaaaagatg

SEQ ID NO: 210425 - DNA, 103 bp, Artificial Sequence
  Synthetic Polynucleotide
taatacgactcactatagggagtctcaacttcacagtgaactggacccctaacagaggagaaggggtatggttcactgtaacctggcggcagcgcaaaagatg

SEQ ID NO: 210426 - DNA, 103 bp, Artificial Sequence
  Synthetic Polynucleotide
taatacgactcactatagggtttcaccaacagtctcaacttcacagtgaaaacagaggagattcactatgaagttgagaaacctggcggcagcgcaaaagatg

SEQ ID NO: 210427 - DNA, 103 bp, Artificial Sequence
  Synthetic Polynucleotide
taatacgactcactataggggctcttgcaatttcaccaacagtctcaactaacagaggagaagttgaatgtgttggtgaaacctggcggcagcgcaaaagatg

SEQ ID NO: 210428 - DNA, 103 bp, Artificial Sequence
  Synthetic Polynucleotide
taatacgactcactatagggttataattcagctcttgcaatttcaccaacaacagaggagagttggtatgattgcaagaaacctggcggcagcgcaaaagatg

SEQ ID NO: 210429 - DNA, 103 bp, Artificial Sequence
  Synthetic Polynucleotide
taatacgactcactataggggactttcaaattataattcagctcttgcaaaacagaggagattgcaaatgctgaattataacctggcggcagcgcaaaagatg

SEQ ID NO: 210430 - DNA, 103 bp, Artificial Sequence
  Synthetic Polynucleotide
taatacgactcactatagggataagactttgactttcaaattataattcaaacagaggagatgaattatgatttgaaagaacctggcggcagcgcaaaagatg

SEQ ID NO: 210431 - DNA, 103 bp, Artificial Sequence
  Synthetic Polynucleotide
taatacgactcactatagggtctttatcaaataagactttgactttcaaaaacagaggagatttgaaatgcaaagtcttaacctggcggcagcgcaaaagatg

SEQ ID NO: 210432 - DNA, 103 bp, Artificial Sequence
  Synthetic Polynucleotide
taatacgactcactatagggctcattcacatctttatcaaataagactttaacagaggagaaaagtcatgtttgataaaaacctggcggcagcgcaaaagatg

SEQ ID NO: 210433 - DNA, 103 bp, Artificial Sequence
  Synthetic Polynucleotide
taatacgactcactatagggcccagtcttgcttttctaaccactgtgccaaacagaggagatggcacatgggttagaaaaacctggcggcagcgcaaaagatg

SEQ ID NO: 210434 - DNA, 103 bp, Artificial Sequence
  Synthetic Polynucleotide
taatacgactcactatagggctgtatttctctcattcacatctttatcaaaacagaggagattgataatgatgtgaatgaacctggcggcagcgcaaaagatg

SEQ ID NO: 210435 - DNA, 103 bp, Artificial Sequence
  Synthetic Polynucleotide
taatacgactcactatagggaatccttttactgtatttctctcattcacaaacagaggagatgtgaaatggagaaatacaacctggcggcagcgcaaaagatg

SEQ ID NO: 210436 - DNA, 103 bp, Artificial Sequence
  Synthetic Polynucleotide
taatacgactcactataggggaacttcctaaatccttttactgtatttctaacagaggagaagaaatatggtaaaaggaaacctggcggcagcgcaaaagatg

SEQ ID NO: 210437 - DNA, 103 bp, Artificial Sequence
  Synthetic Polynucleotide
taatacgactcactatagggccaaaatgttgaacttcctaaatccttttaaacagaggagataaaagatgttaggaagtaacctggcggcagcgcaaaagatg

SEQ ID NO: 210438 - DNA, 103 bp, Artificial Sequence
  Synthetic Polynucleotide
taatacgactcactataggggtgtgcgtgcccaaaatgttgaacttcctaaacagaggagataggaaatgcaacattttaacctggcggcagcgcaaaagatg

SEQ ID NO: 210439 - DNA, 103 bp, Artificial Sequence
  Synthetic Polynucleotide
taatacgactcactatagggcatcacttttgtgtgcgtgcccaaaatgttaacagaggagaaacattatgggcacgcacaacctggcggcagcgcaaaagatg

SEQ ID NO: 210440 - DNA, 103 bp, Artificial Sequence
  Synthetic Polynucleotide
taatacgactcactatagggcctccatgttcatcacttttgtgtgcgtgcaacagaggagagcacgcatgcaaaagtgaaacctggcggcagcgcaaaagatg

SEQ ID NO: 210441 - DNA, 103 bp, Artificial Sequence
  Synthetic Polynucleotide
taatacgactcactatagggttggtggactcctccatgttcatcacttttaacagaggagaaaaagtatggaacatggaaacctggcggcagcgcaaaagatg

SEQ ID NO: 210442 - DNA, 103 bp, Artificial Sequence
  Synthetic Polynucleotide
taatacgactcactatagggcagactgccattggtggactcctccatgttaacagaggagaaacatgatggagtccaccaacctggcggcagcgcaaaagatg

SEQ ID NO: 210443 - DNA, 103 bp, Artificial Sequence
  Synthetic Polynucleotide
taatacgactcactatagggattcagccgccagactgccattggtggactaacagaggagaagtccaatgatggcagtcaacctggcggcagcgcaaaagatg

SEQ ID NO: 210444 - DNA, 103 bp, Artificial Sequence
  Synthetic Polynucleotide
taatacgactcactataggggcagcgtgctcccagtcttgcttttctaacaacagaggagagttagaatggcaagactgaacctggcggcagcgcaaaagatg

SEQ ID NO: 210445 - DNA, 103 bp, Artificial Sequence
  Synthetic Polynucleotide
taatacgactcactatagggaggtgccgaaattcagccgccagactgccaaacagaggagatggcagatgggcggctgaaacctggcggcagcgcaaaagatg

SEQ ID NO: 210446 - DNA, 103 bp, Artificial Sequence
  Synthetic Polynucleotide
taatacgactcactatagggtttcaattgcaggtgccgaaattcagccgcaacagaggagagcggctatgtttcggcacaacctggcggcagcgcaaaagatg

SEQ ID NO: 210447 - DNA, 103 bp, Artificial Sequence
  Synthetic Polynucleotide
taatacgactcactatagggttttctgttctttcaattgcaggtgccgaaaacagaggagattcggcatgtgcaattgaaacctggcggcagcgcaaaagatg

SEQ ID NO: 210448 - DNA, 103 bp, Artificial Sequence
  Synthetic Polynucleotide
taatacgactcactataggggtgccagcatttttctgttctttcaattgcaacagaggagagcaattatgagaacagaaaacctggcggcagcgcaaaagatg

SEQ ID NO: 210449 - DNA, 103 bp, Artificial Sequence
  Synthetic Polynucleotide
taatacgactcactatagggattcgttctggtgccagcatttttctgttcaacagaggagagaacagatgaatgctggcaacctggcggcagcgcaaaagatg

SEQ ID NO: 210450 - DNA, 103 bp, Artificial Sequence
  Synthetic Polynucleotide
taatacgactcactataggggaggaccctcattcgttctggtgccagcataacagaggagaatgctgatgccagaacgaaacctggcggcagcgcaaaagatg

SEQ ID NO: 210451 - DNA, 103 bp, Artificial Sequence
  Synthetic Polynucleotide
taatacgactcactataggggtaacgatgagaggaccctcattcgttctgaacagaggagacagaacatgtgagggtccaacctggcggcagcgcaaaagatg

SEQ ID NO: 210452 - DNA, 103 bp, Artificial Sequence
  Synthetic Polynucleotide
taatacgactcactatagggaagctcttcagtaacgatgagaggaccctcaacagaggagagagggtatgctcatcgttaacctggcggcagcgcaaaagatg

SEQ ID NO: 210453 - DNA, 103 bp, Artificial Sequence
  Synthetic Polynucleotide
taatacgactcactatagggtaagggagtgaagctcttcagtaacgatgaaacagaggagatcatcgatgctgaagagcaacctggcggcagcgcaaaagatg

SEQ ID NO: 210454 - DNA, 103 bp, Artificial Sequence
  Synthetic Polynucleotide
taatacgactcactataggggtttcaaaactaagggagtgaagctcttcaaacagaggagatgaagaatgtcactccctaacctggcggcagcgcaaaagatg

SEQ ID NO: 210455 - DNA, 103 bp, Artificial Sequence
  Synthetic Polynucleotide
taatacgactcactatagggaacatcattggcagcgtgctcccagtcttgaacagaggagacaagacatggagcacgctaacctggcggcagcgcaaaagatg

SEQ ID NO: 210456 - DNA, 103 bp, Artificial Sequence
  Synthetic Polynucleotide
taatacgactcactataggggcacaattgggtttcaaaactaagggagtgaacagaggagacactccatgagttttgaaaacctggcggcagcgcaaaagatg

SEQ ID NO: 210457 - DNA, 103 bp, Artificial Sequence
  Synthetic Polynucleotide
taatacgactcactatagggaaccaggctggcacaattgggtttcaaaacaacagaggagagttttgatgcccaattgtaacctggcggcagcgcaaaagatg

SEQ ID NO: 210458 - DNA, 103 bp, Artificial Sequence
  Synthetic Polynucleotide
taatacgactcactatagggtcaattaccaaaccaggctggcacaattggaacagaggagaccaattatgccagcctggaacctggcggcagcgcaaaagatg

SEQ ID NO: 210459 - DNA, 103 bp, Artificial Sequence
  Synthetic Polynucleotide
taatacgactcactatagggcgtctcgaggtcaattaccaaaccaggctgaacagaggagacagcctatgttggtaattaacctggcggcagcgcaaaagatg

SEQ ID NO: 210460 - DNA, 103 bp, Artificial Sequence
  Synthetic Polynucleotide
taatacgactcactataggggcagagaggtcgtctcgaggtcaattaccaaacagaggagatggtaaatgacctcgagaaacctggcggcagcgcaaaagatg

SEQ ID NO: 210461 - DNA, 103 bp, Artificial Sequence
  Synthetic Polynucleotide
taatacgactcactatagggaccacaacgggcagagaggtcgtctcgaggaacagaggagacctcgaatggacctctctaacctggcggcagcgcaaaagatg

SEQ ID NO: 210462 - DNA, 103 bp, Artificial Sequence
  Synthetic Polynucleotide
taatacgactcactataggggttggagatcaccacaacgggcagagaggtaacagaggagaacctctatgcccgttgtgaacctggcggcagcgcaaaagatg

SEQ ID NO: 210463 - DNA, 103 bp, Artificial Sequence
  Synthetic Polynucleotide
taatacgactcactataggggctggctgacgttggagatcaccacaacggaacagaggagaccgttgatgtgatctccaaacctggcggcagcgcaaaagatg

SEQ ID NO: 210464 - DNA, 103 bp, Artificial Sequence
  Synthetic Polynucleotide
taatacgactcactatagggccgctcgggagctggctgacgttggagatcaacagaggagagatctcatgcgtcagccaaacctggcggcagcgcaaaagatg

SEQ ID NO: 210465 - DNA, 103 bp, Artificial Sequence
  Synthetic Polynucleotide
taatacgactcactatagggggaggcccaaccgctcgggagctggctgacaacagaggagagtcagcatgctcccgagcaacctggcggcagcgcaaaagatg

SEQ ID NO: 210466 - DNA, 103 bp, Artificial Sequence
  Synthetic Polynucleotide
taatacgactcactatagggtggcaaatgaaacatcattggcagcgtgctaacagaggagaagcacgatgccaatgatgaacctggcggcagcgcaaaagatg

SEQ ID NO: 210467 - DNA, 103 bp, Artificial Sequence
  Synthetic Polynucleotide
taatacgactcactatagggaccaaaggatggaggcccaaccgctcgggaaacagaggagatcccgaatggttgggcctaacctggcggcagcgcaaaagatg

SEQ ID NO: 210468 - DNA, 103 bp, Artificial Sequence
  Synthetic Polynucleotide
taatacgactcactatagggagcatgttgtaccaaaggatggaggcccaaaacagaggagattgggcatgcatcctttgaacctggcggcagcgcaaaagatg

SEQ ID NO: 210469 - DNA, 103 bp, Artificial Sequence
  Synthetic Polynucleotide
taatacgactcactatagggttccgccaccagcatgttgtaccaaaggataacagaggagaatccttatgtacaacatgaacctggcggcagcgcaaaagatg

SEQ ID NO: 210470 - DNA, 103 bp, Artificial Sequence
  Synthetic Polynucleotide
taatacgactcactataggggattcctgggttccgccaccagcatgttgtaacagaggagaacaacaatgtggtggcggaacctggcggcagcgcaaaagatg

SEQ ID NO: 210471 - DNA, 103 bp, Artificial Sequence
  Synthetic Polynucleotide
taatacgactcactatagggaagaaggacagattcctgggttccgccaccaacagaggagaggtggcatgacccaggaaaacctggcggcagcgcaaaagatg

SEQ ID NO: 210472 - DNA, 103 bp, Artificial Sequence
  Synthetic Polynucleotide
taatacgactcactatagggtggagtcaggaagaaggacagattcctgggaacagaggagacccaggatgctgtccttcaacctggcggcagcgcaaaagatg

SEQ ID NO: 210473 - DNA, 103 bp, Artificial Sequence
  Synthetic Polynucleotide
taatacgactcactataggggtgcacatggtggagtcaggaagaaggacaaacagaggagatgtcctatgtcctgactcaacctggcggcagcgcaaaagatg

SEQ ID NO: 210474 - DNA, 103 bp, Artificial Sequence
  Synthetic Polynucleotide
taatacgactcactatagggtgagcccatcgtgcacatggtggagtcaggaacagaggagacctgacatgaccatgtgcaacctggcggcagcgcaaaagatg

SEQ ID NO: 210475 - DNA, 103 bp, Artificial Sequence
  Synthetic Polynucleotide
taatacgactcactatagggttctgaaagctgagcccatcgtgcacatggaacagaggagaccatgtatgcgatgggctaacctggcggcagcgcaaaagatg

SEQ ID NO: 210476 - DNA, 103 bp, Artificial Sequence
  Synthetic Polynucleotide
taatacgactcactatagggaactcagcacttctgaaagctgagcccatcaacagaggagagatgggatgagctttcagaacctggcggcagcgcaaaagatg

SEQ ID NO: 210477 - DNA, 103 bp, Artificial Sequence
  Synthetic Polynucleotide
taatacgactcactatagggaaacggatggtggcaaatgaaacatcattgaacagaggagacaatgaatgttcatttgcaacctggcggcagcgcaaaagatg

SEQ ID NO: 210478 - DNA, 103 bp, Artificial Sequence
  Synthetic Polynucleotide
taatacgactcactataggggaaaactgccaactcagcacttctgaaagcaacagaggagagctttcatgagtgctgagaacctggcggcagcgcaaaagatg

SEQ ID NO: 210479 - DNA, 103 bp, Artificial Sequence
  Synthetic Polynucleotide
taatacgactcactatagggggtgacagaagaaaactgccaactcagcacaacagaggagagtgctgatgtggcagtttaacctggcggcagcgcaaaagatg

SEQ ID NO: 210480 - DNA, 103 bp, Artificial Sequence
  Synthetic Polynucleotide
taatacgactcactataggggacctcttttggtgacagaagaaaactgccaacagaggagaggcagtatgcttctgtcaaacctggcggcagcgcaaaagatg

SEQ ID NO: 210481 - DNA, 103 bp, Artificial Sequence
  Synthetic Polynucleotide
taatacgactcactatagggtccacattgagacctcttttggtgacagaaaacagaggagattctgtatgcaaaagaggaacctggcggcagcgcaaaagatg

SEQ ID NO: 210482 - DNA, 103 bp, Artificial Sequence
  Synthetic Polynucleotide
taatacgactcactataggggttcagctggtccacattgagacctcttttaacagaggagaaaaagaatgctcaatgtgaacctggcggcagcgcaaaagatg

SEQ ID NO: 210483 - DNA, 103 bp, Artificial Sequence
  Synthetic Polynucleotide
taatacgactcactatagggctcccaacatgttcagctggtccacattgaaacagaggagatcaatgatgaccagctgaaacctggcggcagcgcaaaagatg

SEQ ID NO: 210484 - DNA, 103 bp, Artificial Sequence
  Synthetic Polynucleotide
taatacgactcactatagggagaagcttctctcccaacatgttcagctggaacagaggagaccagctatgcatgttgggaacctggcggcagcgcaaaagatg

SEQ ID NO: 210485 - DNA, 103 bp, Artificial Sequence
  Synthetic Polynucleotide
taatacgactcactataggggttaggaccaagaagcttctctcccaacataacagaggagaatgttgatggagaagcttaacctggcggcagcgcaaaagatg

SEQ ID NO: 210486 - DNA, 103 bp, Artificial Sequence
  Synthetic Polynucleotide
taatacgactcactatagggcggggctggcgttaggaccaagaagcttctaacagaggagaagaagcatgttggtcctaaacctggcggcagcgcaaaagatg

SEQ ID NO: 210487 - DNA, 103 bp, Artificial Sequence
  Synthetic Polynucleotide
taatacgactcactatagggatgagaccatcggggctggcgttaggaccaaacagaggagatggtccatgcgccagcccaacctggcggcagcgcaaaagatg

SEQ ID NO: 210488 - DNA, 103 bp, Artificial Sequence
  Synthetic Polynucleotide
taatacgactcactataggggaggtcatgaaaacggatggtggcaaatgaaacagaggagatcatttatgaccatccgtaacctggcggcagcgcaaaagatg

SEQ ID NO: 210489 - DNA, 103 bp, Artificial Sequence
  Synthetic Polynucleotide
taatacgactcactatagggcgtccacggaatgagaccatcggggctggcaacagaggagagccagcatggatggtctcaacctggcggcagcgcaaaagatg

SEQ ID NO: 210490 - DNA, 103 bp, Artificial Sequence
  Synthetic Polynucleotide
taatacgactcactatagggtacaaaacctcgtccacggaatgagaccataacagaggagaatggtcatgttccgtggaaacctggcggcagcgcaaaagatg

SEQ ID NO: 210491 - DNA, 103 bp, Artificial Sequence
  Synthetic Polynucleotide
taatacgactcactatagggatattttccttacaaaacctcgtccacggaaacagaggagatccgtgatggaggttttgaacctggcggcagcgcaaaagatg

SEQ ID NO: 210492 - DNA, 103 bp, Artificial Sequence
  Synthetic Polynucleotide
taatacgactcactatagggtttatcatttatattttccttacaaaacctaacagaggagaaggtttatgaaggaaaataacctggcggcagcgcaaaagatg

SEQ ID NO: 210493 - DNA, 103 bp, Artificial Sequence
  Synthetic Polynucleotide
taatacgactcactatagggagggaaaatttttatcatttatattttcctaacagaggagaaggaaaatgtaaatgataaacctggcggcagcgcaaaagatg

SEQ ID NO: 210494 - DNA, 103 bp, Artificial Sequence
  Synthetic Polynucleotide
taatacgactcactatagggcaaagccagaagggaaaatttttatcatttaacagaggagaaaatgaatgaaattttccaacctggcggcagcgcaaaagatg

SEQ ID NO: 210495 - DNA, 103 bp, Artificial Sequence
  Synthetic Polynucleotide
taatacgactcactataggggctttcaatccaaagccagaagggaaaattaacagaggagaaattttatgttctggcttaacctggcggcagcgcaaaagatg

SEQ ID NO: 210496 - DNA, 103 bp, Artificial Sequence
  Synthetic Polynucleotide
taatacgactcactataggggttctaggatgctttcaatccaaagccagaaacagaggagatctggcatgggattgaaaaacctggcggcagcgcaaaagatg

SEQ ID NO: 210497 - DNA, 103 bp, Artificial Sequence
  Synthetic Polynucleotide
taatacgactcactatagggtttttaatgagttctaggatgctttcaatcaacagaggagagattgaatgcatcctagaaacctggcggcagcgcaaaagatg

SEQ ID NO: 210498 - DNA, 103 bp, Artificial Sequence
  Synthetic Polynucleotide
taatacgactcactataggggagcaggtgttttttaatgagttctaggataacagaggagaatcctaatgctcattaaaaacctggcggcagcgcaaaagatg

SEQ ID NO: 210499 - DNA, 103 bp, Artificial Sequence
  Synthetic Polynucleotide
taatacgactcactataggggctgtgacaggaggtcatgaaaacggatggaacagaggagaccatccatgttcatgaccaacctggcggcagcgcaaaagatg

SEQ ID NO: 210500 - DNA, 103 bp, Artificial Sequence
  Synthetic Polynucleotide
taatacgactcactatagggtccagagagggagcaggtgttttttaatgaaacagaggagatcattaatgaacacctgcaacctggcggcagcgcaaaagatg

SEQ ID NO: 210501 - DNA, 103 bp, Artificial Sequence
  Synthetic Polynucleotide
taatacgactcactatagggcacccatcattccagagagggagcaggtgtaacagaggagaacacctatgccctctctgaacctggcggcagcgcaaaagatg

SEQ ID NO: 210502 - DNA, 103 bp, Artificial Sequence
  Synthetic Polynucleotide
taatacgactcactataggggcccatgatgcacccatcattccagagaggaacagaggagacctctcatgaatgatgggaacctggcggcagcgcaaaagatg

SEQ ID NO: 210503 - DNA, 103 bp, Artificial Sequence
  Synthetic Polynucleotide
taatacgactcactatagggtgctgatgaagcccatgatgcacccatcataacagaggagaatgatgatggcatcatggaacctggcggcagcgcaaaagatg

SEQ ID NO: 210504 - DNA, 103 bp, Artificial Sequence
  Synthetic Polynucleotide
taatacgactcactatagggtctcgctccttgctgatgaagcccatgatgaacagaggagacatcatatgcttcatcagaacctggcggcagcgcaaaagatg

SEQ ID NO: 210505 - DNA, 103 bp, Artificial Sequence
  Synthetic Polynucleotide
taatacgactcactatagggcagggcacgctctcgctccttgctgatgaaaacagaggagattcatcatgaaggagcgaaacctggcggcagcgcaaaagatg

SEQ ID NO: 210506 - DNA, 103 bp, Artificial Sequence
  Synthetic Polynucleotide
taatacgactcactatagggggtccttcaacagggcacgctctcgctcctaacagaggagaaggagcatgagcgtgcccaacctggcggcagcgcaaaagatg

SEQ ID NO: 210507 - DNA, 103 bp, Artificial Sequence
  Synthetic Polynucleotide
taatacgactcactatagggcccggctgctggtccttcaacagggcacgcaacagaggagagcgtgcatggttgaaggaaacctggcggcagcgcaaaagatg

SEQ ID NO: 210508 - DNA, 103 bp, Artificial Sequence
  Synthetic Polynucleotide
taatacgactcactatagggcaggaaggtccccggctgctggtccttcaaaacagaggagattgaagatgcagcagccgaacctggcggcagcgcaaaagatg

SEQ ID NO: 210509 - DNA, 103 bp, Artificial Sequence
  Synthetic Polynucleotide
taatacgactcactatagggtgaaccgcagcaggaaggtccccggctgctaacagaggagaagcagcatgggaccttccaacctggcggcagcgcaaaagatg

SEQ ID NO: 210510 - DNA, 103 bp, Artificial Sequence
  Synthetic Polynucleotide
taatacgactcactatagggtgatcatccagctgtgacaggaggtcatgaaacagaggagatcatgaatgcctgtcacaaacctggcggcagcgcaaaagatg

SEQ ID NO: 210511 - DNA, 103 bp, Artificial Sequence
  Synthetic Polynucleotide
taatacgactcactataggggagctctcactgaaccgcagcaggaaggtcaacagaggagagaccttatggctgcggttaacctggcggcagcgcaaaagatg

SEQ ID NO: 210512 - DNA, 103 bp, Artificial Sequence
  Synthetic Polynucleotide
taatacgactcactatagggcccttcccgggagctctcactgaaccgcagaacagaggagactgcggatgagtgagagcaacctggcggcagcgcaaaagatg

SEQ ID NO: 210513 - DNA, 103 bp, Artificial Sequence
  Synthetic Polynucleotide
taatacgactcactatagggatgtgatggccccttcccgggagctctcacaacagaggagagtgagaatgcccgggaagaacctggcggcagcgcaaaagatg

SEQ ID NO: 210514 - DNA, 103 bp, Artificial Sequence
  Synthetic Polynucleotide
taatacgactcactatagggacccatgtgaatgtgatggccccttcccggaacagaggagaccgggaatgggccatcacaacctggcggcagcgcaaaagatg

SEQ ID NO: 210515 - DNA, 103 bp, Artificial Sequence
  Synthetic Polynucleotide
taatacgactcactatagggggaccgctccacccatgtgaatgtgatggcaacagaggagagccatcatgttcacatggaacctggcggcagcgcaaaagatg

SEQ ID NO: 210516 - DNA, 103 bp, Artificial Sequence
  Synthetic Polynucleotide
taatacgactcactatagggctccgttctgggaccgctccacccatgtgaaacagaggagatcacatatgtggagcggtaacctggcggcagcgcaaaagatg

SEQ ID NO: 210517 - DNA, 103 bp, Artificial Sequence
  Synthetic Polynucleotide
taatacgactcactatagggtcaggttcgcctccgttctgggaccgctccaacagaggagaggagcgatgccagaacggaacctggcggcagcgcaaaagatg

SEQ ID NO: 210518 - DNA, 103 bp, Artificial Sequence
  Synthetic Polynucleotide
taatacgactcactatagggcgcatggaagtcaggttcgcctccgttctgaacagaggagacagaacatgggcgaacctaacctggcggcagcgcaaaagatg

SEQ ID NO: 210519 - DNA, 103 bp, Artificial Sequence
  Synthetic Polynucleotide
taatacgactcactatagggagggttcaaccgcatggaagtcaggttcgcaacagaggagagcgaacatgacttccatgaacctggcggcagcgcaaaagatg

SEQ ID NO: 210520 - DNA, 103 bp, Artificial Sequence
  Synthetic Polynucleotide
taatacgactcactatagggttcttcgtgtagggttcaaccgcatggaagaacagaggagacttccaatgggttgaaccaacctggcggcagcgcaaaagatg

SEQ ID NO: 210521 - DNA, 103 bp, Artificial Sequence
  Synthetic Polynucleotide
taatacgactcactataggggcgactatattgatcatccagctgtgacagaacagaggagactgtcaatgctggatgataacctggcggcagcgcaaaagatg

SEQ ID NO: 210522 - DNA, 103 bp, Artificial Sequence
  Synthetic Polynucleotide
taatacgactcactatagggagaaagttctttcttcgtgtagggttcaacaacagaggagagttgaaatgtacacgaagaacctggcggcagcgcaaaagatg

SEQ ID NO: 210523 - DNA, 103 bp, Artificial Sequence
  Synthetic Polynucleotide
taatacgactcactatagggaagtaacagcagaaagttctttcttcgtgtaacagaggagaacacgaatgaagaactttaacctggcggcagcgcaaaagatg

SEQ ID NO: 210524 - DNA, 103 bp, Artificial Sequence
  Synthetic Polynucleotide
taatacgactcactatagggatgtcagggaaagtaacagcagaaagttctaacagaggagaagaactatgtgctgttacaacctggcggcagcgcaaaagatg

SEQ ID NO: 210525 - DNA, 103 bp, Artificial Sequence
  Synthetic Polynucleotide
taatacgactcactatagggattgcgaatgatgtcagggaaagtaacagcaacagaggagagctgttatgttccctgacaacctggcggcagcgcaaaagatg

SEQ ID NO: 210526 - DNA, 103 bp, Artificial Sequence
  Synthetic Polynucleotide
taatacgactcactatagggtgactttgtaattgcgaatgatgtcagggaaacagaggagatccctgatgtcattcgcaaacctggcggcagcgcaaaagatg

SEQ ID NO: 210527 - DNA, 103 bp, Artificial Sequence
  Synthetic Polynucleotide
taatacgactcactatagggtcagcagccatgactttgtaattgcgaatgaacagaggagacattcgatgttacaaagtaacctggcggcagcgcaaaagatg

SEQ ID NO: 210528 - DNA, 103 bp, Artificial Sequence
  Synthetic Polynucleotide
taatacgactcactatagggaggaatattctcagcagccatgactttgtaaacagaggagatacaaaatgatggctgctaacctggcggcagcgcaaaagatg

SEQ ID NO: 210529 - DNA, 103 bp, Artificial Sequence
  Synthetic Polynucleotide
taatacgactcactatagggggggattctcaggaatattctcagcagccaaacagaggagatggctgatgagaatattcaacctggcggcagcgcaaaagatg

SEQ ID NO: 210530 - DNA, 103 bp, Artificial Sequence
  Synthetic Polynucleotide
taatacgactcactatagggagatacttcaggggattctcaggaatattcaacagaggagagaatatatgtgagaatccaacctggcggcagcgcaaaagatg

SEQ ID NO: 210531 - DNA, 103 bp, Artificial Sequence
  Synthetic Polynucleotide
taatacgactcactatagggatttggatacagatacttcaggggattctcaacagaggagagagaatatgctgaagtataacctggcggcagcgcaaaagatg

SEQ ID NO: 210532 - DNA, 103 bp, Artificial Sequence
  Synthetic Polynucleotide
taatacgactcactatagggattttgagtcaagctgctgaagttcgtaccaacagaggagaggtacgatgttcagcagcaacctggcggcagcgcaaaagatg

SEQ ID NO: 210533 - DNA, 103 bp, Artificial Sequence
  Synthetic Polynucleotide
taatacgactcactatagggccaaagaaaagcgactatattgatcatccaaacagaggagatggatgatgaatatagtcaacctggcggcagcgcaaaagatg

SEQ ID NO: 210534 - DNA, 103 bp, Artificial Sequence
  Synthetic Polynucleotide
taatacgactcactatagggctttgtcaatatttggatacagatacttcaaacagaggagatgaagtatgtgtatccaaaacctggcggcagcgcaaaagatg

SEQ ID NO: 210535 - DNA, 103 bp, Artificial Sequence
  Synthetic Polynucleotide
taatacgactcactatagggaaggcatggtctttgtcaatatttggatacaacagaggagagtatccatgtattgacaaaacctggcggcagcgcaaaagatg

SEQ ID NO: 210536 - DNA, 103 bp, Artificial Sequence
  Synthetic Polynucleotide
taatacgactcactatagggatactttccaaaggcatggtctttgtcaataacagaggagaattgacatggaccatgccaacctggcggcagcgcaaaagatg

SEQ ID NO: 210537 - DNA, 103 bp, Artificial Sequence
  Synthetic Polynucleotide
taatacgactcactataggggcctggagtaatactttccaaaggcatggtaacagaggagaaccatgatgttggaaagtaacctggcggcagcgcaaaagatg

SEQ ID NO: 210538 - DNA, 103 bp, Artificial Sequence
  Synthetic Polynucleotide
taatacgactcactataggggcttcctttggcctggagtaatactttccaaacagaggagatggaaaatgttactccagaacctggcggcagcgcaaaagatg

SEQ ID NO: 210539 - DNA, 103 bp, Artificial Sequence
  Synthetic Polynucleotide
taatacgactcactatagggtggctctggtgcttcctttggcctggagtaaacagaggagatactccatgccaaaggaaaacctggcggcagcgcaaaagatg

SEQ ID NO: 210540 - DNA, 103 bp, Artificial Sequence
  Synthetic Polynucleotide
taatacgactcactatagggcaagttccattggctctggtgcttcctttgaacagaggagacaaaggatgcaccagagcaacctggcggcagcgcaaaagatg

SEQ ID NO: 210541 - DNA, 103 bp, Artificial Sequence
  Synthetic Polynucleotide
taatacgactcactatagggttagggccatcaagttccattggctctggtaacagaggagaaccagaatgaatggaactaacctggcggcagcgcaaaagatg

SEQ ID NO: 210542 - DNA, 103 bp, Artificial Sequence
  Synthetic Polynucleotide
taatacgactcactatagggtccagttcctttagggccatcaagttccataacagaggagaatggaaatggatggccctaacctggcggcagcgcaaaagatg

SEQ ID NO: 210543 - DNA, 103 bp, Artificial Sequence
  Synthetic Polynucleotide
taatacgactcactatagggtcttgatatatccagttcctttagggccataacagaggagaatggccatgaaggaactgaacctggcggcagcgcaaaagatg

SEQ ID NO: 210544 - DNA, 103 bp, Artificial Sequence
  Synthetic Polynucleotide
taatacgactcactatagggaagttattctccaaagaaaagcgactatataacagaggagaatatagatgcttttctttaacctggcggcagcgcaaaagatg

SEQ ID NO: 210545 - DNA, 103 bp, Artificial Sequence
  Synthetic Polynucleotide
taatacgactcactatagggatcaactcagtcttgatatatccagttcctaacagaggagaaggaacatgatatatcaaaacctggcggcagcgcaaaagatg

SEQ ID NO: 210546 - DNA, 103 bp, Artificial Sequence
  Synthetic Polynucleotide
taatacgactcactatagggagacacagaaatcaactcagtcttgatataaacagaggagatatatcatgactgagttgaacctggcggcagcgcaaaagatg

SEQ ID NO: 210547 - DNA, 103 bp, Artificial Sequence
  Synthetic Polynucleotide
taatacgactcactatagggctgtagcaagaagttattctccaaagaaaaaacagaggagattttctatggagaataacaacctggcggcagcgcaaaagatg

SEQ ID NO: 210548 - DNA, 103 bp, Artificial Sequence
  Synthetic Polynucleotide
taatacgactcactatagggttatgttatgctgtagcaagaagttattctaacagaggagaagaataatgtcttgctacaacctggcggcagcgcaaaagatg

SEQ ID NO: 210549 - DNA, 103 bp, Artificial Sequence
  Synthetic Polynucleotide
taatacgactcactatagggttgcttttccttatgttatgctgtagcaagaacagaggagacttgctatggcataacataacctggcggcagcgcaaaagatg

SEQ ID NO: 210550 - DNA, 103 bp, Artificial Sequence
  Synthetic Polynucleotide
taatacgactcactatagggaagattacgcttgcttttccttatgttatgaacagaggagacataacatgaggaaaagcaacctggcggcagcgcaaaagatg

SEQ ID NO: 210551 - DNA, 103 bp, Artificial Sequence
  Synthetic Polynucleotide
taatacgactcactatagggaattatcctgaagattacgcttgcttttccaacagaggagaggaaaaatgagcgtaatcaacctggcggcagcgcaaaagatg

SEQ ID NO: 210552 - DNA, 103 bp, Artificial Sequence
  Synthetic Polynucleotide
taatacgactcactatagggtcttcctgaaaattatcctgaagattacgcaacagaggagagcgtaaatgtcaggataaaacctggcggcagcgcaaaagatg

SEQ ID NO: 210553 - DNA, 103 bp, Artificial Sequence
  Synthetic Polynucleotide
taatacgactcactatagggctggattgggtcttcctgaaaattatcctgaacagaggagacaggatatgtttcaggaaaacctggcggcagcgcaaaagatg

SEQ ID NO: 210554 - DNA, 103 bp, Artificial Sequence
  Synthetic Polynucleotide
taatacgactcactatagggtcatagacatctggattgggtcttcctgaaaacagaggagattcaggatgacccaatccaacctggcggcagcgcaaaagatg

SEQ ID NO: 210555 - DNA, 103 bp, Artificial Sequence
  Synthetic Polynucleotide
taatacgactcactatagggtgctccaggaattttgagtcaagctgctgaaacagaggagatcagcaatgtgactcaaaaacctggcggcagcgcaaaagatg

SEQ ID NO: 210556 - DNA, 103 bp, Artificial Sequence
  Synthetic Polynucleotide
taatacgactcactatagggctgtaaatgatcatagacatctggattgggaacagaggagacccaatatggatgtctataacctggcggcagcgcaaaagatg

SEQ ID NO: 210557 - DNA, 103 bp, Artificial Sequence
  Synthetic Polynucleotide
taatacgactcactatagggcttcagacagctgtaaatgatcatagacataacagaggagaatgtctatgatcatttacaacctggcggcagcgcaaaagatg

SEQ ID NO: 210558 - DNA, 103 bp, Artificial Sequence
  Synthetic Polynucleotide
taatacgactcactatagggtcctttcttccttcagacagctgtaaatgaaacagaggagatcatttatggctgtctgaaacctggcggcagcgcaaaagatg

SEQ ID NO: 210559 - DNA, 103 bp, Artificial Sequence
  Synthetic Polynucleotide
taatacgactcactatagggtccagaattttcctttcttccttcagacagaacagaggagactgtctatgggaagaaagaacctggcggcagcgcaaaagatg

SEQ ID NO: 210560 - DNA, 103 bp, Artificial Sequence
  Synthetic Polynucleotide
taatacgactcactatagggctgggcgttttccagaattttcctttcttcaacagaggagagaagaaatgaaaattctgaacctggcggcagcgcaaaagatg

SEQ ID NO: 210561 - DNA, 103 bp, Artificial Sequence
  Synthetic Polynucleotide
taatacgactcactataggggattaaatctctgggcgttttccagaatttaacagaggagaaaattcatgaaaacgcccaacctggcggcagcgcaaaagatg

SEQ ID NO: 210562 - DNA, 103 bp, Artificial Sequence
  Synthetic Polynucleotide
taatacgactcactataggggactgagcctgattaaatctctgggcgtttaacagaggagaaaacgcatggagatttaaaacctggcggcagcgcaaaagatg

SEQ ID NO: 210563 - DNA, 103 bp, Artificial Sequence
  Synthetic Polynucleotide
taatacgactcactatagggaatattccccgactgagcctgattaaatctaacagaggagaagatttatgcaggctcagaacctggcggcagcgcaaaagatg

SEQ ID NO: 210564 - DNA, 103 bp, Artificial Sequence
  Synthetic Polynucleotide
taatacgactcactatagggctgtgctctgaatattccccgactgagcctaacagaggagaaggctcatgcggggaataaacctggcggcagcgcaaaagatg

SEQ ID NO: 210565 - DNA, 103 bp, Artificial Sequence
  Synthetic Polynucleotide
taatacgactcactatagggtctaacatcactgtgctctgaatattccccaacagaggagaggggaaatgtcagagcacaacctggcggcagcgcaaaagatg

SEQ ID NO: 210566 - DNA, 103 bp, Artificial Sequence
  Synthetic Polynucleotide
taatacgactcactatagggctggtgaacctgctccaggaattttgagtcaacagaggagagactcaatgttcctggagaacctggcggcagcgcaaaagatg

SEQ ID NO: 210567 - DNA, 103 bp, Artificial Sequence
  Synthetic Polynucleotide
taatacgactcactatagggtttctgtttgtctaacatcactgtgctctgaacagaggagacagagcatggtgatgttaaacctggcggcagcgcaaaagatg

SEQ ID NO: 210568 - DNA, 103 bp, Artificial Sequence
  Synthetic Polynucleotide
taatacgactcactatagggtgtcaagctctttctgtttgtctaacatcaaacagaggagatgatgtatgacaaacagaaacctggcggcagcgcaaaagatg

SEQ ID NO: 210569 - DNA, 103 bp, Artificial Sequence
  Synthetic Polynucleotide
taatacgactcactatagggctgactttactgtcaagctctttctgtttgaacagaggagacaaacaatgagagcttgaaacctggcggcagcgcaaaagatg

SEQ ID NO: 210570 - DNA, 103 bp, Artificial Sequence
  Synthetic Polynucleotide
taatacgactcactatagggcttcacatttctgactttactgtcaagctcaacagaggagagagcttatgagtaaagtcaacctggcggcagcgcaaaagatg

SEQ ID NO: 210571 - DNA, 103 bp, Artificial Sequence
  Synthetic Polynucleotide
taatacgactcactatagggtaaccttgtccttcacatttctgactttacaacagaggagagtaaagatggaaatgtgaaacctggcggcagcgcaaaagatg

SEQ ID NO: 210572 - DNA, 103 bp, Artificial Sequence
  Synthetic Polynucleotide
taatacgactcactatagggtctatacacataaccttgtccttcacatttaacagaggagaaaatgtatgggacaaggtaacctggcggcagcgcaaaagatg

SEQ ID NO: 210573 - DNA, 103 bp, Artificial Sequence
  Synthetic Polynucleotide
taatacgactcactataggggatttcatgctctatacacataaccttgtcaacagaggagagacaagatgatgtgtataaacctggcggcagcgcaaaagatg

SEQ ID NO: 210574 - DNA, 103 bp, Artificial Sequence
  Synthetic Polynucleotide
taatacgactcactatagggccaggctcttgatttcatgctctatacacaaacagaggagatgtgtaatgagcatgaaaaacctggcggcagcgcaaaagatg

SEQ ID NO: 210575 - DNA, 103 bp, Artificial Sequence
  Synthetic Polynucleotide
taatacgactcactatagggtgtaaatcttccaggctcttgatttcatgcaacagaggagagcatgaatgcaagagcctaacctggcggcagcgcaaaagatg

SEQ ID NO: 210576 - DNA, 103 bp, Artificial Sequence
  Synthetic Polynucleotide
taatacgactcactatagggatattcatcttgtaaatcttccaggctcttaacagaggagaaagagcatggaagatttaaacctggcggcagcgcaaaagatg

SEQ ID NO: 210577 - DNA, 103 bp, Artificial Sequence
  Synthetic Polynucleotide
taatacgactcactatagggcatcataaagctggtgaacctgctccaggaaacagaggagatcctggatgaggttcaccaacctggcggcagcgcaaaagatg

SEQ ID NO: 210578 - DNA, 103 bp, Artificial Sequence
  Synthetic Polynucleotide
taatacgactcactatagggatttgaagtcatattcatcttgtaaatcttaacagaggagaaagattatgaagatgaataacctggcggcagcgcaaaagatg

SEQ ID NO: 210579 - DNA, 103 bp, Artificial Sequence
  Synthetic Polynucleotide
taatacgactcactatagggaaggttttgcatttgaagtcatattcatctaacagaggagaagatgaatgtgacttcaaaacctggcggcagcgcaaaagatg

SEQ ID NO: 210580 - DNA, 103 bp, Artificial Sequence
  Synthetic Polynucleotide
taatacgactcactatagggtctgttctgcaaggttttgcatttgaagtcaacagaggagagacttcatgtgcaaaaccaacctggcggcagcgcaaaagatg

SEQ ID NO: 210581 - DNA, 103 bp, Artificial Sequence
  Synthetic Polynucleotide
taatacgactcactatagggtctcgtgttctctgttctgcaaggttttgcaacagaggagagcaaaaatgtgcagaacaaacctggcggcagcgcaaaagatg

SEQ ID NO: 210582 - DNA, 103 bp, Artificial Sequence
  Synthetic Polynucleotide
taatacgactcactatagggacaccattggtctcgtgttctctgttctgcaacagaggagagcagaaatgagaacacgaaacctggcggcagcgcaaaagatg

SEQ ID NO: 210583 - DNA, 103 bp, Artificial Sequence
  Synthetic Polynucleotide
taatacgactcactatagggactctttgccacaccattggtctcgtgttcaacagaggagagaacacatgaccaatggtaacctggcggcagcgcaaaagatg

SEQ ID NO: 210584 - DNA, 103 bp, Artificial Sequence
  Synthetic Polynucleotide
taatacgactcactataggggtttctgatcactctttgccacaccattggaacagaggagaccaatgatgtggcaaagaaacctggcggcagcgcaaaagatg

SEQ ID NO: 210585 - DNA, 103 bp, Artificial Sequence
  Synthetic Polynucleotide
taatacgactcactatagggagctgttcttgtttctgatcactctttgccaacagaggagaggcaaaatgtgatcagaaaacctggcggcagcgcaaaagatg

SEQ ID NO: 210586 - DNA, 103 bp, Artificial Sequence
  Synthetic Polynucleotide
taatacgactcactatagggcttgagtaacagctgttcttgtttctgatcaacagaggagagatcagatgcaagaacagaacctggcggcagcgcaaaagatg

SEQ ID NO: 210587 - DNA, 103 bp, Artificial Sequence
  Synthetic Polynucleotide
taatacgactcactatagggaatacatcttcttgagtaacagctgttcttaacagaggagaaagaacatgtgttactcaaacctggcggcagcgcaaaagatg

SEQ ID NO: 210588 - DNA, 103 bp, Artificial Sequence
  Synthetic Polynucleotide
taatacgactcactatagggggaaaactgtcatcataaagctggtgaaccaacagaggagaggttcaatggctttatgaaacctggcggcagcgcaaaagatg

SEQ ID NO: 210589 - DNA, 103 bp, Artificial Sequence
  Synthetic Polynucleotide
taatacgactcactatagggtcaagcattaaatacatcttcttgagtaacaacagaggagagttactatggaagatgtaaacctggcggcagcgcaaaagatg

SEQ ID NO: 210590 - DNA, 103 bp, Artificial Sequence
  Synthetic Polynucleotide
taatacgactcactatagggtctcttattgtcaagcattaaatacatcttaacagaggagaaagatgatgttaatgcttaacctggcggcagcgcaaaagatg

SEQ ID NO: 210591 - DNA, 103 bp, Artificial Sequence
  Synthetic Polynucleotide
taatacgactcactatagggctacttcctttctcttattgtcaagcattaaacagaggagataatgcatgacaataagaaacctggcggcagcgcaaaagatg

SEQ ID NO: 210592 - DNA, 103 bp, Artificial Sequence
  Synthetic Polynucleotide
taatacgactcactatagggattttgtgaactacttcctttctcttattgaacagaggagacaataaatgaaaggaagtaacctggcggcagcgcaaaagatg

SEQ ID NO: 210593 - DNA, 103 bp, Artificial Sequence
  Synthetic Polynucleotide
taatacgactcactatagggcaactctattattttgtgaactacttccttaacagaggagaaaggaaatggttcacaaaaacctggcggcagcgcaaaagatg

SEQ ID NO: 210594 - DNA, 103 bp, Artificial Sequence
  Synthetic Polynucleotide
taatacgactcactatagggtgacattcagcaactctattattttgtgaaaacagaggagattcacaatgtaatagagtaacctggcggcagcgcaaaagatg

SEQ ID NO: 210595 - DNA, 103 bp, Artificial Sequence
  Synthetic Polynucleotide
taatacgactcactataggggtaagttcagtgacattcagcaactctattaacagaggagaaatagaatggctgaatgtaacctggcggcagcgcaaaagatg

SEQ ID NO: 210596 - DNA, 103 bp, Artificial Sequence
  Synthetic Polynucleotide
taatacgactcactatagggggcattctgggtaagttcagtgacattcagaacagaggagactgaatatgactgaacttaacctggcggcagcgcaaaagatg

SEQ ID NO: 210597 - DNA, 103 bp, Artificial Sequence
  Synthetic Polynucleotide
taatacgactcactatagggcattaatcagggcattctgggtaagttcagaacagaggagactgaacatgcccagaatgaacctggcggcagcgcaaaagatg

SEQ ID NO: 210598 - DNA, 103 bp, Artificial Sequence
  Synthetic Polynucleotide
taatacgactcactatagggactagttcatcattaatcagggcattctggaacagaggagaccagaaatgcctgattaaaacctggcggcagcgcaaaagatg

SEQ ID NO: 210599 - DNA, 103 bp, Artificial Sequence
  Synthetic Polynucleotide
taatacgactcactataggggatttccatgggaaaactgtcatcataaagaacagaggagactttatatggacagttttaacctggcggcagcgcaaaagatg

SEQ ID NO: 210600 - DNA, 103 bp, Artificial Sequence
  Synthetic Polynucleotide
taatacgactcactatagggcttccactccactagttcatcattaatcagaacagaggagactgattatggatgaactaaacctggcggcagcgcaaaagatg

SEQ ID NO: 210601 - DNA, 103 bp, Artificial Sequence
  Synthetic Polynucleotide
taatacgactcactataggggctgtctccgcttccactccactagttcataacagaggagaatgaacatgtggagtggaaacctggcggcagcgcaaaagatg

SEQ ID NO: 210602 - DNA, 103 bp, Artificial Sequence
  Synthetic Polynucleotide
taatacgactcactatagggcaggcgctctgctgtctccgcttccactccaacagaggagaggagtgatggcggagacaaacctggcggcagcgcaaaagatg

SEQ ID NO: 210603 - DNA, 103 bp, Artificial Sequence
  Synthetic Polynucleotide
taatacgactcactatagggccccccaatacaggcgctctgctgtctccgaacagaggagacggagaatgcagagcgccaacctggcggcagcgcaaaagatg

SEQ ID NO: 210604 - DNA, 103 bp, Artificial Sequence
  Synthetic Polynucleotide
taatacgactcactatagggcattgggcggccccccaatacaggcgctctaacagaggagaagagcgatggtattggggaacctggcggcagcgcaaaagatg

SEQ ID NO: 210605 - DNA, 103 bp, Artificial Sequence
  Synthetic Polynucleotide
taatacgactcactatagggtccaagcaagcattgggcggccccccaataaacagaggagatattggatggccgcccaaaacctggcggcagcgcaaaagatg

SEQ ID NO: 210606 - DNA, 103 bp, Artificial Sequence
  Synthetic Polynucleotide
taatacgactcactatagggctgcagctgatccaagcaagcattgggcggaacagaggagaccgcccatggcttgcttgaacctggcggcagcgcaaaagatg

SEQ ID NO: 210607 - DNA, 103 bp, Artificial Sequence
  Synthetic Polynucleotide
taatacgactcactatagggtgaaccagttctgcagctgatccaagcaagaacagaggagacttgctatgatcagctgcaacctggcggcagcgcaaaagatg

SEQ ID NO: 210608 - DNA, 103 bp, Artificial Sequence
  Synthetic Polynucleotide
taatacgactcactataggggcaactatagtgaaccagttctgcagctgaaacagaggagatcagctatggaactggttaacctggcggcagcgcaaaagatg

SEQ ID NO: 210609 - DNA, 103 bp, Artificial Sequence
  Synthetic Polynucleotide
taatacgactcactatagggcagactctccgcaactatagtgaaccagttaacagaggagaaactggatgactatagttaacctggcggcagcgcaaaagatg

SEQ ID NO: 210610 - DNA, 103 bp, Artificial Sequence
  Synthetic Polynucleotide
taatacgactcactatagggggtactgtctgatttccatgggaaaactgtaacagaggagaacagttatgccatggaaaaacctggcggcagcgcaaaagatg

SEQ ID NO: 210611 - DNA, 103 bp, Artificial Sequence
  Synthetic Polynucleotide
taatacgactcactataggggaacttgctgcagactctccgcaactatagaacagaggagactatagatgcggagagtcaacctggcggcagcgcaaaagatg

SEQ ID NO: 210612 - DNA, 103 bp, Artificial Sequence
  Synthetic Polynucleotide
taatacgactcactatagggagctgctgccgaacttgctgcagactctccaacagaggagaggagagatggcagcaagtaacctggcggcagcgcaaaagatg

SEQ ID NO: 210613 - DNA, 103 bp, Artificial Sequence
  Synthetic Polynucleotide
taatacgactcactatagggcaactttttaagctgctgccgaacttgctgaacagaggagacagcaaatgcggcagcagaacctggcggcagcgcaaaagatg

SEQ ID NO: 210614 - DNA, 103 bp, Artificial Sequence
  Synthetic Polynucleotide
taatacgactcactatagggccaattcctccaactttttaagctgctgccaacagaggagaggcagcatgttaaaaagtaacctggcggcagcgcaaaagatg

SEQ ID NO: 210615 - DNA, 103 bp, Artificial Sequence
  Synthetic Polynucleotide
taatacgactcactatagggtatttctgttccaattcctccaactttttaaacagaggagataaaaaatgggaggaattaacctggcggcagcgcaaaagatg

SEQ ID NO: 210616 - DNA, 103 bp, Artificial Sequence
  Synthetic Polynucleotide
taatacgactcactatagggttcgtaggtgtatttctgttccaattcctcaacagaggagagaggaaatggaacagaaaaacctggcggcagcgcaaaagatg

SEQ ID NO: 210617 - DNA, 103 bp, Artificial Sequence
  Synthetic Polynucleotide
taatacgactcactatagggtagggtcatgttcgtaggtgtatttctgttaacagaggagaaacagaatgacacctacgaacctggcggcagcgcaaaagatg

SEQ ID NO: 210618 - DNA, 103 bp, Artificial Sequence
  Synthetic Polynucleotide
taatacgactcactatagggttttttgtgatagggtcatgttcgtaggtgaacagaggagacacctaatgacatgacccaacctggcggcagcgcaaaagatg

SEQ ID NO: 210619 - DNA, 103 bp, Artificial Sequence
  Synthetic Polynucleotide
taatacgactcactatagggcacttgtttgttttttgtgatagggtcatgaacagaggagacatgacatgatcacaaaaaacctggcggcagcgcaaaagatg

SEQ ID NO: 210620 - DNA, 103 bp, Artificial Sequence
  Synthetic Polynucleotide
taatacgactcactatagggggtcccataacacttgtttgttttttgtgaaacagaggagatcacaaatgacaaacaagaacctggcggcagcgcaaaagatg

SEQ ID NO: 210621 - DNA, 103 bp, Artificial Sequence
  Synthetic Polynucleotide
taatacgactcactatagggcactgtgccaggtactgtctgatttccatgaacagaggagacatggaatgcagacagtaaacctggcggcagcgcaaaagatg

SEQ ID NO: 210622 - DNA, 103 bp, Artificial Sequence
  Synthetic Polynucleotide
taatacgactcactatagggctgaaggtgcggtcccataacacttgtttgaacagaggagacaaacaatggttatgggaaacctggcggcagcgcaaaagatg

SEQ ID NO: 210623 - DNA, 103 bp, Artificial Sequence
  Synthetic Polynucleotide
taatacgactcactatagggctggaaaagactgaaggtgcggtcccataaaacagaggagattatggatgcgcaccttcaacctggcggcagcgcaaaagatg

SEQ ID NO: 210624 - DNA, 103 bp, Artificial Sequence
  Synthetic Polynucleotide
taatacgactcactataggggaatgagctgctggaaaagactgaaggtgcaacagaggagagcacctatggtcttttccaacctggcggcagcgcaaaagatg

SEQ ID NO: 210625 - DNA, 103 bp, Artificial Sequence
  Synthetic Polynucleotide
taatacgactcactatagggaacgagctctgaatgagctgctggaaaagaaacagaggagatcttttatggcagctcataacctggcggcagcgcaaaagatg

SEQ ID NO: 210626 - DNA, 103 bp, Artificial Sequence
  Synthetic Polynucleotide
taatacgactcactatagggttccaccacaaacgagctctgaatgagctgaacagaggagacagctcatgcagagctcgaacctggcggcagcgcaaaagatg

SEQ ID NO: 210627 - DNA, 103 bp, Artificial Sequence
  Synthetic Polynucleotide
taatacgactcactatagggagggctgtctttccaccacaaacgagctctaacagaggagaagagctatgttgtggtggaacctggcggcagcgcaaaagatg

SEQ ID NO: 210628 - DNA, 103 bp, Artificial Sequence
  Synthetic Polynucleotide
taatacgactcactataggggttggcatgcagggctgtctttccaccacaaacagaggagatgtggtatgaagacagccaacctggcggcagcgcaaaagatg

SEQ ID NO: 210629 - DNA, 103 bp, Artificial Sequence
  Synthetic Polynucleotide
taatacgactcactatagggctgagggtgcgttggcatgcagggctgtctaacagaggagaagacagatgtgcatgccaaacctggcggcagcgcaaaagatg

SEQ ID NO: 210630 - DNA, 103 bp, Artificial Sequence
  Synthetic Polynucleotide
taatacgactcactatagggccagcggcctctgagggtgcgttggcatgcaacagaggagagcatgcatgcgcaccctcaacctggcggcagcgcaaaagatg

SEQ ID NO: 210631 - DNA, 103 bp, Artificial Sequence
  Synthetic Polynucleotide
taatacgactcactataggggtcttcaagaccagcggcctctgagggtgcaacagaggagagcacccatggaggccgctaacctggcggcagcgcaaaagatg

SEQ ID NO: 210632 - DNA, 103 bp, Artificial Sequence
  Synthetic Polynucleotide
taatacgactcactatagggaagctgctgtagctgattccattgggccataacagaggagaatggccatgtggaatcagaacctggcggcagcgcaaaagatg

SEQ ID NO: 210633 - DNA, 103 bp, Artificial Sequence
  Synthetic Polynucleotide
taatacgactcactatagggactctcaatccaaggggccagaaactgccgaacagaggagacggcagatgctggcccctaacctggcggcagcgcaaaagatg

SEQ ID NO: 210634 - DNA, 103 bp, Artificial Sequence
  Synthetic Polynucleotide
taatacgactcactatagggcttgatgacgaggggccggtcaggatgcataacagaggagaatgcatatggaccggcccaacctggcggcagcgcaaaagatg

SEQ ID NO: 210635 - DNA, 103 bp, Artificial Sequence
  Synthetic Polynucleotide
taatacgactcactatagggggacgccggtcttgatgacgaggggccggtaacagaggagaaccggcatgtcgtcatcaaacctggcggcagcgcaaaagatg

SEQ ID NO: 210636 - DNA, 103 bp, Artificial Sequence
  Synthetic Polynucleotide
taatacgactcactataggggtagtgaactggacgccggtcttgatgacgaacagaggagacgtcatatggaccggcgtaacctggcggcagcgcaaaagatg

SEQ ID NO: 210637 - DNA, 103 bp, Artificial Sequence
  Synthetic Polynucleotide
taatacgactcactatagggcctgactttagtagtgaactggacgccggtaacagaggagaaccggcatgcagttcactaacctggcggcagcgcaaaagatg

SEQ ID NO: 210638 - DNA, 103 bp, Artificial Sequence
  Synthetic Polynucleotide
taatacgactcactatagggtgaccagcaacctgactttagtagtgaactaacagaggagaagttcaatgctaaagtcaaacctggcggcagcgcaaaagatg

SEQ ID NO: 210639 - DNA, 103 bp, Artificial Sequence
  Synthetic Polynucleotide
taatacgactcactatagggtcagggaatttgaccagcaacctgactttaaacagaggagataaagtatggttgctggtaacctggcggcagcgcaaaagatg

SEQ ID NO: 210640 - DNA, 103 bp, Artificial Sequence
  Synthetic Polynucleotide
taatacgactcactatagggataattcaactcagggaatttgaccagcaaaacagaggagattgctgatgaaattccctaacctggcggcagcgcaaaagatg

SEQ ID NO: 210641 - DNA, 103 bp, Artificial Sequence
  Synthetic Polynucleotide
taatacgactcactatagggttttaagctgataattcaactcagggaattaacagaggagaaattccatgagttgaattaacctggcggcagcgcaaaagatg

SEQ ID NO: 210642 - DNA, 103 bp, Artificial Sequence
  Synthetic Polynucleotide
taatacgactcactatagggcacactttaattttaagctgataattcaacaacagaggagagttgaaatgtcagcttaaaacctggcggcagcgcaaaagatg

SEQ ID NO: 210643 - DNA, 103 bp, Artificial Sequence
  Synthetic Polynucleotide
taatacgactcactatagggtttgtcaatgcacactttaattttaagctgaacagaggagacagcttatgattaaagtgaacctggcggcagcgcaaaagatg

SEQ ID NO: 210644 - DNA, 103 bp, Artificial Sequence
  Synthetic Polynucleotide
taatacgactcactatagggcccaatcttgactctcaatccaaggggccaaacagaggagatggcccatgggattgagaaacctggcggcagcgcaaaagatg

SEQ ID NO: 210645 - DNA, 103 bp, Artificial Sequence
  Synthetic Polynucleotide
taatacgactcactatagggccccagagtctttgtcaatgcacactttaaaacagaggagattaaagatggcattgacaaacctggcggcagcgcaaaagatg

SEQ ID NO: 210646 - DNA, 103 bp, Artificial Sequence
  Synthetic Polynucleotide
taatacgactcactataggggctgcaacgtccccagagtctttgtcaatgaacagaggagacattgaatgagactctggaacctggcggcagcgcaaaagatg

SEQ ID NO: 210647 - DNA, 103 bp, Artificial Sequence
  Synthetic Polynucleotide
taatacgactcactatagggtcctctgagagctgcaacgtccccagagtcaacagaggagagactctatggacgttgcaaacctggcggcagcgcaaaagatg

SEQ ID NO: 210648 - DNA, 103 bp, Artificial Sequence
  Synthetic Polynucleotide
taatacgactcactatagggatttccgggatcctctgagagctgcaacgtaacagaggagaacgttgatgctctcagagaacctggcggcagcgcaaaagatg

SEQ ID NO: 210649 - DNA, 103 bp, Artificial Sequence
  Synthetic Polynucleotide
taatacgactcactatagggagaatgttaaatttccgggatcctctgagaaacagaggagatctcagatgatcccggaaaacctggcggcagcgcaaaagatg

SEQ ID NO: 210650 - DNA, 103 bp, Artificial Sequence
  Synthetic Polynucleotide
taatacgactcactataggggtttgtgcccagaatgttaaatttccgggaaacagaggagatcccggatgtttaacattaacctggcggcagcgcaaaagatg

SEQ ID NO: 210651 - DNA, 103 bp, Artificial Sequence
  Synthetic Polynucleotide
taatacgactcactatagggtcacttttgtgtttgtgcccagaatgttaaaacagaggagattaacaatgtgggcacaaaacctggcggcagcgcaaaagatg

SEQ ID NO: 210652 - DNA, 103 bp, Artificial Sequence
  Synthetic Polynucleotide
taatacgactcactatagggtccatgttcatcacttttgtgtttgtgcccaacagaggagagggcacatgcacaaaagtaacctggcggcagcgcaaaagatg

SEQ ID NO: 210653 - DNA, 103 bp, Artificial Sequence
  Synthetic Polynucleotide
taatacgactcactataggggttggattcttccatgttcatcacttttgtaacagaggagaacaaaaatgatgaacatgaacctggcggcagcgcaaaagatg

SEQ ID NO: 210654 - DNA, 103 bp, Artificial Sequence
  Synthetic Polynucleotide
taatacgactcactatagggggctgccgttgttggattcttccatgttcaaacagaggagatgaacaatgaagaatccaaacctggcggcagcgcaaaagatg

SEQ ID NO: 210655 - DNA, 103 bp, Artificial Sequence
  Synthetic Polynucleotide
taatacgactcactataggggccgcatatgcccaatcttgactctcaatcaacagaggagagattgaatgtcaagattgaacctggcggcagcgcaaaagatg

SEQ ID NO: 210656 - DNA, 103 bp, Artificial Sequence
  Synthetic Polynucleotide
taatacgactcactatagggtctgcagagaggctgccgttgttggattctaacagaggagaagaatcatgcaacggcagaacctggcggcagcgcaaaagatg

SEQ ID NO: 210657 - DNA, 103 bp, Artificial Sequence
  Synthetic Polynucleotide
taatacgactcactataggggtgtttgaattctgcagagaggctgccgttaacagaggagaaacggcatgctctctgcaaacctggcggcagcgcaaaagatg

SEQ ID NO: 210658 - DNA, 103 bp, Artificial Sequence
  Synthetic Polynucleotide
taatacgactcactatagggtcagggtcaagtgtttgaattctgcagagaaacagaggagatctctgatgaattcaaacaacctggcggcagcgcaaaagatg

SEQ ID NO: 210659 - DNA, 103 bp, Artificial Sequence
  Synthetic Polynucleotide
taatacgactcactatagggctctgctccctcagggtcaagtgtttgaataacagaggagaattcaaatgcttgaccctaacctggcggcagcgcaaaagatg

SEQ ID NO: 210660 - DNA, 103 bp, Artificial Sequence
  Synthetic Polynucleotide
taatacgactcactatagggattcccacatctctgctccctcagggtcaaaacagaggagattgaccatgagggagcagaacctggcggcagcgcaaaagatg

SEQ ID NO: 210661 - DNA, 103 bp, Artificial Sequence
  Synthetic Polynucleotide
taatacgactcactatagggctcggcccccattcccacatctctgctcccaacagaggagagggagcatggatgtgggaaacctggcggcagcgcaaaagatg

SEQ ID NO: 210662 - DNA, 103 bp, Artificial Sequence
  Synthetic Polynucleotide
taatacgactcactatagggtcacaattggctcggcccccattcccacataacagaggagaatgtggatgtgggggccgaacctggcggcagcgcaaaagatg

SEQ ID NO: 210663 - DNA, 103 bp, Artificial Sequence
  Synthetic Polynucleotide
taatacgactcactatagggcagggaagcatcacaattggctcggcccccaacagaggagagggggcatggccaattgtaacctggcggcagcgcaaaagatg

SEQ ID NO: 210664 - DNA, 103 bp, Artificial Sequence
  Synthetic Polynucleotide
taatacgactcactatagggcagtcacaatcagggaagcatcacaattggaacagaggagaccaattatgatgcttcccaacctggcggcagcgcaaaagatg

SEQ ID NO: 210665 - DNA, 103 bp, Artificial Sequence
  Synthetic Polynucleotide
taatacgactcactatagggtgcagctcctcagtcacaatcagggaagcaaacagaggagatgcttcatggattgtgacaacctggcggcagcgcaaaagatg

SEQ ID NO: 210666 - DNA, 103 bp, Artificial Sequence
  Synthetic Polynucleotide
taatacgactcactatagggttctttgctggccgcatatgcccaatcttgaacagaggagacaagatatggcatatgcgaacctggcggcagcgcaaaagatg

SEQ ID NO: 210667 - DNA, 103 bp, Artificial Sequence
  Synthetic Polynucleotide
taatacgactcactatagggggtgatcaggtgcagctcctcagtcacaataacagaggagaattgtgatggaggagctgaacctggcggcagcgcaaaagatg

SEQ ID NO: 210668 - DNA, 103 bp, Artificial Sequence
  Synthetic Polynucleotide
taatacgactcactatagggcggtctcaaaggtgatcaggtgcagctcctaacagaggagaaggagcatgacctgatcaaacctggcggcagcgcaaaagatg

SEQ ID NO: 210669 - DNA, 103 bp, Artificial Sequence
  Synthetic Polynucleotide
taatacgactcactatagggtgatacacctcggtctcaaaggtgatcaggaacagaggagacctgatatgctttgagacaacctggcggcagcgcaaaagatg

SEQ ID NO: 210670 - DNA, 103 bp, Artificial Sequence
  Synthetic Polynucleotide
taatacgactcactataggggaggccttggtgatacacctcggtctcaaaaacagaggagatttgagatggaggtgtataacctggcggcagcgcaaaagatg

SEQ ID NO: 210671 - DNA, 103 bp, Artificial Sequence
  Synthetic Polynucleotide
taatacgactcactatagggggtcaatcttgaggccttggtgatacacctaacagaggagaaggtgtatgaccaaggccaacctggcggcagcgcaaaagatg

SEQ ID NO: 210672 - DNA, 103 bp, Artificial Sequence
  Synthetic Polynucleotide
taatacgactcactatagggtgggtctctaggtcaatcttgaggccttggaacagaggagaccaaggatgcaagattgaaacctggcggcagcgcaaaagatg

SEQ ID NO: 210673 - DNA, 103 bp, Artificial Sequence
  Synthetic Polynucleotide
taatacgactcactatagggtggcaaggagtgggtctctaggtcaatcttaacagaggagaaagattatgctagagaccaacctggcggcagcgcaaaagatg

SEQ ID NO: 210674 - DNA, 103 bp, Artificial Sequence
  Synthetic Polynucleotide
taatacgactcactatagggtcaccacaactggcaaggagtgggtctctaaacagaggagatagagaatgactccttgcaacctggcggcagcgcaaaagatg

SEQ ID NO: 210675 - DNA, 103 bp, Artificial Sequence
  Synthetic Polynucleotide
taatacgactcactatagggatgttggagatcaccacaactggcaaggagaacagaggagactccttatgagttgtggtaacctggcggcagcgcaaaagatg

SEQ ID NO: 210676 - DNA, 103 bp, Artificial Sequence
  Synthetic Polynucleotide
taatacgactcactatagggcatctgacagatgttggagatcaccacaacaacagaggagagttgtgatgatctccaacaacctggcggcagcgcaaaagatg

SEQ ID NO: 210677 - DNA, 103 bp, Artificial Sequence
  Synthetic Polynucleotide
taatacgactcactatagggtggcatgtgattctttgctggccgcatatgaacagaggagacatatgatgccagcaaagaacctggcggcagcgcaaaagatg

SEQ ID NO: 210678 - DNA, 103 bp, Artificial Sequence
  Synthetic Polynucleotide
taatacgactcactatagggaggcatttggcatctgacagatgttggagaaacagaggagatctccaatgtctgtcagaaacctggcggcagcgcaaaagatg

SEQ ID NO: 210679 - DNA, 103 bp, Artificial Sequence
  Synthetic Polynucleotide
taatacgactcactatagggatggacgcccaggcatttggcatctgacagaacagaggagactgtcaatggccaaatgcaacctggcggcagcgcaaaagatg

SEQ ID NO: 210680 - DNA, 103 bp, Artificial Sequence
  Synthetic Polynucleotide
taatacgactcactataggggtaccacaggatggacgcccaggcatttggaacagaggagaccaaatatgtgggcgtccaacctggcggcagcgcaaaagatg

SEQ ID NO: 210681 - DNA, 103 bp, Artificial Sequence
  Synthetic Polynucleotide
taatacgactcactatagggtcagcatgttgtaccacaggatggacgcccaacagaggagagggcgtatgtcctgtggtaacctggcggcagcgcaaaagatg

SEQ ID NO: 210682 - DNA, 103 bp, Artificial Sequence
  Synthetic Polynucleotide
taatacgactcactatagggggattgttggtcagcatgttgtaccacaggaacagaggagacctgtgatgcaacatgctaacctggcggcagcgcaaaagatg

SEQ ID NO: 210683 - DNA, 103 bp, Artificial Sequence
  Synthetic Polynucleotide
taatacgactcactatagggtacattcttgggattgttggtcagcatgttaacagaggagaaacatgatgaccaacaataacctggcggcagcgcaaaagatg

SEQ ID NO: 210684 - DNA, 103 bp, Artificial Sequence
  Synthetic Polynucleotide
taatacgactcactatagggtaaaaaagtttacattcttgggattgttggaacagaggagaccaacaatgccaagaatgaacctggcggcagcgcaaaagatg

SEQ ID NO: 210685 - DNA, 103 bp, Artificial Sequence
  Synthetic Polynucleotide
taatacgactcactataggggggggcttggtaaaaaagtttacattcttgaacagaggagacaagaaatgaaactttttaacctggcggcagcgcaaaagatg

SEQ ID NO: 210686 - DNA, 103 bp, Artificial Sequence
  Synthetic Polynucleotide
taatacgactcactatagggggttccaattgggggcttggtaaaaaagttaacagaggagaaactttatgaccaagcccaacctggcggcagcgcaaaagatg

SEQ ID NO: 210687 - DNA, 103 bp, Artificial Sequence
  Synthetic Polynucleotide
taatacgactcactatagggcttgatcccaggttccaattgggggcttggaacagaggagaccaagcatgcaattggaaaacctggcggcagcgcaaaagatg

SEQ ID NO: 210688 - DNA, 103 bp, Artificial Sequence
  Synthetic Polynucleotide
taatacgactcactatagggaacaccaaagtggcatgtgattctttgctgaacagaggagacagcaaatgatcacatgcaacctggcggcagcgcaaaagatg

SEQ ID NO: 210689 - DNA, 103 bp, Artificial Sequence
  Synthetic Polynucleotide
taatacgactcactatagggacctcggccacttgatcccaggttccaattaacagaggagaaattggatgctgggatcaaacctggcggcagcgcaaaagatg

SEQ ID NO: 210690 - DNA, 103 bp, Artificial Sequence
  Synthetic Polynucleotide
taatacgactcactatagggccagctcaggacctcggccacttgatcccaaacagaggagatgggatatggtggccgagaacctggcggcagcgcaaaagatg

SEQ ID NO: 210691 - DNA, 103 bp, Artificial Sequence
  Synthetic Polynucleotide
taatacgactcactatagggaggagaactgccagctcaggacctcggccaaacagaggagatggccgatgtcctgagctaacctggcggcagcgcaaaagatg

SEQ ID NO: 210692 - DNA, 103 bp, Artificial Sequence
  Synthetic Polynucleotide
taatacgactcactatagggttggtggtggaggagaactgccagctcaggaacagaggagacctgagatggcagttctcaacctggcggcagcgcaaaagatg

SEQ ID NO: 210693 - DNA, 103 bp, Artificial Sequence
  Synthetic Polynucleotide
taatacgactcactatagggcagtcctcgcttggtggtggaggagaactgaacagaggagacagttcatgtccaccaccaacctggcggcagcgcaaaagatg

SEQ ID NO: 210694 - DNA, 103 bp, Artificial Sequence
  Synthetic Polynucleotide
taatacgactcactataggggctcgatgctcagtcctcgcttggtggtggaacagaggagaccaccaatgagcgaggacaacctggcggcagcgcaaaagatg

SEQ ID NO: 210695 - DNA, 103 bp, Artificial Sequence
  Synthetic Polynucleotide
taatacgactcactataggggtagtcagctgctcgatgctcagtcctcgcaacagaggagagcgaggatggagcatcgaaacctggcggcagcgcaaaagatg

SEQ ID NO: 210696 - DNA, 103 bp, Artificial Sequence
  Synthetic Polynucleotide
taatacgactcactatagggctctgccagtgtagtcagctgctcgatgctaacagaggagaagcatcatgcagctgactaacctggcggcagcgcaaaagatg

SEQ ID NO: 210697 - DNA, 103 bp, Artificial Sequence
  Synthetic Polynucleotide
taatacgactcactatagggccaagagtttctctgccagtgtagtcagctaacagaggagaagctgaatgcactggcagaacctggcggcagcgcaaaagatg

SEQ ID NO: 210698 - DNA, 103 bp, Artificial Sequence
  Synthetic Polynucleotide
taatacgactcactatagggacaccaggtcccaagagtttctctgccagtaacagaggagaactggcatggaaactcttaacctggcggcagcgcaaaagatg

SEQ ID NO: 210699 - DNA, 103 bp, Artificial Sequence
  Synthetic Polynucleotide
taatacgactcactataggggagattatgaaacaccaaagtggcatgtgaaacagaggagatcacatatgactttggtgaacctggcggcagcgcaaaagatg

SEQ ID NO: 210700 - DNA, 103 bp, Artificial Sequence
  Synthetic Polynucleotide
taatacgactcactatagggtgaataattcacaccaggtcccaagagtttaacagaggagaaaactcatgggacctggtaacctggcggcagcgcaaaagatg

SEQ ID NO: 210701 - DNA, 103 bp, Artificial Sequence
  Synthetic Polynucleotide
taatacgactcactatagggtctgacaccctgaataattcacaccaggtcaacagaggagagacctgatgtgaattattaacctggcggcagcgcaaaagatg

SEQ ID NO: 210702 - DNA, 103 bp, Artificial Sequence
  Synthetic Polynucleotide
taatacgactcactataggggcccatgtgatctgacaccctgaataattcaacagaggagagaattaatgagggtgtcaaacctggcggcagcgcaaaagatg

SEQ ID NO: 210703 - DNA, 103 bp, Artificial Sequence
  Synthetic Polynucleotide
taatacgactcactataggggcaaaatttagcccatgtgatctgacacccaacagaggagagggtgtatgatcacatggaacctggcggcagcgcaaaagatg

SEQ ID NO: 210704 - DNA, 103 bp, Artificial Sequence
  Synthetic Polynucleotide
taatacgactcactatagggtgttttctttgcaaaatttagcccatgtgaaacagaggagatcacatatgctaaattttaacctggcggcagcgcaaaagatg

SEQ ID NO: 210705 - DNA, 103 bp, Artificial Sequence
  Synthetic Polynucleotide
taatacgactcactatagggttgccagccatgttttctttgcaaaatttaaacagaggagataaattatgcaaagaaaaaacctggcggcagcgcaaaagatg

SEQ ID NO: 210706 - DNA, 103 bp, Artificial Sequence
  Synthetic Polynucleotide
taatacgactcactatagggggagaagcccttgccagccatgttttctttaacagaggagaaaagaaatgatggctggcaacctggcggcagcgcaaaagatg

SEQ ID NO: 210707 - DNA, 103 bp, Artificial Sequence
  Synthetic Polynucleotide
taatacgactcactatagggagacccagaaggagaagcccttgccagccaaacagaggagatggctgatgagggcttctaacctggcggcagcgcaaaagatg

SEQ ID NO: 210708 - DNA, 103 bp, Artificial Sequence
  Synthetic Polynucleotide
taatacgactcactatagggttgtccagccagacccagaaggagaagcccaacagaggagagggcttatgcttctgggtaacctggcggcagcgcaaaagatg

SEQ ID NO: 210709 - DNA, 103 bp, Artificial Sequence
  Synthetic Polynucleotide
taatacgactcactataggggtcaatgatattgtccagccagacccagaaaacagaggagattctggatgtggctggacaacctggcggcagcgcaaaagatg

SEQ ID NO: 210710 - DNA, 103 bp, Artificial Sequence
  Synthetic Polynucleotide
taatacgactcactatagggtctctcccaggagattatgaaacaccaaagaacagaggagactttggatgttcataatcaacctggcggcagcgcaaaagatg

SEQ ID NO: 210711 - DNA, 103 bp, Artificial Sequence
  Synthetic Polynucleotide
taatacgactcactatagggttttcacaaggtcaatgatattgtccagccaacagaggagaggctggatgatatcattgaacctggcggcagcgcaaaagatg

SEQ ID NO: 210712 - DNA, 103 bp, Artificial Sequence
  Synthetic Polynucleotide
taatacgactcactatagggaggatgtactttttcacaaggtcaatgataaacagaggagatatcatatgccttgtgaaaacctggcggcagcgcaaaagatg

SEQ ID NO: 210713 - DNA, 103 bp, Artificial Sequence
  Synthetic Polynucleotide
taatacgactcactatagggccaaagggccaggatgtactttttcacaagaacagaggagacttgtgatgaagtacatcaacctggcggcagcgcaaaagatg

SEQ ID NO: 210714 - DNA, 103 bp, Artificial Sequence
  Synthetic Polynucleotide
taatacgactcactatagggacccttcgttccaaagggccaggatgtactaacagaggagaagtacaatgtggccctttaacctggcggcagcgcaaaagatg

SEQ ID NO: 210715 - DNA, 103 bp, Artificial Sequence
  Synthetic Polynucleotide
taatacgactcactatagggcccatgatgtacccttcgttccaaagggccaacagaggagaggccctatggaacgaaggaacctggcggcagcgcaaaagatg

SEQ ID NO: 210716 - DNA, 103 bp, Artificial Sequence
  Synthetic Polynucleotide
taatacgactcactatagggactgataaagcccatgatgtacccttcgttaacagaggagaaacgaaatgtacatcatgaacctggcggcagcgcaaaagatg

SEQ ID NO: 210717 - DNA, 103 bp, Artificial Sequence
  Synthetic Polynucleotide
taatacgactcactatagggcccgctccttactgataaagcccatgatgtaacagaggagaacatcaatggctttatcaaacctggcggcagcgcaaaagatg

SEQ ID NO: 210718 - DNA, 103 bp, Artificial Sequence
  Synthetic Polynucleotide
taatacgactcactatagggatggcccgctcccgctccttactgataaagaacagaggagactttatatgtaaggagcgaacctggcggcagcgcaaaagatg

SEQ ID NO: 210719 - DNA, 103 bp, Artificial Sequence
  Synthetic Polynucleotide
taatacgactcactatagggagtgctcaagatggcccgctcccgctccttaacagaggagaaaggagatggagcgggccaacctggcggcagcgcaaaagatg

SEQ ID NO: 210720 - DNA, 103 bp, Artificial Sequence
  Synthetic Polynucleotide
taatacgactcactatagggctggaggcttagtgctcaagatggcccgctaacagaggagaagcgggatgtcttgagcaaacctggcggcagcgcaaaagatg

SEQ ID NO: 210721 - DNA, 103 bp, Artificial Sequence
  Synthetic Polynucleotide
taatacgactcactatagggtgctggtcaatctctcccaggagattatgaaacagaggagatcataaatgcctgggagaaacctggcggcagcgcaaaagatg

SEQ ID NO: 210722 - DNA, 103 bp, Artificial Sequence
  Synthetic Polynucleotide
taatacgactcactatagggaggaaggtgcctggaggcttagtgctcaagaacagaggagacttgagatgtaagcctccaacctggcggcagcgcaaaagatg

SEQ ID NO: 210723 - DNA, 103 bp, Artificial Sequence
  Synthetic Polynucleotide
taatacgactcactataggggaatcttagcaggaaggtgcctggaggcttaacagaggagaaagcctatgggcaccttcaacctggcggcagcgcaaaagatg

SEQ ID NO: 210724 - DNA, 103 bp, Artificial Sequence
  Synthetic Polynucleotide
taatacgactcactatagggtgctttcactgaatcttagcaggaaggtgcaacagaggagagcacctatgtgctaagataacctggcggcagcgcaaaagatg

SEQ ID NO: 210725 - DNA, 103 bp, Artificial Sequence
  Synthetic Polynucleotide
taatacgactcactatagggccttctttgctgctttcactgaatcttagcaacagaggagagctaagatgcagtgaaagaacctggcggcagcgcaaaagatg

SEQ ID NO: 210726 - DNA, 103 bp, Artificial Sequence
  Synthetic Polynucleotide
taatacgactcactatagggagtgacgcctccttctttgctgctttcactaacagaggagaagtgaaatgagcaaagaaaacctggcggcagcgcaaaagatg

SEQ ID NO: 210727 - DNA, 103 bp, Artificial Sequence
  Synthetic Polynucleotide
taatacgactcactatagggcccaagtgaaagtgacgcctccttctttgcaacagaggagagcaaagatggaggcgtcaaacctggcggcagcgcaaaagatg

SEQ ID NO: 210728 - DNA, 103 bp, Artificial Sequence
  Synthetic Polynucleotide
taatacgactcactatagggtccttctccacccaagtgaaagtgacgcctaacagaggagaaggcgtatgtttcacttgaacctggcggcagcgcaaaagatg

SEQ ID NO: 210729 - DNA, 103 bp, Artificial Sequence
  Synthetic Polynucleotide
taatacgactcactatagggaccgctgatgtccttctccacccaagtgaaaacagaggagattcactatggtggagaagaacctggcggcagcgcaaaagatg

SEQ ID NO: 210730 - DNA, 103 bp, Artificial Sequence
  Synthetic Polynucleotide
taatacgactcactatagggtctgggtcttaccgctgatgtccttctccaaacagaggagatggagaatgacatcagcgaacctggcggcagcgcaaaagatg

SEQ ID NO: 210731 - DNA, 103 bp, Artificial Sequence
  Synthetic Polynucleotide
taatacgactcactatagggacggactggatctgggtcttaccgctgatgaacagaggagacatcagatgtaagacccaaacctggcggcagcgcaaaagatg

SEQ ID NO: 210732 - DNA, 103 bp, Artificial Sequence
  Synthetic Polynucleotide
taatacgactcactataggggcggctatactgctggtcaatctctcccagaacagaggagactgggaatgattgaccagaacctggcggcagcgcaaaagatg

SEQ ID NO: 210733 - DNA, 103 bp, Artificial Sequence
  Synthetic Polynucleotide
taatacgactcactataggggtatggttccacggactggatctgggtcttaacagaggagaaagaccatgatccagtccaacctggcggcagcgcaaaagatg

SEQ ID NO: 210734 - DNA, 103 bp, Artificial Sequence
  Synthetic Polynucleotide
taatacgactcactataggggctgctttgtgtatggttccacggactggaaacagaggagatccagtatgtggaaccataacctggcggcagcgcaaaagatg

SEQ ID NO: 210735 - DNA, 103 bp, Artificial Sequence
  Synthetic Polynucleotide
taatacgactcactatagggttgttcagctgctgctttgtgtatggttccaacagaggagaggaaccatgcacaaagcaaacctggcggcagcgcaaaagatg

SEQ ID NO: 210736 - DNA, 103 bp, Artificial Sequence
  Synthetic Polynucleotide
taatacgactcactatagggaaatgacatgttgttcagctgctgctttgtaacagaggagaacaaagatgcagctgaacaacctggcggcagcgcaaaagatg

SEQ ID NO: 210737 - DNA, 103 bp, Artificial Sequence
  Synthetic Polynucleotide
taatacgactcactatagggtgatttcagcaaatgacatgttgttcagctaacagaggagaagctgaatgacatgtcataacctggcggcagcgcaaaagatg

SEQ ID NO: 210738 - DNA, 103 bp, Artificial Sequence
  Synthetic Polynucleotide
taatacgactcactatagggtagcccatgatgatttcagcaaatgacatgaacagaggagacatgtcatgtgctgaaataacctggcggcagcgcaaaagatg

SEQ ID NO: 210739 - DNA, 103 bp, Artificial Sequence
  Synthetic Polynucleotide
taatacgactcactatagggcatgatcttatagcccatgatgatttcagcaacagaggagagctgaaatgatcatgggcaacctggcggcagcgcaaaagatg

SEQ ID NO: 210740 - DNA, 103 bp, Artificial Sequence
  Synthetic Polynucleotide
taatacgactcactatagggtggtagcatccatgatcttatagcccatgaaacagaggagatcatggatgataagatcaaacctggcggcagcgcaaaagatg

SEQ ID NO: 210741 - DNA, 103 bp, Artificial Sequence
  Synthetic Polynucleotide
taatacgactcactatagggaccaggatattggtagcatccatgatcttaaacagaggagataagatatgggatgctacaacctggcggcagcgcaaaagatg

SEQ ID NO: 210742 - DNA, 103 bp, Artificial Sequence
  Synthetic Polynucleotide
taatacgactcactatagggcagtggagacaccaggatattggtagcatcaacagaggagagatgctatgaatatcctgaacctggcggcagcgcaaaagatg

SEQ ID NO: 210743 - DNA, 103 bp, Artificial Sequence
  Synthetic Polynucleotide
taatacgactcactatagggaccgtgtgtcaagctgctgtagctgattccaacagaggagaggaatcatgtacagcagcaacctggcggcagcgcaaaagatg

SEQ ID NO: 210744 - DNA, 103 bp, Artificial Sequence
  Synthetic Polynucleotide
taatacgactcactatagggcttgcaggaagcggctatactgctggtcaaaacagaggagattgaccatgagtatagccaacctggcggcagcgcaaaagatg

SEQ ID NO: 210745 - DNA, 103 bp, Artificial Sequence
  Synthetic Polynucleotide
taatacgactcactatagggagagatagaccagtggagacaccaggatataacagaggagaatatccatgtgtctccacaacctggcggcagcgcaaaagatg

SEQ ID NO: 210746 - DNA, 103 bp, Artificial Sequence
  Synthetic Polynucleotide
taatacgactcactatagggatgtcaggatagagatagaccagtggagacaacagaggagagtctccatgggtctatctaacctggcggcagcgcaaaagatg

SEQ ID NO: 210747 - DNA, 103 bp, Artificial Sequence
  Synthetic Polynucleotide
taatacgactcactatagggctccttgggaatgtcaggatagagatagacaacagaggagagtctatatgtatcctgacaacctggcggcagcgcaaaagatg

SEQ ID NO: 210748 - DNA, 103 bp, Artificial Sequence
  Synthetic Polynucleotide
taatacgactcactatagggcgaatgcctcctccttgggaatgtcaggataacagaggagaatcctgatgttcccaaggaacctggcggcagcgcaaaagatg

SEQ ID NO: 210749 - DNA, 103 bp, Artificial Sequence
  Synthetic Polynucleotide
taatacgactcactatagggcaatactttccgaatgcctcctccttgggaaacagaggagatcccaaatgggaggcattaacctggcggcagcgcaaaagatg

SEQ ID NO: 210750 - DNA, 103 bp, Artificial Sequence
  Synthetic Polynucleotide
taatacgactcactatagggctctggccgacaatactttccgaatgcctcaacagaggagagaggcaatgggaaagtataacctggcggcagcgcaaaagatg

SEQ ID NO: 210751 - DNA, 103 bp, Artificial Sequence
  Synthetic Polynucleotide
taatacgactcactataggggctcctggctctctggccgacaatactttcaacagaggagagaaagtatggtcggccagaacctggcggcagcgcaaaagatg

SEQ ID NO: 210752 - DNA, 103 bp, Artificial Sequence
  Synthetic Polynucleotide
taatacgactcactataggggcttcaggatgctcctggctctctggccgaaacagaggagatcggccatggagccaggaaacctggcggcagcgcaaaagatg

SEQ ID NO: 210753 - DNA, 103 bp, Artificial Sequence
  Synthetic Polynucleotide
taatacgactcactatagggacctgggtcagcttcaggatgctcctggctaacagaggagaagccagatgcatcctgaaaacctggcggcagcgcaaaagatg

SEQ ID NO: 210754 - DNA, 103 bp, Artificial Sequence
  Synthetic Polynucleotide
taatacgactcactataggggggcagcgctacctgggtcagcttcaggataacagaggagaatcctgatgctgacccagaacctggcggcagcgcaaaagatg

SEQ ID NO: 210755 - DNA, 103 bp, Artificial Sequence
  Synthetic Polynucleotide
taatacgactcactatagggacattcgactcttgcaggaagcggctatacaacagaggagagtatagatgcttcctgcaaacctggcggcagcgcaaaagatg

SEQ ID NO: 210756 - DNA, 103 bp, Artificial Sequence
  Synthetic Polynucleotide
taatacgactcactatagggttcaggtatggggcagcgctacctgggtcaaacagaggagatgacccatgtagcgctgcaacctggcggcagcgcaaaagatg

SEQ ID NO: 210757 - DNA, 103 bp, Artificial Sequence
  Synthetic Polynucleotide
taatacgactcactatagggaaacttggtcttcaggtatggggcagcgctaacagaggagaagcgctatgccatacctgaacctggcggcagcgcaaaagatg

SEQ ID NO: 210758 - DNA, 103 bp, Artificial Sequence
  Synthetic Polynucleotide
taatacgactcactatagggtcacacagataaacttggtcttcaggtatgaacagaggagacataccatgagaccaagtaacctggcggcagcgcaaaagatg

SEQ ID NO: 210759 - DNA, 103 bp, Artificial Sequence
  Synthetic Polynucleotide
taatacgactcactataggggtcgttggtgtcacacagataaacttggtcaacagaggagagaccaaatgtatctgtgtaacctggcggcagcgcaaaagatg

SEQ ID NO: 210760 - DNA, 103 bp, Artificial Sequence
  Synthetic Polynucleotide
taatacgactcactatagggattgctgcaggtcgttggtgtcacacagataacagaggagaatctgtatgacaccaacgaacctggcggcagcgcaaaagatg

SEQ ID NO: 210761 - DNA, 103 bp, Artificial Sequence
  Synthetic Polynucleotide
taatacgactcactatagggggtcaatggtattgctgcaggtcgttggtgaacagaggagacaccaaatgcctgcagcaaacctggcggcagcgcaaaagatg

SEQ ID NO: 210762 - DNA, 103 bp, Artificial Sequence
  Synthetic Polynucleotide
taatacgactcactataggggacatcggcaggtcaatggtattgctgcagaacagaggagactgcagatgtaccattgaaacctggcggcagcgcaaaagatg

SEQ ID NO: 210763 - DNA, 103 bp, Artificial Sequence
  Synthetic Polynucleotide
taatacgactcactatagggagtgcggggggacatcggcaggtcaatggtaacagaggagaaccattatgctgccgatgaacctggcggcagcgcaaaagatg

SEQ ID NO: 210764 - DNA, 103 bp, Artificial Sequence
  Synthetic Polynucleotide
taatacgactcactatagggatgaatctaaagtgcggggggacatcggcaaacagaggagatgccgaatgccccccgcaaacctggcggcagcgcaaaagatg

SEQ ID NO: 210765 - DNA, 103 bp, Artificial Sequence
  Synthetic Polynucleotide
taatacgactcactatagggaactgcatcaatgaatctaaagtgcgggggaacagaggagacccccgatgtttagattcaacctggcggcagcgcaaaagatg

SEQ ID NO: 210766 - DNA, 103 bp, Artificial Sequence
  Synthetic Polynucleotide
taatacgactcactatagggctgatagagaacattcgactcttgcaggaaaacagaggagattcctgatggagtcgaataacctggcggcagcgcaaaagatg

SEQ ID NO: 210767 - DNA, 103 bp, Artificial Sequence
  Synthetic Polynucleotide
taatacgactcactatagggattatttccaaactgcatcaatgaatctaaaacagaggagattagatatgttgatgcagaacctggcggcagcgcaaaagatg

SEQ ID NO: 210768 - DNA, 103 bp, Artificial Sequence
  Synthetic Polynucleotide
taatacgactcactatagggcaccttcaccattatttccaaactgcatcaaacagaggagatgatgcatgttggaaataaacctggcggcagcgcaaaagatg

SEQ ID NO: 210769 - DNA, 103 bp, Artificial Sequence
  Synthetic Polynucleotide
taatacgactcactataggggagggttcagcaccttcaccattatttccaaacagaggagatggaaaatgtggtgaaggaacctggcggcagcgcaaaagatg

SEQ ID NO: 210770 - DNA, 103 bp, Artificial Sequence
  Synthetic Polynucleotide
taatacgactcactatagggccctcctgctgagggttcagcaccttcaccaacagaggagaggtgaaatggctgaacccaacctggcggcagcgcaaaagatg

SEQ ID NO: 210771 - DNA, 103 bp, Artificial Sequence
  Synthetic Polynucleotide
taatacgactcactatagggactcaaactgccctcctgctgagggttcagaacagaggagactgaacatgcagcaggagaacctggcggcagcgcaaaagatg

SEQ ID NO: 210772 - DNA, 103 bp, Artificial Sequence
  Synthetic Polynucleotide
taatacgactcactatagggaaggtgagggactcaaactgccctcctgctaacagaggagaagcaggatggcagtttgaaacctggcggcagcgcaaaagatg

SEQ ID NO: 210773 - DNA, 103 bp, Artificial Sequence
  Synthetic Polynucleotide
taatacgactcactatagggctccatgtcaaaggtgagggactcaaactgaacagaggagacagtttatgtccctcaccaacctggcggcagcgcaaaagatg

SEQ ID NO: 210774 - DNA, 103 bp, Artificial Sequence
  Synthetic Polynucleotide
taatacgactcactatagggccgaggtcaactccatgtcaaaggtgagggaacagaggagaccctcaatgttgacatggaacctggcggcagcgcaaaagatg

SEQ ID NO: 210775 - DNA, 103 bp, Artificial Sequence
  Synthetic Polynucleotide
taatacgactcactataggggtagcgcactccgaggtcaactccatgtcaaacagaggagatgacatatggttgacctcaacctggcggcagcgcaaaagatg

SEQ ID NO: 210776 - DNA, 103 bp, Artificial Sequence
  Synthetic Polynucleotide
taatacgactcactatagggcatgggggaggtagcgcactccgaggtcaaaacagaggagattgaccatggagtgcgctaacctggcggcagcgcaaaagatg

SEQ ID NO: 210777 - DNA, 103 bp, Artificial Sequence
  Synthetic Polynucleotide
taatacgactcactataggggtagattgtgctgatagagaacattcgactaacagaggagaagtcgaatgttctctatcaacctggcggcagcgcaaaagatg

SEQ ID NO: 210778 - DNA, 103 bp, Artificial Sequence
  Synthetic Polynucleotide
taatacgactcactatagggttgattcttcgtagattgtgctgatagagaaacagaggagatctctaatggcacaatctaacctggcggcagcgcaaaagatg

SEQ ID NO: 210779 - DNA, 103 bp, Artificial Sequence
  Synthetic Polynucleotide
taatacgactcactatagggaagaaactgcttgattcttcgtagattgtgaacagaggagacacaatatgcgaagaatcaacctggcggcagcgcaaaagatg

SEQ ID NO: 210780 - DNA, 103 bp, Artificial Sequence
  Synthetic Polynucleotide
taatacgactcactatagggacctgctctgaagaaactgcttgattcttcaacagaggagagaagaaatgagcagtttcaacctggcggcagcgcaaaagatg

SEQ ID NO: 210781 - DNA, 103 bp, Artificial Sequence
  Synthetic Polynucleotide
taatacgactcactatagggttctcaagatacctgctctgaagaaactgcaacagaggagagcagttatgtcagagcagaacctggcggcagcgcaaaagatg

SEQ ID NO: 210782 - DNA, 103 bp, Artificial Sequence
  Synthetic Polynucleotide
taatacgactcactatagggctccattggcttctcaagatacctgctctgaacagaggagacagagcatgtatcttgagaacctggcggcagcgcaaaagatg

SEQ ID NO: 210783 - DNA, 103 bp, Artificial Sequence
  Synthetic Polynucleotide
taatacgactcactatagggtccgggcaatctccattggcttctcaagataacagaggagaatcttgatgagccaatggaacctggcggcagcgcaaaagatg

SEQ ID NO: 210784 - DNA, 103 bp, Artificial Sequence
  Synthetic Polynucleotide
taatacgactcactatagggtgctccaggtaccgtgtgtcaagctgctgtaacagaggagaacagcaatgtgacacacgaacctggcggcagcgcaaaagatg

SEQ ID NO: 210785 - DNA, 103 bp, Artificial Sequence
  Synthetic Polynucleotide
taatacgactcactatagggcgggccacaatccgggcaatctccattggcaacagaggagagccaatatggattgcccgaacctggcggcagcgcaaaagatg

SEQ ID NO: 210786 - DNA, 103 bp, Artificial Sequence
  Synthetic Polynucleotide
taatacgactcactatagggccacaggcaccgggccacaatccgggcaataacagaggagaattgccatgattgtggccaacctggcggcagcgcaaaagatg

SEQ ID NO: 210787 - DNA, 103 bp, Artificial Sequence
  Synthetic Polynucleotide
taatacgactcactataggggtgattcttcccacaggcaccgggccacaaaacagaggagattgtggatgggtgcctgtaacctggcggcagcgcaaaagatg

SEQ ID NO: 210788 - DNA, 103 bp, Artificial Sequence
  Synthetic Polynucleotide
taatacgactcactatagggtgtagaaggcgtgattcttcccacaggcacaacagaggagagtgcctatgggaagaatcaacctggcggcagcgcaaaagatg

SEQ ID NO: 210789 - DNA, 103 bp, Artificial Sequence
  Synthetic Polynucleotide
taatacgactcactatagggggctgcagtctgtagaaggcgtgattcttcaacagaggagagaagaaatgcgccttctaaacctggcggcagcgcaaaagatg

SEQ ID NO: 210790 - DNA, 103 bp, Artificial Sequence
  Synthetic Polynucleotide
taatacgactcactataggggggccgcagtggctgcagtctgtagaaggcaacagaggagagccttcatgagactgcagaacctggcggcagcgcaaaagatg

SEQ ID NO: 210791 - DNA, 103 bp, Artificial Sequence
  Synthetic Polynucleotide
taatacgactcactatagggcccccttgctgggccgcagtggctgcagtcaacagaggagagactgcatgcactgcggcaacctggcggcagcgcaaaagatg

SEQ ID NO: 210792 - DNA, 103 bp, Artificial Sequence
  Synthetic Polynucleotide
taatacgactcactataggggttggcctggcccccttgctgggccgcagtaacagaggagaactgcgatgcagcaagggaacctggcggcagcgcaaaagatg

SEQ ID NO: 210793 - DNA, 103 bp, Artificial Sequence
  Synthetic Polynucleotide
taatacgactcactatagggctgtggggtggttggcctggcccccttgctaacagaggagaagcaagatggccaggccaaacctggcggcagcgcaaaagatg

SEQ ID NO: 210794 - DNA, 103 bp, Artificial Sequence
  Synthetic Polynucleotide
taatacgactcactatagggaccacggctgctgtggggtggttggcctggaacagaggagaccaggcatgccaccccacaacctggcggcagcgcaaaagatg

SEQ ID NO: 210795 - DNA, 103 bp, Artificial Sequence
  Synthetic Polynucleotide
taatacgactcactatagggctgatggagctgctccaggtaccgtgtgtcaacagaggagagacacaatgtacctggagaacctggcggcagcgcaaaagatg

SEQ ID NO: 210796 - DNA, 103 bp, Artificial Sequence
  Synthetic Polynucleotide
taatacgactcactatagggcttctccgtcaccacggctgctgtggggtgaacagaggagacaccccatggcagccgtgaacctggcggcagcgcaaaagatg

SEQ ID NO: 210797 - DNA, 103 bp, Artificial Sequence
  Synthetic Polynucleotide
taatacgactcactataggggcatctgctgcttctccgtcaccacggctgaacagaggagacagccgatgtgacggagaaacctggcggcagcgcaaaagatg

SEQ ID NO: 210798 - DNA, 103 bp, Artificial Sequence
  Synthetic Polynucleotide
taatacgactcactatagggtgctgctccagcatctgctgcttctccgtcaacagaggagagacggaatggcagcagataacctggcggcagcgcaaaagatg

SEQ ID NO: 210799 - DNA, 103 bp, Artificial Sequence
  Synthetic Polynucleotide
taatacgactcactatagggatcctgaaggtgctgctccagcatctgctgaacagaggagacagcagatgctggagcagaacctggcggcagcgcaaaagatg

SEQ ID NO: 210800 - DNA, 103 bp, Artificial Sequence
  Synthetic Polynucleotide
taatacgactcactatagggtcttccggacatcctgaaggtgctgctccaaacagaggagatggagcatgaccttcaggaacctggcggcagcgcaaaagatg

SEQ ID NO: 210801 - DNA, 103 bp, Artificial Sequence
  Synthetic Polynucleotide
taatacgactcactatagggtcctgcactctcttccggacatcctgaaggaacagaggagaccttcaatgtgtccggaaaacctggcggcagcgcaaaagatg

SEQ ID NO: 210802 - DNA, 103 bp, Artificial Sequence
  Synthetic Polynucleotide
taatacgactcactatagggctgttctagatcctgcactctcttccggacaacagaggagagtccggatgagagtgcagaacctggcggcagcgcaaaagatg

SEQ ID NO: 210803 - DNA, 103 bp, Artificial Sequence
  Synthetic Polynucleotide
taatacgactcactatagggctttcattttctgttctagatcctgcactcaacagaggagagagtgcatgatctagaacaacctggcggcagcgcaaaagatg

SEQ ID NO: 210804 - DNA, 103 bp, Artificial Sequence
  Synthetic Polynucleotide
taatacgactcactatagggttctctaccactttcattttctgttctagaaacagaggagatctagaatggaaaatgaaaacctggcggcagcgcaaaagatg

SEQ ID NO: 210805 - DNA, 103 bp, Artificial Sequence
  Synthetic Polynucleotide
taatacgactcactatagggatcctggagattctctaccactttcattttaacagaggagaaaaatgatggtggtagagaacctggcggcagcgcaaaagatg

SEQ ID NO: 210806 - DNA, 103 bp, Artificial Sequence
  Synthetic Polynucleotide
taatacgactcactatagggcactgtagagctgatggagctgctccaggtaacagaggagaacctggatgagctccatcaacctggcggcagcgcaaaagatg

SEQ ID NO: 210807 - DNA, 103 bp, Artificial Sequence
  Synthetic Polynucleotide
taatacgactcactatagggaatcaaagtcatcctggagattctctaccaaacagaggagatggtagatgatctccaggaacctggcggcagcgcaaaagatg

SEQ ID NO: 210808 - DNA, 103 bp, Artificial Sequence
  Synthetic Polynucleotide
taatacgactcactatagggttatagttgaaatcaaagtcatcctggagaaacagaggagatctccaatgtgactttgaaacctggcggcagcgcaaaagatg

SEQ ID NO: 210809 - DNA, 103 bp, Artificial Sequence
  Synthetic Polynucleotide
taatacgactcactatagggcttgagggttttatagttgaaatcaaagtcaacagaggagagactttatgttcaactataacctggcggcagcgcaaaagatg

SEQ ID NO: 210810 - DNA, 103 bp, Artificial Sequence
  Synthetic Polynucleotide
taatacgactcactatagggctccttgactcttgagggttttatagttgaaacagaggagatcaactatgaaaccctcaaacctggcggcagcgcaaaagatg

SEQ ID NO: 210811 - DNA, 103 bp, Artificial Sequence
  Synthetic Polynucleotide
taatacgactcactatagggtcttgcatgtctccttgactcttgagggttaacagaggagaaaccctatggagtcaaggaacctggcggcagcgcaaaagatg

SEQ ID NO: 210812 - DNA, 103 bp, Artificial Sequence
  Synthetic Polynucleotide
taatacgactcactatagggtccattcagatcttgcatgtctccttgactaacagaggagaagtcaaatggacatgcaaaacctggcggcagcgcaaaagatg

SEQ ID NO: 210813 - DNA, 103 bp, Artificial Sequence
  Synthetic Polynucleotide
taatacgactcactatagggactggttgtttccattcagatcttgcatgtaacagaggagaacatgcatgatctgaatgaacctggcggcagcgcaaaagatg

SEQ ID NO: 210814 - DNA, 103 bp, Artificial Sequence
  Synthetic Polynucleotide
taatacgactcactatagggctggtcactgactggttgtttccattcagaaacagaggagatctgaaatgaaacaaccaaacctggcggcagcgcaaaagatg

SEQ ID NO: 210815 - DNA, 103 bp, Artificial Sequence
  Synthetic Polynucleotide
taatacgactcactatagggcatcttctgcctggtcactgactggttgttaacagaggagaaacaacatgtcagtgaccaacctggcggcagcgcaaaagatg

SEQ ID NO: 210816 - DNA, 103 bp, Artificial Sequence
  Synthetic Polynucleotide
taatacgactcactatagggccagctgctgcatcttctgcctggtcactgaacagaggagacagtgaatgggcagaagaaacctggcggcagcgcaaaagatg

SEQ ID NO: 210817 - DNA, 103 bp, Artificial Sequence
  Synthetic Polynucleotide
taatacgactcactataggggggaagctgtcactgtagagctgatggagcaacagaggagagctccaatggctctacagaacctggcggcagcgcaaaagatg

SEQ ID NO: 210818 - DNA, 103 bp, Artificial Sequence
  Synthetic Polynucleotide
taatacgactcactatagggagcatctgttccagctgctgcatcttctgcaacagaggagagcagaaatggcagcagctaacctggcggcagcgcaaaagatg

SEQ ID NO: 210819 - DNA, 103 bp, Artificial Sequence
  Synthetic Polynucleotide
taatacgactcactatagggcagcgcagtgagcatctgttccagctgctgaacagaggagacagcagatggaacagatgaacctggcggcagcgcaaaagatg

SEQ ID NO: 210820 - DNA, 103 bp, Artificial Sequence
  Synthetic Polynucleotide
taatacgactcactataggggcatctggtccagcgcagtgagcatctgttaacagaggagaaacagaatgtcactgcgcaacctggcggcagcgcaaaagatg

SEQ ID NO: 210821 - DNA, 103 bp, Artificial Sequence
  Synthetic Polynucleotide
taatacgactcactatagggatgcttctccgcatctggtccagcgcagtgaacagaggagacactgcatgggaccagataacctggcggcagcgcaaaagatg

SEQ ID NO: 210822 - DNA, 103 bp, Artificial Sequence
  Synthetic Polynucleotide
taatacgactcactatagggctcactcacgatgcttctccgcatctggtcaacagaggagagaccagatgcggagaagcaacctggcggcagcgcaaaagatg

SEQ ID NO: 210823 - DNA, 103 bp, Artificial Sequence
  Synthetic Polynucleotide
taatacgactcactataggggccccgccagctcactcacgatgcttctccaacagaggagaggagaaatgtcgtgagtgaacctggcggcagcgcaaaagatg

SEQ ID NO: 210824 - DNA, 103 bp, Artificial Sequence
  Synthetic Polynucleotide
taatacgactcactataggggctgacaaaagccccgccagctcactcacgaacagaggagacgtgagatggctggcgggaacctggcggcagcgcaaaagatg

SEQ ID NO: 210825 - DNA, 103 bp, Artificial Sequence
  Synthetic Polynucleotide
taatacgactcactataggggtactccatcgctgacaaaagccccgccagaacagaggagactggcgatgcttttgtcaaacctggcggcagcgcaaaagatg

SEQ ID NO: 210826 - DNA, 103 bp, Artificial Sequence
  Synthetic Polynucleotide
taatacgactcactatagggttttctgcacgtactccatcgctgacaaaaaacagaggagattttgtatgcgatggagtaacctggcggcagcgcaaaagatg

SEQ ID NO: 210827 - DNA, 103 bp, Artificial Sequence
  Synthetic Polynucleotide
taatacgactcactatagggtccgtgagagttttctgcacgtactccatcaacagaggagagatggaatgcgtgcagaaaacctggcggcagcgcaaaagatg

SEQ ID NO: 210828 - DNA, 103 bp, Artificial Sequence
  Synthetic Polynucleotide
taatacgactcactatagggcagctccattgggaagctgtcactgtagagaacagaggagactctacatggacagcttcaacctggcggcagcgcaaaagatg

SEQ ID NO: 210829 - DNA, 103 bp, Artificial Sequence
  Synthetic Polynucleotide
taatacgactcactatagggcagctcctcgtccgtgagagttttctgcacaacagaggagagtgcagatgactctcacgaacctggcggcagcgcaaaagatg

SEQ ID NO: 210830 - DNA, 103 bp, Artificial Sequence
  Synthetic Polynucleotide
taatacgactcactatagggtccagtcagccagctcctcgtccgtgagagaacagaggagactctcaatgacgaggagcaacctggcggcagcgcaaaagatg

SEQ ID NO: 210831 - DNA, 103 bp, Artificial Sequence
  Synthetic Polynucleotide
taatacgactcactatagggtgccgcctcttccagtcagccagctcctcgaacagaggagacgaggaatgggctgactgaacctggcggcagcgcaaaagatg

SEQ ID NO: 210832 - DNA, 103 bp, Artificial Sequence
  Synthetic Polynucleotide
taatacgactcactatagggggcaatctgttgccgcctcttccagtcagcaacagaggagagctgacatgaagaggcggaacctggcggcagcgcaaaagatg

SEQ ID NO: 210833 - DNA, 103 bp, Artificial Sequence
  Synthetic Polynucleotide
taatacgactcactatagggctccaatgcaggcaatctgttgccgcctctaacagaggagaagaggcatgaacagattgaacctggcggcagcgcaaaagatg

SEQ ID NO: 210834 - DNA, 103 bp, Artificial Sequence
  Synthetic Polynucleotide
taatacgactcactatagggttgggcgggcctccaatgcaggcaatctgtaacagaggagaacagatatgctgcattggaacctggcggcagcgcaaaagatg

SEQ ID NO: 210835 - DNA, 103 bp, Artificial Sequence
  Synthetic Polynucleotide
taatacgactcactatagggtaggcagatgttgggcgggcctccaatgcaaacagaggagatgcattatgggcccgcccaacctggcggcagcgcaaaagatg

SEQ ID NO: 210836 - DNA, 103 bp, Artificial Sequence
  Synthetic Polynucleotide
taatacgactcactatagggctagccgatctaggcagatgttgggcgggcaacagaggagagcccgcatgacatctgccaacctggcggcagcgcaaaagatg

SEQ ID NO: 210837 - DNA, 103 bp, Artificial Sequence
  Synthetic Polynucleotide
taatacgactcactatagggatccagttttctagccgatctaggcagatgaacagaggagacatctgatgagatcggctaacctggcggcagcgcaaaagatg

SEQ ID NO: 210838 - DNA, 103 bp, Artificial Sequence
  Synthetic Polynucleotide
taatacgactcactatagggtaatgacgttatccagttttctagccgatcaacagaggagagatcggatggaaaactggaacctggcggcagcgcaaaagatg

SEQ ID NO: 210839 - DNA, 103 bp, Artificial Sequence
  Synthetic Polynucleotide
taatacgactcactataggggaaactgccgcagctccattgggaagctgtaacagaggagaacagctatgcaatggagcaacctggcggcagcgcaaaagatg

SEQ ID NO: 210840 - DNA, 103 bp, Artificial Sequence
  Synthetic Polynucleotide
taatacgactcactataggggagattctgctaatgacgttatccagttttaacagaggagaaaaactatgtaacgtcataacctggcggcagcgcaaaagatg

SEQ ID NO: 210841 - DNA, 103 bp, Artificial Sequence
  Synthetic Polynucleotide
taatacgactcactataggggtctgaagttgagattctgctaatgacgttaacagaggagaaacgtcatgagcagaatcaacctggcggcagcgcaaaagatg

SEQ ID NO: 210842 - DNA, 103 bp, Artificial Sequence
  Synthetic Polynucleotide
taatacgactcactatagggttgttgacgggtctgaagttgagattctgcaacagaggagagcagaaatgcaacttcagaacctggcggcagcgcaaaagatg

SEQ ID NO: 210843 - DNA, 103 bp, Artificial Sequence
  Synthetic Polynucleotide
taatacgactcactataggggtttcttaatttgttgacgggtctgaagttaacagaggagaaacttcatgcccgtcaacaacctggcggcagcgcaaaagatg

SEQ ID NO: 210844 - DNA, 103 bp, Artificial Sequence
  Synthetic Polynucleotide
taatacgactcactatagggaactcctccagtttcttaatttgttgacggaacagaggagaccgtcaatgaattaagaaaacctggcggcagcgcaaaagatg

SEQ ID NO: 210845 - DNA, 103 bp, Artificial Sequence
  Synthetic Polynucleotide
taatacgactcactatagggtttttgctgcaactcctccagtttcttaataacagaggagaattaagatgctggaggagaacctggcggcagcgcaaaagatg

SEQ ID NO: 210846 - DNA, 103 bp, Artificial Sequence
  Synthetic Polynucleotide
taatacgactcactatagggtgtaggaaactttttgctgcaactcctccaaacagaggagatggaggatgtgcagcaaaaacctggcggcagcgcaaaagatg

SEQ ID NO: 210847 - DNA, 103 bp, Artificial Sequence
  Synthetic Polynucleotide
taatacgactcactataggggggtcccctttgtaggaaactttttgctgcaacagaggagagcagcaatgagtttcctaaacctggcggcagcgcaaaagatg

SEQ ID NO: 210848 - DNA, 103 bp, Artificial Sequence
  Synthetic Polynucleotide
taatacgactcactatagggctgtacaatggggtcccctttgtaggaaacaacagaggagagtttccatgaaaggggacaacctggcggcagcgcaaaagatg

SEQ ID NO: 210849 - DNA, 103 bp, Artificial Sequence
  Synthetic Polynucleotide
taatacgactcactatagggtcggccggtgctgtacaatggggtccccttaacagaggagaaaggggatgccattgtacaacctggcggcagcgcaaaagatg

SEQ ID NO: 210850 - DNA, 103 bp, Artificial Sequence
  Synthetic Polynucleotide
taatacgactcactatagggcaaggggccagaaactgccgcagctccattaacagaggagaaatggaatggcggcagttaacctggcggcagcgcaaaagatg

SEQ ID NO: 210851 - DNA, 103 bp, Artificial Sequence
  Synthetic Polynucleotide
taatacgactcactatagggtcctccagcatcggccggtgctgtacaatgaacagaggagacattgtatggcaccggccaacctggcggcagcgcaaaagatg

SEQ ID NO: 210852 - DNA, 103 bp, Artificial Sequence
  Synthetic Polynucleotide
taatacgactcactatagggcacgattctctcctccagcatcggccggtgaacagaggagacaccggatgatgctggagaacctggcggcagcgcaaaagatg

SEQ ID NO: 210853 - DNA, 103 bp, Artificial Sequence
  Synthetic Polynucleotide
taatacgactcactatagggtaaacagctccacgattctctcctccagcaaacagaggagatgctggatgagagaatcgaacctggcggcagcgcaaaagatg

SEQ ID NO: 210854 - DNA, 103 bp, Artificial Sequence
  Synthetic Polynucleotide
taatacgactcactatagggattaagtttctaaacagctccacgattctcaacagaggagagagaatatgggagctgttaacctggcggcagcgcaaaagatg

SEQ ID NO: 210855 - DNA, 103 bp, Artificial Sequence
  Synthetic Polynucleotide
taatacgactcactatagggggcacttttcattaagtttctaaacagctcaacagaggagagagctgatgagaaacttaaacctggcggcagcgcaaaagatg

SEQ ID NO: 210856 - DNA, 103 bp, Artificial Sequence
  Synthetic Polynucleotide
taatacgactcactatagggccaccacaaaggcacttttcattaagtttcaacagaggagagaaactatgtgaaaagtgaacctggcggcagcgcaaaagatg

SEQ ID NO: 210857 - DNA, 103 bp, Artificial Sequence
  Synthetic Polynucleotide
taatacgactcactatagggggctgccgctccaccacaaaggcacttttcaacagaggagagaaaagatgctttgtggtaacctggcggcagcgcaaaagatg

SEQ ID NO: 210858 - DNA, 103 bp, Artificial Sequence
  Synthetic Polynucleotide
taatacgactcactataggggggcatgcagggctgccgctccaccacaaaaacagaggagatttgtgatggagcggcagaacctggcggcagcgcaaaagatg

SEQ ID NO: 210859 - DNA, 103 bp, Artificial Sequence
  Synthetic Polynucleotide
taatacgactcactatagggcaggatgcatgggcatgcagggctgccgctaacagaggagaagcggcatgcctgcatgcaacctggcggcagcgcaaaagatg

SEQ ID NO: 210860 - DNA, 103 bp, Artificial Sequence
  Synthetic Polynucleotide
taatacgactcactatagggaggggccggtcaggatgcatgggcatgcagaacagaggagactgcatatgcatgcatccaacctggcggcagcgcaaaagatg

SEQ ID NO: 210861 - DNA, 103 bp, Artificial Sequence
  Synthetic Polynucleotide
taatacgactcactataggggagctgctgagcttgtatccacacagccataacagaggagaatggctatgtggatacaaaacctggcggcagcgcaaaagatg

SEQ ID NO: 210862 - DNA, 103 bp, Artificial Sequence
  Synthetic Polynucleotide
taatacgactcactataggggctttcaatccactgggataaataatgccgaacagaggagacggcatatgttatcccagaacctggcggcagcgcaaaagatg

SEQ ID NO: 210863 - DNA, 103 bp, Artificial Sequence
  Synthetic Polynucleotide
taatacgactcactatagggctgaggaggctgcttctcaatgatgaacgtaacagaggagaacgttcatgattgagaagaacctggcggcagcgcaaaagatg

SEQ ID NO: 210864 - DNA, 103 bp, Artificial Sequence
  Synthetic Polynucleotide
taatacgactcactatagggtcttcaggacctgaggaggctgcttctcaaaacagaggagattgagaatgagcctcctcaacctggcggcagcgcaaaagatg

SEQ ID NO: 210865 - DNA, 103 bp, Artificial Sequence
  Synthetic Polynucleotide
taatacgactcactatagggttggtctgggtcttcaggacctgaggaggcaacagaggagagcctccatgggtcctgaaaacctggcggcagcgcaaaagatg

SEQ ID NO: 210866 - DNA, 103 bp, Artificial Sequence
  Synthetic Polynucleotide
taatacgactcactatagggggctgcaaacttggtctgggtcttcaggacaacagaggagagtcctgatgacccagaccaacctggcggcagcgcaaaagatg

SEQ ID NO: 210867 - DNA, 103 bp, Artificial Sequence
  Synthetic Polynucleotide
taatacgactcactatagggggcgcacagtggctgcaaacttggtctgggaacagaggagacccagaatgagtttgcagaacctggcggcagcgcaaaagatg

SEQ ID NO: 210868 - DNA, 103 bp, Artificial Sequence
  Synthetic Polynucleotide
taatacgactcactatagggcccaccagcaggcgcacagtggctgcaaacaacagaggagagtttgcatgcactgtgcgaacctggcggcagcgcaaaagatg

SEQ ID NO: 210869 - DNA, 103 bp, Artificial Sequence
  Synthetic Polynucleotide
taatacgactcactatagggcagcttcccgcccaccagcaggcgcacagtaacagaggagaactgtgatgctgctggtgaacctggcggcagcgcaaaagatg

SEQ ID NO: 210870 - DNA, 103 bp, Artificial Sequence
  Synthetic Polynucleotide
taatacgactcactatagggtgtgcacgttcagcttcccgcccaccagcaaacagaggagatgctggatggcgggaagcaacctggcggcagcgcaaaagatg

SEQ ID NO: 210871 - DNA, 103 bp, Artificial Sequence
  Synthetic Polynucleotide
taatacgactcactatagggggggggttcatgtgcacgttcagcttcccgaacagaggagacgggaaatggaacgtgcaaacctggcggcagcgcaaaagatg

SEQ ID NO: 210872 - DNA, 103 bp, Artificial Sequence
  Synthetic Polynucleotide
taatacgactcactatagggcttcacctggggggggttcatgtgcacgttaacagaggagaaacgtgatgatgaaccccaacctggcggcagcgcaaaagatg

SEQ ID NO: 210873 - DNA, 103 bp, Artificial Sequence
  Synthetic Polynucleotide
taatacgactcactatagggcccatgcttggctttcaatccactgggataaacagaggagatatcccatgggattgaaaaacctggcggcagcgcaaaagatg

SEQ ID NO: 210874 - DNA, 103 bp, Artificial Sequence
  Synthetic Polynucleotide
taatacgactcactatagggtgatggtggccttcacctggggggggttcaaacagaggagatgaaccatgcccaggtgaaacctggcggcagcgcaaaagatg

SEQ ID NO: 210875 - DNA, 103 bp, Artificial Sequence
  Synthetic Polynucleotide
taatacgactcactatagggtgctcactgatgatggtggccttcacctggaacagaggagaccaggtatgggccaccataacctggcggcagcgcaaaagatg

SEQ ID NO: 210876 - DNA, 103 bp, Artificial Sequence
  Synthetic Polynucleotide
taatacgactcactatagggcttggcctgctgctcactgatgatggtggcaacagaggagagccaccatgatcagtgagaacctggcggcagcgcaaaagatg

SEQ ID NO: 210877 - DNA, 103 bp, Artificial Sequence
  Synthetic Polynucleotide
taatacgactcactatagggtgagcagagacttggcctgctgctcactgaaacagaggagatcagtgatgagcaggccaaacctggcggcagcgcaaaagatg

SEQ ID NO: 210878 - DNA, 103 bp, Artificial Sequence
  Synthetic Polynucleotide
taatacgactcactatagggttctcgttcttgagcagagacttggcctgcaacagaggagagcaggcatggtctctgctaacctggcggcagcgcaaaagatg

SEQ ID NO: 210879 - DNA, 103 bp, Artificial Sequence
  Synthetic Polynucleotide
taatacgactcactatagggattgcgggtgttctcgttcttgagcagagaaacagaggagatctctgatgaagaacgagaacctggcggcagcgcaaaagatg

SEQ ID NO: 210880 - DNA, 103 bp, Artificial Sequence
  Synthetic Polynucleotide
taatacgactcactatagggcactgtaatcattgcgggtgttctcgttctaacagaggagaagaacgatgacacccgcaaacctggcggcagcgcaaaagatg

SEQ ID NO: 210881 - DNA, 103 bp, Artificial Sequence
  Synthetic Polynucleotide
taatacgactcactatagggaagatctcgccactgtaatcattgcgggtgaacagaggagacacccgatgtgattacagaacctggcggcagcgcaaaagatg

SEQ ID NO: 210882 - DNA, 103 bp, Artificial Sequence
  Synthetic Polynucleotide
taatacgactcactataggggcagttgttcaagatctcgccactgtaatcaacagaggagagattacatgggcgagatcaacctggcggcagcgcaaaagatg

SEQ ID NO: 210883 - DNA, 103 bp, Artificial Sequence
  Synthetic Polynucleotide
taatacgactcactatagggccatgacgcagcagttgttcaagatctcgcaacagaggagagcgagaatgtgaacaactaacctggcggcagcgcaaaagatg

SEQ ID NO: 210884 - DNA, 103 bp, Artificial Sequence
  Synthetic Polynucleotide
taatacgactcactatagggtctactgagtcccatgcttggctttcaatcaacagaggagagattgaatgccaagcatgaacctggcggcagcgcaaaagatg

SEQ ID NO: 210885 - DNA, 103 bp, Artificial Sequence
  Synthetic Polynucleotide
taatacgactcactatagggtggtggtactccatgacgcagcagttgttcaacagaggagagaacaaatgctgcgtcataacctggcggcagcgcaaaagatg

SEQ ID NO: 210886 - DNA, 103 bp, Artificial Sequence
  Synthetic Polynucleotide
taatacgactcactataggggcctgtggcttggtggtactccatgacgcaaacagaggagatgcgtcatggagtaccacaacctggcggcagcgcaaaagatg

SEQ ID NO: 210887 - DNA, 103 bp, Artificial Sequence
  Synthetic Polynucleotide
taatacgactcactatagggcactaagggtgcctgtggcttggtggtactaacagaggagaagtaccatgaagccacagaacctggcggcagcgcaaaagatg

SEQ ID NO: 210888 - DNA, 103 bp, Artificial Sequence
  Synthetic Polynucleotide
taatacgactcactatagggctgaagtgggcactaagggtgcctgtggctaacagaggagaagccacatgcacccttagaacctggcggcagcgcaaaagatg

SEQ ID NO: 210889 - DNA, 103 bp, Artificial Sequence
  Synthetic Polynucleotide
taatacgactcactatagggggacatattcctgaagtgggcactaagggtaacagaggagaacccttatggcccacttcaacctggcggcagcgcaaaagatg

SEQ ID NO: 210890 - DNA, 103 bp, Artificial Sequence
  Synthetic Polynucleotide
taatacgactcactatagggttcgtttcagggacatattcctgaagtgggaacagaggagacccactatgggaatatgtaacctggcggcagcgcaaaagatg

SEQ ID NO: 210891 - DNA, 103 bp, Artificial Sequence
  Synthetic Polynucleotide
taatacgactcactataggggacctcttaattcgtttcagggacatattcaacagaggagagaatatatgcctgaaacgaacctggcggcagcgcaaaagatg

SEQ ID NO: 210892 - DNA, 103 bp, Artificial Sequence
  Synthetic Polynucleotide
taatacgactcactatagggacgacggtctgacctcttaattcgtttcagaacagaggagactgaaaatgattaagaggaacctggcggcagcgcaaaagatg

SEQ ID NO: 210893 - DNA, 103 bp, Artificial Sequence
  Synthetic Polynucleotide
taatacgactcactatagggactctgccccacgacggtctgacctcttaaaacagaggagattaagaatgcagaccgtcaacctggcggcagcgcaaaagatg

SEQ ID NO: 210894 - DNA, 103 bp, Artificial Sequence
  Synthetic Polynucleotide
taatacgactcactatagggtctgtcaccgactctgccccacgacggtctaacagaggagaagaccgatgtggggcagaaacctggcggcagcgcaaaagatg

SEQ ID NO: 210895 - DNA, 103 bp, Artificial Sequence
  Synthetic Polynucleotide
taatacgactcactatagggattatcaagatctactgagtcccatgcttgaacagaggagacaagcaatggactcagtaaacctggcggcagcgcaaaagatg

SEQ ID NO: 210896 - DNA, 103 bp, Artificial Sequence
  Synthetic Polynucleotide
taatacgactcactatagggaaatttttcttctgtcaccgactctgccccaacagaggagaggggcaatgtcggtgacaaacctggcggcagcgcaaaagatg

SEQ ID NO: 210897 - DNA, 103 bp, Artificial Sequence
  Synthetic Polynucleotide
taatacgactcactatagggacaggattgtaaatttttcttctgtcaccgaacagaggagacggtgaatgaagaaaaataacctggcggcagcgcaaaagatg

SEQ ID NO: 210898 - DNA, 103 bp, Artificial Sequence
  Synthetic Polynucleotide
taatacgactcactatagggtgggattcaaacaggattgtaaatttttctaacagaggagaagaaaaatgtacaatcctaacctggcggcagcgcaaaagatg

SEQ ID NO: 210899 - DNA, 103 bp, Artificial Sequence
  Synthetic Polynucleotide
taatacgactcactatagggaacactgaactgggattcaaacaggattgtaacagaggagaacaatcatgtttgaatccaacctggcggcagcgcaaaagatg

SEQ ID NO: 210900 - DNA, 103 bp, Artificial Sequence
  Synthetic Polynucleotide
taatacgactcactatagggcatttccaccaacactgaactgggattcaaaacagaggagattgaatatgagttcagtgaacctggcggcagcgcaaaagatg

SEQ ID NO: 210901 - DNA, 103 bp, Artificial Sequence
  Synthetic Polynucleotide
taatacgactcactatagggaaaaccagctcatttccaccaacactgaacaacagaggagagttcagatgtggtggaaaaacctggcggcagcgcaaaagatg

SEQ ID NO: 210902 - DNA, 103 bp, Artificial Sequence
  Synthetic Polynucleotide
taatacgactcactatagggcttgacttgaaaaaccagctcatttccaccaacagaggagaggtggaatggagctggttaacctggcggcagcgcaaaagatg

SEQ ID NO: 210903 - DNA, 103 bp, Artificial Sequence
  Synthetic Polynucleotide
taatacgactcactataggggggacagggtcttgacttgaaaaaccagctaacagaggagaagctggatgttcaagtcaaacctggcggcagcgcaaaagatg

SEQ ID NO: 210904 - DNA, 103 bp, Artificial Sequence
  Synthetic Polynucleotide
taatacgactcactatagggaccactggcagggacagggtcttgacttgaaacagaggagatcaagtatggaccctgtcaacctggcggcagcgcaaaagatg

SEQ ID NO: 210905 - DNA, 103 bp, Artificial Sequence
  Synthetic Polynucleotide
taatacgactcactatagggaacgatcaccaccactggcagggacagggtaacagaggagaaccctgatgctgccagtgaacctggcggcagcgcaaaagatg

SEQ ID NO: 210906 - DNA, 103 bp, Artificial Sequence
  Synthetic Polynucleotide
taatacgactcactatagggtctcctgtggattatcaagatctactgagtaacagaggagaactcagatgatcttgataaacctggcggcagcgcaaaagatg

SEQ ID NO: 210907 - DNA, 103 bp, Artificial Sequence
  Synthetic Polynucleotide
taatacgactcactatagggggctgccatgaacgatcaccaccactggcaaacagaggagatgccagatgtggtgatcgaacctggcggcagcgcaaaagatg

SEQ ID NO: 210908 - DNA, 103 bp, Artificial Sequence
  Synthetic Polynucleotide
taatacgactcactatagggttgttgtcctggctgccatgaacgatcaccaacagaggagaggtgatatgtcatggcagaacctggcggcagcgcaaaagatg

SEQ ID NO: 210909 - DNA, 103 bp, Artificial Sequence
  Synthetic Polynucleotide
taatacgactcactatagggggccgtcgcattgttgtcctggctgccatgaacagaggagacatggcatgcaggacaacaacctggcggcagcgcaaaagatg

SEQ ID NO: 210910 - DNA, 103 bp, Artificial Sequence
  Synthetic Polynucleotide
taatacgactcactatagggagagaacagtggccgtcgcattgttgtcctaacagaggagaaggacaatgatgcgacggaacctggcggcagcgcaaaagatg

SEQ ID NO: 210911 - DNA, 103 bp, Artificial Sequence
  Synthetic Polynucleotide
taatacgactcactataggggcattgtcccagagaacagtggccgtcgcaaacagaggagatgcgacatgcactgttctaacctggcggcagcgcaaaagatg

SEQ ID NO: 210912 - DNA, 103 bp, Artificial Sequence
  Synthetic Polynucleotide
taatacgactcactatagggctctgcaaaagcattgtcccagagaacagtaacagaggagaactgttatgtgggacaataacctggcggcagcgcaaaagatg

SEQ ID NO: 210913 - DNA, 103 bp, Artificial Sequence
  Synthetic Polynucleotide
taatacgactcactatagggccctgccaggctctgcaaaagcattgtcccaacagaggagagggacaatgcttttgcagaacctggcggcagcgcaaaagatg

SEQ ID NO: 210914 - DNA, 103 bp, Artificial Sequence
  Synthetic Polynucleotide
taatacgactcactataggggcaaatggcaccctgccaggctctgcaaaaaacagaggagattttgcatggcctggcagaacctggcggcagcgcaaaagatg

SEQ ID NO: 210915 - DNA, 103 bp, Artificial Sequence
  Synthetic Polynucleotide
taatacgactcactataggggtcaggcacggcaaatggcaccctgccaggaacagaggagacctggcatggtgccatttaacctggcggcagcgcaaaagatg

SEQ ID NO: 210916 - DNA, 103 bp, Artificial Sequence
  Synthetic Polynucleotide
taatacgactcactatagggacagcactttgtcaggcacggcaaatggcaaacagaggagatgccatatgccgtgcctgaacctggcggcagcgcaaaagatg

SEQ ID NO: 210917 - DNA, 103 bp, Artificial Sequence
  Synthetic Polynucleotide
taatacgactcactataggggccttaatgttctcctgtggattatcaagaaacagaggagatcttgaatgtccacaggaaacctggcggcagcgcaaaagatg

SEQ ID NO: 210918 - DNA, 103 bp, Artificial Sequence
  Synthetic Polynucleotide
taatacgactcactatagggagctgtggccacagcactttgtcaggcacgaacagaggagacgtgccatgcaaagtgctaacctggcggcagcgcaaaagatg

SEQ ID NO: 210919 - DNA, 103 bp, Artificial Sequence
  Synthetic Polynucleotide
taatacgactcactatagggcgcctcacacagctgtggccacagcactttaacagaggagaaaagtgatgtggccacagaacctggcggcagcgcaaaagatg

SEQ ID NO: 210920 - DNA, 103 bp, Artificial Sequence
  Synthetic Polynucleotide
taatacgactcactatagggtcatgttgagcgcctcacacagctgtggccaacagaggagaggccacatgtgtgtgaggaacctggcggcagcgcaaaagatg

SEQ ID NO: 210921 - DNA, 103 bp, Artificial Sequence
  Synthetic Polynucleotide
taatacgactcactataggggccttgaatttcatgttgagcgcctcacacaacagaggagagtgtgaatggctcaacataacctggcggcagcgcaaaagatg

SEQ ID NO: 210922 - DNA, 103 bp, Artificial Sequence
  Synthetic Polynucleotide
taatacgactcactatagggctgcacttcggccttgaatttcatgttgagaacagaggagactcaacatgaaattcaagaacctggcggcagcgcaaaagatg

SEQ ID NO: 210923 - DNA, 103 bp, Artificial Sequence
  Synthetic Polynucleotide
taatacgactcactatagggcccggttgctctgcacttcggccttgaattaacagaggagaaattcaatgccgaagtgcaacctggcggcagcgcaaaagatg

SEQ ID NO: 210924 - DNA, 103 bp, Artificial Sequence
  Synthetic Polynucleotide
taatacgactcactatagggttggtcaggccccggttgctctgcacttcgaacagaggagacgaagtatggagcaaccgaacctggcggcagcgcaaaagatg

SEQ ID NO: 210925 - DNA, 103 bp, Artificial Sequence
  Synthetic Polynucleotide
taatacgactcactataggggaggttctccttggtcaggccccggttgctaacagaggagaagcaacatgggcctgaccaacctggcggcagcgcaaaagatg

SEQ ID NO: 210926 - DNA, 103 bp, Artificial Sequence
  Synthetic Polynucleotide
taatacgactcactatagggccaggaacacgaggttctccttggtcaggcaacagaggagagcctgaatgaggagaaccaacctggcggcagcgcaaaagatg

SEQ ID NO: 210927 - DNA, 103 bp, Artificial Sequence
  Synthetic Polynucleotide
taatacgactcactatagggagtttctgcgccaggaacacgaggttctccaacagaggagaggagaaatgcgtgttcctaacctggcggcagcgcaaaagatg

SEQ ID NO: 210928 - DNA, 103 bp, Artificial Sequence
  Synthetic Polynucleotide
taatacgactcactataggggagctgggtggccttaatgttctcctgtggaacagaggagaccacagatgaacattaagaacctggcggcagcgcaaaagatg

SEQ ID NO: 210929 - DNA, 103 bp, Artificial Sequence
  Synthetic Polynucleotide
taatacgactcactataggggttgttgaacagtttctgcgccaggaacacaacagaggagagtgttcatggcgcagaaaaacctggcggcagcgcaaaagatg

SEQ ID NO: 210930 - DNA, 103 bp, Artificial Sequence
  Synthetic Polynucleotide
taatacgactcactatagggggctgctgctgttgttgaacagtttctgcgaacagaggagacgcagaatgtgttcaacaaacctggcggcagcgcaaaagatg

SEQ ID NO: 210931 - DNA, 103 bp, Artificial Sequence
  Synthetic Polynucleotide
taatacgactcactatagggtcctccaggtggctgctgctgttgttgaacaacagaggagagttcaaatgcagcagcagaacctggcggcagcgcaaaagatg

SEQ ID NO: 210932 - DNA, 103 bp, Artificial Sequence
  Synthetic Polynucleotide
taatacgactcactataggggccactgtagtcctccaggtggctgctgctaacagaggagaagcagcatgcacctggagaacctggcggcagcgcaaaagatg

SEQ ID NO: 210933 - DNA, 103 bp, Artificial Sequence
  Synthetic Polynucleotide
taatacgactcactatagggacacagacaggccactgtagtcctccaggtaacagaggagaacctggatgactacagtgaacctggcggcagcgcaaaagatg

SEQ ID NO: 210934 - DNA, 103 bp, Artificial Sequence
  Synthetic Polynucleotide
taatacgactcactatagggtgggaccaggacacagacaggccactgtagaacagaggagactacagatgcctgtctgtaacctggcggcagcgcaaaagatg

SEQ ID NO: 210935 - DNA, 103 bp, Artificial Sequence
  Synthetic Polynucleotide
taatacgactcactatagggcctgttgaactgggaccaggacacagacagaacagaggagactgtctatgtcctggtccaacctggcggcagcgcaaaagatg

SEQ ID NO: 210936 - DNA, 103 bp, Artificial Sequence
  Synthetic Polynucleotide
taatacgactcactataggggtaaattctccctgttgaactgggaccaggaacagaggagacctggtatgagttcaacaaacctggcggcagcgcaaaagatg

SEQ ID NO: 210937 - DNA, 103 bp, Artificial Sequence
  Synthetic Polynucleotide
taatacgactcactatagggttccgtcctggtaaattctccctgttgaacaacagaggagagttcaaatgggagaatttaacctggcggcagcgcaaaagatg

SEQ ID NO: 210938 - DNA, 103 bp, Artificial Sequence
  Synthetic Polynucleotide
taatacgactcactataggggaaagtgtaattccgtcctggtaaattctcaacagaggagagagaatatgccaggacggaacctggcggcagcgcaaaagatg

SEQ ID NO: 210939 - DNA, 103 bp, Artificial Sequence
  Synthetic Polynucleotide
taatacgactcactatagggggccctccaggagctgggtggccttaatgtaacagaggagaacattaatgccacccagcaacctggcggcagcgcaaaagatg

SEQ ID NO: 210940 - DNA, 103 bp, Artificial Sequence
  Synthetic Polynucleotide
taatacgactcactatagggaccattgccagaaagtgtaattccgtcctgaacagaggagacaggacatgattacacttaacctggcggcagcgcaaaagatg

SEQ ID NO: 210941 - DNA, 103 bp, Artificial Sequence
  Synthetic Polynucleotide
taatacgactcactatagggacaccgtcaaaccattgccagaaagtgtaaaacagaggagattacacatgctggcaatgaacctggcggcagcgcaaaagatg

SEQ ID NO: 210942 - DNA, 103 bp, Artificial Sequence
  Synthetic Polynucleotide
taatacgactcactatagggcacttccatcacaccgtcaaaccattgccaaacagaggagatggcaaatgtttgacggtaacctggcggcagcgcaaaagatg

SEQ ID NO: 210943 - DNA, 103 bp, Artificial Sequence
  Synthetic Polynucleotide
taatacgactcactataggggtttttttaacacttccatcacaccgtcaaaacagaggagattgacgatgtgatggaagaacctggcggcagcgcaaaagatg

SEQ ID NO: 210944 - DNA, 103 bp, Artificial Sequence
  Synthetic Polynucleotide
taatacgactcactatagggggcttgagatgtttttttaacacttccatcaacagaggagagatggaatggttaaaaaaaacctggcggcagcgcaaaagatg

SEQ ID NO: 210945 - DNA, 103 bp, Artificial Sequence
  Synthetic Polynucleotide
taatacgactcactatagggattccaatgaggcttgagatgtttttttaaaacagaggagattaaaaatgcatctcaagaacctggcggcagcgcaaaagatg

SEQ ID NO: 210946 - DNA, 103 bp, Artificial Sequence
  Synthetic Polynucleotide
taatacgactcactatagggtggccccatcattccaatgaggcttgagataacagaggagaatctcaatgctcattggaaacctggcggcagcgcaaaagatg

SEQ ID NO: 210947 - DNA, 103 bp, Artificial Sequence
  Synthetic Polynucleotide
taatacgactcactatagggaaccccaaaatggccccatcattccaatgaaacagaggagatcattgatgtgatggggcaacctggcggcagcgcaaaagatg

SEQ ID NO: 210948 - DNA, 103 bp, Artificial Sequence
  Synthetic Polynucleotide
taatacgactcactatagggcttgtttacaaaccccaaaatggccccatcaacagaggagagatgggatgattttggggaacctggcggcagcgcaaaagatg

SEQ ID NO: 210949 - DNA, 103 bp, Artificial Sequence
  Synthetic Polynucleotide
taatacgactcactataggggggcctgttgcttgtttacaaaccccaaaaaacagaggagattttggatgttgtaaacaaacctggcggcagcgcaaaagatg

SEQ ID NO: 210950 - DNA, 103 bp, Artificial Sequence
  Synthetic Polynucleotide
taatacgactcactatagggtcctgcaccaggccctccaggagctgggtgaacagaggagacacccaatgcctggagggaacctggcggcagcgcaaaagatg

SEQ ID NO: 210951 - DNA, 103 bp, Artificial Sequence
  Synthetic Polynucleotide
taatacgactcactatagggagtaggtcatgggcctgttgcttgtttacaaacagaggagatgtaaaatggcaacaggcaacctggcggcagcgcaaaagatg

SEQ ID NO: 210952 - DNA, 103 bp, Artificial Sequence
  Synthetic Polynucleotide
taatacgactcactatagggcttgttaatgagtaggtcatgggcctgttgaacagaggagacaacagatgcatgacctaaacctggcggcagcgcaaaagatg

SEQ ID NO: 210953 - DNA, 103 bp, Artificial Sequence
  Synthetic Polynucleotide
taatacgactcactatagggtcccatctggcttgttaatgagtaggtcataacagaggagaatgaccatgtcattaacaaacctggcggcagcgcaaaagatg

SEQ ID NO: 210954 - DNA, 103 bp, Artificial Sequence
  Synthetic Polynucleotide
taatacgactcactatagggaggaggaaggtcccatctggcttgttaatgaacagaggagacattaaatggccagatggaacctggcggcagcgcaaaagatg

SEQ ID NO: 210955 - DNA, 103 bp, Artificial Sequence
  Synthetic Polynucleotide
taatacgactcactatagggactgaatctcaggaggaaggtcccatctggaacagaggagaccagatatgaccttcctcaacctggcggcagcgcaaaagatg

SEQ ID NO: 210956 - DNA, 103 bp, Artificial Sequence
  Synthetic Polynucleotide
taatacgactcactatagggtttctgagtcactgaatctcaggaggaaggaacagaggagaccttccatgtgagattcaaacctggcggcagcgcaaaagatg

SEQ ID NO: 210957 - DNA, 103 bp, Artificial Sequence
  Synthetic Polynucleotide
taatacgactcactatagggatgccgccaatttctgagtcactgaatctcaacagaggagagagattatgtgactcagaaacctggcggcagcgcaaaagatg

SEQ ID NO: 210958 - DNA, 103 bp, Artificial Sequence
  Synthetic Polynucleotide
taatacgactcactatagggagcaatggtgatgccgccaatttctgagtcaacagaggagagactcaatgattggcggcaacctggcggcagcgcaaaagatg

SEQ ID NO: 210959 - DNA, 103 bp, Artificial Sequence
  Synthetic Polynucleotide
taatacgactcactatagggcaaacttccaagcaatggtgatgccgccaaaacagaggagattggcgatgtcaccattgaacctggcggcagcgcaaaagatg

SEQ ID NO: 210960 - DNA, 103 bp, Artificial Sequence
  Synthetic Polynucleotide
taatacgactcactatagggtcctgagaatcaaacttccaagcaatggtgaacagaggagacaccatatgttggaagttaacctggcggcagcgcaaaagatg

SEQ ID NO: 210961 - DNA, 103 bp, Artificial Sequence
  Synthetic Polynucleotide
taatacgactcactatagggcttctgcagctcctgcaccaggccctccagaacagaggagactggagatgctggtgcagaacctggcggcagcgcaaaagatg

SEQ ID NO: 210962 - DNA, 103 bp, Artificial Sequence
  Synthetic Polynucleotide
taatacgactcactatagggaaacattctttcctgagaatcaaacttccaaacagaggagatggaagatggattctcagaacctggcggcagcgcaaaagatg

SEQ ID NO: 210963 - DNA, 103 bp, Artificial Sequence
  Synthetic Polynucleotide
taatacgactcactatagggtcagattccaaaacattctttcctgagaataacagaggagaattctcatgaaagaatgtaacctggcggcagcgcaaaagatg

SEQ ID NO: 210964 - DNA, 103 bp, Artificial Sequence
  Synthetic Polynucleotide
taatacgactcactataggggtaaaaggcatcagattccaaaacattcttaacagaggagaaagaatatgttggaatctaacctggcggcagcgcaaaagatg

SEQ ID NO: 210965 - DNA, 103 bp, Artificial Sequence
  Synthetic Polynucleotide
taatacgactcactataggggtctctggtggtaaaaggcatcagattccaaacagaggagatggaatatgatgccttttaacctggcggcagcgcaaaagatg

SEQ ID NO: 210966 - DNA, 103 bp, Artificial Sequence
  Synthetic Polynucleotide
taatacgactcactataggggaatggagaagtctctggtggtaaaaggcaaacagaggagatgccttatgccaccagagaacctggcggcagcgcaaaagatg

SEQ ID NO: 210967 - DNA, 103 bp, Artificial Sequence
  Synthetic Polynucleotide
taatacgactcactataggggctagggaccgaatggagaagtctctggtgaacagaggagacaccagatgcttctccataacctggcggcagcgcaaaagatg

SEQ ID NO: 210968 - DNA, 103 bp, Artificial Sequence
  Synthetic Polynucleotide
taatacgactcactatagggcaagcggtcggctagggaccgaatggagaaaacagaggagattctccatgcggtccctaaacctggcggcagcgcaaaagatg

SEQ ID NO: 210969 - DNA, 103 bp, Artificial Sequence
  Synthetic Polynucleotide
taatacgactcactatagggtcaagtctcccaagcggtcggctagggaccaacagaggagaggtcccatgccgaccgctaacctggcggcagcgcaaaagatg

SEQ ID NO: 210970 - DNA, 103 bp, Artificial Sequence
  Synthetic Polynucleotide
taatacgactcactatagggataaggtaattcaagtctcccaagcggtcgaacagaggagacgaccgatggggagacttaacctggcggcagcgcaaaagatg

SEQ ID NO: 210971 - DNA, 103 bp, Artificial Sequence
  Synthetic Polynucleotide
taatacgactcactatagggaaacacgtagataaggtaattcaagtctccaacagaggagaggagacatgaattaccttaacctggcggcagcgcaaaagatg

SEQ ID NO: 210972 - DNA, 103 bp, Artificial Sequence
  Synthetic Polynucleotide
taatacgactcactatagggcttctccttggagctgctgagcttgtatccaacagaggagaggatacatgctcagcagcaacctggcggcagcgcaaaagatg

SEQ ID NO: 210973 - DNA, 103 bp, Artificial Sequence
  Synthetic Polynucleotide
taatacgactcactataggggctctgccttcttctgcagctcctgcaccaaacagaggagatggtgcatgagctgcagaaacctggcggcagcgcaaaagatg

SEQ ID NO: 210974 - DNA, 103 bp, Artificial Sequence
  Synthetic Polynucleotide
taatacgactcactataggggccgatcaggaaacacgtagataaggtaataacagaggagaattaccatgtctacgtgtaacctggcggcagcgcaaaagatg

SEQ ID NO: 210975 - DNA, 103 bp, Artificial Sequence
  Synthetic Polynucleotide
taatacgactcactatagggtcatcttttggccgatcaggaaacacgtagaacagaggagactacgtatgtcctgatcgaacctggcggcagcgcaaaagatg

SEQ ID NO: 210976 - DNA, 103 bp, Artificial Sequence
  Synthetic Polynucleotide
taatacgactcactatagggggagtatacttcatcttttggccgatcaggaacagaggagacctgatatgccaaaagataacctggcggcagcgcaaaagatg

SEQ ID NO: 210977 - DNA, 103 bp, Artificial Sequence
  Synthetic Polynucleotide
taatacgactcactatagggtgtagtatttggagtatacttcatcttttgaacagaggagacaaaagatgaagtatactaacctggcggcagcgcaaaagatg

SEQ ID NO: 210978 - DNA, 103 bp, Artificial Sequence
  Synthetic Polynucleotide
taatacgactcactatagggggaactggtgtgtagtatttggagtatactaacagaggagaagtataatgcaaatactaaacctggcggcagcgcaaaagatg

SEQ ID NO: 210979 - DNA, 103 bp, Artificial Sequence
  Synthetic Polynucleotide
taatacgactcactatagggagactcgcagggaactggtgtgtagtatttaacagaggagaaaatacatgacaccagttaacctggcggcagcgcaaaagatg

SEQ ID NO: 210980 - DNA, 103 bp, Artificial Sequence
  Synthetic Polynucleotide
taatacgactcactatagggtagcagtagcagactcgcagggaactggtgaacagaggagacaccagatgcctgcgagtaacctggcggcagcgcaaaagatg

SEQ ID NO: 210981 - DNA, 103 bp, Artificial Sequence
  Synthetic Polynucleotide
taatacgactcactatagggtcaacagctttagcagtagcagactcgcagaacagaggagactgcgaatgtgctactgcaacctggcggcagcgcaaaagatg

SEQ ID NO: 210982 - DNA, 103 bp, Artificial Sequence
  Synthetic Polynucleotide
taatacgactcactatagggcacgtatccatcaacagctttagcagtagcaacagaggagagctactatgaaagctgttaacctggcggcagcgcaaaagatg

SEQ ID NO: 210983 - DNA, 103 bp, Artificial Sequence
  Synthetic Polynucleotide
taatacgactcactatagggtctgtggcttcacgtatccatcaacagcttaacagaggagaaagctgatgatggatacgaacctggcggcagcgcaaaagatg

SEQ ID NO: 210984 - DNA, 103 bp, Artificial Sequence
  Synthetic Polynucleotide
taatacgactcactatagggcccacctggtgctctgccttcttctgcagcaacagaggagagctgcaatggaaggcagaaacctggcggcagcgcaaaagatg

SEQ ID NO: 210985 - DNA, 103 bp, Artificial Sequence
  Synthetic Polynucleotide
taatacgactcactatagggacttgcttgatctgtggcttcacgtatccaaacagaggagatggataatggaagccacaaacctggcggcagcgcaaaagatg

SEQ ID NO: 210986 - DNA, 103 bp, Artificial Sequence
  Synthetic Polynucleotide
taatacgactcactatagggctcagggaccacttgcttgatctgtggcttaacagaggagaaagccaatgatcaagcaaaacctggcggcagcgcaaaagatg

SEQ ID NO: 210987 - DNA, 103 bp, Artificial Sequence
  Synthetic Polynucleotide
taatacgactcactatagggcgttcacaaactcagggaccacttgcttgaaacagaggagatcaagcatgtggtccctgaacctggcggcagcgcaaaagatg

SEQ ID NO: 210988 - DNA, 103 bp, Artificial Sequence
  Synthetic Polynucleotide
taatacgactcactatagggtctgcagatgcgttcacaaactcagggaccaacagaggagaggtcccatggtttgtgaaaacctggcggcagcgcaaaagatg

SEQ ID NO: 210989 - DNA, 103 bp, Artificial Sequence
  Synthetic Polynucleotide
taatacgactcactataggggcccccggcatctgcagatgcgttcacaaaaacagaggagatttgtgatggcatctgcaaacctggcggcagcgcaaaagatg

SEQ ID NO: 210990 - DNA, 103 bp, Artificial Sequence
  Synthetic Polynucleotide
taatacgactcactatagggtggcgctgccgcccccggcatctgcagatgaacagaggagacatctgatgatgccggggaacctggcggcagcgcaaaagatg

SEQ ID NO: 210991 - DNA, 103 bp, Artificial Sequence
  Synthetic Polynucleotide
taatacgactcactatagggtccatgtacgtggcgctgccgcccccggcaaacagaggagatgccggatgcggcagcgcaacctggcggcagcgcaaaagatg

SEQ ID NO: 210992 - DNA, 103 bp, Artificial Sequence
  Synthetic Polynucleotide
taatacgactcactataggggggggcctggtccatgtacgtggcgctgccaacagaggagaggcagcatgacgtacatgaacctggcggcagcgcaaaagatg

SEQ ID NO: 210993 - DNA, 103 bp, Artificial Sequence
  Synthetic Polynucleotide
taatacgactcactatagggcagctggggagggggcctggtccatgtacgaacagaggagacgtacaatgaccaggcccaacctggcggcagcgcaaaagatg

SEQ ID NO: 210994 - DNA, 103 bp, Artificial Sequence
  Synthetic Polynucleotide
taatacgactcactatagggtggggacacacagctggggagggggcctggaacagaggagaccaggcatgctccccagcaacctggcggcagcgcaaaagatg

SEQ ID NO: 210995 - DNA, 103 bp, Artificial Sequence
  Synthetic Polynucleotide
taatacgactcactatagggcccatcttcccccacctggtgctctgccttaacagaggagaaaggcaatgcaccaggtgaacctggcggcagcgcaaaagatg

SEQ ID NO: 210996 - DNA, 103 bp, Artificial Sequence
  Synthetic Polynucleotide
taatacgactcactatagggatagtgagcctggggacacacagctggggaaacagaggagatccccaatggtgtgtcccaacctggcggcagcgcaaaagatg

SEQ ID NO: 210997 - DNA, 103 bp, Artificial Sequence
  Synthetic Polynucleotide
taatacgactcactatagggggtacatgttatagtgagcctggggacacaaacagaggagatgtgtcatgaggctcactaacctggcggcagcgcaaaagatg

SEQ ID NO: 210998 - DNA, 103 bp, Artificial Sequence
  Synthetic Polynucleotide
taatacgactcactataggggggttctgtgggtacatgttatagtgagccaacagaggagaggctcaatgtaacatgtaaacctggcggcagcgcaaaagatg

SEQ ID NO: 210999 - DNA, 103 bp, Artificial Sequence
  Synthetic Polynucleotide
taatacgactcactataggggactgagtcagggttctgtgggtacatgttaacagaggagaaacatgatgccacagaacaacctggcggcagcgcaaaagatg

SEQ ID NO: 211000 - DNA, 103 bp, Artificial Sequence
  Synthetic Polynucleotide
taatacgactcactatagggcggtgtcaaggactgagtcagggttctgtgaacagaggagacacagaatgctgactcagaacctggcggcagcgcaaaagatg

SEQ ID NO: 211001 - DNA, 103 bp, Artificial Sequence
  Synthetic Polynucleotide
taatacgactcactatagggaagtccccatcggtgtcaaggactgagtcaaacagaggagatgactcatgccttgacacaacctggcggcagcgcaaaagatg

SEQ ID NO: 211002 - DNA, 103 bp, Artificial Sequence
  Synthetic Polynucleotide
taatacgactcactatagggctccagatcgaagtccccatcggtgtcaagaacagaggagacttgacatggatggggacaacctggcggcagcgcaaaagatg

SEQ ID NO: 211003 - DNA, 103 bp, Artificial Sequence
  Synthetic Polynucleotide
taatacgactcactatagggccattgtgtcctccagatcgaagtccccataacagaggagaatggggatgtcgatctggaacctggcggcagcgcaaaagatg

SEQ ID NO: 211004 - DNA, 103 bp, Artificial Sequence
  Synthetic Polynucleotide
taatacgactcactatagggcgcgctacgtccattgtgtcctccagatcgaacagaggagacgatctatgggacacaataacctggcggcagcgcaaaagatg

SEQ ID NO: 211005 - DNA, 103 bp, Artificial Sequence
  Synthetic Polynucleotide
taatacgactcactatagggctccacacgccgcgctacgtccattgtgtcaacagaggagagacacaatggacgtagcgaacctggcggcagcgcaaaagatg

SEQ ID NO: 211006 - DNA, 103 bp, Artificial Sequence
  Synthetic Polynucleotide
taatacgactcactatagggtcagtaaaaacccatcttcccccacctggtaacagaggagaaccaggatggggaagatgaacctggcggcagcgcaaaagatg

SEQ ID NO: 211007 - DNA, 103 bp, Artificial Sequence
  Synthetic Polynucleotide
taatacgactcactatagggccaggagctcctccacacgccgcgctacgtaacagaggagaacgtagatgggcgtgtggaacctggcggcagcgcaaaagatg

SEQ ID NO: 211008 - DNA, 103 bp, Artificial Sequence
  Synthetic Polynucleotide
taatacgactcactatagggattggccggcccaggagctcctccacacgcaacagaggagagcgtgtatgggagctcctaacctggcggcagcgcaaaagatg

SEQ ID NO: 211009 - DNA, 103 bp, Artificial Sequence
  Synthetic Polynucleotide
taatacgactcactatagggctgactgtccattggccggcccaggagctcaacagaggagagagctcatgggccggccaaacctggcggcagcgcaaaagatg

SEQ ID NO: 211010 - DNA, 103 bp, Artificial Sequence
  Synthetic Polynucleotide
taatacgactcactataggggcgggatccactgactgtccattggccggcaacagaggagagccggcatgtggacagtcaacctggcggcagcgcaaaagatg

SEQ ID NO: 211011 - DNA, 103 bp, Artificial Sequence
  Synthetic Polynucleotide
taatacgactcactataggggattgtgcgtgcgggatccactgactgtccaacagaggagaggacagatggtggatcccaacctggcggcagcgcaaaagatg

SEQ ID NO: 211012 - DNA, 103 bp, Artificial Sequence
  Synthetic Polynucleotide
taatacgactcactatagggagcttgatcttcagtaaaaacccatcttccaacagaggagaggaagaatggtttttactaacctggcggcagcgcaaaagatg

SEQ ID NO: 211013 - DNA, 103 bp, Artificial Sequence
  Synthetic Polynucleotide
taatacgactcactatagggatagtgccccagcttgatcttcagtaaaaaaacagaggagatttttaatgaagatcaagaacctggcggcagcgcaaaagatg

SEQ ID NO: 211014 - DNA, 103 bp, Artificial Sequence
  Synthetic Polynucleotide
taatacgactcactataggggctgtgtggcatagtgccccagcttgatctaacagaggagaagatcaatgtggggcactaacctggcggcagcgcaaaagatg

SEQ ID NO: 211015 - DNA, 103 bp, Artificial Sequence
  Synthetic Polynucleotide
taatacgactcactataggggtgttctggagctgtgtggcatagtgccccaacagaggagaggggcaatgtgccacacaaacctggcggcagcgcaaaagatg

SEQ ID NO: 211016 - DNA, 103 bp, Artificial Sequence
  Synthetic Polynucleotide
taatacgactcactataggggcggtcatacgtgttctggagctgtgtggcaacagaggagagccacaatgctccagaacaacctggcggcagcgcaaaagatg

SEQ ID NO: 211017 - DNA, 103 bp, Artificial Sequence
  Synthetic Polynucleotide
taatacgactcactatagggccatggggcagcggtcatacgtgttctggaaacagaggagatccagaatgcgtatgaccaacctggcggcagcgcaaaagatg

SEQ ID NO: 211018 - DNA, 103 bp, Artificial Sequence
  Synthetic Polynucleotide
taatacgactcactatagggtgatgaagggcttctccttggagctgctgaaacagaggagatcagcaatgccaaggagaaacctggcggcagcgcaaaagatg

SEQ ID NO: 211019 - DNA, 103 bp, Artificial Sequence
  Synthetic Polynucleotide
taatacgactcactatagggcggaccagctccatggggcagcggtcatacaacagaggagagtatgaatgctgccccataacctggcggcagcgcaaaagatg

SEQ ID NO: 211020 - DNA, 103 bp, Artificial Sequence
  Synthetic Polynucleotide
taatacgactcactataggggcggatgcagcggaccagctccatggggcaaacagaggagatgccccatggagctggtcaacctggcggcagcgcaaaagatg

SEQ ID NO: 211021 - DNA, 103 bp, Artificial Sequence
  Synthetic Polynucleotide
taatacgactcactatagggacaatatatggcggatgcagcggaccagctaacagaggagaagctggatggctgcatccaacctggcggcagcgcaaaagatg

SEQ ID NO: 211022 - DNA, 103 bp, Artificial Sequence
  Synthetic Polynucleotide
taatacgactcactatagggtgttcattgtacaatatatggcggatgcagaacagaggagactgcatatgccatatattaacctggcggcagcgcaaaagatg

SEQ ID NO: 211023 - DNA, 103 bp, Artificial Sequence
  Synthetic Polynucleotide
taatacgactcactataggggaccaacctctgttcattgtacaatatatgaacagaggagacatataatgtacaatgaaaacctggcggcagcgcaaaagatg

SEQ ID NO: 211024 - DNA, 103 bp, Artificial Sequence
  Synthetic Polynucleotide
taatacgactcactatagggtggcttctcggaccaacctctgttcattgtaacagaggagaacaatgatgagaggttggaacctggcggcagcgcaaaagatg

SEQ ID NO: 211025 - DNA, 103 bp, Artificial Sequence
  Synthetic Polynucleotide
taatacgactcactatagggctaccattgttggcttctcggaccaacctcaacagaggagagaggttatgccgagaagcaacctggcggcagcgcaaaagatg

SEQ ID NO: 211026 - DNA, 103 bp, Artificial Sequence
  Synthetic Polynucleotide
taatacgactcactatagggagctggagagctaccattgttggcttctcgaacagaggagacgagaaatgaacaatggtaacctggcggcagcgcaaaagatg

SEQ ID NO: 211027 - DNA, 103 bp, Artificial Sequence
  Synthetic Polynucleotide
taatacgactcactatagggcaaggcttccagctggagagctaccattgtaacagaggagaacaatgatggctctccagaacctggcggcagcgcaaaagatg

SEQ ID NO: 211028 - DNA, 103 bp, Artificial Sequence
  Synthetic Polynucleotide
taatacgactcactatagggatggcatcagcaaggcttccagctggagagaacagaggagactctccatgtggaagcctaacctggcggcagcgcaaaagatg

SEQ ID NO: 211029 - DNA, 103 bp, Artificial Sequence
  Synthetic Polynucleotide
taatacgactcactatagggcgcttgcatctgatgaagggcttctccttgaacagaggagacaaggaatggcccttcataacctggcggcagcgcaaaagatg

SEQ ID NO: 211030 - DNA, 103 bp, Artificial Sequence
  Synthetic Polynucleotide
taatacgactcactatagggtttctgggacatggcatcagcaaggcttccaacagaggagaggaagcatggctgatgccaacctggcggcagcgcaaaagatg

SEQ ID NO: 211031 - DNA, 103 bp, Artificial Sequence
  Synthetic Polynucleotide
taatacgactcactatagggtctggaggtgtttctgggacatggcatcagaacagaggagactgatgatgtgtcccagaaacctggcggcagcgcaaaagatg

SEQ ID NO: 211032 - DNA, 103 bp, Artificial Sequence
  Synthetic Polynucleotide
taatacgactcactataggggtctggttgatctggaggtgtttctgggacaacagaggagagtcccaatgacacctccaaacctggcggcagcgcaaaagatg

SEQ ID NO: 211033 - DNA, 103 bp, Artificial Sequence
  Synthetic Polynucleotide
taatacgactcactatagggctcctcaaacgtctggttgatctggaggtgaacagaggagacacctcatgatcaaccagaacctggcggcagcgcaaaagatg

SEQ ID NO: 211034 - DNA, 103 bp, Artificial Sequence
  Synthetic Polynucleotide
taatacgactcactatagggccagtcgcagctcctcaaacgtctggttgaaacagaggagatcaaccatgcgtttgaggaacctggcggcagcgcaaaagatg

SEQ ID NO: 211035 - DNA, 103 bp, Artificial Sequence
  Synthetic Polynucleotide
taatacgactcactatagggtcctgcgtgaccagtcgcagctcctcaaacaacagaggagagtttgaatggctgcgactaacctggcggcagcgcaaaagatg

SEQ ID NO: 211036 - DNA, 103 bp, Artificial Sequence
  Synthetic Polynucleotide
taatacgactcactatagggattctctgtgtcctgcgtgaccagtcgcagaacagaggagactgcgaatggtcacgcagaacctggcggcagcgcaaaagatg

SEQ ID NO: 211037 - DNA, 103 bp, Artificial Sequence
  Synthetic Polynucleotide
taatacgactcactatagggtttttaactcattctctgtgtcctgcgtgaaacagaggagatcacgcatgacacagagaaacctggcggcagcgcaaaagatg

SEQ ID NO: 211038 - DNA, 103 bp, Artificial Sequence
  Synthetic Polynucleotide
taatacgactcactatagggtgctgcagcttttttaactcattctctgtgaacagaggagacacagaatgtgagttaaaaacctggcggcagcgcaaaagatg

SEQ ID NO: 211039 - DNA, 103 bp, Artificial Sequence
  Synthetic Polynucleotide
taatacgactcactatagggctcctgagtctgctgcagcttttttaactcaacagaggagagagttaatgaagctgcagaacctggcggcagcgcaaaagatg

SEQ ID NO: 211040 - DNA, 103 bp, Artificial Sequence
  Synthetic Polynucleotide
taatacgactcactatagggggccatataacgcttgcatctgatgaagggaacagaggagacccttcatgagatgcaagaacctggcggcagcgcaaaagatg

SEQ ID NO: 211041 - DNA, 103 bp, Artificial Sequence
  Synthetic Polynucleotide
taatacgactcactatagggtgatgaagtactcctgagtctgctgcagctaacagaggagaagctgcatgagactcaggaacctggcggcagcgcaaaagatg

SEQ ID NO: 211042 - DNA, 103 bp, Artificial Sequence
  Synthetic Polynucleotide
taatacgactcactatagggtggtactggatgatgaagtactcctgagtcaacagaggagagactcaatggtacttcataacctggcggcagcgcaaaagatg

SEQ ID NO: 211043 - DNA, 103 bp, Artificial Sequence
  Synthetic Polynucleotide
taatacgactcactatagggcaggctctcctggtactggatgatgaagtaaacagaggagatacttcatgatccagtacaacctggcggcagcgcaaaagatg

SEQ ID NO: 211044 - DNA, 103 bp, Artificial Sequence
  Synthetic Polynucleotide
taatacgactcactatagggcttggatcctcaggctctcctggtactggaaacagaggagatccagtatgaggagagccaacctggcggcagcgcaaaagatg

SEQ ID NO: 211045 - DNA, 103 bp, Artificial Sequence
  Synthetic Polynucleotide
taatacgactcactatagggccaaactgagcttggatcctcaggctctccaacagaggagaggagagatggaggatccaaacctggcggcagcgcaaaagatg

SEQ ID NO: 211046 - DNA, 103 bp, Artificial Sequence
  Synthetic Polynucleotide
taatacgactcactatagggggccagcgggccaaactgagcttggatcctaacagaggagaaggatcatggctcagtttaacctggcggcagcgcaaaagatg

SEQ ID NO: 211047 - DNA, 103 bp, Artificial Sequence
  Synthetic Polynucleotide
taatacgactcactatagggggctcagctgggccagcgggccaaactgagaacagaggagactcagtatggcccgctggaacctggcggcagcgcaaaagatg

SEQ ID NO: 211048 - DNA, 103 bp, Artificial Sequence
  Synthetic Polynucleotide
taatacgactcactatagggcgctcctgggggctcagctgggccagcgggaacagaggagacccgctatgccagctgagaacctggcggcagcgcaaaagatg

SEQ ID NO: 211049 - DNA, 103 bp, Artificial Sequence
  Synthetic Polynucleotide
taatacgactcactatagggccggctcagacgctcctgggggctcagctgaacagaggagacagctgatgccccaggagaacctggcggcagcgcaaaagatg

SEQ ID NO: 211050 - DNA, 103 bp, Artificial Sequence
  Synthetic Polynucleotide
taatacgactcactataggggggccgtctcccggctcagacgctcctgggaacagaggagacccaggatggtctgagccaacctggcggcagcgcaaaagatg

SEQ ID NO: 211051 - DNA, 103 bp, Artificial Sequence
  Synthetic Polynucleotide
taatacgactcactatagggggaaaatgctggccatataacgcttgcatcaacagaggagagatgcaatggttatatggaacctggcggcagcgcaaaagatg

SEQ ID NO: 211052 - DNA, 103 bp, Artificial Sequence
  Synthetic Polynucleotide
taatacgactcactatagggttctgctggagggccgtctcccggctcagaaacagaggagatctgagatgggagacggcaacctggcggcagcgcaaaagatg

SEQ ID NO: 211053 - DNA, 103 bp, Artificial Sequence
  Synthetic Polynucleotide
taatacgactcactatagggagacacctgcttctgctggagggccgtctcaacagaggagagagacgatgctccagcagaacctggcggcagcgcaaaagatg

SEQ ID NO: 211054 - DNA, 103 bp, Artificial Sequence
  Synthetic Polynucleotide
taatacgactcactatagggaggcctccagagacacctgcttctgctggaaacagaggagatccagcatgagcaggtgtaacctggcggcagcgcaaaagatg

SEQ ID NO: 211055 - DNA, 103 bp, Artificial Sequence
  Synthetic Polynucleotide
taatacgactcactatagggcgctgcaaccaggcctccagagacacctgcaacagaggagagcaggtatgtctggaggcaacctggcggcagcgcaaaagatg

SEQ ID NO: 211056 - DNA, 103 bp, Artificial Sequence
  Synthetic Polynucleotide
taatacgactcactatagggctgtgcctcacgctgcaaccaggcctccagaacagaggagactggagatgtggttgcagaacctggcggcagcgcaaaagatg

SEQ ID NO: 211057 - DNA, 103 bp, Artificial Sequence
  Synthetic Polynucleotide
taatacgactcactataggggctgcagtgtctgtgcctcacgctgcaaccaacagaggagaggttgcatggtgaggcacaacctggcggcagcgcaaaagatg

SEQ ID NO: 211058 - DNA, 103 bp, Artificial Sequence
  Synthetic Polynucleotide
taatacgactcactatagggacgcggtactgctgcagtgtctgtgcctcaaacagaggagatgaggcatggacactgcaaacctggcggcagcgcaaaagatg

SEQ ID NO: 211059 - DNA, 103 bp, Artificial Sequence
  Synthetic Polynucleotide
taatacgactcactatagggggccagctccacgcggtactgctgcagtgtaacagaggagaacactgatgcagtaccgcaacctggcggcagcgcaaaagatg

SEQ ID NO: 211060 - DNA, 103 bp, Artificial Sequence
  Synthetic Polynucleotide
taatacgactcactatagggggtgcttctcggccagctccacgcggtactaacagaggagaagtaccatgtggagctggaacctggcggcagcgcaaaagatg

SEQ ID NO: 211061 - DNA, 103 bp, Artificial Sequence
  Synthetic Polynucleotide
taatacgactcactatagggagggtcttctggtgcttctcggccagctccaacagaggagaggagctatgcgagaagcaaacctggcggcagcgcaaaagatg

SEQ ID NO: 211062 - DNA, 103 bp, Artificial Sequence
  Synthetic Polynucleotide
taatacgactcactatagggcacctcaatgggaaaatgctggccatataaaacagaggagattatatatgcagcattttaacctggcggcagcgcaaaagatg

SEQ ID NO: 211063 - DNA, 103 bp, Artificial Sequence
  Synthetic Polynucleotide
taatacgactcactatagggcagcagctgcagggtcttctggtgcttctcaacagaggagagagaagatgcagaagaccaacctggcggcagcgcaaaagatg

SEQ ID NO: 211064 - DNA, 103 bp, Artificial Sequence
  Synthetic Polynucleotide
taatacgactcactataggggctgcttccgcagcagctgcagggtcttctaacagaggagaagaagaatgtgcagctgcaacctggcggcagcgcaaaagatg

SEQ ID NO: 211065 - DNA, 103 bp, Artificial Sequence
  Synthetic Polynucleotide
taatacgactcactatagggatgatggtctgctgcttccgcagcagctgcaacagaggagagcagctatggcggaagcaaacctggcggcagcgcaaaagatg

SEQ ID NO: 211066 - DNA, 103 bp, Artificial Sequence
  Synthetic Polynucleotide
taatacgactcactataggggtcatccaggatgatggtctgctgcttccgaacagaggagacggaagatgcagaccatcaacctggcggcagcgcaaaagatg

SEQ ID NO: 211067 - DNA, 103 bp, Artificial Sequence
  Synthetic Polynucleotide
taatacgactcactatagggggatcagctcgtcatccaggatgatggtctaacagaggagaagaccaatgtcctggatgaacctggcggcagcgcaaaagatg

SEQ ID NO: 211068 - DNA, 103 bp, Artificial Sequence
  Synthetic Polynucleotide
taatacgactcactatagggcgcttccactggatcagctcgtcatccaggaacagaggagacctggaatgcgagctgataacctggcggcagcgcaaaagatg

SEQ ID NO: 211069 - DNA, 103 bp, Artificial Sequence
  Synthetic Polynucleotide
taatacgactcactatagggctgctgccgccgcttccactggatcagctcaacagaggagagagctgatgcagtggaagaacctggcggcagcgcaaaagatg

SEQ ID NO: 211070 - DNA, 103 bp, Artificial Sequence
  Synthetic Polynucleotide
taatacgactcactatagggtcccggccagctgctgccgccgcttccactaacagaggagaagtggaatgggcggcagcaacctggcggcagcgcaaaagatg

SEQ ID NO: 211071 - DNA, 103 bp, Artificial Sequence
  Synthetic Polynucleotide
taatacgactcactatagggggcccgccgttcccggccagctgctgccgcaacagaggagagcggcaatggctggccggaacctggcggcagcgcaaaagatg

SEQ ID NO: 211072 - DNA, 103 bp, Artificial Sequence
  Synthetic Polynucleotide
taatacgactcactataggggccctcggggggcccgccgttcccggccagaacagaggagactggccatgaacggcgggaacctggcggcagcgcaaaagatg

SEQ ID NO: 211073 - DNA, 103 bp, Artificial Sequence
  Synthetic Polynucleotide
taatacgactcactatagggaataatgccgcacctcaatgggaaaatgctaacagaggagaagcattatgccattgaggaacctggcggcagcgcaaaagatg

SEQ ID NO: 211074 - DNA, 103 bp, Artificial Sequence
  Synthetic Polynucleotide
taatacgactcactatagggcgtccaggctgccctcggggggcccgccgtaacagaggagaacggcgatgcccccgaggaacctggcggcagcgcaaaagatg

SEQ ID NO: 211075 - DNA, 103 bp, Artificial Sequence
  Synthetic Polynucleotide
taatacgactcactataggggactgtagcacgtccaggctgccctcggggaacagaggagaccccgaatgcagcctggaaacctggcggcagcgcaaaagatg

SEQ ID NO: 211076 - DNA, 103 bp, Artificial Sequence
  Synthetic Polynucleotide
taatacgactcactatagggctcacaccaggactgtagcacgtccaggctaacagaggagaagcctgatggtgctacagaacctggcggcagcgcaaaagatg

SEQ ID NO: 211077 - DNA, 103 bp, Artificial Sequence
  Synthetic Polynucleotide
taatacgactcactatagggcggccaacttctcacaccaggactgtagcaaacagaggagatgctacatgcctggtgtgaacctggcggcagcgcaaaagatg

SEQ ID NO: 211078 - DNA, 103 bp, Artificial Sequence
  Synthetic Polynucleotide
taatacgactcactatagggcagatgatctcggccaacttctcacaccagaacagaggagactggtgatggaagttggcaacctggcggcagcgcaaaagatg

SEQ ID NO: 211079 - DNA, 103 bp, Artificial Sequence
  Synthetic Polynucleotide
taatacgactcactatagggccggttctgccagatgatctcggccaacttaacagaggagaaagttgatggagatcatcaacctggcggcagcgcaaaagatg

SEQ ID NO: 211080 - DNA, 103 bp, Artificial Sequence
  Synthetic Polynucleotide
taatacgactcactatagggggatctgctgccggttctgccagatgatctaacagaggagaagatcaatgggcagaaccaacctggcggcagcgcaaaagatg

SEQ ID NO: 211081 - DNA, 103 bp, Artificial Sequence
  Synthetic Polynucleotide
taatacgactcactatagggtcagccctgcggatctgctgccggttctgcaacagaggagagcagaaatggcagcagataacctggcggcagcgcaaaagatg

SEQ ID NO: 211082 - DNA, 103 bp, Artificial Sequence
  Synthetic Polynucleotide
taatacgactcactataggggcagaggtgctcagccctgcggatctgctgaacagaggagacagcagatgcgcagggctaacctggcggcagcgcaaaagatg

SEQ ID NO: 211083 - DNA, 103 bp, Artificial Sequence
  Synthetic Polynucleotide
taatacgactcactataggggcagctgctggcagaggtgctcagccctgcaacagaggagagcagggatgagcacctctaacctggcggcagcgcaaaagatg

SEQ ID NO: 211084 - DNA, 103 bp, Artificial Sequence
  Synthetic Polynucleotide
taatacgactcactatagggcactgggataaataatgccgcacctcaatgaacagaggagacattgaatggcggcattaaacctggcggcagcgcaaaagatg

SEQ ID NO: 211085 - DNA, 103 bp, Artificial Sequence
  Synthetic Polynucleotide
taatacgactcactatagggccggggatgggcagctgctggcagaggtgcaacagaggagagcacctatgccagcagctaacctggcggcagcgcaaaagatg

SEQ ID NO: 211086 - DNA, 103 bp, Artificial Sequence
  Synthetic Polynucleotide
taatacgactcactatagggctccactgggccggggatgggcagctgctgaacagaggagacagcagatgcccatccccaacctggcggcagcgcaaaagatg

SEQ ID NO: 211087 - DNA, 103 bp, Artificial Sequence
  Synthetic Polynucleotide
taatacgactcactatagggccagcatctcctccactgggccggggatggaacagaggagaccatccatggcccagtggaacctggcggcagcgcaaaagatg

SEQ ID NO: 211088 - DNA, 103 bp, Artificial Sequence
  Synthetic Polynucleotide
taatacgactcactatagggttgacctcggccagcatctcctccactgggaacagaggagacccagtatgggagatgctaacctggcggcagcgcaaaagatg

SEQ ID NO: 211089 - DNA, 103 bp, Artificial Sequence
  Synthetic Polynucleotide
taatacgactcactataggggatggtggcgttgacctcggccagcatctcaacagaggagagagatgatggccgaggtcaacctggcggcagcgcaaaagatg

SEQ ID NO: 211090 - DNA, 103 bp, Artificial Sequence
  Synthetic Polynucleotide
taatacgactcactatagggtaatgtccgtgatggtggcgttgacctcggaacagaggagaccgaggatgacgccaccaaacctggcggcagcgcaaaagatg

SEQ ID NO: 211091 - DNA, 103 bp, Artificial Sequence
  Synthetic Polynucleotide
taatacgactcactatagggagggctgagataatgtccgtgatggtggcgaacagaggagacgccacatgcacggacataacctggcggcagcgcaaaagatg

SEQ ID NO: 211092 - DNA, 103 bp, Artificial Sequence
  Synthetic Polynucleotide
taatacgactcactataggggctggtcaccagggctgagataatgtccgtaacagaggagaacggacatgatctcagccaacctggcggcagcgcaaaagatg

SEQ ID NO: 211093 - DNA, 103 bp, Artificial Sequence
  Synthetic Polynucleotide
taatacgactcactatagggtgatgaacgtgctggtcaccagggctgagaaacagaggagatctcagatgtggtgaccaaacctggcggcagcgcaaaagatg

SEQ ID NO: 211094 - DNA, 103 bp, Artificial Sequence
  Synthetic Polynucleotide
taatacgactcactatagggtgcttctcaatgatgaacgtgctggtcaccaacagaggagaggtgacatgcacgttcataacctggcggcagcgcaaaagatg

SEQ ID NO: 211095 - DNA, 103 bp, Artificial Sequence
  Synthetic Polynucleotide
taatacgactcactatagggcatcttggagaccagaccccacagagacataacagaggagaatgtctatgtggggtctgaacctggcggcagcgcaaaagatg

SEQ ID NO: 211096 - DNA, 103 bp, Artificial Sequence
  Synthetic Polynucleotide
taatacgactcactatagggctcccagggctggctctccagccagtcaccaacagaggagaggtgacatgctggagagcaacctggcggcagcgcaaaagatg

SEQ ID NO: 211097 - DNA, 103 bp, Artificial Sequence
  Synthetic Polynucleotide
taatacgactcactataggggatttctccagtgctttctgctccagccccaacagaggagaggggctatggcagaaagcaacctggcggcagcgcaaaagatg

SEQ ID NO: 211098 - DNA, 103 bp, Artificial Sequence
  Synthetic Polynucleotide
taatacgactcactatagggtgttgttgatgatttctccagtgctttctgaacagaggagacagaaaatgctggagaaaaacctggcggcagcgcaaaagatg

SEQ ID NO: 211099 - DNA, 103 bp, Artificial Sequence
  Synthetic Polynucleotide
taatacgactcactatagggaagggcacagtgttgttgatgatttctccaaacagaggagatggagaatgcatcaacaaaacctggcggcagcgcaaaagatg

SEQ ID NO: 211100 - DNA, 103 bp, Artificial Sequence
  Synthetic Polynucleotide
taatacgactcactataggggctgttctccaagggcacagtgttgttgataacagaggagaatcaacatgactgtgcccaacctggcggcagcgcaaaagatg

SEQ ID NO: 211101 - DNA, 103 bp, Artificial Sequence
  Synthetic Polynucleotide
taatacgactcactatagggtcccaggaatgctgttctccaagggcacagaacagaggagactgtgcatgtggagaacaaacctggcggcagcgcaaaagatg

SEQ ID NO: 211102 - DNA, 103 bp, Artificial Sequence
  Synthetic Polynucleotide
taatacgactcactataggggagcagcagttcccaggaatgctgttctccaacagaggagaggagaaatgcattcctggaacctggcggcagcgcaaaagatg

SEQ ID NO: 211103 - DNA, 103 bp, Artificial Sequence
  Synthetic Polynucleotide
taatacgactcactataggggaacagggcagagcagcagttcccaggaataacagaggagaattcctatgaactgctgcaacctggcggcagcgcaaaagatg

SEQ ID NO: 211104 - DNA, 103 bp, Artificial Sequence
  Synthetic Polynucleotide
taatacgactcactataggggcaggttcttgaacagggcagagcagcagtaacagaggagaactgctatgctgccctgtaacctggcggcagcgcaaaagatg

SEQ ID NO: 211105 - DNA, 103 bp, Artificial Sequence
  Synthetic Polynucleotide
taatacgactcactatagggttcttgagaagcaggttcttgaacagggcaaacagaggagatgccctatgcaagaacctaacctggcggcagcgcaaaagatg

SEQ ID NO: 211106 - DNA, 103 bp, Artificial Sequence
  Synthetic Polynucleotide
taatacgactcactatagggccgcttgatcttcttgagaagcaggttcttaacagaggagaaagaacatgcttctcaagaacctggcggcagcgcaaaagatg

SEQ ID NO: 211107 - DNA, 103 bp, Artificial Sequence
  Synthetic Polynucleotide
taatacgactcactatagggcgaccaggaactcccagggctggctctccaaacagaggagatggagaatgagccctgggaacctggcggcagcgcaaaagatg

SEQ ID NO: 211108 - DNA, 103 bp, Artificial Sequence
  Synthetic Polynucleotide
taatacgactcactatagggtccgctcacaccgcttgatcttcttgagaaaacagaggagattctcaatgagatcaagcaacctggcggcagcgcaaaagatg

SEQ ID NO: 211109 - DNA, 103 bp, Artificial Sequence
  Synthetic Polynucleotide
taatacgactcactatagggtcagtgcccttccgctcacaccgcttgatcaacagaggagagatcaaatggtgtgagcgaacctggcggcagcgcaaaagatg

SEQ ID NO: 211110 - DNA, 103 bp, Artificial Sequence
  Synthetic Polynucleotide
taatacgactcactatagggtgtgacagactcagtgcccttccgctcacaaacagaggagatgtgagatgaagggcactaacctggcggcagcgcaaaagatg

SEQ ID NO: 211111 - DNA, 103 bp, Artificial Sequence
  Synthetic Polynucleotide
taatacgactcactatagggacttctcctctgtgacagactcagtgccctaacagaggagaagggcaatgagtctgtcaaacctggcggcagcgcaaaagatg

SEQ ID NO: 211112 - DNA, 103 bp, Artificial Sequence
  Synthetic Polynucleotide
taatacgactcactatagggagcacagcgcacttctcctctgtgacagacaacagaggagagtctgtatgagaggagaaaacctggcggcagcgcaaaagatg

SEQ ID NO: 211113 - DNA, 103 bp, Artificial Sequence
  Synthetic Polynucleotide
taatacgactcactatagggggcagagaagagcacagcgcacttctcctcaacagaggagagaggagatgtgcgctgtgaacctggcggcagcgcaaaagatg

SEQ ID NO: 211114 - DNA, 103 bp, Artificial Sequence
  Synthetic Polynucleotide
taatacgactcactataggggtgtgaagctggcagagaagagcacagcgcaacagaggagagcgctgatgtcttctctgaacctggcggcagcgcaaaagatg

SEQ ID NO: 211115 - DNA, 103 bp, Artificial Sequence
  Synthetic Polynucleotide
taatacgactcactatagggccggggccaagtgtgaagctggcagagaagaacagaggagacttctcatgcagcttcacaacctggcggcagcgcaaaagatg

SEQ ID NO: 211116 - DNA, 103 bp, Artificial Sequence
  Synthetic Polynucleotide
taatacgactcactatagggggggagtttgccggggccaagtgtgaagctaacagaggagaagcttcatgcttggccccaacctggcggcagcgcaaaagatg

SEQ ID NO: 211117 - DNA, 103 bp, Artificial Sequence
  Synthetic Polynucleotide
taatacgactcactatagggggagctggatggggagtttgccggggccaaaacagaggagattggccatggcaaactccaacctggcggcagcgcaaaagatg

SEQ ID NO: 211118 - DNA, 103 bp, Artificial Sequence
  Synthetic Polynucleotide
taatacgactcactataggggcgtcggagccgaccaggaactcccagggcaacagaggagagccctgatggttcctggtaacctggcggcagcgcaaaagatg

SEQ ID NO: 211119 - DNA, 103 bp, Artificial Sequence
  Synthetic Polynucleotide
taatacgactcactataggggacagggcctggagctggatggggagtttgaacagaggagacaaactatgcatccagctaacctggcggcagcgcaaaagatg

SEQ ID NO: 211120 - DNA, 103 bp, Artificial Sequence
  Synthetic Polynucleotide
taatacgactcactatagggcaggggcagagacagggcctggagctggataacagaggagaatccagatgcaggccctgaacctggcggcagcgcaaaagatg

SEQ ID NO: 211121 - DNA, 103 bp, Artificial Sequence
  Synthetic Polynucleotide
taatacgactcactatagggcgatgaccaccaggggcagagacagggcctaacagaggagaaggcccatgctctgccccaacctggcggcagcgcaaaagatg

SEQ ID NO: 211122 - DNA, 103 bp, Artificial Sequence
  Synthetic Polynucleotide
taatacgactcactatagggttgccatggacgatgaccaccaggggcagaaacagaggagatctgccatgggtggtcataacctggcggcagcgcaaaagatg

SEQ ID NO: 211123 - DNA, 103 bp, Artificial Sequence
  Synthetic Polynucleotide
taatacgactcactataggggttgtcttggttgccatggacgatgaccacaacagaggagagtggtcatggtccatggcaacctggcggcagcgcaaaagatg

SEQ ID NO: 211124 - DNA, 103 bp, Artificial Sequence
  Synthetic Polynucleotide
taatacgactcactatagggctttggcattgttgtcttggttgccatggaaacagaggagatccatgatgaccaagacaaacctggcggcagcgcaaaagatg

SEQ ID NO: 211125 - DNA, 103 bp, Artificial Sequence
  Synthetic Polynucleotide
taatacgactcactatagggaggatagtggctttggcattgttgtcttggaacagaggagaccaagaatgcaatgccaaaacctggcggcagcgcaaaagatg

SEQ ID NO: 211126 - DNA, 103 bp, Artificial Sequence
  Synthetic Polynucleotide
taatacgactcactatagggattgtcccacaggatagtggctttggcattaacagaggagaaatgccatggccactatcaacctggcggcagcgcaaaagatg

SEQ ID NO: 211127 - DNA, 103 bp, Artificial Sequence
  Synthetic Polynucleotide
taatacgactcactatagggcagagaaggcattgtcccacaggatagtggaacagaggagaccactaatgtgtgggacaaacctggcggcagcgcaaaagatg

SEQ ID NO: 211128 - DNA, 103 bp, Artificial Sequence
  Synthetic Polynucleotide
taatacgactcactatagggcggtccatctcagagaaggcattgtcccacaacagaggagagtgggaatgtgccttctcaacctggcggcagcgcaaaagatg

SEQ ID NO: 211129 - DNA, 103 bp, Artificial Sequence
  Synthetic Polynucleotide
taatacgactcactataggggcagcagaaggcgtcggagccgaccaggaaaacagaggagattcctgatgggctccgacaacctggcggcagcgcaaaagatg

SEQ ID NO: 211130 - DNA, 103 bp, Artificial Sequence
  Synthetic Polynucleotide
taatacgactcactatagggaaagggcacgcggtccatctcagagaaggcaacagaggagagccttcatggagatggacaacctggcggcagcgcaaaagatg

SEQ ID NO: 211131 - DNA, 103 bp, Artificial Sequence
  Synthetic Polynucleotide
taatacgactcactatagggcagccaccacaaagggcacgcggtccatctaacagaggagaagatggatggcgtgccctaacctggcggcagcgcaaaagatg

SEQ ID NO: 211132 - DNA, 103 bp, Artificial Sequence
  Synthetic Polynucleotide
taatacgactcactatagggggcacccgctcagccaccacaaagggcacgaacagaggagacgtgccatgtgtggtggcaacctggcggcagcgcaaaagatg

SEQ ID NO: 211133 - DNA, 103 bp, Artificial Sequence
  Synthetic Polynucleotide
taatacgactcactatagggcttctcccagggcacccgctcagccaccacaacagaggagagtggtgatggagcgggtgaacctggcggcagcgcaaaagatg

SEQ ID NO: 211134 - DNA, 103 bp, Artificial Sequence
  Synthetic Polynucleotide
taatacgactcactatagggtttcacacatcttctcccagggcacccgctaacagaggagaagcgggatgcctgggagaaacctggcggcagcgcaaaagatg

SEQ ID NO: 211135 - DNA, 103 bp, Artificial Sequence
  Synthetic Polynucleotide
taatacgactcactatagggaggttcagagtttcacacatcttctcccagaacagaggagactgggaatggatgtgtgaaacctggcggcagcgcaaaagatg

SEQ ID NO: 211136 - DNA, 103 bp, Artificial Sequence
  Synthetic Polynucleotide
taatacgactcactatagggcatgaacttcaggttcagagtttcacacataacagaggagaatgtgtatgactctgaacaacctggcggcagcgcaaaagatg

SEQ ID NO: 211137 - DNA, 103 bp, Artificial Sequence
  Synthetic Polynucleotide
taatacgactcactatagggccacctcagccatgaacttcaggttcagagaacagaggagactctgaatgtgaagttcaaacctggcggcagcgcaaaagatg

SEQ ID NO: 211138 - DNA, 103 bp, Artificial Sequence
  Synthetic Polynucleotide
taatacgactcactatagggcggttggtccccacctcagccatgaacttcaacagaggagagaagttatgggctgaggtaacctggcggcagcgcaaaagatg

SEQ ID NO: 211139 - DNA, 103 bp, Artificial Sequence
  Synthetic Polynucleotide
taatacgactcactataggggagcagcccccggttggtccccacctcagcaacagaggagagctgagatggggaccaacaacctggcggcagcgcaaaagatg

SEQ ID NO: 211140 - DNA, 103 bp, Artificial Sequence
  Synthetic Polynucleotide
taatacgactcactatagggtagccaagttgcagcagaaggcgtcggagcaacagaggagagctccgatgccttctgctaacctggcggcagcgcaaaagatg

SEQ ID NO: 211141 - DNA, 103 bp, Artificial Sequence
  Synthetic Polynucleotide
taatacgactcactatagggagtgctctgggagcagcccccggttggtccaacagaggagaggaccaatggggggctgcaacctggcggcagcgcaaaagatg

SEQ ID NO: 211142 - DNA, 103 bp, Artificial Sequence
  Synthetic Polynucleotide
taatacgactcactatagggaggaagaggaagtgctctgggagcagccccaacagaggagaggggctatgcccagagcaaacctggcggcagcgcaaaagatg

SEQ ID NO: 211143 - DNA, 103 bp, Artificial Sequence
  Synthetic Polynucleotide
taatacgactcactatagggcttctgggccaggaagaggaagtgctctggaacagaggagaccagagatgttcctcttcaacctggcggcagcgcaaaagatg

SEQ ID NO: 211144 - DNA, 103 bp, Artificial Sequence
  Synthetic Polynucleotide
taatacgactcactatagggcattgaagatcttctgggccaggaagaggaaacagaggagatcctctatgtggcccagaaacctggcggcagcgcaaaagatg

SEQ ID NO: 211145 - DNA, 103 bp, Artificial Sequence
  Synthetic Polynucleotide
taatacgactcactatagggaggctgttgtcattgaagatcttctgggccaacagaggagaggcccaatggatcttcaaaacctggcggcagcgcaaaagatg

SEQ ID NO: 211146 - DNA, 103 bp, Artificial Sequence
  Synthetic Polynucleotide
taatacgactcactatagggctccatactgaggctgttgtcattgaagataacagaggagaatcttcatggacaacagcaacctggcggcagcgcaaaagatg

SEQ ID NO: 211147 - DNA, 103 bp, Artificial Sequence
  Synthetic Polynucleotide
taatacgactcactataggggctggaaggcctccatactgaggctgttgtaacagaggagaacaacaatgtcagtatggaacctggcggcagcgcaaaagatg

SEQ ID NO: 211148 - DNA, 103 bp, Artificial Sequence
  Synthetic Polynucleotide
taatacgactcactatagggacagaacggtgctggaaggcctccatactgaacagaggagacagtatatgggccttccaaacctggcggcagcgcaaaagatg

SEQ ID NO: 211149 - DNA, 103 bp, Artificial Sequence
  Synthetic Polynucleotide
taatacgactcactatagggcgaccaggacacagaacggtgctggaaggcaacagaggagagccttcatgcaccgttctaacctggcggcagcgcaaaagatg

SEQ ID NO: 211150 - DNA, 103 bp, Artificial Sequence
  Synthetic Polynucleotide
taatacgactcactatagggtgttgaactgcgaccaggacacagaacggtaacagaggagaaccgttatgtgtcctggtaacctggcggcagcgcaaaagatg

SEQ ID NO: 211151 - DNA, 103 bp, Artificial Sequence
  Synthetic Polynucleotide
taatacgactcactatagggagtagggcactagccaagttgcagcagaagaacagaggagacttctgatgcaacttggcaacctggcggcagcgcaaaagatg

SEQ ID NO: 211152 - DNA, 103 bp, Artificial Sequence
  Synthetic Polynucleotide
taatacgactcactatagggaggatctccttgttgaactgcgaccaggacaacagaggagagtcctgatggcagttcaaaacctggcggcagcgcaaaagatg

SEQ ID NO: 211153 - DNA, 103 bp, Artificial Sequence
  Synthetic Polynucleotide
taatacgactcactatagggacggcccagcaggatctccttgttgaactgaacagaggagacagttcatgaaggagatcaacctggcggcagcgcaaaagatg

SEQ ID NO: 211154 - DNA, 103 bp, Artificial Sequence
  Synthetic Polynucleotide
taatacgactcactatagggaggtgaagccacggcccagcaggatctcctaacagaggagaaggagaatgtgctgggccaacctggcggcagcgcaaaagatg

SEQ ID NO: 211155 - DNA, 103 bp, Artificial Sequence
  Synthetic Polynucleotide
taatacgactcactatagggcactgccaaaaggtgaagccacggcccagcaacagaggagagctgggatgtggcttcacaacctggcggcagcgcaaaagatg

SEQ ID NO: 211156 - DNA, 103 bp, Artificial Sequence
  Synthetic Polynucleotide
taatacgactcactatagggaccatcaaaccactgccaaaaggtgaagccaacagaggagaggcttcatgttttggcagaacctggcggcagcgcaaaagatg

SEQ ID NO: 211157 - DNA, 103 bp, Artificial Sequence
  Synthetic Polynucleotide
taatacgactcactatagggggtccaggacaccatcaaaccactgccaaaaacagaggagatttggcatgggtttgatgaacctggcggcagcgcaaaagatg

SEQ ID NO: 211158 - DNA, 103 bp, Artificial Sequence
  Synthetic Polynucleotide
taatacgactcactatagggcgtttggtgaggtccaggacaccatcaaacaacagaggagagtttgaatgtgtcctggaaacctggcggcagcgcaaaagatg

SEQ ID NO: 211159 - DNA, 103 bp, Artificial Sequence
  Synthetic Polynucleotide
taatacgactcactatagggccggagacagcgtttggtgaggtccaggacaacagaggagagtcctgatgctcaccaaaaacctggcggcagcgcaaaagatg

SEQ ID NO: 211160 - DNA, 103 bp, Artificial Sequence
  Synthetic Polynucleotide
taatacgactcactatagggaccagtagctccggagacagcgtttggtgaaacagaggagatcaccaatggctgtctccaacctggcggcagcgcaaaagatg

SEQ ID NO: 211161 - DNA, 103 bp, Artificial Sequence
  Synthetic Polynucleotide
taatacgactcactatagggagccggtcagaccagtagctccggagacagaacagaggagactgtctatggagctactgaacctggcggcagcgcaaaagatg

SEQ ID NO: 211162 - DNA, 103 bp, Artificial Sequence
  Synthetic Polynucleotide
taatacgactcactatagggagtgtctgaaagtagggcactagccaagttaacagaggagaaacttgatgagtgccctaaacctggcggcagcgcaaaagatg

SEQ ID NO: 211163 - DNA, 103 bp, Artificial Sequence
  Synthetic Polynucleotide
taatacgactcactataggggccaatgatcagccggtcagaccagtagctaacagaggagaagctacatgtctgaccggaacctggcggcagcgcaaaagatg

SEQ ID NO: 211164 - DNA, 103 bp, Artificial Sequence
  Synthetic Polynucleotide
taatacgactcactatagggtgctgatgaagccaatgatcagccggtcagaacagaggagactgaccatgtgatcattgaacctggcggcagcgcaaaagatg

SEQ ID NO: 211165 - DNA, 103 bp, Artificial Sequence
  Synthetic Polynucleotide
taatacgactcactatagggacgtactgtttgctgatgaagccaatgatcaacagaggagagatcatatgcttcatcagaacctggcggcagcgcaaaagatg

SEQ ID NO: 211166 - DNA, 103 bp, Artificial Sequence
  Synthetic Polynucleotide
taatacgactcactatagggaaggctagtaacgtactgtttgctgatgaaaacagaggagattcatcatgaaacagtacaacctggcggcagcgcaaaagatg

SEQ ID NO: 211167 - DNA, 103 bp, Artificial Sequence
  Synthetic Polynucleotide
taatacgactcactatagggcattgagaagaaggctagtaacgtactgttaacagaggagaaacagtatgttactagccaacctggcggcagcgcaaaagatg

SEQ ID NO: 211168 - DNA, 103 bp, Artificial Sequence
  Synthetic Polynucleotide
taatacgactcactatagggccgtcgggctcattgagaagaaggctagtaaacagaggagatactagatgtcttctcaaaacctggcggcagcgcaaaagatg

SEQ ID NO: 211169 - DNA, 103 bp, Artificial Sequence
  Synthetic Polynucleotide
taatacgactcactataggggagaaaggttccgtcgggctcattgagaagaacagaggagacttctcatggagcccgacaacctggcggcagcgcaaaagatg

SEQ ID NO: 211170 - DNA, 103 bp, Artificial Sequence
  Synthetic Polynucleotide
taatacgactcactatagggtgaagcggaggagaaaggttccgtcgggctaacagaggagaagcccgatggaacctttcaacctggcggcagcgcaaaagatg

SEQ ID NO: 211171 - DNA, 103 bp, Artificial Sequence
  Synthetic Polynucleotide
taatacgactcactatagggtctgagtcgctgaagcggaggagaaaggttaacagaggagaaaccttatgcctccgcttaacctggcggcagcgcaaaagatg

SEQ ID NO: 211172 - DNA, 103 bp, Artificial Sequence
  Synthetic Polynucleotide
taatacgactcactataggggcccccaatctctgagtcgctgaagcggagaacagaggagactccgcatgagcgactcaaacctggcggcagcgcaaaagatg

SEQ ID NO: 211173 - DNA, 103 bp, Artificial Sequence
  Synthetic Polynucleotide
taatacgactcactatagggggtgctggacagtgtctgaaagtagggcacaacagaggagagtgcccatgtttcagacaaacctggcggcagcgcaaaagatg

SEQ ID NO: 211174 - DNA, 103 bp, Artificial Sequence
  Synthetic Polynucleotide
taatacgactcactatagggcaatggtgatgcccccaatctctgagtcgcaacagaggagagcgactatgagattggggaacctggcggcagcgcaaaagatg

SEQ ID NO: 211175 - DNA, 103 bp, Artificial Sequence
  Synthetic Polynucleotide
taatacgactcactatagggatgacatgggcaatggtgatgcccccaatcaacagaggagagattggatgcatcaccataacctggcggcagcgcaaaagatg

SEQ ID NO: 211176 - DNA, 103 bp, Artificial Sequence
  Synthetic Polynucleotide
taatacgactcactatagggctggccccggatgacatgggcaatggtgataacagaggagaatcaccatggcccatgtcaacctggcggcagcgcaaaagatg

SEQ ID NO: 211177 - DNA, 103 bp, Artificial Sequence
  Synthetic Polynucleotide
taatacgactcactataggggagagccatcctggccccggatgacatgggaacagaggagacccatgatgtccggggccaacctggcggcagcgcaaaagatg

SEQ ID NO: 211178 - DNA, 103 bp, Artificial Sequence
  Synthetic Polynucleotide
taatacgactcactatagggtctatctgtggagagccatcctggccccggaacagaggagaccggggatgggatggctcaacctggcggcagcgcaaaagatg

SEQ ID NO: 211179 - DNA, 103 bp, Artificial Sequence
  Synthetic Polynucleotide
taatacgactcactatagggctggatgttctctatctgtggagagccatcaacagaggagagatggcatgccacagataaacctggcggcagcgcaaaagatg

SEQ ID NO: 211180 - DNA, 103 bp, Artificial Sequence
  Synthetic Polynucleotide
taatacgactcactatagggcagagaatggctggatgttctctatctgtgaacagaggagacacagaatgagaacatccaacctggcggcagcgcaaaagatg

SEQ ID NO: 211181 - DNA, 103 bp, Artificial Sequence
  Synthetic Polynucleotide
taatacgactcactatagggaggtctttggcagagaatggctggatgttcaacagaggagagaacatatggccattctcaacctggcggcagcgcaaaagatg

SEQ ID NO: 211182 - DNA, 103 bp, Artificial Sequence
  Synthetic Polynucleotide
taatacgactcactataggggcgaatggacaggtctttggcagagaatggaacagaggagaccattcatggccaaagacaacctggcggcagcgcaaaagatg

SEQ ID NO: 211183 - DNA, 103 bp, Artificial Sequence
  Synthetic Polynucleotide
taatacgactcactatagggcccccagtgagcgaatggacaggtctttggaacagaggagaccaaagatgtgtccattcaacctggcggcagcgcaaaagatg

SEQ ID NO: 211184 - DNA, 103 bp, Artificial Sequence
  Synthetic Polynucleotide
taatacgactcactataggggaggcctgaaggtgctggacagtgtctgaaaacagaggagattcagaatgtgtccagcaaacctggcggcagcgcaaaagatg

SEQ ID NO: 211185 - DNA, 103 bp, Artificial Sequence
  Synthetic Polynucleotide
taatacgactcactatagggcggattcggtcccccagtgagcgaatggacaacagaggagagtccatatgctcactgggaacctggcggcagcgcaaaagatg

SEQ ID NO: 211186 - DNA, 103 bp, Artificial Sequence
  Synthetic Polynucleotide
taatacgactcactatagggagcaagatcccggattcggtcccccagtgaaacagaggagatcactgatggaccgaatcaacctggcggcagcgcaaaagatg

SEQ ID NO: 211187 - DNA, 103 bp, Artificial Sequence
  Synthetic Polynucleotide
taatacgactcactatagggttttgagctgagcaagatcccggattcggtaacagaggagaaccgaaatggggatcttgaacctggcggcagcgcaaaagatg

SEQ ID NO: 211188 - DNA, 103 bp, Artificial Sequence
  Synthetic Polynucleotide
taatacgactcactatagggggatagagatttttgagctgagcaagatccaacagaggagaggatctatgtcagctcaaaacctggcggcagcgcaaaagatg

SEQ ID NO: 211189 - DNA, 103 bp, Artificial Sequence
  Synthetic Polynucleotide
taatacgactcactataggggggcttcttgggatagagatttttgagctgaacagaggagacagctcatgaatctctataacctggcggcagcgcaaaagatg

SEQ ID NO: 211190 - DNA, 103 bp, Artificial Sequence
  Synthetic Polynucleotide
taatacgactcactatagggcctcatccttgggcttcttgggatagagataacagaggagaatctctatgccaagaagcaacctggcggcagcgcaaaagatg

SEQ ID NO: 211191 - DNA, 103 bp, Artificial Sequence
  Synthetic Polynucleotide
taatacgactcactatagggctccggaaagcctcatccttgggcttcttgaacagaggagacaagaaatgcaaggatgaaacctggcggcagcgcaaaagatg

SEQ ID NO: 211192 - DNA, 103 bp, Artificial Sequence
  Synthetic Polynucleotide
taatacgactcactatagggcttgtagtggctccggaaagcctcatccttaacagaggagaaaggatatggctttccggaacctggcggcagcgcaaaagatg

SEQ ID NO: 211193 - DNA, 103 bp, Artificial Sequence
  Synthetic Polynucleotide
taatacgactcactatagggtctgttcaggcttgtagtggctccggaaagaacagaggagactttccatggccactacaaacctggcggcagcgcaaaagatg

SEQ ID NO: 211194 - DNA, 103 bp, Artificial Sequence
  Synthetic Polynucleotide
taatacgactcactatagggtccttacccatctgttcaggcttgtagtggaacagaggagaccactaatggcctgaacaaacctggcggcagcgcaaaagatg

SEQ ID NO: 211195 - DNA, 103 bp, Artificial Sequence
  Synthetic Polynucleotide
taatacgactcactatagggctctcccaccgaggcctgaaggtgctggacaacagaggagagtccagatgcttcaggccaacctggcggcagcgcaaaagatg

SEQ ID NO: 211196 - DNA, 103 bp, Artificial Sequence
  Synthetic Polynucleotide
taatacgactcactatagggacccctgccatccttacccatctgttcaggaacagaggagacctgaaatgatgggtaagaacctggcggcagcgcaaaagatg

SEQ ID NO: 211197 - DNA, 103 bp, Artificial Sequence
  Synthetic Polynucleotide
taatacgactcactatagggctgggacataacccctgccatccttacccaaacagaggagatgggtaatgatggcagggaacctggcggcagcgcaaaagatg

SEQ ID NO: 211198 - DNA, 103 bp, Artificial Sequence
  Synthetic Polynucleotide
taatacgactcactatagggttgatggtagctgggacataacccctgccaaacagaggagatggcagatgttatgtcccaacctggcggcagcgcaaaagatg

SEQ ID NO: 211199 - DNA, 103 bp, Artificial Sequence
  Synthetic Polynucleotide
taatacgactcactatagggcacggtcatcttgatggtagctgggacataaacagaggagatatgtcatggctaccatcaacctggcggcagcgcaaaagatg

SEQ ID NO: 211200 - DNA, 103 bp, Artificial Sequence
  Synthetic Polynucleotide
taatacgactcactatagggggtccctttccacggtcatcttgatggtagaacagaggagactaccaatgagatgaccgaacctggcggcagcgcaaaagatg

SEQ ID NO: 211201 - DNA, 103 bp, Artificial Sequence
  Synthetic Polynucleotide
taatacgactcactatagggggaagtggttggtccctttccacggtcatcaacagaggagagatgacatgggaaagggaaacctggcggcagcgcaaaagatg

SEQ ID NO: 211202 - DNA, 103 bp, Artificial Sequence
  Synthetic Polynucleotide
taatacgactcactatagggctctggggtaggaagtggttggtccctttcaacagaggagagaaaggatgcaaccacttaacctggcggcagcgcaaaagatg

SEQ ID NO: 211203 - DNA, 103 bp, Artificial Sequence
  Synthetic Polynucleotide
taatacgactcactataggggcatctggagctctggggtaggaagtggttaacagaggagaaaccacatgctaccccagaacctggcggcagcgcaaaagatg

SEQ ID NO: 211204 - DNA, 103 bp, Artificial Sequence
  Synthetic Polynucleotide
taatacgactcactatagggaccatggtaggcatctggagctctggggtaaacagaggagataccccatggctccagataacctggcggcagcgcaaaagatg

SEQ ID NO: 211205 - DNA, 103 bp, Artificial Sequence
  Synthetic Polynucleotide
taatacgactcactatagggataagaaggcaccatggtaggcatctggagaacagaggagactccagatgcctaccatgaacctggcggcagcgcaaaagatg

SEQ ID NO: 211206 - DNA, 103 bp, Artificial Sequence
  Synthetic Polynucleotide
taatacgactcactatagggtttctgggggcatcttggagaccagaccccaacagaggagaggggtcatgtctccaagaaacctggcggcagcgcaaaagatg

SEQ ID NO: 211207 - DNA, 103 bp, Artificial Sequence
  Synthetic Polynucleotide
taatacgactcactatagggcctccccctgctctcccaccgaggcctgaaaacagaggagattcaggatgcggtgggagaacctggcggcagcgcaaaagatg

SEQ ID NO: 211208 - DNA, 103 bp, Artificial Sequence
  Synthetic Polynucleotide
taatacgactcactatagggttccaaggtcataagaaggcaccatggtagaacagaggagactaccaatgtgccttcttaacctggcggcagcgcaaaagatg

SEQ ID NO: 211209 - DNA, 103 bp, Artificial Sequence
  Synthetic Polynucleotide
taatacgactcactatagggtcaggggccattccaaggtcataagaaggcaacagaggagagccttcatgtgaccttggaacctggcggcagcgcaaaagatg

SEQ ID NO: 211210 - DNA, 103 bp, Artificial Sequence
  Synthetic Polynucleotide
taatacgactcactatagggcatggaggaatcaggggccattccaaggtcaacagaggagagaccttatgatggcccctaacctggcggcagcgcaaaagatg

SEQ ID NO: 211211 - DNA, 103 bp, Artificial Sequence
  Synthetic Polynucleotide
taatacgactcactataggggctgcatgctcatggaggaatcaggggccaaacagaggagatggcccatgattcctccaaacctggcggcagcgcaaaagatg

SEQ ID NO: 211212 - DNA, 103 bp, Artificial Sequence
  Synthetic Polynucleotide
taatacgactcactatagggtctgggccaagctgcatgctcatggaggaaaacagaggagattcctcatggagcatgcaaacctggcggcagcgcaaaagatg

SEQ ID NO: 211213 - DNA, 103 bp, Artificial Sequence
  Synthetic Polynucleotide
taatacgactcactataggggggcaccatatctgggccaagctgcatgctaacagaggagaagcatgatgcttggcccaaacctggcggcagcgcaaaagatg

SEQ ID NO: 211214 - DNA, 103 bp, Artificial Sequence
  Synthetic Polynucleotide
taatacgactcactatagggggtacacctggggcaccatatctgggccaaaacagaggagattggccatgatatggtgcaacctggcggcagcgcaaaagatg

SEQ ID NO: 211215 - DNA, 103 bp, Artificial Sequence
  Synthetic Polynucleotide
taatacgactcactataggggagtgtggtgggtacacctggggcaccataaacagaggagatatggtatgccaggtgtaaacctggcggcagcgcaaaagatg

SEQ ID NO: 211216 - DNA, 103 bp, Artificial Sequence
  Synthetic Polynucleotide
taatacgactcactataggggatggagtgagagtgtggtgggtacacctgaacagaggagacaggtgatgccaccacacaacctggcggcagcgcaaaagatg

SEQ ID NO: 211217 - DNA, 103 bp, Artificial Sequence
  Synthetic Polynucleotide
taatacgactcactataggggatacggggggatggagtgagagtgtggtgaacagaggagacaccacatgctcactccaaacctggcggcagcgcaaaagatg

SEQ ID NO: 211218 - DNA, 103 bp, Artificial Sequence
  Synthetic Polynucleotide
taatacgactcactatagggatggtgctcccctccccctgctctcccaccaacagaggagaggtgggatggcagggggaaacctggcggcagcgcaaaagatg

SEQ ID NO: 211219 - DNA, 103 bp, Artificial Sequence
  Synthetic Polynucleotide
taatacgactcactataggggagaggccttgatacggggggatggagtgaaacagaggagatcactcatgccccccgtaaacctggcggcagcgcaaaagatg

SEQ ID NO: 211220 - DNA, 103 bp, Artificial Sequence
  Synthetic Polynucleotide
taatacgactcactatagggttcttctggggagaggccttgatacgggggaacagaggagacccccgatgcaaggcctcaacctggcggcagcgcaaaagatg

SEQ ID NO: 211221 - DNA, 103 bp, Artificial Sequence
  Synthetic Polynucleotide
taatacgactcactatagggcgttgactgattcttctggggagaggccttaacagaggagaaaggccatgccccagaagaacctggcggcagcgcaaaagatg

SEQ ID NO: 211222 - DNA, 103 bp, Artificial Sequence
  Synthetic Polynucleotide
taatacgactcactataggggctgacaacacgttgactgattcttctgggaacagaggagacccagaatgatcagtcaaaacctggcggcagcgcaaaagatg

SEQ ID NO: 211223 - DNA, 103 bp, Artificial Sequence
  Synthetic Polynucleotide
taatacgactcactatagggctcctggaaggctgacaacacgttgactgaaacagaggagatcagtcatggtgttgtcaaacctggcggcagcgcaaaagatg

SEQ ID NO: 211224 - DNA, 103 bp, Artificial Sequence
  Synthetic Polynucleotide
taatacgactcactataggggcaggtgaggctcctggaaggctgacaacaaacagaggagatgttgtatgccttccaggaacctggcggcagcgcaaaagatg

SEQ ID NO: 211225 - DNA, 103 bp, Artificial Sequence
  Synthetic Polynucleotide
taatacgactcactataggggggggcatctgcaggtgaggctcctggaagaacagaggagacttccaatggcctcacctaacctggcggcagcgcaaaagatg

SEQ ID NO: 211226 - DNA, 103 bp, Artificial Sequence
  Synthetic Polynucleotide
taatacgactcactataggggcccaggctggggggcatctgcaggtgaggaacagaggagacctcacatgcagatgcccaacctggcggcagcgcaaaagatg

SEQ ID NO: 211227 - DNA, 103 bp, Artificial Sequence
  Synthetic Polynucleotide
taatacgactcactatagggggctcatctggcccaggctggggggcatctaacagaggagaagatgcatgccagcctggaacctggcggcagcgcaaaagatg

SEQ ID NO: 211228 - DNA, 103 bp, Artificial Sequence
  Synthetic Polynucleotide
taatacgactcactatagggtcaaagggcaggctcatctggcccaggctgaacagaggagacagcctatgccagatgagaacctggcggcagcgcaaaagatg

SEQ ID NO: 211229 - DNA, 103 bp, Artificial Sequence
  Synthetic Polynucleotide
taatacgactcactataggggtgttgcaagatggtgctcccctccccctgaacagaggagacaggggatggggagcaccaacctggcggcagcgcaaaagatg

SEQ ID NO: 211230 - DNA, 103 bp, Artificial Sequence
  Synthetic Polynucleotide
taatacgactcactataggggtgaggctggtcaaagggcaggctcatctgaacagaggagacagatgatgctgccctttaacctggcggcagcgcaaaagatg

SEQ ID NO: 211231 - DNA, 103 bp, Artificial Sequence
  Synthetic Polynucleotide
taatacgactcactatagggggccctgggggtgaggctggtcaaagggcaaacagaggagatgccctatgaccagcctcaacctggcggcagcgcaaaagatg

SEQ ID NO: 211232 - DNA, 103 bp, Artificial Sequence
  Synthetic Polynucleotide
taatacgactcactatagggcacggcagcaggccctgggggtgaggctggaacagaggagaccagccatgcccccagggaacctggcggcagcgcaaaagatg

SEQ ID NO: 211233 - DNA, 103 bp, Artificial Sequence
  Synthetic Polynucleotide
taatacgactcactatagggctgaggctggcacggcagcaggccctggggaacagaggagaccccagatgctgctgccgaacctggcggcagcgcaaaagatg

SEQ ID NO: 211234 - DNA, 103 bp, Artificial Sequence
  Synthetic Polynucleotide
taatacgactcactatagggcagcatgctcctgaggctggcacggcagcaaacagaggagatgctgcatggccagcctcaacctggcggcagcgcaaaagatg

SEQ ID NO: 211235 - DNA, 103 bp, Artificial Sequence
  Synthetic Polynucleotide
taatacgactcactataggggggctggacacagcatgctcctgaggctggaacagaggagaccagccatgggagcatgcaacctggcggcagcgcaaaagatg

SEQ ID NO: 211236 - DNA, 103 bp, Artificial Sequence
  Synthetic Polynucleotide
taatacgactcactatagggcagggggtcagggctggacacagcatgctcaacagaggagagagcatatggtgtccagcaacctggcggcagcgcaaaagatg

SEQ ID NO: 211237 - DNA, 103 bp, Artificial Sequence
  Synthetic Polynucleotide
taatacgactcactatagggctgagcagagcagggggtcagggctggacaaacagaggagatgtccaatgctgacccccaacctggcggcagcgcaaaagatg

SEQ ID NO: 211238 - DNA, 103 bp, Artificial Sequence
  Synthetic Polynucleotide
taatacgactcactatagggatggtcacatctgagcagagcagggggtcaaacagaggagatgacccatggctctgctcaacctggcggcagcgcaaaagatg

SEQ ID NO: 211239 - DNA, 103 bp, Artificial Sequence
  Synthetic Polynucleotide
taatacgactcactataggggtcttccaccatggtcacatctgagcagagaacagaggagactctgcatggatgtgaccaacctggcggcagcgcaaaagatg

SEQ ID NO: 211240 - DNA, 103 bp, Artificial Sequence
  Synthetic Polynucleotide
taatacgactcactataggggggtgctgatgtgttgcaagatggtgctccaacagaggagaggagcaatgtcttgcaacaacctggcggcagcgcaaaagatg

SEQ ID NO: 211241 - DNA, 103 bp, Artificial Sequence
  Synthetic Polynucleotide
taatacgactcactatagggtcaggcagctgtcttccaccatggtcacataacagaggagaatgtgaatgtggtggaagaacctggcggcagcgcaaaagatg

SEQ ID NO: 211242 - DNA, 103 bp, Artificial Sequence
  Synthetic Polynucleotide
taatacgactcactatagggactggctggctcaggcagctgtcttccaccaacagaggagaggtggaatgcagctgcctaacctggcggcagcgcaaaagatg

SEQ ID NO: 211243 - DNA, 103 bp, Artificial Sequence
  Synthetic Polynucleotide
taatacgactcactatagggaaacgctgtcactggctggctcaggcagctaacagaggagaagctgcatgagccagccaaacctggcggcagcgcaaaagatg

SEQ ID NO: 211244 - DNA, 103 bp, Artificial Sequence
  Synthetic Polynucleotide
taatacgactcactatagggtgccctgaggaaacgctgtcactggctggcaacagaggagagccagcatgtgacagcgtaacctggcggcagcgcaaaagatg

SEQ ID NO: 211245 - DNA, 103 bp, Artificial Sequence
  Synthetic Polynucleotide
taatacgactcactatagggccaatccaagtgccctgaggaaacgctgtcaacagaggagagacagcatgtcctcagggaacctggcggcagcgcaaaagatg

SEQ ID NO: 211246 - DNA, 103 bp, Artificial Sequence
  Synthetic Polynucleotide
taatacgactcactatagggtatgtcttcaccaatccaagtgccctgaggaacagaggagacctcagatgacttggattaacctggcggcagcgcaaaagatg

SEQ ID NO: 211247 - DNA, 103 bp, Artificial Sequence
  Synthetic Polynucleotide
taatacgactcactataggggaggagggaatatgtcttcaccaatccaagaacagaggagacttggaatggtgaagacaaacctggcggcagcgcaaaagatg

SEQ ID NO: 211248 - DNA, 103 bp, Artificial Sequence
  Synthetic Polynucleotide
taatacgactcactatagggggaggcagcagaggagggaatatgtcttcaaacagaggagatgaagaatgattccctccaacctggcggcagcgcaaaagatg

SEQ ID NO: 211249 - DNA, 103 bp, Artificial Sequence
  Synthetic Polynucleotide
taatacgactcactatagggctgttcagtgggaggcagcagaggagggaaaacagaggagattccctatgctgctgcctaacctggcggcagcgcaaaagatg

SEQ ID NO: 211250 - DNA, 103 bp, Artificial Sequence
  Synthetic Polynucleotide
taatacgactcactatagggtagtgaggtcctgttcagtgggaggcagcaaacagaggagatgctgcatgccactgaacaacctggcggcagcgcaaaagatg

SEQ ID NO: 211251 - DNA, 103 bp, Artificial Sequence
  Synthetic Polynucleotide
taatacgactcactatagggatgctctcaagggtgctgatgtgttgcaagaacagaggagacttgcaatgcatcagcacaacctggcggcagcgcaaaagatg

SEQ ID NO: 211252 - DNA, 103 bp, Artificial Sequence
  Synthetic Polynucleotide
taatacgactcactatagggaggagaagcttagtgaggtcctgttcagtgaacagaggagacactgaatgggacctcacaacctggcggcagcgcaaaagatg

SEQ ID NO: 211253 - DNA, 103 bp, Artificial Sequence
  Synthetic Polynucleotide
taatacgactcactatagggttgcccctccaggagaagcttagtgaggtcaacagaggagagacctcatgaagcttctcaacctggcggcagcgcaaaagatg

SEQ ID NO: 211254 - DNA, 103 bp, Artificial Sequence
  Synthetic Polynucleotide
taatacgactcactatagggccgactccccttgcccctccaggagaagctaacagaggagaagcttcatgtggaggggcaacctggcggcagcgcaaaagatg

SEQ ID NO: 211255 - DNA, 103 bp, Artificial Sequence
  Synthetic Polynucleotide
taatacgactcactataggggaccctccccccgactccccttgcccctccaacagaggagaggagggatgaggggagtcaacctggcggcagcgcaaaagatg

SEQ ID NO: 211256 - DNA, 103 bp, Artificial Sequence
  Synthetic Polynucleotide
taatacgactcactatagggtgcccccaaggaccctccccccgactccccaacagaggagaggggagatggggggagggaacctggcggcagcgcaaaagatg

SEQ ID NO: 211257 - DNA, 103 bp, Artificial Sequence
  Synthetic Polynucleotide
taatacgactcactatagggggaggggctgtgcccccaaggaccctccccaacagaggagaggggagatgccttgggggaacctggcggcagcgcaaaagatg

SEQ ID NO: 211258 - DNA, 103 bp, Artificial Sequence
  Synthetic Polynucleotide
taatacgactcactataggggagggctgcaggaggggctgtgcccccaagaacagaggagacttgggatgacagcccctaacctggcggcagcgcaaaagatg

SEQ ID NO: 211259 - DNA, 103 bp, Artificial Sequence
  Synthetic Polynucleotide
taatacgactcactatagggcccatagtgggagggctgcaggaggggctgaacagaggagacagcccatgctgcagcccaacctggcggcagcgcaaaagatg

SEQ ID NO: 211260 - DNA, 103 bp, Artificial Sequence
  Synthetic Polynucleotide
taatacgactcactatagggtcccagattgcccatagtgggagggctgcaaacagaggagatgcagcatgcccactatgaacctggcggcagcgcaaaagatg

SEQ ID NO: 211261 - DNA, 103 bp, Artificial Sequence
  Synthetic Polynucleotide
taatacgactcactataggggacattgagatcccagattgcccatagtggaacagaggagaccactaatggcaatctggaacctggcggcagcgcaaaagatg

SEQ ID NO: 211262 - DNA, 103 bp, Artificial Sequence
  Synthetic Polynucleotide
taatacgactcactatagggcctctgatatatgctctcaagggtgctgataacagaggagaatcagcatgcttgagagcaacctggcggcagcgcaaaagatg

SEQ ID NO: 211263 - DNA, 103 bp, Artificial Sequence
  Synthetic Polynucleotide
taatacgactcactataggggtccatgtgggacattgagatcccagattgaacagaggagacaatctatgatctcaatgaacctggcggcagcgcaaaagatg

SEQ ID NO: 211264 - DNA, 103 bp, Artificial Sequence
  Synthetic Polynucleotide
taatacgactcactatagggtggcccttaggtccatgtgggacattgagaaacagaggagatctcaaatgcccacatggaacctggcggcagcgcaaaagatg

SEQ ID NO: 211265 - DNA, 103 bp, Artificial Sequence
  Synthetic Polynucleotide
taatacgactcactatagggcaactggggttggcccttaggtccatgtggaacagaggagaccacatatgcctaagggcaacctggcggcagcgcaaaagatg

SEQ ID NO: 211266 - DNA, 103 bp, Artificial Sequence
  Synthetic Polynucleotide
taatacgactcactatagggtcagggggtccctctgatatatgctctcaaaacagaggagattgagaatgtatatcagaaacctggcggcagcgcaaaagatg

SEQ ID NO: 211267 - DNA, 103 bp, Artificial Sequence
  Synthetic Polynucleotide
taatacgactcactataggggccaccagcttcagggggtccctctgatataacagaggagaatatcaatgggaccccctaacctggcggcagcgcaaaagatg

SEQ ID NO: 211268 - DNA, 103 bp, Artificial Sequence
  Synthetic Polynucleotide
taatacgactcactatagggtctgaaagtggccaccagcttcagggggtcaacagaggagagaccccatgaagctggtgaacctggcggcagcgcaaaagatg

SEQ ID NO: 211269 - DNA, 103 bp, Artificial Sequence
  Synthetic Polynucleotide
taatacgactcactataggggaagtatttgtctgaaagtggccaccagctaacagaggagaagctggatgccactttcaaacctggcggcagcgcaaaagatg

SEQ ID NO: 211270 - DNA, 103 bp, Artificial Sequence
  Synthetic Polynucleotide
taatacgactcactatagggcgctgcactttttctgggggcatcttggagaacagaggagactccaaatggcccccagaaacctggcggcagcgcaaaagatg

SEQ ID NO: 211271 - DNA, 103 bp, Artificial Sequence
  Synthetic Polynucleotide
taatacgactcactatagggttctctccttgaagtatttgtctgaaagtgaacagaggagacactttatgacaaatactaacctggcggcagcgcaaaagatg

SEQ ID NO: 211272 - DNA, 103 bp, Artificial Sequence
  Synthetic Polynucleotide
taatacgactcactatagggaacagcttttttctctccttgaagtatttgaacagaggagacaaataatgcaaggagagaacctggcggcagcgcaaaagatg

SEQ ID NO: 211273 - DNA, 103 bp, Artificial Sequence
  Synthetic Polynucleotide
taatacgactcactatagggactgttccataacagcttttttctctccttaacagaggagaaaggagatgaaaaagctgaacctggcggcagcgcaaaagatg

SEQ ID NO: 211274 - DNA, 103 bp, Artificial Sequence
  Synthetic Polynucleotide
taatacgactcactatagggaagtggcggaactgttccataacagcttttaacagaggagaaaaagcatgtatggaacaaacctggcggcagcgcaaaagatg

SEQ ID NO: 211275 - DNA, 103 bp, Artificial Sequence
  Synthetic Polynucleotide
taatacgactcactatagggaggcattggcaagtggcggaactgttccataacagaggagaatggaaatgttccgccacaacctggcggcagcgcaaaagatg

SEQ ID NO: 211276 - DNA, 103 bp, Artificial Sequence
  Synthetic Polynucleotide
taatacgactcactatagggtccagtggaaaggcattggcaagtggcggaaacagaggagatccgccatgtgccaatgcaacctggcggcagcgcaaaagatg

SEQ ID NO: 211277 - DNA, 103 bp, Artificial Sequence
  Synthetic Polynucleotide
taatacgactcactatagggtcttcctgcttccagtggaaaggcattggcaacagaggagagccaatatgtttccactgaacctggcggcagcgcaaaagatg

SEQ ID NO: 211278 - DNA, 103 bp, Artificial Sequence
  Synthetic Polynucleotide
taatacgactcactatagggaaacttgagttcttcctgcttccagtggaaaacagaggagattccacatgaagcaggaaaacctggcggcagcgcaaaagatg

SEQ ID NO: 211279 - DNA, 103 bp, Artificial Sequence
  Synthetic Polynucleotide
taatacgactcactatagggagcctgtcttaaacttgagttcttcctgctaacagaggagaagcaggatgaactcaagtaacctggcggcagcgcaaaagatg

SEQ ID NO: 211280 - DNA, 103 bp, Artificial Sequence
  Synthetic Polynucleotide
taatacgactcactatagggagcctccgcaagcctgtcttaaacttgagtaacagaggagaactcaaatgtaagacaggaacctggcggcagcgcaaaagatg

SEQ ID NO: 211281 - DNA, 103 bp, Artificial Sequence
  Synthetic Polynucleotide
taatacgactcactataggggacatagagccgctgcactttttctgggggaacagaggagacccccaatgaaagtgcagaacctggcggcagcgcaaaagatg

SEQ ID NO: 211282 - DNA, 103 bp, Artificial Sequence
  Synthetic Polynucleotide
taatacgactcactatagggtcggtgctgcagcctccgcaagcctgtcttaacagaggagaaagacaatgttgcggaggaacctggcggcagcgcaaaagatg

SEQ ID NO: 211283 - DNA, 103 bp, Artificial Sequence
  Synthetic Polynucleotide
taatacgactcactatagggtctcccctactcggtgctgcagcctccgcaaacagaggagatgcggaatgtgcagcaccaacctggcggcagcgcaaaagatg

SEQ ID NO: 211284 - DNA, 103 bp, Artificial Sequence
  Synthetic Polynucleotide
taatacgactcactatagggagaaggtggatctcccctactcggtgctgcaacagaggagagcagcaatgagtaggggaaacctggcggcagcgcaaaagatg

SEQ ID NO: 211285 - DNA, 103 bp, Artificial Sequence
  Synthetic Polynucleotide
taatacgactcactatagggggcttctcggagaaggtggatctcccctacaacagaggagagtagggatgatccaccttaacctggcggcagcgcaaaagatg

SEQ ID NO: 211286 - DNA, 103 bp, Artificial Sequence
  Synthetic Polynucleotide
taatacgactcactatagggccttctgcagggcttctcggagaaggtggaaacagaggagatccaccatgtccgagaagaacctggcggcagcgcaaaagatg

SEQ ID NO: 211287 - DNA, 103 bp, Artificial Sequence
  Synthetic Polynucleotide
taatacgactcactataggggcctcagcccccttctgcagggcttctcggaacagaggagaccgagaatgcctgcagaaaacctggcggcagcgcaaaagatg

SEQ ID NO: 211288 - DNA, 103 bp, Artificial Sequence
  Synthetic Polynucleotide
taatacgactcactatagggcacttggccagcctcagcccccttctgcagaacagaggagactgcagatgggggctgagaacctggcggcagcgcaaaagatg

SEQ ID NO: 211289 - DNA, 103 bp, Artificial Sequence
  Synthetic Polynucleotide
taatacgactcactatagggtgtgcagagacacttggccagcctcagcccaacagaggagagggctgatgctggccaagaacctggcggcagcgcaaaagatg

SEQ ID NO: 211290 - DNA, 103 bp, Artificial Sequence
  Synthetic Polynucleotide
taatacgactcactatagggtctatcaagctgtgcagagacacttggccaaacagaggagatggccaatggtctctgcaaacctggcggcagcgcaaaagatg

SEQ ID NO: 211291 - DNA, 103 bp, Artificial Sequence
  Synthetic Polynucleotide
taatacgactcactatagggagcaggagtttctatcaagctgtgcagagaaacagaggagatctctgatgagcttgataaacctggcggcagcgcaaaagatg

SEQ ID NO: 211292 - DNA, 103 bp, Artificial Sequence
  Synthetic Polynucleotide
taatacgactcactatagggggggaaagtcgacatagagccgctgcacttaacagaggagaaagtgcatgggctctatgaacctggcggcagcgcaaaagatg

SEQ ID NO: 211293 - DNA, 103 bp, Artificial Sequence
  Synthetic Polynucleotide
taatacgactcactatagggcagtcccattagcaggagtttctatcaagcaacagaggagagcttgaatgaaactcctgaacctggcggcagcgcaaaagatg

SEQ ID NO: 211294 - DNA, 103 bp, Artificial Sequence
  Synthetic Polynucleotide
taatacgactcactatagggtcacttggcccagtcccattagcaggagttaacagaggagaaactccatgtaatgggacaacctggcggcagcgcaaaagatg

SEQ ID NO: 211295 - DNA, 103 bp, Artificial Sequence
  Synthetic Polynucleotide
taatacgactcactatagggggccagggcctcacttggcccagtcccattaacagaggagaaatgggatggggccaagtaacctggcggcagcgcaaaagatg

SEQ ID NO: 211296 - DNA, 103 bp, Artificial Sequence
  Synthetic Polynucleotide
taatacgactcactataggggcagtagcatggccagggcctcacttggccaacagaggagaggccaaatgaggccctggaacctggcggcagcgcaaaagatg

SEQ ID NO: 211297 - DNA, 103 bp, Artificial Sequence
  Synthetic Polynucleotide
taatacgactcactataggggtggtctcctgcagtagcatggccagggccaacagaggagaggccctatgcatgctactaacctggcggcagcgcaaaagatg

SEQ ID NO: 211298 - DNA, 103 bp, Artificial Sequence
  Synthetic Polynucleotide
taatacgactcactatagggtagctctccagtggtctcctgcagtagcataacagaggagaatgctaatgcaggagaccaacctggcggcagcgcaaaagatg

SEQ ID NO: 211299 - DNA, 103 bp, Artificial Sequence
  Synthetic Polynucleotide
taatacgactcactatagggtggctgcctctagctctccagtggtctcctaacagaggagaaggagaatgctggagagcaacctggcggcagcgcaaaagatg

SEQ ID NO: 211300 - DNA, 103 bp, Artificial Sequence
  Synthetic Polynucleotide
taatacgactcactatagggactagggctttggctgcctctagctctccaaacagaggagatggagaatgagaggcagcaacctggcggcagcgcaaaagatg

SEQ ID NO: 211301 - DNA, 103 bp, Artificial Sequence
  Synthetic Polynucleotide
taatacgactcactatagggcctcttcagcactagggctttggctgcctcaacagaggagagaggcaatgaaagccctaaacctggcggcagcgcaaaagatg

SEQ ID NO: 211302 - DNA, 103 bp, Artificial Sequence
  Synthetic Polynucleotide
taatacgactcactatagggaaatctggatcctcttcagcactagggcttaacagaggagaaagcccatgtgctgaagaaacctggcggcagcgcaaaagatg

SEQ ID NO: 211303 - DNA, 103 bp, Artificial Sequence
  Synthetic Polynucleotide
taatacgactcactatagggcgcaggtgttggggaaagtcgacatagagcaacagaggagagctctaatgcgactttccaacctggcggcagcgcaaaagatg

SEQ ID NO: 211304 - DNA, 103 bp, Artificial Sequence
  Synthetic Polynucleotide
taatacgactcactatagggtgccgtttccaaatctggatcctcttcagcaacagaggagagctgaaatggatccagataacctggcggcagcgcaaaagatg

SEQ ID NO: 211305 - DNA, 103 bp, Artificial Sequence
  Synthetic Polynucleotide
taatacgactcactatagggcagctgctgctgccgtttccaaatctggataacagaggagaatccagatgtggaaacggaacctggcggcagcgcaaaagatg

SEQ ID NO: 211306 - DNA, 103 bp, Artificial Sequence
  Synthetic Polynucleotide
taatacgactcactatagggcattccctgccagctgctgctgccgtttccaacagaggagaggaaacatgagcagcagcaacctggcggcagcgcaaaagatg

SEQ ID NO: 211307 - DNA, 103 bp, Artificial Sequence
  Synthetic Polynucleotide
taatacgactcactatagggaacggtgcgccattccctgccagctgctgcaacagaggagagcagcaatgggcagggaaaacctggcggcagcgcaaaagatg

SEQ ID NO: 211308 - DNA, 103 bp, Artificial Sequence
  Synthetic Polynucleotide
taatacgactcactataggggctctcctcaaacggtgcgccattccctgcaacagaggagagcagggatgggcgcaccgaacctggcggcagcgcaaaagatg

SEQ ID NO: 211309 - DNA, 103 bp, Artificial Sequence
  Synthetic Polynucleotide
taatacgactcactataggggtggggccaggctctcctcaaacggtgcgcaacagaggagagcgcacatgttgaggagaaacctggcggcagcgcaaaagatg

SEQ ID NO: 211310 - DNA, 103 bp, Artificial Sequence
  Synthetic Polynucleotide
taatacgactcactatagggctctcctggagtggggccaggctctcctcaaacagaggagatgaggaatgcctggccccaacctggcggcagcgcaaaagatg

SEQ ID NO: 211311 - DNA, 103 bp, Artificial Sequence
  Synthetic Polynucleotide
taatacgactcactataggggctttcacacctctcctggagtggggccagaacagaggagactggccatgctccaggagaacctggcggcagcgcaaaagatg

SEQ ID NO: 211312 - DNA, 103 bp, Artificial Sequence
  Synthetic Polynucleotide
taatacgactcactatagggtgtccaccaggctttcacacctctcctggaaacagaggagatccaggatgggtgtgaaaaacctggcggcagcgcaaaagatg

SEQ ID NO: 211313 - DNA, 103 bp, Artificial Sequence
  Synthetic Polynucleotide
taatacgactcactatagggtgggaataaatgtccaccaggctttcacacaacagaggagagtgtgaatgcctggtggaaacctggcggcagcgcaaaagatg

SEQ ID NO: 211314 - DNA, 103 bp, Artificial Sequence
  Synthetic Polynucleotide
taatacgactcactatagggcagaagatgccgcaggtgttggggaaagtcaacagaggagagactttatgcaacacctgaacctggcggcagcgcaaaagatg

SEQ ID NO: 211315 - DNA, 103 bp, Artificial Sequence
  Synthetic Polynucleotide
taatacgactcactatagggctgctgtagctgggaataaatgtccaccagaacagaggagactggtgatgatttattccaacctggcggcagcgcaaaagatg

SEQ ID NO: 211316 - DNA, 103 bp, Artificial Sequence
  Synthetic Polynucleotide
taatacgactcactatagggcccctacctcctgctgtagctgggaataaaaacagaggagatttattatgagctacagcaacctggcggcagcgcaaaagatg

SEQ ID NO: 211317 - DNA, 103 bp, Artificial Sequence
  Synthetic Polynucleotide
taatacgactcactatagggccaccagccgcccctacctcctgctgtagcaacagaggagagctacaatgggaggtaggaacctggcggcagcgcaaaagatg

SEQ ID NO: 211318 - DNA, 103 bp, Artificial Sequence
  Synthetic Polynucleotide
taatacgactcactatagggctcaagctccccaccagccgcccctacctcaacagaggagagaggtaatggcggctggtaacctggcggcagcgcaaaagatg

SEQ ID NO: 211319 - DNA, 103 bp, Artificial Sequence
  Synthetic Polynucleotide
taatacgactcactataggggggtcttgggctcaagctccccaccagccgaacagaggagacggctgatggggagcttgaacctggcggcagcgcaaaagatg

SEQ ID NO: 211320 - DNA, 103 bp, Artificial Sequence
  Synthetic Polynucleotide
taatacgactcactatagggagcgatgcccgggtcttgggctcaagctccaacagaggagaggagctatggcccaagacaacctggcggcagcgcaaaagatg

SEQ ID NO: 211321 - DNA, 103 bp, Artificial Sequence
  Synthetic Polynucleotide
taatacgactcactatagggccggccagtcagcgatgcccgggtcttgggaacagaggagacccaagatgcgggcatcgaacctggcggcagcgcaaaagatg

SEQ ID NO: 211322 - DNA, 103 bp, Artificial Sequence
  Synthetic Polynucleotide
taatacgactcactatagggcttcatccagccggccagtcagcgatgcccaacagaggagagggcatatgtgactggccaacctggcggcagcgcaaaagatg

SEQ ID NO: 211323 - DNA, 103 bp, Artificial Sequence
  Synthetic Polynucleotide
taatacgactcactataggggttctcaggacttcatccagccggccagtcaacagaggagagactggatggctggatgaaacctggcggcagcgcaaaagatg

SEQ ID NO: 211324 - DNA, 103 bp, Artificial Sequence
  Synthetic Polynucleotide
taatacgactcactatagggggtgacgagggttctcaggacttcatccagaacagaggagactggatatggtcctgagaaacctggcggcagcgcaaaagatg

SEQ ID NO: 211325 - DNA, 103 bp, Artificial Sequence
  Synthetic Polynucleotide
taatacgactcactataggggccagtcacccagaagatgccgcaggtgttaacagaggagaaacaccatgggcatcttcaacctggcggcagcgcaaaagatg

SEQ ID NO: 211326 - DNA, 103 bp, Artificial Sequence
  Synthetic Polynucleotide
taatacgactcactatagggggaagcaactggtgacgagggttctcaggaaacagaggagatcctgaatgccctcgtcaaacctggcggcagcgcaaaagatg

SEQ ID NO: 211327 - DNA, 103 bp, Artificial Sequence
  Synthetic Polynucleotide
taatacgactcactatagggttctccaccaggaagcaactggtgacgaggaacagaggagacctcgtatgcagttgcttaacctggcggcagcgcaaaagatg

SEQ ID NO: 211328 - DNA, 103 bp, Artificial Sequence
  Synthetic Polynucleotide
taatacgactcactatagggggggggctgcttctccaccaggaagcaactaacagaggagaagttgcatgctggtggagaacctggcggcagcgcaaaagatg

SEQ ID NO: 211329 - DNA, 103 bp, Artificial Sequence
  Synthetic Polynucleotide
taatacgactcactatagggtcagtacctgggggggctgcttctccaccaaacagaggagatggtggatgagcagccccaacctggcggcagcgcaaaagatg

SEQ ID NO: 211330 - DNA, 103 bp, Artificial Sequence
  Synthetic Polynucleotide
taatacgactcactataggggtctgagtcttcagtacctgggggggctgcaacagaggagagcagccatgccaggtactaacctggcggcagcgcaaaagatg

SEQ ID NO: 211331 - DNA, 103 bp, Artificial Sequence
  Synthetic Polynucleotide
taatacgactcactatagggctggaacttggtctgagtcttcagtacctgaacagaggagacaggtaatgaagactcagaacctggcggcagcgcaaaagatg

SEQ ID NO: 211332 - DNA, 103 bp, Artificial Sequence
  Synthetic Polynucleotide
taatacgactcactataggggaactccagcctggaacttggtctgagtctaacagaggagaagactcatgccaagttccaacctggcggcagcgcaaaagatg

SEQ ID NO: 211333 - DNA, 103 bp, Artificial Sequence
  Synthetic Polynucleotide
taatacgactcactatagggaacaggaatcgaactccagcctggaacttgaacagaggagacaagttatgggctggagtaacctggcggcagcgcaaaagatg

SEQ ID NO: 211334 - DNA, 103 bp, Artificial Sequence
  Synthetic Polynucleotide
taatacgactcactatagggcctcaagcccaacaggaatcgaactccagcaacagaggagagctggaatgcgattcctgaacctggcggcagcgcaaaagatg

SEQ ID NO: 211335 - DNA, 103 bp, Artificial Sequence
  Synthetic Polynucleotide
taatacgactcactatagggcccccaggaacctcaagcccaacaggaatcaacagaggagagattccatgtgggcttgaaacctggcggcagcgcaaaagatg

SEQ ID NO: 211336 - DNA, 103 bp, Artificial Sequence
  Synthetic Polynucleotide
taatacgactcactatagggtggctctccagccagtcacccagaagatgcaacagaggagagcatctatggggtgactgaacctggcggcagcgcaaaagatg

SEQ ID NO: 211337 - DNA, 103 bp, Artificial Sequence
  Synthetic Polynucleotide
taatacgactcactatagggttggctggggcccccaggaacctcaagcccaacagaggagagggcttatggttcctgggaacctggcggcagcgcaaaagatg

SEQ ID NO: 211338 - DNA, 103 bp, Artificial Sequence
  Synthetic Polynucleotide
taatacgactcactatagggcagcggaggcttggctggggcccccaggaaaacagaggagattcctgatggccccagccaacctggcggcagcgcaaaagatg

SEQ ID NO: 211339 - DNA, 103 bp, Artificial Sequence
  Synthetic Polynucleotide
taatacgactcactatagggcggccctgaccagcggaggcttggctggggaacagaggagaccccagatgagcctccgcaacctggcggcagcgcaaaagatg

SEQ ID NO: 211340 - DNA, 103 bp, Artificial Sequence
  Synthetic Polynucleotide
taatacgactcactataggggtcaccatgtcggccctgaccagcggaggcaacagaggagagcctccatgggtcagggcaacctggcggcagcgcaaaagatg

SEQ ID NO: 211341 - DNA, 103 bp, Artificial Sequence
  Synthetic Polynucleotide
taatacgactcactatagggctgcttctctgtcaccatgtcggccctgacaacagaggagagtcaggatggacatggtgaacctggcggcagcgcaaaagatg

SEQ ID NO: 211342 - DNA, 103 bp, Artificial Sequence
  Synthetic Polynucleotide
taatacgactcactataggggctcccgcgcctgcttctctgtcaccatgtaacagaggagaacatggatgcagagaagcaacctggcggcagcgcaaaagatg

SEQ ID NO: 211343 - DNA, 103 bp, Artificial Sequence
  Synthetic Polynucleotide
taatacgactcactatagggggcacactcagctcccgcgcctgcttctctaacagaggagaagagaaatgggcgcgggaaacctggcggcagcgcaaaagatg

SEQ ID NO: 211344 - DNA, 103 bp, Artificial Sequence
  Synthetic Polynucleotide
taatacgactcactatagggaggaccctgaggcacactcagctcccgcgcaacagaggagagcgcggatgctgagtgtgaacctggcggcagcgcaaaagatg

SEQ ID NO: 211345 - DNA, 103 bp, Artificial Sequence
  Synthetic Polynucleotide
taatacgactcactatagggctccagccccaggaccctgaggcacactcaaacagaggagatgagtgatgctcagggtcaacctggcggcagcgcaaaagatg

SEQ ID NO: 211346 - DNA, 103 bp, Artificial Sequence
  Synthetic Polynucleotide
taatacgactcactataggggtgctttctgctccagccccaggaccctgaaacagaggagatcagggatgtggggctggaacctggcggcagcgcaaaagatg

SEQ ID NO: 211347 - DNA, 103 bp, Artificial Sequence
  Synthetic Polynucleotide
taatacgactcactataggggcccggcgccagctgcacgggccgggccataacagaggagaatggccatgcccgtgcagaacctggcggcagcgcaaaagatg

SEQ ID NO: 211348 - DNA, 103 bp, Artificial Sequence
  Synthetic Polynucleotide
taatacgactcactataggggaaagcgcggaacaccgcgcgcccaccaggaacagaggagacctggtatgcgcgcggtgaacctggcggcagcgcaaaagatg

SEQ ID NO: 211349 - DNA, 103 bp, Artificial Sequence
  Synthetic Polynucleotide
taatacgactcactatagggttcaggtgggaactgagcagagaaactgctaacagaggagaagcagtatgtctgctcagaacctggcggcagcgcaaaagatg

SEQ ID NO: 211350 - DNA, 103 bp, Artificial Sequence
  Synthetic Polynucleotide
taatacgactcactatagggcgggccattcttcaggtgggaactgagcagaacagaggagactgctcatgtcccacctgaacctggcggcagcgcaaaagatg

SEQ ID NO: 211351 - DNA, 103 bp, Artificial Sequence
  Synthetic Polynucleotide
taatacgactcactatagggtcatctcggacgggccattcttcaggtgggaacagaggagacccaccatgagaatggccaacctggcggcagcgcaaaagatg

SEQ ID NO: 211352 - DNA, 103 bp, Artificial Sequence
  Synthetic Polynucleotide
taatacgactcactatagggcaagtcatcttcatctcggacgggccattcaacagaggagagaatggatggtccgagataacctggcggcagcgcaaaagatg

SEQ ID NO: 211353 - DNA, 103 bp, Artificial Sequence
  Synthetic Polynucleotide
taatacgactcactatagggggatattgtccaagtcatcttcatctcggaaacagaggagatccgagatgaagatgactaacctggcggcagcgcaaaagatg

SEQ ID NO: 211354 - DNA, 103 bp, Artificial Sequence
  Synthetic Polynucleotide
taatacgactcactatagggacatctcgagggatattgtccaagtcatctaacagaggagaagatgaatgggacaatataacctggcggcagcgcaaaagatg

SEQ ID NO: 211355 - DNA, 103 bp, Artificial Sequence
  Synthetic Polynucleotide
taatacgactcactatagggctcatgttcaacatctcgagggatattgtcaacagaggagagacaatatgcctcgagataacctggcggcagcgcaaaagatg

SEQ ID NO: 211356 - DNA, 103 bp, Artificial Sequence
  Synthetic Polynucleotide
taatacgactcactataggggtttgattatctcatgttcaacatctcgagaacagaggagactcgagatgttgaacatgaacctggcggcagcgcaaaagatg

SEQ ID NO: 211357 - DNA, 103 bp, Artificial Sequence
  Synthetic Polynucleotide
taatacgactcactataggggggttaattcgtttgattatctcatgttcaaacagaggagatgaacaatggataatcaaaacctggcggcagcgcaaaagatg

SEQ ID NO: 211358 - DNA, 103 bp, Artificial Sequence
  Synthetic Polynucleotide
taatacgactcactatagggagtcaaaatggggttaattcgtttgattataacagaggagaataatcatgcgaattaacaacctggcggcagcgcaaaagatg

SEQ ID NO: 211359 - DNA, 103 bp, Artificial Sequence
  Synthetic Polynucleotide
taatacgactcactatagggtggcgcgacggaaagcgcggaacaccgcgcaacagaggagagcgcggatgtccgcgcttaacctggcggcagcgcaaaagatg

SEQ ID NO: 211360 - DNA, 103 bp, Artificial Sequence
  Synthetic Polynucleotide
taatacgactcactatagggaattgtcaacagtcaaaatggggttaattcaacagaggagagaattaatgccattttgaaacctggcggcagcgcaaaagatg

SEQ ID NO: 211361 - DNA, 103 bp, Artificial Sequence
  Synthetic Polynucleotide
taatacgactcactatagggtgtttgattaaattgtcaacagtcaaaatgaacagaggagacattttatgtgttgacaaaacctggcggcagcgcaaaagatg

SEQ ID NO: 211362 - DNA, 103 bp, Artificial Sequence
  Synthetic Polynucleotide
taatacgactcactatagggtaggacagtgtgtttgattaaattgtcaacaacagaggagagttgacatgttaatcaaaaacctggcggcagcgcaaaagatg

SEQ ID NO: 211363 - DNA, 103 bp, Artificial Sequence
  Synthetic Polynucleotide
taatacgactcactatagggatttttgcattaggacagtgtgtttgattaaacagaggagataatcaatgacactgtccaacctggcggcagcgcaaaagatg

SEQ ID NO: 211364 - DNA, 103 bp, Artificial Sequence
  Synthetic Polynucleotide
taatacgactcactatagggtgttcttcgtatttttgcattaggacagtgaacagaggagacactgtatgaatgcaaaaaacctggcggcagcgcaaaagatg

SEQ ID NO: 211365 - DNA, 103 bp, Artificial Sequence
  Synthetic Polynucleotide
taatacgactcactatagggatattttttctgttcttcgtatttttgcataacagaggagaatgcaaatgtacgaagaaaacctggcggcagcgcaaaagatg

SEQ ID NO: 211366 - DNA, 103 bp, Artificial Sequence
  Synthetic Polynucleotide
taatacgactcactatagggcctggctattatattttttctgttcttcgtaacagaggagaacgaagatgagaaaaaataacctggcggcagcgcaaaagatg

SEQ ID NO: 211367 - DNA, 103 bp, Artificial Sequence
  Synthetic Polynucleotide
taatacgactcactataggggtggaagtgccctggctattatattttttcaacagaggagagaaaaaatgtaatagccaaacctggcggcagcgcaaaagatg

SEQ ID NO: 211368 - DNA, 103 bp, Artificial Sequence
  Synthetic Polynucleotide
taatacgactcactatagggcagcatgtcagtggaagtgccctggctattaacagaggagaaatagcatgggcacttccaacctggcggcagcgcaaaagatg

SEQ ID NO: 211369 - DNA, 103 bp, Artificial Sequence
  Synthetic Polynucleotide
taatacgactcactataggggcccgattgtcagcatgtcagtggaagtgcaacagaggagagcacttatgctgacatgcaacctggcggcagcgcaaaagatg

SEQ ID NO: 211370 - DNA, 103 bp, Artificial Sequence
  Synthetic Polynucleotide
taatacgactcactatagggcagcgcgcgttggcgcgacggaaagcgcggaacagaggagaccgcgcatgccgtcgcgcaacctggcggcagcgcaaaagatg

SEQ ID NO: 211371 - DNA, 103 bp, Artificial Sequence
  Synthetic Polynucleotide
taatacgactcactatagggggatacttatgcccgattgtcagcatgtcaaacagaggagatgacatatggacaatcggaacctggcggcagcgcaaaagatg

SEQ ID NO: 211372 - DNA, 103 bp, Artificial Sequence
  Synthetic Polynucleotide
taatacgactcactatagggctcttttgaaggatacttatgcccgattgtaacagaggagaacaatcatgcataagtataacctggcggcagcgcaaaagatg

SEQ ID NO: 211373 - DNA, 103 bp, Artificial Sequence
  Synthetic Polynucleotide
taatacgactcactatagggtcttaaccccctcttttgaaggatacttataacagaggagaataagtatgcttcaaaagaacctggcggcagcgcaaaagatg

SEQ ID NO: 211374 - DNA, 103 bp, Artificial Sequence
  Synthetic Polynucleotide
taatacgactcactatagggccctgccttttcttaaccccctcttttgaaaacagaggagattcaaaatggggggttaaaacctggcggcagcgcaaaagatg

SEQ ID NO: 211375 - DNA, 103 bp, Artificial Sequence
  Synthetic Polynucleotide
taatacgactcactatagggtgcagacagaccctgccttttcttaaccccaacagaggagaggggttatgaaaaggcagaacctggcggcagcgcaaaagatg

SEQ ID NO: 211376 - DNA, 103 bp, Artificial Sequence
  Synthetic Polynucleotide
taatacgactcactatagggcttgaggttttgcagacagaccctgcctttaacagaggagaaaaggcatggtctgtctgaacctggcggcagcgcaaaagatg

SEQ ID NO: 211377 - DNA, 103 bp, Artificial Sequence
  Synthetic Polynucleotide
taatacgactcactatagggtggccctgcccttgaggttttgcagacagaaacagaggagatctgtcatgaaaacctcaaacctggcggcagcgcaaaagatg

SEQ ID NO: 211378 - DNA, 103 bp, Artificial Sequence
  Synthetic Polynucleotide
taatacgactcactatagggccttcgagaatggccctgcccttgaggtttaacagaggagaaaacctatggggcagggcaacctggcggcagcgcaaaagatg

SEQ ID NO: 211379 - DNA, 103 bp, Artificial Sequence
  Synthetic Polynucleotide
taatacgactcactatagggtgtgtctatcccttcgagaatggccctgccaacagaggagaggcaggatgattctcgaaaacctggcggcagcgcaaaagatg

SEQ ID NO: 211380 - DNA, 103 bp, Artificial Sequence
  Synthetic Polynucleotide
taatacgactcactatagggttcctggctttgtgtctatcccttcgagaaaacagaggagattctcgatgggatagacaaacctggcggcagcgcaaaagatg

SEQ ID NO: 211381 - DNA, 103 bp, Artificial Sequence
  Synthetic Polynucleotide
taatacgactcactataggggttccagaagcagcgcgcgttggcgcgacgaacagaggagacgtcgcatgaacgcgcgcaacctggcggcagcgcaaaagatg

SEQ ID NO: 211382 - DNA, 103 bp, Artificial Sequence
  Synthetic Polynucleotide
taatacgactcactatagggacttccctgattcctggctttgtgtctatcaacagaggagagatagaatgaaagccaggaacctggcggcagcgcaaaagatg

SEQ ID NO: 211383 - DNA, 103 bp, Artificial Sequence
  Synthetic Polynucleotide
taatacgactcactataggggctgaaactcacttccctgattcctggcttaacagaggagaaagccaatgatcagggaaaacctggcggcagcgcaaaagatg

SEQ ID NO: 211384 - DNA, 103 bp, Artificial Sequence
  Synthetic Polynucleotide
taatacgactcactatagggatgcttcctggctgaaactcacttccctgaaacagaggagatcagggatgtgagtttcaaacctggcggcagcgcaaaagatg

SEQ ID NO: 211385 - DNA, 103 bp, Artificial Sequence
  Synthetic Polynucleotide
taatacgactcactatagggctccagtctaatgcttcctggctgaaactcaacagaggagagagtttatgccaggaagcaacctggcggcagcgcaaaagatg

SEQ ID NO: 211386 - DNA, 103 bp, Artificial Sequence
  Synthetic Polynucleotide
taatacgactcactatagggtggggtgtttctccagtctaatgcttcctgaacagaggagacaggaaatgttagactggaacctggcggcagcgcaaaagatg

SEQ ID NO: 211387 - DNA, 103 bp, Artificial Sequence
  Synthetic Polynucleotide
taatacgactcactataggggcagggagcttggggtgtttctccagtctaaacagaggagatagactatggaaacacccaacctggcggcagcgcaaaagatg

SEQ ID NO: 211388 - DNA, 103 bp, Artificial Sequence
  Synthetic Polynucleotide
taatacgactcactataggggggctgtgtagcagggagcttggggtgtttaacagaggagaaaacacatgaagctccctaacctggcggcagcgcaaaagatg

SEQ ID NO: 211389 - DNA, 103 bp, Artificial Sequence
  Synthetic Polynucleotide
taatacgactcactatagggttctggggatgggctgtgtagcagggagctaacagaggagaagctccatgctacacagcaacctggcggcagcgcaaaagatg

SEQ ID NO: 211390 - DNA, 103 bp, Artificial Sequence
  Synthetic Polynucleotide
taatacgactcactataggggggcttttaattctggggatgggctgtgtaaacagaggagatacacaatgcatccccagaacctggcggcagcgcaaaagatg

SEQ ID NO: 211391 - DNA, 103 bp, Artificial Sequence
  Synthetic Polynucleotide
taatacgactcactatagggcatttcatttgggcttttaattctggggataacagaggagaatccccatgattaaaagcaacctggcggcagcgcaaaagatg

SEQ ID NO: 211392 - DNA, 103 bp, Artificial Sequence
  Synthetic Polynucleotide
taatacgactcactatagggccagccgcgcgttccagaagcagcgcgcgtaacagaggagaacgcgcatggcttctggaaacctggcggcagcgcaaaagatg

SEQ ID NO: 211393 - DNA, 103 bp, Artificial Sequence
  Synthetic Polynucleotide
taatacgactcactatagggtctgacctaccatttcatttgggcttttaaaacagaggagattaaaaatgcaaatgaaaaacctggcggcagcgcaaaagatg

SEQ ID NO: 211394 - DNA, 103 bp, Artificial Sequence
  Synthetic Polynucleotide
taatacgactcactatagggccaagtggtttctgacctaccatttcatttaacagaggagaaaatgaatgggtaggtcaaacctggcggcagcgcaaaagatg

SEQ ID NO: 211395 - DNA, 103 bp, Artificial Sequence
  Synthetic Polynucleotide
taatacgactcactatagggtgtaatctcaccaagtggtttctgacctacaacagaggagagtaggtatgaaaccacttaacctggcggcagcgcaaaagatg

SEQ ID NO: 211396 - DNA, 103 bp, Artificial Sequence
  Synthetic Polynucleotide
taatacgactcactatagggctagcactgttgtaatctcaccaagtggttaacagaggagaaaccacatggtgagattaaacctggcggcagcgcaaaagatg

SEQ ID NO: 211397 - DNA, 103 bp, Artificial Sequence
  Synthetic Polynucleotide
taatacgactcactatagggaaatgggaacctagcactgttgtaatctcaaacagaggagatgagatatgaacagtgctaacctggcggcagcgcaaaagatg

SEQ ID NO: 211398 - DNA, 103 bp, Artificial Sequence
  Synthetic Polynucleotide
taatacgactcactatagggtttgtaaatcaaatgggaacctagcactgtaacagaggagaacagtgatgggttcccataacctggcggcagcgcaaaagatg

SEQ ID NO: 211399 - DNA, 103 bp, Artificial Sequence
  Synthetic Polynucleotide
taatacgactcactatagggtgattcgctttttgtaaatcaaatgggaacaacagaggagagttcccatgtgatttacaaacctggcggcagcgcaaaagatg

SEQ ID NO: 211400 - DNA, 103 bp, Artificial Sequence
  Synthetic Polynucleotide
taatacgactcactatagggaaaggattactgattcgctttttgtaaatcaacagaggagagatttaatgaaagcgaataacctggcggcagcgcaaaagatg

SEQ ID NO: 211401 - DNA, 103 bp, Artificial Sequence
  Synthetic Polynucleotide
taatacgactcactatagggcaaaccctggaaaggattactgattcgcttaacagaggagaaagcgaatgagtaatcctaacctggcggcagcgcaaaagatg

SEQ ID NO: 211402 - DNA, 103 bp, Artificial Sequence
  Synthetic Polynucleotide
taatacgactcactatagggctcggtgagacaaaccctggaaaggattacaacagaggagagtaatcatgtccagggttaacctggcggcagcgcaaaagatg

SEQ ID NO: 211403 - DNA, 103 bp, Artificial Sequence
  Synthetic Polynucleotide
taatacgactcactataggggcggcgcgcgccagccgcgcgttccagaagaacagaggagacttctgatgcgcgcggctaacctggcggcagcgcaaaagatg

SEQ ID NO: 211404 - DNA, 103 bp, Artificial Sequence
  Synthetic Polynucleotide
taatacgactcactatagggattgtgcttcctcggtgagacaaaccctggaacagaggagaccagggatggtctcaccgaacctggcggcagcgcaaaagatg

SEQ ID NO: 211405 - DNA, 103 bp, Artificial Sequence
  Synthetic Polynucleotide
taatacgactcactatagggccctttggatattgtgcttcctcggtgagaaacagaggagatctcacatgggaagcacaaacctggcggcagcgcaaaagatg

SEQ ID NO: 211406 - DNA, 103 bp, Artificial Sequence
  Synthetic Polynucleotide
taatacgactcactataggggaattttgtgccctttggatattgtgcttcaacagaggagagaagcaatgtatccaaagaacctggcggcagcgcaaaagatg

SEQ ID NO: 211407 - DNA, 103 bp, Artificial Sequence
  Synthetic Polynucleotide
taatacgactcactatagggctcgtcttctgaattttgtgccctttggataacagaggagaatccaaatggcacaaaataacctggcggcagcgcaaaagatg

SEQ ID NO: 211408 - DNA, 103 bp, Artificial Sequence
  Synthetic Polynucleotide
taatacgactcactatagggtttcagatcactcgtcttctgaattttgtgaacagaggagacacaaaatgcagaagacgaacctggcggcagcgcaaaagatg

SEQ ID NO: 211409 - DNA, 103 bp, Artificial Sequence
  Synthetic Polynucleotide
taatacgactcactatagggtctggctgggtttcagatcactcgtcttctaacagaggagaagaagaatggtgatctgaaacctggcggcagcgcaaaagatg

SEQ ID NO: 211410 - DNA, 103 bp, Artificial Sequence
  Synthetic Polynucleotide
taatacgactcactatagggtttggtccagtctggctgggtttcagatcaaacagaggagatgatctatgacccagccaaacctggcggcagcgcaaaagatg

SEQ ID NO: 211411 - DNA, 103 bp, Artificial Sequence
  Synthetic Polynucleotide
taatacgactcactatagggaggcttttcctttggtccagtctggctgggaacagaggagacccagcatgactggaccaaacctggcggcagcgcaaaagatg

SEQ ID NO: 211412 - DNA, 103 bp, Artificial Sequence
  Synthetic Polynucleotide
taatacgactcactataggggcttttggaaaggcttttcctttggtccagaacagaggagactggacatgaggaaaagcaacctggcggcagcgcaaaagatg

SEQ ID NO: 211413 - DNA, 103 bp, Artificial Sequence
  Synthetic Polynucleotide
taatacgactcactatagggaaggacctaggcttttggaaaggcttttccaacagaggagaggaaaaatgtttccaaaaaacctggcggcagcgcaaaagatg

SEQ ID NO: 211414 - DNA, 103 bp, Artificial Sequence
  Synthetic Polynucleotide
taatacgactcactatagggcagccgcgaggcggcgcgcgccagccgcgcaacagaggagagcgcggatggcgcgcgccaacctggcggcagcgcaaaagatg

SEQ ID NO: 211415 - DNA, 103 bp, Artificial Sequence
  Synthetic Polynucleotide
taatacgactcactatagggtgaggaatccaaggacctaggcttttggaaaacagaggagattccaaatgcctaggtccaacctggcggcagcgcaaaagatg

SEQ ID NO: 211416 - DNA, 103 bp, Artificial Sequence
  Synthetic Polynucleotide
taatacgactcactatagggcaaagattcttgaggaatccaaggacctagaacagaggagactaggtatgtggattcctaacctggcggcagcgcaaaagatg

SEQ ID NO: 211417 - DNA, 103 bp, Artificial Sequence
  Synthetic Polynucleotide
taatacgactcactataggggctttaccatcaaagattcttgaggaatccaacagaggagaggattcatgaagaatcttaacctggcggcagcgcaaaagatg

SEQ ID NO: 211418 - DNA, 103 bp, Artificial Sequence
  Synthetic Polynucleotide
taatacgactcactatagggtggctctttggctttaccatcaaagattctaacagaggagaagaatcatggatggtaaaaacctggcggcagcgcaaaagatg

SEQ ID NO: 211419 - DNA, 103 bp, Artificial Sequence
  Synthetic Polynucleotide
taatacgactcactataggggttcagcatatggctctttggctttaccataacagaggagaatggtaatgccaaagagcaacctggcggcagcgcaaaagatg

SEQ ID NO: 211420 - DNA, 103 bp, Artificial Sequence
  Synthetic Polynucleotide
taatacgactcactatagggtcattaggttgttcagcatatggctctttgaacagaggagacaaagaatgatatgctgaaacctggcggcagcgcaaaagatg

SEQ ID NO: 211421 - DNA, 103 bp, Artificial Sequence
  Synthetic Polynucleotide
taatacgactcactatagggttccattttatcattaggttgttcagcataaacagaggagatatgctatgcaacctaataacctggcggcagcgcaaaagatg

SEQ ID NO: 211422 - DNA, 103 bp, Artificial Sequence
  Synthetic Polynucleotide
taatacgactcactatagggtggattctgcttccattttatcattaggttaacagaggagaaacctaatgataaaatggaacctggcggcagcgcaaaagatg

SEQ ID NO: 211423 - DNA, 103 bp, Artificial Sequence
  Synthetic Polynucleotide
taatacgactcactatagggtttatgtaaatggattctgcttccattttaaacagaggagataaaatatgagcagaatcaacctggcggcagcgcaaaagatg

SEQ ID NO: 211424 - DNA, 103 bp, Artificial Sequence
  Synthetic Polynucleotide
taatacgactcactatagggagtagggtcatttatgtaaatggattctgcaacagaggagagcagaaatgatttacataaacctggcggcagcgcaaaagatg

SEQ ID NO: 211425 - DNA, 103 bp, Artificial Sequence
  Synthetic Polynucleotide
taatacgactcactatagggcctggaaggccagccgcgaggcggcgcgcgaacagaggagacgcgcgatgcctcgcggcaacctggcggcagcgcaaaagatg

SEQ ID NO: 211426 - DNA, 103 bp, Artificial Sequence
  Synthetic Polynucleotide
taatacgactcactatagggtgggtttgacagtagggtcatttatgtaaaaacagaggagatttacaatgatgaccctaaacctggcggcagcgcaaaagatg

SEQ ID NO: 211427 - DNA, 103 bp, Artificial Sequence
  Synthetic Polynucleotide
taatacgactcactatagggtcatcattgatgggtttgacagtagggtcaaacagaggagatgacccatgtgtcaaaccaacctggcggcagcgcaaaagatg

SEQ ID NO: 211428 - DNA, 103 bp, Artificial Sequence
  Synthetic Polynucleotide
taatacgactcactatagggacctctgaagtcatcattgatgggtttgacaacagaggagagtcaaaatgatcaatgataacctggcggcagcgcaaaagatg

SEQ ID NO: 211429 - DNA, 103 bp, Artificial Sequence
  Synthetic Polynucleotide
taatacgactcactatagggtgaagaggtgacctctgaagtcatcattgaaacagaggagatcaatgatgacttcagagaacctggcggcagcgcaaaagatg

SEQ ID NO: 211430 - DNA, 103 bp, Artificial Sequence
  Synthetic Polynucleotide
taatacgactcactatagggtgagggtgactgaagaggtgacctctgaagaacagaggagacttcagatgtcacctcttaacctggcggcagcgcaaaagatg

SEQ ID NO: 211431 - DNA, 103 bp, Artificial Sequence
  Synthetic Polynucleotide
taatacgactcactatagggcatgctctgttgagggtgactgaagaggtgaacagaggagacacctcatgagtcaccctaacctggcggcagcgcaaaagatg

SEQ ID NO: 211432 - DNA, 103 bp, Artificial Sequence
  Synthetic Polynucleotide
taatacgactcactatagggcattttgcaacatgctctgttgagggtgacaacagaggagagtcaccatgaacagagcaaacctggcggcagcgcaaaagatg

SEQ ID NO: 211433 - DNA, 103 bp, Artificial Sequence
  Synthetic Polynucleotide
taatacgactcactatagggcatttaccatcattttgcaacatgctctgtaacagaggagaacagagatggttgcaaaaaacctggcggcagcgcaaaagatg

SEQ ID NO: 211434 - DNA, 103 bp, Artificial Sequence
  Synthetic Polynucleotide
taatacgactcactatagggaaagggacagcatttaccatcattttgcaaaacagaggagattgcaaatggatggtaaaaacctggcggcagcgcaaaagatg

SEQ ID NO: 211435 - DNA, 103 bp, Artificial Sequence
  Synthetic Polynucleotide
taatacgactcactatagggtgctttccataaagggacagcatttaccataacagaggagaatggtaatggctgtccctaacctggcggcagcgcaaaagatg

SEQ ID NO: 211436 - DNA, 103 bp, Artificial Sequence
  Synthetic Polynucleotide
taatacgactcactatagggcgcagccagccctggaaggccagccgcgagaacagaggagactcgcgatgggccttccaaacctggcggcagcgcaaaagatg

SEQ ID NO: 211437 - DNA, 103 bp, Artificial Sequence
  Synthetic Polynucleotide
taatacgactcactatagggtatctcaacatgctttccataaagggacagaacagaggagactgtccatgtatggaaagaacctggcggcagcgcaaaagatg

SEQ ID NO: 211438 - DNA, 103 bp, Artificial Sequence
  Synthetic Polynucleotide
taatacgactcactatagggatacacttcatatctcaacatgctttccataacagaggagaatggaaatgatgttgagaaacctggcggcagcgcaaaagatg

SEQ ID NO: 211439 - DNA, 103 bp, Artificial Sequence
  Synthetic Polynucleotide
taatacgactcactatagggtttctccaccatacacttcatatctcaacaaacagaggagatgttgaatgatgaagtgtaacctggcggcagcgcaaaagatg

SEQ ID NO: 211440 - DNA, 103 bp, Artificial Sequence
  Synthetic Polynucleotide
taatacgactcactatagggattacctcattttctccaccatacacttcaaacagaggagatgaagtatgtggtggagaaacctggcggcagcgcaaaagatg

SEQ ID NO: 211441 - DNA, 103 bp, Artificial Sequence
  Synthetic Polynucleotide
taatacgactcactataggggacttcaggaattacctcattttctccaccaacagaggagaggtggaatgaatgaggtaaacctggcggcagcgcaaaagatg

SEQ ID NO: 211442 - DNA, 103 bp, Artificial Sequence
  Synthetic Polynucleotide
taatacgactcactatagggttttcctcaagacttcaggaattacctcataacagaggagaatgaggatgttcctgaagaacctggcggcagcgcaaaagatg

SEQ ID NO: 211443 - DNA, 103 bp, Artificial Sequence
  Synthetic Polynucleotide
taatacgactcactatagggtgggaatgacttttcctcaagacttcaggaaacagaggagatcctgaatgcttgaggaaaacctggcggcagcgcaaaagatg

SEQ ID NO: 211444 - DNA, 103 bp, Artificial Sequence
  Synthetic Polynucleotide
taatacgactcactatagggtttgtcaaagtgggaatgacttttcctcaaaacagaggagattgaggatgagtcattccaacctggcggcagcgcaaaagatg

SEQ ID NO: 211445 - DNA, 103 bp, Artificial Sequence
  Synthetic Polynucleotide
taatacgactcactatagggtctcccctaatttgtcaaagtgggaatgacaacagaggagagtcattatgactttgacaaacctggcggcagcgcaaaagatg

SEQ ID NO: 211446 - DNA, 103 bp, Artificial Sequence
  Synthetic Polynucleotide
taatacgactcactataggggtctgtttggtctcccctaatttgtcaaagaacagaggagactttgaatgattaggggaaacctggcggcagcgcaaaagatg

SEQ ID NO: 211447 - DNA, 103 bp, Artificial Sequence
  Synthetic Polynucleotide
taatacgactcactatagggcaccccccgccgcagccagccctggaaggcaacagaggagagccttcatgggctggctgaacctggcggcagcgcaaaagatg

SEQ ID NO: 211448 - DNA, 103 bp, Artificial Sequence
  Synthetic Polynucleotide
taatacgactcactatagggactatgcggagtctgtttggtctcccctaaaacagaggagattagggatgaccaaacagaacctggcggcagcgcaaaagatg

SEQ ID NO: 211449 - DNA, 103 bp, Artificial Sequence
  Synthetic Polynucleotide
taatacgactcactataggggtgatggcagactatgcggagtctgtttggaacagaggagaccaaacatgctccgcataaacctggcggcagcgcaaaagatg

SEQ ID NO: 211450 - DNA, 103 bp, Artificial Sequence
  Synthetic Polynucleotide
taatacgactcactataggggaggcacctcgtgatggcagactatgcggaaacagaggagatccgcaatgtctgccatcaacctggcggcagcgcaaaagatg

SEQ ID NO: 211451 - DNA, 103 bp, Artificial Sequence
  Synthetic Polynucleotide
taatacgactcactataggggtctgaaaaggaggcacctcgtgatggcagaacagaggagactgccaatgcgaggtgccaacctggcggcagcgcaaaagatg

SEQ ID NO: 211452 - DNA, 103 bp, Artificial Sequence
  Synthetic Polynucleotide
taatacgactcactatagggagggtgttcggtctgaaaaggaggcacctcaacagaggagagaggtgatgccttttcagaacctggcggcagcgcaaaagatg

SEQ ID NO: 211453 - DNA, 103 bp, Artificial Sequence
  Synthetic Polynucleotide
taatacgactcactatagggctacaagcagagggtgttcggtctgaaaagaacagaggagacttttcatgccgaacaccaacctggcggcagcgcaaaagatg

SEQ ID NO: 211454 - DNA, 103 bp, Artificial Sequence
  Synthetic Polynucleotide
taatacgactcactatagggatccactaatctacaagcagagggtgttcgaacagaggagacgaacaatgtctgcttgtaacctggcggcagcgcaaaagatg

SEQ ID NO: 211455 - DNA, 103 bp, Artificial Sequence
  Synthetic Polynucleotide
taatacgactcactataggggtattgtgttatccactaatctacaagcagaacagaggagactgcttatggattagtggaacctggcggcagcgcaaaagatg

SEQ ID NO: 211456 - DNA, 103 bp, Artificial Sequence
  Synthetic Polynucleotide
taatacgactcactatagggtgaaactggtgtattgtgttatccactaataacagaggagaattagtatgtaacacaataacctggcggcagcgcaaaagatg

SEQ ID NO: 211457 - DNA, 103 bp, Artificial Sequence
  Synthetic Polynucleotide
taatacgactcactataggggccaagattttgaaactggtgtattgtgttaacagaggagaaacacaatgcaccagtttaacctggcggcagcgcaaaagatg

SEQ ID NO: 211458 - DNA, 103 bp, Artificial Sequence
  Synthetic Polynucleotide
taatacgactcactataggggcgccagcgagcccggcgccagctgcacggaacagaggagaccgtgcatgtggcgccggaacctggcggcagcgcaaaagatg

SEQ ID NO: 211459 - DNA, 103 bp, Artificial Sequence
  Synthetic Polynucleotide
taatacgactcactataggggcaccagcagcaccccccgccgcagccagcaacagaggagagctggcatgggcggggggaacctggcggcagcgcaaaagatg

SEQ ID NO: 211460 - DNA, 103 bp, Artificial Sequence
  Synthetic Polynucleotide
taatacgactcactatagggaatccaaaaggccaagattttgaaactggtaacagaggagaaccagtatgaaaatcttgaacctggcggcagcgcaaaagatg

SEQ ID NO: 211461 - DNA, 103 bp, Artificial Sequence
  Synthetic Polynucleotide
taatacgactcactatagggccaactgggtaatccaaaaggccaagatttaacagaggagaaaatctatgccttttggaaacctggcggcagcgcaaaagatg

SEQ ID NO: 211462 - DNA, 103 bp, Artificial Sequence
  Synthetic Polynucleotide
taatacgactcactatagggagggttcacgccaactgggtaatccaaaagaacagaggagacttttgatgtacccagttaacctggcggcagcgcaaaagatg

SEQ ID NO: 211463 - DNA, 103 bp, Artificial Sequence
  Synthetic Polynucleotide
taatacgactcactatagggcttgtcttaaagggttcacgccaactgggtaacagaggagaacccagatggcgtgaaccaacctggcggcagcgcaaaagatg

SEQ ID NO: 211464 - DNA, 103 bp, Artificial Sequence
  Synthetic Polynucleotide
taatacgactcactatagggtgtcttgcagcttgtcttaaagggttcacgaacagaggagacgtgaaatgtttaagacaaacctggcggcagcgcaaaagatg

SEQ ID NO: 211465 - DNA, 103 bp, Artificial Sequence
  Synthetic Polynucleotide
taatacgactcactataggggtctttgtcttgtcttgcagcttgtcttaaaacagaggagattaagaatggctgcaagaaacctggcggcagcgcaaaagatg

SEQ ID NO: 211466 - DNA, 103 bp, Artificial Sequence
  Synthetic Polynucleotide
taatacgactcactatagggattcttctgagtctttgtcttgtcttgcagaacagaggagactgcaaatgaagacaaagaacctggcggcagcgcaaaagatg

SEQ ID NO: 211467 - DNA, 103 bp, Artificial Sequence
  Synthetic Polynucleotide
taatacgactcactatagggtttctcaataattcttctgagtctttgtctaacagaggagaagacaaatgctcagaagaaacctggcggcagcgcaaaagatg

SEQ ID NO: 211468 - DNA, 103 bp, Artificial Sequence
  Synthetic Polynucleotide
taatacgactcactataggggacaaatccttttctcaataattcttctgaaacagaggagatcagaaatgttattgagaaacctggcggcagcgcaaaagatg

SEQ ID NO: 211469 - DNA, 103 bp, Artificial Sequence
  Synthetic Polynucleotide
taatacgactcactatagggctgcatcctggacaaatccttttctcaataaacagaggagatattgaatgaaggatttgaacctggcggcagcgcaaaagatg

SEQ ID NO: 211470 - DNA, 103 bp, Artificial Sequence
  Synthetic Polynucleotide
taatacgactcactataggggggggcgcgcgcaccagcagcaccccccgcaacagaggagagcggggatggctgctggtaacctggcggcagcgcaaaagatg

SEQ ID NO: 211471 - DNA, 103 bp, Artificial Sequence
  Synthetic Polynucleotide
taatacgactcactatagggcttgtagtctctgcatcctggacaaatcctaacagaggagaaggattatgccaggatgcaacctggcggcagcgcaaaagatg

SEQ ID NO: 211472 - DNA, 103 bp, Artificial Sequence
  Synthetic Polynucleotide
taatacgactcactatagggattttctaggcttgtagtctctgcatcctgaacagaggagacaggatatggagactacaaacctggcggcagcgcaaaagatg

SEQ ID NO: 211473 - DNA, 103 bp, Artificial Sequence
  Synthetic Polynucleotide
taatacgactcactatagggaaagctgttcattttctaggcttgtagtctaacagaggagaagactaatggcctagaaaaacctggcggcagcgcaaaagatg

SEQ ID NO: 211474 - DNA, 103 bp, Artificial Sequence
  Synthetic Polynucleotide
taatacgactcactatagggtcatcgttagaaagctgttcattttctaggaacagaggagacctagaatgtgaacagctaacctggcggcagcgcaaaagatg

SEQ ID NO: 211475 - DNA, 103 bp, Artificial Sequence
  Synthetic Polynucleotide
taatacgactcactatagggcaaggcctggtcatcgttagaaagctgttcaacagaggagagaacagatgtctaacgataacctggcggcagcgcaaaagatg

SEQ ID NO: 211476 - DNA, 103 bp, Artificial Sequence
  Synthetic Polynucleotide
taatacgactcactatagggcattctgatacaaggcctggtcatcgttagaacagaggagactaacgatgaccaggcctaacctggcggcagcgcaaaagatg

SEQ ID NO: 211477 - DNA, 103 bp, Artificial Sequence
  Synthetic Polynucleotide
taatacgactcactatagggtcttccacttcattctgatacaaggcctggaacagaggagaccaggcatggtatcagaaaacctggcggcagcgcaaaagatg

SEQ ID NO: 211478 - DNA, 103 bp, Artificial Sequence
  Synthetic Polynucleotide
taatacgactcactatagggaccatcatcatcttccacttcattctgataaacagaggagatatcagatggaagtggaaaacctggcggcagcgcaaaagatg

SEQ ID NO: 211479 - DNA, 103 bp, Artificial Sequence
  Synthetic Polynucleotide
taatacgactcactatagggaactacaggcaccatcatcatcttccacttaacagaggagaaagtggatgatgatgatgaacctggcggcagcgcaaaagatg

SEQ ID NO: 211480 - DNA, 103 bp, Artificial Sequence
  Synthetic Polynucleotide
taatacgactcactatagggagatataatgaactacaggcaccatcatcaaacagaggagatgatgaatgtgcctgtagaacctggcggcagcgcaaaagatg

SEQ ID NO: 211481 - DNA, 103 bp, Artificial Sequence
  Synthetic Polynucleotide
taatacgactcactatagggcaggcaggcggggggcgcgcgcaccagcagaacagaggagactgctgatgcgcgcgcccaacctggcggcagcgcaaaagatg

SEQ ID NO: 211482 - DNA, 103 bp, Artificial Sequence
  Synthetic Polynucleotide
taatacgactcactatagggatcctcctctagatataatgaactacaggcaacagaggagagcctgtatgtcattatataacctggcggcagcgcaaaagatg

SEQ ID NO: 211483 - DNA, 103 bp, Artificial Sequence
  Synthetic Polynucleotide
taatacgactcactatagggcagaaatgtcatcctcctctagatataatgaacagaggagacattatatgtagaggaggaacctggcggcagcgcaaaagatg

SEQ ID NO: 211484 - DNA, 103 bp, Artificial Sequence
  Synthetic Polynucleotide
taatacgactcactatagggtcgtcattctcagaaatgtcatcctcctctaacagaggagaagaggaatgtgacatttcaacctggcggcagcgcaaaagatg

SEQ ID NO: 211485 - DNA, 103 bp, Artificial Sequence
  Synthetic Polynucleotide
taatacgactcactatagggttgacgtaagtcgtcattctcagaaatgtcaacagaggagagacattatggagaatgacaacctggcggcagcgcaaaagatg

SEQ ID NO: 211486 - DNA, 103 bp, Artificial Sequence
  Synthetic Polynucleotide
taatacgactcactatagggcaggcagcatttgacgtaagtcgtcattctaacagaggagaagaatgatgacttacgtcaacctggcggcagcgcaaaagatg

SEQ ID NO: 211487 - DNA, 103 bp, Artificial Sequence
  Synthetic Polynucleotide
taatacgactcactatagggtgactgtggccaggcagcatttgacgtaagaacagaggagacttacgatgaatgctgccaacctggcggcagcgcaaaagatg

SEQ ID NO: 211488 - DNA, 103 bp, Artificial Sequence
  Synthetic Polynucleotide
taatacgactcactataggggaaggaatactgactgtggccaggcagcataacagaggagaatgctgatgggccacagtaacctggcggcagcgcaaaagatg

SEQ ID NO: 211489 - DNA, 103 bp, Artificial Sequence
  Synthetic Polynucleotide
taatacgactcactatagggttccacctgtgaaggaatactgactgtggcaacagaggagagccacaatgagtattcctaacctggcggcagcgcaaaagatg

SEQ ID NO: 211490 - DNA, 103 bp, Artificial Sequence
  Synthetic Polynucleotide
taatacgactcactatagggtttccctggcttccacctgtgaaggaatacaacagaggagagtattcatgcacaggtggaacctggcggcagcgcaaaagatg

SEQ ID NO: 211491 - DNA, 103 bp, Artificial Sequence
  Synthetic Polynucleotide
taatacgactcactatagggtcctaaatgatttccctggcttccacctgtaacagaggagaacaggtatgagccagggaaacctggcggcagcgcaaaagatg

SEQ ID NO: 211492 - DNA, 103 bp, Artificial Sequence
  Synthetic Polynucleotide
taatacgactcactataggggcagcacctgcaggcaggcggggggcgcgcaacagaggagagcgcgcatgccgcctgccaacctggcggcagcgcaaaagatg

SEQ ID NO: 211493 - DNA, 103 bp, Artificial Sequence
  Synthetic Polynucleotide
taatacgactcactatagggctttttgttttcctaaatgatttccctggcaacagaggagagccaggatgatcatttagaacctggcggcagcgcaaaagatg

SEQ ID NO: 211494 - DNA, 103 bp, Artificial Sequence
  Synthetic Polynucleotide
taatacgactcactatagggctctcaatcactttttgttttcctaaatgaaacagaggagatcatttatgaaaacaaaaaacctggcggcagcgcaaaagatg

SEQ ID NO: 211495 - DNA, 103 bp, Artificial Sequence
  Synthetic Polynucleotide
taatacgactcactatagggggtcagagatctctcaatcactttttgtttaacagaggagaaaacaaatggtgattgagaacctggcggcagcgcaaaagatg

SEQ ID NO: 211496 - DNA, 103 bp, Artificial Sequence
  Synthetic Polynucleotide
taatacgactcactatagggtgttgtactcggtcagagatctctcaatcaaacagaggagatgattgatggatctctgaaacctggcggcagcgcaaaagatg

SEQ ID NO: 211497 - DNA, 103 bp, Artificial Sequence
  Synthetic Polynucleotide
taatacgactcactatagggtccattgtgctgttgtactcggtcagagataacagaggagaatctctatgcgagtacaaaacctggcggcagcgcaaaagatg

SEQ ID NO: 211498 - DNA, 103 bp, Artificial Sequence
  Synthetic Polynucleotide
taatacgactcactatagggctcaaccctctccattgtgctgttgtactcaacagaggagagagtacatgagcacaatgaacctggcggcagcgcaaaagatg

SEQ ID NO: 211499 - DNA, 103 bp, Artificial Sequence
  Synthetic Polynucleotide
taatacgactcactataggggcacctgagactcaaccctctccattgtgcaacagaggagagcacaaatgagagggttgaacctggcggcagcgcaaaagatg

SEQ ID NO: 211500 - DNA, 103 bp, Artificial Sequence
  Synthetic Polynucleotide
taatacgactcactatagggtttcttttaagcacctgagactcaaccctcaacagaggagagagggtatggtctcaggtaacctggcggcagcgcaaaagatg

SEQ ID NO: 211501 - DNA, 103 bp, Artificial Sequence
  Synthetic Polynucleotide
taatacgactcactataggggtagcattcatttcttttaagcacctgagaaacagaggagatctcagatgcttaaaagaaacctggcggcagcgcaaaagatg

SEQ ID NO: 211502 - DNA, 103 bp, Artificial Sequence
  Synthetic Polynucleotide
taatacgactcactatagggcagtgggtttgtagcattcatttcttttaaaacagaggagattaaaaatgatgaatgctaacctggcggcagcgcaaaagatg

SEQ ID NO: 211503 - DNA, 103 bp, Artificial Sequence
  Synthetic Polynucleotide
taatacgactcactatagggcaggcatcgcgcagcacctgcaggcaggcgaacagaggagacgcctgatggcaggtgctaacctggcggcagcgcaaaagatg

SEQ ID NO: 211504 - DNA, 103 bp, Artificial Sequence
  Synthetic Polynucleotide
taatacgactcactataggggcatgcagcccagtgggtttgtagcattcaaacagaggagatgaatgatgcaaacccacaacctggcggcagcgcaaaagatg

SEQ ID NO: 211505 - DNA, 103 bp, Artificial Sequence
  Synthetic Polynucleotide
taatacgactcactatagggacctggggtagcatgcagcccagtgggtttaacagaggagaaaacccatggggctgcataacctggcggcagcgcaaaagatg

SEQ ID NO: 211506 - DNA, 103 bp, Artificial Sequence
  Synthetic Polynucleotide
taatacgactcactatagggcttggctttcacctggggtagcatgcagccaacagaggagaggctgcatgctaccccagaacctggcggcagcgcaaaagatg

SEQ ID NO: 211507 - DNA, 103 bp, Artificial Sequence
  Synthetic Polynucleotide
taatacgactcactatagggaggttaggttcttggctttcacctggggtaaacagaggagataccccatgtgaaagccaaacctggcggcagcgcaaaagatg

SEQ ID NO: 211508 - DNA, 103 bp, Artificial Sequence
  Synthetic Polynucleotide
taatacgactcactatagggttcagcagagaggttaggttcttggctttcaacagaggagagaaagcatggaacctaacaacctggcggcagcgcaaaagatg

SEQ ID NO: 211509 - DNA, 103 bp, Artificial Sequence
  Synthetic Polynucleotide
taatacgactcactatagggggccacaactttcagcagagaggttaggttaacagaggagaaacctaatgtctctgctgaacctggcggcagcgcaaaagatg

SEQ ID NO: 211510 - DNA, 103 bp, Artificial Sequence
  Synthetic Polynucleotide
taatacgactcactatagggcctgaatttaggccacaactttcagcagagaacagaggagactctgcatgaagttgtggaacctggcggcagcgcaaaagatg

SEQ ID NO: 211511 - DNA, 103 bp, Artificial Sequence
  Synthetic Polynucleotide
taatacgactcactatagggaaactgggcccctgaatttaggccacaactaacagaggagaagttgtatgctaaattcaaacctggcggcagcgcaaaagatg

SEQ ID NO: 211512 - DNA, 103 bp, Artificial Sequence
  Synthetic Polynucleotide
taatacgactcactatagggagttaaaaccaaactgggcccctgaatttaaacagaggagataaattatggggcccagtaacctggcggcagcgcaaaagatg

SEQ ID NO: 211513 - DNA, 103 bp, Artificial Sequence
  Synthetic Polynucleotide
taatacgactcactatagggtcttcttcgtagttaaaaccaaactgggccaacagaggagaggcccaatgtggttttaaaacctggcggcagcgcaaaagatg

SEQ ID NO: 211514 - DNA, 103 bp, Artificial Sequence
  Synthetic Polynucleotide
taatacgactcactatagggccggcgccgccaggcatcgcgcagcacctgaacagaggagacaggtgatgcgcgatgccaacctggcggcagcgcaaaagatg

SEQ ID NO: 211515 - DNA, 103 bp, Artificial Sequence
  Synthetic Polynucleotide
taatacgactcactatagggaacactgggttcttcttcgtagttaaaaccaacagaggagaggttttatgtacgaagaaaacctggcggcagcgcaaaagatg

SEQ ID NO: 211516 - DNA, 103 bp, Artificial Sequence
  Synthetic Polynucleotide
taatacgactcactatagggcacatttagcaacactgggttcttcttcgtaacagaggagaacgaagatgaacccagtgaacctggcggcagcgcaaaagatg

SEQ ID NO: 211517 - DNA, 103 bp, Artificial Sequence
  Synthetic Polynucleotide
taatacgactcactataggggaggcctgtacacatttagcaacactgggtaacagaggagaacccagatgtgctaaatgaacctggcggcagcgcaaaagatg

SEQ ID NO: 211518 - DNA, 103 bp, Artificial Sequence
  Synthetic Polynucleotide
taatacgactcactatagggagcaggtgctgaggcctgtacacatttagcaacagaggagagctaaaatggtacaggccaacctggcggcagcgcaaaagatg

SEQ ID NO: 211519 - DNA, 103 bp, Artificial Sequence
  Synthetic Polynucleotide
taatacgactcactatagggttctttcatcagcaggtgctgaggcctgtaaacagaggagatacaggatgcagcacctgaacctggcggcagcgcaaaagatg

SEQ ID NO: 211520 - DNA, 103 bp, Artificial Sequence
  Synthetic Polynucleotide
taatacgactcactatagggtaatcaaagattctttcatcagcaggtgctaacagaggagaagcaccatgtgatgaaagaacctggcggcagcgcaaaagatg

SEQ ID NO: 211521 - DNA, 103 bp, Artificial Sequence
  Synthetic Polynucleotide
taatacgactcactatagggtgcgctatagtaatcaaagattctttcatcaacagaggagagatgaaatgatctttgataacctggcggcagcgcaaaagatg

SEQ ID NO: 211522 - DNA, 103 bp, Artificial Sequence
  Synthetic Polynucleotide
taatacgactcactatagggtggcttttcttgcgctatagtaatcaaagaaacagaggagatctttgatgactatagcgaacctggcggcagcgcaaaagatg

SEQ ID NO: 211523 - DNA, 103 bp, Artificial Sequence
  Synthetic Polynucleotide
taatacgactcactataggggcttcaaaactggcttttcttgcgctatagaacagaggagactatagatgaagaaaagcaacctggcggcagcgcaaaagatg

SEQ ID NO: 211524 - DNA, 103 bp, Artificial Sequence
  Synthetic Polynucleotide
taatacgactcactatagggtatgacttcagcttcaaaactggcttttctaacagaggagaagaaaaatgagttttgaaaacctggcggcagcgcaaaagatg

SEQ ID NO: 211525 - DNA, 103 bp, Artificial Sequence
  Synthetic Polynucleotide
taatacgactcactataggggccgcagggcccggcgccgccaggcatcgcaacagaggagagcgatgatgggcggcgccaacctggcggcagcgcaaaagatg

SEQ ID NO: 211526 - DNA, 103 bp, Artificial Sequence
  Synthetic Polynucleotide
taatacgactcactatagggtagtgtcttgtatgacttcagcttcaaaacaacagaggagagttttgatgctgaagtcaaacctggcggcagcgcaaaagatg

SEQ ID NO: 211527 - DNA, 103 bp, Artificial Sequence
  Synthetic Polynucleotide
taatacgactcactataggggtgtcaccaatagtgtcttgtatgacttcaaacagaggagatgaagtatgacaagacacaacctggcggcagcgcaaaagatg

SEQ ID NO: 211528 - DNA, 103 bp, Artificial Sequence
  Synthetic Polynucleotide
taatacgactcactatagggcttctttcctgtgtcaccaatagtgtcttgaacagaggagacaagacatgattggtgacaacctggcggcagcgcaaaagatg

SEQ ID NO: 211529 - DNA, 103 bp, Artificial Sequence
  Synthetic Polynucleotide
taatacgactcactatagggagctagctggcttctttcctgtgtcaccaaaacagaggagattggtgatgcaggaaagaaacctggcggcagcgcaaaagatg

SEQ ID NO: 211530 - DNA, 103 bp, Artificial Sequence
  Synthetic Polynucleotide
taatacgactcactatagggctctgactccagctagctggcttctttcctaacagaggagaaggaaaatggccagctagaacctggcggcagcgcaaaagatg

SEQ ID NO: 211531 - DNA, 103 bp, Artificial Sequence
  Synthetic Polynucleotide
taatacgactcactatagggattctgaggactctgactccagctagctggaacagaggagaccagctatgtggagtcagaacctggcggcagcgcaaaagatg

SEQ ID NO: 211532 - DNA, 103 bp, Artificial Sequence
  Synthetic Polynucleotide
taatacgactcactatagggtcatttcctgattctgaggactctgactccaacagaggagaggagtcatggtcctcagaaacctggcggcagcgcaaaagatg

SEQ ID NO: 211533 - DNA, 103 bp, Artificial Sequence
  Synthetic Polynucleotide
taatacgactcactatagggaaatgttttctcatttcctgattctgaggaaacagaggagatcctcaatgtcaggaaataacctggcggcagcgcaaaagatg

SEQ ID NO: 211534 - DNA, 103 bp, Artificial Sequence
  Synthetic Polynucleotide
taatacgactcactatagggcttttgtgggaaatgttttctcatttcctgaacagaggagacaggaaatgagaaaacataacctggcggcagcgcaaaagatg

SEQ ID NO: 211535 - DNA, 103 bp, Artificial Sequence
  Synthetic Polynucleotide
taatacgactcactatagggaaagttggaacttttgtgggaaatgttttcaacagaggagagaaaacatgtcccacaaaaacctggcggcagcgcaaaagatg

SEQ ID NO: 211536 - DNA, 103 bp, Artificial Sequence
  Synthetic Polynucleotide
taatacgactcactatagggccgcgcggcggccgcagggcccggcgccgcaacagaggagagcggcgatgggccctgcgaacctggcggcagcgcaaaagatg

SEQ ID NO: 211537 - DNA, 103 bp, Artificial Sequence
  Synthetic Polynucleotide
taatacgactcactataggggaagtgttgaaaagttggaacttttgtgggaacagaggagacccacaatggttccaactaacctggcggcagcgcaaaagatg

SEQ ID NO: 211538 - DNA, 103 bp, Artificial Sequence
  Synthetic Polynucleotide
taatacgactcactatagggtggcatatgtgaagtgttgaaaagttggaaaacagaggagattccaaatgttcaacactaacctggcggcagcgcaaaagatg

SEQ ID NO: 211539 - DNA, 103 bp, Artificial Sequence
  Synthetic Polynucleotide
taatacgactcactataggggagccaacactggcatatgtgaagtgttgaaacagaggagatcaacaatgcacatatgcaacctggcggcagcgcaaaagatg

SEQ ID NO: 211540 - DNA, 103 bp, Artificial Sequence
  Synthetic Polynucleotide
taatacgactcactatagggtggacatcctgagccaacactggcatatgtaacagaggagaacatatatgagtgttggcaacctggcggcagcgcaaaagatg

SEQ ID NO: 211541 - DNA, 103 bp, Artificial Sequence
  Synthetic Polynucleotide
taatacgactcactataggggtgttcatattggacatcctgagccaacacaacagaggagagtgttgatgcaggatgtcaacctggcggcagcgcaaaagatg

SEQ ID NO: 211542 - DNA, 103 bp, Artificial Sequence
  Synthetic Polynucleotide
taatacgactcactatagggccaagtgactgtgttcatattggacatcctaacagaggagaaggatgatgaatatgaacaacctggcggcagcgcaaaagatg

SEQ ID NO: 211543 - DNA, 103 bp, Artificial Sequence
  Synthetic Polynucleotide
taatacgactcactatagggtctgtcccttccaagtgactgtgttcatataacagaggagaatatgaatgcagtcacttaacctggcggcagcgcaaaagatg

SEQ ID NO: 211544 - DNA, 103 bp, Artificial Sequence
  Synthetic Polynucleotide
taatacgactcactataggggctgtgattttctgtcccttccaagtgactaacagaggagaagtcacatggaagggacaaacctggcggcagcgcaaaagatg

SEQ ID NO: 211545 - DNA, 103 bp, Artificial Sequence
  Synthetic Polynucleotide
taatacgactcactatagggctcctgccatgctgtgattttctgtcccttaacagaggagaaagggaatgaaaatcacaaacctggcggcagcgcaaaagatg

SEQ ID NO: 211546 - DNA, 103 bp, Artificial Sequence
  Synthetic Polynucleotide
taatacgactcactatagggattccactatctcctgccatgctgtgatttaacagaggagaaaatcaatgcatggcaggaacctggcggcagcgcaaaagatg

SEQ ID NO: 211547 - DNA, 103 bp, Artificial Sequence
  Synthetic Polynucleotide
taatacgactcactataggggatgcggaagccgcgcggcggccgcagggcaacagaggagagccctgatgccgccgcgcaacctggcggcagcgcaaaagatg

SEQ ID NO: 211548 - DNA, 103 bp, Artificial Sequence
  Synthetic Polynucleotide
taatacgactcactatagggtggagaatctattccactatctcctgccataacagaggagaatggcaatggatagtggaaacctggcggcagcgcaaaagatg

SEQ ID NO: 211549 - DNA, 103 bp, Artificial Sequence
  Synthetic Polynucleotide
taatacgactcactatagggtctgtgtccgtggagaatctattccactataacagaggagaatagtgatgtagattctcaacctggcggcagcgcaaaagatg

SEQ ID NO: 211550 - DNA, 103 bp, Artificial Sequence
  Synthetic Polynucleotide
taatacgactcactataggggatcccagactctgtgtccgtggagaatctaacagaggagaagattcatgacggacacaaacctggcggcagcgcaaaagatg

SEQ ID NO: 211551 - DNA, 103 bp, Artificial Sequence
  Synthetic Polynucleotide
taatacgactcactatagggtgaattattagatcccagactctgtgtccgaacagaggagacggacaatgagtctgggaaacctggcggcagcgcaaaagatg

SEQ ID NO: 211552 - DNA, 103 bp, Artificial Sequence
  Synthetic Polynucleotide
taatacgactcactatagggccaaaatgactgaattattagatcccagacaacagaggagagtctggatgctaataattaacctggcggcagcgcaaaagatg

SEQ ID NO: 211553 - DNA, 103 bp, Artificial Sequence
  Synthetic Polynucleotide
taatacgactcactatagggtttagtccatccaaaatgactgaattattaaacagaggagataataaatgagtcattttaacctggcggcagcgcaaaagatg

SEQ ID NO: 211554 - DNA, 103 bp, Artificial Sequence
  Synthetic Polynucleotide
taatacgactcactatagggctgtcttctttttagtccatccaaaatgacaacagaggagagtcattatggatggactaaacctggcggcagcgcaaaagatg

SEQ ID NO: 211555 - DNA, 103 bp, Artificial Sequence
  Synthetic Polynucleotide
taatacgactcactataggggcagaaaattctgtcttctttttagtccataacagaggagaatggacatgaaagaagacaacctggcggcagcgcaaaagatg

SEQ ID NO: 211556 - DNA, 103 bp, Artificial Sequence
  Synthetic Polynucleotide
taatacgactcactatagggtcgacattttgcagaaaattctgtcttcttaacagaggagaaagaagatggaattttctaacctggcggcagcgcaaaagatg

SEQ ID NO: 211557 - DNA, 103 bp, Artificial Sequence
  Synthetic Polynucleotide
taatacgactcactatagggctttgtgccttcgacattttgcagaaaattaacagaggagaaattttatgcaaaatgtcaacctggcggcagcgcaaaagatg

SEQ ID NO: 211558 - DNA, 103 bp, Artificial Sequence
  Synthetic Polynucleotide
taatacgactcactatagggccaccgccctgatgcggaagccgcgcggcgaacagaggagacgccgcatggcttccgcaaacctggcggcagcgcaaaagatg

SEQ ID NO: 211559 - DNA, 103 bp, Artificial Sequence
  Synthetic Polynucleotide
taatacgactcactataggggttgactgctctttgtgccttcgacattttaacagaggagaaaaatgatgaaggcacaaaacctggcggcagcgcaaaagatg

SEQ ID NO: 211560 - DNA, 103 bp, Artificial Sequence
  Synthetic Polynucleotide
taatacgactcactataggggatgtgagtggttgactgctctttgtgcctaacagaggagaaggcacatggagcagtcaaacctggcggcagcgcaaaagatg

SEQ ID NO: 211561 - DNA, 103 bp, Artificial Sequence
  Synthetic Polynucleotide
taatacgactcactatagggtaaggaattagatgtgagtggttgactgctaacagaggagaagcagtatgccactcacaaacctggcggcagcgcaaaagatg

SEQ ID NO: 211562 - DNA, 103 bp, Artificial Sequence
  Synthetic Polynucleotide
taatacgactcactatagggttagcggtagtaaggaattagatgtgagtgaacagaggagacactcaatgctaattcctaacctggcggcagcgcaaaagatg

SEQ ID NO: 211563 - DNA, 103 bp, Artificial Sequence
  Synthetic Polynucleotide
taatacgactcactatagggatgactggagttagcggtagtaaggaattaaacagaggagataattcatgactaccgctaacctggcggcagcgcaaaagatg

SEQ ID NO: 211564 - DNA, 103 bp, Artificial Sequence
  Synthetic Polynucleotide
taatacgactcactatagggttaaacgtttatgactggagttagcggtagaacagaggagactaccgatgactccagtcaacctggcggcagcgcaaaagatg

SEQ ID NO: 211565 - DNA, 103 bp, Artificial Sequence
  Synthetic Polynucleotide
taatacgactcactatagggcacagcactagcgccagcgagcccggcgccaacagaggagaggcgccatgctcgctggcaacctggcggcagcgcaaaagatg

SEQ ID NO: 211566 - DNA, 103 bp, Artificial Sequence
  Synthetic Polynucleotide
taatacgactcactatagggaagacatcacccaccgccctgatgcggaagaacagaggagacttccgatgcagggcggtaacctggcggcagcgcaaaagatg

SEQ ID NO: 211567 - DNA, 103 bp, Artificial Sequence
  Synthetic Polynucleotide
taatacgactcactatagggttgcactggaaagacatcacccaccgccctaacagaggagaagggcgatgggtgatgtcaacctggcggcagcgcaaaagatg

SEQ ID NO: 211568 - DNA, 103 bp, Artificial Sequence
  Synthetic Polynucleotide
taatacgactcactatagggttggattcatttgcactggaaagacatcacaacagaggagagtgatgatgttccagtgcaacctggcggcagcgcaaaagatg

SEQ ID NO: 211569 - DNA, 103 bp, Artificial Sequence
  Synthetic Polynucleotide
taatacgactcactataggggattgagttattggattcatttgcactggaaacagaggagatccagtatgaatgaatccaacctggcggcagcgcaaaagatg

SEQ ID NO: 211570 - DNA, 103 bp, Artificial Sequence
  Synthetic Polynucleotide
taatacgactcactatagggtacgaactgagattgagttattggattcataacagaggagaatgaatatgataactcaaaacctggcggcagcgcaaaagatg

SEQ ID NO: 211571 - DNA, 103 bp, Artificial Sequence
  Synthetic Polynucleotide
taatacgactcactatagggcacccaaaggtacgaactgagattgagttaaacagaggagataactcatgctcagttcgaacctggcggcagcgcaaaagatg

SEQ ID NO: 211572 - DNA, 103 bp, Artificial Sequence
  Synthetic Polynucleotide
taatacgactcactatagggcaaagaacttcacccaaaggtacgaactgaaacagaggagatcagttatgacctttgggaacctggcggcagcgcaaaagatg

SEQ ID NO: 211573 - DNA, 103 bp, Artificial Sequence
  Synthetic Polynucleotide
taatacgactcactatagggtatagcacagcaaagaacttcacccaaaggaacagaggagacctttgatggaagttcttaacctggcggcagcgcaaaagatg

SEQ ID NO: 211574 - DNA, 103 bp, Artificial Sequence
  Synthetic Polynucleotide
taatacgactcactatagggtcatatcagatatagcacagcaaagaacttaacagaggagaaagttcatggctgtgctaaacctggcggcagcgcaaaagatg

SEQ ID NO: 211575 - DNA, 103 bp, Artificial Sequence
  Synthetic Polynucleotide
taatacgactcactatagggtgagctgtattcatatcagatatagcacagaacagaggagactgtgcatgatctgatataacctggcggcagcgcaaaagatg

SEQ ID NO: 211576 - DNA, 103 bp, Artificial Sequence
  Synthetic Polynucleotide
taatacgactcactatagggctccagccggcacagcactagcgccagcgaaacagaggagatcgctgatgctagtgctgaacctggcggcagcgcaaaagatg

SEQ ID NO: 211577 - DNA, 103 bp, Artificial Sequence
  Synthetic Polynucleotide
taatacgactcactatagggtactacaatctgagctgtattcatatcagaaacagaggagatctgatatgaatacagctaacctggcggcagcgcaaaagatg

SEQ ID NO: 211578 - DNA, 103 bp, Artificial Sequence
  Synthetic Polynucleotide
taatacgactcactatagggattcctgcgttactacaatctgagctgtataacagaggagaatacagatgagattgtagaacctggcggcagcgcaaaagatg

SEQ ID NO: 211579 - DNA, 103 bp, Artificial Sequence
  Synthetic Polynucleotide
taatacgactcactatagggtccaaaagtgattcctgcgttactacaatcaacagaggagagattgtatgaacgcaggaaacctggcggcagcgcaaaagatg

SEQ ID NO: 211580 - DNA, 103 bp, Artificial Sequence
  Synthetic Polynucleotide
taatacgactcactatagggcatcaaacgctccaaaagtgattcctgcgtaacagaggagaacgcagatgtcacttttgaacctggcggcagcgcaaaagatg

SEQ ID NO: 211581 - DNA, 103 bp, Artificial Sequence
  Synthetic Polynucleotide
taatacgactcactatagggggtaatgtttcatcaaacgctccaaaagtgaacagaggagacactttatgagcgtttgaaacctggcggcagcgcaaaagatg

SEQ ID NO: 211582 - DNA, 103 bp, Artificial Sequence
  Synthetic Polynucleotide
taatacgactcactataggggcaatgcctgggtaatgtttcatcaaacgcaacagaggagagcgtttatggaaacattaaacctggcggcagcgcaaaagatg

SEQ ID NO: 211583 - DNA, 103 bp, Artificial Sequence
  Synthetic Polynucleotide
taatacgactcactatagggcgatggaattgcaatgcctgggtaatgtttaacagaggagaaaacatatgccaggcattaacctggcggcagcgcaaaagatg

SEQ ID NO: 211584 - DNA, 103 bp, Artificial Sequence
  Synthetic Polynucleotide
taatacgactcactataggggaatatcttccgatggaattgcaatgcctgaacagaggagacaggcaatgcaattccataacctggcggcagcgcaaaagatg

SEQ ID NO: 211585 - DNA, 103 bp, Artificial Sequence
  Synthetic Polynucleotide
taatacgactcactataggggtggtataaagaatatcttccgatggaattaacagaggagaaattccatgggaagatataacctggcggcagcgcaaaagatg

SEQ ID NO: 211586 - DNA, 103 bp, Artificial Sequence
  Synthetic Polynucleotide
taatacgactcactatagggcgttcccagagtggtataaagaatatcttcaacagaggagagaagatatgctttataccaacctggcggcagcgcaaaagatg

SEQ ID NO: 211587 - DNA, 103 bp, Artificial Sequence
  Synthetic Polynucleotide
taatacgactcactatagggccttctgcgcctccagccggcacagcactaaacagaggagatagtgcatggccggctggaacctggcggcagcgcaaaagatg

SEQ ID NO: 211588 - DNA, 103 bp, Artificial Sequence
  Synthetic Polynucleotide
taatacgactcactatagggctttaatcagcgttcccagagtggtataaaaacagaggagatttataatgctctgggaaaacctggcggcagcgcaaaagatg

SEQ ID NO: 211589 - DNA, 103 bp, Artificial Sequence
  Synthetic Polynucleotide
taatacgactcactatagggatcttcctttctttaatcagcgttcccagaaacagaggagatctgggatggctgattaaaacctggcggcagcgcaaaagatg

SEQ ID NO: 211590 - DNA, 103 bp, Artificial Sequence
  Synthetic Polynucleotide
taatacgactcactatagggagtgtgataaatcttcctttctttaatcagaacagaggagactgattatggaaaggaagaacctggcggcagcgcaaaagatg

SEQ ID NO: 211591 - DNA, 103 bp, Artificial Sequence
  Synthetic Polynucleotide
taatacgactcactatagggatccttctccagtgtgataaatcttcctttaacagaggagaaaaggaatgtttatcacaaacctggcggcagcgcaaaagatg

SEQ ID NO: 211592 - DNA, 103 bp, Artificial Sequence
  Synthetic Polynucleotide
taatacgactcactatagggactatgaagtatccttctccagtgtgataaaacagaggagattatcaatgtggagaaggaacctggcggcagcgcaaaagatg

SEQ ID NO: 211593 - DNA, 103 bp, Artificial Sequence
  Synthetic Polynucleotide
taatacgactcactatagggctgaggagtaactatgaagtatccttctccaacagaggagaggagaaatgtacttcataaacctggcggcagcgcaaaagatg

SEQ ID NO: 211594 - DNA, 103 bp, Artificial Sequence
  Synthetic Polynucleotide
taatacgactcactatagggtgaagtaagtctgaggagtaactatgaagtaacagaggagaacttcaatgttactcctcaacctggcggcagcgcaaaagatg

SEQ ID NO: 211595 - DNA, 103 bp, Artificial Sequence
  Synthetic Polynucleotide
taatacgactcactataggggtatttgtaatgaagtaagtctgaggagtaaacagaggagatactccatggacttacttaacctggcggcagcgcaaaagatg

SEQ ID NO: 211596 - DNA, 103 bp, Artificial Sequence
  Synthetic Polynucleotide
taatacgactcactatagggctgggtggttgtatttgtaatgaagtaagtaacagaggagaacttacatgattacaaataacctggcggcagcgcaaaagatg

SEQ ID NO: 211597 - DNA, 103 bp, Artificial Sequence
  Synthetic Polynucleotide
taatacgactcactatagggtcttattttcctgggtggttgtatttgtaaaacagaggagattacaaatgcaaccacccaacctggcggcagcgcaaaagatg

SEQ ID NO: 211598 - DNA, 103 bp, Artificial Sequence
  Synthetic Polynucleotide
taatacgactcactataggggcccccgccgccttctgcgcctccagccggaacagaggagaccggctatgggcgcagaaaacctggcggcagcgcaaaagatg

SEQ ID NO: 211599 - DNA, 103 bp, Artificial Sequence
  Synthetic Polynucleotide
taatacgactcactatagggggcagcattctcttattttcctgggtggttaacagaggagaaaccacatgggaaaataaaacctggcggcagcgcaaaagatg

SEQ ID NO: 211600 - DNA, 103 bp, Artificial Sequence
  Synthetic Polynucleotide
taatacgactcactatagggttcatctgatggcagcattctcttattttcaacagaggagagaaaatatgagaatgctgaacctggcggcagcgcaaaagatg

SEQ ID NO: 211601 - DNA, 103 bp, Artificial Sequence
  Synthetic Polynucleotide
taatacgactcactatagggtcaggcgactttcatctgatggcagcattcaacagaggagagaatgcatgcatcagatgaacctggcggcagcgcaaaagatg

SEQ ID NO: 211602 - DNA, 103 bp, Artificial Sequence
  Synthetic Polynucleotide
taatacgactcactataggggaagctggcatcaggcgactttcatctgataacagaggagaatcagaatgaagtcgcctaacctggcggcagcgcaaaagatg

SEQ ID NO: 211603 - DNA, 103 bp, Artificial Sequence
  Synthetic Polynucleotide
taatacgactcactatagggatatgtcatggaagctggcatcaggcgactaacagaggagaagtcgcatgatgccagctaacctggcggcagcgcaaaagatg

SEQ ID NO: 211604 - DNA, 103 bp, Artificial Sequence
  Synthetic Polynucleotide
taatacgactcactatagggtgctcaccagatatgtcatggaagctggcaaacagaggagatgccagatgccatgacataacctggcggcagcgcaaaagatg

SEQ ID NO: 211605 - DNA, 103 bp, Artificial Sequence
  Synthetic Polynucleotide
taatacgactcactatagggcagctctccatgctcaccagatatgtcatgaacagaggagacatgacatgtctggtgagaacctggcggcagcgcaaaagatg

SEQ ID NO: 211606 - DNA, 103 bp, Artificial Sequence
  Synthetic Polynucleotide
taatacgactcactatagggtgactctgcacagctctccatgctcaccagaacagaggagactggtgatgatggagagcaacctggcggcagcgcaaaagatg

SEQ ID NO: 211607 - DNA, 103 bp, Artificial Sequence
  Synthetic Polynucleotide
taatacgactcactatagggtctcttgggctgactctgcacagctctccaaacagaggagatggagaatggtgcagagtaacctggcggcagcgcaaaagatg

SEQ ID NO: 211608 - DNA, 103 bp, Artificial Sequence
  Synthetic Polynucleotide
taatacgactcactatagggggggcagcattctcttgggctgactctgcaaacagaggagatgcagaatgagcccaagaaacctggcggcagcgcaaaagatg

SEQ ID NO: 211609 - DNA, 103 bp, Artificial Sequence
  Synthetic Polynucleotide
taatacgactcactatagggctcctccgcggcccccgccgccttctgcgcaacagaggagagcgcagatggcggcggggaacctggcggcagcgcaaaagatg

SEQ ID NO: 211610 - DNA, 103 bp, Artificial Sequence
  Synthetic Polynucleotide
taatacgactcactataggggtgggatatgggggcagcattctcttgggcaacagaggagagcccaaatgaatgctgccaacctggcggcagcgcaaaagatg

SEQ ID NO: 211611 - DNA, 103 bp, Artificial Sequence
  Synthetic Polynucleotide
taatacgactcactatagggaagactgacagtgggatatgggggcagcataacagaggagaatgctgatgccatatcccaacctggcggcagcgcaaaagatg

SEQ ID NO: 211612 - DNA, 103 bp, Artificial Sequence
  Synthetic Polynucleotide
taatacgactcactatagggaaacactggcaagactgacagtgggatatgaacagaggagacatatcatgctgtcagtcaacctggcggcagcgcaaaagatg

SEQ ID NO: 211613 - DNA, 103 bp, Artificial Sequence
  Synthetic Polynucleotide
taatacgactcactatagggcatgtcccggaaacactggcaagactgacaaacagaggagatgtcagatgtgccagtgtaacctggcggcagcgcaaaagatg

SEQ ID NO: 211614 - DNA, 103 bp, Artificial Sequence
  Synthetic Polynucleotide
taatacgactcactatagggcctgagtgtgcatgtcccggaaacactggcaacagaggagagccagtatgtccgggacaaacctggcggcagcgcaaaagatg

SEQ ID NO: 211615 - DNA, 103 bp, Artificial Sequence
  Synthetic Polynucleotide
taatacgactcactatagggtcctgaacatcctgagtgtgcatgtcccggaacagaggagaccgggaatggcacactcaaacctggcggcagcgcaaaagatg

SEQ ID NO: 211616 - DNA, 103 bp, Artificial Sequence
  Synthetic Polynucleotide
taatacgactcactatagggaactggtgcttcctgaacatcctgagtgtgaacagaggagacacactatggatgttcagaacctggcggcagcgcaaaagatg

SEQ ID NO: 211617 - DNA, 103 bp, Artificial Sequence
  Synthetic Polynucleotide
taatacgactcactatagggcttctgcagcaactggtgcttcctgaacataacagaggagaatgttcatgaagcaccagaacctggcggcagcgcaaaagatg

SEQ ID NO: 211618 - DNA, 103 bp, Artificial Sequence
  Synthetic Polynucleotide
taatacgactcactatagggttcctagtcacttctgcagcaactggtgctaacagaggagaagcaccatgtgctgcagaaacctggcggcagcgcaaaagatg

SEQ ID NO: 211619 - DNA, 103 bp, Artificial Sequence
  Synthetic Polynucleotide
taatacgactcactatagggtctgtgactcttcctagtcacttctgcagcaacagaggagagctgcaatggtgactaggaacctggcggcagcgcaaaagatg

SEQ ID NO: 211620 - DNA, 103 bp, Artificial Sequence
  Synthetic Polynucleotide
taatacgactcactataggggcccaccaggctcctccgcggcccccgccgaacagaggagacggcggatgccgcggaggaacctggcggcagcgcaaaagatg

SEQ ID NO: 211621 - DNA, 103 bp, Artificial Sequence
  Synthetic Polynucleotide
taatacgactcactatagggccccaagacctctgtgactcttcctagtcaaacagaggagatgactaatgagagtcacaaacctggcggcagcgcaaaagatg

SEQ ID NO: 211622 - DNA, 103 bp, Artificial Sequence
  Synthetic Polynucleotide
taatacgactcactataggggatacggattccccaagacctctgtgactcaacagaggagagagtcaatgaggtcttggaacctggcggcagcgcaaaagatg

SEQ ID NO: 211623 - DNA, 103 bp, Artificial Sequence
  Synthetic Polynucleotide
taatacgactcactatagggctgtacccaagatacggattccccaagaccaacagaggagaggtcttatggaatccgtaaacctggcggcagcgcaaaagatg

SEQ ID NO: 211624 - DNA, 103 bp, Artificial Sequence
  Synthetic Polynucleotide
taatacgactcactatagggctgccccattctgtacccaagatacggattaacagaggagaaatccgatgcttgggtacaacctggcggcagcgcaaaagatg

SEQ ID NO: 211625 - DNA, 103 bp, Artificial Sequence
  Synthetic Polynucleotide
taatacgactcactataggggacactgaaactgccccattctgtacccaaaacagaggagattgggtatggaatggggcaacctggcggcagcgcaaaagatg

SEQ ID NO: 211626 - DNA, 103 bp, Artificial Sequence
  Synthetic Polynucleotide
taatacgactcactataggggtgctccgcagacactgaaactgccccattaacagaggagaaatgggatggtttcagtgaacctggcggcagcgcaaaagatg

SEQ ID NO: 211627 - DNA, 103 bp, Artificial Sequence
  Synthetic Polynucleotide
taatacgactcactatagggcacaaatgtggtgctccgcagacactgaaaaacagaggagatttcagatgctgcggagcaacctggcggcagcgcaaaagatg

SEQ ID NO: 211628 - DNA, 103 bp, Artificial Sequence
  Synthetic Polynucleotide
taatacgactcactatagggttggtgctctcacaaatgtggtgctccgcaaacagaggagatgcggaatgccacatttgaacctggcggcagcgcaaaagatg

SEQ ID NO: 211629 - DNA, 103 bp, Artificial Sequence
  Synthetic Polynucleotide
taatacgactcactatagggtggtaaaggtttggtgctctcacaaatgtgaacagaggagacacattatggagagcaccaacctggcggcagcgcaaaagatg

SEQ ID NO: 211630 - DNA, 103 bp, Artificial Sequence
  Synthetic Polynucleotide
taatacgactcactatagggctcttgtgtatggtaaaggtttggtgctctaacagaggagaagagcaatgaacctttacaacctggcggcagcgcaaaagatg

SEQ ID NO: 211631 - DNA, 103 bp, Artificial Sequence
  Synthetic Polynucleotide
taatacgactcactatagggaacaccgcgcgcccaccaggctcctccgcgaacagaggagacgcggaatggcctggtggaacctggcggcagcgcaaaagatg

SEQ ID NO: 211632 - DNA, 103 bp, Artificial Sequence
  Synthetic Polynucleotide
taatacgactcactatagggttttctttatctcttgtgtatggtaaaggtaacagaggagaacctttatgatacacaagaacctggcggcagcgcaaaagatg

SEQ ID NO: 211633 - DNA, 103 bp, Artificial Sequence
  Synthetic Polynucleotide
taatacgactcactatagggcttcttgcctttttctttatctcttgtgtaaacagaggagatacacaatggataaagaaaacctggcggcagcgcaaaagatg

SEQ ID NO: 211634 - DNA, 103 bp, Artificial Sequence
  Synthetic Polynucleotide
taatacgactcactatagggtaaaaccaaacttcttgcctttttctttataacagaggagaataaagatgaaggcaagaaacctggcggcagcgcaaaagatg

SEQ ID NO: 211635 - DNA, 103 bp, Artificial Sequence
  Synthetic Polynucleotide
taatacgactcactatagggcataagagactaaaaccaaacttcttgcctaacagaggagaaggcaaatggtttggtttaacctggcggcagcgcaaaagatg

SEQ ID NO: 211636 - DNA, 103 bp, Artificial Sequence
  Synthetic Polynucleotide
taatacgactcactatagggtaagctgcgccataagagactaaaaccaaaaacagaggagatttggtatgagtctcttaaacctggcggcagcgcaaaagatg

SEQ ID NO: 211637 - DNA, 103 bp, Artificial Sequence
  Synthetic Polynucleotide
taatacgactcactatagggcctttctagataagctgcgccataagagacaacagaggagagtctctatgggcgcagctaacctggcggcagcgcaaaagatg

SEQ ID NO: 211638 - DNA, 103 bp, Artificial Sequence
  Synthetic Polynucleotide
taatacgactcactatagggttgggcttctcctttctagataagctgcgcaacagaggagagcgcagatgatctagaaaaacctggcggcagcgcaaaagatg

SEQ ID NO: 211639 - DNA, 103 bp, Artificial Sequence
  Synthetic Polynucleotide
taatacgactcactataggggtgttctgttttgggcttctcctttctagaaacagaggagatctagaatggagaagcccaacctggcggcagcgcaaaagatg

SEQ ID NO: 211640 - DNA, 103 bp, Artificial Sequence
  Synthetic Polynucleotide
taatacgactcactatagggagaaactgctgtgttctgttttgggcttctaacagaggagaagaagcatgaaacagaacaacctggcggcagcgcaaaagatg

SEQ ID NO: 211641 - DNA, 103 bp, Artificial Sequence
  Synthetic Polynucleotide
taatacgactcactatagggaactgagcagagaaactgctgtgttctgttaacagaggagaaacagaatgcagcagtttaacctggcggcagcgcaaaagatg

SEQ ID NO: 211642 - DNA, 103 bp, Artificial Sequence
  Synthetic Polynucleotide
taatacgactcactataggggtcatttctcaggcgactcatccccaccataacagaggagaatggtgatgatgagtcgcaacctggcggcagcgcaaaagatg

SEQ ID NO: 211643 - DNA, 103 bp, Artificial Sequence
  Synthetic Polynucleotide
taatacgactcactatagggggagagcttggccaggcggcacaggtcctgaacagaggagacaggacatgtgccgcctgaacctggcggcagcgcaaaagatg

SEQ ID NO: 211644 - DNA, 103 bp, Artificial Sequence
  Synthetic Polynucleotide
taatacgactcactataggggttggggtcacaactgtggttgacaaagtgaacagaggagacactttatgaaccacagtaacctggcggcagcgcaaaagatg

SEQ ID NO: 211645 - DNA, 103 bp, Artificial Sequence
  Synthetic Polynucleotide
taatacgactcactatagggacacctgcaggttggggtcacaactgtggtaacagaggagaaccacaatggtgaccccaaacctggcggcagcgcaaaagatg

SEQ ID NO: 211646 - DNA, 103 bp, Artificial Sequence
  Synthetic Polynucleotide
taatacgactcactatagggaagacgttgtacacctgcaggttggggtcaaacagaggagatgacccatgcctgcaggtaacctggcggcagcgcaaaagatg

SEQ ID NO: 211647 - DNA, 103 bp, Artificial Sequence
  Synthetic Polynucleotide
taatacgactcactataggggttgtctatgaagacgttgtacacctgcagaacagaggagactgcagatgtacaacgtcaacctggcggcagcgcaaaagatg

SEQ ID NO: 211648 - DNA, 103 bp, Artificial Sequence
  Synthetic Polynucleotide
taatacgactcactataggggctcgtcaaggttgtctatgaagacgttgtaacagaggagaacaacgatgtcatagacaaacctggcggcagcgcaaaagatg

SEQ ID NO: 211649 - DNA, 103 bp, Artificial Sequence
  Synthetic Polynucleotide
taatacgactcactatagggcggggcagccgctcgtcaaggttgtctatgaacagaggagacatagaatgccttgacgaaacctggcggcagcgcaaaagatg

SEQ ID NO: 211650 - DNA, 103 bp, Artificial Sequence
  Synthetic Polynucleotide
taatacgactcactataggggaaagcgatgcggggcagccgctcgtcaagaacagaggagacttgacatgcggctgcccaacctggcggcagcgcaaaagatg

SEQ ID NO: 211651 - DNA, 103 bp, Artificial Sequence
  Synthetic Polynucleotide
taatacgactcactatagggttgtggcaaagaaagcgatgcggggcagccaacagaggagaggctgcatggcatcgcttaacctggcggcagcgcaaaagatg

SEQ ID NO: 211652 - DNA, 103 bp, Artificial Sequence
  Synthetic Polynucleotide
taatacgactcactatagggcggatggttcttgtggcaaagaaagcgatgaacagaggagacatcgcatgctttgccacaacctggcggcagcgcaaaagatg

SEQ ID NO: 211653 - DNA, 103 bp, Artificial Sequence
  Synthetic Polynucleotide
taatacgactcactatagggctcgcctgcccggatggttcttgtggcaaaaacagaggagatttgccatgagaaccatcaacctggcggcagcgcaaaagatg

SEQ ID NO: 211654 - DNA, 103 bp, Artificial Sequence
  Synthetic Polynucleotide
taatacgactcactataggggggcagggcaggagagcttggccaggcggcaacagaggagagccgccatgccaagctctaacctggcggcagcgcaaaagatg

SEQ ID NO: 211655 - DNA, 103 bp, Artificial Sequence
  Synthetic Polynucleotide
taatacgactcactatagggaggtgagctcctcgcctgcccggatggttcaacagaggagagaaccaatggggcaggcgaacctggcggcagcgcaaaagatg

SEQ ID NO: 211656 - DNA, 103 bp, Artificial Sequence
  Synthetic Polynucleotide
taatacgactcactatagggttgtaatcaaaggtgagctcctcgcctgccaacagaggagaggcaggatgggagctcacaacctggcggcagcgcaaaagatg

SEQ ID NO: 211657 - DNA, 103 bp, Artificial Sequence
  Synthetic Polynucleotide
taatacgactcactatagggcacttgcatgttgtaatcaaaggtgagctcaacagaggagagagctcatgtttgattacaacctggcggcagcgcaaaagatg

SEQ ID NO: 211658 - DNA, 103 bp, Artificial Sequence
  Synthetic Polynucleotide
taatacgactcactatagggccacggggtccacttgcatgttgtaatcaaaacagaggagattgattatgacatgcaagaacctggcggcagcgcaaaagatg

SEQ ID NO: 211659 - DNA, 103 bp, Artificial Sequence
  Synthetic Polynucleotide
taatacgactcactatagggctctccatgtccacggggtccacttgcatgaacagaggagacatgcaatgggaccccgtaacctggcggcagcgcaaaagatg

SEQ ID NO: 211660 - DNA, 103 bp, Artificial Sequence
  Synthetic Polynucleotide
taatacgactcactatagggcatgcgggtgctctccatgtccacggggtcaacagaggagagaccccatggacatggagaacctggcggcagcgcaaaagatg

SEQ ID NO: 211661 - DNA, 103 bp, Artificial Sequence
  Synthetic Polynucleotide
taatacgactcactatagggagttggagtccatgcgggtgctctccatgtaacagaggagaacatggatggcacccgcaaacctggcggcagcgcaaaagatg

SEQ ID NO: 211662 - DNA, 103 bp, Artificial Sequence
  Synthetic Polynucleotide
taatacgactcactataggggccaggccaaagttggagtccatgcgggtgaacagaggagacacccgatgggactccaaaacctggcggcagcgcaaaagatg

SEQ ID NO: 211663 - DNA, 103 bp, Artificial Sequence
  Synthetic Polynucleotide
taatacgactcactatagggagggagcccagccaggccaaagttggagtcaacagaggagagactccatgtttggcctgaacctggcggcagcgcaaaagatg

SEQ ID NO: 211664 - DNA, 103 bp, Artificial Sequence
  Synthetic Polynucleotide
taatacgactcactatagggtaggggagccagggagcccagccaggccaaaacagaggagattggccatgctgggctccaacctggcggcagcgcaaaagatg

SEQ ID NO: 211665 - DNA, 103 bp, Artificial Sequence
  Synthetic Polynucleotide
taatacgactcactataggggagataccgagggcagggcaggagagcttgaacagaggagacaagctatgctgccctgcaacctggcggcagcgcaaaagatg

SEQ ID NO: 211666 - DNA, 103 bp, Artificial Sequence
  Synthetic Polynucleotide
taatacgactcactatagggacccgcttcttaggggagccagggagcccaaacagaggagatgggctatgtggctccccaacctggcggcagcgcaaaagatg

SEQ ID NO: 211667 - DNA, 103 bp, Artificial Sequence
  Synthetic Polynucleotide
taatacgactcactatagggttcaatacggacccgcttcttaggggagccaacagaggagaggctccatgaagaagcggaacctggcggcagcgcaaaagatg

SEQ ID NO: 211668 - DNA, 103 bp, Artificial Sequence
  Synthetic Polynucleotide
taatacgactcactatagggcacacttgcattcaatacggacccgcttctaacagaggagaagaagcatgtccgtattgaacctggcggcagcgcaaaagatg

SEQ ID NO: 211669 - DNA, 103 bp, Artificial Sequence
  Synthetic Polynucleotide
taatacgactcactataggggactcagtcccacacttgcattcaatacggaacagaggagaccgtatatgatgcaagtgaacctggcggcagcgcaaaagatg

SEQ ID NO: 211670 - DNA, 103 bp, Artificial Sequence
  Synthetic Polynucleotide
taatacgactcactatagggtttgcggcaggactcagtcccacacttgcaaacagaggagatgcaagatggggactgagaacctggcggcagcgcaaaagatg

SEQ ID NO: 211671 - DNA, 103 bp, Artificial Sequence
  Synthetic Polynucleotide
taatacgactcactatagggagaagaggtatttgcggcaggactcagtccaacagaggagaggactgatgcctgccgcaaacctggcggcagcgcaaaagatg

SEQ ID NO: 211672 - DNA, 103 bp, Artificial Sequence
  Synthetic Polynucleotide
taatacgactcactataggggttcctcttagagataccgagggcagggcaaacagaggagatgccctatgctcggtatcaacctggcggcagcgcaaaagatg

SEQ ID NO: 211673 - DNA, 103 bp, Artificial Sequence
  Synthetic Polynucleotide
taatacgactcactatagggagtcatagaggttcctcttagagataccgaaacagaggagatcggtaatgctaagaggaaacctggcggcagcgcaaaagatg

SEQ ID NO: 211674 - DNA, 103 bp, Artificial Sequence
  Synthetic Polynucleotide
taatacgactcactatagggtcgacttcaaagtcatagaggttcctcttaaacagaggagataagagatgcctctatgaaacctggcggcagcgcaaaagatg

SEQ ID NO: 211675 - DNA, 103 bp, Artificial Sequence
  Synthetic Polynucleotide
taatacgactcactataggggcacaggtactcgacttcaaagtcatagagaacagaggagactctatatgtttgaagtcaacctggcggcagcgcaaaagatg

SEQ ID NO: 211676 - DNA, 103 bp, Artificial Sequence
  Synthetic Polynucleotide
taatacgactcactatagggtcttgtaatcgcacaggtactcgacttcaaaacagaggagattgaagatgagtacctgtaacctggcggcagcgcaaaagatg

SEQ ID NO: 211677 - DNA, 103 bp, Artificial Sequence
  Synthetic Polynucleotide
taatacgactcactatagggtcgcggatcttcttgtaatcgcacaggtacaacagaggagagtacctatgcgattacaaaacctggcggcagcgcaaaagatg

SEQ ID NO: 211678 - DNA, 103 bp, Artificial Sequence
  Synthetic Polynucleotide
taatacgactcactatagggatattcctgttcgcggatcttcttgtaatcaacagaggagagattacatgaagatccgcaacctggcggcagcgcaaaagatg

SEQ ID NO: 211679 - DNA, 103 bp, Artificial Sequence
  Synthetic Polynucleotide
taatacgactcactatagggcagccagtctgtcatttctcaggcgactcaaacagaggagatgagtcatgtgagaaatgaacctggcggcagcgcaaaagatg

SEQ ID NO: 211680 - DNA, 103 bp, Artificial Sequence
  Synthetic Polynucleotide
taatacgactcactatagggtcaccaggtaatattcctgttcgcggatctaacagaggagaagatccatgaacaggaataacctggcggcagcgcaaaagatg

SEQ ID NO: 211681 - DNA, 103 bp, Artificial Sequence
  Synthetic Polynucleotide
taatacgactcactatagggccacgccatttcaccaggtaatattcctgtaacagaggagaacaggaatgttacctggtaacctggcggcagcgcaaaagatg

SEQ ID NO: 211682 - DNA, 103 bp, Artificial Sequence
  Synthetic Polynucleotide
taatacgactcactataggggtctggatatccacgccatttcaccaggtaaacagaggagatacctgatgaaatggcgtaacctggcggcagcgcaaaagatg

SEQ ID NO: 211683 - DNA, 103 bp, Artificial Sequence
  Synthetic Polynucleotide
taatacgactcactatagggtgctctctgagtctggatatccacgccattaacagaggagaaatggcatggatatccagaacctggcggcagcgcaaaagatg

SEQ ID NO: 211684 - DNA, 103 bp, Artificial Sequence
  Synthetic Polynucleotide
taatacgactcactatagggggctcccaggtgctctctgagtctggatataacagaggagaatatccatgctcagagagaacctggcggcagcgcaaaagatg

SEQ ID NO: 211685 - DNA, 103 bp, Artificial Sequence
  Synthetic Polynucleotide
taatacgactcactatagggattctgccgtggctcccaggtgctctctgaaacagaggagatcagagatgacctgggagaacctggcggcagcgcaaaagatg

SEQ ID NO: 211686 - DNA, 103 bp, Artificial Sequence
  Synthetic Polynucleotide
taatacgactcactatagggcacacttgagattctgccgtggctcccaggaacagaggagacctgggatgcacggcagaaacctggcggcagcgcaaaagatg

SEQ ID NO: 211687 - DNA, 103 bp, Artificial Sequence
  Synthetic Polynucleotide
taatacgactcactatagggaggatacgcacacacttgagattctgccgtaacagaggagaacggcaatgtctcaagtgaacctggcggcagcgcaaaagatg

SEQ ID NO: 211688 - DNA, 103 bp, Artificial Sequence
  Synthetic Polynucleotide
taatacgactcactataggggaactgcttgaggatacgcacacacttgagaacagaggagactcaagatggtgcgtatcaacctggcggcagcgcaaaagatg

SEQ ID NO: 211689 - DNA, 103 bp, Artificial Sequence
  Synthetic Polynucleotide
taatacgactcactatagggagtccttgtggaactgcttgaggatacgcaaacagaggagatgcgtaatgtcaagcagtaacctggcggcagcgcaaaagatg

SEQ ID NO: 211690 - DNA, 103 bp, Artificial Sequence
  Synthetic Polynucleotide
taatacgactcactataggggtcagtgggtcagccagtctgtcatttctcaacagaggagagagaaaatgcagactggcaacctggcggcagcgcaaaagatg

SEQ ID NO: 211691 - DNA, 103 bp, Artificial Sequence
  Synthetic Polynucleotide
taatacgactcactatagggtccctttctaagtccttgtggaactgcttgaacagaggagacaagcaatgccacaaggaaacctggcggcagcgcaaaagatg

SEQ ID NO: 211692 - DNA, 103 bp, Artificial Sequence
  Synthetic Polynucleotide
taatacgactcactatagggccggagcagctccctttctaagtccttgtgaacagaggagacacaagatgttagaaaggaacctggcggcagcgcaaaagatg

SEQ ID NO: 211693 - DNA, 103 bp, Artificial Sequence
  Synthetic Polynucleotide
taatacgactcactatagggggtggtgccgccggagcagctccctttctaaacagaggagatagaaaatgagctgctccaacctggcggcagcgcaaaagatg

SEQ ID NO: 211694 - DNA, 103 bp, Artificial Sequence
  Synthetic Polynucleotide
taatacgactcactataggggtctttgaccggtggtgccgccggagcagcaacagaggagagctgctatggcggcaccaaacctggcggcagcgcaaaagatg

SEQ ID NO: 211695 - DNA, 103 bp, Artificial Sequence
  Synthetic Polynucleotide
taatacgactcactataggggtgccggggggtctttgaccggtggtgccgaacagaggagacggcacatgcggtcaaagaacctggcggcagcgcaaaagatg

SEQ ID NO: 211696 - DNA, 103 bp, Artificial Sequence
  Synthetic Polynucleotide
taatacgactcactatagggttgggtccaggtgccggggggtctttgaccaacagaggagaggtcaaatgccccccggcaacctggcggcagcgcaaaagatg

SEQ ID NO: 211697 - DNA, 103 bp, Artificial Sequence
  Synthetic Polynucleotide
taatacgactcactatagggttggccaagcttgggtccaggtgccgggggaacagaggagacccccgatgcctggacccaacctggcggcagcgcaaaagatg

SEQ ID NO: 211698 - DNA, 103 bp, Artificial Sequence
  Synthetic Polynucleotide
taatacgactcactatagggcaccaggtagttggccaagcttgggtccagaacagaggagactggacatgagcttggccaacctggcggcagcgcaaaagatg

SEQ ID NO: 211699 - DNA, 103 bp, Artificial Sequence
  Synthetic Polynucleotide
taatacgactcactatagggtggccttctgcaccaggtagttggccaagcaacagaggagagcttggatgactacctggaacctggcggcagcgcaaaagatg

SEQ ID NO: 211700 - DNA, 103 bp, Artificial Sequence
  Synthetic Polynucleotide
taatacgactcactatagggcgcctctgcttggccttctgcaccaggtagaacagaggagactacctatggcagaaggcaacctggcggcagcgcaaaagatg

SEQ ID NO: 211701 - DNA, 103 bp, Artificial Sequence
  Synthetic Polynucleotide
taatacgactcactataggggctgcagcctgtcagtgggtcagccagtctaacagaggagaagactgatggacccactgaacctggcggcagcgcaaaagatg

SEQ ID NO: 211702 - DNA, 103 bp, Artificial Sequence
  Synthetic Polynucleotide
taatacgactcactatagggacggagcgcccgcctctgcttggccttctgaacagaggagacagaagatgaagcagaggaacctggcggcagcgcaaaagatg

SEQ ID NO: 211703 - DNA, 103 bp, Artificial Sequence
  Synthetic Polynucleotide
taatacgactcactataggggctcccagcgacggagcgcccgcctctgctaacagaggagaagcagaatggggcgctccaacctggcggcagcgcaaaagatg

SEQ ID NO: 211704 - DNA, 103 bp, Artificial Sequence
  Synthetic Polynucleotide
taatacgactcactatagggttgagctcctgctcccagcgacggagcgccaacagaggagaggcgctatgtcgctgggaaacctggcggcagcgcaaaagatg

SEQ ID NO: 211705 - DNA, 103 bp, Artificial Sequence
  Synthetic Polynucleotide
taatacgactcactataggggcgcttggcattgagctcctgctcccagcgaacagaggagacgctggatgcaggagctcaacctggcggcagcgcaaaagatg

SEQ ID NO: 211706 - DNA, 103 bp, Artificial Sequence
  Synthetic Polynucleotide
taatacgactcactatagggccagatggctgcgcttggcattgagctcctaacagaggagaaggagcatgatgccaagcaacctggcggcagcgcaaaagatg

SEQ ID NO: 211707 - DNA, 103 bp, Artificial Sequence
  Synthetic Polynucleotide
taatacgactcactataggggtgatgcgtcccagatggctgcgcttggcaaacagaggagatgccaaatgcagccatctaacctggcggcagcgcaaaagatg

SEQ ID NO: 211708 - DNA, 103 bp, Artificial Sequence
  Synthetic Polynucleotide
taatacgactcactatagggattctctacagtgatgcgtcccagatggctaacagaggagaagccatatgggacgcatcaacctggcggcagcgcaaaagatg

SEQ ID NO: 211709 - DNA, 103 bp, Artificial Sequence
  Synthetic Polynucleotide
taatacgactcactatagggggtccacctcattctctacagtgatgcgtcaacagaggagagacgcaatgctgtagagaaacctggcggcagcgcaaaagatg

SEQ ID NO: 211710 - DNA, 103 bp, Artificial Sequence
  Synthetic Polynucleotide
taatacgactcactataggggggccgtccaggtccacctcattctctacaaacagaggagatgtagaatgtgaggtggaaacctggcggcagcgcaaaagatg

SEQ ID NO: 211711 - DNA, 103 bp, Artificial Sequence
  Synthetic Polynucleotide
taatacgactcactatagggggcccgcggagggccgtccaggtccacctcaacagaggagagaggtgatgctggacggcaacctggcggcagcgcaaaagatg

SEQ ID NO: 211712 - DNA, 103 bp, Artificial Sequence
  Synthetic Polynucleotide
taatacgactcactatagggtgcaacacacgctgcagcctgtcagtgggtaacagaggagaacccacatgcaggctgcaaacctggcggcagcgcaaaagatg

SEQ ID NO: 211713 - DNA, 103 bp, Artificial Sequence
  Synthetic Polynucleotide
taatacgactcactatagggtgtacacgaaggcccgcggagggccgtccaaacagaggagatggacgatgctccgcgggaacctggcggcagcgcaaaagatg

SEQ ID NO: 211714 - DNA, 103 bp, Artificial Sequence
  Synthetic Polynucleotide
taatacgactcactatagggtactcattgatgtacacgaaggcccgcggaaacagaggagatccgcgatgcttcgtgtaaacctggcggcagcgcaaaagatg

SEQ ID NO: 211715 - DNA, 103 bp, Artificial Sequence
  Synthetic Polynucleotide
taatacgactcactatagggaccaacacggtactcattgatgtacacgaaaacagaggagattcgtgatgatcaatgagaacctggcggcagcgcaaaagatg

SEQ ID NO: 211716 - DNA, 103 bp, Artificial Sequence
  Synthetic Polynucleotide
taatacgactcactatagggtgatgccctcaccaacacggtactcattgaaacagaggagatcaatgatgaccgtgttgaacctggcggcagcgcaaaagatg

SEQ ID NO: 211717 - DNA, 103 bp, Artificial Sequence
  Synthetic Polynucleotide
taatacgactcactatagggtggttgagggtgatgccctcaccaacacggaacagaggagaccgtgtatgtgagggcataacctggcggcagcgcaaaagatg

SEQ ID NO: 211718 - DNA, 103 bp, Artificial Sequence
  Synthetic Polynucleotide
taatacgactcactatagggcacagccacctggttgagggtgatgccctcaacagaggagagagggcatgaccctcaacaacctggcggcagcgcaaaagatg

SEQ ID NO: 211719 - DNA, 103 bp, Artificial Sequence
  Synthetic Polynucleotide
taatacgactcactatagggactcgcagcccacagccacctggttgagggaacagaggagaccctcaatgaggtggctgaacctggcggcagcgcaaaagatg

SEQ ID NO: 211720 - DNA, 103 bp, Artificial Sequence
  Synthetic Polynucleotide
taatacgactcactatagggcagtcctggcactcgcagcccacagccaccaacagaggagaggtggcatggggctgcgaaacctggcggcagcgcaaaagatg

SEQ ID NO: 211721 - DNA, 103 bp, Artificial Sequence
  Synthetic Polynucleotide
taatacgactcactatagggtgcccacagacagtcctggcactcgcagccaacagaggagaggctgcatgtgccaggacaacctggcggcagcgcaaaagatg

SEQ ID NO: 211722 - DNA, 103 bp, Artificial Sequence
  Synthetic Polynucleotide
taatacgactcactatagggctccagtgggtgcccacagacagtcctggcaacagaggagagccaggatggtctgtgggaacctggcggcagcgcaaaagatg

SEQ ID NO: 211723 - DNA, 103 bp, Artificial Sequence
  Synthetic Polynucleotide
taatacgactcactatagggcaagaagacttgcaacacacgctgcagcctaacagaggagaaggctgatgcgtgtgttgaacctggcggcagcgcaaaagatg

SEQ ID NO: 211724 - DNA, 103 bp, Artificial Sequence
  Synthetic Polynucleotide
taatacgactcactataggggggcagcagcctccagtgggtgcccacagaaacagaggagatctgtgatgacccactggaacctggcggcagcgcaaaagatg

SEQ ID NO: 211725 - DNA, 103 bp, Artificial Sequence
  Synthetic Polynucleotide
taatacgactcactatagggtgacgcccccgggcagcagcctccagtgggaacagaggagacccactatgggctgctgcaacctggcggcagcgcaaaagatg

SEQ ID NO: 211726 - DNA, 103 bp, Artificial Sequence
  Synthetic Polynucleotide
taatacgactcactatagggacttgtgcagtgacgcccccgggcagcagcaacagaggagagctgctatgcgggggcgtaacctggcggcagcgcaaaagatg

SEQ ID NO: 211727 - DNA, 103 bp, Artificial Sequence
  Synthetic Polynucleotide
taatacgactcactatagggttgtaggcaaacttgtgcagtgacgcccccaacagaggagagggggcatgactgcacaaaacctggcggcagcgcaaaagatg

SEQ ID NO: 211728 - DNA, 103 bp, Artificial Sequence
  Synthetic Polynucleotide
taatacgactcactataggggccctggtcattgtaggcaaacttgtgcagaacagaggagactgcacatgtttgcctacaacctggcggcagcgcaaaagatg

SEQ ID NO: 211729 - DNA, 103 bp, Artificial Sequence
  Synthetic Polynucleotide
taatacgactcactataggggccgcacctggccctggtcattgtaggcaaaacagaggagattgcctatgatgaccaggaacctggcggcagcgcaaaagatg

SEQ ID NO: 211730 - DNA, 103 bp, Artificial Sequence
  Synthetic Polynucleotide
taatacgactcactatagggccggctcgaagccgcacctggccctggtcaaacagaggagatgaccaatgccaggtgcgaacctggcggcagcgcaaaagatg

SEQ ID NO: 211731 - DNA, 103 bp, Artificial Sequence
  Synthetic Polynucleotide
taatacgactcactataggggatgggcagcccggctcgaagccgcacctgaacagaggagacaggtgatgcttcgagccaacctggcggcagcgcaaaagatg

SEQ ID NO: 211732 - DNA, 103 bp, Artificial Sequence
  Synthetic Polynucleotide
taatacgactcactatagggtgcactcgtagatgggcagcccggctcgaaaacagaggagattcgagatgggctgcccaaacctggcggcagcgcaaaagatg

SEQ ID NO: 211733 - DNA, 103 bp, Artificial Sequence
  Synthetic Polynucleotide
taatacgactcactatagggcagcgggagttgcactcgtagatgggcagcaacagaggagagctgccatgctacgagtgaacctggcggcagcgcaaaagatg

SEQ ID NO: 211734 - DNA, 103 bp, Artificial Sequence
  Synthetic Polynucleotide
taatacgactcactatagggcagctgattccaagaagacttgcaacacacaacagaggagagtgtgtatgaagtcttctaacctggcggcagcgcaaaagatg

SEQ ID NO: 211735 - DNA, 103 bp, Artificial Sequence
  Synthetic Polynucleotide
taatacgactcactataggggccgcagcggcagcgggagttgcactcgtaaacagaggagatacgagatgaactcccgcaacctggcggcagcgcaaaagatg

SEQ ID NO: 211736 - DNA, 103 bp, Artificial Sequence
  Synthetic Polynucleotide
taatacgactcactatagggggcagtcatagccgcagcggcagcgggagtaacagaggagaactcccatggccgctgcgaacctggcggcagcgcaaaagatg

SEQ ID NO: 211737 - DNA, 103 bp, Artificial Sequence
  Synthetic Polynucleotide
taatacgactcactatagggacacgatttgggcagtcatagccgcagcggaacagaggagaccgctgatgctatgactgaacctggcggcagcgcaaaagatg

SEQ ID NO: 211738 - DNA, 103 bp, Artificial Sequence
  Synthetic Polynucleotide
taatacgactcactatagggcttctgtaccacacgatttgggcagtcataaacagaggagatatgacatgccaaatcgtaacctggcggcagcgcaaaagatg

SEQ ID NO: 211739 - DNA, 103 bp, Artificial Sequence
  Synthetic Polynucleotide
taatacgactcactatagggatcggatacccttctgtaccacacgatttgaacagaggagacaaatcatgtggtacagaaacctggcggcagcgcaaaagatg

SEQ ID NO: 211740 - DNA, 103 bp, Artificial Sequence
  Synthetic Polynucleotide
taatacgactcactatagggcagaggtcatatcggatacccttctgtaccaacagaggagaggtacaatggggtatccgaacctggcggcagcgcaaaagatg

SEQ ID NO: 211741 - DNA, 103 bp, Artificial Sequence
  Synthetic Polynucleotide
taatacgactcactataggggcggaagatgcagaggtcatatcggataccaacagaggagaggtatcatgtatgacctcaacctggcggcagcgcaaaagatg

SEQ ID NO: 211742 - DNA, 103 bp, Artificial Sequence
  Synthetic Polynucleotide
taatacgactcactatagggcatcatccgtgcggaagatgcagaggtcataacagaggagaatgaccatggcatcttccaacctggcggcagcgcaaaagatg

SEQ ID NO: 211743 - DNA, 103 bp, Artificial Sequence
  Synthetic Polynucleotide
taatacgactcactatagggcagccacgcccatcatccgtgcggaagatgaacagaggagacatcttatgcacggatgaaacctggcggcagcgcaaaagatg

SEQ ID NO: 211744 - DNA, 103 bp, Artificial Sequence
  Synthetic Polynucleotide
taatacgactcactataggggcggacgccccagccacgcccatcatccgtaacagaggagaacggatatggggcgtggcaacctggcggcagcgcaaaagatg

SEQ ID NO: 211745 - DNA, 103 bp, Artificial Sequence
  Synthetic Polynucleotide
taatacgactcactatagggacaggtcctgcagctgattccaagaagactaacagaggagaagtcttatgggaatcagcaacctggcggcagcgcaaaagatg

SEQ ID NO: 211746 - DNA, 103 bp, Artificial Sequence
  Synthetic Polynucleotide
taatacgactcactatagggtctccagggtgcggacgccccagccacgccaacagaggagaggcgtgatgggggcgtccaacctggcggcagcgcaaaagatg

SEQ ID NO: 211747 - DNA, 103 bp, Artificial Sequence
  Synthetic Polynucleotide
taatacgactcactatagggttgcgaatcttctccagggtgcggacgcccaacagaggagagggcgtatgcaccctggaaacctggcggcagcgcaaaagatg

SEQ ID NO: 211748 - DNA, 103 bp, Artificial Sequence
  Synthetic Polynucleotide
taatacgactcactataggggaagctgttcttgcgaatcttctccagggtaacagaggagaaccctgatgaagattcgcaacctggcggcagcgcaaaagatg

SEQ ID NO: 211749 - DNA, 103 bp, Artificial Sequence
  Synthetic Polynucleotide
taatacgactcactatagggactccatgacgaagctgttcttgcgaatctaacagaggagaagattcatgagaacagctaacctggcggcagcgcaaaagatg

SEQ ID NO: 211750 - DNA, 103 bp, Artificial Sequence
  Synthetic Polynucleotide
taatacgactcactatagggtctcccacgtactccatgacgaagctgttcaacagaggagagaacagatgcgtcatggaaacctggcggcagcgcaaaagatg

SEQ ID NO: 211751 - DNA, 103 bp, Artificial Sequence
  Synthetic Polynucleotide
taatacgactcactatagggggtaatgatctctcccacgtactccatgacaacagaggagagtcatgatgtacgtgggaaacctggcggcagcgcaaaagatg

SEQ ID NO: 211752 - DNA, 103 bp, Artificial Sequence
  Synthetic Polynucleotide
taatacgactcactatagggcctcctctgaggtaatgatctctcccacgtaacagaggagaacgtggatgagatcattaaacctggcggcagcgcaaaagatg

SEQ ID NO: 211753 - DNA, 103 bp, Artificial Sequence
  Synthetic Polynucleotide
taatacgactcactatagggcgccgctctgcctcctctgaggtaatgatcaacagaggagagatcatatgctcagaggaaacctggcggcagcgcaaaagatg

SEQ ID NO: 211754 - DNA, 103 bp, Artificial Sequence
  Synthetic Polynucleotide
taatacgactcactataggggatctggccccgccgctctgcctcctctgaaacagaggagatcagagatggcagagcggaacctggcggcagcgcaaaagatg

SEQ ID NO: 211755 - DNA, 103 bp, Artificial Sequence
  Synthetic Polynucleotide
taatacgactcactataggggacggtcgtagatctggccccgccgctctgaacagaggagacagagcatgggggccagaaacctggcggcagcgcaaaagatg

SEQ ID NO: 211756 - DNA, 103 bp, Artificial Sequence
  Synthetic Polynucleotide
taatacgactcactataggggccaggcggcacaggtcctgcagctgattcaacagaggagagaatcaatggcaggacctaacctggcggcagcgcaaaagatg

SEQ ID NO: 211757 - DNA, 103 bp, Artificial Sequence
  Synthetic Polynucleotide
taatacgactcactataggggtggcgccctgacggtcgtagatctggcccaacagaggagagggccaatgctacgaccgaacctggcggcagcgcaaaagatg

SEQ ID NO: 211758 - DNA, 103 bp, Artificial Sequence
  Synthetic Polynucleotide
taatacgactcactatagggaaagaggtaggtggcgccctgacggtcgtaaacagaggagatacgacatgcagggcgccaacctggcggcagcgcaaaagatg

SEQ ID NO: 211759 - DNA, 103 bp, Artificial Sequence
  Synthetic Polynucleotide
taatacgactcactatagggagtccaggtcaaagaggtaggtggcgccctaacagaggagaagggcgatgcctacctctaacctggcggcagcgcaaaagatg

SEQ ID NO: 211760 - DNA, 103 bp, Artificial Sequence
  Synthetic Polynucleotide
taatacgactcactatagggtcctccacgtagtccaggtcaaagaggtagaacagaggagactacctatgtgacctggaaacctggcggcagcgcaaaagatg

SEQ ID NO: 211761 - DNA, 103 bp, Artificial Sequence
  Synthetic Polynucleotide
taatacgactcactatagggggtgtacacgtcctccacgtagtccaggtcaacagaggagagacctgatgtacgtggagaacctggcggcagcgcaaaagatg

SEQ ID NO: 211762 - DNA, 103 bp, Artificial Sequence
  Synthetic Polynucleotide
taatacgactcactatagggcggcatccacggtgtacacgtcctccacgtaacagaggagaacgtggatgacgtgtacaaacctggcggcagcgcaaaagatg

SEQ ID NO: 211763 - DNA, 103 bp, Artificial Sequence
  Synthetic Polynucleotide
taatacgactcactatagggccatagtaggcggcatccacggtgtacacgaacagaggagacgtgtaatgcgtggatgcaacctggcggcagcgcaaaagatg

SEQ ID NO: 211764 - DNA, 103 bp, Artificial Sequence
  Synthetic Polynucleotide
taatacgactcactatagggggagatgttgccatagtaggcggcatccacaacagaggagagtggatatggcctactataacctggcggcagcgcaaaagatg

SEQ ID NO: 211765 - DNA, 103 bp, Artificial Sequence
  Synthetic Polynucleotide
taatacgactcactatagggtgacaaagtgggagatgttgccatagtaggaacagaggagacctactatggcaacatctaacctggcggcagcgcaaaagatg

SEQ ID NO: 211766 - DNA, 103 bp, Artificial Sequence
  Synthetic Polynucleotide
taatacgactcactatagggcaactgtggttgacaaagtgggagatgttgaacagaggagacaacatatgccactttgtaacctggcggcagcgcaaaagatg

SEQ ID NO: 211767 - DNA, 103 bp, Artificial Sequence
  Synthetic Polynucleotide
taatacgactcactatagggtcctcgcgcctcggccccgaccgccgccataacagaggagaatggcgatggtcggggccaacctggcggcagcgcaaaagatg

SEQ ID NO: 211768 - DNA, 103 bp, Artificial Sequence
  Synthetic Polynucleotide
taatacgactcactatagggggtgattccaatcgatttacatgtgagcttaacagaggagaaagctcatgtgtaaatcgaacctggcggcagcgcaaaagatg

SEQ ID NO: 211769 - DNA, 103 bp, Artificial Sequence
  Synthetic Polynucleotide
taatacgactcactataggggaacacctgaagatttgggtcacagctgtgaacagaggagacacagcatggacccaaataacctggcggcagcgcaaaagatg

SEQ ID NO: 211770 - DNA, 103 bp, Artificial Sequence
  Synthetic Polynucleotide
taatacgactcactatagggtgaaaacattgaacacctgaagatttgggtaacagaggagaacccaaatgttcaggtgtaacctggcggcagcgcaaaagatg

SEQ ID NO: 211771 - DNA, 103 bp, Artificial Sequence
  Synthetic Polynucleotide
taatacgactcactatagggaggttatcaatgaaaacattgaacacctgaaacagaggagatcaggtatgcaatgttttaacctggcggcagcgcaaaagatg

SEQ ID NO: 211772 - DNA, 103 bp, Artificial Sequence
  Synthetic Polynucleotide
taatacgactcactatagggacgagtatcgaggttatcaatgaaaacattaacagaggagaaatgttatgattgataacaacctggcggcagcgcaaaagatg

SEQ ID NO: 211773 - DNA, 103 bp, Artificial Sequence
  Synthetic Polynucleotide
taatacgactcactatagggttcggggaagacgagtatcgaggttatcaaaacagaggagattgataatgtcgatactcaacctggcggcagcgcaaaagatg

SEQ ID NO: 211774 - DNA, 103 bp, Artificial Sequence
  Synthetic Polynucleotide
taatacgactcactatagggaacaatgctattcggggaagacgagtatcgaacagaggagacgatacatgtcttccccgaacctggcggcagcgcaaaagatg

SEQ ID NO: 211775 - DNA, 103 bp, Artificial Sequence
  Synthetic Polynucleotide
taatacgactcactatagggtcttgtggaaaacaatgctattcggggaagaacagaggagacttcccatgatagcattgaacctggcggcagcgcaaaagatg

SEQ ID NO: 211776 - DNA, 103 bp, Artificial Sequence
  Synthetic Polynucleotide
taatacgactcactatagggcatttatggttcttgtggaaaacaatgctaaacagaggagatagcatatgtttccacaaaacctggcggcagcgcaaaagatg

SEQ ID NO: 211777 - DNA, 103 bp, Artificial Sequence
  Synthetic Polynucleotide
taatacgactcactatagggtcttctccagcatttatggttcttgtggaaaacagaggagattccacatgaaccataaaaacctggcggcagcgcaaaagatg

SEQ ID NO: 211778 - DNA, 103 bp, Artificial Sequence
  Synthetic Polynucleotide
taatacgactcactatagggaaaagtcagctcttctccagcatttatggtaacagaggagaaccataatggctggagaaaacctggcggcagcgcaaaagatg

SEQ ID NO: 211779 - DNA, 103 bp, Artificial Sequence
  Synthetic Polynucleotide
taatacgactcactataggggattccttttggtgattccaatcgatttacaacagaggagagtaaatatgttggaatcaaacctggcggcagcgcaaaagatg

SEQ ID NO: 211780 - DNA, 103 bp, Artificial Sequence
  Synthetic Polynucleotide
taatacgactcactatagggtttgataatcaaaagtcagctcttctccagaacagaggagactggagatgagctgacttaacctggcggcagcgcaaaagatg

SEQ ID NO: 211781 - DNA, 103 bp, Artificial Sequence
  Synthetic Polynucleotide
taatacgactcactataggggaacctttcatttgataatcaaaagtcagcaacagaggagagctgacatgtgattatcaaacctggcggcagcgcaaaagatg

SEQ ID NO: 211782 - DNA, 103 bp, Artificial Sequence
  Synthetic Polynucleotide
taatacgactcactatagggtatatctccagaacctttcatttgataatcaacagaggagagattatatgatgaaaggtaacctggcggcagcgcaaaagatg

SEQ ID NO: 211783 - DNA, 103 bp, Artificial Sequence
  Synthetic Polynucleotide
taatacgactcactatagggaatctgaagatatatctccagaacctttcaaacagaggagatgaaagatgctggagataaacctggcggcagcgcaaaagatg

SEQ ID NO: 211784 - DNA, 103 bp, Artificial Sequence
  Synthetic Polynucleotide
taatacgactcactatagggtggtcaatagaatctgaagatatatctccaaacagaggagatggagaatgatcttcagaaacctggcggcagcgcaaaagatg

SEQ ID NO: 211785 - DNA, 103 bp, Artificial Sequence
  Synthetic Polynucleotide
taatacgactcactatagggggctgggctgtggtcaatagaatctgaagaaacagaggagatcttcaatgtctattgacaacctggcggcagcgcaaaagatg

SEQ ID NO: 211786 - DNA, 103 bp, Artificial Sequence
  Synthetic Polynucleotide
taatacgactcactatagggccctctttttggctgggctgtggtcaatagaacagaggagactattgatgacagcccagaacctggcggcagcgcaaaagatg

SEQ ID NO: 211787 - DNA, 103 bp, Artificial Sequence
  Synthetic Polynucleotide
taatacgactcactatagggactgttctgaccctctttttggctgggctgaacagaggagacagcccatgcaaaaagagaacctggcggcagcgcaaaagatg

SEQ ID NO: 211788 - DNA, 103 bp, Artificial Sequence
  Synthetic Polynucleotide
taatacgactcactatagggacatttacatactgttctgaccctctttttaacagaggagaaaaaagatggtcagaacaaacctggcggcagcgcaaaagatg

SEQ ID NO: 211789 - DNA, 103 bp, Artificial Sequence
  Synthetic Polynucleotide
taatacgactcactatagggtcacagctccacatttacatactgttctgaaacagaggagatcagaaatgtatgtaaataacctggcggcagcgcaaaagatg

SEQ ID NO: 211790 - DNA, 103 bp, Artificial Sequence
  Synthetic Polynucleotide
taatacgactcactatagggtaattgtttagattccttttggtgattccaaacagaggagatggaatatgcaaaaggaaaacctggcggcagcgcaaaagatg

SEQ ID NO: 211791 - DNA, 103 bp, Artificial Sequence
  Synthetic Polynucleotide
taatacgactcactatagggcctctgcaagtcacagctccacatttacataacagaggagaatgtaaatgtggagctgtaacctggcggcagcgcaaaagatg

SEQ ID NO: 211792 - DNA, 103 bp, Artificial Sequence
  Synthetic Polynucleotide
taatacgactcactataggggttgaggtaacctctgcaagtcacagctccaacagaggagaggagctatgacttgcagaaacctggcggcagcgcaaaagatg

SEQ ID NO: 211793 - DNA, 103 bp, Artificial Sequence
  Synthetic Polynucleotide
taatacgactcactatagggttccacctcataattgtttagattccttttaacagaggagaaaaaggatgctaaacaataacctggcggcagcgcaaaagatg

SEQ ID NO: 211794 - DNA, 103 bp, Artificial Sequence
  Synthetic Polynucleotide
taatacgactcactatagggcacacaagtattccacctcataattgtttaaacagaggagataaacaatgatgaggtggaacctggcggcagcgcaaaagatg

SEQ ID NO: 211795 - DNA, 103 bp, Artificial Sequence
  Synthetic Polynucleotide
taatacgactcactatagggaccttgtagtcacacaagtattccacctcaaacagaggagatgaggtatgatacttgtgaacctggcggcagcgcaaaagatg

SEQ ID NO: 211796 - DNA, 103 bp, Artificial Sequence
  Synthetic Polynucleotide
taatacgactcactatagggatcctttactaccttgtagtcacacaagtaaacagaggagatacttgatggactacaagaacctggcggcagcgcaaaagatg

SEQ ID NO: 211797 - DNA, 103 bp, Artificial Sequence
  Synthetic Polynucleotide
taatacgactcactatagggaatattccatatcctttactaccttgtagtaacagaggagaactacaatgtagtaaaggaacctggcggcagcgcaaaagatg

SEQ ID NO: 211798 - DNA, 103 bp, Artificial Sequence
  Synthetic Polynucleotide
taatacgactcactatagggtttacaagataatattccatatcctttactaacagaggagaagtaaaatgtatggaataaacctggcggcagcgcaaaagatg

SEQ ID NO: 211799 - DNA, 103 bp, Artificial Sequence
  Synthetic Polynucleotide
taatacgactcactatagggtcctttccattttacaagataatattccataacagaggagaatggaaatgtatcttgtaaacctggcggcagcgcaaaagatg

SEQ ID NO: 211800 - DNA, 103 bp, Artificial Sequence
  Synthetic Polynucleotide
taatacgactcactatagggcacaccaagctcctcgcgcctcggccccgaaacagaggagatcggggatgaggcgcgagaacctggcggcagcgcaaaagatg

SEQ ID NO: 211801 - DNA, 103 bp, Artificial Sequence
  Synthetic Polynucleotide
taatacgactcactatagggaatctggccatcctttccattttacaagataacagaggagaatcttgatgaatggaaagaacctggcggcagcgcaaaagatg

SEQ ID NO: 211802 - DNA, 103 bp, Artificial Sequence
  Synthetic Polynucleotide
taatacgactcactataggggtatttgtagaatctggccatcctttccataacagaggagaatggaaatgatggccagaaacctggcggcagcgcaaaagatg

SEQ ID NO: 211803 - DNA, 103 bp, Artificial Sequence
  Synthetic Polynucleotide
taatacgactcactatagggaggttcccaagtatttgtagaatctggccaaacagaggagatggccaatgtctacaaataacctggcggcagcgcaaaagatg

SEQ ID NO: 211804 - DNA, 103 bp, Artificial Sequence
  Synthetic Polynucleotide
taatacgactcactataggggattttgcaaaggttcccaagtatttgtagaacagaggagactacaaatgcttgggaacaacctggcggcagcgcaaaagatg

SEQ ID NO: 211805 - DNA, 103 bp, Artificial Sequence
  Synthetic Polynucleotide
taatacgactcactataggggggcacttcagattttgcaaaggttcccaaaacagaggagattgggaatgtttgcaaaaaacctggcggcagcgcaaaagatg

SEQ ID NO: 211806 - DNA, 103 bp, Artificial Sequence
  Synthetic Polynucleotide
taatacgactcactatagggaagcagtaacgggcacttcagattttgcaaaacagaggagattgcaaatgctgaagtgcaacctggcggcagcgcaaaagatg

SEQ ID NO: 211807 - DNA, 103 bp, Artificial Sequence
  Synthetic Polynucleotide
taatacgactcactatagggagaattgctgaagcagtaacgggcacttcaaacagaggagatgaagtatgcgttactgcaacctggcggcagcgcaaaagatg

SEQ ID NO: 211808 - DNA, 103 bp, Artificial Sequence
  Synthetic Polynucleotide
taatacgactcactatagggttgtcattagagaattgctgaagcagtaacaacagaggagagttactatgtcagcaattaacctggcggcagcgcaaaagatg

SEQ ID NO: 211809 - DNA, 103 bp, Artificial Sequence
  Synthetic Polynucleotide
taatacgactcactatagggataattatgcttgtcattagagaattgctgaacagaggagacagcaaatgtctaatgacaacctggcggcagcgcaaaagatg

SEQ ID NO: 211810 - DNA, 103 bp, Artificial Sequence
  Synthetic Polynucleotide
taatacgactcactatagggcctgagataaataattatgcttgtcattagaacagaggagactaatgatgagcataattaacctggcggcagcgcaaaagatg

SEQ ID NO: 211811 - DNA, 103 bp, Artificial Sequence
  Synthetic Polynucleotide
taatacgactcactatagggaggcaaggcacacaccaagctcctcgcgccaacagaggagaggcgcgatgagcttggtgaacctggcggcagcgcaaaagatg

SEQ ID NO: 211812 - DNA, 103 bp, Artificial Sequence
  Synthetic Polynucleotide
taatacgactcactatagggcctttctttacctgagataaataattatgcaacagaggagagcataaatgtttatctcaaacctggcggcagcgcaaaagatg

SEQ ID NO: 211813 - DNA, 103 bp, Artificial Sequence
  Synthetic Polynucleotide
taatacgactcactatagggtattgctttgcctttctttacctgagataaaacagaggagattatctatggtaaagaaaaacctggcggcagcgcaaaagatg

SEQ ID NO: 211814 - DNA, 103 bp, Artificial Sequence
  Synthetic Polynucleotide
taatacgactcactatagggcttttggagttattgctttgcctttctttaaacagaggagataaagaatggcaaagcaaaacctggcggcagcgcaaaagatg

SEQ ID NO: 211815 - DNA, 103 bp, Artificial Sequence
  Synthetic Polynucleotide
taatacgactcactatagggttgttattgtcttttggagttattgctttgaacagaggagacaaagcatgaactccaaaaacctggcggcagcgcaaaagatg

SEQ ID NO: 211816 - DNA, 103 bp, Artificial Sequence
  Synthetic Polynucleotide
taatacgactcactatagggtttcaaagttttgttattgtcttttggagtaacagaggagaactccaatggacaataacaacctggcggcagcgcaaaagatg

SEQ ID NO: 211817 - DNA, 103 bp, Artificial Sequence
  Synthetic Polynucleotide
taatacgactcactatagggcaatggcaggtttcaaagttttgttattgtaacagaggagaacaataatgaaactttgaaacctggcggcagcgcaaaagatg

SEQ ID NO: 211818 - DNA, 103 bp, Artificial Sequence
  Synthetic Polynucleotide
taatacgactcactatagggatgtactcagcaatggcaggtttcaaagttaacagaggagaaactttatgacctgccataacctggcggcagcgcaaaagatg

SEQ ID NO: 211819 - DNA, 103 bp, Artificial Sequence
  Synthetic Polynucleotide
taatacgactcactatagggcttcttcacaatgtactcagcaatggcaggaacagaggagacctgccatggctgagtacaacctggcggcagcgcaaaagatg

SEQ ID NO: 211820 - DNA, 103 bp, Artificial Sequence
  Synthetic Polynucleotide
taatacgactcactatagggtttgtttagccttcttcacaatgtactcagaacagaggagactgagtatgttgtgaagaaacctggcggcagcgcaaaagatg

SEQ ID NO: 211821 - DNA, 103 bp, Artificial Sequence
  Synthetic Polynucleotide
taatacgactcactatagggagagctatcctttgtttagccttcttcacaaacagaggagatgtgaaatgggctaaacaaacctggcggcagcgcaaaagatg

SEQ ID NO: 211822 - DNA, 103 bp, Artificial Sequence
  Synthetic Polynucleotide
taatacgactcactatagggaagtgaaactaggcaaggcacacaccaagcaacagaggagagcttggatggtgccttgcaacctggcggcagcgcaaaagatg

SEQ ID NO: 211823 - DNA, 103 bp, Artificial Sequence
  Synthetic Polynucleotide
taatacgactcactatagggccatctctgcagagctatcctttgtttagcaacagaggagagctaaaatgaggatagctaacctggcggcagcgcaaaagatg

SEQ ID NO: 211824 - DNA, 103 bp, Artificial Sequence
  Synthetic Polynucleotide
taatacgactcactataggggttcatcttgccatctctgcagagctatccaacagaggagaggatagatgtgcagagataacctggcggcagcgcaaaagatg

SEQ ID NO: 211825 - DNA, 103 bp, Artificial Sequence
  Synthetic Polynucleotide
taatacgactcactatagggcttctgttgagttcatcttgccatctctgcaacagaggagagcagagatggcaagatgaaacctggcggcagcgcaaaagatg

SEQ ID NO: 211826 - DNA, 103 bp, Artificial Sequence
  Synthetic Polynucleotide
taatacgactcactatagggatgattctttcttctgttgagttcatcttgaacagaggagacaagatatgctcaacagaaacctggcggcagcgcaaaagatg

SEQ ID NO: 211827 - DNA, 103 bp, Artificial Sequence
  Synthetic Polynucleotide
taatacgactcactatagggtcattcctttatgattctttcttctgttgaaacagaggagatcaacaatggaaagaatcaacctggcggcagcgcaaaagatg

SEQ ID NO: 211828 - DNA, 103 bp, Artificial Sequence
  Synthetic Polynucleotide
taatacgactcactatagggtcaacaaatatcattcctttatgattctttaacagaggagaaaagaaatgtaaaggaataacctggcggcagcgcaaaagatg

SEQ ID NO: 211829 - DNA, 103 bp, Artificial Sequence
  Synthetic Polynucleotide
taatacgactcactatagggaacagtattttcaacaaatatcattcctttaacagaggagaaaaggaatgatatttgttaacctggcggcagcgcaaaagatg

SEQ ID NO: 211830 - DNA, 103 bp, Artificial Sequence
  Synthetic Polynucleotide
taatacgactcactatagggcctctaaatcaacagtattttcaacaaataaacagaggagatatttgatgaaaatactgaacctggcggcagcgcaaaagatg

SEQ ID NO: 211831 - DNA, 103 bp, Artificial Sequence
  Synthetic Polynucleotide
taatacgactcactataggggaaggtgggccctctaaatcaacagtatttaacagaggagaaaatacatgtgatttagaaacctggcggcagcgcaaaagatg

SEQ ID NO: 211832 - DNA, 103 bp, Artificial Sequence
  Synthetic Polynucleotide
taatacgactcactatagggatagaagtctgaaggtgggccctctaaatcaacagaggagagatttaatgggcccacctaacctggcggcagcgcaaaagatg

SEQ ID NO: 211833 - DNA, 103 bp, Artificial Sequence
  Synthetic Polynucleotide
taatacgactcactataggggaagagtatcaagtgaaactaggcaaggcaaacagaggagatgccttatgtagtttcacaacctggcggcagcgcaaaagatg

SEQ ID NO: 211834 - DNA, 103 bp, Artificial Sequence
  Synthetic Polynucleotide
taatacgactcactatagggcgttaatgtaatagaagtctgaaggtgggcaacagaggagagcccacatgcagacttctaacctggcggcagcgcaaaagatg

SEQ ID NO: 211835 - DNA, 103 bp, Artificial Sequence
  Synthetic Polynucleotide
taatacgactcactatagggggtttgtattcgttaatgtaatagaagtctaacagaggagaagacttatgttacattaaaacctggcggcagcgcaaaagatg

SEQ ID NO: 211836 - DNA, 103 bp, Artificial Sequence
  Synthetic Polynucleotide
taatacgactcactatagggtccaggagctggtttgtattcgttaatgtaaacagaggagatacattatggaatacaaaaacctggcggcagcgcaaaagatg

SEQ ID NO: 211837 - DNA, 103 bp, Artificial Sequence
  Synthetic Polynucleotide
taatacgactcactatagggctaagctgattccaggagctggtttgtattaacagaggagaaatacaatgcagctcctgaacctggcggcagcgcaaaagatg

SEQ ID NO: 211838 - DNA, 103 bp, Artificial Sequence
  Synthetic Polynucleotide
taatacgactcactataggggcttcattgactaagctgattccaggagctaacagaggagaagctccatgaatcagcttaacctggcggcagcgcaaaagatg

SEQ ID NO: 211839 - DNA, 103 bp, Artificial Sequence
  Synthetic Polynucleotide
taatacgactcactatagggaccaaaggtagcttcattgactaagctgataacagaggagaatcagcatggtcaatgaaaacctggcggcagcgcaaaagatg

SEQ ID NO: 211840 - DNA, 103 bp, Artificial Sequence
  Synthetic Polynucleotide
taatacgactcactatagggtgcatgaacaaccaaaggtagcttcattgaaacagaggagatcaatgatgctacctttgaacctggcggcagcgcaaaagatg

SEQ ID NO: 211841 - DNA, 103 bp, Artificial Sequence
  Synthetic Polynucleotide
taatacgactcactatagggaagcaatctgtgcatgaacaaccaaaggtaaacagaggagataccttatgttgttcatgaacctggcggcagcgcaaaagatg

SEQ ID NO: 211842 - DNA, 103 bp, Artificial Sequence
  Synthetic Polynucleotide
taatacgactcactatagggtttttgaaagaagcaatctgtgcatgaacaaacagaggagatgttcaatgacagattgcaacctggcggcagcgcaaaagatg

SEQ ID NO: 211843 - DNA, 103 bp, Artificial Sequence
  Synthetic Polynucleotide
taatacgactcactatagggcaggacaacatttttgaaagaagcaatctgaacagaggagacagattatgtctttcaaaaacctggcggcagcgcaaaagatg

SEQ ID NO: 211844 - DNA, 103 bp, Artificial Sequence
  Synthetic Polynucleotide
taatacgactcactatagggcataattcctgaagagtatcaagtgaaactaacagaggagaagtttcatgtgatactctaacctggcggcagcgcaaaagatg

SEQ ID NO: 211845 - DNA, 103 bp, Artificial Sequence
  Synthetic Polynucleotide
taatacgactcactatagggccagcttcagcaggacaacatttttgaaagaacagaggagactttcaatgatgttgtccaacctggcggcagcgcaaaagatg

SEQ ID NO: 211846 - DNA, 103 bp, Artificial Sequence
  Synthetic Polynucleotide
taatacgactcactatagggcaaaagaactccagcttcagcaggacaacaaacagaggagatgttgtatggctgaagctaacctggcggcagcgcaaaagatg

SEQ ID NO: 211847 - DNA, 103 bp, Artificial Sequence
  Synthetic Polynucleotide
taatacgactcactatagggtattataagccaaaagaactccagcttcagaacagaggagactgaagatggagttctttaacctggcggcagcgcaaaagatg

SEQ ID NO: 211848 - DNA, 103 bp, Artificial Sequence
  Synthetic Polynucleotide
taatacgactcactatagggtgttggtttttattataagccaaaagaactaacagaggagaagttctatgggcttataaaacctggcggcagcgcaaaagatg

SEQ ID NO: 211849 - DNA, 103 bp, Artificial Sequence
  Synthetic Polynucleotide
taatacgactcactataggggattttaatttgttggtttttattataagcaacagaggagagcttatatgaaaaaccaaaacctggcggcagcgcaaaagatg

SEQ ID NO: 211850 - DNA, 103 bp, Artificial Sequence
  Synthetic Polynucleotide
taatacgactcactatagggtaccaggtgggattttaatttgttggttttaacagaggagaaaaaccatgaaattaaaaaacctggcggcagcgcaaaagatg

SEQ ID NO: 211851 - DNA, 103 bp, Artificial Sequence
  Synthetic Polynucleotide
taatacgactcactatagggtagatgggagtaccaggtgggattttaattaacagaggagaaattaaatgcccacctggaacctggcggcagcgcaaaagatg

SEQ ID NO: 211852 - DNA, 103 bp, Artificial Sequence
  Synthetic Polynucleotide
taatacgactcactataggggttgcattcatagatgggagtaccaggtggaacagaggagaccacctatgactcccatcaacctggcggcagcgcaaaagatg

SEQ ID NO: 211853 - DNA, 103 bp, Artificial Sequence
  Synthetic Polynucleotide
taatacgactcactataggggacaccttgagttgcattcatagatgggagaacagaggagactcccaatgatgaatgcaaacctggcggcagcgcaaaagatg

SEQ ID NO: 211854 - DNA, 103 bp, Artificial Sequence
  Synthetic Polynucleotide
taatacgactcactatagggggaccacactgacaccttgagttgcattcaaacagaggagatgaatgatgctcaaggtgaacctggcggcagcgcaaaagatg

SEQ ID NO: 211855 - DNA, 103 bp, Artificial Sequence
  Synthetic Polynucleotide
taatacgactcactatagggttcttttctacataattcctgaagagtatcaacagaggagagatactatgcaggaattaaacctggcggcagcgcaaaagatg

SEQ ID NO: 211856 - DNA, 103 bp, Artificial Sequence
  Synthetic Polynucleotide
taatacgactcactataggggggacaatcaggaccacactgacaccttgaaacagaggagatcaaggatgcagtgtggtaacctggcggcagcgcaaaagatg

SEQ ID NO: 211857 - DNA, 103 bp, Artificial Sequence
  Synthetic Polynucleotide
taatacgactcactatagggcaatcctattgggacaatcaggaccacactaacagaggagaagtgtgatgctgattgtcaacctggcggcagcgcaaaagatg

SEQ ID NO: 211858 - DNA, 103 bp, Artificial Sequence
  Synthetic Polynucleotide
taatacgactcactatagggcctttttgtacaatcctattgggacaatcaaacagaggagatgattgatgcaataggataacctggcggcagcgcaaaagatg

SEQ ID NO: 211859 - DNA, 103 bp, Artificial Sequence
  Synthetic Polynucleotide
taatacgactcactatagggatactgtgtgcctttttgtacaatcctattaacagaggagaaataggatggtacaaaaaaacctggcggcagcgcaaaagatg

SEQ ID NO: 211860 - DNA, 103 bp, Artificial Sequence
  Synthetic Polynucleotide
taatacgactcactatagggtgcaaagcgaatactgtgtgcctttttgtaaacagaggagatacaaaatggcacacagtaacctggcggcagcgcaaaagatg

SEQ ID NO: 211861 - DNA, 103 bp, Artificial Sequence
  Synthetic Polynucleotide
taatacgactcactataggggttcgaaagatgcaaagcgaatactgtgtgaacagaggagacacacaatgttcgctttgaacctggcggcagcgcaaaagatg

SEQ ID NO: 211862 - DNA, 103 bp, Artificial Sequence
  Synthetic Polynucleotide
taatacgactcactatagggtccattgctagttcgaaagatgcaaagcgaaacagaggagatcgcttatgatctttcgaaacctggcggcagcgcaaaagatg

SEQ ID NO: 211863 - DNA, 103 bp, Artificial Sequence
  Synthetic Polynucleotide
taatacgactcactatagggcccagccacgtccattgctagttcgaaagaaacagaggagatctttcatgctagcaatgaacctggcggcagcgcaaaagatg

SEQ ID NO: 211864 - DNA, 103 bp, Artificial Sequence
  Synthetic Polynucleotide
taatacgactcactataggggtctttacaccccagccacgtccattgctaaacagaggagatagcaaatgacgtggctgaacctggcggcagcgcaaaagatg

SEQ ID NO: 211865 - DNA, 103 bp, Artificial Sequence
  Synthetic Polynucleotide
taatacgactcactatagggcttcacaagggtctttacaccccagccacgaacagaggagacgtggcatgggtgtaaagaacctggcggcagcgcaaaagatg

SEQ ID NO: 211866 - DNA, 103 bp, Artificial Sequence
  Synthetic Polynucleotide
taatacgactcactatagggatgtgagcttttcttttctacataattcctaacagaggagaaggaatatggtagaaaagaacctggcggcagcgcaaaagatg

SEQ ID NO: 211867 - DNA, 103 bp, Artificial Sequence
  Synthetic Polynucleotide
taatacgactcactatagggttcttttaatcttcacaagggtctttacacaacagaggagagtgtaaatgcccttgtgaaacctggcggcagcgcaaaagatg

SEQ ID NO: 211868 - DNA, 103 bp, Artificial Sequence
  Synthetic Polynucleotide
taatacgactcactatagggacaaaactcattcttttaatcttcacaaggaacagaggagaccttgtatggattaaaagaacctggcggcagcgcaaaagatg

SEQ ID NO: 211869 - DNA, 103 bp, Artificial Sequence
  Synthetic Polynucleotide
taatacgactcactatagggatattccatgacaaaactcattcttttaataacagaggagaattaaaatgatgagttttaacctggcggcagcgcaaaagatg

SEQ ID NO: 211870 - DNA, 103 bp, Artificial Sequence
  Synthetic Polynucleotide
taatacgactcactatagggcctctccaacatattccatgacaaaactcaaacagaggagatgagttatgtcatggaataacctggcggcagcgcaaaagatg

SEQ ID NO: 211871 - DNA, 103 bp, Artificial Sequence
  Synthetic Polynucleotide
taatacgactcactatagggcttgtgattacctctccaacatattccatgaacagaggagacatggaatgtgttggagaaacctggcggcagcgcaaaagatg

SEQ ID NO: 211872 - DNA, 103 bp, Artificial Sequence
  Synthetic Polynucleotide
taatacgactcactatagggagcttcttcacttgtgattacctctccaacaacagaggagagttggaatggtaatcacaaacctggcggcagcgcaaaagatg

SEQ ID NO: 211873 - DNA, 103 bp, Artificial Sequence
  Synthetic Polynucleotide
taatacgactcactatagggctcgtctttcagcttcttcacttgtgattaaacagaggagataatcaatggtgaagaagaacctggcggcagcgcaaaagatg

SEQ ID NO: 211874 - DNA, 103 bp, Artificial Sequence
  Synthetic Polynucleotide
taatacgactcactatagggtagaactgtcctcgtctttcagcttcttcaaacagaggagatgaagaatgtgaaagacgaacctggcggcagcgcaaaagatg

SEQ ID NO: 211875 - DNA, 103 bp, Artificial Sequence
  Synthetic Polynucleotide
taatacgactcactatagggcttgttgtcatagaactgtcctcgtctttcaacagaggagagaaagaatgggacagttcaacctggcggcagcgcaaaagatg

SEQ ID NO: 211876 - DNA, 103 bp, Artificial Sequence
  Synthetic Polynucleotide
taatacgactcactatagggacgtgattcccttgttgtcatagaactgtcaacagaggagagacagtatgatgacaacaaacctggcggcagcgcaaaagatg

SEQ ID NO: 211877 - DNA, 103 bp, Artificial Sequence
  Synthetic Polynucleotide
taatacgactcactatagggatcgatttacatgtgagcttttcttttctaaacagaggagatagaaaatgaaagctcacaacctggcggcagcgcaaaagatg

SEQ ID NO: 211878 - DNA, 103 bp, Artificial Sequence
  Synthetic Polynucleotide
taatacgactcactatagggtcaaagagatacgtgattcccttgttgtcaaacagaggagatgacaaatggggaatcacaacctggcggcagcgcaaaagatg

SEQ ID NO: 211879 - DNA, 103 bp, Artificial Sequence
  Synthetic Polynucleotide
taatacgactcactatagggatagtccagatcaaagagatacgtgattccaacagaggagaggaatcatgtatctctttaacctggcggcagcgcaaaagatg

SEQ ID NO: 211880 - DNA, 103 bp, Artificial Sequence
  Synthetic Polynucleotide
taatacgactcactatagggcatcagactcatagtccagatcaaagagataacagaggagaatctctatgatctggactaacctggcggcagcgcaaaagatg

SEQ ID NO: 211881 - DNA, 103 bp, Artificial Sequence
  Synthetic Polynucleotide
taatacgactcactatagggactgtgaattcatcagactcatagtccagaaacagaggagatctggaatgtgagtctgaaacctggcggcagcgcaaaagatg

SEQ ID NO: 211882 - DNA, 103 bp, Artificial Sequence
  Synthetic Polynucleotide
taatacgactcactatagggagccgcatccactgtgaattcatcagactcaacagaggagagagtctatggaattcacaaacctggcggcagcgcaaaagatg

SEQ ID NO: 211883 - DNA, 103 bp, Artificial Sequence
  Synthetic Polynucleotide
taatacgactcactatagggtgccgtatcgagccgcatccactgtgaattaacagaggagaaattcaatgtggatgcggaacctggcggcagcgcaaaagatg

SEQ ID NO: 211884 - DNA, 103 bp, Artificial Sequence
  Synthetic Polynucleotide
taatacgactcactatagggtgagacacattgccgtatcgagccgcatccaacagaggagaggatgcatgtcgatacggaacctggcggcagcgcaaaagatg

SEQ ID NO: 211885 - DNA, 103 bp, Artificial Sequence
  Synthetic Polynucleotide
taatacgactcactatagggattcacaaaatgagacacattgccgtatcgaacagaggagacgatacatgaatgtgtctaacctggcggcagcgcaaaagatg

SEQ ID NO: 211886 - DNA, 103 bp, Artificial Sequence
  Synthetic Polynucleotide
taatacgactcactatagggcacagctgtgattcacaaaatgagacacataacagaggagaatgtgtatgattttgtgaaacctggcggcagcgcaaaagatg

SEQ ID NO: 211887 - DNA, 103 bp, Artificial Sequence
  Synthetic Polynucleotide
taatacgactcactatagggagatttgggtcacagctgtgattcacaaaaaacagaggagattttgtatgtcacagctgaacctggcggcagcgcaaaagatg

SEQ ID NO: 211888 - DNA, 103 bp, Artificial Sequence
  Synthetic Polynucleotide
taatacgactcactatagggtcccccaccgccgtgcttctgaggcgccataacagaggagaatggcgatgcagaagcacaacctggcggcagcgcaaaagatg

SEQ ID NO: 211889 - DNA, 103 bp, Artificial Sequence
  Synthetic Polynucleotide
taatacgactcactatagggtttgccgcccgaagccgtcgccgccgccacaacagaggagagtggcgatggcgacggctaacctggcggcagcgcaaaagatg

SEQ ID NO: 211890 - DNA, 103 bp, Artificial Sequence
  Synthetic Polynucleotide
taatacgactcactatagggcccatcaagaatagtctcccatgttgctctaacagaggagaagagcaatgtgggagactaacctggcggcagcgcaaaagatg

SEQ ID NO: 211891 - DNA, 103 bp, Artificial Sequence
  Synthetic Polynucleotide
taatacgactcactataggggcagcctcttcccatcaagaatagtctcccaacagaggagagggagaatgttcttgatgaacctggcggcagcgcaaaagatg

SEQ ID NO: 211892 - DNA, 103 bp, Artificial Sequence
  Synthetic Polynucleotide
taatacgactcactatagggtcgaatggaggcagcctcttcccatcaagaaacagaggagatcttgaatggaagaggctaacctggcggcagcgcaaaagatg

SEQ ID NO: 211893 - DNA, 103 bp, Artificial Sequence
  Synthetic Polynucleotide
taatacgactcactatagggagaaaatgtttcgaatggaggcagcctcttaacagaggagaaagaggatgcctccattcaacctggcggcagcgcaaaagatg

SEQ ID NO: 211894 - DNA, 103 bp, Artificial Sequence
  Synthetic Polynucleotide
taatacgactcactatagggtaggtccctgagaaaatgtttcgaatggagaacagaggagactccatatgaaacattttaacctggcggcagcgcaaaagatg

SEQ ID NO: 211895 - DNA, 103 bp, Artificial Sequence
  Synthetic Polynucleotide
taatacgactcactatagggaactgcaacgtaggtccctgagaaaatgttaacagaggagaaacattatgtcagggaccaacctggcggcagcgcaaaagatg

SEQ ID NO: 211896 - DNA, 103 bp, Artificial Sequence
  Synthetic Polynucleotide
taatacgactcactatagggacgaagagtgaactgcaacgtaggtccctgaacagaggagacagggaatgacgttgcagaacctggcggcagcgcaaaagatg

SEQ ID NO: 211897 - DNA, 103 bp, Artificial Sequence
  Synthetic Polynucleotide
taatacgactcactatagggctcctgtccaacgaagagtgaactgcaacgaacagaggagacgttgcatgtcactcttcaacctggcggcagcgcaaaagatg

SEQ ID NO: 211898 - DNA, 103 bp, Artificial Sequence
  Synthetic Polynucleotide
taatacgactcactatagggtcattggtctctcctgtccaacgaagagtgaacagaggagacactctatgttggacaggaacctggcggcagcgcaaaagatg

SEQ ID NO: 211899 - DNA, 103 bp, Artificial Sequence
  Synthetic Polynucleotide
taatacgactcactatagggcgtagatttatcattggtctctcctgtccaaacagaggagatggacaatggagaccaataacctggcggcagcgcaaaagatg

SEQ ID NO: 211900 - DNA, 103 bp, Artificial Sequence
  Synthetic Polynucleotide
taatacgactcactatagggcgccgccggatttgccgcccgaagccgtcgaacagaggagacgacggatgcgggcggcaaacctggcggcagcgcaaaagatg

SEQ ID NO: 211901 - DNA, 103 bp, Artificial Sequence
  Synthetic Polynucleotide
taatacgactcactatagggcaataggagccgtagatttatcattggtctaacagaggagaagaccaatgataaatctaaacctggcggcagcgcaaaagatg

SEQ ID NO: 211902 - DNA, 103 bp, Artificial Sequence
  Synthetic Polynucleotide
taatacgactcactatagggagaggtttggcaataggagccgtagatttaaacagaggagataaatcatgggctcctataacctggcggcagcgcaaaagatg

SEQ ID NO: 211903 - DNA, 103 bp, Artificial Sequence
  Synthetic Polynucleotide
taatacgactcactatagggtctagtggcaagaggtttggcaataggagcaacagaggagagctcctatggccaaacctaacctggcggcagcgcaaaagatg

SEQ ID NO: 211904 - DNA, 103 bp, Artificial Sequence
  Synthetic Polynucleotide
taatacgactcactatagggtctctgaatttctagtggcaagaggtttggaacagaggagaccaaacatgttgccactaaacctggcggcagcgcaaaagatg

SEQ ID NO: 211905 - DNA, 103 bp, Artificial Sequence
  Synthetic Polynucleotide
taatacgactcactatagggtgatggagactctctgaatttctagtggcaaacagaggagatgccacatgaaattcagaaacctggcggcagcgcaaaagatg

SEQ ID NO: 211906 - DNA, 103 bp, Artificial Sequence
  Synthetic Polynucleotide
taatacgactcactatagggcttgttttcctgatggagactctctgaattaacagaggagaaattcaatgagtctccataacctggcggcagcgcaaaagatg

SEQ ID NO: 211907 - DNA, 103 bp, Artificial Sequence
  Synthetic Polynucleotide
taatacgactcactatagggctgaaccaggcttgttttcctgatggagacaacagaggagagtctccatgaggaaaacaaacctggcggcagcgcaaaagatg

SEQ ID NO: 211908 - DNA, 103 bp, Artificial Sequence
  Synthetic Polynucleotide
taatacgactcactataggggtaggtttaactgaaccaggcttgttttccaacagaggagaggaaaaatggcctggttcaacctggcggcagcgcaaaagatg

SEQ ID NO: 211909 - DNA, 103 bp, Artificial Sequence
  Synthetic Polynucleotide
taatacgactcactatagggaatagtttgagtaggtttaactgaaccaggaacagaggagacctggtatggttaaacctaacctggcggcagcgcaaaagatg

SEQ ID NO: 211910 - DNA, 103 bp, Artificial Sequence
  Synthetic Polynucleotide
taatacgactcactatagggctttaacagcaatagtttgagtaggtttaaaacagaggagattaaacatgctcaaactaaacctggcggcagcgcaaaagatg

SEQ ID NO: 211911 - DNA, 103 bp, Artificial Sequence
  Synthetic Polynucleotide
taatacgactcactatagggccacagctcccgccgccggatttgccgcccaacagaggagagggcggatgatccggcggaacctggcggcagcgcaaaagatg

SEQ ID NO: 211912 - DNA, 103 bp, Artificial Sequence
  Synthetic Polynucleotide
taatacgactcactataggggtcaatgattctttaacagcaatagtttgaaacagaggagatcaaacatgtgctgttaaaacctggcggcagcgcaaaagatg

SEQ ID NO: 211913 - DNA, 103 bp, Artificial Sequence
  Synthetic Polynucleotide
taatacgactcactatagggtagatctgtagtcaatgattctttaacagcaacagaggagagctgttatggaatcattgaacctggcggcagcgcaaaagatg

SEQ ID NO: 211914 - DNA, 103 bp, Artificial Sequence
  Synthetic Polynucleotide
taatacgactcactatagggttcttgtttgtagatctgtagtcaatgattaacagaggagaaatcatatgctacagatcaacctggcggcagcgcaaaagatg

SEQ ID NO: 211915 - DNA, 103 bp, Artificial Sequence
  Synthetic Polynucleotide
taatacgactcactatagggtccttttcttttcttgtttgtagatctgtaaacagaggagatacagaatgacaaacaagaacctggcggcagcgcaaaagatg

SEQ ID NO: 211916 - DNA, 103 bp, Artificial Sequence
  Synthetic Polynucleotide
taatacgactcactatagggatttggagtatccttttcttttcttgtttgaacagaggagacaaacaatgaaagaaaagaacctggcggcagcgcaaaagatg

SEQ ID NO: 211917 - DNA, 103 bp, Artificial Sequence
  Synthetic Polynucleotide
taatacgactcactataggggtcggttttcatttggagtatccttttcttaacagaggagaaagaaaatgatactccaaaacctggcggcagcgcaaaagatg

SEQ ID NO: 211918 - DNA, 103 bp, Artificial Sequence
  Synthetic Polynucleotide
taatacgactcactatagggcttaatttttgtcggttttcatttggagtaaacagaggagatactccatgtgaaaaccgaacctggcggcagcgcaaaagatg

SEQ ID NO: 211919 - DNA, 103 bp, Artificial Sequence
  Synthetic Polynucleotide
taatacgactcactatagggataaaatattcttaatttttgtcggttttcaacagaggagagaaaacatgcaaaaattaaacctggcggcagcgcaaaagatg

SEQ ID NO: 211920 - DNA, 103 bp, Artificial Sequence
  Synthetic Polynucleotide
taatacgactcactatagggagagaaactgataaaatattcttaatttttaacagaggagaaaaaatatggaatattttaacctggcggcagcgcaaaagatg

SEQ ID NO: 211921 - DNA, 103 bp, Artificial Sequence
  Synthetic Polynucleotide
taatacgactcactatagggttgttgttatagagaaactgataaaatattaacagaggagaaatattatgtcagtttctaacctggcggcagcgcaaaagatg

SEQ ID NO: 211922 - DNA, 103 bp, Artificial Sequence
  Synthetic Polynucleotide
taatacgactcactataggggccaccccctccacagctcccgccgccggaaacagaggagatccggcatggggagctgtaacctggcggcagcgcaaaagatg

SEQ ID NO: 211923 - DNA, 103 bp, Artificial Sequence
  Synthetic Polynucleotide
taatacgactcactatagggttgccttgtattgttgttatagagaaactgaacagaggagacagtttatgtataacaacaacctggcggcagcgcaaaagatg

SEQ ID NO: 211924 - DNA, 103 bp, Artificial Sequence
  Synthetic Polynucleotide
taatacgactcactatagggcttcagtttgttgccttgtattgttgttataacagaggagaataacaatgatacaaggcaacctggcggcagcgcaaaagatg

SEQ ID NO: 211925 - DNA, 103 bp, Artificial Sequence
  Synthetic Polynucleotide
taatacgactcactatagggtcatctcttgcttcagtttgttgccttgtaaacagaggagatacaagatgacaaactgaaacctggcggcagcgcaaaagatg

SEQ ID NO: 211926 - DNA, 103 bp, Artificial Sequence
  Synthetic Polynucleotide
taatacgactcactataggggcaatgcaggtcatctcttgcttcagtttgaacagaggagacaaactatggcaagagataacctggcggcagcgcaaaagatg

SEQ ID NO: 211927 - DNA, 103 bp, Artificial Sequence
  Synthetic Polynucleotide
taatacgactcactatagggtacaccaagggcaatgcaggtcatctcttgaacagaggagacaagagatgacctgcattaacctggcggcagcgcaaaagatg

SEQ ID NO: 211928 - DNA, 103 bp, Artificial Sequence
  Synthetic Polynucleotide
taatacgactcactatagggcagttcagagtacaccaagggcaatgcaggaacagaggagacctgcaatgcccttggtgaacctggcggcagcgcaaaagatg

SEQ ID NO: 211929 - DNA, 103 bp, Artificial Sequence
  Synthetic Polynucleotide
taatacgactcactatagggaagtttgcggcagttcagagtacaccaaggaacagaggagaccttggatgactctgaacaacctggcggcagcgcaaaagatg

SEQ ID NO: 211930 - DNA, 103 bp, Artificial Sequence
  Synthetic Polynucleotide
taatacgactcactataggggtaaactataaagtttgcggcagttcagagaacagaggagactctgaatggccgcaaacaacctggcggcagcgcaaaagatg

SEQ ID NO: 211931 - DNA, 103 bp, Artificial Sequence
  Synthetic Polynucleotide
taatacgactcactatagggagatgcttgagtaaactataaagtttgcggaacagaggagaccgcaaatgttatagtttaacctggcggcagcgcaaaagatg

SEQ ID NO: 211932 - DNA, 103 bp, Artificial Sequence
  Synthetic Polynucleotide
taatacgactcactataggggcagagtttaagatgcttgagtaaactataaacagaggagatatagtatgctcaagcataacctggcggcagcgcaaaagatg

SEQ ID NO: 211933 - DNA, 103 bp, Artificial Sequence
  Synthetic Polynucleotide
taatacgactcactatagggccgagtaactgccaccccctccacagctccaacagaggagaggagctatggagggggtgaacctggcggcagcgcaaaagatg

SEQ ID NO: 211934 - DNA, 103 bp, Artificial Sequence
  Synthetic Polynucleotide
taatacgactcactatagggatctgctatggcagagtttaagatgcttgaaacagaggagatcaagcatgttaaactctaacctggcggcagcgcaaaagatg

SEQ ID NO: 211935 - DNA, 103 bp, Artificial Sequence
  Synthetic Polynucleotide
taatacgactcactatagggttgaagataaatctgctatggcagagtttaaacagaggagataaactatgccatagcagaacctggcggcagcgcaaaagatg

SEQ ID NO: 211936 - DNA, 103 bp, Artificial Sequence
  Synthetic Polynucleotide
taatacgactcactatagggataaacatagttgaagataaatctgctatgaacagaggagacatagcatgtttatcttcaacctggcggcagcgcaaaagatg

SEQ ID NO: 211937 - DNA, 103 bp, Artificial Sequence
  Synthetic Polynucleotide
taatacgactcactatagggcttttggatgataaacatagttgaagataaaacagaggagattatctatgactatgtttaacctggcggcagcgcaaaagatg

SEQ ID NO: 211938 - DNA, 103 bp, Artificial Sequence
  Synthetic Polynucleotide
taatacgactcactatagggatcctagcaccttttggatgataaacatagaacagaggagactatgtatgtcatccaaaaacctggcggcagcgcaaaagatg

SEQ ID NO: 211939 - DNA, 103 bp, Artificial Sequence
  Synthetic Polynucleotide
taatacgactcactatagggagaaacatctatcctagcaccttttggatgaacagaggagacatccaatgggtgctaggaacctggcggcagcgcaaaagatg

SEQ ID NO: 211940 - DNA, 103 bp, Artificial Sequence
  Synthetic Polynucleotide
taatacgactcactatagggactcattgatagaaacatctatcctagcacaacagaggagagtgctaatgtagatgtttaacctggcggcagcgcaaaagatg

SEQ ID NO: 211941 - DNA, 103 bp, Artificial Sequence
  Synthetic Polynucleotide
taatacgactcactatagggccatcataacactcattgatagaaacatctaacagaggagaagatgtatgtatcaatgaaacctggcggcagcgcaaaagatg

SEQ ID NO: 211942 - DNA, 103 bp, Artificial Sequence
  Synthetic Polynucleotide
taatacgactcactatagggtgcataggagccatcataacactcattgataacagaggagaatcaatatgtgttatgataacctggcggcagcgcaaaagatg

SEQ ID NO: 211943 - DNA, 103 bp, Artificial Sequence
  Synthetic Polynucleotide
taatacgactcactataggggaggatttcctgcataggagccatcataacaacagaggagagttatgatggctcctatgaacctggcggcagcgcaaaagatg

SEQ ID NO: 211944 - DNA, 103 bp, Artificial Sequence
  Synthetic Polynucleotide
taatacgactcactataggggaggaggaggccgagtaactgccaccccctaacagaggagaagggggatgcagttactcaacctggcggcagcgcaaaagatg

SEQ ID NO: 211945 - DNA, 103 bp, Artificial Sequence
  Synthetic Polynucleotide
taatacgactcactatagggtgaatatcctgaggatttcctgcataggagaacagaggagactcctaatgaggaaatccaacctggcggcagcgcaaaagatg

SEQ ID NO: 211946 - DNA, 103 bp, Artificial Sequence
  Synthetic Polynucleotide
taatacgactcactatagggaggttggcgatgaatatcctgaggatttccaacagaggagaggaaatatgcaggatattaacctggcggcagcgcaaaagatg

SEQ ID NO: 211947 - DNA, 103 bp, Artificial Sequence
  Synthetic Polynucleotide
taatacgactcactatagggaagcaaatccaggttggcgatgaatatcctaacagaggagaaggataatgatcgccaacaacctggcggcagcgcaaaagatg

SEQ ID NO: 211948 - DNA, 103 bp, Artificial Sequence
  Synthetic Polynucleotide
taatacgactcactatagggttgcgactaaaagcaaatccaggttggcgaaacagaggagatcgccaatgtggatttgcaacctggcggcagcgcaaaagatg

SEQ ID NO: 211949 - DNA, 103 bp, Artificial Sequence
  Synthetic Polynucleotide
taatacgactcactatagggaactggtccgttgcgactaaaagcaaatccaacagaggagaggatttatgtttagtcgcaacctggcggcagcgcaaaagatg

SEQ ID NO: 211950 - DNA, 103 bp, Artificial Sequence
  Synthetic Polynucleotide
taatacgactcactataggggtgttctcttaactggtccgttgcgactaaaacagaggagattagtcatgacggaccagaacctggcggcagcgcaaaagatg

SEQ ID NO: 211951 - DNA, 103 bp, Artificial Sequence
  Synthetic Polynucleotide
taatacgactcactatagggtgtgtgataggtgttctcttaactggtccgaacagaggagacggaccatgtaagagaacaacctggcggcagcgcaaaagatg

SEQ ID NO: 211952 - DNA, 103 bp, Artificial Sequence
  Synthetic Polynucleotide
taatacgactcactatagggcacaagaatatgtgtgataggtgttctcttaacagaggagaaagagaatgcctatcacaaacctggcggcagcgcaaaagatg

SEQ ID NO: 211953 - DNA, 103 bp, Artificial Sequence
  Synthetic Polynucleotide
taatacgactcactatagggttggcctgcacacaagaatatgtgtgatagaacagaggagactatcaatgatattcttgaacctggcggcagcgcaaaagatg

SEQ ID NO: 211954 - DNA, 103 bp, Artificial Sequence
  Synthetic Polynucleotide
taatacgactcactatagggtttgttcgttttggcctgcacacaagaataaacagaggagatattctatggtgcaggccaacctggcggcagcgcaaaagatg

SEQ ID NO: 211955 - DNA, 103 bp, Artificial Sequence
  Synthetic Polynucleotide
taatacgactcactatagggcgcggaggaggaggaggaggccgagtaactaacagaggagaagttacatggcctcctccaacctggcggcagcgcaaaagatg

SEQ ID NO: 211956 - DNA, 103 bp, Artificial Sequence
  Synthetic Polynucleotide
taatacgactcactatagggcatgcttgcttttgttcgttttggcctgcaaacagaggagatgcaggatgaaacgaacaaacctggcggcagcgcaaaagatg

SEQ ID NO: 211957 - DNA, 103 bp, Artificial Sequence
  Synthetic Polynucleotide
taatacgactcactataggggaaattcagacatgcttgcttttgttcgttaacagaggagaaacgaaatgaagcaagcaaacctggcggcagcgcaaaagatg

SEQ ID NO: 211958 - DNA, 103 bp, Artificial Sequence
  Synthetic Polynucleotide
taatacgactcactatagggtcagattcaagaaattcagacatgcttgctaacagaggagaagcaagatggtctgaattaacctggcggcagcgcaaaagatg

SEQ ID NO: 211959 - DNA, 103 bp, Artificial Sequence
  Synthetic Polynucleotide
taatacgactcactatagggttccccatcttcagattcaagaaattcagaaacagaggagatctgaaatgcttgaatctaacctggcggcagcgcaaaagatg

SEQ ID NO: 211960 - DNA, 103 bp, Artificial Sequence
  Synthetic Polynucleotide
taatacgactcactataggggctgttctacttccccatcttcagattcaaaacagaggagattgaatatgaagatggggaacctggcggcagcgcaaaagatg

SEQ ID NO: 211961 - DNA, 103 bp, Artificial Sequence
  Synthetic Polynucleotide
taatacgactcactatagggtatgttctttgctgttctacttccccatctaacagaggagaagatggatgagtagaacaaacctggcggcagcgcaaaagatg

SEQ ID NO: 211962 - DNA, 103 bp, Artificial Sequence
  Synthetic Polynucleotide
taatacgactcactataggggccactactatatgttctttgctgttctacaacagaggagagtagaaatgcaaagaacaaacctggcggcagcgcaaaagatg

SEQ ID NO: 211963 - DNA, 103 bp, Artificial Sequence
  Synthetic Polynucleotide
taatacgactcactataggggacgattgtggccactactatatgttctttaacagaggagaaaagaaatgatagtagtgaacctggcggcagcgcaaaagatg

SEQ ID NO: 211964 - DNA, 103 bp, Artificial Sequence
  Synthetic Polynucleotide
taatacgactcactatagggtggaaatacagacgattgtggccactactaaacagaggagatagtagatgccacaatcgaacctggcggcagcgcaaaagatg

SEQ ID NO: 211965 - DNA, 103 bp, Artificial Sequence
  Synthetic Polynucleotide
taatacgactcactatagggggtatcactatggaaatacagacgattgtgaacagaggagacacaatatgctgtatttcaacctggcggcagcgcaaaagatg

SEQ ID NO: 211966 - DNA, 103 bp, Artificial Sequence
  Synthetic Polynucleotide
taatacgactcactatagggccgctgccgccgcggaggaggaggaggaggaacagaggagacctcctatgcctcctccgaacctggcggcagcgcaaaagatg

SEQ ID NO: 211967 - DNA, 103 bp, Artificial Sequence
  Synthetic Polynucleotide
taatacgactcactataggggaggtaagcaggtatcactatggaaatacaaacagaggagatgtattatgatagtgataaacctggcggcagcgcaaaagatg

SEQ ID NO: 211968 - DNA, 103 bp, Artificial Sequence
  Synthetic Polynucleotide
taatacgactcactatagggtgtggacggagaggtaagcaggtatcactaaacagaggagatagtgaatgctgcttaccaacctggcggcagcgcaaaagatg

SEQ ID NO: 211969 - DNA, 103 bp, Artificial Sequence
  Synthetic Polynucleotide
taatacgactcactatagggttccatttcttgtggacggagaggtaagcaaacagaggagatgcttaatgctccgtccaaacctggcggcagcgcaaaagatg

SEQ ID NO: 211970 - DNA, 103 bp, Artificial Sequence
  Synthetic Polynucleotide
taatacgactcactatagggcactatctacttccatttcttgtggacggaaacagaggagatccgtcatgaagaaatggaacctggcggcagcgcaaaagatg

SEQ ID NO: 211971 - DNA, 103 bp, Artificial Sequence
  Synthetic Polynucleotide
taatacgactcactatagggttttcatcttcactatctacttccatttctaacagaggagaagaaatatgagtagatagaacctggcggcagcgcaaaagatg

SEQ ID NO: 211972 - DNA, 103 bp, Artificial Sequence
  Synthetic Polynucleotide
taatacgactcactatagggttcaggatccttttcatcttcactatctacaacagaggagagtagatatggaagatgaaaacctggcggcagcgcaaaagatg

SEQ ID NO: 211973 - DNA, 103 bp, Artificial Sequence
  Synthetic Polynucleotide
taatacgactcactatagggctcttagccattcaggatccttttcatcttaacagaggagaaagatgatgaggatcctgaacctggcggcagcgcaaaagatg

SEQ ID NO: 211974 - DNA, 103 bp, Artificial Sequence
  Synthetic Polynucleotide
taatacgactcactatagggatggttttttctcttagccattcaggatccaacagaggagaggatccatgatggctaagaacctggcggcagcgcaaaagatg

SEQ ID NO: 211975 - DNA, 103 bp, Artificial Sequence
  Synthetic Polynucleotide
taatacgactcactatagggaatttgtgtaatggttttttctcttagccaaacagaggagatggctaatggaaaaaaccaacctggcggcagcgcaaaagatg

SEQ ID NO: 211976 - DNA, 103 bp, Artificial Sequence
  Synthetic Polynucleotide
taatacgactcactatagggaaaactcttcaatttgtgtaatggttttttaacagaggagaaaaaaaatgttacacaaaaacctggcggcagcgcaaaagatg

SEQ ID NO: 211977 - DNA, 103 bp, Artificial Sequence
  Synthetic Polynucleotide
taatacgactcactataggggcagcccccgccgctgccgccgcggaggagaacagaggagactcctcatgggcggcagcaacctggcggcagcgcaaaagatg

SEQ ID NO: 211978 - DNA, 103 bp, Artificial Sequence
  Synthetic Polynucleotide
taatacgactcactatagggttaacatcagaaaactcttcaatttgtgtaaacagaggagatacacaatgtgaagagttaacctggcggcagcgcaaaagatg

SEQ ID NO: 211979 - DNA, 103 bp, Artificial Sequence
  Synthetic Polynucleotide
taatacgactcactatagggctctccttcattaacatcagaaaactcttcaacagaggagagaagagatgtctgatgttaacctggcggcagcgcaaaagatg

SEQ ID NO: 211980 - DNA, 103 bp, Artificial Sequence
  Synthetic Polynucleotide
taatacgactcactatagggtcacttctttctctccttcattaacatcagaacagaggagactgatgatgatgaaggagaacctggcggcagcgcaaaagatg

SEQ ID NO: 211981 - DNA, 103 bp, Artificial Sequence
  Synthetic Polynucleotide
taatacgactcactatagggcagagtttcatcacttctttctctccttcaaacagaggagatgaaggatggaaagaagtaacctggcggcagcgcaaaagatg

SEQ ID NO: 211982 - DNA, 103 bp, Artificial Sequence
  Synthetic Polynucleotide
taatacgactcactatagggatggagattccagagtttcatcacttctttaacagaggagaaaagaaatgatgaaactcaacctggcggcagcgcaaaagatg

SEQ ID NO: 211983 - DNA, 103 bp, Artificial Sequence
  Synthetic Polynucleotide
taatacgactcactataggggcttcatgacatggagattccagagtttcaaacagaggagatgaaacatgggaatctccaacctggcggcagcgcaaaagatg

SEQ ID NO: 211984 - DNA, 103 bp, Artificial Sequence
  Synthetic Polynucleotide
taatacgactcactatagggataaacccatgcttcatgacatggagattcaacagaggagagaatctatgtgtcatgaaaacctggcggcagcgcaaaagatg

SEQ ID NO: 211985 - DNA, 103 bp, Artificial Sequence
  Synthetic Polynucleotide
taatacgactcactatagggattgtcagcaataaacccatgcttcatgacaacagaggagagtcatgatgcatgggtttaacctggcggcagcgcaaaagatg

SEQ ID NO: 211986 - DNA, 103 bp, Artificial Sequence
  Synthetic Polynucleotide
taatacgactcactataggggattcatttgattgtcagcaataaacccataacagaggagaatgggtatgttgctgacaaacctggcggcagcgcaaaagatg

SEQ ID NO: 211987 - DNA, 103 bp, Artificial Sequence
  Synthetic Polynucleotide
taatacgactcactatagggatacaggcatgattcatttgattgtcagcaaacagaggagatgctgaatgtcaaatgaaaacctggcggcagcgcaaaagatg

SEQ ID NO: 211988 - DNA, 103 bp, Artificial Sequence
  Synthetic Polynucleotide
taatacgactcactatagggcggtaacaccgcagcccccgccgctgccgcaacagaggagagcggcaatggcgggggctaacctggcggcagcgcaaaagatg

SEQ ID NO: 211989 - DNA, 103 bp, Artificial Sequence
  Synthetic Polynucleotide
taatacgactcactatagggtacaaacagcatacaggcatgattcatttgaacagaggagacaaatgatgcatgcctgtaacctggcggcagcgcaaaagatg

SEQ ID NO: 211990 - DNA, 103 bp, Artificial Sequence
  Synthetic Polynucleotide
taatacgactcactatagggcataattttctacaaacagcatacaggcataacagaggagaatgcctatgtgctgtttgaacctggcggcagcgcaaaagatg

SEQ ID NO: 211991 - DNA, 103 bp, Artificial Sequence
  Synthetic Polynucleotide
taatacgactcactatagggattttctgtccataattttctacaaacagcaacagaggagagctgttatgagaaaattaaacctggcggcagcgcaaaagatg

SEQ ID NO: 211992 - DNA, 103 bp, Artificial Sequence
  Synthetic Polynucleotide
taatacgactcactatagggcttcttaattattttctgtccataattttcaacagaggagagaaaatatgggacagaaaaacctggcggcagcgcaaaagatg

SEQ ID NO: 211993 - DNA, 103 bp, Artificial Sequence
  Synthetic Polynucleotide
taatacgactcactataggggacataaattcttcttaattattttctgtcaacagaggagagacagaatgtaattaagaaacctggcggcagcgcaaaagatg

SEQ ID NO: 211994 - DNA, 103 bp, Artificial Sequence
  Synthetic Polynucleotide
taatacgactcactatagggatgaagtttcgacataaattcttcttaattaacagaggagaaattaaatggaatttatgaacctggcggcagcgcaaaagatg

SEQ ID NO: 211995 - DNA, 103 bp, Artificial Sequence
  Synthetic Polynucleotide
taatacgactcactatagggtagatgaagcatgaagtttcgacataaattaacagaggagaaatttaatgcgaaacttcaacctggcggcagcgcaaaagatg

SEQ ID NO: 211996 - DNA, 103 bp, Artificial Sequence
  Synthetic Polynucleotide
taatacgactcactataggggcatgctgactagatgaagcatgaagtttcaacagaggagagaaactatgtgcttcatcaacctggcggcagcgcaaaagatg

SEQ ID NO: 211997 - DNA, 103 bp, Artificial Sequence
  Synthetic Polynucleotide
taatacgactcactatagggttaaagtcatgcatgctgactagatgaagcaacagaggagagcttcaatgagtcagcataacctggcggcagcgcaaaagatg

SEQ ID NO: 211998 - DNA, 103 bp, Artificial Sequence
  Synthetic Polynucleotide
taatacgactcactataggggctaataagattaaagtcatgcatgctgacaacagaggagagtcagcatgcatgactttaacctggcggcagcgcaaaagatg

SEQ ID NO: 211999 - DNA, 103 bp, Artificial Sequence
  Synthetic Polynucleotide
taatacgactcactatagggagccgccccctcccccaccgccgtgcttctaacagaggagaagaagcatggcggtggggaacctggcggcagcgcaaaagatg

SEQ ID NO: 212000 - DNA, 103 bp, Artificial Sequence
  Synthetic Polynucleotide
taatacgactcactataggggcttcttcaccggtaacaccgcagcccccgaacagaggagacgggggatgcggtgttacaacctggcggcagcgcaaaagatg

SEQ ID NO: 212001 - DNA, 103 bp, Artificial Sequence
  Synthetic Polynucleotide
taatacgactcactatagggttgacattatgctaataagattaaagtcataacagaggagaatgactatgatcttattaaacctggcggcagcgcaaaagatg

SEQ ID NO: 212002 - DNA, 103 bp, Artificial Sequence
  Synthetic Polynucleotide
taatacgactcactataggggctttatctattgacattatgctaataagaaacagaggagatcttatatgcataatgtcaacctggcggcagcgcaaaagatg

SEQ ID NO: 212003 - DNA, 103 bp, Artificial Sequence
  Synthetic Polynucleotide
taatacgactcactatagggcttggtaacagctttatctattgacattataacagaggagaataatgatgatagataaaaacctggcggcagcgcaaaagatg

SEQ ID NO: 212004 - DNA, 103 bp, Artificial Sequence
  Synthetic Polynucleotide
taatacgactcactatagggtttcacggagcttggtaacagctttatctaaacagaggagatagataatgctgttaccaaacctggcggcagcgcaaaagatg

SEQ ID NO: 212005 - DNA, 103 bp, Artificial Sequence
  Synthetic Polynucleotide
taatacgactcactatagggttttgctgcatttcacggagcttggtaacaaacagaggagatgttacatggctccgtgaaacctggcggcagcgcaaaagatg

SEQ ID NO: 212006 - DNA, 103 bp, Artificial Sequence
  Synthetic Polynucleotide
taatacgactcactatagggcttttctaatttttgctgcatttcacggagaacagaggagactccgtatgatgcagcaaaacctggcggcagcgcaaaagatg

SEQ ID NO: 212007 - DNA, 103 bp, Artificial Sequence
  Synthetic Polynucleotide
taatacgactcactatagggcagattcccccttttctaatttttgctgcaaacagaggagatgcagcatgaattagaaaaacctggcggcagcgcaaaagatg

SEQ ID NO: 212008 - DNA, 103 bp, Artificial Sequence
  Synthetic Polynucleotide
taatacgactcactataggggcaggggaagcagattcccccttttctaataacagaggagaattagaatggggggaatcaacctggcggcagcgcaaaagatg

SEQ ID NO: 212009 - DNA, 103 bp, Artificial Sequence
  Synthetic Polynucleotide
taatacgactcactatagggttcttcgtttgcaggggaagcagattccccaacagaggagaggggaaatggcttcccctaacctggcggcagcgcaaaagatg

SEQ ID NO: 212010 - DNA, 103 bp, Artificial Sequence
  Synthetic Polynucleotide
taatacgactcactatagggcttcagttatttcttcgtttgcaggggaagaacagaggagacttcccatgcaaacgaagaacctggcggcagcgcaaaagatg

SEQ ID NO: 212011 - DNA, 103 bp, Artificial Sequence
  Synthetic Polynucleotide
taatacgactcactatagggtccattttcggcttcttcaccggtaacaccaacagaggagaggtgttatgggtgaagaaaacctggcggcagcgcaaaagatg

SEQ ID NO: 212012 - DNA, 103 bp, Artificial Sequence
  Synthetic Polynucleotide
taatacgactcactatagggccattttgttcttcagttatttcttcgtttaacagaggagaaaacgaatgaataactgaaacctggcggcagcgcaaaagatg

SEQ ID NO: 212013 - DNA, 103 bp, Artificial Sequence
  Synthetic Polynucleotide
taatacgactcactatagggatttgctgtcccattttgttcttcagttataacagaggagaataactatggaacaaaataacctggcggcagcgcaaaagatg

SEQ ID NO: 212014 - DNA, 103 bp, Artificial Sequence
  Synthetic Polynucleotide
taatacgactcactatagggcactaaatccatttgctgtcccattttgttaacagaggagaaacaaaatgggacagcaaaacctggcggcagcgcaaaagatg

SEQ ID NO: 212015 - DNA, 103 bp, Artificial Sequence
  Synthetic Polynucleotide
taatacgactcactataggggagttaatttcactaaatccatttgctgtcaacagaggagagacagcatgtggatttagaacctggcggcagcgcaaaagatg

SEQ ID NO: 212016 - DNA, 103 bp, Artificial Sequence
  Synthetic Polynucleotide
taatacgactcactatagggtttctcttttgagttaatttcactaaatccaacagaggagaggatttatggaaattaacaacctggcggcagcgcaaaagatg

SEQ ID NO: 212017 - DNA, 103 bp, Artificial Sequence
  Synthetic Polynucleotide
taatacgactcactatagggtttccaaagctttctcttttgagttaatttaacagaggagaaaattaatgcaaaagagaaacctggcggcagcgcaaaagatg

SEQ ID NO: 212018 - DNA, 103 bp, Artificial Sequence
  Synthetic Polynucleotide
taatacgactcactatagggacactatctgtttccaaagctttctcttttaacagaggagaaaaagaatgagctttggaaacctggcggcagcgcaaaagatg

SEQ ID NO: 212019 - DNA, 103 bp, Artificial Sequence
  Synthetic Polynucleotide
taatacgactcactatagggaacccctgagacactatctgtttccaaagcaacagaggagagctttgatgacagatagtaacctggcggcagcgcaaaagatg

SEQ ID NO: 212020 - DNA, 103 bp, Artificial Sequence
  Synthetic Polynucleotide
taatacgactcactatagggtctgttttgaaacccctgagacactatctgaacagaggagacagataatgtctcaggggaacctggcggcagcgcaaaagatg

SEQ ID NO: 212021 - DNA, 103 bp, Artificial Sequence
  Synthetic Polynucleotide
taatacgactcactatagggtgttttttgctctgttttgaaacccctgagaacagaggagactcaggatgttcaaaacaaacctggcggcagcgcaaaagatg

SEQ ID NO: 212022 - DNA, 103 bp, Artificial Sequence
  Synthetic Polynucleotide
taatacgactcactatagggctggacgtgctccattttcggcttcttcacaacagaggagagtgaagatgccgaaaatgaacctggcggcagcgcaaaagatg

SEQ ID NO: 212023 - DNA, 103 bp, Artificial Sequence
  Synthetic Polynucleotide
taatacgactcactatagggtcagagtttttgttttttgctctgttttgaaacagaggagatcaaaaatgagcaaaaaaaacctggcggcagcgcaaaagatg

SEQ ID NO: 212024 - DNA, 103 bp, Artificial Sequence
  Synthetic Polynucleotide
taatacgactcactatagggcgtggtcagcctggacgtgctccattttcgaacagaggagacgaaaaatgagcacgtccaacctggcggcagcgcaaaagatg

SEQ ID NO: 212025 - DNA, 103 bp, Artificial Sequence
  Synthetic Polynucleotide
taatacgactcactatagggaggaaaagctcgtggtcagcctggacgtgcaacagaggagagcacgtatgggctgaccaaacctggcggcagcgcaaaagatg

SEQ ID NO: 212026 - DNA, 103 bp, Artificial Sequence
  Synthetic Polynucleotide
taatacgactcactatagggaaaggcctggaggaaaagctcgtggtcagcaacagaggagagctgacatggagcttttcaacctggcggcagcgcaaaagatg

SEQ ID NO: 212027 - DNA, 103 bp, Artificial Sequence
  Synthetic Polynucleotide
taatacgactcactatagggttggcttctcaaaggcctggaggaaaagctaacagaggagaagctttatgtccaggcctaacctggcggcagcgcaaaagatg

SEQ ID NO: 212028 - DNA, 103 bp, Artificial Sequence
  Synthetic Polynucleotide
taatacgactcactatagggtagatctgtgttggcttctcaaaggcctggaacagaggagaccaggcatgtgagaagccaacctggcggcagcgcaaaagatg

SEQ ID NO: 212029 - DNA, 103 bp, Artificial Sequence
  Synthetic Polynucleotide
taatacgactcactatagggaagaaatctatagatctgtgttggcttctcaacagaggagagagaagatgacacagatcaacctggcggcagcgcaaaagatg

SEQ ID NO: 212030 - DNA, 103 bp, Artificial Sequence
  Synthetic Polynucleotide
taatacgactcactatagggtccgagttcgaagaaatctatagatctgtgaacagaggagacacagaatgatagatttcaacctggcggcagcgcaaaagatg

SEQ ID NO: 212031 - DNA, 103 bp, Artificial Sequence
  Synthetic Polynucleotide
taatacgactcactatagggctgggccccgagccgccccctcccccaccgaacagaggagacggtggatgagggggcggaacctggcggcagcgcaaaagatg

SEQ ID NO: 212032 - DNA, 103 bp, Artificial Sequence
  Synthetic Polynucleotide
taatacgactcactataggggctatgagattccgagttcgaagaaatctaaacagaggagatagattatgtcgaactcgaacctggcggcagcgcaaaagatg

SEQ ID NO: 212033 - DNA, 103 bp, Artificial Sequence
  Synthetic Polynucleotide
taatacgactcactatagggaaatattggtgctatgagattccgagttcgaacagaggagacgaactatgaatctcataaacctggcggcagcgcaaaagatg

SEQ ID NO: 212034 - DNA, 103 bp, Artificial Sequence
  Synthetic Polynucleotide
taatacgactcactatagggttctgtgcaaaaatattggtgctatgagataacagaggagaatctcaatgcaccaatataacctggcggcagcgcaaaagatg

SEQ ID NO: 212035 - DNA, 103 bp, Artificial Sequence
  Synthetic Polynucleotide
taatacgactcactatagggtaagtaagagttctgtgcaaaaatattggtaacagaggagaaccaatatgtttgcacagaacctggcggcagcgcaaaagatg

SEQ ID NO: 212036 - DNA, 103 bp, Artificial Sequence
  Synthetic Polynucleotide
taatacgactcactatagggatgagacatgtaagtaagagttctgtgcaaaacagaggagattgcacatgactcttactaacctggcggcagcgcaaaagatg

SEQ ID NO: 212037 - DNA, 103 bp, Artificial Sequence
  Synthetic Polynucleotide
taatacgactcactatagggtggagtttcgatgagacatgtaagtaagagaacagaggagactcttaatgacatgtctcaacctggcggcagcgcaaaagatg

SEQ ID NO: 212038 - DNA, 103 bp, Artificial Sequence
  Synthetic Polynucleotide
taatacgactcactatagggatgtttgttctggagtttcgatgagacatgaacagaggagacatgtcatgtcgaaactcaacctggcggcagcgcaaaagatg

SEQ ID NO: 212039 - DNA, 103 bp, Artificial Sequence
  Synthetic Polynucleotide
taatacgactcactatagggtttccttttgatgtttgttctggagtttcgaacagaggagacgaaacatgagaacaaacaacctggcggcagcgcaaaagatg

SEQ ID NO: 212040 - DNA, 103 bp, Artificial Sequence
  Synthetic Polynucleotide
taatacgactcactatagggctttaaatgttttccttttgatgtttgttcaacagaggagagaacaaatgtcaaaaggaaacctggcggcagcgcaaaagatg

SEQ ID NO: 212041 - DNA, 103 bp, Artificial Sequence
  Synthetic Polynucleotide
taatacgactcactatagggatatcatcaactttaaatgttttccttttgaacagaggagacaaaagatgaacatttaaaacctggcggcagcgcaaaagatg

SEQ ID NO: 212042 - DNA, 103 bp, Artificial Sequence
  Synthetic Polynucleotide
taatacgactcactatagggggaccccgcgctgggccccgagccgcccccaacagaggagagggggcatgtcggggcccaacctggcggcagcgcaaaagatg

SEQ ID NO: 212043 - DNA, 103 bp, Artificial Sequence
  Synthetic Polynucleotide
taatacgactcactatagggttttgataacatatcatcaactttaaatgtaacagaggagaacatttatggttgatgataacctggcggcagcgcaaaagatg

SEQ ID NO: 212044 - DNA, 103 bp, Artificial Sequence
  Synthetic Polynucleotide
taatacgactcactatagggttttctctacttttgataacatatcatcaaaacagaggagattgatgatgtgttatcaaaacctggcggcagcgcaaaagatg

SEQ ID NO: 212045 - DNA, 103 bp, Artificial Sequence
  Synthetic Polynucleotide
taatacgactcactatagggtctcctttcattttctctacttttgataacaacagaggagagttatcatgagtagagaaaacctggcggcagcgcaaaagatg

SEQ ID NO: 212046 - DNA, 103 bp, Artificial Sequence
  Synthetic Polynucleotide
taatacgactcactatagggagattcttgctctcctttcattttctctacaacagaggagagtagagatgatgaaaggaaacctggcggcagcgcaaaagatg

SEQ ID NO: 212047 - DNA, 103 bp, Artificial Sequence
  Synthetic Polynucleotide
taatacgactcactatagggacaagctatgagattcttgctctcctttcaaacagaggagatgaaagatgagcaagaataacctggcggcagcgcaaaagatg

SEQ ID NO: 212048 - DNA, 103 bp, Artificial Sequence
  Synthetic Polynucleotide
taatacgactcactatagggaaatgagctgacaagctatgagattcttgcaacagaggagagcaagaatgtcatagcttaacctggcggcagcgcaaaagatg

SEQ ID NO: 212049 - DNA, 103 bp, Artificial Sequence
  Synthetic Polynucleotide
taatacgactcactatagggcgtaagctgcaaatgagctgacaagctatgaacagaggagacatagcatgtcagctcataacctggcggcagcgcaaaagatg

SEQ ID NO: 212050 - DNA, 103 bp, Artificial Sequence
  Synthetic Polynucleotide
taatacgactcactatagggaaccagtaaacgtaagctgcaaatgagctgaacagaggagacagctcatgtgcagcttaaacctggcggcagcgcaaaagatg

SEQ ID NO: 212051 - DNA, 103 bp, Artificial Sequence
  Synthetic Polynucleotide
taatacgactcactatagggttgtggaagaaaccagtaaacgtaagctgcaacagaggagagcagctatggtttactggaacctggcggcagcgcaaaagatg

SEQ ID NO: 212052 - DNA, 103 bp, Artificial Sequence
  Synthetic Polynucleotide
taatacgactcactatagggcttatcatttttgtggaagaaaccagtaaaaacagaggagatttactatgttcttccacaacctggcggcagcgcaaaagatg

SEQ ID NO: 212053 - DNA, 103 bp, Artificial Sequence
  Synthetic Polynucleotide
taatacgactcactatagggcgcctcccccggaccccgcgctgggccccgaacagaggagacggggcatggcgcggggtaacctggcggcagcgcaaaagatg

SEQ ID NO: 212054 - DNA, 103 bp, Artificial Sequence
  Synthetic Polynucleotide
taatacgactcactatagggttggtgatggcttatcatttttgtggaagaaacagaggagatcttccatgaaaatgataaacctggcggcagcgcaaaagatg

SEQ ID NO: 212055 - DNA, 103 bp, Artificial Sequence
  Synthetic Polynucleotide
taatacgactcactatagggttttctgagtttggtgatggcttatcatttaacagaggagaaaatgaatggccatcaccaacctggcggcagcgcaaaagatg

SEQ ID NO: 212056 - DNA, 103 bp, Artificial Sequence
  Synthetic Polynucleotide
taatacgactcactatagggattttgttcattttctgagtttggtgatggaacagaggagaccatcaatgaactcagaaaacctggcggcagcgcaaaagatg

SEQ ID NO: 212057 - DNA, 103 bp, Artificial Sequence
  Synthetic Polynucleotide
taatacgactcactataggggggtaacagaattttgttcattttctgagtaacagaggagaactcagatgatgaacaaaaacctggcggcagcgcaaaagatg

SEQ ID NO: 212058 - DNA, 103 bp, Artificial Sequence
  Synthetic Polynucleotide
taatacgactcactatagggaggacttccagggtaacagaattttgttcaaacagaggagatgaacaatgttctgttacaacctggcggcagcgcaaaagatg

SEQ ID NO: 212059 - DNA, 103 bp, Artificial Sequence
  Synthetic Polynucleotide
taatacgactcactatagggtttcacaagcaggacttccagggtaacagaaacagaggagatctgttatgctggaagtcaacctggcggcagcgcaaaagatg

SEQ ID NO: 212060 - DNA, 103 bp, Artificial Sequence
  Synthetic Polynucleotide
taatacgactcactatagggtgtggcaaactttcacaagcaggacttccaaacagaggagatggaagatgtgcttgtgaaacctggcggcagcgcaaaagatg

SEQ ID NO: 212061 - DNA, 103 bp, Artificial Sequence
  Synthetic Polynucleotide
taatacgactcactatagggtttctttttttgtggcaaactttcacaagcaacagaggagagcttgtatgagtttgccaaacctggcggcagcgcaaaagatg

SEQ ID NO: 212062 - DNA, 103 bp, Artificial Sequence
  Synthetic Polynucleotide
taatacgactcactatagggacttacatcctttctttttttgtggcaaacaacagaggagagtttgcatgaaaaaaagaaacctggcggcagcgcaaaagatg

SEQ ID NO: 212063 - DNA, 103 bp, Artificial Sequence
  Synthetic Polynucleotide
taatacgactcactatagggttattggacaacttacatcctttcttttttaacagaggagaaaaaaaatgaggatgtaaaacctggcggcagcgcaaaagatg

SEQ ID NO: 212064 - DNA, 103 bp, Artificial Sequence
  Synthetic Polynucleotide
taatacgactcactatagggcccccgaagccgcctcccccggaccccgcgaacagaggagacgcgggatgcgggggaggaacctggcggcagcgcaaaagatg

SEQ ID NO: 212065 - DNA, 103 bp, Artificial Sequence
  Synthetic Polynucleotide
taatacgactcactatagggggaacttgccttattggacaacttacatccaacagaggagaggatgtatgttgtccaataacctggcggcagcgcaaaagatg

SEQ ID NO: 212066 - DNA, 103 bp, Artificial Sequence
  Synthetic Polynucleotide
taatacgactcactatagggtttacctgtgggaacttgccttattggacaaacagaggagatgtccaatgaggcaagttaacctggcggcagcgcaaaagatg

SEQ ID NO: 212067 - DNA, 103 bp, Artificial Sequence
  Synthetic Polynucleotide
taatacgactcactataggggcacctgctttttacctgtgggaacttgccaacagaggagaggcaagatgccacaggtaaacctggcggcagcgcaaaagatg

SEQ ID NO: 212068 - DNA, 103 bp, Artificial Sequence
  Synthetic Polynucleotide
taatacgactcactatagggggattcaaaggcacctgctttttacctgtgaacagaggagacacaggatgaaagcaggtaacctggcggcagcgcaaaagatg

SEQ ID NO: 212069 - DNA, 103 bp, Artificial Sequence
  Synthetic Polynucleotide
taatacgactcactatagggattgaggtcaggattcaaaggcacctgcttaacagaggagaaagcagatgcctttgaataacctggcggcagcgcaaaagatg

SEQ ID NO: 212070 - DNA, 103 bp, Artificial Sequence
  Synthetic Polynucleotide
taatacgactcactataggggttttgtttgattgaggtcaggattcaaagaacagaggagactttgaatgctgacctcaaacctggcggcagcgcaaaagatg

SEQ ID NO: 212071 - DNA, 103 bp, Artificial Sequence
  Synthetic Polynucleotide
taatacgactcactatagggaaatttccgggttttgtttgattgaggtcaaacagaggagatgacctatgtcaaacaaaaacctggcggcagcgcaaaagatg

SEQ ID NO: 212072 - DNA, 103 bp, Artificial Sequence
  Synthetic Polynucleotide
taatacgactcactatagggaagggacgggaaatttccgggttttgtttgaacagaggagacaaacaatgcccggaaataacctggcggcagcgcaaaagatg

SEQ ID NO: 212073 - DNA, 103 bp, Artificial Sequence
  Synthetic Polynucleotide
taatacgactcactatagggtggaaactgcaagggacgggaaatttccggaacagaggagaccggaaatgtcccgtcccaacctggcggcagcgcaaaagatg

SEQ ID NO: 212074 - DNA, 103 bp, Artificial Sequence
  Synthetic Polynucleotide
taatacgactcactatagggaattcattactggaaactgcaagggacgggaacagaggagacccgtcatgtgcagtttcaacctggcggcagcgcaaaagatg

SEQ ID NO: 212075 - DNA, 103 bp, Artificial Sequence
  Synthetic Polynucleotide
taatacgactcactatagggcgccgccgaacccccgaagccgcctcccccaacagaggagagggggaatgggcttcgggaacctggcggcagcgcaaaagatg

SEQ ID NO: 212076 - DNA, 103 bp, Artificial Sequence
  Synthetic Polynucleotide
taatacgactcactatagggactaggttcaaattcattactggaaactgcaacagaggagagcagttatgagtaatgaaaacctggcggcagcgcaaaagatg

SEQ ID NO: 212077 - DNA, 103 bp, Artificial Sequence
  Synthetic Polynucleotide
taatacgactcactatagggtatggctgttactaggttcaaattcattacaacagaggagagtaatgatgttgaacctaaacctggcggcagcgcaaaagatg

SEQ ID NO: 212078 - DNA, 103 bp, Artificial Sequence
  Synthetic Polynucleotide
taatacgactcactataggggacttcaccatatggctgttactaggttcaaacagaggagatgaaccatgtaacagccaaacctggcggcagcgcaaaagatg

SEQ ID NO: 212079 - DNA, 103 bp, Artificial Sequence
  Synthetic Polynucleotide
taatacgactcactatagggcaacgagtaagacttcaccatatggctgttaacagaggagaaacagcatgatggtgaagaacctggcggcagcgcaaaagatg

SEQ ID NO: 212080 - DNA, 103 bp, Artificial Sequence
  Synthetic Polynucleotide
taatacgactcactatagggctctaaatagcaacgagtaagacttcaccaaacagaggagatggtgaatgcttactcgtaacctggcggcagcgcaaaagatg

SEQ ID NO: 212081 - DNA, 103 bp, Artificial Sequence
  Synthetic Polynucleotide
taatacgactcactatagggggacgagtcactctaaatagcaacgagtaaaacagaggagattactcatggctatttagaacctggcggcagcgcaaaagatg

SEQ ID NO: 212082 - DNA, 103 bp, Artificial Sequence
  Synthetic Polynucleotide
taatacgactcactatagggtcttcttcctggacgagtcactctaaatagaacagaggagactatttatggtgactcgtaacctggcggcagcgcaaaagatg

SEQ ID NO: 212083 - DNA, 103 bp, Artificial Sequence
  Synthetic Polynucleotide
taatacgactcactatagggcattaaactctcttcttcctggacgagtcaaacagaggagatgactcatgcaggaagaaaacctggcggcagcgcaaaagatg

SEQ ID NO: 212084 - DNA, 103 bp, Artificial Sequence
  Synthetic Polynucleotide
taatacgactcactatagggttaatcattccattaaactctcttcttcctaacagaggagaaggaagatgagagtttaaaacctggcggcagcgcaaaagatg

SEQ ID NO: 212085 - DNA, 103 bp, Artificial Sequence
  Synthetic Polynucleotide
taatacgactcactatagggggtttctccattaatcattccattaaactcaacagaggagagagtttatgggaatgattaacctggcggcagcgcaaaagatg

SEQ ID NO: 212086 - DNA, 103 bp, Artificial Sequence
  Synthetic Polynucleotide
taatacgactcactatagggccgccgccaccgccgccgaacccccgaagcaacagaggagagcttcgatggttcggcggaacctggcggcagcgcaaaagatg

SEQ ID NO: 212087 - DNA, 103 bp, Artificial Sequence
  Synthetic Polynucleotide
taatacgactcactatagggtattttcattggtttctccattaatcattcaacagaggagagaatgaatgatggagaaaaacctggcggcagcgcaaaagatg

SEQ ID NO: 212088 - DNA, 103 bp, Artificial Sequence
  Synthetic Polynucleotide
taatacgactcactatagggttgacatcaatattttcattggtttctccaaacagaggagatggagaatgcaatgaaaaaacctggcggcagcgcaaaagatg

SEQ ID NO: 212089 - DNA, 103 bp, Artificial Sequence
  Synthetic Polynucleotide
taatacgactcactatagggaagctcttcattgacatcaatattttcattaacagaggagaaatgaaatgattgatgtcaacctggcggcagcgcaaaagatg

SEQ ID NO: 212090 - DNA, 103 bp, Artificial Sequence
  Synthetic Polynucleotide
taatacgactcactatagggttctggctggaagctcttcattgacatcaaaacagaggagattgatgatgatgaagagcaacctggcggcagcgcaaaagatg

SEQ ID NO: 212091 - DNA, 103 bp, Artificial Sequence
  Synthetic Polynucleotide
taatacgactcactatagggtttcgttttcttctggctggaagctcttcaaacagaggagatgaagaatgtccagccagaacctggcggcagcgcaaaagatg

SEQ ID NO: 212092 - DNA, 103 bp, Artificial Sequence
  Synthetic Polynucleotide
taatacgactcactatagggatcctcacgatttcgttttcttctggctggaacagaggagaccagccatgagaaaacgaaacctggcggcagcgcaaaagatg

SEQ ID NO: 212093 - DNA, 103 bp, Artificial Sequence
  Synthetic Polynucleotide
taatacgactcactatagggtcttttccccatcctcacgatttcgttttcaacagaggagagaaaacatgatcgtgaggaacctggcggcagcgcaaaagatg

SEQ ID NO: 212094 - DNA, 103 bp, Artificial Sequence
  Synthetic Polynucleotide
taatacgactcactataggggcaacaaatgtcttttccccatcctcacgaaacagaggagatcgtgaatgtggggaaaaaacctggcggcagcgcaaaagatg

SEQ ID NO: 212095 - DNA, 103 bp, Artificial Sequence
  Synthetic Polynucleotide
taatacgactcactatagggtgtcatttgtgcaacaaatgtcttttccccaacagaggagaggggaaatgacatttgttaacctggcggcagcgcaaaagatg

SEQ ID NO: 212096 - DNA, 103 bp, Artificial Sequence
  Synthetic Polynucleotide
taatacgactcactatagggtatcaaatactgtcatttgtgcaacaaatgaacagaggagacatttgatgcacaaatgaaacctggcggcagcgcaaaagatg

SEQ ID NO: 212097 - DNA, 103 bp, Artificial Sequence
  Synthetic Polynucleotide
taatacgactcactataggggaagccgtcgccgccgccaccgccgccgaaaacagaggagattcggcatgggtggcggcaacctggcggcagcgcaaaagatg

SEQ ID NO: 212098 - DNA, 103 bp, Artificial Sequence
  Synthetic Polynucleotide
taatacgactcactatagggcgcctgtttttatcaaatactgtcatttgtaacagaggagaacaaatatgagtatttgaaacctggcggcagcgcaaaagatg

SEQ ID NO: 212099 - DNA, 103 bp, Artificial Sequence
  Synthetic Polynucleotide
taatacgactcactatagggaagctgtaagcgcctgtttttatcaaatacaacagaggagagtatttatgaaaaacaggaacctggcggcagcgcaaaagatg

SEQ ID NO: 212100 - DNA, 103 bp, Artificial Sequence
  Synthetic Polynucleotide
taatacgactcactatagggccccatctaaaagctgtaagcgcctgttttaacagaggagaaaaacaatggcttacagcaacctggcggcagcgcaaaagatg

SEQ ID NO: 212101 - DNA, 103 bp, Artificial Sequence
  Synthetic Polynucleotide
taatacgactcactatagggacttcatattccccatctaaaagctgtaagaacagaggagacttacaatgtttagatggaacctggcggcagcgcaaaagatg

SEQ ID NO: 212102 - DNA, 103 bp, Artificial Sequence
  Synthetic Polynucleotide
taatacgactcactatagggctgcatggctacttcatattccccatctaaaacagaggagattagatatggaatatgaaaacctggcggcagcgcaaaagatg

SEQ ID NO: 212103 - DNA, 103 bp, Artificial Sequence
  Synthetic Polynucleotide
taatacgactcactatagggcttccatttcctgcatggctacttcatattaacagaggagaaatatgatgtagccatgcaacctggcggcagcgcaaaagatg

SEQ ID NO: 212104 - DNA, 103 bp, Artificial Sequence
  Synthetic Polynucleotide
taatacgactcactatagggattggacattcttccatttcctgcatggctaacagaggagaagccatatgggaaatggaaacctggcggcagcgcaaaagatg

SEQ ID NO: 212105 - DNA, 103 bp, Artificial Sequence
  Synthetic Polynucleotide
taatacgactcactatagggtttcttgcttattggacattcttccatttcaacagaggagagaaatgatggaatgtccaaacctggcggcagcgcaaaagatg

SEQ ID NO: 212106 - DNA, 103 bp, Artificial Sequence
  Synthetic Polynucleotide
taatacgactcactatagggatgttgctcttttcttgcttattggacattaacagaggagaaatgtcatgtaagcaagaaacctggcggcagcgcaaaagatg

SEQ ID NO: 212107 - DNA, 103 bp, Artificial Sequence
  Synthetic Polynucleotide
taatacgactcactatagggatagtctcccatgttgctcttttcttgcttaacagaggagaaagcaaatgaagagcaacaacctggcggcagcgcaaaagatg

SEQ ID NO: 212108 - DNA, 103 bp, Artificial Sequence
  Synthetic Polynucleotide
taatacgactcactatagggccgcagcagcaaatcgcagccgggtcccataacagaggagaatgggaatgggctgcgataacctggcggcagcgcaaaagatg

SEQ ID NO: 212109 - DNA, 103 bp, Artificial Sequence
  Synthetic Polynucleotide
taatacgactcactatagggacccgctaaagaaaatgggccgcctccagcaacagaggagagctggaatgggcccatttaacctggcggcagcgcaaaagatg

SEQ ID NO: 212110 - DNA, 103 bp, Artificial Sequence
  Synthetic Polynucleotide
taatacgactcactatagggggactccacaggagccatcatcgtgatttcaacagaggagagaaatcatgatgatggctaacctggcggcagcgcaaaagatg

SEQ ID NO: 212111 - DNA, 103 bp, Artificial Sequence
  Synthetic Polynucleotide
taatacgactcactataggggggaaaatttggactccacaggagccatcaaacagaggagatgatggatgctgtggagtaacctggcggcagcgcaaaagatg

SEQ ID NO: 212112 - DNA, 103 bp, Artificial Sequence
  Synthetic Polynucleotide
taatacgactcactatagggccagttgattgggaaaatttggactccacaaacagaggagatgtggaatgcaaattttcaacctggcggcagcgcaaaagatg

SEQ ID NO: 212113 - DNA, 103 bp, Artificial Sequence
  Synthetic Polynucleotide
taatacgactcactatagggatctatatctccagttgattgggaaaatttaacagaggagaaaatttatgcaatcaactaacctggcggcagcgcaaaagatg

SEQ ID NO: 212114 - DNA, 103 bp, Artificial Sequence
  Synthetic Polynucleotide
taatacgactcactatagggctgtcactttatctatatctccagttgattaacagaggagaaatcaaatggagatatagaacctggcggcagcgcaaaagatg

SEQ ID NO: 212115 - DNA, 103 bp, Artificial Sequence
  Synthetic Polynucleotide
taatacgactcactatagggggtttggtatctgtcactttatctatatctaacagaggagaagatatatgtaaagtgacaacctggcggcagcgcaaaagatg

SEQ ID NO: 212116 - DNA, 103 bp, Artificial Sequence
  Synthetic Polynucleotide
taatacgactcactatagggagccactcttggtttggtatctgtcactttaacagaggagaaaagtgatggataccaaaaacctggcggcagcgcaaaagatg

SEQ ID NO: 212117 - DNA, 103 bp, Artificial Sequence
  Synthetic Polynucleotide
taatacgactcactatagggaacgccactcagccactcttggtttggtataacagaggagaataccaatgcaagagtggaacctggcggcagcgcaaaagatg

SEQ ID NO: 212118 - DNA, 103 bp, Artificial Sequence
  Synthetic Polynucleotide
taatacgactcactataggggcaggcccataacgccactcagccactcttaacagaggagaaagagtatgtgagtggcgaacctggcggcagcgcaaaagatg

SEQ ID NO: 212119 - DNA, 103 bp, Artificial Sequence
  Synthetic Polynucleotide
taatacgactcactatagggccacagtcgggcaggcccataacgccactcaacagaggagagagtggatgtatgggcctaacctggcggcagcgcaaaagatg

SEQ ID NO: 212120 - DNA, 103 bp, Artificial Sequence
  Synthetic Polynucleotide
taatacgactcactatagggcgaaaaggaaacccgctaaagaaaatgggcaacagaggagagcccatatgctttagcggaacctggcggcagcgcaaaagatg

SEQ ID NO: 212121 - DNA, 103 bp, Artificial Sequence
  Synthetic Polynucleotide
taatacgactcactataggggcatatcataccacagtcgggcaggcccataacagaggagaatgggcatgcccgactgtaacctggcggcagcgcaaaagatg

SEQ ID NO: 212122 - DNA, 103 bp, Artificial Sequence
  Synthetic Polynucleotide
taatacgactcactataggggggacacccagcatatcataccacagtcggaacagaggagaccgactatggtatgatataacctggcggcagcgcaaaagatg

SEQ ID NO: 212123 - DNA, 103 bp, Artificial Sequence
  Synthetic Polynucleotide
taatacgactcactataggggccatcttcagggacacccagcatatcataaacagaggagatatgatatgctgggtgtcaacctggcggcagcgcaaaagatg

SEQ ID NO: 212124 - DNA, 103 bp, Artificial Sequence
  Synthetic Polynucleotide
taatacgactcactatagggcaaacccactgccatcttcagggacacccaaacagaggagatgggtgatgctgaagatgaacctggcggcagcgcaaaagatg

SEQ ID NO: 212125 - DNA, 103 bp, Artificial Sequence
  Synthetic Polynucleotide
taatacgactcactatagggaagccatagtcaaacccactgccatcttcaaacagaggagatgaagaatgcagtgggttaacctggcggcagcgcaaaagatg

SEQ ID NO: 212126 - DNA, 103 bp, Artificial Sequence
  Synthetic Polynucleotide
taatacgactcactatagggtctcagtttgaagccatagtcaaacccactaacagaggagaagtgggatggactatggcaacctggcggcagcgcaaaagatg

SEQ ID NO: 212127 - DNA, 103 bp, Artificial Sequence
  Synthetic Polynucleotide
taatacgactcactataggggttctgtctttctcagtttgaagccatagtaacagaggagaactatgatgtcaaactgaaacctggcggcagcgcaaaagatg

SEQ ID NO: 212128 - DNA, 103 bp, Artificial Sequence
  Synthetic Polynucleotide
taatacgactcactatagggacaggttcatgttctgtctttctcagtttgaacagaggagacaaactatgaaagacagaaacctggcggcagcgcaaaagatg

SEQ ID NO: 212129 - DNA, 103 bp, Artificial Sequence
  Synthetic Polynucleotide
taatacgactcactatagggagattttatcacaggttcatgttctgtcttaacagaggagaaagacaatgcatgaacctaacctggcggcagcgcaaaagatg

SEQ ID NO: 212130 - DNA, 103 bp, Artificial Sequence
  Synthetic Polynucleotide
taatacgactcactatagggctatcattctagattttatcacaggttcataacagaggagaatgaacatgtgataaaataacctggcggcagcgcaaaagatg

SEQ ID NO: 212131 - DNA, 103 bp, Artificial Sequence
  Synthetic Polynucleotide
taatacgactcactatagggttgatgttgccgaaaaggaaacccgctaaaaacagaggagatttagcatgtttccttttaacctggcggcagcgcaaaagatg

SEQ ID NO: 212132 - DNA, 103 bp, Artificial Sequence
  Synthetic Polynucleotide
taatacgactcactatagggctaaattcctctatcattctagattttatcaacagaggagagataaaatgtagaatgataacctggcggcagcgcaaaagatg

SEQ ID NO: 212133 - DNA, 103 bp, Artificial Sequence
  Synthetic Polynucleotide
taatacgactcactatagggctcaagtttcctaaattcctctatcattctaacagaggagaagaatgatggaggaatttaacctggcggcagcgcaaaagatg

SEQ ID NO: 212134 - DNA, 103 bp, Artificial Sequence
  Synthetic Polynucleotide
taatacgactcactatagggcattgttttcctcaagtttcctaaattcctaacagaggagaaggaatatgggaaacttgaacctggcggcagcgcaaaagatg

SEQ ID NO: 212135 - DNA, 103 bp, Artificial Sequence
  Synthetic Polynucleotide
taatacgactcactatagggagatcagtgccattgttttcctcaagtttcaacagaggagagaaactatgggaaaacaaaacctggcggcagcgcaaaagatg

SEQ ID NO: 212136 - DNA, 103 bp, Artificial Sequence
  Synthetic Polynucleotide
taatacgactcactatagggatcagccagaagatcagtgccattgttttcaacagaggagagaaaacatgggcactgataacctggcggcagcgcaaaagatg

SEQ ID NO: 212137 - DNA, 103 bp, Artificial Sequence
  Synthetic Polynucleotide
taatacgactcactatagggggaagttttcatcagccagaagatcagtgcaacagaggagagcactgatgttctggctgaacctggcggcagcgcaaaagatg

SEQ ID NO: 212138 - DNA, 103 bp, Artificial Sequence
  Synthetic Polynucleotide
taatacgactcactataggggtcaccatcaggaagttttcatcagccagaaacagaggagatctggcatgtgaaaacttaacctggcggcagcgcaaaagatg

SEQ ID NO: 212139 - DNA, 103 bp, Artificial Sequence
  Synthetic Polynucleotide
taatacgactcactatagggatgcagctgtgtcaccatcaggaagttttcaacagaggagagaaaacatgctgatggtgaacctggcggcagcgcaaaagatg

SEQ ID NO: 212140 - DNA, 103 bp, Artificial Sequence
  Synthetic Polynucleotide
taatacgactcactatagggcatcctcccaatgcagctgtgtcaccatcaaacagaggagatgatggatgcacagctgcaacctggcggcagcgcaaaagatg

SEQ ID NO: 212141 - DNA, 103 bp, Artificial Sequence
  Synthetic Polynucleotide
taatacgactcactatagggcagatgatatcatcctcccaatgcagctgtaacagaggagaacagctatgttgggaggaaacctggcggcagcgcaaaagatg

SEQ ID NO: 212142 - DNA, 103 bp, Artificial Sequence
  Synthetic Polynucleotide
taatacgactcactatagggcccggctccattgatgttgccgaaaaggaaaacagaggagattccttatgggcaacatcaacctggcggcagcgcaaaagatg

SEQ ID NO: 212143 - DNA, 103 bp, Artificial Sequence
  Synthetic Polynucleotide
taatacgactcactatagggctccccatcccagatgatatcatcctcccaaacagaggagatgggagatggatatcatcaacctggcggcagcgcaaaagatg

SEQ ID NO: 212144 - DNA, 103 bp, Artificial Sequence
  Synthetic Polynucleotide
taatacgactcactataggggtttgacatcctccccatcccagatgatataacagaggagaatatcaatggggatggggaacctggcggcagcgcaaaagatg

SEQ ID NO: 212145 - DNA, 103 bp, Artificial Sequence
  Synthetic Polynucleotide
taatacgactcactataggggtccctttgtgtttgacatcctccccatccaacagaggagaggatggatgggatgtcaaaacctggcggcagcgcaaaagatg

SEQ ID NO: 212146 - DNA, 103 bp, Artificial Sequence
  Synthetic Polynucleotide
taatacgactcactatagggctgaggttttgtccctttgtgtttgacatcaacagaggagagatgtcatgcacaaagggaacctggcggcagcgcaaaagatg

SEQ ID NO: 212147 - DNA, 103 bp, Artificial Sequence
  Synthetic Polynucleotide
taatacgactcactatagggggcttgcacgctgaggttttgtccctttgtaacagaggagaacaaagatgcaaaacctcaacctggcggcagcgcaaaagatg

SEQ ID NO: 212148 - DNA, 103 bp, Artificial Sequence
  Synthetic Polynucleotide
taatacgactcactatagggcagcctgccaggcttgcacgctgaggttttaacagaggagaaaaaccatggcgtgcaagaacctggcggcagcgcaaaagatg

SEQ ID NO: 212149 - DNA, 103 bp, Artificial Sequence
  Synthetic Polynucleotide
taatacgactcactatagggagaaggaagccagcctgccaggcttgcacgaacagaggagacgtgcaatgctggcaggcaacctggcggcagcgcaaaagatg

SEQ ID NO: 212150 - DNA, 103 bp, Artificial Sequence
  Synthetic Polynucleotide
taatacgactcactatagggtagtcatgctagaaggaagccagcctgccaaacagaggagatggcagatgggcttccttaacctggcggcagcgcaaaagatg

SEQ ID NO: 212151 - DNA, 103 bp, Artificial Sequence
  Synthetic Polynucleotide
taatacgactcactatagggatcgcattcctagtcatgctagaaggaagcaacagaggagagcttccatgtagcatgacaacctggcggcagcgcaaaagatg

SEQ ID NO: 212152 - DNA, 103 bp, Artificial Sequence
  Synthetic Polynucleotide
taatacgactcactatagggattgtaagccatcgcattcctagtcatgctaacagaggagaagcatgatgaggaatgcgaacctggcggcagcgcaaaagatg

SEQ ID NO: 212153 - DNA, 103 bp, Artificial Sequence
  Synthetic Polynucleotide
taatacgactcactatagggcctccagctgcccggctccattgatgttgcaacagaggagagcaacaatgatggagccgaacctggcggcagcgcaaaagatg

SEQ ID NO: 212154 - DNA, 103 bp, Artificial Sequence
  Synthetic Polynucleotide
taatacgactcactatagggcttgctgaacattgtaagccatcgcattccaacagaggagaggaatgatgtggcttacaaacctggcggcagcgcaaaagatg

SEQ ID NO: 212155 - DNA, 103 bp, Artificial Sequence
  Synthetic Polynucleotide
taatacgactcactataggggctgcaaaaccttgctgaacattgtaagccaacagaggagaggcttaatgtgttcagcaaacctggcggcagcgcaaaagatg

SEQ ID NO: 212156 - DNA, 103 bp, Artificial Sequence
  Synthetic Polynucleotide
taatacgactcactatagggatcaagagtggctgcaaaaccttgctgaacaacagaggagagttcagatgggttttgcaaacctggcggcagcgcaaaagatg

SEQ ID NO: 212157 - DNA, 103 bp, Artificial Sequence
  Synthetic Polynucleotide
taatacgactcactataggggtttgtcatcatcaagagtggctgcaaaacaacagaggagagttttgatgccactcttgaacctggcggcagcgcaaaagatg

SEQ ID NO: 212158 - DNA, 103 bp, Artificial Sequence
  Synthetic Polynucleotide
taatacgactcactataggggagtaccaaggtttgtcatcatcaagagtgaacagaggagacactctatgtgatgacaaaacctggcggcagcgcaaaagatg

SEQ ID NO: 212159 - DNA, 103 bp, Artificial Sequence
  Synthetic Polynucleotide
taatacgactcactataggggggaaaaatggagtaccaaggtttgtcatcaacagaggagagatgacatgccttggtacaacctggcggcagcgcaaaagatg

SEQ ID NO: 212160 - DNA, 103 bp, Artificial Sequence
  Synthetic Polynucleotide
taatacgactcactatagggcattgtcaatgggaaaaatggagtaccaagaacagaggagacttggtatgccatttttcaacctggcggcagcgcaaaagatg

SEQ ID NO: 212161 - DNA, 103 bp, Artificial Sequence
  Synthetic Polynucleotide
taatacgactcactatagggaccagatcctcattgtcaatgggaaaaatgaacagaggagacattttatgcattgacaaaacctggcggcagcgcaaaagatg

SEQ ID NO: 212162 - DNA, 103 bp, Artificial Sequence
  Synthetic Polynucleotide
taatacgactcactataggggcgtccatataccagatcctcattgtcaataacagaggagaattgacatggaggatctgaacctggcggcagcgcaaaagatg

SEQ ID NO: 212163 - DNA, 103 bp, Artificial Sequence
  Synthetic Polynucleotide
taatacgactcactatagggtgtcctcccagcgtccatataccagatcctaacagaggagaaggatcatgtatatggacaacctggcggcagcgcaaaagatg

SEQ ID NO: 212164 - DNA, 103 bp, Artificial Sequence
  Synthetic Polynucleotide
taatacgactcactatagggacgctttccccctccagctgcccggctccaaacagaggagatggagcatggcagctggaaacctggcggcagcgcaaaagatg

SEQ ID NO: 212165 - DNA, 103 bp, Artificial Sequence
  Synthetic Polynucleotide
taatacgactcactatagggcaaatgatattgtcctcccagcgtccatataacagaggagaatatggatgctgggaggaaacctggcggcagcgcaaaagatg

SEQ ID NO: 212166 - DNA, 103 bp, Artificial Sequence
  Synthetic Polynucleotide
taatacgactcactatagggctgagcatcccaaatgatattgtcctcccaaacagaggagatgggagatgaatatcattaacctggcggcagcgcaaaagatg

SEQ ID NO: 212167 - DNA, 103 bp, Artificial Sequence
  Synthetic Polynucleotide
taatacgactcactatagggggggcatggcctgagcatcccaaatgatataacagaggagaatatcaatggggatgctcaacctggcggcagcgcaaaagatg

SEQ ID NO: 212168 - DNA, 103 bp, Artificial Sequence
  Synthetic Polynucleotide
taatacgactcactatagggtccaacagccggggcatggcctgagcatccaacagaggagaggatgcatgggccatgccaacctggcggcagcgcaaaagatg

SEQ ID NO: 212169 - DNA, 103 bp, Artificial Sequence
  Synthetic Polynucleotide
taatacgactcactatagggaacaggaggttccaacagccggggcatggcaacagaggagagccatgatgcggctgttgaacctggcggcagcgcaaaagatg

SEQ ID NO: 212170 - DNA, 103 bp, Artificial Sequence
  Synthetic Polynucleotide
taatacgactcactatagggcaagtgtcaaaacaggaggttccaacagccaacagaggagaggctgtatgaacctcctgaacctggcggcagcgcaaaagatg

SEQ ID NO: 212171 - DNA, 103 bp, Artificial Sequence
  Synthetic Polynucleotide
taatacgactcactatagggtcattgggatcaagtgtcaaaacaggaggtaacagaggagaacctccatgtttgacactaacctggcggcagcgcaaaagatg

SEQ ID NO: 212172 - DNA, 103 bp, Artificial Sequence
  Synthetic Polynucleotide
taatacgactcactataggggaggttctcatcattgggatcaagtgtcaaaacagaggagattgacaatggatcccaataacctggcggcagcgcaaaagatg

SEQ ID NO: 212173 - DNA, 103 bp, Artificial Sequence
  Synthetic Polynucleotide
taatacgactcactatagggtttccaaaatgaggttctcatcattgggataacagaggagaatcccaatgatgagaaccaacctggcggcagcgcaaaagatg

SEQ ID NO: 212174 - DNA, 103 bp, Artificial Sequence
  Synthetic Polynucleotide
taatacgactcactatagggtcatcaggaatttccaaaatgaggttctcaaacagaggagatgagaaatgcattttggaaacctggcggcagcgcaaaagatg

SEQ ID NO: 212175 - DNA, 103 bp, Artificial Sequence
  Synthetic Polynucleotide
taatacgactcactatagggatcatccaagacgctttccccctccagctgaacagaggagacagctgatgggggaaagcaacctggcggcagcgcaaaagatg

SEQ ID NO: 212176 - DNA, 103 bp, Artificial Sequence
  Synthetic Polynucleotide
taatacgactcactatagggctcttccttctcatcaggaatttccaaaataacagaggagaattttgatgattcctgataacctggcggcagcgcaaaagatg

SEQ ID NO: 212177 - DNA, 103 bp, Artificial Sequence
  Synthetic Polynucleotide
taatacgactcactatagggtagaggtggcctcttccttctcatcaggaaaacagaggagattcctgatgagaaggaagaacctggcggcagcgcaaaagatg

SEQ ID NO: 212178 - DNA, 103 bp, Artificial Sequence
  Synthetic Polynucleotide
taatacgactcactataggggagggggagttagaggtggcctcttccttcaacagaggagagaaggaatgggccacctcaacctggcggcagcgcaaaagatg

SEQ ID NO: 212179 - DNA, 103 bp, Artificial Sequence
  Synthetic Polynucleotide
taatacgactcactatagggactctccttggagggggagttagaggtggcaacagaggagagccaccatgaactcccccaacctggcggcagcgcaaaagatg

SEQ ID NO: 212180 - DNA, 103 bp, Artificial Sequence
  Synthetic Polynucleotide
taatacgactcactatagggattccttcttactctccttggagggggagtaacagaggagaactcccatgccaaggagaaacctggcggcagcgcaaaagatg

SEQ ID NO: 212181 - DNA, 103 bp, Artificial Sequence
  Synthetic Polynucleotide
taatacgactcactatagggttcagagatgattccttcttactctccttgaacagaggagacaaggaatgtaagaaggaaacctggcggcagcgcaaaagatg

SEQ ID NO: 212182 - DNA, 103 bp, Artificial Sequence
  Synthetic Polynucleotide
taatacgactcactatagggtcgactcttcttcagagatgattccttcttaacagaggagaaagaagatgtcatctctgaacctggcggcagcgcaaaagatg

SEQ ID NO: 212183 - DNA, 103 bp, Artificial Sequence
  Synthetic Polynucleotide
taatacgactcactatagggctaagagaattcgactcttcttcagagatgaacagaggagacatctcatgagaagagtcaacctggcggcagcgcaaaagatg

SEQ ID NO: 212184 - DNA, 103 bp, Artificial Sequence
  Synthetic Polynucleotide
taatacgactcactatagggcctgttttccctaagagaattcgactcttcaacagaggagagaagagatgaattctcttaacctggcggcagcgcaaaagatg

SEQ ID NO: 212185 - DNA, 103 bp, Artificial Sequence
  Synthetic Polynucleotide
taatacgactcactatagggcttgatgactcctgttttccctaagagaataacagaggagaattctcatggggaaaacaaacctggcggcagcgcaaaagatg

SEQ ID NO: 212186 - DNA, 103 bp, Artificial Sequence
  Synthetic Polynucleotide
taatacgactcactatagggtcttacattcatcatccaagacgctttcccaacagaggagagggaaaatgtcttggatgaacctggcggcagcgcaaaagatg

SEQ ID NO: 212187 - DNA, 103 bp, Artificial Sequence
  Synthetic Polynucleotide
taatacgactcactataggggtggttcctccttgatgactcctgttttccaacagaggagaggaaaaatggagtcatcaaacctggcggcagcgcaaaagatg

SEQ ID NO: 212188 - DNA, 103 bp, Artificial Sequence
  Synthetic Polynucleotide
taatacgactcactatagggatgttctgctgtggttcctccttgatgactaacagaggagaagtcatatgggaggaaccaacctggcggcagcgcaaaagatg

SEQ ID NO: 212189 - DNA, 103 bp, Artificial Sequence
  Synthetic Polynucleotide
taatacgactcactatagggtggctgagacatgttctgctgtggttcctcaacagaggagagaggaaatgcagcagaacaacctggcggcagcgcaaaagatg

SEQ ID NO: 212190 - DNA, 103 bp, Artificial Sequence
  Synthetic Polynucleotide
taatacgactcactatagggctttcacttctggctgagacatgttctgctaacagaggagaagcagaatgtgtctcagcaacctggcggcagcgcaaaagatg

SEQ ID NO: 212191 - DNA, 103 bp, Artificial Sequence
  Synthetic Polynucleotide
taatacgactcactatagggttccatggatctttcacttctggctgagacaacagaggagagtctcaatgagaagtgaaaacctggcggcagcgcaaaagatg

SEQ ID NO: 212192 - DNA, 103 bp, Artificial Sequence
  Synthetic Polynucleotide
taatacgactcactatagggattggagagattccatggatctttcacttcaacagaggagagaagtgatggatccatggaacctggcggcagcgcaaaagatg

SEQ ID NO: 212193 - DNA, 103 bp, Artificial Sequence
  Synthetic Polynucleotide
taatacgactcactatagggaatactcatcattggagagattccatggataacagaggagaatccatatgatctctccaaacctggcggcagcgcaaaagatg

SEQ ID NO: 212194 - DNA, 103 bp, Artificial Sequence
  Synthetic Polynucleotide
taatacgactcactatagggttgggataataatactcatcattggagagaaacagaggagatctctcatgtgatgagtaaacctggcggcagcgcaaaagatg

SEQ ID NO: 212195 - DNA, 103 bp, Artificial Sequence
  Synthetic Polynucleotide
taatacgactcactatagggaccctgttgcttgggataataatactcatcaacagaggagagatgagatgtattatcccaacctggcggcagcgcaaaagatg

SEQ ID NO: 212196 - DNA, 103 bp, Artificial Sequence
  Synthetic Polynucleotide
taatacgactcactatagggtgcctcgaagaccctgttgcttgggataataacagaggagaattatcatgagcaacaggaacctggcggcagcgcaaaagatg

SEQ ID NO: 212197 - DNA, 103 bp, Artificial Sequence
  Synthetic Polynucleotide
taatacgactcactataggggccaagtgcttcttacattcatcatccaagaacagaggagacttggaatgtgaatgtaaaacctggcggcagcgcaaaagatg

SEQ ID NO: 212198 - DNA, 103 bp, Artificial Sequence
  Synthetic Polynucleotide
taatacgactcactatagggcctccaaaggtgcctcgaagaccctgttgcaacagaggagagcaacaatgtcttcgaggaacctggcggcagcgcaaaagatg

SEQ ID NO: 212199 - DNA, 103 bp, Artificial Sequence
  Synthetic Polynucleotide
taatacgactcactataggggataatattccctccaaaggtgcctcgaagaacagaggagacttcgaatgacctttggaaacctggcggcagcgcaaaagatg

SEQ ID NO: 212200 - DNA, 103 bp, Artificial Sequence
  Synthetic Polynucleotide
taatacgactcactatagggttgaatgctggataatattccctccaaaggaacagaggagacctttgatgggaatattaaacctggcggcagcgcaaaagatg

SEQ ID NO: 212201 - DNA, 103 bp, Artificial Sequence
  Synthetic Polynucleotide
taatacgactcactatagggacagcaggaattgaatgctggataatattcaacagaggagagaatatatgccagcattcaacctggcggcagcgcaaaagatg

SEQ ID NO: 212202 - DNA, 103 bp, Artificial Sequence
  Synthetic Polynucleotide
taatacgactcactatagggccgtaattccacagcaggaattgaatgctgaacagaggagacagcatatgattcctgctaacctggcggcagcgcaaaagatg

SEQ ID NO: 212203 - DNA, 103 bp, Artificial Sequence
  Synthetic Polynucleotide
taatacgactcactatagggagaagggctgccgtaattccacagcaggaaaacagaggagattcctgatgtggaattacaacctggcggcagcgcaaaagatg

SEQ ID NO: 212204 - DNA, 103 bp, Artificial Sequence
  Synthetic Polynucleotide
taatacgactcactatagggtgggtgggaaagaagggctgccgtaattccaacagaggagaggaattatggcagcccttaacctggcggcagcgcaaaagatg

SEQ ID NO: 212205 - DNA, 103 bp, Artificial Sequence
  Synthetic Polynucleotide
taatacgactcactataggggggccccatgtgggtgggaaagaagggctgaacagaggagacagcccatgtttcccaccaacctggcggcagcgcaaaagatg

SEQ ID NO: 212206 - DNA, 103 bp, Artificial Sequence
  Synthetic Polynucleotide
taatacgactcactatagggggagtttgatgggccccatgtgggtgggaaaacagaggagattcccaatgacatggggcaacctggcggcagcgcaaaagatg

SEQ ID NO: 212207 - DNA, 103 bp, Artificial Sequence
  Synthetic Polynucleotide
taatacgactcactatagggtggaactgccggagtttgatgggccccatgaacagaggagacatgggatgcatcaaactaacctggcggcagcgcaaaagatg

SEQ ID NO: 212208 - DNA, 103 bp, Artificial Sequence
  Synthetic Polynucleotide
taatacgactcactatagggccccaagcctgccaagtgcttcttacattcaacagaggagagaatgtatgaagcacttgaacctggcggcagcgcaaaagatg

SEQ ID NO: 212209 - DNA, 103 bp, Artificial Sequence
  Synthetic Polynucleotide
taatacgactcactatagggaggtgggcgatggaactgccggagtttgataacagaggagaatcaaaatgcggcagttcaacctggcggcagcgcaaaagatg

SEQ ID NO: 212210 - DNA, 103 bp, Artificial Sequence
  Synthetic Polynucleotide
taatacgactcactatagggactttttcagaggtgggcgatggaactgccaacagaggagaggcagtatgatcgcccacaacctggcggcagcgcaaaagatg

SEQ ID NO: 212211 - DNA, 103 bp, Artificial Sequence
  Synthetic Polynucleotide
taatacgactcactatagggccaaatgagtactttttcagaggtgggcgaaacagaggagatcgcccatgtctgaaaaaaacctggcggcagcgcaaaagatg

SEQ ID NO: 212212 - DNA, 103 bp, Artificial Sequence
  Synthetic Polynucleotide
taatacgactcactatagggagaaagtgcaccaaatgagtactttttcagaacagaggagactgaaaatgtactcatttaacctggcggcagcgcaaaagatg

SEQ ID NO: 212213 - DNA, 103 bp, Artificial Sequence
  Synthetic Polynucleotide
taatacgactcactataggggacctggctgagaaagtgcaccaaatgagtaacagaggagaactcatatggtgcactttaacctggcggcagcgcaaaagatg

SEQ ID NO: 212214 - DNA, 103 bp, Artificial Sequence
  Synthetic Polynucleotide
taatacgactcactatagggactgagtggggacctggctgagaaagtgcaaacagaggagatgcactatgtcagccaggaacctggcggcagcgcaaaagatg

SEQ ID NO: 212215 - DNA, 103 bp, Artificial Sequence
  Synthetic Polynucleotide
taatacgactcactatagggcaaaggttggactgagtggggacctggctgaacagaggagacagccaatgccccactcaaacctggcggcagcgcaaaagatg

SEQ ID NO: 212216 - DNA, 103 bp, Artificial Sequence
  Synthetic Polynucleotide
taatacgactcactatagggtgtgctttagcaaaggttggactgagtgggaacagaggagacccactatgtccaaccttaacctggcggcagcgcaaaagatg

SEQ ID NO: 212217 - DNA, 103 bp, Artificial Sequence
  Synthetic Polynucleotide
taatacgactcactatagggttttttttgatgtgctttagcaaaggttggaacagaggagaccaaccatggctaaagcaaacctggcggcagcgcaaaagatg

SEQ ID NO: 212218 - DNA, 103 bp, Artificial Sequence
  Synthetic Polynucleotide
taatacgactcactatagggcatcttggccttttttttgatgtgctttagaacagaggagactaaagatgatcaaaaaaaacctggcggcagcgcaaaagatg

SEQ ID NO: 212219 - DNA, 103 bp, Artificial Sequence
  Synthetic Polynucleotide
taatacgactcactatagggtagctgctgtccgcagcagcaaatcgcagcaacagaggagagctgcgatgtgctgctgcaacctggcggcagcgcaaaagatg

SEQ ID NO: 212220 - DNA, 103 bp, Artificial Sequence
  Synthetic Polynucleotide
taatacgactcactataggggccccaaagcccccaagcctgccaagtgctaacagaggagaagcactatgcaggcttggaacctggcggcagcgcaaaagatg

SEQ ID NO: 212221 - DNA, 103 bp, Artificial Sequence
  Synthetic Polynucleotide
taatacgactcactatagggcttgttctctcatcttggccttttttttgaaacagaggagatcaaaaatgaggccaagaaacctggcggcagcgcaaaagatg

SEQ ID NO: 212222 - DNA, 103 bp, Artificial Sequence
  Synthetic Polynucleotide
taatacgactcactataggggcttgcctctcttgttctctcatcttggccaacagaggagaggccaaatggagagaacaaacctggcggcagcgcaaaagatg

SEQ ID NO: 212223 - DNA, 103 bp, Artificial Sequence
  Synthetic Polynucleotide
taatacgactcactatagggaccacctgaagcttgcctctcttgttctctaacagaggagaagagaaatggagaggcaaaacctggcggcagcgcaaaagatg

SEQ ID NO: 212224 - DNA, 103 bp, Artificial Sequence
  Synthetic Polynucleotide
taatacgactcactatagggacatctctccaccacctgaagcttgcctctaacagaggagaagaggcatgcttcaggtgaacctggcggcagcgcaaaagatg

SEQ ID NO: 212225 - DNA, 103 bp, Artificial Sequence
  Synthetic Polynucleotide
taatacgactcactatagggcgcataaaaaacatctctccaccacctgaaaacagaggagattcaggatgtggagagataacctggcggcagcgcaaaagatg

SEQ ID NO: 212226 - DNA, 103 bp, Artificial Sequence
  Synthetic Polynucleotide
taatacgactcactatagggctgaggtgtgcgcataaaaaacatctctccaacagaggagaggagagatgttttttatgaacctggcggcagcgcaaaagatg

SEQ ID NO: 212227 - DNA, 103 bp, Artificial Sequence
  Synthetic Polynucleotide
taatacgactcactatagggctgtgaggtcctgaggtgtgcgcataaaaaaacagaggagatttttaatggcacacctcaacctggcggcagcgcaaaagatg

SEQ ID NO: 212228 - DNA, 103 bp, Artificial Sequence
  Synthetic Polynucleotide
taatacgactcactatagggccatctttgcctgtgaggtcctgaggtgtgaacagaggagacacaccatgggacctcacaacctggcggcagcgcaaaagatg

SEQ ID NO: 212229 - DNA, 103 bp, Artificial Sequence
  Synthetic Polynucleotide
taatacgactcactatagggaataagatcaccatctttgcctgtgaggtcaacagaggagagacctcatgggcaaagataacctggcggcagcgcaaaagatg

SEQ ID NO: 212230 - DNA, 103 bp, Artificial Sequence
  Synthetic Polynucleotide
taatacgactcactatagggattctgcaagaataagatcaccatctttgcaacagaggagagcaaagatggtgatcttaaacctggcggcagcgcaaaagatg

SEQ ID NO: 212231 - DNA, 103 bp, Artificial Sequence
  Synthetic Polynucleotide
taatacgactcactatagggaggctgcccagccccaaagcccccaagcctaacagaggagaaggcttatgggctttgggaacctggcggcagcgcaaaagatg

SEQ ID NO: 212232 - DNA, 103 bp, Artificial Sequence
  Synthetic Polynucleotide
taatacgactcactatagggtcctcactatattctgcaagaataagatcaaacagaggagatgatctatgtcttgcagaaacctggcggcagcgcaaaagatg

SEQ ID NO: 212233 - DNA, 103 bp, Artificial Sequence
  Synthetic Polynucleotide
taatacgactcactataggggggtccattttcctcactatattctgcaagaacagaggagacttgcaatgtatagtgagaacctggcggcagcgcaaaagatg

SEQ ID NO: 212234 - DNA, 103 bp, Artificial Sequence
  Synthetic Polynucleotide
taatacgactcactataggggcatcattaagggtccattttcctcactataacagaggagaatagtgatgaaaatggacaacctggcggcagcgcaaaagatg

SEQ ID NO: 212235 - DNA, 103 bp, Artificial Sequence
  Synthetic Polynucleotide
taatacgactcactatagggatgccaacctgcatcattaagggtccatttaacagaggagaaaatggatgcttaatgataacctggcggcagcgcaaaagatg

SEQ ID NO: 212236 - DNA, 103 bp, Artificial Sequence
  Synthetic Polynucleotide
taatacgactcactatagggcttggttgccatgccaacctgcatcattaaaacagaggagattaatgatgcaggttggcaacctggcggcagcgcaaaagatg

SEQ ID NO: 212237 - DNA, 103 bp, Artificial Sequence
  Synthetic Polynucleotide
taatacgactcactatagggagttctttatcttggttgccatgccaacctaacagaggagaaggttgatgtggcaaccaaacctggcggcagcgcaaaagatg

SEQ ID NO: 212238 - DNA, 103 bp, Artificial Sequence
  Synthetic Polynucleotide
taatacgactcactatagggcgtttataatagttctttatcttggttgccaacagaggagaggcaacatggataaagaaaacctggcggcagcgcaaaagatg

SEQ ID NO: 212239 - DNA, 103 bp, Artificial Sequence
  Synthetic Polynucleotide
taatacgactcactatagggtccaggtttccgtttataatagttctttataacagaggagaataaagatgtattataaaaacctggcggcagcgcaaaagatg

SEQ ID NO: 212240 - DNA, 103 bp, Artificial Sequence
  Synthetic Polynucleotide
taatacgactcactatagggcaggatcttttccaggtttccgtttataataacagaggagaattataatgggaaacctgaacctggcggcagcgcaaaagatg

SEQ ID NO: 212241 - DNA, 103 bp, Artificial Sequence
  Synthetic Polynucleotide
taatacgactcactatagggtctggtgctccaggatcttttccaggtttcaacagaggagagaaaccatgaaaagatccaacctggcggcagcgcaaaagatg

SEQ ID NO: 212242 - DNA, 103 bp, Artificial Sequence
  Synthetic Polynucleotide
taatacgactcactatagggttcagtgatcaggctgcccagccccaaagcaacagaggagagctttgatgctgggcagcaacctggcggcagcgcaaaagatg

SEQ ID NO: 212243 - DNA, 103 bp, Artificial Sequence
  Synthetic Polynucleotide
taatacgactcactatagggatatttacaatctggtgctccaggatctttaacagaggagaaaagatatgggagcaccaaacctggcggcagcgcaaaagatg

SEQ ID NO: 212244 - DNA, 103 bp, Artificial Sequence
  Synthetic Polynucleotide
taatacgactcactatagggcagtttccccatatttacaatctggtgctcaacagaggagagagcacatgattgtaaataacctggcggcagcgcaaaagatg

SEQ ID NO: 212245 - DNA, 103 bp, Artificial Sequence
  Synthetic Polynucleotide
taatacgactcactatagggtggcagtaaacagtttccccatatttacaaaacagaggagattgtaaatgtggggaaacaacctggcggcagcgcaaaagatg

SEQ ID NO: 212246 - DNA, 103 bp, Artificial Sequence
  Synthetic Polynucleotide
taatacgactcactatagggaggagatgtatggcagtaaacagtttccccaacagaggagaggggaaatggtttactgcaacctggcggcagcgcaaaagatg

SEQ ID NO: 212247 - DNA, 103 bp, Artificial Sequence
  Synthetic Polynucleotide
taatacgactcactatagggaacccaggaaaggagatgtatggcagtaaaaacagaggagatttactatgatacatctcaacctggcggcagcgcaaaagatg

SEQ ID NO: 212248 - DNA, 103 bp, Artificial Sequence
  Synthetic Polynucleotide
taatacgactcactatagggggatggagagaacccaggaaaggagatgtaaacagaggagatacatcatgtttcctgggaacctggcggcagcgcaaaagatg

SEQ ID NO: 212249 - DNA, 103 bp, Artificial Sequence
  Synthetic Polynucleotide
taatacgactcactatagggcaattggccaggatggagagaacccaggaaaacagaggagattcctgatgtctctccataacctggcggcagcgcaaaagatg

SEQ ID NO: 212250 - DNA, 103 bp, Artificial Sequence
  Synthetic Polynucleotide
taatacgactcactatagggatgcttgcagcaattggccaggatggagagaacagaggagactctccatgctggccaataacctggcggcagcgcaaaagatg

SEQ ID NO: 212251 - DNA, 103 bp, Artificial Sequence
  Synthetic Polynucleotide
taatacgactcactatagggttgttctcaaatgcttgcagcaattggccaaacagaggagatggccaatggctgcaagcaacctggcggcagcgcaaaagatg

SEQ ID NO: 212252 - DNA, 103 bp, Artificial Sequence
  Synthetic Polynucleotide
taatacgactcactatagggacgaaaaaggttgttctcaaatgcttgcagaacagaggagactgcaaatgtttgagaacaacctggcggcagcgcaaaagatg

SEQ ID NO: 212253 - DNA, 103 bp, Artificial Sequence
  Synthetic Polynucleotide
taatacgactcactatagggttgccgtgagttcagtgatcaggctgcccaaacagaggagatgggcaatgtgatcactgaacctggcggcagcgcaaaagatg

SEQ ID NO: 212254 - DNA, 103 bp, Artificial Sequence
  Synthetic Polynucleotide
taatacgactcactatagggaaattggagcacgaaaaaggttgttctcaaaacagaggagattgagaatgacctttttcaacctggcggcagcgcaaaagatg

SEQ ID NO: 212255 - DNA, 103 bp, Artificial Sequence
  Synthetic Polynucleotide
taatacgactcactatagggttatgaagataaattggagcacgaaaaaggaacagaggagaccttttatgtgctccaataacctggcggcagcgcaaaagatg

SEQ ID NO: 212256 - DNA, 103 bp, Artificial Sequence
  Synthetic Polynucleotide
taatacgactcactatagggttctggcatcttatgaagataaattggagcaacagaggagagctccaatgtatcttcataacctggcggcagcgcaaaagatg

SEQ ID NO: 212257 - DNA, 103 bp, Artificial Sequence
  Synthetic Polynucleotide
taatacgactcactatagggagaaatcagtttctggcatcttatgaagataacagaggagaatcttcatgagatgccagaacctggcggcagcgcaaaagatg

SEQ ID NO: 212258 - DNA, 103 bp, Artificial Sequence
  Synthetic Polynucleotide
taatacgactcactatagggcgaatgatcaagaaatcagtttctggcatcaacagaggagagatgccatgaactgatttaacctggcggcagcgcaaaagatg

SEQ ID NO: 212259 - DNA, 103 bp, Artificial Sequence
  Synthetic Polynucleotide
taatacgactcactatagggctgtcttgtccgaatgatcaagaaatcagtaacagaggagaactgatatgttgatcattaacctggcggcagcgcaaaagatg

SEQ ID NO: 212260 - DNA, 103 bp, Artificial Sequence
  Synthetic Polynucleotide
taatacgactcactatagggtatagtaaccctgtcttgtccgaatgatcaaacagaggagatgatcaatgggacaagacaacctggcggcagcgcaaaagatg

SEQ ID NO: 212261 - DNA, 103 bp, Artificial Sequence
  Synthetic Polynucleotide
taatacgactcactatagggaattcccgaatatagtaaccctgtcttgtcaacagaggagagacaagatggggttactaaacctggcggcagcgcaaaagatg

SEQ ID NO: 212262 - DNA, 103 bp, Artificial Sequence
  Synthetic Polynucleotide
taatacgactcactatagggaatatccactaattcccgaatatagtaaccaacagaggagaggttacatgattcgggaaaacctggcggcagcgcaaaagatg

SEQ ID NO: 212263 - DNA, 103 bp, Artificial Sequence
  Synthetic Polynucleotide
taatacgactcactatagggcaaccacaaaaatatccactaattcccgaaaacagaggagattcgggatgtagtggataaacctggcggcagcgcaaaagatg

SEQ ID NO: 212264 - DNA, 103 bp, Artificial Sequence
  Synthetic Polynucleotide
taatacgactcactatagggaattcttcatttgccgtgagttcagtgatcaacagaggagagatcacatgactcacggcaacctggcggcagcgcaaaagatg

SEQ ID NO: 212265 - DNA, 103 bp, Artificial Sequence
  Synthetic Polynucleotide
taatacgactcactatagggcactgctggccaaccacaaaaatatccactaacagaggagaagtggaatgttttgtggtaacctggcggcagcgcaaaagatg

SEQ ID NO: 212266 - DNA, 103 bp, Artificial Sequence
  Synthetic Polynucleotide
taatacgactcactatagggaaacaagggacactgctggccaaccacaaaaacagaggagatttgtgatgggccagcagaacctggcggcagcgcaaaagatg

SEQ ID NO: 212267 - DNA, 103 bp, Artificial Sequence
  Synthetic Polynucleotide
taatacgactcactatagggcaggaacttcaaacaagggacactgctggcaacagaggagagccagcatggtcccttgtaacctggcggcagcgcaaaagatg

SEQ ID NO: 212268 - DNA, 103 bp, Artificial Sequence
  Synthetic Polynucleotide
taatacgactcactataggggagttaggcccaggaacttcaaacaagggaaacagaggagatcccttatgtgaagttccaacctggcggcagcgcaaaagatg

SEQ ID NO: 212269 - DNA, 103 bp, Artificial Sequence
  Synthetic Polynucleotide
taatacgactcactatagggggcccttttggagttaggcccaggaacttcaacagaggagagaagttatggggcctaacaacctggcggcagcgcaaaagatg

SEQ ID NO: 212270 - DNA, 103 bp, Artificial Sequence
  Synthetic Polynucleotide
taatacgactcactatagggtatgcgtattggcccttttggagttaggccaacagaggagaggcctaatgccaaaagggaacctggcggcagcgcaaaagatg

SEQ ID NO: 212271 - DNA, 103 bp, Artificial Sequence
  Synthetic Polynucleotide
taatacgactcactatagggaagtctcgaatatgcgtattggcccttttgaacagaggagacaaaagatgcaatacgcaaacctggcggcagcgcaaaagatg

SEQ ID NO: 212272 - DNA, 103 bp, Artificial Sequence
  Synthetic Polynucleotide
taatacgactcactatagggaacctgtagaaagtctcgaatatgcgtattaacagaggagaaatacgatgattcgagacaacctggcggcagcgcaaaagatg

SEQ ID NO: 212273 - DNA, 103 bp, Artificial Sequence
  Synthetic Polynucleotide
taatacgactcactatagggggtaaataaaaacctgtagaaagtctcgaaaacagaggagattcgagatgttctacaggaacctggcggcagcgcaaaagatg

SEQ ID NO: 212274 - DNA, 103 bp, Artificial Sequence
  Synthetic Polynucleotide
taatacgactcactatagggcagaaaaggcggtaaataaaaacctgtagaaacagaggagatctacaatgttttatttaaacctggcggcagcgcaaaagatg

SEQ ID NO: 212275 - DNA, 103 bp, Artificial Sequence
  Synthetic Polynucleotide
taatacgactcactatagggagtcccggtcaattcttcatttgccgtgagaacagaggagactcacgatgaatgaagaaaacctggcggcagcgcaaaagatg

SEQ ID NO: 212276 - DNA, 103 bp, Artificial Sequence
  Synthetic Polynucleotide
taatacgactcactatagggtttacttttccagaaaaggcggtaaataaaaacagaggagatttattatgcgccttttcaacctggcggcagcgcaaaagatg

SEQ ID NO: 212277 - DNA, 103 bp, Artificial Sequence
  Synthetic Polynucleotide
taatacgactcactataggggtggccgatctttacttttccagaaaaggcaacagaggagagcctttatgggaaaagtaaacctggcggcagcgcaaaagatg

SEQ ID NO: 212278 - DNA, 103 bp, Artificial Sequence
  Synthetic Polynucleotide
taatacgactcactatagggcgtatcctccgtggccgatctttacttttcaacagaggagagaaaagatgagatcggccaacctggcggcagcgcaaaagatg

SEQ ID NO: 212279 - DNA, 103 bp, Artificial Sequence
  Synthetic Polynucleotide
taatacgactcactatagggatcttccattcgtatcctccgtggccgatcaacagaggagagatcggatgcggaggataaacctggcggcagcgcaaaagatg

SEQ ID NO: 212280 - DNA, 103 bp, Artificial Sequence
  Synthetic Polynucleotide
taatacgactcactatagggctttttttatatcttccattcgtatcctccaacagaggagaggaggaatggaatggaagaacctggcggcagcgcaaaagatg

SEQ ID NO: 212281 - DNA, 103 bp, Artificial Sequence
  Synthetic Polynucleotide
taatacgactcactataggggaaggaaaggctttttttatatcttccattaacagaggagaaatggaatgtataaaaaaaacctggcggcagcgcaaaagatg

SEQ ID NO: 212282 - DNA, 103 bp, Artificial Sequence
  Synthetic Polynucleotide
taatacgactcactatagggttctgaatgggaaggaaaggctttttttataacagaggagaataaaaatggcctttcctaacctggcggcagcgcaaaagatg

SEQ ID NO: 212283 - DNA, 103 bp, Artificial Sequence
  Synthetic Polynucleotide
taatacgactcactatagggggatgctgctttctgaatgggaaggaaaggaacagaggagacctttcatgcccattcagaacctggcggcagcgcaaaagatg

SEQ ID NO: 212284 - DNA, 103 bp, Artificial Sequence
  Synthetic Polynucleotide
taatacgactcactatagggagcctcttccggatgctgctttctgaatggaacagaggagaccattcatgaagcagcataacctggcggcagcgcaaaagatg

SEQ ID NO: 212285 - DNA, 103 bp, Artificial Sequence
  Synthetic Polynucleotide
taatacgactcactataggggcagagctttagcctcttccggatgctgctaacagaggagaagcagcatgcggaagaggaacctggcggcagcgcaaaagatg

SEQ ID NO: 212286 - DNA, 103 bp, Artificial Sequence
  Synthetic Polynucleotide
taatacgactcactatagggaggcaccgtcagtcccggtcaattcttcataacagaggagaatgaagatgtgaccgggaaacctggcggcagcgcaaaagatg

SEQ ID NO: 212287 - DNA, 103 bp, Artificial Sequence
  Synthetic Polynucleotide
taatacgactcactatagggtgaagtcagcgcagagctttagcctcttccaacagaggagaggaagaatgtaaagctctaacctggcggcagcgcaaaagatg

SEQ ID NO: 212288 - DNA, 103 bp, Artificial Sequence
  Synthetic Polynucleotide
taatacgactcactatagggcctgtgcgtttgaagtcagcgcagagctttaacagaggagaaaagctatgcgctgacttaacctggcggcagcgcaaaagatg

SEQ ID NO: 212289 - DNA, 103 bp, Artificial Sequence
  Synthetic Polynucleotide
taatacgactcactatagggtgagtccatccctgtgcgtttgaagtcagcaacagaggagagctgacatgaaacgcacaaacctggcggcagcgcaaaagatg

SEQ ID NO: 212290 - DNA, 103 bp, Artificial Sequence
  Synthetic Polynucleotide
taatacgactcactatagggcccaccagtttgagtccatccctgtgcgttaacagaggagaaacgcaatgggatggactaacctggcggcagcgcaaaagatg

SEQ ID NO: 212291 - DNA, 103 bp, Artificial Sequence
  Synthetic Polynucleotide
taatacgactcactataggggacttaagcacccaccagtttgagtccatcaacagaggagagatggaatgaaactggtgaacctggcggcagcgcaaaagatg

SEQ ID NO: 212292 - DNA, 103 bp, Artificial Sequence
  Synthetic Polynucleotide
taatacgactcactatagggacgaaaatcagacttaagcacccaccagttaacagaggagaaactggatggtgcttaagaacctggcggcagcgcaaaagatg

SEQ ID NO: 212293 - DNA, 103 bp, Artificial Sequence
  Synthetic Polynucleotide
taatacgactcactatagggccgttggtaaacgaaaatcagacttaagcaaacagaggagatgcttaatgctgattttcaacctggcggcagcgcaaaagatg

SEQ ID NO: 212294 - DNA, 103 bp, Artificial Sequence
  Synthetic Polynucleotide
taatacgactcactatagggatctcttcttccgttggtaaacgaaaatcaaacagaggagatgatttatgtttaccaacaacctggcggcagcgcaaaagatg

SEQ ID NO: 212295 - DNA, 103 bp, Artificial Sequence
  Synthetic Polynucleotide
taatacgactcactatagggcatagctctgatctcttcttccgttggtaaaacagaggagattaccaatggaagaagagaacctggcggcagcgcaaaagatg

SEQ ID NO: 212296 - DNA, 103 bp, Artificial Sequence
  Synthetic Polynucleotide
taatacgactcactatagggctggtgacaccatagctctgatctcttcttaacagaggagaaagaagatgtcagagctaaacctggcggcagcgcaaaagatg

SEQ ID NO: 212297 - DNA, 103 bp, Artificial Sequence
  Synthetic Polynucleotide
taatacgactcactatagggtcatttaccaaggcaccgtcagtcccggtcaacagaggagagaccggatgtgacggtgcaacctggcggcagcgcaaaagatg

SEQ ID NO: 212298 - DNA, 103 bp, Artificial Sequence
  Synthetic Polynucleotide
taatacgactcactatagggcagcactgctctggtgacaccatagctctgaacagaggagacagagcatgggtgtcaccaacctggcggcagcgcaaaagatg

SEQ ID NO: 212299 - DNA, 103 bp, Artificial Sequence
  Synthetic Polynucleotide
taatacgactcactatagggataataagcacagcactgctctggtgacacaacagaggagagtgtcaatggagcagtgcaacctggcggcagcgcaaaagatg

SEQ ID NO: 212300 - DNA, 103 bp, Artificial Sequence
  Synthetic Polynucleotide
taatacgactcactatagggctatcatgctataataagcacagcactgctaacagaggagaagcagtatggtgcttattaacctggcggcagcgcaaaagatg

SEQ ID NO: 212301 - DNA, 103 bp, Artificial Sequence
  Synthetic Polynucleotide
taatacgactcactatagggtgctctgcagctatcatgctataataagcaaacagaggagatgcttaatgtagcatgataacctggcggcagcgcaaaagatg

SEQ ID NO: 212302 - DNA, 103 bp, Artificial Sequence
  Synthetic Polynucleotide
taatacgactcactatagggcttcagtcgttgctctgcagctatcatgctaacagaggagaagcatgatggctgcagagaacctggcggcagcgcaaaagatg

SEQ ID NO: 212303 - DNA, 103 bp, Artificial Sequence
  Synthetic Polynucleotide
taatacgactcactatagggagccagcatccttcagtcgttgctctgcagaacagaggagactgcagatgaacgactgaaacctggcggcagcgcaaaagatg

SEQ ID NO: 212304 - DNA, 103 bp, Artificial Sequence
  Synthetic Polynucleotide
taatacgactcactatagggttctcaccatagccagcatccttcagtcgtaacagaggagaacgactatgggatgctggaacctggcggcagcgcaaaagatg

SEQ ID NO: 212305 - DNA, 103 bp, Artificial Sequence
  Synthetic Polynucleotide
taatacgactcactatagggaaaaaaggatttctcaccatagccagcatcaacagaggagagatgctatgtatggtgagaacctggcggcagcgcaaaagatg

SEQ ID NO: 212306 - DNA, 103 bp, Artificial Sequence
  Synthetic Polynucleotide
taatacgactcactatagggcttctggagcaaaaaaggatttctcaccataacagaggagaatggtgatgaatccttttaacctggcggcagcgcaaaagatg

SEQ ID NO: 212307 - DNA, 103 bp, Artificial Sequence
  Synthetic Polynucleotide
taatacgactcactatagggtcattttcttcttctggagcaaaaaaggataacagaggagaatccttatgtgctccagaaacctggcggcagcgcaaaagatg

SEQ ID NO: 212308 - DNA, 103 bp, Artificial Sequence
  Synthetic Polynucleotide
taatacgactcactatagggccacccttcatcatttaccaaggcaccgtcaacagaggagagacggtatgttggtaaataacctggcggcagcgcaaaagatg

SEQ ID NO: 212309 - DNA, 103 bp, Artificial Sequence
  Synthetic Polynucleotide
taatacgactcactataggggaaatcttcctcattttcttcttctggagcaacagaggagagctccaatggaagaaaataacctggcggcagcgcaaaagatg

SEQ ID NO: 212310 - DNA, 103 bp, Artificial Sequence
  Synthetic Polynucleotide
taatacgactcactatagggtcttcatctggaaatcttcctcattttcttaacagaggagaaagaaaatgaggaagattaacctggcggcagcgcaaaagatg

SEQ ID NO: 212311 - DNA, 103 bp, Artificial Sequence
  Synthetic Polynucleotide
taatacgactcactatagggtcatcatcaatcttcatctggaaatcttccaacagaggagaggaagaatgccagatgaaaacctggcggcagcgcaaaagatg

SEQ ID NO: 212312 - DNA, 103 bp, Artificial Sequence
  Synthetic Polynucleotide
taatacgactcactatagggagtgcgaacttcatcatcaatcttcatctgaacagaggagacagatgatgattgatgataacctggcggcagcgcaaaagatg

SEQ ID NO: 212313 - DNA, 103 bp, Artificial Sequence
  Synthetic Polynucleotide
taatacgactcactatagggtccaaggggcagtgcgaacttcatcatcaaaacagaggagattgatgatgaagttcgcaaacctggcggcagcgcaaaagatg

SEQ ID NO: 212314 - DNA, 103 bp, Artificial Sequence
  Synthetic Polynucleotide
taatacgactcactatagggcttgtggtgttccaaggggcagtgcgaactaacagaggagaagttcgatgtgccccttgaacctggcggcagcgcaaaagatg

SEQ ID NO: 212315 - DNA, 103 bp, Artificial Sequence
  Synthetic Polynucleotide
taatacgactcactatagggaatgaaggcccttgtggtgttccaaggggcaacagaggagagcccctatgaacaccacaaacctggcggcagcgcaaaagatg

SEQ ID NO: 212316 - DNA, 103 bp, Artificial Sequence
  Synthetic Polynucleotide
taatacgactcactatagggtcatggcagcaatgaaggcccttgtggtgtaacagaggagaacaccaatggggccttcaaacctggcggcagcgcaaaagatg

SEQ ID NO: 212317 - DNA, 103 bp, Artificial Sequence
  Synthetic Polynucleotide
taatacgactcactatagggcacttgcccttcatggcagcaatgaaggccaacagaggagaggccttatgtgctgccataacctggcggcagcgcaaaagatg

SEQ ID NO: 212318 - DNA, 103 bp, Artificial Sequence
  Synthetic Polynucleotide
taatacgactcactatagggctctagcagacacttgcccttcatggcagcaacagaggagagctgccatgaagggcaagaacctggcggcagcgcaaaagatg

SEQ ID NO: 212319 - DNA, 103 bp, Artificial Sequence
  Synthetic Polynucleotide
taatacgactcactatagggtactcctaacccacccttcatcatttaccaaacagaggagatggtaaatgatgaagggtaacctggcggcagcgcaaaagatg

SEQ ID NO: 212320 - DNA, 103 bp, Artificial Sequence
  Synthetic Polynucleotide
taatacgactcactatagggccccagtcacctctagcagacacttgccctaacagaggagaagggcaatggtctgctagaacctggcggcagcgcaaaagatg

SEQ ID NO: 212321 - DNA, 103 bp, Artificial Sequence
  Synthetic Polynucleotide
taatacgactcactatagggggatctgccaccccagtcacctctagcagaaacagaggagatctgctatgggtgactggaacctggcggcagcgcaaaagatg

SEQ ID NO: 212322 - DNA, 103 bp, Artificial Sequence
  Synthetic Polynucleotide
taatacgactcactatagggacaccccgtgggatctgccaccccagtcacaacagaggagagtgactatggtggcagataacctggcggcagcgcaaaagatg

SEQ ID NO: 212323 - DNA, 103 bp, Artificial Sequence
  Synthetic Polynucleotide
taatacgactcactatagggatccttcaccacaccccgtgggatctgccaaacagaggagatggcagatgccacggggtaacctggcggcagcgcaaaagatg

SEQ ID NO: 212324 - DNA, 103 bp, Artificial Sequence
  Synthetic Polynucleotide
taatacgactcactatagggacataggagaatccttcaccacaccccgtgaacagaggagacacgggatgtggtgaaggaacctggcggcagcgcaaaagatg

SEQ ID NO: 212325 - DNA, 103 bp, Artificial Sequence
  Synthetic Polynucleotide
taatacgactcactatagggtggaatcttcacataggagaatccttcaccaacagaggagaggtgaaatgttctcctataacctggcggcagcgcaaaagatg

SEQ ID NO: 212326 - DNA, 103 bp, Artificial Sequence
  Synthetic Polynucleotide
taatacgactcactatagggttggtttgtttggaatcttcacataggagaaacagaggagatctcctatgtgaagattcaacctggcggcagcgcaaaagatg

SEQ ID NO: 212327 - DNA, 103 bp, Artificial Sequence
  Synthetic Polynucleotide
taatacgactcactatagggttctgctgtgttggtttgtttggaatcttcaacagaggagagaagatatgaaacaaaccaacctggcggcagcgcaaaagatg

SEQ ID NO: 212328 - DNA, 103 bp, Artificial Sequence
  Synthetic Polynucleotide
taatacgactcactatagggtttatcatccttctgctgtgttggtttgttaacagaggagaaacaaaatgacacagcagaacctggcggcagcgcaaaagatg

SEQ ID NO: 212329 - DNA, 103 bp, Artificial Sequence
  Synthetic Polynucleotide
taatacgactcactataggggctgcggttctttatcatccttctgctgtgaacagaggagacacagcatgaggatgataaacctggcggcagcgcaaaagatg

SEQ ID NO: 212330 - DNA, 103 bp, Artificial Sequence
  Synthetic Polynucleotide
taatacgactcactataggggcagtgatggtagctgctgtccgcagcagcaacagaggagagctgctatggacagcagcaacctggcggcagcgcaaaagatg

SEQ ID NO: 212331 - DNA, 103 bp, Artificial Sequence
  Synthetic Polynucleotide
taatacgactcactataggggcatcttctgtactcctaacccacccttcaaacagaggagatgaaggatgggttaggagaacctggcggcagcgcaaaagatg

SEQ ID NO: 212332 - DNA, 103 bp, Artificial Sequence
  Synthetic Polynucleotide
taatacgactcactatagggttcttcactggctgcggttctttatcatccaacagaggagaggatgaatgagaaccgcaaacctggcggcagcgcaaaagatg

SEQ ID NO: 212333 - DNA, 103 bp, Artificial Sequence
  Synthetic Polynucleotide
taatacgactcactatagggtgtcactgtcttcttcactggctgcggttcaacagaggagagaaccgatgccagtgaagaacctggcggcagcgcaaaagatg

SEQ ID NO: 212334 - DNA, 103 bp, Artificial Sequence
  Synthetic Polynucleotide
taatacgactcactatagggcatctgttcctgtcactgtcttcttcactgaacagaggagacagtgaatgagacagtgaaacctggcggcagcgcaaaagatg

SEQ ID NO: 212335 - DNA, 103 bp, Artificial Sequence
  Synthetic Polynucleotide
taatacgactcactatagggcgaaggtctgcatctgttcctgtcactgtcaacagaggagagacagtatgaggaacagaaacctggcggcagcgcaaaagatg

SEQ ID NO: 212336 - DNA, 103 bp, Artificial Sequence
  Synthetic Polynucleotide
taatacgactcactatagggggaaaggcgacgaaggtctgcatctgttccaacagaggagaggaacaatggcagaccttaacctggcggcagcgcaaaagatg

SEQ ID NO: 212337 - DNA, 103 bp, Artificial Sequence
  Synthetic Polynucleotide
taatacgactcactatagggcatttttcagggaaaggcgacgaaggtctgaacagaggagacagaccatggtcgcctttaacctggcggcagcgcaaaagatg

SEQ ID NO: 212338 - DNA, 103 bp, Artificial Sequence
  Synthetic Polynucleotide
taatacgactcactatagggagttgcttggcatttttcagggaaaggcgaaacagaggagatcgcctatgcctgaaaaaaacctggcggcagcgcaaaagatg

SEQ ID NO: 212339 - DNA, 103 bp, Artificial Sequence
  Synthetic Polynucleotide
taatacgactcactatagggtttacgtagaagttgcttggcatttttcagaacagaggagactgaaaatggccaagcaaaacctggcggcagcgcaaaagatg

SEQ ID NO: 212340 - DNA, 103 bp, Artificial Sequence
  Synthetic Polynucleotide
taatacgactcactataggggcacaccaaatttacgtagaagttgcttggaacagaggagaccaagcatgttctacgtaaacctggcggcagcgcaaaagatg

SEQ ID NO: 212341 - DNA, 103 bp, Artificial Sequence
  Synthetic Polynucleotide
taatacgactcactatagggtcttcctcaggcacaccaaatttacgtagaaacagaggagatctacgatgatttggtgtaacctggcggcagcgcaaaagatg

SEQ ID NO: 212342 - DNA, 103 bp, Artificial Sequence
  Synthetic Polynucleotide
taatacgactcactatagggatagtccacagcatcttctgtactcctaacaacagaggagagttaggatgacagaagataacctggcggcagcgcaaaagatg

SEQ ID NO: 212343 - DNA, 103 bp, Artificial Sequence
  Synthetic Polynucleotide
taatacgactcactatagggctttttaatctcttcctcaggcacaccaaaaacagaggagatttggtatgcctgaggaaaacctggcggcagcgcaaaagatg

SEQ ID NO: 212344 - DNA, 103 bp, Artificial Sequence
  Synthetic Polynucleotide
taatacgactcactatagggagcgggacaactttttaatctcttcctcagaacagaggagactgaggatgagattaaaaaacctggcggcagcgcaaaagatg

SEQ ID NO: 212345 - DNA, 103 bp, Artificial Sequence
  Synthetic Polynucleotide
taatacgactcactatagggatcacttcccagcgggacaactttttaatcaacagaggagagattaaatggttgtcccgaacctggcggcagcgcaaaagatg

SEQ ID NO: 212346 - DNA, 103 bp, Artificial Sequence
  Synthetic Polynucleotide
taatacgactcactatagggcaccacatcaatcacttcccagcgggacaaaacagaggagattgtccatgtgggaagtgaacctggcggcagcgcaaaagatg

SEQ ID NO: 212347 - DNA, 103 bp, Artificial Sequence
  Synthetic Polynucleotide
taatacgactcactatagggacattgtgcgcaccacatcaatcacttcccaacagaggagagggaagatgttgatgtggaacctggcggcagcgcaaaagatg

SEQ ID NO: 212348 - DNA, 103 bp, Artificial Sequence
  Synthetic Polynucleotide
taatacgactcactatagggtgttctgttgacattgtgcgcaccacatcaaacagaggagatgatgtatggcgcacaataacctggcggcagcgcaaaagatg

SEQ ID NO: 212349 - DNA, 103 bp, Artificial Sequence
  Synthetic Polynucleotide
taatacgactcactatagggagaacgagcctgttctgttgacattgtgcgaacagaggagacgcacaatgtcaacagaaaacctggcggcagcgcaaaagatg

SEQ ID NO: 212350 - DNA, 103 bp, Artificial Sequence
  Synthetic Polynucleotide
taatacgactcactataggggcccctctccagaacgagcctgttctgttgaacagaggagacaacagatgaggctcgttaacctggcggcagcgcaaaagatg

SEQ ID NO: 212351 - DNA, 103 bp, Artificial Sequence
  Synthetic Polynucleotide
taatacgactcactatagggttactcatgggcccctctccagaacgagccaacagaggagaggctcgatgtggagagggaacctggcggcagcgcaaaagatg

SEQ ID NO: 212352 - DNA, 103 bp, Artificial Sequence
  Synthetic Polynucleotide
taatacgactcactatagggacgggcaaatttactcatgggcccctctccaacagaggagaggagagatgcccatgagtaacctggcggcagcgcaaaagatg

SEQ ID NO: 212353 - DNA, 103 bp, Artificial Sequence
  Synthetic Polynucleotide
taatacgactcactatagggtgatgtctgaatagtccacagcatcttctgaacagaggagacagaagatgctgtggactaacctggcggcagcgcaaaagatg

SEQ ID NO: 212354 - DNA, 103 bp, Artificial Sequence
  Synthetic Polynucleotide
taatacgactcactatagggaccttgatccacgggcaaatttactcatggaacagaggagaccatgaatgaatttgcccaacctggcggcagcgcaaaagatg

SEQ ID NO: 212355 - DNA, 103 bp, Artificial Sequence
  Synthetic Polynucleotide
taatacgactcactataggggccacagaaaaccttgatccacgggcaaataacagaggagaatttgcatgtggatcaagaacctggcggcagcgcaaaagatg

SEQ ID NO: 212356 - DNA, 103 bp, Artificial Sequence
  Synthetic Polynucleotide
taatacgactcactatagggttgatgctcagccacagaaaaccttgatccaacagaggagaggatcaatgttttctgtgaacctggcggcagcgcaaaagatg

SEQ ID NO: 212357 - DNA, 103 bp, Artificial Sequence
  Synthetic Polynucleotide
taatacgactcactatagggtgtaacgctcttgatgctcagccacagaaaaacagaggagatttctgatgctgagcatcaacctggcggcagcgcaaaagatg

SEQ ID NO: 212358 - DNA, 103 bp, Artificial Sequence
  Synthetic Polynucleotide
taatacgactcactatagggcattcctctttgtaacgctcttgatgctcaaacagaggagatgagcaatgagagcgttaaacctggcggcagcgcaaaagatg

SEQ ID NO: 212359 - DNA, 103 bp, Artificial Sequence
  Synthetic Polynucleotide
taatacgactcactataggggatgcgctgacattcctctttgtaacgctcaacagaggagagagcgtatgaaagaggaaaacctggcggcagcgcaaaagatg

SEQ ID NO: 212360 - DNA, 103 bp, Artificial Sequence
  Synthetic Polynucleotide
taatacgactcactataggggtaggtcaaagatgcgctgacattcctcttaacagaggagaaagaggatggtcagcgcaaacctggcggcagcgcaaaagatg

SEQ ID NO: 212361 - DNA, 103 bp, Artificial Sequence
  Synthetic Polynucleotide
taatacgactcactatagggaccttgttctgtaggtcaaagatgcgctgaaacagaggagatcagcgatgctttgacctaacctggcggcagcgcaaaagatg

SEQ ID NO: 212362 - DNA, 103 bp, Artificial Sequence
  Synthetic Polynucleotide
taatacgactcactatagggtgatgacagaaccttgttctgtaggtcaaaaacagaggagatttgacatgcagaacaagaacctggcggcagcgcaaaagatg

SEQ ID NO: 212363 - DNA, 103 bp, Artificial Sequence
  Synthetic Polynucleotide
taatacgactcactatagggagacttcagttgatgacagaaccttgttctaacagaggagaagaacaatgttctgtcataacctggcggcagcgcaaaagatg

SEQ ID NO: 212364 - DNA, 103 bp, Artificial Sequence
  Synthetic Polynucleotide
taatacgactcactataggggccacctcattgatgtctgaatagtccacaaacagaggagatgtggaatgttcagacataacctggcggcagcgcaaaagatg

SEQ ID NO: 212365 - DNA, 103 bp, Artificial Sequence
  Synthetic Polynucleotide
taatacgactcactatagggtcagttgataagacttcagttgatgacagaaacagaggagatctgtcatgaactgaagtaacctggcggcagcgcaaaagatg

SEQ ID NO: 212366 - DNA, 103 bp, Artificial Sequence
  Synthetic Polynucleotide
taatacgactcactataggggctgtctgtgtcagttgataagacttcagtaacagaggagaactgaaatgttatcaactaacctggcggcagcgcaaaagatg

SEQ ID NO: 212367 - DNA, 103 bp, Artificial Sequence
  Synthetic Polynucleotide
taatacgactcactatagggcagctgagctgctgtctgtgtcagttgataaacagaggagatatcaaatgacacagacaaacctggcggcagcgcaaaagatg

SEQ ID NO: 212368 - DNA, 103 bp, Artificial Sequence
  Synthetic Polynucleotide
taatacgactcactatagggtcactatcttcagctgagctgctgtctgtgaacagaggagacacagaatgcagctcagcaacctggcggcagcgcaaaagatg

SEQ ID NO: 212369 - DNA, 103 bp, Artificial Sequence
  Synthetic Polynucleotide
taatacgactcactatagggttcttcaaagtcactatcttcagctgagctaacagaggagaagctcaatggaagatagtaacctggcggcagcgcaaaagatg

SEQ ID NO: 212370 - DNA, 103 bp, Artificial Sequence
  Synthetic Polynucleotide
taatacgactcactatagggtctttcccatttcttcaaagtcactatcttaacagaggagaaagataatgactttgaagaacctggcggcagcgcaaaagatg

SEQ ID NO: 212371 - DNA, 103 bp, Artificial Sequence
  Synthetic Polynucleotide
taatacgactcactatagggttctcaatgttctttcccatttcttcaaagaacagaggagactttgaatgaatgggaaaaacctggcggcagcgcaaaagatg

SEQ ID NO: 212372 - DNA, 103 bp, Artificial Sequence
  Synthetic Polynucleotide
taatacgactcactatagggctgcaacatgttctcaatgttctttcccataacagaggagaatgggaatgaacattgagaacctggcggcagcgcaaaagatg

SEQ ID NO: 212373 - DNA, 103 bp, Artificial Sequence
  Synthetic Polynucleotide
taatacgactcactatagggttttcttgttctgcaacatgttctcaatgtaacagaggagaacattgatgacatgttgcaacctggcggcagcgcaaaagatg

SEQ ID NO: 212374 - DNA, 103 bp, Artificial Sequence
  Synthetic Polynucleotide
taatacgactcactatagggtgagagctggttttcttgttctgcaacatgaacagaggagacatgttatggaacaagaaaacctggcggcagcgcaaaagatg

SEQ ID NO: 212375 - DNA, 103 bp, Artificial Sequence
  Synthetic Polynucleotide
taatacgactcactatagggttcatcttctgccacctcattgatgtctgaaacagaggagatcagacatgaatgaggtgaacctggcggcagcgcaaaagatg

SEQ ID NO: 212376 - DNA, 103 bp, Artificial Sequence
  Synthetic Polynucleotide
taatacgactcactatagggacgtgaaagctgagagctggttttcttgttaacagaggagaaacaagatgaccagctctaacctggcggcagcgcaaaagatg

SEQ ID NO: 212377 - DNA, 103 bp, Artificial Sequence
  Synthetic Polynucleotide
taatacgactcactatagggcctcccgttcacgtgaaagctgagagctggaacagaggagaccagctatgagctttcacaacctggcggcagcgcaaaagatg

SEQ ID NO: 212378 - DNA, 103 bp, Artificial Sequence
  Synthetic Polynucleotide
taatacgactcactatagggcgctcctgttcctcccgttcacgtgaaagcaacagaggagagctttcatgtgaacgggaaacctggcggcagcgcaaaagatg

SEQ ID NO: 212379 - DNA, 103 bp, Artificial Sequence
  Synthetic Polynucleotide
taatacgactcactatagggtagttccttccgctcctgttcctcccgttcaacagaggagagaacggatggaacaggagaacctggcggcagcgcaaaagatg

SEQ ID NO: 212380 - DNA, 103 bp, Artificial Sequence
  Synthetic Polynucleotide
taatacgactcactataggggcattcgctgtagttccttccgctcctgttaacagaggagaaacaggatgggaaggaacaacctggcggcagcgcaaaagatg

SEQ ID NO: 212381 - DNA, 103 bp, Artificial Sequence
  Synthetic Polynucleotide
taatacgactcactataggggctgccagtagcattcgctgtagttccttcaacagaggagagaaggaatgacagcgaataacctggcggcagcgcaaaagatg

SEQ ID NO: 212382 - DNA, 103 bp, Artificial Sequence
  Synthetic Polynucleotide
taatacgactcactatagggtgctgagcctgctgccagtagcattcgctgaacagaggagacagcgaatgctactggcaaacctggcggcagcgcaaaagatg

SEQ ID NO: 212383 - DNA, 103 bp, Artificial Sequence
  Synthetic Polynucleotide
taatacgactcactatagggttccggatgctgctgagcctgctgccagtaaacagaggagatactggatgcaggctcagaacctggcggcagcgcaaaagatg

SEQ ID NO: 212384 - DNA, 103 bp, Artificial Sequence
  Synthetic Polynucleotide
taatacgactcactatagggctgtgattgtttccggatgctgctgagcctaacagaggagaaggctcatgagcatccggaacctggcggcagcgcaaaagatg

SEQ ID NO: 212385 - DNA, 103 bp, Artificial Sequence
  Synthetic Polynucleotide
taatacgactcactataggggtcatcatctctgtgattgtttccggatgcaacagaggagagcatccatgaacaatcacaacctggcggcagcgcaaaagatg

SEQ ID NO: 212386 - DNA, 103 bp, Artificial Sequence
  Synthetic Polynucleotide
taatacgactcactatagggatcttcggctttcatcttctgccacctcataacagaggagaatgaggatgcagaagatgaacctggcggcagcgcaaaagatg

SEQ ID NO: 212387 - DNA, 103 bp, Artificial Sequence
  Synthetic Polynucleotide
taatacgactcactatagggcggaagctgtgtcatcatctctgtgattgtaacagaggagaacaatcatggagatgatgaacctggcggcagcgcaaaagatg

SEQ ID NO: 212388 - DNA, 103 bp, Artificial Sequence
  Synthetic Polynucleotide
taatacgactcactatagggaggctagtcacggaagctgtgtcatcatctaacagaggagaagatgaatgcacagcttcaacctggcggcagcgcaaaagatg

SEQ ID NO: 212389 - DNA, 103 bp, Artificial Sequence
  Synthetic Polynucleotide
taatacgactcactatagggagaagagttaaggctagtcacggaagctgtaacagaggagaacagctatggtgactagcaacctggcggcagcgcaaaagatg

SEQ ID NO: 212390 - DNA, 103 bp, Artificial Sequence
  Synthetic Polynucleotide
taatacgactcactataggggtccagtggcagaagagttaaggctagtcaaacagaggagatgactaatgttaactcttaacctggcggcagcgcaaaagatg

SEQ ID NO: 212391 - DNA, 103 bp, Artificial Sequence
  Synthetic Polynucleotide
taatacgactcactatagggttgagacagcgtccagtggcagaagagttaaacagaggagataactcatgtgccactggaacctggcggcagcgcaaaagatg

SEQ ID NO: 212392 - DNA, 103 bp, Artificial Sequence
  Synthetic Polynucleotide
taatacgactcactataggggcgataaatcttgagacagcgtccagtggcaacagaggagagccactatgcgctgtctcaacctggcggcagcgcaaaagatg

SEQ ID NO: 212393 - DNA, 103 bp, Artificial Sequence
  Synthetic Polynucleotide
taatacgactcactatagggctcgaaacgtgcgataaatcttgagacagcaacagaggagagctgtcatgagatttatcaacctggcggcagcgcaaaagatg

SEQ ID NO: 212394 - DNA, 103 bp, Artificial Sequence
  Synthetic Polynucleotide
taatacgactcactatagggccctcttcatctcgaaacgtgcgataaatcaacagaggagagatttaatgcacgtttcgaacctggcggcagcgcaaaagatg

SEQ ID NO: 212395 - DNA, 103 bp, Artificial Sequence
  Synthetic Polynucleotide
taatacgactcactatagggatactctttcccctcttcatctcgaaacgtaacagaggagaacgtttatggatgaagagaacctggcggcagcgcaaaagatg

SEQ ID NO: 212396 - DNA, 103 bp, Artificial Sequence
  Synthetic Polynucleotide
taatacgactcactatagggcacagcgaacatactctttcccctcttcataacagaggagaatgaagatgggaaagagtaacctggcggcagcgcaaaagatg

SEQ ID NO: 212397 - DNA, 103 bp, Artificial Sequence
  Synthetic Polynucleotide
taatacgactcactataggggtctgctggtatcttcggctttcatcttctaacagaggagaagaagaatgaagccgaagaacctggcggcagcgcaaaagatg

SEQ ID NO: 212398 - DNA, 103 bp, Artificial Sequence
  Synthetic Polynucleotide
taatacgactcactatagggcggactgtctcacagcgaacatactctttcaacagaggagagaaagaatgtgttcgctgaacctggcggcagcgcaaaagatg

SEQ ID NO: 212399 - DNA, 103 bp, Artificial Sequence
  Synthetic Polynucleotide
taatacgactcactatagggagctggttttcggactgtctcacagcgaacaacagaggagagttcgcatggagacagtcaacctggcggcagcgcaaaagatg

SEQ ID NO: 212400 - DNA, 103 bp, Artificial Sequence
  Synthetic Polynucleotide
taatacgactcactatagggcatcaatgacagctggttttcggactgtctaacagaggagaagacagatggaaaaccagaacctggcggcagcgcaaaagatg

SEQ ID NO: 212401 - DNA, 103 bp, Artificial Sequence
  Synthetic Polynucleotide
taatacgactcactatagggcgcacataggcatcaatgacagctggttttaacagaggagaaaaaccatgtgtcattgaaacctggcggcagcgcaaaagatg

SEQ ID NO: 212402 - DNA, 103 bp, Artificial Sequence
  Synthetic Polynucleotide
taatacgactcactatagggagtccgtatgcgcacataggcatcaatgacaacagaggagagtcattatggcctatgtgaacctggcggcagcgcaaaagatg

SEQ ID NO: 212403 - DNA, 103 bp, Artificial Sequence
  Synthetic Polynucleotide
taatacgactcactatagggcatcttttgtagtccgtatgcgcacataggaacagaggagacctatgatggcatacggaaacctggcggcagcgcaaaagatg

SEQ ID NO: 212404 - DNA, 103 bp, Artificial Sequence
  Synthetic Polynucleotide
taatacgactcactatagggatgaattcctcatcttttgtagtccgtatgaacagaggagacatacgatgtacaaaagaaacctggcggcagcgcaaaagatg

SEQ ID NO: 212405 - DNA, 103 bp, Artificial Sequence
  Synthetic Polynucleotide
taatacgactcactatagggaaattttcgaatgaattcctcatcttttgtaacagaggagaacaaaaatggaggaattcaacctggcggcagcgcaaaagatg

SEQ ID NO: 212406 - DNA, 103 bp, Artificial Sequence
  Synthetic Polynucleotide
taatacgactcactatagggcaaaaagggcaaattttcgaatgaattcctaacagaggagaaggaatatgttcgaaaataacctggcggcagcgcaaaagatg

SEQ ID NO: 212407 - DNA, 103 bp, Artificial Sequence
  Synthetic Polynucleotide
taatacgactcactatagggtgttgttcatcaaaaagggcaaattttcgaaacagaggagatcgaaaatgtgcccttttaacctggcggcagcgcaaaagatg

SEQ ID NO: 212408 - DNA, 103 bp, Artificial Sequence
  Synthetic Polynucleotide
taatacgactcactataggggctccccatcgtctgctggtatcttcggctaacagaggagaagccgaatgtaccagcagaacctggcggcagcgcaaaagatg

SEQ ID NO: 212409 - DNA, 103 bp, Artificial Sequence
  Synthetic Polynucleotide
taatacgactcactatagggctcttcccgatgttgttcatcaaaaagggcaacagaggagagcccttatggatgaacaaaacctggcggcagcgcaaaagatg

SEQ ID NO: 212410 - DNA, 103 bp, Artificial Sequence
  Synthetic Polynucleotide
taatacgactcactatagggcttttcgcatctcttcccgatgttgttcataacagaggagaatgaacatgatcgggaagaacctggcggcagcgcaaaagatg

SEQ ID NO: 212411 - DNA, 103 bp, Artificial Sequence
  Synthetic Polynucleotide
taatacgactcactatagggctccgccgttcttttcgcatctcttcccgaaacagaggagatcgggaatggatgcgaaaaacctggcggcagcgcaaaagatg

SEQ ID NO: 212412 - DNA, 103 bp, Artificial Sequence
  Synthetic Polynucleotide
taatacgactcactatagggctcttgaatcctccgccgttcttttcgcataacagaggagaatgcgaatggaacggcggaacctggcggcagcgcaaaagatg

SEQ ID NO: 212413 - DNA, 103 bp, Artificial Sequence
  Synthetic Polynucleotide
taatacgactcactataggggcctcagttgctcttgaatcctccgccgttaacagaggagaaacggcatgggattcaagaacctggcggcagcgcaaaagatg

SEQ ID NO: 212414 - DNA, 103 bp, Artificial Sequence
  Synthetic Polynucleotide
taatacgactcactatagggctcttaagccgcctcagttgctcttgaatcaacagaggagagattcaatggcaactgagaacctggcggcagcgcaaaagatg

SEQ ID NO: 212415 - DNA, 103 bp, Artificial Sequence
  Synthetic Polynucleotide
taatacgactcactatagggttcctggttcctcttaagccgcctcagttgaacagaggagacaactgatgcggcttaagaacctggcggcagcgcaaaagatg

SEQ ID NO: 212416 - DNA, 103 bp, Artificial Sequence
  Synthetic Polynucleotide
taatacgactcactataggggcttctccttttcctggttcctcttaagccaacagaggagaggcttaatgggaaccaggaacctggcggcagcgcaaaagatg

SEQ ID NO: 212417 - DNA, 103 bp, Artificial Sequence
  Synthetic Polynucleotide
taatacgactcactatagggggacccttaagcttctccttttcctggttcaacagaggagagaaccaatgaaaggagaaaacctggcggcagcgcaaaagatg

SEQ ID NO: 212418 - DNA, 103 bp, Artificial Sequence
  Synthetic Polynucleotide
taatacgactcactatagggcttctcaggaggacccttaagcttctccttaacagaggagaaaggagatgcttaagggtaacctggcggcagcgcaaaagatg

SEQ ID NO: 212419 - DNA, 103 bp, Artificial Sequence
  Synthetic Polynucleotide
taatacgactcactatagggggggctgcaagctccccatcgtctgctggtaacagaggagaaccagcatgcgatggggaaacctggcggcagcgcaaaagatg

SEQ ID NO: 212420 - DNA, 103 bp, Artificial Sequence
  Synthetic Polynucleotide
taatacgactcactatagggtcttgggcttcttctcaggaggacccttaaaacagaggagattaaggatgctcctgagaaacctggcggcagcgcaaaagatg

SEQ ID NO: 212421 - DNA, 103 bp, Artificial Sequence
  Synthetic Polynucleotide
taatacgactcactatagggtccttcattttcttgggcttcttctcaggaaacagaggagatcctgaatggaagcccaaaacctggcggcagcgcaaaagatg

SEQ ID NO: 212422 - DNA, 103 bp, Artificial Sequence
  Synthetic Polynucleotide
taatacgactcactataggggtcaggacgctccttcattttcttgggcttaacagaggagaaagcccatgaaaatgaagaacctggcggcagcgcaaaagatg

SEQ ID NO: 212423 - DNA, 103 bp, Artificial Sequence
  Synthetic Polynucleotide
taatacgactcactatagggtcagttttaggtcaggacgctccttcatttaacagaggagaaaatgaatgagcgtcctgaacctggcggcagcgcaaaagatg

SEQ ID NO: 212424 - DNA, 103 bp, Artificial Sequence
  Synthetic Polynucleotide
taatacgactcactataggggccccacatttcagttttaggtcaggacgcaacagaggagagcgtccatgcctaaaactaacctggcggcagcgcaaaagatg

SEQ ID NO: 212425 - DNA, 103 bp, Artificial Sequence
  Synthetic Polynucleotide
taatacgactcactatagggggcaccacatgccccacatttcagttttagaacagaggagactaaaaatgaaatgtgggaacctggcggcagcgcaaaagatg

SEQ ID NO: 212426 - DNA, 103 bp, Artificial Sequence
  Synthetic Polynucleotide
taatacgactcactatagggtgtgtccaatggcaccacatgccccacattaacagaggagaaatgtgatgcatgtggtgaacctggcggcagcgcaaaagatg

SEQ ID NO: 212427 - DNA, 103 bp, Artificial Sequence
  Synthetic Polynucleotide
taatacgactcactatagggttagtcctcatgtgtccaatggcaccacataacagaggagaatgtggatgcattggacaaacctggcggcagcgcaaaagatg

SEQ ID NO: 212428 - DNA, 103 bp, Artificial Sequence
  Synthetic Polynucleotide
taatacgactcactataggggcagaatttgttagtcctcatgtgtccaataacagaggagaattggaatgatgaggactaacctggcggcagcgcaaaagatg

SEQ ID NO: 212429 - DNA, 103 bp, Artificial Sequence
  Synthetic Polynucleotide
taatacgactcactatagggaatagagggggcagaatttgttagtcctcaaacagaggagatgaggaatgacaaattctaacctggcggcagcgcaaaagatg

SEQ ID NO: 212430 - DNA, 103 bp, Artificial Sequence
  Synthetic Polynucleotide
taatacgactcactataggggagtggcaaaggggctgcaagctccccatcaacagaggagagatgggatgcttgcagccaacctggcggcagcgcaaaagatg

SEQ ID NO: 212431 - DNA, 103 bp, Artificial Sequence
  Synthetic Polynucleotide
taatacgactcactatagggtttgtttgataatagagggggcagaatttgaacagaggagacaaattatgccccctctaaacctggcggcagcgcaaaagatg

SEQ ID NO: 212432 - DNA, 103 bp, Artificial Sequence
  Synthetic Polynucleotide
taatacgactcactatagggaggtggcgcatttgtttgataatagaggggaacagaggagacccctcatgtatcaaacaaacctggcggcagcgcaaaagatg

SEQ ID NO: 212433 - DNA, 103 bp, Artificial Sequence
  Synthetic Polynucleotide
taatacgactcactatagggcagggttggaaggtggcgcatttgtttgataacagaggagaatcaaaatgatgcgccacaacctggcggcagcgcaaaagatg

SEQ ID NO: 212434 - DNA, 103 bp, Artificial Sequence
  Synthetic Polynucleotide
taatacgactcactataggggtcatggcaacagggttggaaggtggcgcaaacagaggagatgcgccatgttccaacccaacctggcggcagcgcaaaagatg

SEQ ID NO: 212435 - DNA, 103 bp, Artificial Sequence
  Synthetic Polynucleotide
taatacgactcactatagggctgttcttctgtcatggcaacagggttggaaacagaggagatccaacatggttgccatgaacctggcggcagcgcaaaagatg

SEQ ID NO: 212436 - DNA, 103 bp, Artificial Sequence
  Synthetic Polynucleotide
taatacgactcactatagggactcctcctcctgttcttctgtcatggcaaaacagaggagattgccaatgcagaagaacaacctggcggcagcgcaaaagatg

SEQ ID NO: 212437 - DNA, 103 bp, Artificial Sequence
  Synthetic Polynucleotide
taatacgactcactataggggtcttttccaactcctcctcctgttcttctaacagaggagaagaagaatgggaggaggaaacctggcggcagcgcaaaagatg

SEQ ID NO: 212438 - DNA, 103 bp, Artificial Sequence
  Synthetic Polynucleotide
taatacgactcactatagggatgaatgactgtcttttccaactcctcctcaacagaggagagaggagatgttggaaaagaacctggcggcagcgcaaaagatg

SEQ ID NO: 212439 - DNA, 103 bp, Artificial Sequence
  Synthetic Polynucleotide
taatacgactcactatagggcattatcattatgaatgactgtcttttccaaacagaggagatggaaaatgcagtcattcaacctggcggcagcgcaaaagatg

SEQ ID NO: 212440 - DNA, 103 bp, Artificial Sequence
  Synthetic Polynucleotide
taatacgactcactatagggataagttcttcattatcattatgaatgactaacagaggagaagtcatatgtaatgataaaacctggcggcagcgcaaaagatg

SEQ ID NO: 212441 - DNA, 103 bp, Artificial Sequence
  Synthetic Polynucleotide
taatacgactcactataggggatggcggcagcagtgatggtagctgctgtaacagaggagaacagcaatgaccatcactaacctggcggcagcgcaaaagatg

SEQ ID NO: 212442 - DNA, 103 bp, Artificial Sequence
  Synthetic Polynucleotide
taatacgactcactatagggatcataatctgagtggcaaaggggctgcaaaacagaggagattgcagatgctttgccacaacctggcggcagcgcaaaagatg

SEQ ID NO: 212443 - DNA, 103 bp, Artificial Sequence
  Synthetic Polynucleotide
taatacgactcactatagggttcaaccttgataagttcttcattatcattaacagaggagaaatgatatggaagaacttaacctggcggcagcgcaaaagatg

SEQ ID NO: 212444 - DNA, 103 bp, Artificial Sequence
  Synthetic Polynucleotide
taatacgactcactatagggttttggtcccttcaaccttgataagttcttaacagaggagaaagaacatgtcaaggttgaacctggcggcagcgcaaaagatg

SEQ ID NO: 212445 - DNA, 103 bp, Artificial Sequence
  Synthetic Polynucleotide
taatacgactcactatagggcccaagacaattttggtcccttcaaccttgaacagaggagacaaggtatgagggaccaaaacctggcggcagcgcaaaagatg

SEQ ID NO: 212446 - DNA, 103 bp, Artificial Sequence
  Synthetic Polynucleotide
taatacgactcactatagggtagctgtttccccaagacaattttggtcccaacagaggagagggaccatgattgtcttgaacctggcggcagcgcaaaagatg

SEQ ID NO: 212447 - DNA, 103 bp, Artificial Sequence
  Synthetic Polynucleotide
taatacgactcactatagggcactctcaattagctgtttccccaagacaaaacagaggagattgtctatgggaaacagcaacctggcggcagcgcaaaagatg

SEQ ID NO: 212448 - DNA, 103 bp, Artificial Sequence
  Synthetic Polynucleotide
taatacgactcactatagggacctcatccgcactctcaattagctgtttcaacagaggagagaaacaatgaattgagagaacctggcggcagcgcaaaagatg

SEQ ID NO: 212449 - DNA, 103 bp, Artificial Sequence
  Synthetic Polynucleotide
taatacgactcactatagggttttctgcgaacctcatccgcactctcaataacagaggagaattgagatggcggatgagaacctggcggcagcgcaaaagatg

SEQ ID NO: 212450 - DNA, 103 bp, Artificial Sequence
  Synthetic Polynucleotide
taatacgactcactataggggaaccagagattttctgcgaacctcatccgaacagaggagacggatgatgttcgcagaaaacctggcggcagcgcaaaagatg

SEQ ID NO: 212451 - DNA, 103 bp, Artificial Sequence
  Synthetic Polynucleotide
taatacgactcactatagggggaaacttgagaaccagagattttctgcgaaacagaggagatcgcagatgatctctggtaacctggcggcagcgcaaaagatg

SEQ ID NO: 212452 - DNA, 103 bp, Artificial Sequence
  Synthetic Polynucleotide
taatacgactcactatagggctgctgtttaggaaacttgagaaccagagaaacagaggagatctctgatgctcaagtttaacctggcggcagcgcaaaagatg

SEQ ID NO: 212453 - DNA, 103 bp, Artificial Sequence
  Synthetic Polynucleotide
taatacgactcactatagggagtcatcttcatcataatctgagtggcaaaaacagaggagatttgccatgcagattatgaacctggcggcagcgcaaaagatg

SEQ ID NO: 212454 - DNA, 103 bp, Artificial Sequence
  Synthetic Polynucleotide
taatacgactcactatagggttggaggaagctgctgtttaggaaacttgaaacagaggagatcaagtatgctaaacagcaacctggcggcagcgcaaaagatg

SEQ ID NO: 212455 - DNA, 103 bp, Artificial Sequence
  Synthetic Polynucleotide
taatacgactcactatagggcgtttcttctttggaggaagctgctgtttaaacagaggagataaacaatggcttcctccaacctggcggcagcgcaaaagatg

SEQ ID NO: 212456 - DNA, 103 bp, Artificial Sequence
  Synthetic Polynucleotide
taatacgactcactatagggtccaactcgccgtttcttctttggaggaagaacagaggagacttcctatgaagaagaaaaacctggcggcagcgcaaaagatg

SEQ ID NO: 212457 - DNA, 103 bp, Artificial Sequence
  Synthetic Polynucleotide
taatacgactcactataggggaacagtggttccaactcgccgtttcttctaacagaggagaagaagaatgggcgagttgaacctggcggcagcgcaaaagatg

SEQ ID NO: 212458 - DNA, 103 bp, Artificial Sequence
  Synthetic Polynucleotide
taatacgactcactatagggtagtcacagtgaacagtggttccaactcgcaacagaggagagcgagtatgaaccactgtaacctggcggcagcgcaaaagatg

SEQ ID NO: 212459 - DNA, 103 bp, Artificial Sequence
  Synthetic Polynucleotide
taatacgactcactatagggtctattcaaatagtcacagtgaacagtggtaacagaggagaaccactatgcactgtgacaacctggcggcagcgcaaaagatg

SEQ ID NO: 212460 - DNA, 103 bp, Artificial Sequence
  Synthetic Polynucleotide
taatacgactcactatagggacttatgaggtctattcaaatagtcacagtaacagaggagaactgtgatgatttgaataaacctggcggcagcgcaaaagatg

SEQ ID NO: 212461 - DNA, 103 bp, Artificial Sequence
  Synthetic Polynucleotide
taatacgactcactatagggcggtggatggacttatgaggtctattcaaaaacagaggagatttgaaatgacctcataaaacctggcggcagcgcaaaagatg

SEQ ID NO: 212462 - DNA, 103 bp, Artificial Sequence
  Synthetic Polynucleotide
taatacgactcactatagggtgtgcggcgccggtggatggacttatgaggaacagaggagacctcatatgtccatccacaacctggcggcagcgcaaaagatg

SEQ ID NO: 212463 - DNA, 103 bp, Artificial Sequence
  Synthetic Polynucleotide
taatacgactcactatagggccatagggtctgtgcggcgccggtggatggaacagaggagaccatccatgggcgccgcaaacctggcggcagcgcaaaagatg

SEQ ID NO: 212464 - DNA, 103 bp, Artificial Sequence
  Synthetic Polynucleotide
taatacgactcactatagggtcagcatcatagtcatcttcatcataatctaacagaggagaagattaatgtgaagatgaaacctggcggcagcgcaaaagatg

SEQ ID NO: 212465 - DNA, 103 bp, Artificial Sequence
  Synthetic Polynucleotide
taatacgactcactataggggacagcgtcaccatagggtctgtgcggcgcaacagaggagagcgccgatgagaccctataacctggcggcagcgcaaaagatg

SEQ ID NO: 212466 - DNA, 103 bp, Artificial Sequence
  Synthetic Polynucleotide
taatacgactcactatagggcaagatggacgacagcgtcaccatagggtcaacagaggagagaccctatggtgacgctgaacctggcggcagcgcaaaagatg

SEQ ID NO: 212467 - DNA, 103 bp, Artificial Sequence
  Synthetic Polynucleotide
taatacgactcactatagggtgatagactccaagatggacgacagcgtcaaacagaggagatgacgcatgcgtccatctaacctggcggcagcgcaaaagatg

SEQ ID NO: 212468 - DNA, 103 bp, Artificial Sequence
  Synthetic Polynucleotide
taatacgactcactatagggatgtcattgatgatagactccaagatggacaacagaggagagtccatatgggagtctataacctggcggcagcgcaaaagatg

SEQ ID NO: 212469 - DNA, 103 bp, Artificial Sequence
  Synthetic Polynucleotide
taatacgactcactatagggaagatctctcatgtcattgatgatagactcaacagaggagagagtctatgatcaatgacaacctggcggcagcgcaaaagatg

SEQ ID NO: 212470 - DNA, 103 bp, Artificial Sequence
  Synthetic Polynucleotide
taatacgactcactatagggatgtatttggaagatctctcatgtcattgaaacagaggagatcaatgatgtgagagatcaacctggcggcagcgcaaaagatg

SEQ ID NO: 212471 - DNA, 103 bp, Artificial Sequence
  Synthetic Polynucleotide
taatacgactcactatagggtggaaagggtatgtatttggaagatctctcaacagaggagagagagaatgtccaaatacaacctggcggcagcgcaaaagatg

SEQ ID NO: 212472 - DNA, 103 bp, Artificial Sequence
  Synthetic Polynucleotide
taatacgactcactataggggactggagtgtggaaagggtatgtatttggaacagaggagaccaaatatgtaccctttcaacctggcggcagcgcaaaagatg

SEQ ID NO: 212473 - DNA, 103 bp, Artificial Sequence
  Synthetic Polynucleotide
taatacgactcactatagggcctttgcattgactggagtgtggaaagggtaacagaggagaacccttatgacactccagaacctggcggcagcgcaaaagatg

SEQ ID NO: 212474 - DNA, 103 bp, Artificial Sequence
  Synthetic Polynucleotide
taatacgactcactatagggtcctttacaacctttgcattgactggagtgaacagaggagacactccatgcaatgcaaaaacctggcggcagcgcaaaagatg

SEQ ID NO: 212475 - DNA, 103 bp, Artificial Sequence
  Synthetic Polynucleotide
taatacgactcactataggggtcttcacaatcagcatcatagtcatcttcaacagaggagagaagatatgtatgatgctaacctggcggcagcgcaaaagatg

SEQ ID NO: 212476 - DNA, 103 bp, Artificial Sequence
  Synthetic Polynucleotide
taatacgactcactatagggtttgtagtagtcctttacaacctttgcattaacagaggagaaatgcaatggttgtaaagaacctggcggcagcgcaaaagatg

SEQ ID NO: 212477 - DNA, 103 bp, Artificial Sequence
  Synthetic Polynucleotide
taatacgactcactataggggagtgatgattttgtagtagtcctttacaaaacagaggagattgtaaatgactactacaaacctggcggcagcgcaaaagatg

SEQ ID NO: 212478 - DNA, 103 bp, Artificial Sequence
  Synthetic Polynucleotide
taatacgactcactatagggtccattggccgagtgatgattttgtagtagaacagaggagactactaatgaatcatcacaacctggcggcagcgcaaaagatg

SEQ ID NO: 212479 - DNA, 103 bp, Artificial Sequence
  Synthetic Polynucleotide
taatacgactcactatagggtgtttgtaggtccattggccgagtgatgataacagaggagaatcatcatgcggccaatgaacctggcggcagcgcaaaagatg

SEQ ID NO: 212480 - DNA, 103 bp, Artificial Sequence
  Synthetic Polynucleotide
taatacgactcactatagggtttcgcggagtgtttgtaggtccattggccaacagaggagaggccaaatgacctacaaaaacctggcggcagcgcaaaagatg

SEQ ID NO: 212481 - DNA, 103 bp, Artificial Sequence
  Synthetic Polynucleotide
taatacgactcactatagggttacgcacgttttcgcggagtgtttgtaggaacagaggagacctacaatgactccgcgaaacctggcggcagcgcaaaagatg

SEQ ID NO: 212482 - DNA, 103 bp, Artificial Sequence
  Synthetic Polynucleotide
taatacgactcactataggggtagaggcgtttacgcacgttttcgcggagaacagaggagactccgcatgaacgtgcgtaacctggcggcagcgcaaaagatg

SEQ ID NO: 212483 - DNA, 103 bp, Artificial Sequence
  Synthetic Polynucleotide
taatacgactcactatagggcccgagatgggtagaggcgtttacgcacgtaacagaggagaacgtgcatgaacgcctctaacctggcggcagcgcaaaagatg

SEQ ID NO: 212484 - DNA, 103 bp, Artificial Sequence
  Synthetic Polynucleotide
taatacgactcactatagggctgaactcttcccgagatgggtagaggcgtaacagaggagaacgcctatgcccatctcgaacctggcggcagcgcaaaagatg

SEQ ID NO: 212485 - DNA, 103 bp, Artificial Sequence
  Synthetic Polynucleotide
taatacgactcactatagggcagatgctctctgaactcttcccgagatggaacagaggagaccatctatggaagagttcaacctggcggcagcgcaaaagatg

SEQ ID NO: 212486 - DNA, 103 bp, Artificial Sequence
  Synthetic Polynucleotide
taatacgactcactatagggtgcaatcaatgtcttcacaatcagcatcataacagaggagaatgatgatgattgtgaagaacctggcggcagcgcaaaagatg

SEQ ID NO: 212487 - DNA, 103 bp, Artificial Sequence
  Synthetic Polynucleotide
taatacgactcactatagggcaattagctccagatgctctctgaactcttaacagaggagaaagagtatggagagcatcaacctggcggcagcgcaaaagatg

SEQ ID NO: 212488 - DNA, 103 bp, Artificial Sequence
  Synthetic Polynucleotide
taatacgactcactatagggctatttttcacaattagctccagatgctctaacagaggagaagagcaatgggagctaataacctggcggcagcgcaaaagatg

SEQ ID NO: 212489 - DNA, 103 bp, Artificial Sequence
  Synthetic Polynucleotide
taatacgactcactataggggtaggttgcactatttttcacaattagctcaacagaggagagagctaatggtgaaaaataacctggcggcagcgcaaaagatg

SEQ ID NO: 212490 - DNA, 103 bp, Artificial Sequence
  Synthetic Polynucleotide
taatacgactcactatagggttggcccattgtaggttgcactatttttcaaacagaggagatgaaaaatggtgcaacctaacctggcggcagcgcaaaagatg

SEQ ID NO: 212491 - DNA, 103 bp, Artificial Sequence
  Synthetic Polynucleotide
taatacgactcactatagggaatgagtgttttggcccattgtaggttgcaaacagaggagatgcaacatgcaatgggccaacctggcggcagcgcaaaagatg

SEQ ID NO: 212492 - DNA, 103 bp, Artificial Sequence
  Synthetic Polynucleotide
taatacgactcactataggggatctgagtcaatgagtgttttggcccattaacagaggagaaatgggatgaaacactcaaacctggcggcagcgcaaaagatg

SEQ ID NO: 212493 - DNA, 103 bp, Artificial Sequence
  Synthetic Polynucleotide
taatacgactcactatagggtggattgagagatctgagtcaatgagtgttaacagaggagaaacactatgtgactcagaaacctggcggcagcgcaaaagatg

SEQ ID NO: 212494 - DNA, 103 bp, Artificial Sequence
  Synthetic Polynucleotide
taatacgactcactatagggagatccagcatggattgagagatctgagtcaacagaggagagactcaatgctctcaatcaacctggcggcagcgcaaaagatg

SEQ ID NO: 212495 - DNA, 103 bp, Artificial Sequence
  Synthetic Polynucleotide
taatacgactcactatagggttcatcacagagatccagcatggattgagaaacagaggagatctcaaatgatgctggataacctggcggcagcgcaaaagatg

SEQ ID NO: 212496 - DNA, 103 bp, Artificial Sequence
  Synthetic Polynucleotide
taatacgactcactatagggctttgagtttttcatcacagagatccagcaaacagaggagatgctggatgtctgtgatgaacctggcggcagcgcaaaagatg

SEQ ID NO: 212497 - DNA, 103 bp, Artificial Sequence
  Synthetic Polynucleotide
taatacgactcactatagggggcatcaacttgcaatcaatgtcttcacaaaacagaggagattgtgaatgcattgattgaacctggcggcagcgcaaaagatg

SEQ ID NO: 212498 - DNA, 103 bp, Artificial Sequence
  Synthetic Polynucleotide
taatacgactcactatagggtcttctttctctttgagtttttcatcacagaacagaggagactgtgaatgaaaactcaaaacctggcggcagcgcaaaagatg

SEQ ID NO: 212499 - DNA, 103 bp, Artificial Sequence
  Synthetic Polynucleotide
taatacgactcactatagggagctaatttgtcttctttctctttgagtttaacagaggagaaaactcatggagaaagaaaacctggcggcagcgcaaaagatg

SEQ ID NO: 212500 - DNA, 103 bp, Artificial Sequence
  Synthetic Polynucleotide
taatacgactcactatagggtctctaagcgagctaatttgtcttctttctaacagaggagaagaaagatgacaaattagaacctggcggcagcgcaaaagatg

SEQ ID NO: 212501 - DNA, 103 bp, Artificial Sequence
  Synthetic Polynucleotide
taatacgactcactatagggttgatagctttctctaagcgagctaatttgaacagaggagacaaattatgtcgcttagaaacctggcggcagcgcaaaagatg

SEQ ID NO: 212502 - DNA, 103 bp, Artificial Sequence
  Synthetic Polynucleotide
taatacgactcactatagggcagcaaggggttgatagctttctctaagcgaacagaggagacgcttaatgaaagctatcaacctggcggcagcgcaaaagatg

SEQ ID NO: 212503 - DNA, 103 bp, Artificial Sequence
  Synthetic Polynucleotide
taatacgactcactatagggcatcatcatccagcaaggggttgatagcttaacagaggagaaagctaatgaccccttgcaacctggcggcagcgcaaaagatg

SEQ ID NO: 212504 - DNA, 103 bp, Artificial Sequence
  Synthetic Polynucleotide
taatacgactcactataggggccacttggtcatcatcatccagcaaggggaacagaggagaccccttatgggatgatgaaacctggcggcagcgcaaaagatg

SEQ ID NO: 212505 - DNA, 103 bp, Artificial Sequence
  Synthetic Polynucleotide
taatacgactcactataggggaaagaaaacgccacttggtcatcatcatcaacagaggagagatgatatggaccaagtgaacctggcggcagcgcaaaagatg

SEQ ID NO: 212506 - DNA, 103 bp, Artificial Sequence
  Synthetic Polynucleotide
taatacgactcactatagggtgtccagaatgaaagaaaacgccacttggtaacagaggagaaccaagatgcgttttcttaacctggcggcagcgcaaaagatg

SEQ ID NO: 212507 - DNA, 103 bp, Artificial Sequence
  Synthetic Polynucleotide
taatacgactcactataggggtgacaatgttgtccagaatgaaagaaaacaacagaggagagttttcatgcattctggaaacctggcggcagcgcaaaagatg

SEQ ID NO: 212508 - DNA, 103 bp, Artificial Sequence
  Synthetic Polynucleotide
taatacgactcactatagggaggtggaggaggcatcaacttgcaatcaataacagaggagaattgatatgaagttgatgaacctggcggcagcgcaaaagatg

SEQ ID NO: 212509 - DNA, 103 bp, Artificial Sequence
  Synthetic Polynucleotide
taatacgactcactatagggcattttctgggtgacaatgttgtccagaataacagaggagaattctgatgaacattgtcaacctggcggcagcgcaaaagatg

SEQ ID NO: 212510 - DNA, 103 bp, Artificial Sequence
  Synthetic Polynucleotide
taatacgactcactataggggaactgccatcattttctgggtgacaatgtaacagaggagaacattgatgcccagaaaaaacctggcggcagcgcaaaagatg

SEQ ID NO: 212511 - DNA, 103 bp, Artificial Sequence
  Synthetic Polynucleotide
taatacgactcactatagggcaagaatctggaactgccatcattttctggaacagaggagaccagaaatggatggcagtaacctggcggcagcgcaaaagatg

SEQ ID NO: 212512 - DNA, 103 bp, Artificial Sequence
  Synthetic Polynucleotide
taatacgactcactatagggatgaaatggccaagaatctggaactgccataacagaggagaatggcaatgccagattctaacctggcggcagcgcaaaagatg

SEQ ID NO: 212513 - DNA, 103 bp, Artificial Sequence
  Synthetic Polynucleotide
taatacgactcactatagggtaactgggtgatgaaatggccaagaatctgaacagaggagacagattatgggccatttcaacctggcggcagcgcaaaagatg

SEQ ID NO: 212514 - DNA, 103 bp, Artificial Sequence
  Synthetic Polynucleotide
taatacgactcactatagggaatttcttattaactgggtgatgaaatggcaacagaggagagccattatgtcacccagtaacctggcggcagcgcaaaagatg

SEQ ID NO: 212515 - DNA, 103 bp, Artificial Sequence
  Synthetic Polynucleotide
taatacgactcactatagggatctggaacaaatttcttattaactgggtgaacagaggagacacccaatgaataagaaaaacctggcggcagcgcaaaagatg

SEQ ID NO: 212516 - DNA, 103 bp, Artificial Sequence
  Synthetic Polynucleotide
taatacgactcactatagggctttgtaataatctggaacaaatttcttataacagaggagaataagaatgttgttccagaacctggcggcagcgcaaaagatg

SEQ ID NO: 212517 - DNA, 103 bp, Artificial Sequence
  Synthetic Polynucleotide
taatacgactcactatagggttgacaatcactttgtaataatctggaacaaacagaggagatgttccatgttattacaaaacctggcggcagcgcaaaagatg

SEQ ID NO: 212518 - DNA, 103 bp, Artificial Sequence
  Synthetic Polynucleotide
taatacgactcactatagggatccattggattgacaatcactttgtaataaacagaggagatattacatggtgattgtcaacctggcggcagcgcaaaagatg

SEQ ID NO: 212519 - DNA, 103 bp, Artificial Sequence
  Synthetic Polynucleotide
taatacgactcactatagggccgggggtggaggtggaggaggcatcaactaacagaggagaagttgaatgctcctccacaacctggcggcagcgcaaaagatg

SEQ ID NO: 212520 - DNA, 103 bp, Artificial Sequence
  Synthetic Polynucleotide
taatacgactcactatagggtggtctctaaatccattggattgacaatcaaacagaggagatgattgatgatccaatggaacctggcggcagcgcaaaagatg

SEQ ID NO: 212521 - DNA, 103 bp, Artificial Sequence
  Synthetic Polynucleotide
taatacgactcactatagggttcttacgtatggtctctaaatccattggaaacagaggagatccaatatgtttagagacaacctggcggcagcgcaaaagatg

SEQ ID NO: 212522 - DNA, 103 bp, Artificial Sequence
  Synthetic Polynucleotide
taatacgactcactatagggcttggagatgttcttacgtatggtctctaaaacagaggagattagagatgatacgtaagaacctggcggcagcgcaaaagatg

SEQ ID NO: 212523 - DNA, 103 bp, Artificial Sequence
  Synthetic Polynucleotide
taatacgactcactataggggatacttgtgcttggagatgttcttacgtaaacagaggagatacgtaatgacatctccaaacctggcggcagcgcaaaagatg

SEQ ID NO: 212524 - DNA, 103 bp, Artificial Sequence
  Synthetic Polynucleotide
taatacgactcactatagggtcccgactctgatacttgtgcttggagatgaacagaggagacatctcatggcacaagtaaacctggcggcagcgcaaaagatg

SEQ ID NO: 212525 - DNA, 103 bp, Artificial Sequence
  Synthetic Polynucleotide
taatacgactcactatagggcagaaagctctcccgactctgatacttgtgaacagaggagacacaagatgcagagtcggaacctggcggcagcgcaaaagatg

SEQ ID NO: 212526 - DNA, 103 bp, Artificial Sequence
  Synthetic Polynucleotide
taatacgactcactatagggttacatcatccagaaagctctcccgactctaacagaggagaagagtcatgagagctttcaacctggcggcagcgcaaaagatg

SEQ ID NO: 212527 - DNA, 103 bp, Artificial Sequence
  Synthetic Polynucleotide
taatacgactcactatagggagaataaggtttacatcatccagaaagctcaacagaggagagagcttatgggatgatgtaacctggcggcagcgcaaaagatg

SEQ ID NO: 212528 - DNA, 103 bp, Artificial Sequence
  Synthetic Polynucleotide
taatacgactcactatagggactgttggccagaataaggtttacatcatcaacagaggagagatgatatgaaccttattaacctggcggcagcgcaaaagatg

SEQ ID NO: 212529 - DNA, 103 bp, Artificial Sequence
  Synthetic Polynucleotide
taatacgactcactatagggtatacttaacactgttggccagaataaggtaacagaggagaaccttaatgtggccaacaaacctggcggcagcgcaaaagatg

SEQ ID NO: 212530 - DNA, 103 bp, Artificial Sequence
  Synthetic Polynucleotide
taatacgactcactatagggttcattggtcccgggggtggaggtggaggaaacagaggagatcctccatgtccacccccaacctggcggcagcgcaaaagatg

SEQ ID NO: 212531 - DNA, 103 bp, Artificial Sequence
  Synthetic Polynucleotide
taatacgactcactatagggtcaggtccattatacttaacactgttggccaacagaggagaggccaaatgtgttaagtaaacctggcggcagcgcaaaagatg

SEQ ID NO: 212532 - DNA, 103 bp, Artificial Sequence
  Synthetic Polynucleotide
taatacgactcactatagggatactgactctcaggtccattatacttaacaacagaggagagttaagatgaatggacctaacctggcggcagcgcaaaagatg

SEQ ID NO: 212533 - DNA, 103 bp, Artificial Sequence
  Synthetic Polynucleotide
taatacgactcactatagggcagtcttagtatactgactctcaggtccataacagaggagaatggacatgagagtcagtaacctggcggcagcgcaaaagatg

SEQ ID NO: 212534 - DNA, 103 bp, Artificial Sequence
  Synthetic Polynucleotide
taatacgactcactatagggatctcctgggcagtcttagtatactgactcaacagaggagagagtcaatgtactaagacaacctggcggcagcgcaaaagatg

SEQ ID NO: 212535 - DNA, 103 bp, Artificial Sequence
  Synthetic Polynucleotide
taatacgactcactataggggacgttcacaatctcctgggcagtcttagtaacagaggagaactaagatggcccaggagaacctggcggcagcgcaaaagatg

SEQ ID NO: 212536 - DNA, 103 bp, Artificial Sequence
  Synthetic Polynucleotide
taatacgactcactatagggtctggtaacagacgttcacaatctcctgggaacagaggagacccaggatgttgtgaacgaacctggcggcagcgcaaaagatg

SEQ ID NO: 212537 - DNA, 103 bp, Artificial Sequence
  Synthetic Polynucleotide
taatacgactcactatagggtcagtcaatgtctggtaacagacgttcacaaacagaggagatgtgaaatgctgttaccaaacctggcggcagcgcaaaagatg

SEQ ID NO: 212538 - DNA, 103 bp, Artificial Sequence
  Synthetic Polynucleotide
taatacgactcactatagggttcatcatactcagtcaatgtctggtaacaaacagaggagatgttacatgacattgactaacctggcggcagcgcaaaagatg

SEQ ID NO: 212539 - DNA, 103 bp, Artificial Sequence
  Synthetic Polynucleotide
taatacgactcactataggggagtcaaatgttcatcatactcagtcaatgaacagaggagacattgaatgagtatgatgaacctggcggcagcgcaaaagatg

SEQ ID NO: 212540 - DNA, 103 bp, Artificial Sequence
  Synthetic Polynucleotide
taatacgactcactatagggttctcaagttgagtcaaatgttcatcatacaacagaggagagtatgaatgacatttgacaacctggcggcagcgcaaaagatg

SEQ ID NO: 212541 - DNA, 103 bp, Artificial Sequence
  Synthetic Polynucleotide
taatacgactcactatagggcttatccttcttcattggtcccgggggtggaacagaggagaccacccatgggaccaatgaacctggcggcagcgcaaaagatg

SEQ ID NO: 212542 - DNA, 103 bp, Artificial Sequence
  Synthetic Polynucleotide
taatacgactcactatagggacaaatatccttctcaagttgagtcaaatgaacagaggagacatttgatgcaacttgagaacctggcggcagcgcaaaagatg

SEQ ID NO: 212543 - DNA, 103 bp, Artificial Sequence
  Synthetic Polynucleotide
taatacgactcactatagggctttagcagtacaaatatccttctcaagttaacagaggagaaacttgatgaggatatttaacctggcggcagcgcaaaagatg

SEQ ID NO: 212544 - DNA, 103 bp, Artificial Sequence
  Synthetic Polynucleotide
taatacgactcactatagggaaagctgcttctttagcagtacaaatatccaacagaggagaggatatatgtactgctaaaacctggcggcagcgcaaaagatg

SEQ ID NO: 212545 - DNA, 103 bp, Artificial Sequence
  Synthetic Polynucleotide
taatacgactcactatagggtgcttcctccaaagctgcttctttagcagtaacagaggagaactgctatggaagcagctaacctggcggcagcgcaaaagatg

SEQ ID NO: 212546 - DNA, 103 bp, Artificial Sequence
  Synthetic Polynucleotide
taatacgactcactatagggtttctaattctgcttcctccaaagctgcttaacagaggagaaagcagatgtggaggaagaacctggcggcagcgcaaaagatg

SEQ ID NO: 212547 - DNA, 103 bp, Artificial Sequence
  Synthetic Polynucleotide
taatacgactcactataggggggtccaggctttctaattctgcttcctccaacagaggagaggaggaatgagaattagaaacctggcggcagcgcaaaagatg

SEQ ID NO: 212548 - DNA, 103 bp, Artificial Sequence
  Synthetic Polynucleotide
taatacgactcactatagggtggggtcattgggtccaggctttctaattcaacagaggagagaattaatgagcctggacaacctggcggcagcgcaaaagatg

SEQ ID NO: 212549 - DNA, 103 bp, Artificial Sequence
  Synthetic Polynucleotide
taatacgactcactatagggtgtagggccctggggtcattgggtccaggcaacagaggagagcctggatgcaatgacccaacctggcggcagcgcaaaagatg

SEQ ID NO: 212550 - DNA, 103 bp, Artificial Sequence
  Synthetic Polynucleotide
taatacgactcactatagggggctgaggcgtgtagggccctggggtcattaacagaggagaaatgacatgagggccctaaacctggcggcagcgcaaaagatg

SEQ ID NO: 212551 - DNA, 103 bp, Artificial Sequence
  Synthetic Polynucleotide
taatacgactcactatagggcaaatcaggaggctgaggcgtgtagggcccaacagaggagagggcccatgacgcctcagaacctggcggcagcgcaaaagatg

SEQ ID NO: 212552 - DNA, 103 bp, Artificial Sequence
  Synthetic Polynucleotide
taatacgactcactatagggtgtctgacatgatggcggcagcagtgatggaacagaggagaccatcaatgctgccgccaaacctggcggcagcgcaaaagatg

SEQ ID NO: 212553 - DNA, 103 bp, Artificial Sequence
  Synthetic Polynucleotide
taatacgactcactatagggaatcctggtccttatccttcttcattggtcaacagaggagagaccaaatgagaaggataaacctggcggcagcgcaaaagatg

SEQ ID NO: 212554 - DNA, 103 bp, Artificial Sequence
  Synthetic Polynucleotide
taatacgactcactatagggtggtatcatacaaatcaggaggctgaggcgaacagaggagacgcctcatgctcctgattaacctggcggcagcgcaaaagatg

SEQ ID NO: 212555 - DNA, 103 bp, Artificial Sequence
  Synthetic Polynucleotide
taatacgactcactatagggagggatgtgttggtatcatacaaatcaggaaacagaggagatcctgaatggtatgatacaacctggcggcagcgcaaaagatg

SEQ ID NO: 212556 - DNA, 103 bp, Artificial Sequence
  Synthetic Polynucleotide
taatacgactcactatagggagacatactgagggatgtgttggtatcataaacagaggagatatgatatgaacacatccaacctggcggcagcgcaaaagatg

SEQ ID NO: 212557 - DNA, 103 bp, Artificial Sequence
  Synthetic Polynucleotide
taatacgactcactatagggaggcatctcgagacatactgagggatgtgtaacagaggagaacacatatgtcagtatgtaacctggcggcagcgcaaaagatg

SEQ ID NO: 212558 - DNA, 103 bp, Artificial Sequence
  Synthetic Polynucleotide
taatacgactcactatagggtgaaatacagaggcatctcgagacatactgaacagaggagacagtatatgtcgagatgcaacctggcggcagcgcaaaagatg

SEQ ID NO: 212559 - DNA, 103 bp, Artificial Sequence
  Synthetic Polynucleotide
taatacgactcactataggggctctcatcttgaaatacagaggcatctcgaacagaggagacgagatatgtctgtatttaacctggcggcagcgcaaaagatg

SEQ ID NO: 212560 - DNA, 103 bp, Artificial Sequence
  Synthetic Polynucleotide
taatacgactcactatagggcagacatattgctctcatcttgaaatacagaacagaggagactgtatatgaagatgagaaacctggcggcagcgcaaaagatg

SEQ ID NO: 212561 - DNA, 103 bp, Artificial Sequence
  Synthetic Polynucleotide
taatacgactcactatagggatatccaagacagacatattgctctcatctaacagaggagaagatgaatgcaatatgtcaacctggcggcagcgcaaaagatg

SEQ ID NO: 212562 - DNA, 103 bp, Artificial Sequence
  Synthetic Polynucleotide
taatacgactcactatagggggcactgggaatatccaagacagacatattaacagaggagaaatatgatggtcttggataacctggcggcagcgcaaaagatg

SEQ ID NO: 212563 - DNA, 103 bp, Artificial Sequence
  Synthetic Polynucleotide
taatacgactcactatagggtttctggagtggcactgggaatatccaagaaacagaggagatcttggatgttcccagtgaacctggcggcagcgcaaaagatg

SEQ ID NO: 212564 - DNA, 103 bp, Artificial Sequence
  Synthetic Polynucleotide
taatacgactcactatagggccagtaatagaatcctggtccttatccttcaacagaggagagaaggaatgggaccaggaaacctggcggcagcgcaaaagatg

SEQ ID NO: 212565 - DNA, 103 bp, Artificial Sequence
  Synthetic Polynucleotide
taatacgactcactataggggttacctgcttttctggagtggcactgggaaacagaggagatcccagatgcactccagaaacctggcggcagcgcaaaagatg

SEQ ID NO: 212566 - DNA, 103 bp, Artificial Sequence
  Synthetic Polynucleotide
taatacgactcactatagggaccttcctgtgttacctgcttttctggagtaacagaggagaactccaatgaagcaggtaaacctggcggcagcgcaaaagatg

SEQ ID NO: 212567 - DNA, 103 bp, Artificial Sequence
  Synthetic Polynucleotide
taatacgactcactatagggctccatcttcaccttcctgtgttacctgctaacagaggagaagcaggatgcacaggaagaacctggcggcagcgcaaaagatg

SEQ ID NO: 212568 - DNA, 103 bp, Artificial Sequence
  Synthetic Polynucleotide
taatacgactcactatagggagatcaccatctccatcttcaccttcctgtaacagaggagaacaggaatgtgaagatggaacctggcggcagcgcaaaagatg

SEQ ID NO: 212569 - DNA, 103 bp, Artificial Sequence
  Synthetic Polynucleotide
taatacgactcactatagggttcatctgcaagatcaccatctccatcttcaacagaggagagaagatatggatggtgataacctggcggcagcgcaaaagatg

SEQ ID NO: 212570 - DNA, 103 bp, Artificial Sequence
  Synthetic Polynucleotide
taatacgactcactatagggttccttcctcttcatctgcaagatcaccataacagaggagaatggtgatgttgcagatgaacctggcggcagcgcaaaagatg

SEQ ID NO: 212571 - DNA, 103 bp, Artificial Sequence
  Synthetic Polynucleotide
taatacgactcactatagggtgttgtacagttccttcctcttcatctgcaaacagaggagatgcagaatgagaggaaggaacctggcggcagcgcaaaagatg

SEQ ID NO: 212572 - DNA, 103 bp, Artificial Sequence
  Synthetic Polynucleotide
taatacgactcactatagggggcttgaggctgttgtacagttccttcctcaacagaggagagaggaaatgactgtacaaaacctggcggcagcgcaaaagatg

SEQ ID NO: 212573 - DNA, 103 bp, Artificial Sequence
  Synthetic Polynucleotide
taatacgactcactatagggacaggacactggcttgaggctgttgtacagaacagaggagactgtacatgagcctcaagaacctggcggcagcgcaaaagatg

SEQ ID NO: 212574 - DNA, 103 bp, Artificial Sequence
  Synthetic Polynucleotide
taatacgactcactatagggaaatcctcatacaggacactggcttgaggcaacagaggagagcctcaatgcagtgtcctaacctggcggcagcgcaaaagatg

SEQ ID NO: 212575 - DNA, 103 bp, Artificial Sequence
  Synthetic Polynucleotide
taatacgactcactatagggttcagacacaccagtaatagaatcctggtcaacagaggagagaccagatgtctattactaacctggcggcagcgcaaaagatg

SEQ ID NO: 212576 - DNA, 103 bp, Artificial Sequence
  Synthetic Polynucleotide
taatacgactcactatagggagacataagcaaatcctcatacaggacactaacagaggagaagtgtcatgtatgaggataacctggcggcagcgcaaaagatg

SEQ ID NO: 212577 - DNA, 103 bp, Artificial Sequence
  Synthetic Polynucleotide
taatacgactcactatagggcttctccttcagacataagcaaatcctcataacagaggagaatgaggatgtgcttatgtaacctggcggcagcgcaaaagatg

SEQ ID NO: 212578 - DNA, 103 bp, Artificial Sequence
  Synthetic Polynucleotide
taatacgactcactatagggtcctcatcatcttctccttcagacataagcaacagaggagagcttatatgtgaaggagaaacctggcggcagcgcaaaagatg

SEQ ID NO: 212579 - DNA, 103 bp, Artificial Sequence
  Synthetic Polynucleotide
taatacgactcactatagggcccagcatcttcctcatcatcttctccttcaacagaggagagaaggaatggatgatgagaacctggcggcagcgcaaaagatg

SEQ ID NO: 212580 - DNA, 103 bp, Artificial Sequence
  Synthetic Polynucleotide
taatacgactcactatagggcttcatcactcccagcatcttcctcatcataacagaggagaatgatgatgaagatgctgaacctggcggcagcgcaaaagatg

SEQ ID NO: 212581 - DNA, 103 bp, Artificial Sequence
  Synthetic Polynucleotide
taatacgactcactatagggttgtctccttcttcatcactcccagcatctaacagaggagaagatgcatggagtgatgaaacctggcggcagcgcaaaagatg

SEQ ID NO: 212582 - DNA, 103 bp, Artificial Sequence
  Synthetic Polynucleotide
taatacgactcactatagggagagaaaggattgtctccttcttcatcactaacagaggagaagtgatatggaaggagacaacctggcggcagcgcaaaagatg

SEQ ID NO: 212583 - DNA, 103 bp, Artificial Sequence
  Synthetic Polynucleotide
taatacgactcactataggggctggatagcagagaaaggattgtctccttaacagaggagaaaggagatgatcctttctaacctggcggcagcgcaaaagatg

SEQ ID NO: 212584 - DNA, 103 bp, Artificial Sequence
  Synthetic Polynucleotide
taatacgactcactatagggctttcactcagctggatagcagagaaaggaaacagaggagatcctttatgtgctatccaaacctggcggcagcgcaaaagatg

SEQ ID NO: 212585 - DNA, 103 bp, Artificial Sequence
  Synthetic Polynucleotide
taatacgactcactataggggtcacttccactttcactcagctggatagcaacagaggagagctatcatgctgagtgaaaacctggcggcagcgcaaaagatg

SEQ ID NO: 212586 - DNA, 103 bp, Artificial Sequence
  Synthetic Polynucleotide
taatacgactcactatagggcttctccattttcagacacaccagtaatagaacagaggagactattaatggtgtgtctgaacctggcggcagcgcaaaagatg

SEQ ID NO: 212587 - DNA, 103 bp, Artificial Sequence
  Synthetic Polynucleotide
taatacgactcactatagggccacatcagagtcacttccactttcactcaaacagaggagatgagtgatggtggaagtgaacctggcggcagcgcaaaagatg

SEQ ID NO: 212588 - DNA, 103 bp, Artificial Sequence
  Synthetic Polynucleotide
taatacgactcactatagggccaccagatcccacatcagagtcacttccaaacagaggagatggaagatgctctgatgtaacctggcggcagcgcaaaagatg

SEQ ID NO: 212589 - DNA, 103 bp, Artificial Sequence
  Synthetic Polynucleotide
taatacgactcactataggggggtcttattccaccagatcccacatcagaaacagaggagatctgatatgggatctggtaacctggcggcagcgcaaaagatg

SEQ ID NO: 212590 - DNA, 103 bp, Artificial Sequence
  Synthetic Polynucleotide
taatacgactcactatagggggggttgtttgggtcttattccaccagatcaacagaggagagatctgatggaataagacaacctggcggcagcgcaaaagatg

SEQ ID NO: 212591 - DNA, 103 bp, Artificial Sequence
  Synthetic Polynucleotide
taatacgactcactatagggtgaagcatgcggggttgtttgggtcttattaacagaggagaaataagatgcaaacaaccaacctggcggcagcgcaaaagatg

SEQ ID NO: 212592 - DNA, 103 bp, Artificial Sequence
  Synthetic Polynucleotide
taatacgactcactatagggtgtgttctcctgaagcatgcggggttgtttaacagaggagaaaacaaatgcgcatgcttaacctggcggcagcgcaaaagatg

SEQ ID NO: 212593 - DNA, 103 bp, Artificial Sequence
  Synthetic Polynucleotide
taatacgactcactatagggtgtccatccttgtgttctcctgaagcatgcaacagaggagagcatgcatgaggagaacaaacctggcggcagcgcaaaagatg

SEQ ID NO: 212594 - DNA, 103 bp, Artificial Sequence
  Synthetic Polynucleotide
taatacgactcactatagggtcattttccatgtccatccttgtgttctccaacagaggagaggagaaatgaaggatggaaacctggcggcagcgcaaaagatg

SEQ ID NO: 212595 - DNA, 103 bp, Artificial Sequence
  Synthetic Polynucleotide
taatacgactcactatagggcatgctttcttcattttccatgtccatcctaacagaggagaaggatgatgatggaaaataacctggcggcagcgcaaaagatg

SEQ ID NO: 212596 - DNA, 103 bp, Artificial Sequence
  Synthetic Polynucleotide
taatacgactcactatagggcataggacatcatgctttcttcattttccaaacagaggagatggaaaatgaagaaagcaaacctggcggcagcgcaaaagatg

SEQ ID NO: 212597 - DNA, 103 bp, Artificial Sequence
  Synthetic Polynucleotide
taatacgactcactatagggaagatgatgccttctccattttcagacacaaacagaggagatgtgtcatgaaatggagaaacctggcggcagcgcaaaagatg

SEQ ID NO: 212598 - DNA, 103 bp, Artificial Sequence
  Synthetic Polynucleotide
taatacgactcactatagggccgtctccctcataggacatcatgctttctaacagaggagaagaaagatggatgtcctaaacctggcggcagcgcaaaagatg

SEQ ID NO: 212599 - DNA, 103 bp, Artificial Sequence
  Synthetic Polynucleotide
taatacgactcactatagggagcctccccaccgtctccctcataggacataacagaggagaatgtccatggagggagacaacctggcggcagcgcaaaagatg

SEQ ID NO: 212600 - DNA, 103 bp, Artificial Sequence
  Synthetic Polynucleotide
taatacgactcactatagggaaccatgggaagcctccccaccgtctccctaacagaggagaagggagatggtggggaggaacctggcggcagcgcaaaagatg

SEQ ID NO: 212601 - DNA, 103 bp, Artificial Sequence
  Synthetic Polynucleotide
taatacgactcactatagggctatcctccaaaccatgggaagcctccccaaacagaggagatggggaatgttcccatggaacctggcggcagcgcaaaagatg

SEQ ID NO: 212602 - DNA, 103 bp, Artificial Sequence
  Synthetic Polynucleotide
taatacgactcactatagggactgatgttgctatcctccaaaccatgggaaacagaggagatcccatatgttggaggataacctggcggcagcgcaaaagatg

SEQ ID NO: 212603 - DNA, 103 bp, Artificial Sequence
  Synthetic Polynucleotide
taatacgactcactatagggagctcccataactgatgttgctatcctccaaacagaggagatggaggatggcaacatcaaacctggcggcagcgcaaaagatg

SEQ ID NO: 212604 - DNA, 103 bp, Artificial Sequence
  Synthetic Polynucleotide
taatacgactcactatagggggctcctcatagctcccataactgatgttgaacagaggagacaacatatgttatgggagaacctggcggcagcgcaaaagatg

SEQ ID NO: 212605 - DNA, 103 bp, Artificial Sequence
  Synthetic Polynucleotide
taatacgactcactatagggcttgggatcaggctcctcatagctcccataaacagaggagatatgggatgtatgaggagaacctggcggcagcgcaaaagatg

SEQ ID NO: 212606 - DNA, 103 bp, Artificial Sequence
  Synthetic Polynucleotide
taatacgactcactataggggggtgttcgacttgggatcaggctcctcataacagaggagaatgaggatgctgatcccaaacctggcggcagcgcaaaagatg

SEQ ID NO: 212607 - DNA, 103 bp, Artificial Sequence
  Synthetic Polynucleotide
taatacgactcactatagggcttgtgtcttgggtgttcgacttgggatcaaacagaggagatgatccatggtcgaacacaacctggcggcagcgcaaaagatg

SEQ ID NO: 212608 - DNA, 103 bp, Artificial Sequence
  Synthetic Polynucleotide
taatacgactcactataggggatggagggcaagatgatgccttctccattaacagaggagaaatggaatgggcatcatcaacctggcggcagcgcaaaagatg

SEQ ID NO: 212609 - DNA, 103 bp, Artificial Sequence
  Synthetic Polynucleotide
taatacgactcactataggggctgctgaagcttgtgtcttgggtgttcgaaacagaggagatcgaacatgcaagacacaaacctggcggcagcgcaaaagatg

SEQ ID NO: 212610 - DNA, 103 bp, Artificial Sequence
  Synthetic Polynucleotide
taatacgactcactatagggacccaccgatgctgctgaagcttgtgtcttaacagaggagaaagacaatggcttcagcaaacctggcggcagcgcaaaagatg

SEQ ID NO: 212611 - DNA, 103 bp, Artificial Sequence
  Synthetic Polynucleotide
taatacgactcactataggggatacctcatacccaccgatgctgctgaagaacagaggagacttcagatgcatcggtggaacctggcggcagcgcaaaagatg

SEQ ID NO: 212612 - DNA, 103 bp, Artificial Sequence
  Synthetic Polynucleotide
taatacgactcactatagggttcctcctctgatacctcatacccaccgataacagaggagaatcggtatgtatgaggtaaacctggcggcagcgcaaaagatg

SEQ ID NO: 212613 - DNA, 103 bp, Artificial Sequence
  Synthetic Polynucleotide
taatacgactcactatagggcctcatcttcttcctcctctgatacctcataacagaggagaatgaggatgcagaggaggaacctggcggcagcgcaaaagatg

SEQ ID NO: 212614 - DNA, 103 bp, Artificial Sequence
  Synthetic Polynucleotide
taatacgactcactatagggtcttcctcctcctcatcttcttcctcctctaacagaggagaagaggaatgagaagatgaaacctggcggcagcgcaaaagatg

SEQ ID NO: 212615 - DNA, 103 bp, Artificial Sequence
  Synthetic Polynucleotide
taatacgactcactatagggagagcgctgctcttcctcctcctcatcttcaacagaggagagaagatatggaggaggaaaacctggcggcagcgcaaaagatg

SEQ ID NO: 212616 - DNA, 103 bp, Artificial Sequence
  Synthetic Polynucleotide
taatacgactcactatagggcgctcggcccagagcgctgctcttcctcctaacagaggagaaggaggatgagcagcgctaacctggcggcagcgcaaaagatg

SEQ ID NO: 212617 - DNA, 103 bp, Artificial Sequence
  Synthetic Polynucleotide
taatacgactcactatagggtggcttagtacgctcggcccagagcgctgcaacagaggagagcagcgatgtgggccgagaacctggcggcagcgcaaaagatg

SEQ ID NO: 212618 - DNA, 103 bp, Artificial Sequence
  Synthetic Polynucleotide
taatacgactcactatagggcaggtggacctggcttagtacgctcggcccaacagaggagagggccgatggtactaagcaacctggcggcagcgcaaaagatg

SEQ ID NO: 212619 - DNA, 103 bp, Artificial Sequence
  Synthetic Polynucleotide
taatacgactcactatagggaaggggcaatgatggagggcaagatgatgcaacagaggagagcatcaatgtgccctccaaacctggcggcagcgcaaaagatg

SEQ ID NO: 212620 - DNA, 103 bp, Artificial Sequence
  Synthetic Polynucleotide
taatacgactcactatagggcgtcctctgacaggtggacctggcttagtaaacagaggagatactaaatgaggtccaccaacctggcggcagcgcaaaagatg

SEQ ID NO: 212621 - DNA, 103 bp, Artificial Sequence
  Synthetic Polynucleotide
taatacgactcactatagggctgtcctcctcgtcctctgacaggtggaccaacagaggagaggtccaatggtcagaggaaacctggcggcagcgcaaaagatg

SEQ ID NO: 212622 - DNA, 103 bp, Artificial Sequence
  Synthetic Polynucleotide
taatacgactcactataggggaaatcctcactgtcctcctcgtcctctgaaacagaggagatcagagatggaggaggacaacctggcggcagcgcaaaagatg

SEQ ID NO: 212623 - DNA, 103 bp, Artificial Sequence
  Synthetic Polynucleotide
taatacgactcactatagggcaatggagtggaaatcctcactgtcctcctaacagaggagaaggaggatggtgaggattaacctggcggcagcgcaaaagatg

SEQ ID NO: 212624 - DNA, 103 bp, Artificial Sequence
  Synthetic Polynucleotide
taatacgactcactatagggctgtccccagcaatggagtggaaatcctcaaacagaggagatgaggaatgccactccataacctggcggcagcgcaaaagatg

SEQ ID NO: 212625 - DNA, 103 bp, Artificial Sequence
  Synthetic Polynucleotide
taatacgactcactataggggtccaagtcactgtccccagcaatggagtgaacagaggagacactccatggctggggacaacctggcggcagcgcaaaagatg

SEQ ID NO: 212626 - DNA, 103 bp, Artificial Sequence
  Synthetic Polynucleotide
taatacgactcactatagggattcatcagagtccaagtcactgtccccagaacagaggagactggggatggtgacttggaacctggcggcagcgcaaaagatg

SEQ ID NO: 212627 - DNA, 103 bp, Artificial Sequence
  Synthetic Polynucleotide
taatacgactcactataggggccaaagaggaaggggcaatgatggagggcaacagaggagagccctcatgcattgccccaacctggcggcagcgcaaaagatg

SEQ ID NO: 212628 - DNA, 103 bp, Artificial Sequence
  Synthetic Polynucleotide
taatacgactcactatagggtttctctgaggccaaagaggaaggggcaataacagaggagaattgccatgtcctctttgaacctggcggcagcgcaaaagatg

SEQ ID NO: 212629 - DNA, 103 bp, Artificial Sequence
  Synthetic Polynucleotide
taatacgactcactatagggtgaagtccactttctctgaggccaaagaggaacagaggagacctcttatgcctcagagaaacctggcggcagcgcaaaagatg

SEQ ID NO: 212630 - DNA, 103 bp, Artificial Sequence
  Synthetic Polynucleotide
taatacgactcactatagggtcgctgtccgtgtctgacatgatggcggcaaacagaggagatgccgcatgcatgtcagaaacctggcggcagcgcaaaagatg

SEQ ID NO: 212631 - DNA, 103 bp, Artificial Sequence
  Synthetic Polynucleotide
taatacgactcactataggggaggaactactgaagtccactttctctgagaacagaggagactcagaatgagtggacttaacctggcggcagcgcaaaagatg

SEQ ID NO: 212632 - DNA, 103 bp, Artificial Sequence
  Synthetic Polynucleotide
taatacgactcactatagggttctgagtcagaggaactactgaagtccacaacagaggagagtggacatgagtagttccaacctggcggcagcgcaaaagatg

SEQ ID NO: 212633 - DNA, 103 bp, Artificial Sequence
  Synthetic Polynucleotide
taatacgactcactatagggccatctcagattctgagtcagaggaactacaacagaggagagtagttatgctgactcagaacctggcggcagcgcaaaagatg

SEQ ID NO: 212634 - DNA, 103 bp, Artificial Sequence
  Synthetic Polynucleotide
taatacgactcactatagggtcctgaggtcccatctcagattctgagtcaaacagaggagatgactcatgatctgagataacctggcggcagcgcaaaagatg

SEQ ID NO: 212635 - DNA, 103 bp, Artificial Sequence
  Synthetic Polynucleotide
taatacgactcactatagggctgtgttgcttcctgaggtcccatctcagaaacagaggagatctgagatgggacctcagaacctggcggcagcgcaaaagatg

SEQ ID NO: 212636 - DNA, 103 bp, Artificial Sequence
  Synthetic Polynucleotide
taatacgactcactatagggcagattctgcctgtgttgcttcctgaggtcaacagaggagagacctcatgaagcaacacaacctggcggcagcgcaaaagatg

SEQ ID NO: 212637 - DNA, 103 bp, Artificial Sequence
  Synthetic Polynucleotide
taatacgactcactatagggtttccatcttcagattctgcctgtgttgctaacagaggagaagcaacatgggcagaatcaacctggcggcagcgcaaaagatg

SEQ ID NO: 212638 - DNA, 103 bp, Artificial Sequence
  Synthetic Polynucleotide
taatacgactcactatagggaagggtcagctttccatcttcagattctgcaacagaggagagcagaaatggaagatggaaacctggcggcagcgcaaaagatg

SEQ ID NO: 212639 - DNA, 103 bp, Artificial Sequence
  Synthetic Polynucleotide
taatacgactcactatagggcagccaatggaagggtcagctttccatcttaacagaggagaaagatgatgagctgacccaacctggcggcagcgcaaaagatg

SEQ ID NO: 212640 - DNA, 103 bp, Artificial Sequence
  Synthetic Polynucleotide
taatacgactcactatagggtgcataatcccagccaatggaagggtcagcaacagaggagagctgacatgtccattggcaacctggcggcagcgcaaaagatg

SEQ ID NO: 212641 - DNA, 103 bp, Artificial Sequence
  Synthetic Polynucleotide
taatacgactcactatagggggaatcttcgtcgctgtccgtgtctgacataacagaggagaatgtcaatgacggacagcaacctggcggcagcgcaaaagatg

SEQ ID NO: 212642 - DNA, 103 bp, Artificial Sequence
  Synthetic Polynucleotide
taatacgactcactatagggggcatcatgctgcataatcccagccaatggaacagaggagaccattgatggggattatgaacctggcggcagcgcaaaagatg

SEQ ID NO: 212643 - DNA, 103 bp, Artificial Sequence
  Synthetic Polynucleotide
taatacgactcactatagggacagcttggtggcatcatgctgcataatccaacagaggagaggattaatgagcatgatgaacctggcggcagcgcaaaagatg

SEQ ID NO: 212644 - DNA, 103 bp, Artificial Sequence
  Synthetic Polynucleotide
taatacgactcactatagggacacttggcaacagcttggtggcatcatgcaacagaggagagcatgaatgcaccaagctaacctggcggcagcgcaaaagatg

SEQ ID NO: 212645 - DNA, 103 bp, Artificial Sequence
  Synthetic Polynucleotide
taatacgactcactatagggaagttctgtgacacttggcaacagcttggtaacagaggagaaccaagatgttgccaagtaacctggcggcagcgcaaaagatg

SEQ ID NO: 212646 - DNA, 103 bp, Artificial Sequence
  Synthetic Polynucleotide
taatacgactcactatagggattctggaaaaagttctgtgacacttggcaaacagaggagatgccaaatgtcacagaacaacctggcggcagcgcaaaagatg

SEQ ID NO: 212647 - DNA, 103 bp, Artificial Sequence
  Synthetic Polynucleotide
taatacgactcactatagggccaggtcgaaattctggaaaaagttctgtgaacagaggagacacagaatgttttccagaaacctggcggcagcgcaaaagatg

SEQ ID NO: 212648 - DNA, 103 bp, Artificial Sequence
  Synthetic Polynucleotide
taatacgactcactatagggtaacacctttccaggtcgaaattctggaaaaacagaggagatttccaatgtttcgacctaacctggcggcagcgcaaaagatg

SEQ ID NO: 212649 - DNA, 103 bp, Artificial Sequence
  Synthetic Polynucleotide
taatacgactcactataggggtagaaaacgtaacacctttccaggtcgaaaacagaggagattcgacatggaaaggtgtaacctggcggcagcgcaaaagatg

SEQ ID NO: 212650 - DNA, 103 bp, Artificial Sequence
  Synthetic Polynucleotide
taatacgactcactatagggccaaaaagacgtagaaaacgtaacacctttaacagaggagaaaaggtatgacgttttctaacctggcggcagcgcaaaagatg

SEQ ID NO: 212651 - DNA, 103 bp, Artificial Sequence
  Synthetic Polynucleotide
taatacgactcactatagggcttccctggtccaaaaagacgtagaaaacgaacagaggagacgttttatgcgtctttttaacctggcggcagcgcaaaagatg

SEQ ID NO: 212652 - DNA, 103 bp, Artificial Sequence
  Synthetic Polynucleotide
taatacgactcactatagggcgcctccagcggaatcttcgtcgctgtccgaacagaggagacggacaatgacgaagattaacctggcggcagcgcaaaagatg

SEQ ID NO: 212653 - DNA, 103 bp, Artificial Sequence
  Synthetic Polynucleotide
taatacgactcactatagggatgggacattcttccctggtccaaaaagacaacagaggagagtctttatggaccagggaaacctggcggcagcgcaaaagatg

SEQ ID NO: 212654 - DNA, 103 bp, Artificial Sequence
  Synthetic Polynucleotide
taatacgactcactatagggcgccaaacagatgggacattcttccctggtaacagaggagaaccaggatggaatgtcccaacctggcggcagcgcaaaagatg

SEQ ID NO: 212655 - DNA, 103 bp, Artificial Sequence
  Synthetic Polynucleotide
taatacgactcactatagggccgagcactccgccaaacagatgggacattaacagaggagaaatgtcatgtctgtttggaacctggcggcagcgcaaaagatg

SEQ ID NO: 212656 - DNA, 103 bp, Artificial Sequence
  Synthetic Polynucleotide
taatacgactcactatagggtcctctttctccgagcactccgccaaacagaacagaggagactgtttatgggagtgctcaacctggcggcagcgcaaaagatg

SEQ ID NO: 212657 - DNA, 103 bp, Artificial Sequence
  Synthetic Polynucleotide
taatacgactcactatagggtgcttcttcttcctctttctccgagcactcaacagaggagagagtgcatggagaaagagaacctggcggcagcgcaaaagatg

SEQ ID NO: 212658 - DNA, 103 bp, Artificial Sequence
  Synthetic Polynucleotide
taatacgactcactatagggcagctcacggtgcttcttcttcctctttctaacagaggagaagaaagatgaagaagaagaacctggcggcagcgcaaaagatg

SEQ ID NO: 212659 - DNA, 103 bp, Artificial Sequence
  Synthetic Polynucleotide
taatacgactcactatagggcttcctgtatcagctcacggtgcttcttctaacagaggagaagaagaatgaccgtgagcaacctggcggcagcgcaaaagatg

SEQ ID NO: 212660 - DNA, 103 bp, Artificial Sequence
  Synthetic Polynucleotide
taatacgactcactatagggtggatctgctcttcctgtatcagctcacggaacagaggagaccgtgaatggatacaggaaacctggcggcagcgcaaaagatg

SEQ ID NO: 212661 - DNA, 103 bp, Artificial Sequence
  Synthetic Polynucleotide
taatacgactcactatagggctccacctcctggatctgctcttcctgtataacagaggagaatacagatggagcagatcaacctggcggcagcgcaaaagatg

SEQ ID NO: 212662 - DNA, 103 bp, Artificial Sequence
  Synthetic Polynucleotide
taatacgactcactatagggctactgagcactccacctcctggatctgctaacagaggagaagcagaatgaggaggtggaacctggcggcagcgcaaaagatg

SEQ ID NO: 212663 - DNA, 103 bp, Artificial Sequence
  Synthetic Polynucleotide
taatacgactcactataggggaaaatgggccgcctccagcggaatcttcgaacagaggagacgaagaatgcgctggaggaacctggcggcagcgcaaaagatg

SEQ ID NO: 212664 - DNA, 103 bp, Artificial Sequence
  Synthetic Polynucleotide
taatacgactcactatagggacttctgattctactgagcactccacctccaacagaggagaggaggtatggtgctcagtaacctggcggcagcgcaaaagatg

SEQ ID NO: 212665 - DNA, 103 bp, Artificial Sequence
  Synthetic Polynucleotide
taatacgactcactatagggcttctggctgacttctgattctactgagcaaacagaggagatgctcaatggaatcagaaaacctggcggcagcgcaaaagatg

SEQ ID NO: 212666 - DNA, 103 bp, Artificial Sequence
  Synthetic Polynucleotide
taatacgactcactatagggtccacaaagacttctggctgacttctgattaacagaggagaaatcagatgtcagccagaaacctggcggcagcgcaaaagatg

SEQ ID NO: 212667 - DNA, 103 bp, Artificial Sequence
  Synthetic Polynucleotide
taatacgactcactatagggtagtcgtagttccacaaagacttctggctgaacagaggagacagccaatggtctttgtgaacctggcggcagcgcaaaagatg

SEQ ID NO: 212668 - DNA, 103 bp, Artificial Sequence
  Synthetic Polynucleotide
taatacgactcactatagggtggtggagcgtagtcgtagttccacaaagaaacagaggagatctttgatgaactacgacaacctggcggcagcgcaaaagatg

SEQ ID NO: 212669 - DNA, 103 bp, Artificial Sequence
  Synthetic Polynucleotide
taatacgactcactatagggctggaggtggtggtggagcgtagtcgtagtaacagaggagaactacgatgacgctccacaacctggcggcagcgcaaaagatg

SEQ ID NO: 212670 - DNA, 103 bp, Artificial Sequence
  Synthetic Polynucleotide
taatacgactcactatagggagacactgctctggaggtggtggtggagcgaacagaggagacgctccatgaccacctccaacctggcggcagcgcaaaagatg

SEQ ID NO: 212671 - DNA, 103 bp, Artificial Sequence
  Synthetic Polynucleotide
taatacgactcactatagggatcatcagagagacactgctctggaggtggaacagaggagaccacctatggagcagtgtaacctggcggcagcgcaaaagatg

SEQ ID NO: 212672 - DNA, 103 bp, Artificial Sequence
  Synthetic Polynucleotide
taatacgactcactatagggtcgtgatttcatcatcagagagacactgctaacagaggagaagcagtatgtctctgatgaacctggcggcagcgcaaaagatg

SEQ ID NO: 212673 - DNA, 103 bp, Artificial Sequence
  Synthetic Polynucleotide
taatacgactcactatagggggagccatcatcgtgatttcatcatcagagaacagaggagactctgaatgtgaaatcacaacctggcggcagcgcaaaagatg

SEQ ID NO: 212674 - DNA, 103 bp, Artificial Sequence
  Synthetic Polynucleotide
taatacgactcactatagggtttaaactcttccgcctcctcgaggtccataacagaggagaatggacatggaggaggcgaacctggcggcagcgcaaaagatg

SEQ ID NO: 212675 - DNA, 103 bp, Artificial Sequence
  Synthetic Polynucleotide
taatacgactcactatagggtctctctgtaacattgtggcaagaagtgcaaacagaggagatgcactatgtgccacaataacctggcggcagcgcaaaagatg

SEQ ID NO: 212676 - DNA, 103 bp, Artificial Sequence
  Synthetic Polynucleotide
taatacgactcactatagggcagaaaatccacttctcccattccagtcataacagaggagaatgactatgatgggagaaaacctggcggcagcgcaaaagatg

SEQ ID NO: 212677 - DNA, 103 bp, Artificial Sequence
  Synthetic Polynucleotide
taatacgactcactataggggatcaaatgtcagaaaatccacttctcccaaacagaggagatgggagatgtggattttcaacctggcggcagcgcaaaagatg

SEQ ID NO: 212678 - DNA, 103 bp, Artificial Sequence
  Synthetic Polynucleotide
taatacgactcactatagggttagctataggatcaaatgtcagaaaatccaacagaggagaggatttatggacatttgaaacctggcggcagcgcaaaagatg

SEQ ID NO: 212679 - DNA, 103 bp, Artificial Sequence
  Synthetic Polynucleotide
taatacgactcactatagggttttgccattttagctataggatcaaatgtaacagaggagaacatttatgcctatagctaacctggcggcagcgcaaaagatg

SEQ ID NO: 212680 - DNA, 103 bp, Artificial Sequence
  Synthetic Polynucleotide
taatacgactcactatagggacttaacagtttttgccattttagctatagaacagaggagactatagatgaaatggcaaaacctggcggcagcgcaaaagatg

SEQ ID NO: 212681 - DNA, 103 bp, Artificial Sequence
  Synthetic Polynucleotide
taatacgactcactatagggtgtacatcgtacttaacagtttttgccattaacagaggagaaatggcatgaactgttaaaacctggcggcagcgcaaaagatg

SEQ ID NO: 212682 - DNA, 103 bp, Artificial Sequence
  Synthetic Polynucleotide
taatacgactcactatagggagctacagcttgtacatcgtacttaacagtaacagaggagaactgttatgtacgatgtaaacctggcggcagcgcaaaagatg

SEQ ID NO: 212683 - DNA, 103 bp, Artificial Sequence
  Synthetic Polynucleotide
taatacgactcactatagggccacaatgatagctacagcttgtacatcgtaacagaggagaacgatgatgaagctgtagaacctggcggcagcgcaaaagatg

SEQ ID NO: 212684 - DNA, 103 bp, Artificial Sequence
  Synthetic Polynucleotide
taatacgactcactatagggttcaataccaccacaatgatagctacagctaacagaggagaagctgtatgtatcattgtaacctggcggcagcgcaaaagatg

SEQ ID NO: 212685 - DNA, 103 bp, Artificial Sequence
  Synthetic Polynucleotide
taatacgactcactatagggaaagagcagtttcaataccaccacaatgataacagaggagaatcattatggtggtattgaacctggcggcagcgcaaaagatg

SEQ ID NO: 212686 - DNA, 103 bp, Artificial Sequence
  Synthetic Polynucleotide
taatacgactcactatagggcttcctgatatctctctgtaacattgtggcaacagaggagagccacaatgttacagagaaacctggcggcagcgcaaaagatg

SEQ ID NO: 212687 - DNA, 103 bp, Artificial Sequence
  Synthetic Polynucleotide
taatacgactcactatagggcatccaatagaaagagcagtttcaataccaaacagaggagatggtatatgaactgctctaacctggcggcagcgcaaaagatg

SEQ ID NO: 212688 - DNA, 103 bp, Artificial Sequence
  Synthetic Polynucleotide
taatacgactcactatagggtcgaaactgtcatccaatagaaagagcagtaacagaggagaactgctatgtctattggaaacctggcggcagcgcaaaagatg

SEQ ID NO: 212689 - DNA, 103 bp, Artificial Sequence
  Synthetic Polynucleotide
taatacgactcactatagggcaaagaccactcgaaactgtcatccaatagaacagaggagactattgatggacagtttcaacctggcggcagcgcaaaagatg

SEQ ID NO: 212690 - DNA, 103 bp, Artificial Sequence
  Synthetic Polynucleotide
taatacgactcactatagggcaagattagacaaagaccactcgaaactgtaacagaggagaacagttatgagtggtcttaacctggcggcagcgcaaaagatg

SEQ ID NO: 212691 - DNA, 103 bp, Artificial Sequence
  Synthetic Polynucleotide
taatacgactcactatagggtgcttttcagcaagattagacaaagaccacaacagaggagagtggtcatggtctaatctaacctggcggcagcgcaaaagatg

SEQ ID NO: 212692 - DNA, 103 bp, Artificial Sequence
  Synthetic Polynucleotide
taatacgactcactatagggcttttcattatgcttttcagcaagattagaaacagaggagatctaatatggctgaaaagaacctggcggcagcgcaaaagatg

SEQ ID NO: 212693 - DNA, 103 bp, Artificial Sequence
  Synthetic Polynucleotide
taatacgactcactatagggcttttttgttcttttcattatgcttttcagaacagaggagactgaaaatgataatgaaaaacctggcggcagcgcaaaagatg

SEQ ID NO: 212694 - DNA, 103 bp, Artificial Sequence
  Synthetic Polynucleotide
taatacgactcactatagggcatggcttatcttttttgttcttttcattaaacagaggagataatgaatggaacaaaaaaacctggcggcagcgcaaaagatg

SEQ ID NO: 212695 - DNA, 103 bp, Artificial Sequence
  Synthetic Polynucleotide
taatacgactcactataggggaaatcaaaccatggcttatcttttttgttaacagaggagaaacaaaatggataagccaaacctggcggcagcgcaaaagatg

SEQ ID NO: 212696 - DNA, 103 bp, Artificial Sequence
  Synthetic Polynucleotide
taatacgactcactatagggaccactttctgaaatcaaaccatggcttataacagaggagaataagcatgggtttgattaacctggcggcagcgcaaaagatg

SEQ ID NO: 212697 - DNA, 103 bp, Artificial Sequence
  Synthetic Polynucleotide
taatacgactcactataggggtgtttgtaacttcctgatatctctctgtaaacagaggagatacagaatgatatcaggaaacctggcggcagcgcaaaagatg

SEQ ID NO: 212698 - DNA, 103 bp, Artificial Sequence
  Synthetic Polynucleotide
taatacgactcactatagggataatttggtaccactttctgaaatcaaacaacagaggagagtttgaatgcagaaagtgaacctggcggcagcgcaaaagatg

SEQ ID NO: 212699 - DNA, 103 bp, Artificial Sequence
  Synthetic Polynucleotide
taatacgactcactatagggagctttcttcataatttggtaccactttctaacagaggagaagaaagatgtaccaaattaacctggcggcagcgcaaaagatg

SEQ ID NO: 212700 - DNA, 103 bp, Artificial Sequence
  Synthetic Polynucleotide
taatacgactcactatagggtctcatcaaaagctttcttcataatttggtaacagaggagaaccaaaatgtgaagaaagaacctggcggcagcgcaaaagatg

SEQ ID NO: 212701 - DNA, 103 bp, Artificial Sequence
  Synthetic Polynucleotide
taatacgactcactatagggttttgttttttctcatcaaaagctttcttcaacagaggagagaagaaatgttttgatgaaacctggcggcagcgcaaaagatg

SEQ ID NO: 212702 - DNA, 103 bp, Artificial Sequence
  Synthetic Polynucleotide
taatacgactcactatagggttcttcccatttttgttttttctcatcaaaaacagaggagatttgatatgaaaaaacaaaacctggcggcagcgcaaaagatg

SEQ ID NO: 212703 - DNA, 103 bp, Artificial Sequence
  Synthetic Polynucleotide
taatacgactcactatagggtggcccttgcttcttcccatttttgtttttaacagaggagaaaaaacatgaatgggaagaacctggcggcagcgcaaaagatg

SEQ ID NO: 212704 - DNA, 103 bp, Artificial Sequence
  Synthetic Polynucleotide
taatacgactcactatagggcacaggtacttggcccttgcttcttcccataacagaggagaatgggaatgagcaagggcaacctggcggcagcgcaaaagatg

SEQ ID NO: 212705 - DNA, 103 bp, Artificial Sequence
  Synthetic Polynucleotide
taatacgactcactatagggttcacttttccacaggtacttggcccttgcaacagaggagagcaaggatgaagtacctgaacctggcggcagcgcaaaagatg

SEQ ID NO: 212706 - DNA, 103 bp, Artificial Sequence
  Synthetic Polynucleotide
taatacgactcactatagggagagtggcttttcacttttccacaggtactaacagaggagaagtaccatgggaaaagtgaacctggcggcagcgcaaaagatg

SEQ ID NO: 212707 - DNA, 103 bp, Artificial Sequence
  Synthetic Polynucleotide
taatacgactcactatagggaatgagtagtagagtggcttttcacttttcaacagaggagagaaaagatgaaagccactaacctggcggcagcgcaaaagatg

SEQ ID NO: 212708 - DNA, 103 bp, Artificial Sequence
  Synthetic Polynucleotide
taatacgactcactatagggaataagatcagtgtttgtaacttcctgataaacagaggagatatcagatggttacaaacaacctggcggcagcgcaaaagatg

SEQ ID NO: 212709 - DNA, 103 bp, Artificial Sequence
  Synthetic Polynucleotide
taatacgactcactatagggtttgtcgacaaatgagtagtagagtggcttaacagaggagaaagccaatgtactactcaaacctggcggcagcgcaaaagatg

SEQ ID NO: 212710 - DNA, 103 bp, Artificial Sequence
  Synthetic Polynucleotide
taatacgactcactatagggatgctactggtttgtcgacaaatgagtagtaacagaggagaactactatgttgtcgacaaacctggcggcagcgcaaaagatg

SEQ ID NO: 212711 - DNA, 103 bp, Artificial Sequence
  Synthetic Polynucleotide
taatacgactcactatagggctttttttatatgctactggtttgtcgacaaacagaggagatgtcgaatgaccagtagcaacctggcggcagcgcaaaagatg

SEQ ID NO: 212712 - DNA, 103 bp, Artificial Sequence
  Synthetic Polynucleotide
taatacgactcactatagggcaccatttctctttttttatatgctactggaacagaggagaccagtaatgtataaaaaaaacctggcggcagcgcaaaagatg

SEQ ID NO: 212713 - DNA, 103 bp, Artificial Sequence
  Synthetic Polynucleotide
taatacgactcactataggggtagattcaccaccatttctctttttttataacagaggagaataaaaatggagaaatggaacctggcggcagcgcaaaagatg

SEQ ID NO: 212714 - DNA, 103 bp, Artificial Sequence
  Synthetic Polynucleotide
taatacgactcactatagggaattgtttctgtagattcaccaccatttctaacagaggagaagaaatatgggtgaatctaacctggcggcagcgcaaaagatg

SEQ ID NO: 212715 - DNA, 103 bp, Artificial Sequence
  Synthetic Polynucleotide
taatacgactcactatagggcagtgtgctaaattgtttctgtagattcacaacagaggagagtgaatatgcagaaacaaaacctggcggcagcgcaaaagatg

SEQ ID NO: 212716 - DNA, 103 bp, Artificial Sequence
  Synthetic Polynucleotide
taatacgactcactatagggttgactcgaccagtgtgctaaattgtttctaacagaggagaagaaacatgttagcacacaacctggcggcagcgcaaaagatg

SEQ ID NO: 212717 - DNA, 103 bp, Artificial Sequence
  Synthetic Polynucleotide
taatacgactcactataggggcagttgctgttgactcgaccagtgtgctaaacagaggagatagcacatgggtcgagtcaacctggcggcagcgcaaaagatg

SEQ ID NO: 212718 - DNA, 103 bp, Artificial Sequence
  Synthetic Polynucleotide
taatacgactcactatagggtttttttccagcagttgctgttgactcgacaacagaggagagtcgagatgacagcaactaacctggcggcagcgcaaaagatg

SEQ ID NO: 212719 - DNA, 103 bp, Artificial Sequence
  Synthetic Polynucleotide
taatacgactcactataggggggtattaggaataagatcagtgtttgtaaaacagaggagattacaaatgctgatcttaaacctggcggcagcgcaaaagatg

SEQ ID NO: 212720 - DNA, 103 bp, Artificial Sequence
  Synthetic Polynucleotide
taatacgactcactatagggttgaagggcttttttttccagcagttgctgaacagaggagacagcaaatgctggaaaaaaacctggcggcagcgcaaaagatg

SEQ ID NO: 212721 - DNA, 103 bp, Artificial Sequence
  Synthetic Polynucleotide
taatacgactcactatagggaactgaaaacttgaagggcttttttttccaaacagaggagatggaaaatgaagcccttcaacctggcggcagcgcaaaagatg

SEQ ID NO: 212722 - DNA, 103 bp, Artificial Sequence
  Synthetic Polynucleotide
taatacgactcactatagggagtccagttgaactgaaaacttgaagggctaacagaggagaagccctatgagttttcagaacctggcggcagcgcaaaagatg

SEQ ID NO: 212723 - DNA, 103 bp, Artificial Sequence
  Synthetic Polynucleotide
taatacgactcactatagggtgtcctcttcagtccagttgaactgaaaacaacagaggagagttttcatgtcaactggaaacctggcggcagcgcaaaagatg

SEQ ID NO: 212724 - DNA, 103 bp, Artificial Sequence
  Synthetic Polynucleotide
taatacgactcactataggggttctatcagtgtcctcttcagtccagttgaacagaggagacaactgatgtgaagaggaaacctggcggcagcgcaaaagatg

SEQ ID NO: 212725 - DNA, 103 bp, Artificial Sequence
  Synthetic Polynucleotide
taatacgactcactatagggatggaaacacgttctatcagtgtcctcttcaacagaggagagaagagatgactgatagaaacctggcggcagcgcaaaagatg

SEQ ID NO: 212726 - DNA, 103 bp, Artificial Sequence
  Synthetic Polynucleotide
taatacgactcactatagggggctgtgtccatggaaacacgttctatcagaacagaggagactgataatgcgtgtttccaacctggcggcagcgcaaaagatg

SEQ ID NO: 212727 - DNA, 103 bp, Artificial Sequence
  Synthetic Polynucleotide
taatacgactcactatagggactccctgaaggctgtgtccatggaaacacaacagaggagagtgtttatgtggacacagaacctggcggcagcgcaaaagatg

SEQ ID NO: 212728 - DNA, 103 bp, Artificial Sequence
  Synthetic Polynucleotide
taatacgactcactatagggctctttcaggactccctgaaggctgtgtccaacagaggagaggacacatgcttcagggaaacctggcggcagcgcaaaagatg

SEQ ID NO: 212729 - DNA, 103 bp, Artificial Sequence
  Synthetic Polynucleotide
taatacgactcactatagggattggcctttctctttcaggactccctgaaaacagaggagattcaggatgtcctgaaagaacctggcggcagcgcaaaagatg

SEQ ID NO: 212730 - DNA, 103 bp, Artificial Sequence
  Synthetic Polynucleotide
taatacgactcactataggggcttttatttgggtattaggaataagatcaaacagaggagatgatctatgtcctaatacaacctggcggcagcgcaaaagatg

SEQ ID NO: 212731 - DNA, 103 bp, Artificial Sequence
  Synthetic Polynucleotide
taatacgactcactataggggtcagcagtgattggcctttctctttcaggaacagaggagacctgaaatggaaaggccaaacctggcggcagcgcaaaagatg

SEQ ID NO: 212732 - DNA, 103 bp, Artificial Sequence
  Synthetic Polynucleotide
taatacgactcactatagggtgaattcttagtcagcagtgattggcctttaacagaggagaaaaggcatgtcactgctgaacctggcggcagcgcaaaagatg

SEQ ID NO: 212733 - DNA, 103 bp, Artificial Sequence
  Synthetic Polynucleotide
taatacgactcactataggggccaatataatgaattcttagtcagcagtgaacagaggagacactgcatgctaagaattaacctggcggcagcgcaaaagatg

SEQ ID NO: 212734 - DNA, 103 bp, Artificial Sequence
  Synthetic Polynucleotide
taatacgactcactatagggtgtgtactaagccaatataatgaattcttaaacagaggagataagaaatgattatattgaacctggcggcagcgcaaaagatg

SEQ ID NO: 212735 - DNA, 103 bp, Artificial Sequence
  Synthetic Polynucleotide
taatacgactcactataggggcagaatttctgtgtactaagccaatataaaacagaggagattatatatgcttagtacaaacctggcggcagcgcaaaagatg

SEQ ID NO: 212736 - DNA, 103 bp, Artificial Sequence
  Synthetic Polynucleotide
taatacgactcactatagggaatagcatctgcagaatttctgtgtactaaaacagaggagattagtaatgagaaattctaacctggcggcagcgcaaaagatg

SEQ ID NO: 212737 - DNA, 103 bp, Artificial Sequence
  Synthetic Polynucleotide
taatacgactcactatagggacatgtgtacaatagcatctgcagaatttcaacagaggagagaaattatgcagatgctaaacctggcggcagcgcaaaagatg

SEQ ID NO: 212738 - DNA, 103 bp, Artificial Sequence
  Synthetic Polynucleotide
taatacgactcactatagggataggttgtcacatgtgtacaatagcatctaacagaggagaagatgcatgtgtacacataacctggcggcagcgcaaaagatg

SEQ ID NO: 212739 - DNA, 103 bp, Artificial Sequence
  Synthetic Polynucleotide
taatacgactcactatagggttgattcttcataggttgtcacatgtgtacaacagaggagagtacacatgtgacaacctaacctggcggcagcgcaaaagatg

SEQ ID NO: 212740 - DNA, 103 bp, Artificial Sequence
  Synthetic Polynucleotide
taatacgactcactatagggagagaataatttgattcttcataggttgtcaacagaggagagacaacatgtgaagaatcaacctggcggcagcgcaaaagatg

SEQ ID NO: 212741 - DNA, 103 bp, Artificial Sequence
  Synthetic Polynucleotide
taatacgactcactatagggccggttgagggcttttatttgggtattaggaacagaggagacctaatatgcaaataaaaaacctggcggcagcgcaaaagatg

SEQ ID NO: 212742 - DNA, 103 bp, Artificial Sequence
  Synthetic Polynucleotide
taatacgactcactatagggctgataactcagagaataatttgattcttcaacagaggagagaagaaatgaattattctaacctggcggcagcgcaaaagatg

SEQ ID NO: 212743 - DNA, 103 bp, Artificial Sequence
  Synthetic Polynucleotide
taatacgactcactatagggttagtataaactgataactcagagaataataacagaggagaattattatgtgagttatcaacctggcggcagcgcaaaagatg

SEQ ID NO: 212744 - DNA, 103 bp, Artificial Sequence
  Synthetic Polynucleotide
taatacgactcactataggggagaagagatttagtataaactgataactcaacagaggagagagttaatggtttatactaacctggcggcagcgcaaaagatg

SEQ ID NO: 212745 - DNA, 103 bp, Artificial Sequence
  Synthetic Polynucleotide
taatacgactcactataggggagcaggaaggagaagagatttagtataaaaacagaggagatttataatgaatctcttcaacctggcggcagcgcaaaagatg

SEQ ID NO: 212746 - DNA, 103 bp, Artificial Sequence
  Synthetic Polynucleotide
taatacgactcactatagggtctttattctgagcaggaaggagaagagataacagaggagaatctctatgccttcctgcaacctggcggcagcgcaaaagatg

SEQ ID NO: 212747 - DNA, 103 bp, Artificial Sequence
  Synthetic Polynucleotide
taatacgactcactatagggagaagggaagtctttattctgagcaggaagaacagaggagacttcctatgcagaataaaaacctggcggcagcgcaaaagatg

SEQ ID NO: 212748 - DNA, 103 bp, Artificial Sequence
  Synthetic Polynucleotide
taatacgactcactatagggttcttcatggagaagggaagtctttattctaacagaggagaagaataatgacttcccttaacctggcggcagcgcaaaagatg

SEQ ID NO: 212749 - DNA, 103 bp, Artificial Sequence
  Synthetic Polynucleotide
taatacgactcactatagggctaagctcacttcttcatggagaagggaagaacagaggagacttcccatgtccatgaagaacctggcggcagcgcaaaagatg

SEQ ID NO: 212750 - DNA, 103 bp, Artificial Sequence
  Synthetic Polynucleotide
taatacgactcactatagggttcttctcaactaagctcacttcttcatggaacagaggagaccatgaatgagtgagcttaacctggcggcagcgcaaaagatg

SEQ ID NO: 212751 - DNA, 103 bp, Artificial Sequence
  Synthetic Polynucleotide
taatacgactcactatagggctcaaaaagtttcttctcaactaagctcacaacagaggagagtgagcatggttgagaagaacctggcggcagcgcaaaagatg

SEQ ID NO: 212752 - DNA, 103 bp, Artificial Sequence
  Synthetic Polynucleotide
taatacgactcactatagggttttaagcccccggttgagggcttttatttaacagaggagaaaataaatgccctcaaccaacctggcggcagcgcaaaagatg

SEQ ID NO: 212753 - DNA, 103 bp, Artificial Sequence
  Synthetic Polynucleotide
taatacgactcactatagggtgtattttttctcaaaaagtttcttctcaaaacagaggagattgagaatgaactttttgaacctggcggcagcgcaaaagatg

SEQ ID NO: 212754 - DNA, 103 bp, Artificial Sequence
  Synthetic Polynucleotide
taatacgactcactatagggctttttacactgtattttttctcaaaaagtaacagaggagaacttttatggaaaaaataaacctggcggcagcgcaaaagatg

SEQ ID NO: 212755 - DNA, 103 bp, Artificial Sequence
  Synthetic Polynucleotide
taatacgactcactatagggtgatttctttctttttacactgtattttttaacagaggagaaaaaaaatgagtgtaaaaaacctggcggcagcgcaaaagatg

SEQ ID NO: 212756 - DNA, 103 bp, Artificial Sequence
  Synthetic Polynucleotide
taatacgactcactatagggtcttggatcttgatttctttctttttacacaacagaggagagtgtaaatggaaagaaataacctggcggcagcgcaaaagatg

SEQ ID NO: 212757 - DNA, 103 bp, Artificial Sequence
  Synthetic Polynucleotide
taatacgactcactatagggcgtctcactttcttggatcttgatttctttaacagaggagaaaagaaatgaagatccaaaacctggcggcagcgcaaaagatg

SEQ ID NO: 212758 - DNA, 103 bp, Artificial Sequence
  Synthetic Polynucleotide
taatacgactcactatagggttgtttttttttttaagcccccggttgaggaacagaggagacctcaaatgggggcttaaaacctggcggcagcgcaaaagatg

SEQ ID NO: 212759 - DNA, 103 bp, Artificial Sequence
  Synthetic Polynucleotide
taatacgactcactatagggtttttcagtattgtttttttttttaagcccaacagaggagagggcttatgaaaaaaaacaacctggcggcagcgcaaaagatg

SEQ ID NO: 212760 - DNA, 103 bp, Artificial Sequence
  Synthetic Polynucleotide
taatacgactcactatagggtacagcgttctttaaactcttccgcctcctaacagaggagaaggaggatgaagagtttaaacctggcggcagcgcaaaagatg

SEQ ID NO: 212761 - DNA, 103 bp, Artificial Sequence
  Synthetic Polynucleotide
taatacgactcactatagggaatcccagcctttttcagtattgtttttttaacagaggagaaaaaaaatgatactgaaaaacctggcggcagcgcaaaagatg

SEQ ID NO: 212762 - DNA, 103 bp, Artificial Sequence
  Synthetic Polynucleotide
taatacgactcactatagggcacacataccaatcccagcctttttcagtaaacagaggagatactgaatgaggctgggaaacctggcggcagcgcaaaagatg

SEQ ID NO: 212763 - DNA, 103 bp, Artificial Sequence
  Synthetic Polynucleotide
taatacgactcactataggggaaaccttcacacacataccaatcccagccaacagaggagaggctggatgtggtatgtgaacctggcggcagcgcaaaagatg

SEQ ID NO: 212764 - DNA, 103 bp, Artificial Sequence
  Synthetic Polynucleotide
taatacgactcactataggggaatatactggaaaccttcacacacataccaacagaggagaggtatgatggtgaaggttaacctggcggcagcgcaaaagatg

SEQ ID NO: 212765 - DNA, 103 bp, Artificial Sequence
  Synthetic Polynucleotide
taatacgactcactatagggtgttgataaagaatatactggaaaccttcaaacagaggagatgaaggatgccagtatataacctggcggcagcgcaaaagatg

SEQ ID NO: 212766 - DNA, 103 bp, Artificial Sequence
  Synthetic Polynucleotide
taatacgactcactatagggggcttctgcttgttgataaagaatatactgaacagaggagacagtatatgctttatcaaaacctggcggcagcgcaaaagatg

SEQ ID NO: 212767 - DNA, 103 bp, Artificial Sequence
  Synthetic Polynucleotide
taatacgactcactatagggggttctttaaggcttctgcttgttgataaaaacagaggagatttatcatgaagcagaagaacctggcggcagcgcaaaagatg

SEQ ID NO: 212768 - DNA, 103 bp, Artificial Sequence
  Synthetic Polynucleotide
taatacgactcactatagggcctactccaaggttctttaaggcttctgctaacagaggagaagcagaatgcttaaagaaaacctggcggcagcgcaaaagatg

SEQ ID NO: 212769 - DNA, 103 bp, Artificial Sequence
  Synthetic Polynucleotide
taatacgactcactatagggtaactctgggcctactccaaggttctttaaaacagaggagattaaagatgcttggagtaaacctggcggcagcgcaaaagatg

SEQ ID NO: 212770 - DNA, 103 bp, Artificial Sequence
  Synthetic Polynucleotide
taatacgactcactatagggcatcgttctttaactctgggcctactccaaaacagaggagattggagatggcccagagtaacctggcggcagcgcaaaagatg

SEQ ID NO: 212771 - DNA, 103 bp, Artificial Sequence
  Synthetic Polynucleotide
taatacgactcactataggggcacactgagtacagcgttctttaaactctaacagaggagaagagttatgagaacgctgaacctggcggcagcgcaaaagatg

SEQ ID NO: 212772 - DNA, 103 bp, Artificial Sequence
  Synthetic Polynucleotide
taatacgactcactatagggttatgtaaaacatcgttctttaactctgggaacagaggagacccagaatgaaagaacgaaacctggcggcagcgcaaaagatg

SEQ ID NO: 212773 - DNA, 103 bp, Artificial Sequence
  Synthetic Polynucleotide
taatacgactcactatagggcttccaaaaattatgtaaaacatcgttcttaacagaggagaaagaacatggttttacataacctggcggcagcgcaaaagatg

SEQ ID NO: 212774 - DNA, 103 bp, Artificial Sequence
  Synthetic Polynucleotide
taatacgactcactataggggaaggtagcgcttccaaaaattatgtaaaaaacagaggagattttacatgatttttggaaacctggcggcagcgcaaaagatg

SEQ ID NO: 212775 - DNA, 103 bp, Artificial Sequence
  Synthetic Polynucleotide
taatacgactcactatagggttgctcttctgaaggtagcgcttccaaaaaaacagaggagatttttgatggcgctacctaacctggcggcagcgcaaaagatg

SEQ ID NO: 212776 - DNA, 103 bp, Artificial Sequence
  Synthetic Polynucleotide
taatacgactcactatagggatatgcctgcttgctcttctgaaggtagcgaacagaggagacgctacatgcagaagagcaacctggcggcagcgcaaaagatg

SEQ ID NO: 212777 - DNA, 103 bp, Artificial Sequence
  Synthetic Polynucleotide
taatacgactcactatagggggttcttacaatatgcctgcttgctcttctaacagaggagaagaagaatgagcaggcataacctggcggcagcgcaaaagatg

SEQ ID NO: 212778 - DNA, 103 bp, Artificial Sequence
  Synthetic Polynucleotide
taatacgactcactataggggtataaactgggttcttacaatatgcctgcaacagaggagagcaggcatgttgtaagaaaacctggcggcagcgcaaaagatg

SEQ ID NO: 212779 - DNA, 103 bp, Artificial Sequence
  Synthetic Polynucleotide
taatacgactcactatagggccttccagtggtataaactgggttcttacaaacagaggagatgtaagatgccagtttataacctggcggcagcgcaaaagatg

SEQ ID NO: 212780 - DNA, 103 bp, Artificial Sequence
  Synthetic Polynucleotide
taatacgactcactatagggccgtaggtttccttccagtggtataaactgaacagaggagacagtttatgccactggaaaacctggcggcagcgcaaaagatg

SEQ ID NO: 212781 - DNA, 103 bp, Artificial Sequence
  Synthetic Polynucleotide
taatacgactcactatagggtcttctaataccgtaggtttccttccagtgaacagaggagacactggatggaaacctacaacctggcggcagcgcaaaagatg

SEQ ID NO: 212782 - DNA, 103 bp, Artificial Sequence
  Synthetic Polynucleotide
taatacgactcactatagggtgagacagcagcacactgagtacagcgttcaacagaggagagaacgcatgactcagtgtaacctggcggcagcgcaaaagatg

SEQ ID NO: 212783 - DNA, 103 bp, Artificial Sequence
  Synthetic Polynucleotide
taatacgactcactatagggacttagattatcttctaataccgtaggtttaacagaggagaaaacctatggtattagaaaacctggcggcagcgcaaaagatg

SEQ ID NO: 212784 - DNA, 103 bp, Artificial Sequence
  Synthetic Polynucleotide
taatacgactcactatagggagtctgaatgacttagattatcttctaataaacagaggagatattagatgataatctaaaacctggcggcagcgcaaaagatg

SEQ ID NO: 212785 - DNA, 103 bp, Artificial Sequence
  Synthetic Polynucleotide
taatacgactcactatagggtcactagcccagtctgaatgacttagattaaacagaggagataatctatgtcattcagaaacctggcggcagcgcaaaagatg

SEQ ID NO: 212786 - DNA, 103 bp, Artificial Sequence
  Synthetic Polynucleotide
taatacgactcactatagggcagctcaggctcactagcccagtctgaatgaacagaggagacattcaatgtgggctagtaacctggcggcagcgcaaaagatg

SEQ ID NO: 212787 - DNA, 103 bp, Artificial Sequence
  Synthetic Polynucleotide
taatacgactcactatagggcatcacttagcagctcaggctcactagcccaacagaggagagggctaatgagcctgagcaacctggcggcagcgcaaaagatg

SEQ ID NO: 212788 - DNA, 103 bp, Artificial Sequence
  Synthetic Polynucleotide
taatacgactcactatagggggacagctgacatcacttagcagctcaggcaacagaggagagcctgaatggctaagtgaaacctggcggcagcgcaaaagatg

SEQ ID NO: 212789 - DNA, 103 bp, Artificial Sequence
  Synthetic Polynucleotide
taatacgactcactatagggaagaaaaggaggacagctgacatcacttagaacagaggagactaagtatggtcagctgtaacctggcggcagcgcaaaagatg

SEQ ID NO: 212790 - DNA, 103 bp, Artificial Sequence
  Synthetic Polynucleotide
taatacgactcactatagggctccactttcaagaaaaggaggacagctgaaacagaggagatcagctatgctccttttcaacctggcggcagcgcaaaagatg

SEQ ID NO: 212791 - DNA, 103 bp, Artificial Sequence
  Synthetic Polynucleotide
taatacgactcactatagggtgagactccgctccactttcaagaaaaggaaacagaggagatcctttatgtgaaagtggaacctggcggcagcgcaaaagatg

SEQ ID NO: 212792 - DNA, 103 bp, Artificial Sequence
  Synthetic Polynucleotide
taatacgactcactataggggatgtcagactgagactccgctccactttcaacagaggagagaaagtatggcggagtctaacctggcggcagcgcaaaagatg

SEQ ID NO: 212793 - DNA, 103 bp, Artificial Sequence
  Synthetic Polynucleotide
taatacgactcactatagggtaagaccccatgagacagcagcacactgagaacagaggagactcagtatgctgctgtctaacctggcggcagcgcaaaagatg

SEQ ID NO: 212794 - DNA, 103 bp, Artificial Sequence
  Synthetic Polynucleotide
taatacgactcactatagggttcgagtgtggatgtcagactgagactccgaacagaggagacggagtatgagtctgacaaacctggcggcagcgcaaaagatg

SEQ ID NO: 212795 - DNA, 103 bp, Artificial Sequence
  Synthetic Polynucleotide
taatacgactcactataggggggaaaggttttcgagtgtggatgtcagacaacagaggagagtctgaatgccacactcgaacctggcggcagcgcaaaagatg

SEQ ID NO: 212796 - DNA, 103 bp, Artificial Sequence
  Synthetic Polynucleotide
taatacgactcactatagggtttgctgacggggaaaggttttcgagtgtgaacagaggagacacactatgaaacctttcaacctggcggcagcgcaaaagatg

SEQ ID NO: 212797 - DNA, 103 bp, Artificial Sequence
  Synthetic Polynucleotide
taatacgactcactatagggattgtgatgctttgctgacggggaaaggttaacagaggagaaaccttatgccgtcagcaaacctggcggcagcgcaaaagatg

SEQ ID NO: 212798 - DNA, 103 bp, Artificial Sequence
  Synthetic Polynucleotide
taatacgactcactataggggacgtttctgattgtgatgctttgctgacgaacagaggagacgtcagatgagcatcacaaacctggcggcagcgcaaaagatg

SEQ ID NO: 212799 - DNA, 103 bp, Artificial Sequence
  Synthetic Polynucleotide
taatacgactcactatagggagagcagacagacgtttctgattgtgatgcaacagaggagagcatcaatgtcagaaacgaacctggcggcagcgcaaaagatg

SEQ ID NO: 212800 - DNA, 103 bp, Artificial Sequence
  Synthetic Polynucleotide
taatacgactcactatagggccagagatccagagcagacagacgtttctgaacagaggagacagaaaatgctgtctgctaacctggcggcagcgcaaaagatg

SEQ ID NO: 212801 - DNA, 103 bp, Artificial Sequence
  Synthetic Polynucleotide
taatacgactcactatagggtcaactccatccagagatccagagcagacaaacagaggagatgtctgatgtggatctctaacctggcggcagcgcaaaagatg

SEQ ID NO: 212802 - DNA, 103 bp, Artificial Sequence
  Synthetic Polynucleotide
taatacgactcactatagggttgtgagtattcaactccatccagagatccaacagaggagaggatctatggatggagttaacctggcggcagcgcaaaagatg

SEQ ID NO: 212803 - DNA, 103 bp, Artificial Sequence
  Synthetic Polynucleotide
taatacgactcactatagggtctcctttcgttgtgagtattcaactccataacagaggagaatggagatgaatactcacaacctggcggcagcgcaaaagatg

SEQ ID NO: 212804 - DNA, 103 bp, Artificial Sequence
  Synthetic Polynucleotide
taatacgactcactatagggccttcatcagtaagaccccatgagacagcaaacagaggagatgctgtatgatggggtctaacctggcggcagcgcaaaagatg

SEQ ID NO: 212805 - DNA, 103 bp, Artificial Sequence
  Synthetic Polynucleotide
taatacgactcactatagggacgattcccttctcctttcgttgtgagtataacagaggagaatactcatgacgaaaggaaacctggcggcagcgcaaaagatg

SEQ ID NO: 212806 - DNA, 103 bp, Artificial Sequence
  Synthetic Polynucleotide
taatacgactcactatagggggtcatcttcacgattcccttctcctttcgaacagaggagacgaaagatgaagggaatcaacctggcggcagcgcaaaagatg

SEQ ID NO: 212807 - DNA, 103 bp, Artificial Sequence
  Synthetic Polynucleotide
taatacgactcactatagggtctgtggcatggtcatcttcacgattccctaacagaggagaagggaaatgtgaagatgaaacctggcggcagcgcaaaagatg

SEQ ID NO: 212808 - DNA, 103 bp, Artificial Sequence
  Synthetic Polynucleotide
taatacgactcactatagggaaggcaagtgtctgtggcatggtcatcttcaacagaggagagaagatatgcatgccacaaacctggcggcagcgcaaaagatg

SEQ ID NO: 212809 - DNA, 103 bp, Artificial Sequence
  Synthetic Polynucleotide
taatacgactcactatagggcagataacagaaggcaagtgtctgtggcataacagaggagaatgccaatgacacttgccaacctggcggcagcgcaaaagatg

SEQ ID NO: 212810 - DNA, 103 bp, Artificial Sequence
  Synthetic Polynucleotide
taatacgactcactatagggaaagtaaggacagataacagaaggcaagtgaacagaggagacacttgatgtctgttatcaacctggcggcagcgcaaaagatg

SEQ ID NO: 212811 - DNA, 103 bp, Artificial Sequence
  Synthetic Polynucleotide
taatacgactcactatagggtctctctgccaaagtaaggacagataacagaacagaggagactgttaatggtccttactaacctggcggcagcgcaaaagatg

SEQ ID NO: 212812 - DNA, 103 bp, Artificial Sequence
  Synthetic Polynucleotide
taatacgactcactatagggtgttattgcttctctctgccaaagtaaggaaacagaggagatccttaatgtggcagagaaacctggcggcagcgcaaaagatg

SEQ ID NO: 212813 - DNA, 103 bp, Artificial Sequence
  Synthetic Polynucleotide
taatacgactcactataggggatctgaaagtgttattgcttctctctgccaacagaggagaggcagaatgaagcaataaaacctggcggcagcgcaaaagatg

SEQ ID NO: 212814 - DNA, 103 bp, Artificial Sequence
  Synthetic Polynucleotide
taatacgactcactatagggaacctcaaaagatctgaaagtgttattgctaacagaggagaagcaatatgactttcagaaacctggcggcagcgcaaaagatg

SEQ ID NO: 212815 - DNA, 103 bp, Artificial Sequence
  Synthetic Polynucleotide
taatacgactcactatagggataatatttgccttcatcagtaagaccccaaacagaggagatggggtatgactgatgaaaacctggcggcagcgcaaaagatg

SEQ ID NO: 212816 - DNA, 103 bp, Artificial Sequence
  Synthetic Polynucleotide
taatacgactcactatagggctcttcaacaaacctcaaaagatctgaaagaacagaggagactttcaatgcttttgaggaacctggcggcagcgcaaaagatg

SEQ ID NO: 212817 - DNA, 103 bp, Artificial Sequence
  Synthetic Polynucleotide
taatacgactcactataggggaatatggtcctcttcaacaaacctcaaaaaacagaggagattttgaatgttgttgaagaacctggcggcagcgcaaaagatg

SEQ ID NO: 212818 - DNA, 103 bp, Artificial Sequence
  Synthetic Polynucleotide
taatacgactcactatagggtttatgtaaggaatatggtcctcttcaacaaacagaggagatgttgaatgggaccatataacctggcggcagcgcaaaagatg

SEQ ID NO: 212819 - DNA, 103 bp, Artificial Sequence
  Synthetic Polynucleotide
taatacgactcactatagggctgaaaagcatttatgtaaggaatatggtcaacagaggagagaccatatgccttacataaacctggcggcagcgcaaaagatg

SEQ ID NO: 212820 - DNA, 103 bp, Artificial Sequence
  Synthetic Polynucleotide
taatacgactcactatagggctggaaaatgctgaaaagcatttatgtaagaacagaggagacttacaatgatgcttttcaacctggcggcagcgcaaaagatg

SEQ ID NO: 212821 - DNA, 103 bp, Artificial Sequence
  Synthetic Polynucleotide
taatacgactcactatagggttcatctgttctggaaaatgctgaaaagcaaacagaggagatgctttatggcattttccaacctggcggcagcgcaaaagatg

SEQ ID NO: 212822 - DNA, 103 bp, Artificial Sequence
  Synthetic Polynucleotide
taatacgactcactatagggtccatataatttcatctgttctggaaaatgaacagaggagacattttatggaacagatgaacctggcggcagcgcaaaagatg

SEQ ID NO: 212823 - DNA, 103 bp, Artificial Sequence
  Synthetic Polynucleotide
taatacgactcactatagggctctgtcacgtccatataatttcatctgttaacagaggagaaacagaatgaattatatgaacctggcggcagcgcaaaagatg

SEQ ID NO: 212824 - DNA, 103 bp, Artificial Sequence
  Synthetic Polynucleotide
taatacgactcactatagggccaaagattcctctgtcacgtccatataataacagaggagaattataatgacgtgacagaacctggcggcagcgcaaaagatg

SEQ ID NO: 212825 - DNA, 103 bp, Artificial Sequence
  Synthetic Polynucleotide
taatacgactcactatagggagactctataccaaagattcctctgtcacgaacagaggagacgtgacatgggaatctttaacctggcggcagcgcaaaagatg

SEQ ID NO: 212826 - DNA, 103 bp, Artificial Sequence
  Synthetic Polynucleotide
taatacgactcactatagggaagaagtgcaataatatttgccttcatcagaacagaggagactgatgatggcaaatattaacctggcggcagcgcaaaagatg

SEQ ID NO: 212827 - DNA, 103 bp, Artificial Sequence
  Synthetic Polynucleotide
taatacgactcactatagggagtcaggccaagactctataccaaagattcaacagaggagagaatctatggtatagagtaacctggcggcagcgcaaaagatg

SEQ ID NO: 212828 - DNA, 103 bp, Artificial Sequence
  Synthetic Polynucleotide
taatacgactcactatagggatgtcctcgtagtcaggccaagactctataaacagaggagatatagaatgttggcctgaaacctggcggcagcgcaaaagatg

SEQ ID NO: 212829 - DNA, 103 bp, Artificial Sequence
  Synthetic Polynucleotide
taatacgactcactatagggttttttgtagatgtcctcgtagtcaggccaaacagaggagatggcctatgtacgaggacaacctggcggcagcgcaaaagatg

SEQ ID NO: 212830 - DNA, 103 bp, Artificial Sequence
  Synthetic Polynucleotide
taatacgactcactatagggcttctactgtttttttgtagatgtcctcgtaacagaggagaacgaggatgtctacaaaaaacctggcggcagcgcaaaagatg

SEQ ID NO: 212831 - DNA, 103 bp, Artificial Sequence
  Synthetic Polynucleotide
taatacgactcactatagggaatgttccaacttctactgtttttttgtagaacagaggagactacaaatgaacagtagaaacctggcggcagcgcaaaagatg

SEQ ID NO: 212832 - DNA, 103 bp, Artificial Sequence
  Synthetic Polynucleotide
taatacgactcactatagggcaaatctaaaaatgttccaacttctactgtaacagaggagaacagtaatggttggaacaaacctggcggcagcgcaaaagatg

SEQ ID NO: 212833 - DNA, 103 bp, Artificial Sequence
  Synthetic Polynucleotide
taatacgactcactataggggaaaacgaggcaaatctaaaaatgttccaaaacagaggagattggaaatgttttagattaacctggcggcagcgcaaaagatg

SEQ ID NO: 212834 - DNA, 103 bp, Artificial Sequence
  Synthetic Polynucleotide
taatacgactcactataggggttatgtctggaaaacgaggcaaatctaaaaacagaggagatttagaatggcctcgtttaacctggcggcagcgcaaaagatg

SEQ ID NO: 212835 - DNA, 103 bp, Artificial Sequence
  Synthetic Polynucleotide
taatacgactcactataggggcagtcttcagttatgtctggaaaacgaggaacagaggagacctcgtatgccagacataaacctggcggcagcgcaaaagatg

SEQ ID NO: 212836 - DNA, 103 bp, Artificial Sequence
  Synthetic Polynucleotide
taatacgactcactataggggatgaagatagcagtcttcagttatgtctgaacagaggagacagacaatgctgaagactaacctggcggcagcgcaaaagatg

SEQ ID NO: 212837 - DNA, 103 bp, Artificial Sequence
  Synthetic Polynucleotide
taatacgactcactatagggacattgtggcaagaagtgcaataatatttgaacagaggagacaaataatgttgcacttcaacctggcggcagcgcaaaagatg

SEQ ID NO: 212838 - DNA, 103 bp, Artificial Sequence
  Synthetic Polynucleotide
taatacgactcactatagggagtatgttgggatgaagatagcagtcttcaaacagaggagatgaagaatgctatcttcaaacctggcggcagcgcaaaagatg

SEQ ID NO: 212839 - DNA, 103 bp, Artificial Sequence
  Synthetic Polynucleotide
taatacgactcactatagggtttcatacacagtatgttgggatgaagataaacagaggagatatcttatgcccaacataaacctggcggcagcgcaaaagatg

SEQ ID NO: 212840 - DNA, 103 bp, Artificial Sequence
  Synthetic Polynucleotide
taatacgactcactatagggccatcaagtatttcatacacagtatgttggaacagaggagaccaacaatgtgtgtatgaaacctggcggcagcgcaaaagatg

SEQ ID NO: 212841 - DNA, 103 bp, Artificial Sequence
  Synthetic Polynucleotide
taatacgactcactatagggaggttgacttccatcaagtatttcatacacaacagaggagagtgtatatgatacttgataacctggcggcagcgcaaaagatg

SEQ ID NO: 212842 - DNA, 103 bp, Artificial Sequence
  Synthetic Polynucleotide
taatacgactcactatagggttcatcagggaggttgacttccatcaagtaaacagaggagatacttgatggaagtcaacaacctggcggcagcgcaaaagatg

SEQ ID NO: 212843 - DNA, 103 bp, Artificial Sequence
  Synthetic Polynucleotide
taatacgactcactatagggagctatgcatttcatcagggaggttgacttaacagaggagaaagtcaatgtccctgatgaacctggcggcagcgcaaaagatg

SEQ ID NO: 212844 - DNA, 103 bp, Artificial Sequence
  Synthetic Polynucleotide
taatacgactcactatagggtggcaagttaagctatgcatttcatcagggaacagaggagaccctgaatgaatgcatagaacctggcggcagcgcaaaagatg

SEQ ID NO: 212845 - DNA, 103 bp, Artificial Sequence
  Synthetic Polynucleotide
taatacgactcactatagggttttaccacgtggcaagttaagctatgcataacagaggagaatgcatatgttaacttgcaacctggcggcagcgcaaaagatg

SEQ ID NO: 212846 - DNA, 103 bp, Artificial Sequence
  Synthetic Polynucleotide
taatacgactcactatagggttccagtcatttttaccacgtggcaagttaaacagaggagataacttatgacgtggtaaaacctggcggcagcgcaaaagatg

SEQ ID NO: 212847 - DNA, 103 bp, Artificial Sequence
  Synthetic Polynucleotide
taatacgactcactatagggacttctcccattccagtcatttttaccacgaacagaggagacgtggtatgaatgactggaacctggcggcagcgcaaaagatg

SEQ ID NO: 212848 - DNA, 103 bp, Artificial Sequence
  Synthetic Polynucleotide
taatacgactcactataggggtcccagggatcgatgaggggaggcagcataacagaggagaatgctgatgcccctcatcaacctggcggcagcgcaaaagatg

SEQ ID NO: 212849 - DNA, 103 bp, Artificial Sequence
  Synthetic Polynucleotide
taatacgactcactataggggatctgctcagtcacatccagcacgactcgaacagaggagacgagtcatgctggatgtgaacctggcggcagcgcaaaagatg

SEQ ID NO: 212850 - DNA, 103 bp, Artificial Sequence
  Synthetic Polynucleotide
taatacgactcactatagggctggcacgaagcctctgcccccaaacgaaaaacagaggagatttcgtatgggggcagagaacctggcggcagcgcaaaagatg

SEQ ID NO: 212851 - DNA, 103 bp, Artificial Sequence
  Synthetic Polynucleotide
taatacgactcactataggggttcccctttctggcacgaagcctctgcccaacagaggagagggcagatgcttcgtgccaacctggcggcagcgcaaaagatg

SEQ ID NO: 212852 - DNA, 103 bp, Artificial Sequence
  Synthetic Polynucleotide
taatacgactcactatagggagcaggacacgttcccctttctggcacgaaaacagaggagattcgtgatggaaaggggaaacctggcggcagcgcaaaagatg

SEQ ID NO: 212853 - DNA, 103 bp, Artificial Sequence
  Synthetic Polynucleotide
taatacgactcactataggggtactgggtaagcaggacacgttcccctttaacagaggagaaaagggatgcgtgtcctgaacctggcggcagcgcaaaagatg

SEQ ID NO: 212854 - DNA, 103 bp, Artificial Sequence
  Synthetic Polynucleotide
taatacgactcactatagggagtgccccaggtactgggtaagcaggacacaacagaggagagtgtccatgttacccagtaacctggcggcagcgcaaaagatg

SEQ ID NO: 212855 - DNA, 103 bp, Artificial Sequence
  Synthetic Polynucleotide
taatacgactcactatagggttggggctggagtgccccaggtactgggtaaacagaggagatacccaatgcctggggcaaacctggcggcagcgcaaaagatg

SEQ ID NO: 212856 - DNA, 103 bp, Artificial Sequence
  Synthetic Polynucleotide
taatacgactcactatagggggggaggcatttggggctggagtgccccagaacagaggagactggggatgtccagccccaacctggcggcagcgcaaaagatg

SEQ ID NO: 212857 - DNA, 103 bp, Artificial Sequence
  Synthetic Polynucleotide
taatacgactcactataggggaagagtaggggggaggcatttggggctggaacagaggagaccagccatgaatgcctccaacctggcggcagcgcaaaagatg

SEQ ID NO: 212858 - DNA, 103 bp, Artificial Sequence
  Synthetic Polynucleotide
taatacgactcactatagggcagacgagatgaagagtaggggggaggcataacagaggagaatgcctatgccctactctaacctggcggcagcgcaaaagatg

SEQ ID NO: 212859 - DNA, 103 bp, Artificial Sequence
  Synthetic Polynucleotide
taatacgactcactataggggaactgggtacagacgagatgaagagtaggaacagaggagacctactatgcatctcgtcaacctggcggcagcgcaaaagatg

SEQ ID NO: 212860 - DNA, 103 bp, Artificial Sequence
  Synthetic Polynucleotide
taatacgactcactatagggggaaccggctgatctgctcagtcacatccaaacagaggagatggatgatgctgagcagaaacctggcggcagcgcaaaagatg

SEQ ID NO: 212861 - DNA, 103 bp, Artificial Sequence
  Synthetic Polynucleotide
taatacgactcactatagggggtagagagagaactgggtacagacgagataacagaggagaatctcgatggtacccagtaacctggcggcagcgcaaaagatg

SEQ ID NO: 212862 - DNA, 103 bp, Artificial Sequence
  Synthetic Polynucleotide
taatacgactcactatagggtcgtccactaggtagagagagaactgggtaaacagaggagatacccaatgctctctctaaacctggcggcagcgcaaaagatg

SEQ ID NO: 212863 - DNA, 103 bp, Artificial Sequence
  Synthetic Polynucleotide
taatacgactcactataggggggaaggcgctcgtccactaggtagagagaaacagaggagatctctcatgctagtggacaacctggcggcagcgcaaaagatg

SEQ ID NO: 212864 - DNA, 103 bp, Artificial Sequence
  Synthetic Polynucleotide
taatacgactcactatagggtcggcaccaggggaaggcgctcgtccactaaacagaggagatagtggatgagcgccttcaacctggcggcagcgcaaaagatg

SEQ ID NO: 212865 - DNA, 103 bp, Artificial Sequence
  Synthetic Polynucleotide
taatacgactcactatagggcacttcagcatcggcaccaggggaaggcgcaacagaggagagcgcctatgcctggtgccaacctggcggcagcgcaaaagatg

SEQ ID NO: 212866 - DNA, 103 bp, Artificial Sequence
  Synthetic Polynucleotide
taatacgactcactataggggccatggttccacttcagcatcggcaccagaacagaggagactggtgatgatgctgaagaacctggcggcagcgcaaaagatg

SEQ ID NO: 212867 - DNA, 103 bp, Artificial Sequence
  Synthetic Polynucleotide
taatacgactcactataggggggaggggaggccatggttccacttcagcaaacagaggagatgctgaatgggaaccatgaacctggcggcagcgcaaaagatg

SEQ ID NO: 212868 - DNA, 103 bp, Artificial Sequence
  Synthetic Polynucleotide
taatacgactcactatagggagcaggagcggggaggggaggccatggttcaacagaggagagaaccaatgcctcccctcaacctggcggcagcgcaaaagatg

SEQ ID NO: 212869 - DNA, 103 bp, Artificial Sequence
  Synthetic Polynucleotide
taatacgactcactatagggcagtcgggccagcaggagcggggaggggagaacagaggagactccccatgccgctcctgaacctggcggcagcgcaaaagatg

SEQ ID NO: 212870 - DNA, 103 bp, Artificial Sequence
  Synthetic Polynucleotide
taatacgactcactataggggcggaggcagcagtcgggccagcaggagcgaacagaggagacgctccatgtggcccgacaacctggcggcagcgcaaaagatg

SEQ ID NO: 212871 - DNA, 103 bp, Artificial Sequence
  Synthetic Polynucleotide
taatacgactcactatagggtgatccaagaggaaccggctgatctgctcaaacagaggagatgagcaatgcagccggttaacctggcggcagcgcaaaagatg

SEQ ID NO: 212872 - DNA, 103 bp, Artificial Sequence
  Synthetic Polynucleotide
taatacgactcactatagggctgggccggggcggaggcagcagtcgggccaacagaggagaggcccgatggctgcctccaacctggcggcagcgcaaaagatg

SEQ ID NO: 212873 - DNA, 103 bp, Artificial Sequence
  Synthetic Polynucleotide
taatacgactcactatagggctgcacgcagctgggccggggcggaggcagaacagaggagactgcctatgccccggcccaacctggcggcagcgcaaaagatg

SEQ ID NO: 212874 - DNA, 103 bp, Artificial Sequence
  Synthetic Polynucleotide
taatacgactcactatagggggagcaggggctgcacgcagctgggccgggaacagaggagacccggcatggctgcgtgcaacctggcggcagcgcaaaagatg

SEQ ID NO: 212875 - DNA, 103 bp, Artificial Sequence
  Synthetic Polynucleotide
taatacgactcactatagggtggcctccgaggagcaggggctgcacgcagaacagaggagactgcgtatggcccctgctaacctggcggcagcgcaaaagatg

SEQ ID NO: 212876 - DNA, 103 bp, Artificial Sequence
  Synthetic Polynucleotide
taatacgactcactatagggctgcccaccctggcctccgaggagcaggggaacagaggagacccctgatgctcggaggcaacctggcggcagcgcaaaagatg

SEQ ID NO: 212877 - DNA, 103 bp, Artificial Sequence
  Synthetic Polynucleotide
taatacgactcactataggggcagctgcagctgcccaccctggcctccgaaacagaggagatcggagatgagggtgggcaacctggcggcagcgcaaaagatg

SEQ ID NO: 212878 - DNA, 103 bp, Artificial Sequence
  Synthetic Polynucleotide
taatacgactcactataggggccaggtgcagcagctgcagctgcccacccaacagaggagagggtggatggctgcagctaacctggcggcagcgcaaaagatg

SEQ ID NO: 212879 - DNA, 103 bp, Artificial Sequence
  Synthetic Polynucleotide
taatacgactcactatagggcgccccttctgccaggtgcagcagctgcagaacagaggagactgcagatgctgcacctgaacctggcggcagcgcaaaagatg

SEQ ID NO: 212880 - DNA, 103 bp, Artificial Sequence
  Synthetic Polynucleotide
taatacgactcactatagggggggcaccgacgccccttctgccaggtgcaaacagaggagatgcaccatgcagaaggggaacctggcggcagcgcaaaagatg

SEQ ID NO: 212881 - DNA, 103 bp, Artificial Sequence
  Synthetic Polynucleotide
taatacgactcactatagggcctgccaggcggggcaccgacgccccttctaacagaggagaagaaggatggtcggtgccaacctggcggcagcgcaaaagatg

SEQ ID NO: 212882 - DNA, 103 bp, Artificial Sequence
  Synthetic Polynucleotide
taatacgactcactatagggtacgtctccatgatccaagaggaaccggctaacagaggagaagccggatgctcttggataacctggcggcagcgcaaaagatg

SEQ ID NO: 212883 - DNA, 103 bp, Artificial Sequence
  Synthetic Polynucleotide
taatacgactcactatagggctggggggggcctgccaggcggggcaccgaaacagaggagatcggtgatgcgcctggcaaacctggcggcagcgcaaaagatg

SEQ ID NO: 212884 - DNA, 103 bp, Artificial Sequence
  Synthetic Polynucleotide
taatacgactcactatagggaaggaagagactggggggggcctgccaggcaacagaggagagcctggatggccccccccaacctggcggcagcgcaaaagatg

SEQ ID NO: 212885 - DNA, 103 bp, Artificial Sequence
  Synthetic Polynucleotide
taatacgactcactatagggtcgatcctggaaggaagagactggggggggaacagaggagaccccccatggtctcttccaacctggcggcagcgcaaaagatg

SEQ ID NO: 212886 - DNA, 103 bp, Artificial Sequence
  Synthetic Polynucleotide
taatacgactcactatagggagggagggagtcgatcctggaaggaagagaaacagaggagatctcttatgtccaggatcaacctggcggcagcgcaaaagatg

SEQ ID NO: 212887 - DNA, 103 bp, Artificial Sequence
  Synthetic Polynucleotide
taatacgactcactataggggaggaaatgcagggagggagtcgatcctggaacagaggagaccaggaatgactccctccaacctggcggcagcgcaaaagatg

SEQ ID NO: 212888 - DNA, 103 bp, Artificial Sequence
  Synthetic Polynucleotide
taatacgactcactatagggggctccagcagaggaaatgcagggagggagaacagaggagactccctatgtgcatttccaacctggcggcagcgcaaaagatg

SEQ ID NO: 212889 - DNA, 103 bp, Artificial Sequence
  Synthetic Polynucleotide
taatacgactcactatagggctggatcttaggctccagcagaggaaatgcaacagaggagagcatttatgctgctggagaacctggcggcagcgcaaaagatg

SEQ ID NO: 212890 - DNA, 103 bp, Artificial Sequence
  Synthetic Polynucleotide
taatacgactcactataggggcagccgccactggatcttaggctccagcaaacagaggagatgctggatgctaagatccaacctggcggcagcgcaaaagatg

SEQ ID NO: 212891 - DNA, 103 bp, Artificial Sequence
  Synthetic Polynucleotide
taatacgactcactatagggaggcgctcctgcagccgccactggatcttaaacagaggagataagatatggtggcggctaacctggcggcagcgcaaaagatg

SEQ ID NO: 212892 - DNA, 103 bp, Artificial Sequence
  Synthetic Polynucleotide
taatacgactcactatagggcggtgctttcaggcgctcctgcagccgccaaacagaggagatggcggatgcaggagcgcaacctggcggcagcgcaaaagatg

SEQ ID NO: 212893 - DNA, 103 bp, Artificial Sequence
  Synthetic Polynucleotide
taatacgactcactataggggcgcaaaggctacgtctccatgatccaagaaacagaggagatcttggatgatggagacgaacctggcggcagcgcaaaagatg

SEQ ID NO: 212894 - DNA, 103 bp, Artificial Sequence
  Synthetic Polynucleotide
taatacgactcactataggggacctatggtcggtgctttcaggcgctcctaacagaggagaaggagcatgtgaaagcacaacctggcggcagcgcaaaagatg

SEQ ID NO: 212895 - DNA, 103 bp, Artificial Sequence
  Synthetic Polynucleotide
taatacgactcactatagggacggcagccagacctatggtcggtgctttcaacagaggagagaaagcatggaccataggaacctggcggcagcgcaaaagatg

SEQ ID NO: 212896 - DNA, 103 bp, Artificial Sequence
  Synthetic Polynucleotide
taatacgactcactataggggggcgggacgacggcagccagacctatggtaacagaggagaaccataatgctggctgccaacctggcggcagcgcaaaagatg

SEQ ID NO: 212897 - DNA, 103 bp, Artificial Sequence
  Synthetic Polynucleotide
taatacgactcactatagggctgagggcaagggcgggacgacggcagccaaacagaggagatggctgatgtcgtcccgcaacctggcggcagcgcaaaagatg

SEQ ID NO: 212898 - DNA, 103 bp, Artificial Sequence
  Synthetic Polynucleotide
taatacgactcactatagggggtgtgggcgctgagggcaagggcgggacgaacagaggagacgtcccatgcttgccctcaacctggcggcagcgcaaaagatg

SEQ ID NO: 212899 - DNA, 103 bp, Artificial Sequence
  Synthetic Polynucleotide
taatacgactcactatagggcaccaggcctggtgtgggcgctgagggcaaaacagaggagattgcccatggcgcccacaaacctggcggcagcgcaaaagatg

SEQ ID NO: 212900 - DNA, 103 bp, Artificial Sequence
  Synthetic Polynucleotide
taatacgactcactataggggctggaagagcaccaggcctggtgtgggcgaacagaggagacgcccaatgcaggcctggaacctggcggcagcgcaaaagatg

SEQ ID NO: 212901 - DNA, 103 bp, Artificial Sequence
  Synthetic Polynucleotide
taatacgactcactataggggccgccgagagctggaagagcaccaggcctaacagaggagaaggcctatggctcttccaaacctggcggcagcgcaaaagatg

SEQ ID NO: 212902 - DNA, 103 bp, Artificial Sequence
  Synthetic Polynucleotide
taatacgactcactataggggacatctcccgccgccgagagctggaagagaacagaggagactcttcatgctctcggcgaacctggcggcagcgcaaaagatg

SEQ ID NO: 212903 - DNA, 103 bp, Artificial Sequence
  Synthetic Polynucleotide
taatacgactcactataggggctggtagaagacatctcccgccgccgagaaacagaggagatctcggatgcgggagatgaacctggcggcagcgcaaaagatg

SEQ ID NO: 212904 - DNA, 103 bp, Artificial Sequence
  Synthetic Polynucleotide
taatacgactcactatagggttccccaggggcgcaaaggctacgtctccaaacagaggagatggagaatgagcctttgcaacctggcggcagcgcaaaagatg

SEQ ID NO: 212905 - DNA, 103 bp, Artificial Sequence
  Synthetic Polynucleotide
taatacgactcactataggggggcggagctgctggtagaagacatctcccaacagaggagagggagaatgcttctaccaaacctggcggcagcgcaaaagatg

SEQ ID NO: 212906 - DNA, 103 bp, Artificial Sequence
  Synthetic Polynucleotide
taatacgactcactataggggtccacctgggggcggagctgctggtagaaaacagaggagattctacatgcagctccgcaacctggcggcagcgcaaaagatg

SEQ ID NO: 212907 - DNA, 103 bp, Artificial Sequence
  Synthetic Polynucleotide
taatacgactcactatagggggaggctggagtccacctgggggcggagctaacagaggagaagctccatgcccaggtggaacctggcggcagcgcaaaagatg

SEQ ID NO: 212908 - DNA, 103 bp, Artificial Sequence
  Synthetic Polynucleotide
taatacgactcactataggggcatctctgcggaggctggagtccacctggaacagaggagaccaggtatgctccagcctaacctggcggcagcgcaaaagatg

SEQ ID NO: 212909 - DNA, 103 bp, Artificial Sequence
  Synthetic Polynucleotide
taatacgactcactatagggaggaggcccagcatctctgcggaggctggaaacagaggagatccagcatgcgcagagataacctggcggcagcgcaaaagatg

SEQ ID NO: 212910 - DNA, 103 bp, Artificial Sequence
  Synthetic Polynucleotide
taatacgactcactataggggggtgtcgccaggaggcccagcatctctgcaacagaggagagcagagatgctgggcctcaacctggcggcagcgcaaaagatg

SEQ ID NO: 212911 - DNA, 103 bp, Artificial Sequence
  Synthetic Polynucleotide
taatacgactcactatagggcagtcaggttgggtgtcgccaggaggcccaaacagaggagatgggccatgtggcgacacaacctggcggcagcgcaaaagatg

SEQ ID NO: 212912 - DNA, 103 bp, Artificial Sequence
  Synthetic Polynucleotide
taatacgactcactataggggggggcatggcagtcaggttgggtgtcgccaacagaggagaggcgacatgcaacctgacaacctggcggcagcgcaaaagatg

SEQ ID NO: 212913 - DNA, 103 bp, Artificial Sequence
  Synthetic Polynucleotide
taatacgactcactatagggaggaagctgtgggggcatggcagtcaggttaacagaggagaaacctgatggccatgcccaacctggcggcagcgcaaaagatg

SEQ ID NO: 212914 - DNA, 103 bp, Artificial Sequence
  Synthetic Polynucleotide
taatacgactcactatagggtgggaggtccaggaagctgtgggggcatggaacagaggagaccatgcatgcacagcttcaacctggcggcagcgcaaaagatg

SEQ ID NO: 212915 - DNA, 103 bp, Artificial Sequence
  Synthetic Polynucleotide
taatacgactcactatagggcagcatcagcttccccaggggcgcaaaggcaacagaggagagcctttatgcccctggggaacctggcggcagcgcaaaagatg

SEQ ID NO: 212916 - DNA, 103 bp, Artificial Sequence
  Synthetic Polynucleotide
taatacgactcactatagggggcagtgtcctgggaggtccaggaagctgtaacagaggagaacagctatgtggacctccaacctggcggcagcgcaaaagatg

SEQ ID NO: 212917 - DNA, 103 bp, Artificial Sequence
  Synthetic Polynucleotide
taatacgactcactatagggggctgcagccggcagtgtcctgggaggtccaacagaggagaggacctatgaggacactgaacctggcggcagcgcaaaagatg

SEQ ID NO: 212918 - DNA, 103 bp, Artificial Sequence
  Synthetic Polynucleotide
taatacgactcactatagggttcagccactggctgcagccggcagtgtccaacagaggagaggacacatgcggctgcagaacctggcggcagcgcaaaagatg

SEQ ID NO: 212919 - DNA, 103 bp, Artificial Sequence
  Synthetic Polynucleotide
taatacgactcactatagggtagcagggccttcagccactggctgcagccaacagaggagaggctgcatgcagtggctgaacctggcggcagcgcaaaagatg

SEQ ID NO: 212920 - DNA, 103 bp, Artificial Sequence
  Synthetic Polynucleotide
taatacgactcactatagggggggcacttttagcagggccttcagccactaacagaggagaagtggcatgaggccctgcaacctggcggcagcgcaaaagatg

SEQ ID NO: 212921 - DNA, 103 bp, Artificial Sequence
  Synthetic Polynucleotide
taatacgactcactatagggggaggagccaggggcacttttagcagggccaacagaggagaggccctatgaaaagtgccaacctggcggcagcgcaaaagatg

SEQ ID NO: 212922 - DNA, 103 bp, Artificial Sequence
  Synthetic Polynucleotide
taatacgactcactatagggtgtccacacaggaggagccaggggcactttaacagaggagaaaagtgatgctggctcctaacctggcggcagcgcaaaagatg

SEQ ID NO: 212923 - DNA, 103 bp, Artificial Sequence
  Synthetic Polynucleotide
taatacgactcactatagggaggtgggtgctgtccacacaggaggagccaaacagaggagatggctcatgctgtgtggaaacctggcggcagcgcaaaagatg

SEQ ID NO: 212924 - DNA, 103 bp, Artificial Sequence
  Synthetic Polynucleotide
taatacgactcactatagggcggtgggtgaaggtgggtgctgtccacacaaacagaggagatgtgtgatgagcacccacaacctggcggcagcgcaaaagatg

SEQ ID NO: 212925 - DNA, 103 bp, Artificial Sequence
  Synthetic Polynucleotide
taatacgactcactatagggcagcatctggcggtgggtgaaggtgggtgcaacagaggagagcacccatgttcacccacaacctggcggcagcgcaaaagatg

SEQ ID NO: 212926 - DNA, 103 bp, Artificial Sequence
  Synthetic Polynucleotide
taatacgactcactatagggtgaaattctccagcatcagcttccccagggaacagaggagaccctggatgagctgatgcaacctggcggcagcgcaaaagatg

SEQ ID NO: 212927 - DNA, 103 bp, Artificial Sequence
  Synthetic Polynucleotide
taatacgactcactatagggctgtgctgcccagcatctggcggtgggtgaaacagaggagatcacccatggccagatgcaacctggcggcagcgcaaaagatg

SEQ ID NO: 212928 - DNA, 103 bp, Artificial Sequence
  Synthetic Polynucleotide
taatacgactcactatagggctccgcagctctgtgctgcccagcatctggaacagaggagaccagatatggggcagcacaacctggcggcagcgcaaaagatg

SEQ ID NO: 212929 - DNA, 103 bp, Artificial Sequence
  Synthetic Polynucleotide
taatacgactcactatagggctcttcctccctccgcagctctgtgctgccaacagaggagaggcagcatggagctgcggaacctggcggcagcgcaaaagatg

SEQ ID NO: 212930 - DNA, 103 bp, Artificial Sequence
  Synthetic Polynucleotide
taatacgactcactataggggctgcccttcctcttcctccctccgcagctaacagaggagaagctgcatggggaggaagaacctggcggcagcgcaaaagatg

SEQ ID NO: 212931 - DNA, 103 bp, Artificial Sequence
  Synthetic Polynucleotide
taatacgactcactatagggacacccagccgctgcccttcctcttcctccaacagaggagaggaggaatgggaagggcaaacctggcggcagcgcaaaagatg

SEQ ID NO: 212932 - DNA, 103 bp, Artificial Sequence
  Synthetic Polynucleotide
taatacgactcactatagggcttgcggagcacacccagccgctgcccttcaacagaggagagaagggatgcggctgggtaacctggcggcagcgcaaaagatg

SEQ ID NO: 212933 - DNA, 103 bp, Artificial Sequence
  Synthetic Polynucleotide
taatacgactcactataggggggccatggccttgcggagcacacccagccaacagaggagaggctggatgtgctccgcaaacctggcggcagcgcaaaagatg

SEQ ID NO: 212934 - DNA, 103 bp, Artificial Sequence
  Synthetic Polynucleotide
taatacgactcactatagggagctgccctcgggccatggccttgcggagcaacagaggagagctccgatgggccatggcaacctggcggcagcgcaaaagatg

SEQ ID NO: 212935 - DNA, 103 bp, Artificial Sequence
  Synthetic Polynucleotide
taatacgactcactatagggctgcagcaggagctgccctcgggccatggcaacagaggagagccatgatgcgagggcagaacctggcggcagcgcaaaagatg

SEQ ID NO: 212936 - DNA, 103 bp, Artificial Sequence
  Synthetic Polynucleotide
taatacgactcactatagggccaggtctctctgcagcaggagctgccctcaacagaggagagagggcatgtcctgctgcaacctggcggcagcgcaaaagatg

SEQ ID NO: 212937 - DNA, 103 bp, Artificial Sequence
  Synthetic Polynucleotide
taatacgactcactatagggccctccagcttgaaattctccagcatcagcaacagaggagagctgatatgggagaatttaacctggcggcagcgcaaaagatg

SEQ ID NO: 212938 - DNA, 103 bp, Artificial Sequence
  Synthetic Polynucleotide
taatacgactcactataggggggagggagcccaggtctctctgcagcaggaacagaggagacctgctatggagagacctaacctggcggcagcgcaaaagatg

SEQ ID NO: 212939 - DNA, 103 bp, Artificial Sequence
  Synthetic Polynucleotide
taatacgactcactatagggctctgccgcagggagggagcccaggtctctaacagaggagaagagacatgggctccctcaacctggcggcagcgcaaaagatg

SEQ ID NO: 212940 - DNA, 103 bp, Artificial Sequence
  Synthetic Polynucleotide
taatacgactcactatagggcagggggtggctctgccgcagggagggagcaacagaggagagctcccatgctgcggcagaacctggcggcagcgcaaaagatg

SEQ ID NO: 212941 - DNA, 103 bp, Artificial Sequence
  Synthetic Polynucleotide
taatacgactcactataggggactcgggtgcagggggtggctctgccgcaaacagaggagatgcggcatggccacccccaacctggcggcagcgcaaaagatg

SEQ ID NO: 212942 - DNA, 103 bp, Artificial Sequence
  Synthetic Polynucleotide
taatacgactcactatagggctctaggcctgactcgggtgcagggggtggaacagaggagaccacccatggcacccgagaacctggcggcagcgcaaaagatg

SEQ ID NO: 212943 - DNA, 103 bp, Artificial Sequence
  Synthetic Polynucleotide
taatacgactcactatagggtgagcttgtcctctaggcctgactcgggtgaacagaggagacacccgatgcaggcctagaacctggcggcagcgcaaaagatg

SEQ ID NO: 212944 - DNA, 103 bp, Artificial Sequence
  Synthetic Polynucleotide
taatacgactcactatagggaggcgctcactgagcttgtcctctaggcctaacagaggagaaggcctatgggacaagctaacctggcggcagcgcaaaagatg

SEQ ID NO: 212945 - DNA, 103 bp, Artificial Sequence
  Synthetic Polynucleotide
taatacgactcactatagggggcttcccccaggcgctcactgagcttgtcaacagaggagagacaagatgagtgagcgcaacctggcggcagcgcaaaagatg

SEQ ID NO: 212946 - DNA, 103 bp, Artificial Sequence
  Synthetic Polynucleotide
taatacgactcactatagggggcctgcccaggcttcccccaggcgctcacaacagaggagagtgagcatgtgggggaagaacctggcggcagcgcaaaagatg

SEQ ID NO: 212947 - DNA, 103 bp, Artificial Sequence
  Synthetic Polynucleotide
taatacgactcactataggggcagcccctcggcctgcccaggcttcccccaacagaggagagggggaatgctgggcaggaacctggcggcagcgcaaaagatg

SEQ ID NO: 212948 - DNA, 103 bp, Artificial Sequence
  Synthetic Polynucleotide
taatacgactcactataggggctccccgctccctccagcttgaaattctcaacagaggagagagaatatgaagctggagaacctggcggcagcgcaaaagatg

SEQ ID NO: 212949 - DNA, 103 bp, Artificial Sequence
  Synthetic Polynucleotide
taatacgactcactatagggctcccaccaggcagcccctcggcctgcccaaacagaggagatgggcaatgcgaggggctaacctggcggcagcgcaaaagatg

SEQ ID NO: 212950 - DNA, 103 bp, Artificial Sequence
  Synthetic Polynucleotide
taatacgactcactatagggcctgctgcctctcccaccaggcagcccctcaacagaggagagaggggatgcctggtgggaacctggcggcagcgcaaaagatg

SEQ ID NO: 212951 - DNA, 103 bp, Artificial Sequence
  Synthetic Polynucleotide
taatacgactcactataggggaggtcctgccctgctgcctctcccaccagaacagaggagactggtgatggaggcagcaaacctggcggcagcgcaaaagatg

SEQ ID NO: 212952 - DNA, 103 bp, Artificial Sequence
  Synthetic Polynucleotide
taatacgactcactatagggcccgggctccgaggtcctgccctgctgcctaacagaggagaaggcagatgggcaggaccaacctggcggcagcgcaaaagatg

SEQ ID NO: 212953 - DNA, 103 bp, Artificial Sequence
  Synthetic Polynucleotide
taatacgactcactatagggtggtctgtctcccgggctccgaggtcctgcaacagaggagagcaggaatgcggagcccgaacctggcggcagcgcaaaagatg

SEQ ID NO: 212954 - DNA, 103 bp, Artificial Sequence
  Synthetic Polynucleotide
taatacgactcactatagggttgggccgcctggtctgtctcccgggctccaacagaggagaggagccatggagacagacaacctggcggcagcgcaaaagatg

SEQ ID NO: 212955 - DNA, 103 bp, Artificial Sequence
  Synthetic Polynucleotide
taatacgactcactatagggggtccggcgcttgggccgcctggtctgtctaacagaggagaagacagatgaggcggcccaacctggcggcagcgcaaaagatg

SEQ ID NO: 212956 - DNA, 103 bp, Artificial Sequence
  Synthetic Polynucleotide
taatacgactcactatagggtggacagctgggtccggcgcttgggccgccaacagaggagaggcggcatgagcgccggaaacctggcggcagcgcaaaagatg

SEQ ID NO: 212957 - DNA, 103 bp, Artificial Sequence
  Synthetic Polynucleotide
taatacgactcactataggggaaaagctgctggacagctgggtccggcgcaacagaggagagcgccgatgccagctgtcaacctggcggcagcgcaaaagatg

SEQ ID NO: 212958 - DNA, 103 bp, Artificial Sequence
  Synthetic Polynucleotide
taatacgactcactataggggccactgagcgaaaagctgctggacagctgaacagaggagacagctgatgagcagctttaacctggcggcagcgcaaaagatg

SEQ ID NO: 212959 - DNA, 103 bp, Artificial Sequence
  Synthetic Polynucleotide
taatacgactcactatagggtcaggccagggtcccagggatcgatgagggaacagaggagaccctcaatgatccctgggaacctggcggcagcgcaaaagatg

SEQ ID NO: 212960 - DNA, 103 bp, Artificial Sequence
  Synthetic Polynucleotide
taatacgactcactatagggtcttagtgcggctccccgctccctccagctaacagaggagaagctggatggagcggggaaacctggcggcagcgcaaaagatg

SEQ ID NO: 212961 - DNA, 103 bp, Artificial Sequence
  Synthetic Polynucleotide
taatacgactcactataggggatccacatggccactgagcgaaaagctgcaacagaggagagcagctatgcgctcagtgaacctggcggcagcgcaaaagatg

SEQ ID NO: 212962 - DNA, 103 bp, Artificial Sequence
  Synthetic Polynucleotide
taatacgactcactatagggtcctctgagggatccacatggccactgagcaacagaggagagctcagatgccatgtggaaacctggcggcagcgcaaaagatg

SEQ ID NO: 212963 - DNA, 103 bp, Artificial Sequence
  Synthetic Polynucleotide
taatacgactcactatagggggagctggtgtcctctgagggatccacatgaacagaggagacatgtgatgccctcagagaacctggcggcagcgcaaaagatg

SEQ ID NO: 212964 - DNA, 103 bp, Artificial Sequence
  Synthetic Polynucleotide
taatacgactcactatagggggctatgaggggagctggtgtcctctgaggaacagaggagacctcagatgacaccagctaacctggcggcagcgcaaaagatg

SEQ ID NO: 212965 - DNA, 103 bp, Artificial Sequence
  Synthetic Polynucleotide
taatacgactcactatagggggccactcagggctatgaggggagctggtgaacagaggagacaccagatgccctcatagaacctggcggcagcgcaaaagatg

SEQ ID NO: 212966 - DNA, 103 bp, Artificial Sequence
  Synthetic Polynucleotide
taatacgactcactatagggatcagcaggtggccactcagggctatgaggaacagaggagacctcatatgcctgagtggaacctggcggcagcgcaaaagatg

SEQ ID NO: 212967 - DNA, 103 bp, Artificial Sequence
  Synthetic Polynucleotide
taatacgactcactatagggggggcagagcatcagcaggtggccactcagaacagaggagactgagtatgcacctgctgaacctggcggcagcgcaaaagatg

SEQ ID NO: 212968 - DNA, 103 bp, Artificial Sequence
  Synthetic Polynucleotide
taatacgactcactataggggtggggggcaggggcagagcatcagcaggtaacagaggagaacctgcatgtgctctgccaacctggcggcagcgcaaaagatg

SEQ ID NO: 212969 - DNA, 103 bp, Artificial Sequence
  Synthetic Polynucleotide
taatacgactcactataggggggcggggtcgtggggggcaggggcagagcaacagaggagagctctgatgctgccccccaacctggcggcagcgcaaaagatg

SEQ ID NO: 212970 - DNA, 103 bp, Artificial Sequence
  Synthetic Polynucleotide
taatacgactcactatagggactcctgggagggcggggtcgtggggggcaaacagaggagatgccccatgcgaccccgcaacctggcggcagcgcaaaagatg

SEQ ID NO: 212971 - DNA, 103 bp, Artificial Sequence
  Synthetic Polynucleotide
taatacgactcactatagggactgtcttcttcttagtgcggctccccgctaacagaggagaagcgggatgccgcactaaaacctggcggcagcgcaaaagatg

SEQ ID NO: 212972 - DNA, 103 bp, Artificial Sequence
  Synthetic Polynucleotide
taatacgactcactatagggtccggagtcaactcctgggagggcggggtcaacagaggagagaccccatgctcccaggaaacctggcggcagcgcaaaagatg

SEQ ID NO: 212973 - DNA, 103 bp, Artificial Sequence
  Synthetic Polynucleotide
taatacgactcactatagggggcgcatgcatccggagtcaactcctgggaaacagaggagatcccagatgttgactccgaacctggcggcagcgcaaaagatg

SEQ ID NO: 212974 - DNA, 103 bp, Artificial Sequence
  Synthetic Polynucleotide
taatacgactcactatagggggacgccctgggcgcatgcatccggagtcaaacagaggagatgactcatgatgcatgcgaacctggcggcagcgcaaaagatg

SEQ ID NO: 212975 - DNA, 103 bp, Artificial Sequence
  Synthetic Polynucleotide
taatacgactcactatagggtgctctgatgggacgccctgggcgcatgcaaacagaggagatgcatgatgccagggcgtaacctggcggcagcgcaaaagatg

SEQ ID NO: 212976 - DNA, 103 bp, Artificial Sequence
  Synthetic Polynucleotide
taatacgactcactatagggcatctgccgctgctctgatgggacgccctgaacagaggagacagggcatgccatcagagaacctggcggcagcgcaaaagatg

SEQ ID NO: 212977 - DNA, 103 bp, Artificial Sequence
  Synthetic Polynucleotide
taatacgactcactatagggagtcacggagcatctgccgctgctctgatgaacagaggagacatcagatgagcggcagaaacctggcggcagcgcaaaagatg

SEQ ID NO: 212978 - DNA, 103 bp, Artificial Sequence
  Synthetic Polynucleotide
taatacgactcactatagggttggccatgtagtcacggagcatctgccgcaacagaggagagcggcaatggctccgtgaaacctggcggcagcgcaaaagatg

SEQ ID NO: 212979 - DNA, 103 bp, Artificial Sequence
  Synthetic Polynucleotide
taatacgactcactataggggggtggtagcttggccatgtagtcacggagaacagaggagactccgtatgtacatggccaacctggcggcagcgcaaaagatg

SEQ ID NO: 212980 - DNA, 103 bp, Artificial Sequence
  Synthetic Polynucleotide
taatacgactcactatagggtgtccctctggggtggtagcttggccatgtaacagaggagaacatggatgagctaccacaacctggcggcagcgcaaaagatg

SEQ ID NO: 212981 - DNA, 103 bp, Artificial Sequence
  Synthetic Polynucleotide
taatacgactcactatagggcagcctggggtgtccctctggggtggtagcaacagaggagagctaccatgccagagggaaacctggcggcagcgcaaaagatg

SEQ ID NO: 212982 - DNA, 103 bp, Artificial Sequence
  Synthetic Polynucleotide
taatacgactcactatagggcacactgaccactgtcttcttcttagtgcgaacagaggagacgcactatgaagaagacaaacctggcggcagcgcaaaagatg

SEQ ID NO: 212983 - DNA, 103 bp, Artificial Sequence
  Synthetic Polynucleotide
taatacgactcactatagggtgtggtggcacagcctggggtgtccctctgaacagaggagacagaggatgaccccaggcaacctggcggcagcgcaaaagatg

SEQ ID NO: 212984 - DNA, 103 bp, Artificial Sequence
  Synthetic Polynucleotide
taatacgactcactatagggagtggggaggtgtggtggcacagcctggggaacagaggagaccccagatggtgccaccaaacctggcggcagcgcaaaagatg

SEQ ID NO: 212985 - DNA, 103 bp, Artificial Sequence
  Synthetic Polynucleotide
taatacgactcactataggggaggcctgggagtggggaggtgtggtggcaaacagaggagatgccacatgacctccccaaacctggcggcagcgcaaaagatg

SEQ ID NO: 212986 - DNA, 103 bp, Artificial Sequence
  Synthetic Polynucleotide
taatacgactcactatagggccggacgctggaggcctgggagtggggaggaacagaggagacctcccatgtcccaggccaacctggcggcagcgcaaaagatg

SEQ ID NO: 212987 - DNA, 103 bp, Artificial Sequence
  Synthetic Polynucleotide
taatacgactcactatagggagcgagtggcccggacgctggaggcctgggaacagaggagacccaggatgccagcgtccaacctggcggcagcgcaaaagatg

SEQ ID NO: 212988 - DNA, 103 bp, Artificial Sequence
  Synthetic Polynucleotide
taatacgactcactatagggtgctgctgggagcgagtggcccggacgctgaacagaggagacagcgtatgggccactcgaacctggcggcagcgcaaaagatg

SEQ ID NO: 212989 - DNA, 103 bp, Artificial Sequence
  Synthetic Polynucleotide
taatacgactcactataggggacgggtgtgtgctgctgggagcgagtggcaacagaggagagccactatgtcccagcagaacctggcggcagcgcaaaagatg

SEQ ID NO: 212990 - DNA, 103 bp, Artificial Sequence
  Synthetic Polynucleotide
taatacgactcactatagggagctagagaggacgggtgtgtgctgctgggaacagaggagacccagcatgacacacccgaacctggcggcagcgcaaaagatg

SEQ ID NO: 212991 - DNA, 103 bp, Artificial Sequence
  Synthetic Polynucleotide
taatacgactcactatagggaggggctgagagctagagaggacgggtgtgaacagaggagacacaccatgcctctctagaacctggcggcagcgcaaaagatg

SEQ ID NO: 212992 - DNA, 103 bp, Artificial Sequence
  Synthetic Polynucleotide
taatacgactcactatagggcttcttccggaggggctgagagctagagagaacagaggagactctctatgtctcagcccaacctggcggcagcgcaaaagatg

SEQ ID NO: 212993 - DNA, 103 bp, Artificial Sequence
  Synthetic Polynucleotide
taatacgactcactataggggcagcttcttcacactgaccactgtcttctaacagaggagaagaagaatgtggtcagtgaacctggcggcagcgcaaaagatg

SEQ ID NO: 212994 - DNA, 103 bp, Artificial Sequence
  Synthetic Polynucleotide
taatacgactcactatagggccattcgaggcttcttccggaggggctgagaacagaggagactcagcatgtccggaagaaacctggcggcagcgcaaaagatg

SEQ ID NO: 212995 - DNA, 103 bp, Artificial Sequence
  Synthetic Polynucleotide
taatacgactcactatagggaggtcctggagcagcttcttcacactgaccaacagaggagaggtcagatggaagaagctaacctggcggcagcgcaaaagatg

SEQ ID NO: 212996 - DNA, 103 bp, Artificial Sequence
  Synthetic Polynucleotide
taatacgactcactataggggtgtccaccgaggtcctggagcagcttcttaacagaggagaaagaagatgctccaggacaacctggcggcagcgcaaaagatg

SEQ ID NO: 212997 - DNA, 103 bp, Artificial Sequence
  Synthetic Polynucleotide
taatacgactcactatagggcccagggctggtgtccaccgaggtcctggaaacagaggagatccaggatgtcggtggacaacctggcggcagcgcaaaagatg

SEQ ID NO: 212998 - DNA, 103 bp, Artificial Sequence
  Synthetic Polynucleotide
taatacgactcactatagggcagggacacccccagggctggtgtccaccgaacagaggagacggtggatgccagccctgaacctggcggcagcgcaaaagatg

SEQ ID NO: 212999 - DNA, 103 bp, Artificial Sequence
  Synthetic Polynucleotide
taatacgactcactataggggaggtaagcccagggacacccccagggctgaacagaggagacagcccatggggtgtcccaacctggcggcagcgcaaaagatg

SEQ ID NO: 213000 - DNA, 103 bp, Artificial Sequence
  Synthetic Polynucleotide
taatacgactcactataggggtcggttgctgaggtaagcccagggacaccaacagaggagaggtgtcatggggcttaccaacctggcggcagcgcaaaagatg

SEQ ID NO: 213001 - DNA, 103 bp, Artificial Sequence
  Synthetic Polynucleotide
taatacgactcactatagggtcccgggcagtcaggccagggtcccagggaaacagaggagatccctgatgccctggcctaacctggcggcagcgcaaaagatg

SEQ ID NO: 213002 - DNA, 103 bp, Artificial Sequence
  Synthetic Polynucleotide
taatacgactcactatagggaagcggcgctgtcggttgctgaggtaagccaacagaggagaggcttaatgcagcaaccgaacctggcggcagcgcaaaagatg

SEQ ID NO: 213003 - DNA, 103 bp, Artificial Sequence
  Synthetic Polynucleotide
taatacgactcactataggggaggatagagaagcggcgctgtcggttgctaacagaggagaagcaacatgcagcgccgcaacctggcggcagcgcaaaagatg

SEQ ID NO: 213004 - DNA, 103 bp, Artificial Sequence
  Synthetic Polynucleotide
taatacgactcactatagggtggggcccccgaggatagagaagcggcgctaacagaggagaagcgccatgtctctatccaacctggcggcagcgcaaaagatg

SEQ ID NO: 213005 - DNA, 103 bp, Artificial Sequence
  Synthetic Polynucleotide
taatacgactcactataggggtgcccaggatggggcccccgaggatagagaacagaggagactctatatgcgggggcccaacctggcggcagcgcaaaagatg

SEQ ID NO: 213006 - DNA, 103 bp, Artificial Sequence
  Synthetic Polynucleotide
taatacgactcactatagggcgccaccgacgtgcccaggatggggcccccaacagaggagagggggcatgatcctgggcaacctggcggcagcgcaaaagatg

SEQ ID NO: 213007 - DNA, 103 bp, Artificial Sequence
  Synthetic Polynucleotide
taatacgactcactatagggccaagtggctcgccaccgacgtgcccaggaaacagaggagatcctggatgcgtcggtggaacctggcggcagcgcaaaagatg

SEQ ID NO: 213008 - DNA, 103 bp, Artificial Sequence
  Synthetic Polynucleotide
taatacgactcactatagggagcagctctgccaagtggctcgccaccgacaacagaggagagtcggtatggagccacttaacctggcggcagcgcaaaagatg

SEQ ID NO: 213009 - DNA, 103 bp, Artificial Sequence
  Synthetic Polynucleotide
taatacgactcactatagggctcctcgtgcagcagctctgccaagtggctaacagaggagaagccacatggcagagctgaacctggcggcagcgcaaaagatg

SEQ ID NO: 213010 - DNA, 103 bp, Artificial Sequence
  Synthetic Polynucleotide
taatacgactcactataggggcagcaccagctcctcgtgcagcagctctgaacagaggagacagagcatgtgcacgaggaacctggcggcagcgcaaaagatg

SEQ ID NO: 213011 - DNA, 103 bp, Artificial Sequence
  Synthetic Polynucleotide
taatacgactcactatagggtgctcccaccgcagcaccagctcctcgtgcaacagaggagagcacgaatggctggtgctaacctggcggcagcgcaaaagatg

SEQ ID NO: 213012 - DNA, 103 bp, Artificial Sequence
  Synthetic Polynucleotide
taatacgactcactataggggaaaagcaggtcccgggcagtcaggccaggaacagaggagacctggcatgactgcccggaacctggcggcagcgcaaaagatg

SEQ ID NO: 213013 - DNA, 103 bp, Artificial Sequence
  Synthetic Polynucleotide
taatacgactcactatagggcagaagcagctgctcccaccgcagcaccagaacagaggagactggtgatgcggtgggagaacctggcggcagcgcaaaagatg

SEQ ID NO: 213014 - DNA, 103 bp, Artificial Sequence
  Synthetic Polynucleotide
taatacgactcactatagggaggcctcatccagaagcagctgctcccaccaacagaggagaggtgggatgagctgcttcaacctggcggcagcgcaaaagatg

SEQ ID NO: 213015 - DNA, 103 bp, Artificial Sequence
  Synthetic Polynucleotide
taatacgactcactatagggcccccagtgcaggcctcatccagaagcagcaacagaggagagctgctatgggatgaggcaacctggcggcagcgcaaaagatg

SEQ ID NO: 213016 - DNA, 103 bp, Artificial Sequence
  Synthetic Polynucleotide
taatacgactcactatagggggccagcgcgcccccagtgcaggcctcatcaacagaggagagatgagatgtgcactgggaacctggcggcagcgcaaaagatg

SEQ ID NO: 213017 - DNA, 103 bp, Artificial Sequence
  Synthetic Polynucleotide
taatacgactcactatagggcaggaacccaggccagcgcgcccccagtgcaacagaggagagcactgatggcgcgctggaacctggcggcagcgcaaaagatg

SEQ ID NO: 213018 - DNA, 103 bp, Artificial Sequence
  Synthetic Polynucleotide
taatacgactcactatagggggtgtccttccaggaacccaggccagcgcgaacagaggagacgcgctatgctgggttccaacctggcggcagcgcaaaagatg

SEQ ID NO: 213019 - DNA, 103 bp, Artificial Sequence
  Synthetic Polynucleotide
taatacgactcactatagggcccgaactggggtgtccttccaggaacccaaacagaggagatgggttatgggaaggacaaacctggcggcagcgcaaaagatg

SEQ ID NO: 213020 - DNA, 103 bp, Artificial Sequence
  Synthetic Polynucleotide
taatacgactcactatagggagaccagctgcccgaactggggtgtccttcaacagaggagagaaggaatgcccagttcgaacctggcggcagcgcaaaagatg

SEQ ID NO: 213021 - DNA, 103 bp, Artificial Sequence
  Synthetic Polynucleotide
taatacgactcactatagggccagcagggtagaccagctgcccgaactggaacagaggagaccagttatggcagctggtaacctggcggcagcgcaaaagatg

SEQ ID NO: 213022 - DNA, 103 bp, Artificial Sequence
  Synthetic Polynucleotide
taatacgactcactatagggctgggcgcctccagcagggtagaccagctgaacagaggagacagctgatgtaccctgctaacctggcggcagcgcaaaagatg

SEQ ID NO: 213023 - DNA, 103 bp, Artificial Sequence
  Synthetic Polynucleotide
taatacgactcactatagggaccctccgcggaaaagcaggtcccgggcagaacagaggagactgcccatgacctgctttaacctggcggcagcgcaaaagatg

SEQ ID NO: 213024 - DNA, 103 bp, Artificial Sequence
  Synthetic Polynucleotide
taatacgactcactataggggcagcctgtcctgggcgcctccagcagggtaacagaggagaaccctgatggaggcgcccaacctggcggcagcgcaaaagatg

SEQ ID NO: 213025 - DNA, 103 bp, Artificial Sequence
  Synthetic Polynucleotide
taatacgactcactatagggtcttggaaatgcagcctgtcctgggcgcctaacagaggagaaggcgcatgggacaggctaacctggcggcagcgcaaaagatg

SEQ ID NO: 213026 - DNA, 103 bp, Artificial Sequence
  Synthetic Polynucleotide
taatacgactcactatagggcagaacgacctcttggaaatgcagcctgtcaacagaggagagacaggatgcatttccaaaacctggcggcagcgcaaaagatg

SEQ ID NO: 213027 - DNA, 103 bp, Artificial Sequence
  Synthetic Polynucleotide
taatacgactcactatagggcacctggggtcagaacgacctcttggaaataacagaggagaatttccatgaggtcgttcaacctggcggcagcgcaaaagatg

SEQ ID NO: 213028 - DNA, 103 bp, Artificial Sequence
  Synthetic Polynucleotide
taatacgactcactatagggtggggattgtcacctggggtcagaacgaccaacagaggagaggtcgtatggaccccaggaacctggcggcagcgcaaaagatg

SEQ ID NO: 213029 - DNA, 103 bp, Artificial Sequence
  Synthetic Polynucleotide
taatacgactcactatagggcccaaggaattggggattgtcacctggggtaacagaggagaaccccaatggacaatcccaacctggcggcagcgcaaaagatg

SEQ ID NO: 213030 - DNA, 103 bp, Artificial Sequence
  Synthetic Polynucleotide
taatacgactcactataggggtccaggtttcccaaggaattggggattgtaacagaggagaacaatcatgaattccttgaacctggcggcagcgcaaaagatg

SEQ ID NO: 213031 - DNA, 103 bp, Artificial Sequence
  Synthetic Polynucleotide
taatacgactcactatagggagctggatgcgtccaggtttcccaaggaataacagaggagaattcctatggaaacctggaacctggcggcagcgcaaaagatg

SEQ ID NO: 213032 - DNA, 103 bp, Artificial Sequence
  Synthetic Polynucleotide
taatacgactcactatagggaggtccctggagctggatgcgtccaggtttaacagaggagaaaacctatgcgcatccagaacctggcggcagcgcaaaagatg

SEQ ID NO: 213033 - DNA, 103 bp, Artificial Sequence
  Synthetic Polynucleotide
taatacgactcactatagggcttgccggacaggtccctggagctggatgcaacagaggagagcatccatgtccagggacaacctggcggcagcgcaaaagatg

SEQ ID NO: 213034 - DNA, 103 bp, Artificial Sequence
  Synthetic Polynucleotide
taatacgactcactatagggcgataccggcaccctccgcggaaaagcaggaacagaggagacctgctatgccgcggaggaacctggcggcagcgcaaaagatg

SEQ ID NO: 213035 - DNA, 103 bp, Artificial Sequence
  Synthetic Polynucleotide
taatacgactcactatagggcatgtcaccacttgccggacaggtccctggaacagaggagaccagggatgtgtccggcaaacctggcggcagcgcaaaagatg

SEQ ID NO: 213036 - DNA, 103 bp, Artificial Sequence
  Synthetic Polynucleotide
taatacgactcactatagggctggacggtgcatgtcaccacttgccggacaacagaggagagtccggatggtggtgacaaacctggcggcagcgcaaaagatg

SEQ ID NO: 213037 - DNA, 103 bp, Artificial Sequence
  Synthetic Polynucleotide
taatacgactcactataggggagtttctccctggacggtgcatgtcaccaaacagaggagatggtgaatggcaccgtccaacctggcggcagcgcaaaagatg

SEQ ID NO: 213038 - DNA, 103 bp, Artificial Sequence
  Synthetic Polynucleotide
taatacgactcactatagggacggccagcagagtttctccctggacggtgaacagaggagacaccgtatggggagaaacaacctggcggcagcgcaaaagatg

SEQ ID NO: 213039 - DNA, 103 bp, Artificial Sequence
  Synthetic Polynucleotide
taatacgactcactataggggtcagagcggacggccagcagagtttctccaacagaggagaggagaaatgctgctggccaacctggcggcagcgcaaaagatg

SEQ ID NO: 213040 - DNA, 103 bp, Artificial Sequence
  Synthetic Polynucleotide
taatacgactcactatagggcacagtggtagtcagagcggacggccagcaaacagaggagatgctggatgtccgctctgaacctggcggcagcgcaaaagatg

SEQ ID NO: 213041 - DNA, 103 bp, Artificial Sequence
  Synthetic Polynucleotide
taatacgactcactatagggttccacacggcacagtggtagtcagagcggaacagaggagaccgctcatgctaccactgaacctggcggcagcgcaaaagatg

SEQ ID NO: 213042 - DNA, 103 bp, Artificial Sequence
  Synthetic Polynucleotide
taatacgactcactatagggtttaccaaacttccacacggcacagtggtaaacagaggagataccacatggccgtgtggaacctggcggcagcgcaaaagatg

SEQ ID NO: 213043 - DNA, 103 bp, Artificial Sequence
  Synthetic Polynucleotide
taatacgactcactataggggctgccactgtttaccaaacttccacacggaacagaggagaccgtgtatgagtttggtaaacctggcggcagcgcaaaagatg

SEQ ID NO: 213044 - DNA, 103 bp, Artificial Sequence
  Synthetic Polynucleotide
taatacgactcactatagggagaagggttggctgccactgtttaccaaacaacagaggagagtttggatgacagtggcaaacctggcggcagcgcaaaagatg

SEQ ID NO: 213045 - DNA, 103 bp, Artificial Sequence
  Synthetic Polynucleotide
taatacgactcactataggggggccgcttccgataccggcaccctccgcgaacagaggagacgcggaatgtgccggtataacctggcggcagcgcaaaagatg

SEQ ID NO: 213046 - DNA, 103 bp, Artificial Sequence
  Synthetic Polynucleotide
taatacgactcactatagggcattgcctgcagaagggttggctgccactgaacagaggagacagtggatgccaacccttaacctggcggcagcgcaaaagatg

SEQ ID NO: 213047 - DNA, 103 bp, Artificial Sequence
  Synthetic Polynucleotide
taatacgactcactatagggtctccacctgcattgcctgcagaagggttgaacagaggagacaacccatgtgcaggcaaaacctggcggcagcgcaaaagatg

SEQ ID NO: 213048 - DNA, 103 bp, Artificial Sequence
  Synthetic Polynucleotide
taatacgactcactataggggtggcccctttctccacctgcattgcctgcaacagaggagagcaggcatggcaggtggaaacctggcggcagcgcaaaagatg

SEQ ID NO: 213049 - DNA, 103 bp, Artificial Sequence
  Synthetic Polynucleotide
taatacgactcactataggggctgatccccgtggcccctttctccacctgaacagaggagacaggtgatgaaaggggccaacctggcggcagcgcaaaagatg

SEQ ID NO: 213050 - DNA, 103 bp, Artificial Sequence
  Synthetic Polynucleotide
taatacgactcactataggggagggctgaggctgatccccgtggccccttaacagaggagaaaggggatgcggggatcaaacctggcggcagcgcaaaagatg

SEQ ID NO: 213051 - DNA, 103 bp, Artificial Sequence
  Synthetic Polynucleotide
taatacgactcactatagggccgggcaggtgagggctgaggctgatccccaacagaggagaggggatatgcctcagcccaacctggcggcagcgcaaaagatg

SEQ ID NO: 213052 - DNA, 103 bp, Artificial Sequence
  Synthetic Polynucleotide
taatacgactcactatagggggccagctccccgggcaggtgagggctgagaacagaggagactcagcatgcacctgcccaacctggcggcagcgcaaaagatg

SEQ ID NO: 213053 - DNA, 103 bp, Artificial Sequence
  Synthetic Polynucleotide
taatacgactcactatagggggctgcagatggccagctccccgggcaggtaacagaggagaacctgcatggggagctggaacctggcggcagcgcaaaagatg

SEQ ID NO: 213054 - DNA, 103 bp, Artificial Sequence
  Synthetic Polynucleotide
taatacgactcactataggggctcccgagcggctgcagatggccagctccaacagaggagaggagctatgcatctgcagaacctggcggcagcgcaaaagatg

SEQ ID NO: 213055 - DNA, 103 bp, Artificial Sequence
  Synthetic Polynucleotide
taatacgactcactatagggcaggcagacggctcccgagcggctgcagataacagaggagaatctgcatgcgctcgggaaacctggcggcagcgcaaaagatg

SEQ ID NO: 213056 - DNA, 103 bp, Artificial Sequence
  Synthetic Polynucleotide
taatacgactcactataggggcacgactcggggccgcttccgataccggcaacagaggagagccggtatgggaagcggcaacctggcggcagcgcaaaagatg

SEQ ID NO: 213057 - DNA, 103 bp, Artificial Sequence
  Synthetic Polynucleotide
taatacgactcactatagggcagggctccacaggcagacggctcccgagcaacagaggagagctcggatgccgtctgccaacctggcggcagcgcaaaagatg

SEQ ID NO: 213058 - DNA, 103 bp, Artificial Sequence
  Synthetic Polynucleotide
taatacgactcactatagggagcccatcctcagggctccacaggcagacgaacagaggagacgtctgatggtggagcccaacctggcggcagcgcaaaagatg

SEQ ID NO: 213059 - DNA, 103 bp, Artificial Sequence
  Synthetic Polynucleotide
taatacgactcactataggggatttgccgcagcccatcctcagggctccaaacagaggagatggagcatggaggatgggaacctggcggcagcgcaaaagatg

SEQ ID NO: 213060 - DNA, 103 bp, Artificial Sequence
  Synthetic Polynucleotide
taatacgactcactatagggggtccctgtagatttgccgcagcccatcctaacagaggagaaggatgatgtgcggcaaaaacctggcggcagcgcaaaagatg

SEQ ID NO: 213061 - DNA, 103 bp, Artificial Sequence
  Synthetic Polynucleotide
taatacgactcactatagggagggtctcagggtccctgtagatttgccgcaacagaggagagcggcaatgctacagggaaacctggcggcagcgcaaaagatg

SEQ ID NO: 213062 - DNA, 103 bp, Artificial Sequence
  Synthetic Polynucleotide
taatacgactcactatagggccggaacacgagggtctcagggtccctgtaaacagaggagatacaggatgcctgagaccaacctggcggcagcgcaaaagatg

SEQ ID NO: 213063 - DNA, 103 bp, Artificial Sequence
  Synthetic Polynucleotide
taatacgactcactatagggaagaggagtcccggaacacgagggtctcagaacagaggagactgagaatgtcgtgttccaacctggcggcagcgcaaaagatg

SEQ ID NO: 213064 - DNA, 103 bp, Artificial Sequence
  Synthetic Polynucleotide
taatacgactcactatagggcaacgccacgaagaggagtcccggaacacgaacagaggagacgtgttatgggactcctcaacctggcggcagcgcaaaagatg

SEQ ID NO: 213065 - DNA, 103 bp, Artificial Sequence
  Synthetic Polynucleotide
taatacgactcactataggggaagtctgcccaacgccacgaagaggagtcaacagaggagagactccatgtcgtggcgtaacctggcggcagcgcaaaagatg

SEQ ID NO: 213066 - DNA, 103 bp, Artificial Sequence
  Synthetic Polynucleotide
taatacgactcactatagggggtgcgcagtgaagtctgcccaacgccacgaacagaggagacgtggcatggggcagactaacctggcggcagcgcaaaagatg

SEQ ID NO: 213067 - DNA, 103 bp, Artificial Sequence
  Synthetic Polynucleotide
taatacgactcactataggggtcacatccagcacgactcggggccgcttcaacagaggagagaagcgatgccgagtcgtaacctggcggcagcgcaaaagatg

SEQ ID NO: 213068 - DNA, 103 bp, Artificial Sequence
  Synthetic Polynucleotide
taatacgactcactatagggagcacccgagggtgcgcagtgaagtctgccaacagaggagaggcagaatgcactgcgcaaacctggcggcagcgcaaaagatg

SEQ ID NO: 213069 - DNA, 103 bp, Artificial Sequence
  Synthetic Polynucleotide
taatacgactcactatagggacccacggtcagcacccgagggtgcgcagtaacagaggagaactgcgatgcctcgggtgaacctggcggcagcgcaaaagatg

SEQ ID NO: 213070 - DNA, 103 bp, Artificial Sequence
  Synthetic Polynucleotide
taatacgactcactatagggcggtgcggtcacccacggtcagcacccgagaacagaggagactcgggatgtgaccgtggaacctggcggcagcgcaaaagatg

SEQ ID NO: 213071 - DNA, 103 bp, Artificial Sequence
  Synthetic Polynucleotide
taatacgactcactatagggatcttcactccggtgcggtcacccacggtcaacagaggagagaccgtatgtgaccgcacaacctggcggcagcgcaaaagatg

SEQ ID NO: 213072 - DNA, 103 bp, Artificial Sequence
  Synthetic Polynucleotide
taatacgactcactatagggagtgtccagcatcttcactccggtgcggtcaacagaggagagaccgcatgggagtgaagaacctggcggcagcgcaaaagatg

SEQ ID NO: 213073 - DNA, 103 bp, Artificial Sequence
  Synthetic Polynucleotide
taatacgactcactataggggcgggccctgagtgtccagcatcttcactcaacagaggagagagtgaatgtgctggacaaacctggcggcagcgcaaaagatg

SEQ ID NO: 213074 - DNA, 103 bp, Artificial Sequence
  Synthetic Polynucleotide
taatacgactcactatagggccacagcccggcgggccctgagtgtccagcaacagaggagagctggaatgtcagggcccaacctggcggcagcgcaaaagatg

SEQ ID NO: 213075 - DNA, 103 bp, Artificial Sequence
  Synthetic Polynucleotide
taatacgactcactatagggaagcaacagaccacagcccggcgggccctgaacagaggagacagggcatgccgggctgtaacctggcggcagcgcaaaagatg

SEQ ID NO: 213076 - DNA, 103 bp, Artificial Sequence
  Synthetic Polynucleotide
taatacgactcactatagggccaaacgaaaaagcaacagaccacagcccgaacagaggagacgggctatggtctgttgcaacctggcggcagcgcaaaagatg

SEQ ID NO: 213077 - DNA, 103 bp, Artificial Sequence
  Synthetic Polynucleotide
taatacgactcactataggggcctctgcccccaaacgaaaaagcaacagaaacagaggagatctgttatgttttcgtttaacctggcggcagcgcaaaagatg

SEQ ID NO: 213078 - DNA, 103 bp, Artificial Sequence
  Synthetic Polynucleotide
taatacgactcactatagggtctggcgggctctacaccagtcagcggcataacagaggagaatgccgatgactggtgtaaacctggcggcagcgcaaaagatg

SEQ ID NO: 213079 - DNA, 103 bp, Artificial Sequence
  Synthetic Polynucleotide
taatacgactcactataggggaaatttatgttgttgatgcagacgacctgaacagaggagacaggtcatgtgcatcaacaacctggcggcagcgcaaaagatg

SEQ ID NO: 213080 - DNA, 103 bp, Artificial Sequence
  Synthetic Polynucleotide
taatacgactcactatagggaggtgtctcatctataatcatggcactgtgaacagaggagacacagtatgatgattataaacctggcggcagcgcaaaagatg

SEQ ID NO: 213081 - DNA, 103 bp, Artificial Sequence
  Synthetic Polynucleotide
taatacgactcactatagggttctagtcaaaggtgtctcatctataatcaaacagaggagatgattaatgatgagacacaacctggcggcagcgcaaaagatg

SEQ ID NO: 213082 - DNA, 103 bp, Artificial Sequence
  Synthetic Polynucleotide
taatacgactcactataggggctaaacaccttctagtcaaaggtgtctcaaacagaggagatgagacatgtttgactagaacctggcggcagcgcaaaagatg

SEQ ID NO: 213083 - DNA, 103 bp, Artificial Sequence
  Synthetic Polynucleotide
taatacgactcactatagggcaaggattgggctaaacaccttctagtcaaaacagaggagattgactatgaggtgtttaaacctggcggcagcgcaaaagatg

SEQ ID NO: 213084 - DNA, 103 bp, Artificial Sequence
  Synthetic Polynucleotide
taatacgactcactatagggactgctgggccaaggattgggctaaacaccaacagaggagaggtgttatgcccaatcctaacctggcggcagcgcaaaagatg

SEQ ID NO: 213085 - DNA, 103 bp, Artificial Sequence
  Synthetic Polynucleotide
taatacgactcactatagggcaaccaaaaaactgctgggccaaggattggaacagaggagaccaatcatgggcccagcaaacctggcggcagcgcaaaagatg

SEQ ID NO: 213086 - DNA, 103 bp, Artificial Sequence
  Synthetic Polynucleotide
taatacgactcactatagggagatatgaaacaaccaaaaaactgctgggcaacagaggagagcccagatgttttttggtaacctggcggcagcgcaaaagatg

SEQ ID NO: 213087 - DNA, 103 bp, Artificial Sequence
  Synthetic Polynucleotide
taatacgactcactatagggaagacattctagatatgaaacaaccaaaaaaacagaggagatttttgatggtttcatataacctggcggcagcgcaaaagatg

SEQ ID NO: 213088 - DNA, 103 bp, Artificial Sequence
  Synthetic Polynucleotide
taatacgactcactatagggtcatcagaccaagacattctagatatgaaaaacagaggagatttcatatgtagaatgtcaacctggcggcagcgcaaaagatg

SEQ ID NO: 213089 - DNA, 103 bp, Artificial Sequence
  Synthetic Polynucleotide
taatacgactcactatagggcagcacccattcatcagaccaagacattctaacagaggagaagaatgatgtggtctgataacctggcggcagcgcaaaagatg

SEQ ID NO: 213090 - DNA, 103 bp, Artificial Sequence
  Synthetic Polynucleotide
taatacgactcactatagggattttctctggaaatttatgttgttgatgcaacagaggagagcatcaatgacataaattaacctggcggcagcgcaaaagatg

SEQ ID NO: 213091 - DNA, 103 bp, Artificial Sequence
  Synthetic Polynucleotide
taatacgactcactatagggaaattcccttcagcacccattcatcagaccaacagaggagaggtctgatgaatgggtgcaacctggcggcagcgcaaaagatg

SEQ ID NO: 213092 - DNA, 103 bp, Artificial Sequence
  Synthetic Polynucleotide
taatacgactcactatagggatatagcctgaaattcccttcagcacccataacagaggagaatgggtatggaagggaataacctggcggcagcgcaaaagatg

SEQ ID NO: 213093 - DNA, 103 bp, Artificial Sequence
  Synthetic Polynucleotide
taatacgactcactatagggaagtccatagatatagcctgaaattcccttaacagaggagaaagggaatgtcaggctataacctggcggcagcgcaaaagatg

SEQ ID NO: 213094 - DNA, 103 bp, Artificial Sequence
  Synthetic Polynucleotide
taatacgactcactatagggttttcatccaaagtccatagatatagcctgaacagaggagacaggctatgtctatggacaacctggcggcagcgcaaaagatg

SEQ ID NO: 213095 - DNA, 103 bp, Artificial Sequence
  Synthetic Polynucleotide
taatacgactcactatagggccaaaagtttttttcatccaaagtccatagaacagaggagactatggatgttggatgaaaacctggcggcagcgcaaaagatg

SEQ ID NO: 213096 - DNA, 103 bp, Artificial Sequence
  Synthetic Polynucleotide
taatacgactcactatagggctcattaacaccaaaagtttttttcatccaaacagaggagatggatgatgaaaacttttaacctggcggcagcgcaaaagatg

SEQ ID NO: 213097 - DNA, 103 bp, Artificial Sequence
  Synthetic Polynucleotide
taatacgactcactatagggaatggcggtactcattaacaccaaaagtttaacagaggagaaaacttatggtgttaatgaacctggcggcagcgcaaaagatg

SEQ ID NO: 213098 - DNA, 103 bp, Artificial Sequence
  Synthetic Polynucleotide
taatacgactcactatagggtctttaatccaatggcggtactcattaacaaacagaggagatgttaaatggtaccgccaaacctggcggcagcgcaaaagatg

SEQ ID NO: 213099 - DNA, 103 bp, Artificial Sequence
  Synthetic Polynucleotide
taatacgactcactataggggtctagctcctctttaatccaatggcggtaaacagaggagataccgcatgtggattaaaaacctggcggcagcgcaaaagatg

SEQ ID NO: 213100 - DNA, 103 bp, Artificial Sequence
  Synthetic Polynucleotide
taatacgactcactatagggccactattttgtctagctcctctttaatccaacagaggagaggattaatgaggagctagaacctggcggcagcgcaaaagatg

SEQ ID NO: 213101 - DNA, 103 bp, Artificial Sequence
  Synthetic Polynucleotide
taatacgactcactatagggcccacaacagattttctctggaaatttatgaacagaggagacataaaatgccagagaaaaacctggcggcagcgcaaaagatg

SEQ ID NO: 213102 - DNA, 103 bp, Artificial Sequence
  Synthetic Polynucleotide
taatacgactcactatagggagttcatatgccactattttgtctagctccaacagaggagaggagctatgcaaaatagtaacctggcggcagcgcaaaagatg

SEQ ID NO: 213103 - DNA, 103 bp, Artificial Sequence
  Synthetic Polynucleotide
taatacgactcactatagggaccagtttttagttcatatgccactattttaacagaggagaaaaataatggcatatgaaaacctggcggcagcgcaaaagatg

SEQ ID NO: 213104 - DNA, 103 bp, Artificial Sequence
  Synthetic Polynucleotide
taatacgactcactataggggtaaaaccccaccagtttttagttcatatgaacagaggagacatatgatgtaaaaactgaacctggcggcagcgcaaaagatg

SEQ ID NO: 213105 - DNA, 103 bp, Artificial Sequence
  Synthetic Polynucleotide
taatacgactcactatagggatgggatgtagtaaaaccccaccagtttttaacagaggagaaaaaacatgtggggttttaacctggcggcagcgcaaaagatg

SEQ ID NO: 213106 - DNA, 103 bp, Artificial Sequence
  Synthetic Polynucleotide
taatacgactcactatagggtccaccaaatatgggatgtagtaaaaccccaacagaggagaggggttatgctacatcccaacctggcggcagcgcaaaagatg

SEQ ID NO: 213107 - DNA, 103 bp, Artificial Sequence
  Synthetic Polynucleotide
taatacgactcactatagggtctcttttcctccaccaaatatgggatgtaaacagaggagatacatcatgtatttggtgaacctggcggcagcgcaaaagatg

SEQ ID NO: 213108 - DNA, 103 bp, Artificial Sequence
  Synthetic Polynucleotide
taatacgactcactatagggggattatccttctcttttcctccaccaaataacagaggagaatttggatgaggaaaagaaacctggcggcagcgcaaaagatg

SEQ ID NO: 213109 - DNA, 103 bp, Artificial Sequence
  Synthetic Polynucleotide
taatacgactcactatagggatgggaagccggattatccttctcttttccaacagaggagaggaaaaatgaaggataataacctggcggcagcgcaaaagatg

SEQ ID NO: 213110 - DNA, 103 bp, Artificial Sequence
  Synthetic Polynucleotide
taatacgactcactatagggaaaagtgtagatgggaagccggattatcctaacagaggagaaggataatgcggcttcccaacctggcggcagcgcaaaagatg

SEQ ID NO: 213111 - DNA, 103 bp, Artificial Sequence
  Synthetic Polynucleotide
taatacgactcactatagggtgctttattgaaaagtgtagatgggaagccaacagaggagaggcttcatgtctacacttaacctggcggcagcgcaaaagatg

SEQ ID NO: 213112 - DNA, 103 bp, Artificial Sequence
  Synthetic Polynucleotide
taatacgactcactatagggttccacaaatcccacaacagattttctctgaacagaggagacagagaatgtctgttgtgaacctggcggcagcgcaaaagatg

SEQ ID NO: 213113 - DNA, 103 bp, Artificial Sequence
  Synthetic Polynucleotide
taatacgactcactatagggtgtatgtggatgctttattgaaaagtgtagaacagaggagactacacatgtcaataaagaacctggcggcagcgcaaaagatg

SEQ ID NO: 213114 - DNA, 103 bp, Artificial Sequence
  Synthetic Polynucleotide
taatacgactcactatagggcccaggacagtgtatgtggatgctttattgaacagaggagacaataaatgatccacataaacctggcggcagcgcaaaagatg

SEQ ID NO: 213115 - DNA, 103 bp, Artificial Sequence
  Synthetic Polynucleotide
taatacgactcactatagggctgtagtattcccaggacagtgtatgtggaaacagaggagatccacaatgactgtcctgaacctggcggcagcgcaaaagatg

SEQ ID NO: 213116 - DNA, 103 bp, Artificial Sequence
  Synthetic Polynucleotide
taatacgactcactatagggctgaaacatactgtagtattcccaggacagaacagaggagactgtccatggaatactacaacctggcggcagcgcaaaagatg

SEQ ID NO: 213117 - DNA, 103 bp, Artificial Sequence
  Synthetic Polynucleotide
taatacgactcactataggggggctttacactgaaacatactgtagtattaacagaggagaaatactatggtatgtttcaacctggcggcagcgcaaaagatg

SEQ ID NO: 213118 - DNA, 103 bp, Artificial Sequence
  Synthetic Polynucleotide
taatacgactcactatagggatcacaaggtgggctttacactgaaacataaacagaggagatatgttatggtgtaaagcaacctggcggcagcgcaaaagatg

SEQ ID NO: 213119 - DNA, 103 bp, Artificial Sequence
  Synthetic Polynucleotide
taatacgactcactatagggaatcaatctcatcacaaggtgggctttacaaacagaggagatgtaaaatgcaccttgtgaacctggcggcagcgcaaaagatg

SEQ ID NO: 213120 - DNA, 103 bp, Artificial Sequence
  Synthetic Polynucleotide
taatacgactcactatagggtcctattttcaatcaatctcatcacaaggtaacagaggagaaccttgatgtgagattgaaacctggcggcagcgcaaaagatg

SEQ ID NO: 213121 - DNA, 103 bp, Artificial Sequence
  Synthetic Polynucleotide
taatacgactcactatagggtccatactgatcctattttcaatcaatctcaacagaggagagagattatgtgaaaatagaacctggcggcagcgcaaaagatg

SEQ ID NO: 213122 - DNA, 103 bp, Artificial Sequence
  Synthetic Polynucleotide
taatacgactcactatagggtagcataaattccatactgatcctattttcaacagaggagagaaaatatgatcagtatgaacctggcggcagcgcaaaagatg

SEQ ID NO: 213123 - DNA, 103 bp, Artificial Sequence
  Synthetic Polynucleotide
taatacgactcactatagggatatagtcagttccacaaatcccacaacagaacagaggagactgttgatggatttgtggaacctggcggcagcgcaaaagatg

SEQ ID NO: 213124 - DNA, 103 bp, Artificial Sequence
  Synthetic Polynucleotide
taatacgactcactatagggtgaaaacttgtagcataaattccatactgaaacagaggagatcagtaatgaatttatgcaacctggcggcagcgcaaaagatg

SEQ ID NO: 213125 - DNA, 103 bp, Artificial Sequence
  Synthetic Polynucleotide
taatacgactcactatagggagcagtttattgaaaacttgtagcataaataacagaggagaatttatatgacaagttttaacctggcggcagcgcaaaagatg

SEQ ID NO: 213126 - DNA, 103 bp, Artificial Sequence
  Synthetic Polynucleotide
taatacgactcactatagggagccagacttagcagtttattgaaaacttgaacagaggagacaagttatgaataaactgaacctggcggcagcgcaaaagatg

SEQ ID NO: 213127 - DNA, 103 bp, Artificial Sequence
  Synthetic Polynucleotide
taatacgactcactatagggaagcagtactagccagacttagcagtttataacagaggagaataaacatgtaagtctggaacctggcggcagcgcaaaagatg

SEQ ID NO: 213128 - DNA, 103 bp, Artificial Sequence
  Synthetic Polynucleotide
taatacgactcactatagggttctgagatgaagcagtactagccagacttaacagaggagaaagtctatgtagtactgcaacctggcggcagcgcaaaagatg

SEQ ID NO: 213129 - DNA, 103 bp, Artificial Sequence
  Synthetic Polynucleotide
taatacgactcactatagggtgactggaacttctgagatgaagcagtactaacagaggagaagtactatgtcatctcagaacctggcggcagcgcaaaagatg

SEQ ID NO: 213130 - DNA, 103 bp, Artificial Sequence
  Synthetic Polynucleotide
taatacgactcactatagggtccacatatgtgactggaacttctgagatgaacagaggagacatctcatgagttccagtaacctggcggcagcgcaaaagatg

SEQ ID NO: 213131 - DNA, 103 bp, Artificial Sequence
  Synthetic Polynucleotide
taatacgactcactatagggaacatctgactccacatatgtgactggaacaacagaggagagttccaatgacatatgtgaacctggcggcagcgcaaaagatg

SEQ ID NO: 213132 - DNA, 103 bp, Artificial Sequence
  Synthetic Polynucleotide
taatacgactcactatagggtgtggaaaccaacatctgactccacatatgaacagaggagacatatgatgagtcagatgaacctggcggcagcgcaaaagatg

SEQ ID NO: 213133 - DNA, 103 bp, Artificial Sequence
  Synthetic Polynucleotide
taatacgactcactatagggaaaacccagatgtggaaaccaacatctgacaacagaggagagtcagaatgtggtttccaaacctggcggcagcgcaaaagatg

SEQ ID NO: 213134 - DNA, 103 bp, Artificial Sequence
  Synthetic Polynucleotide
taatacgactcactatagggactgtgggaaatatagtcagttccacaaataacagaggagaatttgtatgactgactataacctggcggcagcgcaaaagatg

SEQ ID NO: 213135 - DNA, 103 bp, Artificial Sequence
  Synthetic Polynucleotide
taatacgactcactatagggatggatttcaaaaacccagatgtggaaaccaacagaggagaggtttcatgatctgggttaacctggcggcagcgcaaaagatg

SEQ ID NO: 213136 - DNA, 103 bp, Artificial Sequence
  Synthetic Polynucleotide
taatacgactcactataggggacatttgaaatggatttcaaaaacccagaaacagaggagatctgggatgttgaaatccaacctggcggcagcgcaaaagatg

SEQ ID NO: 213137 - DNA, 103 bp, Artificial Sequence
  Synthetic Polynucleotide
taatacgactcactatagggctttgccagagacatttgaaatggatttcaaacagaggagatgaaatatgtttcaaatgaacctggcggcagcgcaaaagatg

SEQ ID NO: 213138 - DNA, 103 bp, Artificial Sequence
  Synthetic Polynucleotide
taatacgactcactatagggggctgaatatctttgccagagacatttgaaaacagaggagattcaaaatgctctggcaaaacctggcggcagcgcaaaagatg

SEQ ID NO: 213139 - DNA, 103 bp, Artificial Sequence
  Synthetic Polynucleotide
taatacgactcactatagggctttattaacggctgaatatctttgccagaaacagaggagatctggcatggatattcagaacctggcggcagcgcaaaagatg

SEQ ID NO: 213140 - DNA, 103 bp, Artificial Sequence
  Synthetic Polynucleotide
taatacgactcactatagggctacccactgctttattaacggctgaatataacagaggagaatattcatgcgttaataaaacctggcggcagcgcaaaagatg

SEQ ID NO: 213141 - DNA, 103 bp, Artificial Sequence
  Synthetic Polynucleotide
taatacgactcactatagggccactctgatctacccactgctttattaacaacagaggagagttaatatggcagtgggtaacctggcggcagcgcaaaagatg

SEQ ID NO: 213142 - DNA, 103 bp, Artificial Sequence
  Synthetic Polynucleotide
taatacgactcactatagggttttaccactccactctgatctacccactgaacagaggagacagtggatggatcagagtaacctggcggcagcgcaaaagatg

SEQ ID NO: 213143 - DNA, 103 bp, Artificial Sequence
  Synthetic Polynucleotide
taatacgactcactatagggttccataaaattttaccactccactctgataacagaggagaatcagaatggagtggtaaaacctggcggcagcgcaaaagatg

SEQ ID NO: 213144 - DNA, 103 bp, Artificial Sequence
  Synthetic Polynucleotide
taatacgactcactatagggaatgcaaaacttccataaaattttaccactaacagaggagaagtggtatgattttatggaacctggcggcagcgcaaaagatg

SEQ ID NO: 213145 - DNA, 103 bp, Artificial Sequence
  Synthetic Polynucleotide
taatacgactcactatagggcaagtttgcaactgtgggaaatatagtcagaacagaggagactgactatgtttcccacaaacctggcggcagcgcaaaagatg

SEQ ID NO: 213146 - DNA, 103 bp, Artificial Sequence
  Synthetic Polynucleotide
taatacgactcactatagggttttctattaaatgcaaaacttccataaaaaacagaggagattttatatgagttttgcaaacctggcggcagcgcaaaagatg

SEQ ID NO: 213147 - DNA, 103 bp, Artificial Sequence
  Synthetic Polynucleotide
taatacgactcactatagggagacatttcgttttctattaaatgcaaaacaacagaggagagttttgatgttaatagaaaacctggcggcagcgcaaaagatg

SEQ ID NO: 213148 - DNA, 103 bp, Artificial Sequence
  Synthetic Polynucleotide
taatacgactcactatagggtccagttccaagacatttcgttttctattaaacagaggagataatagatgacgaaatgtaacctggcggcagcgcaaaagatg

SEQ ID NO: 213149 - DNA, 103 bp, Artificial Sequence
  Synthetic Polynucleotide
taatacgactcactatagggctgttttatttccagttccaagacatttcgaacagaggagacgaaatatgttggaactgaacctggcggcagcgcaaaagatg

SEQ ID NO: 213150 - DNA, 103 bp, Artificial Sequence
  Synthetic Polynucleotide
taatacgactcactatagggatgtatagtcctgttttatttccagttccaaacagaggagatggaacatgaaataaaacaacctggcggcagcgcaaaagatg

SEQ ID NO: 213151 - DNA, 103 bp, Artificial Sequence
  Synthetic Polynucleotide
taatacgactcactataggggttccaggagatgtatagtcctgttttattaacagaggagaaataaaatgggactatacaacctggcggcagcgcaaaagatg

SEQ ID NO: 213152 - DNA, 103 bp, Artificial Sequence
  Synthetic Polynucleotide
taatacgactcactataggggtatttctgagttccaggagatgtatagtcaacagaggagagactatatgtctcctggaaacctggcggcagcgcaaaagatg

SEQ ID NO: 213153 - DNA, 103 bp, Artificial Sequence
  Synthetic Polynucleotide
taatacgactcactataggggtggtcccacgtatttctgagttccaggagaacagaggagactcctgatgctcagaaataacctggcggcagcgcaaaagatg

SEQ ID NO: 213154 - DNA, 103 bp, Artificial Sequence
  Synthetic Polynucleotide
taatacgactcactataggggtcactttaagtggtcccacgtatttctgaaacagaggagatcagaaatgcgtgggaccaacctggcggcagcgcaaaagatg

SEQ ID NO: 213155 - DNA, 103 bp, Artificial Sequence
  Synthetic Polynucleotide
taatacgactcactatagggctcctgcactgtcactttaagtggtcccacaacagaggagagtgggaatgcttaaagtgaacctggcggcagcgcaaaagatg

SEQ ID NO: 213156 - DNA, 103 bp, Artificial Sequence
  Synthetic Polynucleotide
taatacgactcactatagggtgattctattcaagtttgcaactgtgggaaaacagaggagattcccaatgttgcaaactaacctggcggcagcgcaaaagatg

SEQ ID NO: 213157 - DNA, 103 bp, Artificial Sequence
  Synthetic Polynucleotide
taatacgactcactatagggatccatctaactcctgcactgtcactttaaaacagaggagattaaagatgcagtgcaggaacctggcggcagcgcaaaagatg

SEQ ID NO: 213158 - DNA, 103 bp, Artificial Sequence
  Synthetic Polynucleotide
taatacgactcactatagggtgattgaaggatccatctaactcctgcactaacagaggagaagtgcaatggttagatggaacctggcggcagcgcaaaagatg

SEQ ID NO: 213159 - DNA, 103 bp, Artificial Sequence
  Synthetic Polynucleotide
taatacgactcactatagggttgcagtgtatgattgaaggatccatctaaaacagaggagattagatatgtccttcaataacctggcggcagcgcaaaagatg

SEQ ID NO: 213160 - DNA, 103 bp, Artificial Sequence
  Synthetic Polynucleotide
taatacgactcactatagggtttcttcaatttgcagtgtatgattgaaggaacagaggagaccttcaatgatacactgcaacctggcggcagcgcaaaagatg

SEQ ID NO: 213161 - DNA, 103 bp, Artificial Sequence
  Synthetic Polynucleotide
taatacgactcactatagggttaaggctgttttcttcaatttgcagtgtaaacagaggagatacactatgaattgaagaaacctggcggcagcgcaaaagatg

SEQ ID NO: 213162 - DNA, 103 bp, Artificial Sequence
  Synthetic Polynucleotide
taatacgactcactatagggtatatcatgtttaaggctgttttcttcaataacagaggagaattgaaatgaacagccttaacctggcggcagcgcaaaagatg

SEQ ID NO: 213163 - DNA, 103 bp, Artificial Sequence
  Synthetic Polynucleotide
taatacgactcactatagggaatggcagggtatatcatgtttaaggctgtaacagaggagaacagccatgaacatgataaacctggcggcagcgcaaaagatg

SEQ ID NO: 213164 - DNA, 103 bp, Artificial Sequence
  Synthetic Polynucleotide
taatacgactcactatagggctacttttggaatggcagggtatatcatgtaacagaggagaacatgaatgaccctgccaaacctggcggcagcgcaaaagatg

SEQ ID NO: 213165 - DNA, 103 bp, Artificial Sequence
  Synthetic Polynucleotide
taatacgactcactatagggtttattccttctacttttggaatggcagggaacagaggagaccctgcatgtccaaaagtaacctggcggcagcgcaaaagatg

SEQ ID NO: 213166 - DNA, 103 bp, Artificial Sequence
  Synthetic Polynucleotide
taatacgactcactatagggtttttttctttttattccttctacttttggaacagaggagaccaaaaatggaaggaataaacctggcggcagcgcaaaagatg

SEQ ID NO: 213167 - DNA, 103 bp, Artificial Sequence
  Synthetic Polynucleotide
taatacgactcactatagggctgttcaacttgattctattcaagtttgcaaacagaggagatgcaaaatggaatagaataacctggcggcagcgcaaaagatg

SEQ ID NO: 213168 - DNA, 103 bp, Artificial Sequence
  Synthetic Polynucleotide
taatacgactcactatagggatcagtgggatttttttctttttattccttaacagaggagaaaggaaatgaaagaaaaaaacctggcggcagcgcaaaagatg

SEQ ID NO: 213169 - DNA, 103 bp, Artificial Sequence
  Synthetic Polynucleotide
taatacgactcactatagggttctccattcatcagtgggatttttttcttaacagaggagaaagaaaatgatcccactgaacctggcggcagcgcaaaagatg

SEQ ID NO: 213170 - DNA, 103 bp, Artificial Sequence
  Synthetic Polynucleotide
taatacgactcactatagggtatcaacttcttctccattcatcagtgggaaacagaggagatcccacatgtgaatggagaacctggcggcagcgcaaaagatg

SEQ ID NO: 213171 - DNA, 103 bp, Artificial Sequence
  Synthetic Polynucleotide
taatacgactcactataggggaaagatccatatcaacttcttctccattcaacagaggagagaatggatgagaagttgaaacctggcggcagcgcaaaagatg

SEQ ID NO: 213172 - DNA, 103 bp, Artificial Sequence
  Synthetic Polynucleotide
taatacgactcactatagggatccattgcagaaagatccatatcaacttcaacagaggagagaagttatgatggatcttaacctggcggcagcgcaaaagatg

SEQ ID NO: 213173 - DNA, 103 bp, Artificial Sequence
  Synthetic Polynucleotide
taatacgactcactataggggggaatcagcatccattgcagaaagatccaaacagaggagatggatcatgctgcaatggaacctggcggcagcgcaaaagatg

SEQ ID NO: 213174 - DNA, 103 bp, Artificial Sequence
  Synthetic Polynucleotide
taatacgactcactatagggcacagcaaaggggaatcagcatccattgcaaacagaggagatgcaatatgtgctgattcaacctggcggcagcgcaaaagatg

SEQ ID NO: 213175 - DNA, 103 bp, Artificial Sequence
  Synthetic Polynucleotide
taatacgactcactatagggtatccttatccacagcaaaggggaatcagcaacagaggagagctgatatgcctttgctgaacctggcggcagcgcaaaagatg

SEQ ID NO: 213176 - DNA, 103 bp, Artificial Sequence
  Synthetic Polynucleotide
taatacgactcactatagggtatctgggtctatccttatccacagcaaagaacagaggagactttgcatgggataaggaaacctggcggcagcgcaaaagatg

SEQ ID NO: 213177 - DNA, 103 bp, Artificial Sequence
  Synthetic Polynucleotide
taatacgactcactatagggaatactgacatatctgggtctatccttatcaacagaggagagataagatgagacccagaaacctggcggcagcgcaaaagatg

SEQ ID NO: 213178 - DNA, 103 bp, Artificial Sequence
  Synthetic Polynucleotide
taatacgactcactatagggacactgtttgctgttcaacttgattctattaacagaggagaaatagaatgaagttgaacaacctggcggcagcgcaaaagatg

SEQ ID NO: 213179 - DNA, 103 bp, Artificial Sequence
  Synthetic Polynucleotide
taatacgactcactatagggtaccttcctcaatactgacatatctgggtcaacagaggagagacccaatgatgtcagtaaacctggcggcagcgcaaaagatg

SEQ ID NO: 213180 - DNA, 103 bp, Artificial Sequence
  Synthetic Polynucleotide
taatacgactcactataggggctcaaattctaccttcctcaatactgacaaacagaggagatgtcagatgtgaggaaggaacctggcggcagcgcaaaagatg

SEQ ID NO: 213181 - DNA, 103 bp, Artificial Sequence
  Synthetic Polynucleotide
taatacgactcactatagggaaatcagcttgctcaaattctaccttcctcaacagaggagagaggaaatgagaatttgaaacctggcggcagcgcaaaagatg

SEQ ID NO: 213182 - DNA, 103 bp, Artificial Sequence
  Synthetic Polynucleotide
taatacgactcactatagggctgccacataaaatcagcttgctcaaattcaacagaggagagaatttatgcaagctgataacctggcggcagcgcaaaagatg

SEQ ID NO: 213183 - DNA, 103 bp, Artificial Sequence
  Synthetic Polynucleotide
taatacgactcactatagggggagctgatactgccacataaaatcagcttaacagaggagaaagctgatgttatgtggcaacctggcggcagcgcaaaagatg

SEQ ID NO: 213184 - DNA, 103 bp, Artificial Sequence
  Synthetic Polynucleotide
taatacgactcactatagggctctcatagcggagctgatactgccacataaacagaggagatatgtgatggtatcagctaacctggcggcagcgcaaaagatg

SEQ ID NO: 213185 - DNA, 103 bp, Artificial Sequence
  Synthetic Polynucleotide
taatacgactcactatagggaacaacatctctctcatagcggagctgataaacagaggagatatcagatgcgctatgagaacctggcggcagcgcaaaagatg

SEQ ID NO: 213186 - DNA, 103 bp, Artificial Sequence
  Synthetic Polynucleotide
taatacgactcactatagggcctgctgtgcaacaacatctctctcatagcaacagaggagagctatgatggagatgttgaacctggcggcagcgcaaaagatg

SEQ ID NO: 213187 - DNA, 103 bp, Artificial Sequence
  Synthetic Polynucleotide
taatacgactcactatagggaaaatggattcctgctgtgcaacaacatctaacagaggagaagatgtatgtgcacagcaaacctggcggcagcgcaaaagatg

SEQ ID NO: 213188 - DNA, 103 bp, Artificial Sequence
  Synthetic Polynucleotide
taatacgactcactatagggttccaaagccaaaatggattcctgctgtgcaacagaggagagcacagatggaatccattaacctggcggcagcgcaaaagatg

SEQ ID NO: 213189 - DNA, 103 bp, Artificial Sequence
  Synthetic Polynucleotide
taatacgactcactatagggtcctgttcattctggcgggctctacaccagaacagaggagactggtgatgagcccgccaaacctggcggcagcgcaaaagatg

SEQ ID NO: 213190 - DNA, 103 bp, Artificial Sequence
  Synthetic Polynucleotide
taatacgactcactatagggggtatattctacactgtttgctgttcaactaacagaggagaagttgaatggcaaacagtaacctggcggcagcgcaaaagatg

SEQ ID NO: 213191 - DNA, 103 bp, Artificial Sequence
  Synthetic Polynucleotide
taatacgactcactatagggtagggaatttttccaaagccaaaatggattaacagaggagaaatccaatgtggctttggaacctggcggcagcgcaaaagatg

SEQ ID NO: 213192 - DNA, 103 bp, Artificial Sequence
  Synthetic Polynucleotide
taatacgactcactataggggatgctggagtagggaatttttccaaagccaacagaggagaggctttatgaaaattcccaacctggcggcagcgcaaaagatg

SEQ ID NO: 213193 - DNA, 103 bp, Artificial Sequence
  Synthetic Polynucleotide
taatacgactcactatagggtgcaagccgagatgctggagtagggaatttaacagaggagaaaattcatgactccagcaaacctggcggcagcgcaaaagatg

SEQ ID NO: 213194 - DNA, 103 bp, Artificial Sequence
  Synthetic Polynucleotide
taatacgactcactatagggtatcagtgagtgcaagccgagatgctggagaacagaggagactccagatgctcggcttgaacctggcggcagcgcaaaagatg

SEQ ID NO: 213195 - DNA, 103 bp, Artificial Sequence
  Synthetic Polynucleotide
taatacgactcactatagggtgttctaatatatcagtgagtgcaagccgaaacagaggagatcggctatgactcactgaaacctggcggcagcgcaaaagatg

SEQ ID NO: 213196 - DNA, 103 bp, Artificial Sequence
  Synthetic Polynucleotide
taatacgactcactatagggacactgctcttgttctaatatatcagtgagaacagaggagactcactatgatattagaaaacctggcggcagcgcaaaagatg

SEQ ID NO: 213197 - DNA, 103 bp, Artificial Sequence
  Synthetic Polynucleotide
taatacgactcactatagggctctgtagaaacactgctcttgttctaataaacagaggagatattagatgaagagcagtaacctggcggcagcgcaaaagatg

SEQ ID NO: 213198 - DNA, 103 bp, Artificial Sequence
  Synthetic Polynucleotide
taatacgactcactataggggacattcttactctgtagaaacactgctctaacagaggagaagagcaatgtttctacagaacctggcggcagcgcaaaagatg

SEQ ID NO: 213199 - DNA, 103 bp, Artificial Sequence
  Synthetic Polynucleotide
taatacgactcactataggggaagcaagctgacattcttactctgtagaaaacagaggagattctacatggtaagaatgaacctggcggcagcgcaaaagatg

SEQ ID NO: 213200 - DNA, 103 bp, Artificial Sequence
  Synthetic Polynucleotide
taatacgactcactatagggttgcaagacagaagcaagctgacattcttaaacagaggagataagaaatgcagcttgctaacctggcggcagcgcaaaagatg

SEQ ID NO: 213201 - DNA, 103 bp, Artificial Sequence
  Synthetic Polynucleotide
taatacgactcactatagggatccttactcggtatattctacactgtttgaacagaggagacaaacaatgtagaatataaacctggcggcagcgcaaaagatg

SEQ ID NO: 213202 - DNA, 103 bp, Artificial Sequence
  Synthetic Polynucleotide
taatacgactcactatagggtttgcaatctttgcaagacagaagcaagctaacagaggagaagcttgatgctgtcttgcaacctggcggcagcgcaaaagatg

SEQ ID NO: 213203 - DNA, 103 bp, Artificial Sequence
  Synthetic Polynucleotide
taatacgactcactatagggcaccattgaatttgcaatctttgcaagacaaacagaggagatgtcttatgaagattgcaaacctggcggcagcgcaaaagatg

SEQ ID NO: 213204 - DNA, 103 bp, Artificial Sequence
  Synthetic Polynucleotide
taatacgactcactatagggtccatgtgctcaccattgaatttgcaatctaacagaggagaagattgatgattcaatggaacctggcggcagcgcaaaagatg

SEQ ID NO: 213205 - DNA, 103 bp, Artificial Sequence
  Synthetic Polynucleotide
taatacgactcactatagggggtggtcctgtccatgtgctcaccattgaaaacagaggagattcaatatggagcacatgaacctggcggcagcgcaaaagatg

SEQ ID NO: 213206 - DNA, 103 bp, Artificial Sequence
  Synthetic Polynucleotide
taatacgactcactatagggcttcatggctggtggtcctgtccatgtgctaacagaggagaagcacaatgacaggaccaaacctggcggcagcgcaaaagatg

SEQ ID NO: 213207 - DNA, 103 bp, Artificial Sequence
  Synthetic Polynucleotide
taatacgactcactatagggtgaagagtgacttcatggctggtggtcctgaacagaggagacaggacatgcagccatgaaacctggcggcagcgcaaaagatg

SEQ ID NO: 213208 - DNA, 103 bp, Artificial Sequence
  Synthetic Polynucleotide
taatacgactcactatagggaacatcctagtgaagagtgacttcatggctaacagaggagaagccatatggtcactcttaacctggcggcagcgcaaaagatg

SEQ ID NO: 213209 - DNA, 103 bp, Artificial Sequence
  Synthetic Polynucleotide
taatacgactcactatagggtttacaacaaaacatcctagtgaagagtgaaacagaggagatcactcatgactaggatgaacctggcggcagcgcaaaagatg

SEQ ID NO: 213210 - DNA, 103 bp, Artificial Sequence
  Synthetic Polynucleotide
taatacgactcactatagggttggacaacttttacaacaaaacatcctagaacagaggagactaggaatgtttgttgtaaacctggcggcagcgcaaaagatg

SEQ ID NO: 213211 - DNA, 103 bp, Artificial Sequence
  Synthetic Polynucleotide
taatacgactcactatagggttcacaatgtttggacaacttttacaacaaaacagaggagattgttgatgaagttgtccaacctggcggcagcgcaaaagatg

SEQ ID NO: 213212 - DNA, 103 bp, Artificial Sequence
  Synthetic Polynucleotide
taatacgactcactatagggtaaatcattgatccttactcggtatattctaacagaggagaagaataatgcgagtaaggaacctggcggcagcgcaaaagatg

SEQ ID NO: 213213 - DNA, 103 bp, Artificial Sequence
  Synthetic Polynucleotide
taatacgactcactataggggttgtttgttttcacaatgtttggacaactaacagaggagaagttgtatgaacattgtgaacctggcggcagcgcaaaagatg

SEQ ID NO: 213214 - DNA, 103 bp, Artificial Sequence
  Synthetic Polynucleotide
taatacgactcactatagggagctcataaagttgtttgttttcacaatgtaacagaggagaacattgatgaaacaaacaaacctggcggcagcgcaaaagatg

SEQ ID NO: 213215 - DNA, 103 bp, Artificial Sequence
  Synthetic Polynucleotide
taatacgactcactatagggtagctttgaaagctcataaagttgtttgttaacagaggagaaacaaaatgctttatgagaacctggcggcagcgcaaaagatg

SEQ ID NO: 213216 - DNA, 103 bp, Artificial Sequence
  Synthetic Polynucleotide
taatacgactcactatagggctgtagaaaatagctttgaaagctcataaaaacagaggagatttatgatgtttcaaagcaacctggcggcagcgcaaaagatg

SEQ ID NO: 213217 - DNA, 103 bp, Artificial Sequence
  Synthetic Polynucleotide
taatacgactcactataggggcatagtcttctgtagaaaatagctttgaaaacagaggagattcaaaatgattttctacaacctggcggcagcgcaaaagatg

SEQ ID NO: 213218 - DNA, 103 bp, Artificial Sequence
  Synthetic Polynucleotide
taatacgactcactatagggattgcaactggcatagtcttctgtagaaaaaacagaggagattttctatggaagactataacctggcggcagcgcaaaagatg

SEQ ID NO: 213219 - DNA, 103 bp, Artificial Sequence
  Synthetic Polynucleotide
taatacgactcactatagggtaataaagccattgcaactggcatagtcttaacagaggagaaagactatgccagttgcaaacctggcggcagcgcaaaagatg

SEQ ID NO: 213220 - DNA, 103 bp, Artificial Sequence
  Synthetic Polynucleotide
taatacgactcactataggggaacatctcttaataaagccattgcaactgaacagaggagacagttgatgtggctttataacctggcggcagcgcaaaagatg

SEQ ID NO: 213221 - DNA, 103 bp, Artificial Sequence
  Synthetic Polynucleotide
taatacgactcactatagggcaaagattatgaacatctcttaataaagccaacagaggagaggctttatgaagagatgtaacctggcggcagcgcaaaagatg

SEQ ID NO: 213222 - DNA, 103 bp, Artificial Sequence
  Synthetic Polynucleotide
taatacgactcactatagggttctttaggacaaagattatgaacatctctaacagaggagaagagatatgcataatcttaacctggcggcagcgcaaaagatg

SEQ ID NO: 213223 - DNA, 103 bp, Artificial Sequence
  Synthetic Polynucleotide
taatacgactcactatagggaagcagcctctaaatcattgatccttactcaacagaggagagagtaaatgtcaatgattaacctggcggcagcgcaaaagatg

SEQ ID NO: 213224 - DNA, 103 bp, Artificial Sequence
  Synthetic Polynucleotide
taatacgactcactatagggatgttaagacttctttaggacaaagattataacagaggagaataatcatggtcctaaagaacctggcggcagcgcaaaagatg

SEQ ID NO: 213225 - DNA, 103 bp, Artificial Sequence
  Synthetic Polynucleotide
taatacgactcactatagggtctaaaataaatgttaagacttctttaggaaacagaggagatcctaaatgagtcttaacaacctggcggcagcgcaaaagatg

SEQ ID NO: 213226 - DNA, 103 bp, Artificial Sequence
  Synthetic Polynucleotide
taatacgactcactatagggcttgattaagtctaaaataaatgttaagacaacagaggagagtcttaatgtttattttaaacctggcggcagcgcaaaagatg

SEQ ID NO: 213227 - DNA, 103 bp, Artificial Sequence
  Synthetic Polynucleotide
taatacgactcactatagggtgtcattgtacttgattaagtctaaaataaaacagaggagattatttatgacttaatcaaacctggcggcagcgcaaaagatg

SEQ ID NO: 213228 - DNA, 103 bp, Artificial Sequence
  Synthetic Polynucleotide
taatacgactcactatagggtttttcctgttgtcattgtacttgattaagaacagaggagacttaatatggtacaatgaaacctggcggcagcgcaaaagatg

SEQ ID NO: 213229 - DNA, 103 bp, Artificial Sequence
  Synthetic Polynucleotide
taatacgactcactatagggtgaaaacttatttttcctgttgtcattgtaaacagaggagatacaatatgaacaggaaaaacctggcggcagcgcaaaagatg

SEQ ID NO: 213230 - DNA, 103 bp, Artificial Sequence
  Synthetic Polynucleotide
taatacgactcactatagggaatagttatctgaaaacttatttttcctgtaacagaggagaacaggaatgataagttttaacctggcggcagcgcaaaagatg

SEQ ID NO: 213231 - DNA, 103 bp, Artificial Sequence
  Synthetic Polynucleotide
taatacgactcactatagggtctgcacgataatagttatctgaaaacttaaacagaggagataagttatgagataactaaacctggcggcagcgcaaaagatg

SEQ ID NO: 213232 - DNA, 103 bp, Artificial Sequence
  Synthetic Polynucleotide
taatacgactcactatagggatcaatcatttctgcacgataatagttatcaacagaggagagataacatgtatcgtgcaaacctggcggcagcgcaaaagatg

SEQ ID NO: 213233 - DNA, 103 bp, Artificial Sequence
  Synthetic Polynucleotide
taatacgactcactatagggtggccagggcatcaatcatttctgcacgataacagaggagaatcgtgatgaaatgattgaacctggcggcagcgcaaaagatg

SEQ ID NO: 213234 - DNA, 103 bp, Artificial Sequence
  Synthetic Polynucleotide
taatacgactcactatagggttataaataaaagcagcctctaaatcattgaacagaggagacaatgaatgagaggctgcaacctggcggcagcgcaaaagatg

SEQ ID NO: 213235 - DNA, 103 bp, Artificial Sequence
  Synthetic Polynucleotide
taatacgactcactataggggtaacagagttggccagggcatcaatcattaacagaggagaaatgatatgtgccctggcaacctggcggcagcgcaaaagatg

SEQ ID NO: 213236 - DNA, 103 bp, Artificial Sequence
  Synthetic Polynucleotide
taatacgactcactataggggactgcaggtgtaacagagttggccagggcaacagaggagagccctgatgaactctgttaacctggcggcagcgcaaaagatg

SEQ ID NO: 213237 - DNA, 103 bp, Artificial Sequence
  Synthetic Polynucleotide
taatacgactcactatagggtattcacactgactgcaggtgtaacagagtaacagaggagaactctgatgcacctgcagaacctggcggcagcgcaaaagatg

SEQ ID NO: 213238 - DNA, 103 bp, Artificial Sequence
  Synthetic Polynucleotide
taatacgactcactatagggctaacttcattattcacactgactgcaggtaacagaggagaacctgcatgcagtgtgaaaacctggcggcagcgcaaaagatg

SEQ ID NO: 213239 - DNA, 103 bp, Artificial Sequence
  Synthetic Polynucleotide
taatacgactcactatagggatccaaagttctaacttcattattcacactaacagaggagaagtgtgatgaatgaagttaacctggcggcagcgcaaaagatg

SEQ ID NO: 213240 - DNA, 103 bp, Artificial Sequence
  Synthetic Polynucleotide
taatacgactcactataggggatttaagttatccaaagttctaacttcataacagaggagaatgaagatggaactttggaacctggcggcagcgcaaaagatg

SEQ ID NO: 213241 - DNA, 103 bp, Artificial Sequence
  Synthetic Polynucleotide
taatacgactcactatagggcgcacatcaggatttaagttatccaaagttaacagaggagaaactttatgtaacttaaaaacctggcggcagcgcaaaagatg

SEQ ID NO: 213242 - DNA, 103 bp, Artificial Sequence
  Synthetic Polynucleotide
taatacgactcactatagggaagaatgagtcgcacatcaggatttaagttaacagaggagaaacttaatgcctgatgtgaacctggcggcagcgcaaaagatg

SEQ ID NO: 213243 - DNA, 103 bp, Artificial Sequence
  Synthetic Polynucleotide
taatacgactcactatagggtgatttcttcaagaatgagtcgcacatcagaacagaggagactgatgatggactcattcaacctggcggcagcgcaaaagatg

SEQ ID NO: 213244 - DNA, 103 bp, Artificial Sequence
  Synthetic Polynucleotide
taatacgactcactatagggaaaaatctggtgatttcttcaagaatgagtaacagaggagaactcatatgtgaagaaataacctggcggcagcgcaaaagatg

SEQ ID NO: 213245 - DNA, 103 bp, Artificial Sequence
  Synthetic Polynucleotide
taatacgactcactatagggggttgggtcattataaataaaagcagcctcaacagaggagagaggctatgtttatttataacctggcggcagcgcaaaagatg

SEQ ID NO: 213246 - DNA, 103 bp, Artificial Sequence
  Synthetic Polynucleotide
taatacgactcactatagggttccatattcaaaaatctggtgatttcttcaacagaggagagaagaaatgaccagatttaacctggcggcagcgcaaaagatg

SEQ ID NO: 213247 - DNA, 103 bp, Artificial Sequence
  Synthetic Polynucleotide
taatacgactcactataggggaagaagtttttccatattcaaaaatctggaacagaggagaccagatatgtgaatatggaacctggcggcagcgcaaaagatg

SEQ ID NO: 213248 - DNA, 103 bp, Artificial Sequence
  Synthetic Polynucleotide
taatacgactcactatagggctgtaactcggaagaagtttttccatattcaacagaggagagaatatatgaaaacttctaacctggcggcagcgcaaaagatg

SEQ ID NO: 213249 - DNA, 103 bp, Artificial Sequence
  Synthetic Polynucleotide
taatacgactcactataggggatggtatgcctgtaactcggaagaagtttaacagaggagaaaacttatgccgagttacaacctggcggcagcgcaaaagatg

SEQ ID NO: 213250 - DNA, 103 bp, Artificial Sequence
  Synthetic Polynucleotide
taatacgactcactatagggaactgacagtgatggtatgcctgtaactcgaacagaggagacgagttatgggcataccaaacctggcggcagcgcaaaagatg

SEQ ID NO: 213251 - DNA, 103 bp, Artificial Sequence
  Synthetic Polynucleotide
taatacgactcactataggggctctcaaacaactgacagtgatggtatgcaacagaggagagcatacatgcactgtcagaacctggcggcagcgcaaaagatg

SEQ ID NO: 213252 - DNA, 103 bp, Artificial Sequence
  Synthetic Polynucleotide
taatacgactcactatagggtacccgtatggctctcaaacaactgacagtaacagaggagaactgtcatgtgtttgagaaacctggcggcagcgcaaaagatg

SEQ ID NO: 213253 - DNA, 103 bp, Artificial Sequence
  Synthetic Polynucleotide
taatacgactcactatagggtcttctgaagtacccgtatggctctcaaacaacagaggagagtttgaatgccatacgggaacctggcggcagcgcaaaagatg

SEQ ID NO: 213254 - DNA, 103 bp, Artificial Sequence
  Synthetic Polynucleotide
taatacgactcactatagggacatgtccgttcttctgaagtacccgtatgaacagaggagacatacgatgacttcagaaaacctggcggcagcgcaaaagatg

SEQ ID NO: 213255 - DNA, 103 bp, Artificial Sequence
  Synthetic Polynucleotide
taatacgactcactatagggatcacttggcacatgtccgttcttctgaagaacagaggagacttcagatgaacggacataacctggcggcagcgcaaaagatg

SEQ ID NO: 213256 - DNA, 103 bp, Artificial Sequence
  Synthetic Polynucleotide
taatacgactcactatagggaaacttccaaggttgggtcattataaataaaacagaggagattatttatgatgacccaaaacctggcggcagcgcaaaagatg

SEQ ID NO: 213257 - DNA, 103 bp, Artificial Sequence
  Synthetic Polynucleotide
taatacgactcactatagggaaagagctggatcacttggcacatgtccgtaacagaggagaacggacatgtgccaagtgaacctggcggcagcgcaaaagatg

SEQ ID NO: 213258 - DNA, 103 bp, Artificial Sequence
  Synthetic Polynucleotide
taatacgactcactatagggtaagatttaaaaagagctggatcacttggcaacagaggagagccaagatgtccagctctaacctggcggcagcgcaaaagatg

SEQ ID NO: 213259 - DNA, 103 bp, Artificial Sequence
  Synthetic Polynucleotide
taatacgactcactatagggatattcagcataagatttaaaaagagctggaacagaggagaccagctatgtttaaatctaacctggcggcagcgcaaaagatg

SEQ ID NO: 213260 - DNA, 103 bp, Artificial Sequence
  Synthetic Polynucleotide
taatacgactcactatagggcaaagtggccatattcagcataagatttaaaacagaggagattaaatatgatgctgaataacctggcggcagcgcaaaagatg

SEQ ID NO: 213261 - DNA, 103 bp, Artificial Sequence
  Synthetic Polynucleotide
taatacgactcactatagggctaatgtccacaaagtggccatattcagcaaacagaggagatgctgaatgtggccacttaacctggcggcagcgcaaaagatg

SEQ ID NO: 213262 - DNA, 103 bp, Artificial Sequence
  Synthetic Polynucleotide
taatacgactcactatagggagctgctatcctaatgtccacaaagtggccaacagaggagaggccacatggtggacattaacctggcggcagcgcaaaagatg

SEQ ID NO: 213263 - DNA, 103 bp, Artificial Sequence
  Synthetic Polynucleotide
taatacgactcactatagggctgcttccaaagctgctatcctaatgtccaaacagaggagatggacaatgggatagcagaacctggcggcagcgcaaaagatg

SEQ ID NO: 213264 - DNA, 103 bp, Artificial Sequence
  Synthetic Polynucleotide
taatacgactcactatagggtaatcaacaactgcttccaaagctgctatcaacagaggagagatagcatgtttggaagcaacctggcggcagcgcaaaagatg

SEQ ID NO: 213265 - DNA, 103 bp, Artificial Sequence
  Synthetic Polynucleotide
taatacgactcactatagggcactttagtataatcaacaactgcttccaaaacagaggagattggaaatggttgttgataacctggcggcagcgcaaaagatg

SEQ ID NO: 213266 - DNA, 103 bp, Artificial Sequence
  Synthetic Polynucleotide
taatacgactcactatagggaacttctgtccactttagtataatcaacaaaacagaggagattgttgatgatactaaagaacctggcggcagcgcaaaagatg

SEQ ID NO: 213267 - DNA, 103 bp, Artificial Sequence
  Synthetic Polynucleotide
taatacgactcactatagggtcactgtgacaaacttccaaggttgggtcaaacagaggagatgacccatgcttggaagtaacctggcggcagcgcaaaagatg

SEQ ID NO: 213268 - DNA, 103 bp, Artificial Sequence
  Synthetic Polynucleotide
taatacgactcactatagggagttcttcataacttctgtccactttagtaaacagaggagatactaaatgggacagaagaacctggcggcagcgcaaaagatg

SEQ ID NO: 213269 - DNA, 103 bp, Artificial Sequence
  Synthetic Polynucleotide
taatacgactcactatagggtagccattgcagttcttcataacttctgtcaacagaggagagacagaatgtatgaagaaaacctggcggcagcgcaaaagatg

SEQ ID NO: 213270 - DNA, 103 bp, Artificial Sequence
  Synthetic Polynucleotide
taatacgactcactatagggtcatattaagtagccattgcagttcttcataacagaggagaatgaagatgtgcaatggcaacctggcggcagcgcaaaagatg

SEQ ID NO: 213271 - DNA, 103 bp, Artificial Sequence
  Synthetic Polynucleotide
taatacgactcactatagggtcattctgaatcatattaagtagccattgcaacagaggagagcaatgatgacttaatataacctggcggcagcgcaaaagatg

SEQ ID NO: 213272 - DNA, 103 bp, Artificial Sequence
  Synthetic Polynucleotide
taatacgactcactataggggggtacagggtcattctgaatcatattaagaacagaggagacttaatatgattcagaataacctggcggcagcgcaaaagatg

SEQ ID NO: 213273 - DNA, 103 bp, Artificial Sequence
  Synthetic Polynucleotide
taatacgactcactataggggccttacatagggtacagggtcattctgaaaacagaggagattcagaatgaccctgtacaacctggcggcagcgcaaaagatg

SEQ ID NO: 213274 - DNA, 103 bp, Artificial Sequence
  Synthetic Polynucleotide
taatacgactcactatagggagaatcttatgccttacatagggtacagggaacagaggagaccctgtatgctatgtaagaacctggcggcagcgcaaaagatg

SEQ ID NO: 213275 - DNA, 103 bp, Artificial Sequence
  Synthetic Polynucleotide
taatacgactcactatagggcaacatgttgagaatcttatgccttacataaacagaggagatatgtaatgcataagattaacctggcggcagcgcaaaagatg

SEQ ID NO: 213276 - DNA, 103 bp, Artificial Sequence
  Synthetic Polynucleotide
taatacgactcactatagggggttcttagtcaacatgttgagaatcttataacagaggagaataagaatgtcaacatgtaacctggcggcagcgcaaaagatg

SEQ ID NO: 213277 - DNA, 103 bp, Artificial Sequence
  Synthetic Polynucleotide
taatacgactcactataggggtaaatggtgggttcttagtcaacatgttgaacagaggagacaacatatggactaagaaaacctggcggcagcgcaaaagatg

SEQ ID NO: 213278 - DNA, 103 bp, Artificial Sequence
  Synthetic Polynucleotide
taatacgactcactatagggctgttttgattcactgtgacaaacttccaaaacagaggagattggaaatgtgtcacagtaacctggcggcagcgcaaaagatg

SEQ ID NO: 213279 - DNA, 103 bp, Artificial Sequence
  Synthetic Polynucleotide
taatacgactcactatagggcatgttcttagtaaatggtgggttcttagtaacagaggagaactaagatgccaccatttaacctggcggcagcgcaaaagatg

SEQ ID NO: 213280 - DNA, 103 bp, Artificial Sequence
  Synthetic Polynucleotide
taatacgactcactatagggagggagactccatgttcttagtaaatggtgaacagaggagacaccatatgctaagaacaaacctggcggcagcgcaaaagatg

SEQ ID NO: 213281 - DNA, 103 bp, Artificial Sequence
  Synthetic Polynucleotide
taatacgactcactatagggtcattgcataagggagactccatgttcttaaacagaggagataagaaatgggagtctccaacctggcggcagcgcaaaagatg

SEQ ID NO: 213282 - DNA, 103 bp, Artificial Sequence
  Synthetic Polynucleotide
taatacgactcactatagggtaccagggcttcattgcataagggagactcaacagaggagagagtctatgttatgcaataacctggcggcagcgcaaaagatg

SEQ ID NO: 213283 - DNA, 103 bp, Artificial Sequence
  Synthetic Polynucleotide
taatacgactcactatagggaaagttgatctaccagggcttcattgcataaacagaggagatatgcaatgaagccctggaacctggcggcagcgcaaaagatg

SEQ ID NO: 213284 - DNA, 103 bp, Artificial Sequence
  Synthetic Polynucleotide
taatacgactcactatagggataagtttccaaagttgatctaccagggctaacagaggagaagccctatgagatcaactaacctggcggcagcgcaaaagatg

SEQ ID NO: 213285 - DNA, 103 bp, Artificial Sequence
  Synthetic Polynucleotide
taatacgactcactatagggaccagaattcataagtttccaaagttgatcaacagaggagagatcaaatgtggaaacttaacctggcggcagcgcaaaagatg

SEQ ID NO: 213286 - DNA, 103 bp, Artificial Sequence
  Synthetic Polynucleotide
taatacgactcactatagggcatgtgaagtaccagaattcataagtttccaacagaggagaggaaacatgtgaattctgaacctggcggcagcgcaaaagatg

SEQ ID NO: 213287 - DNA, 103 bp, Artificial Sequence
  Synthetic Polynucleotide
taatacgactcactatagggaacctccagtcatgtgaagtaccagaattcaacagaggagagaattcatgtacttcacaaacctggcggcagcgcaaaagatg

SEQ ID NO: 213288 - DNA, 103 bp, Artificial Sequence
  Synthetic Polynucleotide
taatacgactcactatagggaccacaccgtaacctccagtcatgtgaagtaacagaggagaacttcaatggactggaggaacctggcggcagcgcaaaagatg

SEQ ID NO: 213289 - DNA, 103 bp, Artificial Sequence
  Synthetic Polynucleotide
taatacgactcactatagggtgaggtttctctgttttgattcactgtgacaacagaggagagtcacaatgaatcaaaacaacctggcggcagcgcaaaagatg

SEQ ID NO: 213290 - DNA, 103 bp, Artificial Sequence
  Synthetic Polynucleotide
taatacgactcactatagggagtccacagcaccacaccgtaacctccagtaacagaggagaactggaatgtacggtgtgaacctggcggcagcgcaaaagatg

SEQ ID NO: 213291 - DNA, 103 bp, Artificial Sequence
  Synthetic Polynucleotide
taatacgactcactataggggtgaagtacaagtccacagcaccacaccgtaacagaggagaacggtgatgtgctgtggaaacctggcggcagcgcaaaagatg

SEQ ID NO: 213292 - DNA, 103 bp, Artificial Sequence
  Synthetic Polynucleotide
taatacgactcactataggggccaaaaagtgtgaagtacaagtccacagcaacagaggagagctgtgatgttgtacttcaacctggcggcagcgcaaaagatg

SEQ ID NO: 213293 - DNA, 103 bp, Artificial Sequence
  Synthetic Polynucleotide
taatacgactcactataggggtctactgaggccaaaaagtgtgaagtacaaacagaggagatgtactatgcactttttgaacctggcggcagcgcaaaagatg

SEQ ID NO: 213294 - DNA, 103 bp, Artificial Sequence
  Synthetic Polynucleotide
taatacgactcactatagggaaacaggaaggtctactgaggccaaaaagtaacagaggagaacttttatgcctcagtagaacctggcggcagcgcaaaagatg

SEQ ID NO: 213295 - DNA, 103 bp, Artificial Sequence
  Synthetic Polynucleotide
taatacgactcactatagggtggcaagggtaaacaggaaggtctactgagaacagaggagactcagtatgccttcctgtaacctggcggcagcgcaaaagatg

SEQ ID NO: 213296 - DNA, 103 bp, Artificial Sequence
  Synthetic Polynucleotide
taatacgactcactatagggacccaagctctggcaagggtaaacaggaagaacagaggagacttcctatgtacccttgcaacctggcggcagcgcaaaagatg

SEQ ID NO: 213297 - DNA, 103 bp, Artificial Sequence
  Synthetic Polynucleotide
taatacgactcactatagggttaagaaccaacccaagctctggcaagggtaacagaggagaacccttatgagagcttggaacctggcggcagcgcaaaagatg

SEQ ID NO: 213298 - DNA, 103 bp, Artificial Sequence
  Synthetic Polynucleotide
taatacgactcactatagggctcctttagattaagaaccaacccaagctcaacagaggagagagcttatgttggttcttaacctggcggcagcgcaaaagatg

SEQ ID NO: 213299 - DNA, 103 bp, Artificial Sequence
  Synthetic Polynucleotide
taatacgactcactatagggcagcttttttctcctttagattaagaaccaaacagaggagatggttcatgatctaaaggaacctggcggcagcgcaaaagatg

SEQ ID NO: 213300 - DNA, 103 bp, Artificial Sequence
  Synthetic Polynucleotide
taatacgactcactatagggtctcctttcttcctgttcattctggcgggcaacagaggagagcccgcatgaatgaacagaacctggcggcagcgcaaaagatg

SEQ ID NO: 213301 - DNA, 103 bp, Artificial Sequence
  Synthetic Polynucleotide
taatacgactcactataggggaaaaataattgaggtttctctgttttgataacagaggagaatcaaaatggagaaacctaacctggcggcagcgcaaaagatg

SEQ ID NO: 213302 - DNA, 103 bp, Artificial Sequence
  Synthetic Polynucleotide
taatacgactcactatagggggattcaagacagcttttttctcctttagaaacagaggagatctaaaatggaaaaaagcaacctggcggcagcgcaaaagatg

SEQ ID NO: 213303 - DNA, 103 bp, Artificial Sequence
  Synthetic Polynucleotide
taatacgactcactatagggaattatggtaggattcaagacagcttttttaacagaggagaaaaaaaatggtcttgaataacctggcggcagcgcaaaagatg

SEQ ID NO: 213304 - DNA, 103 bp, Artificial Sequence
  Synthetic Polynucleotide
taatacgactcactatagggctgactctggaattatggtaggattcaagaaacagaggagatcttgaatgctaccataaaacctggcggcagcgcaaaagatg

SEQ ID NO: 213305 - DNA, 103 bp, Artificial Sequence
  Synthetic Polynucleotide
taatacgactcactatagggttgcctgctactgactctggaattatggtaaacagaggagataccatatgtccagagtcaacctggcggcagcgcaaaagatg

SEQ ID NO: 213306 - DNA, 103 bp, Artificial Sequence
  Synthetic Polynucleotide
taatacgactcactatagggagcttcttggttgcctgctactgactctggaacagaggagaccagagatggtagcaggcaacctggcggcagcgcaaaagatg

SEQ ID NO: 213307 - DNA, 103 bp, Artificial Sequence
  Synthetic Polynucleotide
taatacgactcactataggggattatttgcagcttcttggttgcctgctaaacagaggagatagcagatgaccaagaagaacctggcggcagcgcaaaagatg

SEQ ID NO: 213308 - DNA, 103 bp, Artificial Sequence
  Synthetic Polynucleotide
taatacgactcactatagggtgactgcttggattatttgcagcttcttggaacagaggagaccaagaatgtgcaaataaaacctggcggcagcgcaaaagatg

SEQ ID NO: 213309 - DNA, 103 bp, Artificial Sequence
  Synthetic Polynucleotide
taatacgactcactatagggtagctgtgggtgactgcttggattatttgcaacagaggagagcaaatatgccaagcagtaacctggcggcagcgcaaaagatg

SEQ ID NO: 213310 - DNA, 103 bp, Artificial Sequence
  Synthetic Polynucleotide
taatacgactcactataggggaaatccaactagctgtgggtgactgcttgaacagaggagacaagcaatgacccacagcaacctggcggcagcgcaaaagatg

SEQ ID NO: 213311 - DNA, 103 bp, Artificial Sequence
  Synthetic Polynucleotide
taatacgactcactatagggaaagggttctgaaatccaactagctgtgggaacagaggagacccacaatgagttggattaacctggcggcagcgcaaaagatg

SEQ ID NO: 213312 - DNA, 103 bp, Artificial Sequence
  Synthetic Polynucleotide
taatacgactcactatagggataagcattggaaaaataattgaggtttctaacagaggagaagaaacatgaattattttaacctggcggcagcgcaaaagatg

SEQ ID NO: 213313 - DNA, 103 bp, Artificial Sequence
  Synthetic Polynucleotide
taatacgactcactatagggagaactggaaaaagggttctgaaatccaacaacagaggagagttggaatgcagaaccctaacctggcggcagcgcaaaagatg

SEQ ID NO: 213314 - DNA, 103 bp, Artificial Sequence
  Synthetic Polynucleotide
taatacgactcactatagggcctcatcttgagaactggaaaaagggttctaacagaggagaagaaccatgtttccagttaacctggcggcagcgcaaaagatg

SEQ ID NO: 213315 - DNA, 103 bp, Artificial Sequence
  Synthetic Polynucleotide
taatacgactcactatagggtcaatctcctcctcatcttgagaactggaaaacagaggagattccagatgtcaagatgaaacctggcggcagcgcaaaagatg

SEQ ID NO: 213316 - DNA, 103 bp, Artificial Sequence
  Synthetic Polynucleotide
taatacgactcactatagggagtatccatatcaatctcctcctcatcttgaacagaggagacaagatatggaggagattaacctggcggcagcgcaaaagatg

SEQ ID NO: 213317 - DNA, 103 bp, Artificial Sequence
  Synthetic Polynucleotide
taatacgactcactatagggtatcatgaacagtatccatatcaatctcctaacagaggagaaggagaatgatatggataaacctggcggcagcgcaaaagatg

SEQ ID NO: 213318 - DNA, 103 bp, Artificial Sequence
  Synthetic Polynucleotide
taatacgactcactatagggaaggcctggctatcatgaacagtatccataaacagaggagatatggaatgtgttcatgaaacctggcggcagcgcaaaagatg

SEQ ID NO: 213319 - DNA, 103 bp, Artificial Sequence
  Synthetic Polynucleotide
taatacgactcactatagggatgggaaatgaaggcctggctatcatgaacaacagaggagagttcatatgagccaggccaacctggcggcagcgcaaaagatg

SEQ ID NO: 213320 - DNA, 103 bp, Artificial Sequence
  Synthetic Polynucleotide
taatacgactcactatagggtgtttaaatgatgggaaatgaaggcctggcaacagaggagagccaggatgtcatttcccaacctggcggcagcgcaaaagatg

SEQ ID NO: 213321 - DNA, 103 bp, Artificial Sequence
  Synthetic Polynucleotide
taatacgactcactatagggctttcaagcatgtttaaatgatgggaaatgaacagaggagacatttcatgtcatttaaaaacctggcggcagcgcaaaagatg

SEQ ID NO: 213322 - DNA, 103 bp, Artificial Sequence
  Synthetic Polynucleotide
taatacgactcactatagggagttgacggcctttcaagcatgtttaaatgaacagaggagacatttaatgatgcttgaaaacctggcggcagcgcaaaagatg

SEQ ID NO: 213323 - DNA, 103 bp, Artificial Sequence
  Synthetic Polynucleotide
taatacgactcactatagggctgcagctgcataagcattggaaaaataataacagaggagaattattatgccaatgcttaacctggcggcagcgcaaaagatg

SEQ ID NO: 213324 - DNA, 103 bp, Artificial Sequence
  Synthetic Polynucleotide
taatacgactcactatagggagagccctggagttgacggcctttcaagcaaacagaggagatgcttgatgggccgtcaaaacctggcggcagcgcaaaagatg

SEQ ID NO: 213325 - DNA, 103 bp, Artificial Sequence
  Synthetic Polynucleotide
taatacgactcactatagggcgatatttcgagagccctggagttgacggcaacagaggagagccgtcatgtccagggctaacctggcggcagcgcaaaagatg

SEQ ID NO: 213326 - DNA, 103 bp, Artificial Sequence
  Synthetic Polynucleotide
taatacgactcactataggggctagctggccgatatttcgagagccctggaacagaggagaccagggatgtcgaaatataacctggcggcagcgcaaaagatg

SEQ ID NO: 213327 - DNA, 103 bp, Artificial Sequence
  Synthetic Polynucleotide
taatacgactcactatagggcagatcgggagctagctggccgatatttcgaacagaggagacgaaatatgggccagctaaacctggcggcagcgcaaaagatg

SEQ ID NO: 213328 - DNA, 103 bp, Artificial Sequence
  Synthetic Polynucleotide
taatacgactcactatagggggtattaaagcagatcgggagctagctggcaacagaggagagccagcatgctcccgatcaacctggcggcagcgcaaaagatg

SEQ ID NO: 213329 - DNA, 103 bp, Artificial Sequence
  Synthetic Polynucleotide
taatacgactcactatagggtgagtgctggggtattaaagcagatcgggaaacagaggagatcccgaatggctttaataaacctggcggcagcgcaaaagatg

SEQ ID NO: 213330 - DNA, 103 bp, Artificial Sequence
  Synthetic Polynucleotide
taatacgactcactatagggcacagcctgctgagtgctggggtattaaagaacagaggagactttaaatgcccagcactaacctggcggcagcgcaaaagatg

SEQ ID NO: 213331 - DNA, 103 bp, Artificial Sequence
  Synthetic Polynucleotide
taatacgactcactatagggggtgtgctgtcacagcctgctgagtgctggaacagaggagaccagcaatgagcaggctgaacctggcggcagcgcaaaagatg

SEQ ID NO: 213332 - DNA, 103 bp, Artificial Sequence
  Synthetic Polynucleotide
taatacgactcactatagggttttgtggtgggtgtgctgtcacagcctgcaacagaggagagcaggcatggacagcacaaacctggcggcagcgcaaaagatg

SEQ ID NO: 213333 - DNA, 103 bp, Artificial Sequence
  Synthetic Polynucleotide
taatacgactcactatagggtccactggggttttgtggtgggtgtgctgtaacagaggagaacagcaatgccaccacaaaacctggcggcagcgcaaaagatg

SEQ ID NO: 213334 - DNA, 103 bp, Artificial Sequence
  Synthetic Polynucleotide
taatacgactcactatagggacagcactaactgcagctgcataagcattgaacagaggagacaatgcatgtgcagctgcaacctggcggcagcgcaaaagatg

SEQ ID NO: 213335 - DNA, 103 bp, Artificial Sequence
  Synthetic Polynucleotide
taatacgactcactatagggagttccaaactccactggggttttgtggtgaacagaggagacaccacatgaccccagtgaacctggcggcagcgcaaaagatg

SEQ ID NO: 213336 - DNA, 103 bp, Artificial Sequence
  Synthetic Polynucleotide
taatacgactcactatagggcttccgtgcaagttccaaactccactggggaacagaggagaccccagatgagtttggaaaacctggcggcagcgcaaaagatg

SEQ ID NO: 213337 - DNA, 103 bp, Artificial Sequence
  Synthetic Polynucleotide
taatacgactcactatagggtacctgttcccttccgtgcaagttccaaacaacagaggagagtttggatgttgcacggaaacctggcggcagcgcaaaagatg

SEQ ID NO: 213338 - DNA, 103 bp, Artificial Sequence
  Synthetic Polynucleotide
taatacgactcactataggggcttgttctttacctgttcccttccgtgcaaacagaggagatgcacgatggggaacaggaacctggcggcagcgcaaaagatg

SEQ ID NO: 213339 - DNA, 103 bp, Artificial Sequence
  Synthetic Polynucleotide
taatacgactcactatagggctccaaaggtgcttgttctttacctgttccaacagaggagaggaacaatgaaagaacaaaacctggcggcagcgcaaaagatg

SEQ ID NO: 213340 - DNA, 103 bp, Artificial Sequence
  Synthetic Polynucleotide
taatacgactcactataggggcatactcatctccaaaggtgcttgttcttaacagaggagaaagaacatgcacctttggaacctggcggcagcgcaaaagatg

SEQ ID NO: 213341 - DNA, 103 bp, Artificial Sequence
  Synthetic Polynucleotide
taatacgactcactataggggccgctggatgcatactcatctccaaaggtaacagaggagaacctttatggatgagtataacctggcggcagcgcaaaagatg

SEQ ID NO: 213342 - DNA, 103 bp, Artificial Sequence
  Synthetic Polynucleotide
taatacgactcactatagggtggagcgcttgccgctggatgcatactcataacagaggagaatgagtatgcatccagcgaacctggcggcagcgcaaaagatg

SEQ ID NO: 213343 - DNA, 103 bp, Artificial Sequence
  Synthetic Polynucleotide
taatacgactcactatagggagactgagagtggagcgcttgccgctggataacagaggagaatccagatgcaagcgctcaacctggcggcagcgcaaaagatg

SEQ ID NO: 213344 - DNA, 103 bp, Artificial Sequence
  Synthetic Polynucleotide
taatacgactcactatagggtccttagtaaagactgagagtggagcgcttaacagaggagaaagcgcatgactctcagtaacctggcggcagcgcaaaagatg

SEQ ID NO: 213345 - DNA, 103 bp, Artificial Sequence
  Synthetic Polynucleotide
taatacgactcactatagggatcagggtccacagcactaactgcagctgcaacagaggagagcagctatggttagtgctaacctggcggcagcgcaaaagatg

SEQ ID NO: 213346 - DNA, 103 bp, Artificial Sequence
  Synthetic Polynucleotide
taatacgactcactatagggggctgtagattccttagtaaagactgagagaacagaggagactctcaatgtttactaagaacctggcggcagcgcaaaagatg

SEQ ID NO: 213347 - DNA, 103 bp, Artificial Sequence
  Synthetic Polynucleotide
taatacgactcactatagggtgtgtttggaggctgtagattccttagtaaaacagaggagattactaatgaatctacagaacctggcggcagcgcaaaagatg

SEQ ID NO: 213348 - DNA, 103 bp, Artificial Sequence
  Synthetic Polynucleotide
taatacgactcactatagggtggtggtcactgtgtttggaggctgtagataacagaggagaatctacatgctccaaacaaacctggcggcagcgcaaaagatg

SEQ ID NO: 213349 - DNA, 103 bp, Artificial Sequence
  Synthetic Polynucleotide
taatacgactcactatagggatggtggtgatggtggtcactgtgtttggaaacagaggagatccaaaatgagtgaccacaacctggcggcagcgcaaaagatg

SEQ ID NO: 213350 - DNA, 103 bp, Artificial Sequence
  Synthetic Polynucleotide
taatacgactcactataggggctcatggtgatggtggtgatggtggtcacaacagaggagagtgaccatgatcaccaccaacctggcggcagcgcaaaagatg

SEQ ID NO: 213351 - DNA, 103 bp, Artificial Sequence
  Synthetic Polynucleotide
taatacgactcactatagggtttttcttgtgctcatggtgatggtggtgaaacagaggagatcaccaatgtcaccatgaaacctggcggcagcgcaaaagatg

SEQ ID NO: 213352 - DNA, 103 bp, Artificial Sequence
  Synthetic Polynucleotide
taatacgactcactatagggcttcttcttctttttcttgtgctcatggtgaacagaggagacaccatatgcacaagaaaaacctggcggcagcgcaaaagatg

SEQ ID NO: 213353 - DNA, 103 bp, Artificial Sequence
  Synthetic Polynucleotide
taatacgactcactatagggtatgtttatgcttcttcttctttttcttgtaacagaggagaacaagaatgagaagaagaaacctggcggcagcgcaaaagatg

SEQ ID NO: 213354 - DNA, 103 bp, Artificial Sequence
  Synthetic Polynucleotide
taatacgactcactatagggtgtttgtgcttatgtttatgcttcttcttcaacagaggagagaagaaatggcataaacaaacctggcggcagcgcaaaagatg

SEQ ID NO: 213355 - DNA, 103 bp, Artificial Sequence
  Synthetic Polynucleotide
taatacgactcactatagggcttatgcttgtgtttgtgcttatgtttatgaacagaggagacataaaatgaagcacaaaaacctggcggcagcgcaaaagatg

SEQ ID NO: 213356 - DNA, 103 bp, Artificial Sequence
  Synthetic Polynucleotide
taatacgactcactatagggcatttcctgcatcagggtccacagcactaaaacagaggagattagtgatgtggaccctgaacctggcggcagcgcaaaagatg

SEQ ID NO: 213357 - DNA, 103 bp, Artificial Sequence
  Synthetic Polynucleotide
taatacgactcactatagggtactgtcatgcttatgcttgtgtttgtgctaacagaggagaagcacaatgacaagcataaacctggcggcagcgcaaaagatg

SEQ ID NO: 213358 - DNA, 103 bp, Artificial Sequence
  Synthetic Polynucleotide
taatacgactcactatagggtccttttctttactgtcatgcttatgcttgaacagaggagacaagcaatggcatgacagaacctggcggcagcgcaaaagatg

SEQ ID NO: 213359 - DNA, 103 bp, Artificial Sequence
  Synthetic Polynucleotide
taatacgactcactatagggaggctccttgtccttttctttactgtcatgaacagaggagacatgacatgaaagaaaagaacctggcggcagcgcaaaagatg

SEQ ID NO: 213360 - DNA, 103 bp, Artificial Sequence
  Synthetic Polynucleotide
taatacgactcactatagggagaaagtgaaaggctccttgtccttttcttaacagaggagaaagaaaatgacaaggagcaacctggcggcagcgcaaaagatg

SEQ ID NO: 213361 - DNA, 103 bp, Artificial Sequence
  Synthetic Polynucleotide
taatacgactcactataggggcagggctggagaaagtgaaaggctccttgaacagaggagacaaggaatgtttcactttaacctggcggcagcgcaaaagatg

SEQ ID NO: 213362 - DNA, 103 bp, Artificial Sequence
  Synthetic Polynucleotide
taatacgactcactatagggcctgccactggcagggctggagaaagtgaaaacagaggagattcactatgtccagccctaacctggcggcagcgcaaaagatg

SEQ ID NO: 213363 - DNA, 103 bp, Artificial Sequence
  Synthetic Polynucleotide
taatacgactcactatagggaacgaatagacctgccactggcagggctggaacagaggagaccagccatgccagtggcaaacctggcggcagcgcaaaagatg

SEQ ID NO: 213364 - DNA, 103 bp, Artificial Sequence
  Synthetic Polynucleotide
taatacgactcactatagggagggaaggagaacgaatagacctgccactgaacagaggagacagtggatggtctattcgaacctggcggcagcgcaaaagatg

SEQ ID NO: 213365 - DNA, 103 bp, Artificial Sequence
  Synthetic Polynucleotide
taatacgactcactatagggtcagtctgaaagggaaggagaacgaatagaaacagaggagatctattatgtctccttccaacctggcggcagcgcaaaagatg

SEQ ID NO: 213366 - DNA, 103 bp, Artificial Sequence
  Synthetic Polynucleotide
taatacgactcactatagggcaaagttctccatttcctgcatcagggtccaacagaggagaggacccatgtgcaggaaaaacctggcggcagcgcaaaagatg

SEQ ID NO: 213367 - DNA, 103 bp, Artificial Sequence
  Synthetic Polynucleotide
taatacgactcactatagggaaccttaatgcaaagttctccatttcctgcaacagaggagagcaggaatgggagaacttaacctggcggcagcgcaaaagatg

SEQ ID NO: 213368 - DNA, 103 bp, Artificial Sequence
  Synthetic Polynucleotide
taatacgactcactataggggctctgatggaaccttaatgcaaagttctcaacagaggagagagaacatggcattaaggaacctggcggcagcgcaaaagatg

SEQ ID NO: 213369 - DNA, 103 bp, Artificial Sequence
  Synthetic Polynucleotide
taatacgactcactatagggtgtttccatagctctgatggaaccttaatgaacagaggagacattaaatgtccatcagaaacctggcggcagcgcaaaagatg

SEQ ID NO: 213370 - DNA, 103 bp, Artificial Sequence
  Synthetic Polynucleotide
taatacgactcactatagggaaagcccttgtctcctttcttcctgttcataacagaggagaatgaacatgaagaaaggaaacctggcggcagcgcaaaagatg

SEQ ID NO: 213371 - DNA, 103 bp, Artificial Sequence
  Synthetic Polynucleotide
taatacgactcactatagggctcatcaacgtgtttccatagctctgatggaacagaggagaccatcaatgctatggaaaaacctggcggcagcgcaaaagatg

SEQ ID NO: 213372 - DNA, 103 bp, Artificial Sequence
  Synthetic Polynucleotide
taatacgactcactatagggggacctttaactcatcaacgtgtttccataaacagaggagatatggaatgacgttgatgaacctggcggcagcgcaaaagatg

SEQ ID NO: 213373 - DNA, 103 bp, Artificial Sequence
  Synthetic Polynucleotide
taatacgactcactatagggtgtatcttcaggacctttaactcatcaacgaacagaggagacgttgaatggttaaaggtaacctggcggcagcgcaaaagatg

SEQ ID NO: 213374 - DNA, 103 bp, Artificial Sequence
  Synthetic Polynucleotide
taatacgactcactatagggaaaattgatgtgtatcttcaggacctttaaaacagaggagattaaagatgctgaagataaacctggcggcagcgcaaaagatg

SEQ ID NO: 213375 - DNA, 103 bp, Artificial Sequence
  Synthetic Polynucleotide
taatacgactcactataggggatccaaagaaaaattgatgtgtatcttcaaacagaggagatgaagaatgacatcaattaacctggcggcagcgcaaaagatg

SEQ ID NO: 213376 - DNA, 103 bp, Artificial Sequence
  Synthetic Polynucleotide
taatacgactcactatagggcctttgggctgatccaaagaaaaattgatgaacagaggagacatcaaatgttctttggaaacctggcggcagcgcaaaagatg

SEQ ID NO: 213377 - DNA, 103 bp, Artificial Sequence
  Synthetic Polynucleotide
taatacgactcactatagggatgaagacctcctttgggctgatccaaagaaacagaggagatctttgatgcagcccaaaaacctggcggcagcgcaaaagatg

SEQ ID NO: 213378 - DNA, 103 bp, Artificial Sequence
  Synthetic Polynucleotide
taatacgactcactataggggtaccacaaaatgaagacctcctttgggctaacagaggagaagcccaatggaggtcttcaacctggcggcagcgcaaaagatg

SEQ ID NO: 213379 - DNA, 103 bp, Artificial Sequence
  Synthetic Polynucleotide
taatacgactcactatagggtctacactgggtaccacaaaatgaagacctaacagaggagaaggtctatgttttgtggtaacctggcggcagcgcaaaagatg

SEQ ID NO: 213380 - DNA, 103 bp, Artificial Sequence
  Synthetic Polynucleotide
taatacgactcactatagggcatacttccctctacactgggtaccacaaaaacagaggagatttgtgatgcccagtgtaaacctggcggcagcgcaaaagatg

SEQ ID NO: 213381 - DNA, 103 bp, Artificial Sequence
  Synthetic Polynucleotide
taatacgactcactatagggttgggctttcaaagcccttgtctcctttctaacagaggagaagaaagatgacaagggctaacctggcggcagcgcaaaagatg

SEQ ID NO: 213382 - DNA, 103 bp, Artificial Sequence
  Synthetic Polynucleotide
taatacgactcactatagggctctctctgccatacttccctctacactggaacagaggagaccagtgatgagggaagtaaacctggcggcagcgcaaaagatg

SEQ ID NO: 213383 - DNA, 103 bp, Artificial Sequence
  Synthetic Polynucleotide
taatacgactcactatagggacatgagcacctctctctgccatacttcccaacagaggagagggaagatgggcagagagaacctggcggcagcgcaaaagatg

SEQ ID NO: 213384 - DNA, 103 bp, Artificial Sequence
  Synthetic Polynucleotide
taatacgactcactatagggacaagagaaaacatgagcacctctctctgcaacagaggagagcagagatgggtgctcataacctggcggcagcgcaaaagatg

SEQ ID NO: 213385 - DNA, 103 bp, Artificial Sequence
  Synthetic Polynucleotide
taatacgactcactatagggtttgatacccacaagagaaaacatgagcacaacagaggagagtgctcatgttttctcttaacctggcggcagcgcaaaagatg

SEQ ID NO: 213386 - DNA, 103 bp, Artificial Sequence
  Synthetic Polynucleotide
taatacgactcactatagggcttgtagaattttgatacccacaagagaaaaacagaggagatttctcatgtgggtatcaaacctggcggcagcgcaaaagatg

SEQ ID NO: 213387 - DNA, 103 bp, Artificial Sequence
  Synthetic Polynucleotide
taatacgactcactataggggaaccaaaatcttgtagaattttgatacccaacagaggagagggtatatgaattctacaaacctggcggcagcgcaaaagatg

SEQ ID NO: 213388 - DNA, 103 bp, Artificial Sequence
  Synthetic Polynucleotide
taatacgactcactatagggcaacacaagggaaccaaaatcttgtagaataacagaggagaattctaatggattttggtaacctggcggcagcgcaaaagatg

SEQ ID NO: 213389 - DNA, 103 bp, Artificial Sequence
  Synthetic Polynucleotide
taatacgactcactataggggagtatgaatcaacacaagggaaccaaaataacagaggagaattttgatgcccttgtgtaacctggcggcagcgcaaaagatg

SEQ ID NO: 213390 - DNA, 103 bp, Artificial Sequence
  Synthetic Polynucleotide
taatacgactcactatagggacacaattcagagtatgaatcaacacaaggaacagaggagaccttgtatggattcatacaacctggcggcagcgcaaaagatg

SEQ ID NO: 213391 - DNA, 103 bp, Artificial Sequence
  Synthetic Polynucleotide
taatacgactcactatagggatttccatgtacacaattcagagtatgaataacagaggagaattcatatgctgaattgtaacctggcggcagcgcaaaagatg

SEQ ID NO: 213392 - DNA, 103 bp, Artificial Sequence
  Synthetic Polynucleotide
taatacgactcactatagggttatatggccttgggctttcaaagcccttgaacagaggagacaagggatgtgaaagcccaacctggcggcagcgcaaaagatg

SEQ ID NO: 213393 - DNA, 103 bp, Artificial Sequence
  Synthetic Polynucleotide
taatacgactcactataggggtaaattctaatttccatgtacacaattcaaacagaggagatgaattatgtacatggaaaacctggcggcagcgcaaaagatg

SEQ ID NO: 213394 - DNA, 103 bp, Artificial Sequence
  Synthetic Polynucleotide
taatacgactcactatagggagcatctactgtaaattctaatttccatgtaacagaggagaacatggatgttagaatttaacctggcggcagcgcaaaagatg

SEQ ID NO: 213395 - DNA, 103 bp, Artificial Sequence
  Synthetic Polynucleotide
taatacgactcactatagggcaaccattgcagcatctactgtaaattctaaacagaggagatagaatatgcagtagatgaacctggcggcagcgcaaaagatg

SEQ ID NO: 213396 - DNA, 103 bp, Artificial Sequence
  Synthetic Polynucleotide
taatacgactcactatagggttagaaacagcaaccattgcagcatctactaacagaggagaagtagaatgtgcaatggtaacctggcggcagcgcaaaagatg

SEQ ID NO: 213397 - DNA, 103 bp, Artificial Sequence
  Synthetic Polynucleotide
taatacgactcactatagggcaaatcgccattagaaacagcaaccattgcaacagaggagagcaatgatggctgtttctaacctggcggcagcgcaaaagatg

SEQ ID NO: 213398 - DNA, 103 bp, Artificial Sequence
  Synthetic Polynucleotide
taatacgactcactatagggctgtctccaccaaatcgccattagaaacagaacagaggagactgtttatgatggcgattaacctggcggcagcgcaaaagatg

SEQ ID NO: 213399 - DNA, 103 bp, Artificial Sequence
  Synthetic Polynucleotide
taatacgactcactatagggtgagtatacactgtctccaccaaatcgccaaacagaggagatggcgaatgggtggagacaacctggcggcagcgcaaaagatg

SEQ ID NO: 213400 - DNA, 103 bp, Artificial Sequence
  Synthetic Polynucleotide
taatacgactcactatagggcctcatatcatgagtatacactgtctccacaacagaggagagtggagatggtgtatactaacctggcggcagcgcaaaagatg

SEQ ID NO: 213401 - DNA, 103 bp, Artificial Sequence
  Synthetic Polynucleotide
taatacgactcactatagggaagttttcttcctcatatcatgagtatacaaacagaggagatgtataatgatgatatgaaacctggcggcagcgcaaaagatg

SEQ ID NO: 213402 - DNA, 103 bp, Artificial Sequence
  Synthetic Polynucleotide
taatacgactcactatagggatataatggaaagttttcttcctcatatcaaacagaggagatgatatatggaagaaaacaacctggcggcagcgcaaaagatg

SEQ ID NO: 213403 - DNA, 103 bp, Artificial Sequence
  Synthetic Polynucleotide
taatacgactcactatagggatgggttaatttatatggccttgggctttcaacagaggagagaaagcatgaggccatataacctggcggcagcgcaaaagatg

SEQ ID NO: 213404 - DNA, 103 bp, Artificial Sequence
  Synthetic Polynucleotide
taatacgactcactatagggaatggtaagcatataatggaaagttttcttaacagaggagaaagaaaatgttccattataacctggcggcagcgcaaaagatg

SEQ ID NO: 213405 - DNA, 103 bp, Artificial Sequence
  Synthetic Polynucleotide
taatacgactcactatagggctgctgtaggaatggtaagcatataatggaaacagaggagatccattatgtgcttaccaaacctggcggcagcgcaaaagatg

SEQ ID NO: 213406 - DNA, 103 bp, Artificial Sequence
  Synthetic Polynucleotide
taatacgactcactatagggatatttgacgctgctgtaggaatggtaagcaacagaggagagcttacatgtcctacagcaacctggcggcagcgcaaaagatg

SEQ ID NO: 213407 - DNA, 103 bp, Artificial Sequence
  Synthetic Polynucleotide
taatacgactcactatagggggccaaggagatatttgacgctgctgtaggaacagaggagacctacaatggcgtcaaataacctggcggcagcgcaaaagatg

SEQ ID NO: 213408 - DNA, 103 bp, Artificial Sequence
  Synthetic Polynucleotide
taatacgactcactatagggatggtccaatggccaaggagatatttgacgaacagaggagacgtcaaatgtctccttggaacctggcggcagcgcaaaagatg

SEQ ID NO: 213409 - DNA, 103 bp, Artificial Sequence
  Synthetic Polynucleotide
taatacgactcactatagggagtatttcaaatggtccaatggccaaggagaacagaggagactccttatgcattggaccaacctggcggcagcgcaaaagatg

SEQ ID NO: 213410 - DNA, 103 bp, Artificial Sequence
  Synthetic Polynucleotide
taatacgactcactatagggtggatctaccagtatttcaaatggtccaataacagaggagaattggaatgtttgaaataaacctggcggcagcgcaaaagatg

SEQ ID NO: 213411 - DNA, 103 bp, Artificial Sequence
  Synthetic Polynucleotide
taatacgactcactatagggcatgcatgtatggatctaccagtatttcaaaacagaggagattgaaaatgtggtagatcaacctggcggcagcgcaaaagatg

SEQ ID NO: 213412 - DNA, 103 bp, Artificial Sequence
  Synthetic Polynucleotide
taatacgactcactatagggtgagtaacctcatgcatgtatggatctaccaacagaggagaggtagaatgatacatgcaaacctggcggcagcgcaaaagatg

SEQ ID NO: 213413 - DNA, 103 bp, Artificial Sequence
  Synthetic Polynucleotide
taatacgactcactatagggcaaacaaaaatgagtaacctcatgcatgtaaacagaggagatacatgatggaggttactaacctggcggcagcgcaaaagatg

SEQ ID NO: 213414 - DNA, 103 bp, Artificial Sequence
  Synthetic Polynucleotide
taatacgactcactatagggagacgacctgatgggttaatttatatggccaacagaggagaggccatatgaattaacccaacctggcggcagcgcaaaagatg

SEQ ID NO: 213415 - DNA, 103 bp, Artificial Sequence
  Synthetic Polynucleotide
taatacgactcactataggggaagttggggcaaacaaaaatgagtaacctaacagaggagaaggttaatgatttttgttaacctggcggcagcgcaaaagatg

SEQ ID NO: 213416 - DNA, 103 bp, Artificial Sequence
  Synthetic Polynucleotide
taatacgactcactatagggagcaatggaagaagttggggcaaacaaaaaaacagaggagatttttgatggccccaactaacctggcggcagcgcaaaagatg

SEQ ID NO: 213417 - DNA, 103 bp, Artificial Sequence
  Synthetic Polynucleotide
taatacgactcactatagggggtatgtttcagcaatggaagaagttggggaacagaggagaccccaaatgcttccattgaacctggcggcagcgcaaaagatg

SEQ ID NO: 213418 - DNA, 103 bp, Artificial Sequence
  Synthetic Polynucleotide
taatacgactcactatagggggtatgatgtggtatgtttcagcaatggaaaacagaggagattccatatgtgaaacataaacctggcggcagcgcaaaagatg

SEQ ID NO: 213419 - DNA, 103 bp, Artificial Sequence
  Synthetic Polynucleotide
taatacgactcactatagggacttcatgaaggtatgatgtggtatgtttcaacagaggagagaaacaatgcacatcataaacctggcggcagcgcaaaagatg

SEQ ID NO: 213420 - DNA, 103 bp, Artificial Sequence
  Synthetic Polynucleotide
taatacgactcactatagggaaattcaaagacttcatgaaggtatgatgtaacagaggagaacatcaatgcttcatgaaaacctggcggcagcgcaaaagatg

SEQ ID NO: 213421 - DNA, 103 bp, Artificial Sequence
  Synthetic Polynucleotide
taatacgactcactatagggtttcttcataaaattcaaagacttcatgaaaacagaggagattcatgatgtctttgaataacctggcggcagcgcaaaagatg

SEQ ID NO: 213422 - DNA, 103 bp, Artificial Sequence
  Synthetic Polynucleotide
taatacgactcactatagggcatgtaagaatttcttcataaaattcaaagaacagaggagactttgaatgttatgaagaaacctggcggcagcgcaaaagatg

SEQ ID NO: 213423 - DNA, 103 bp, Artificial Sequence
  Synthetic Polynucleotide
taatacgactcactatagggtgggtaacgacatgtaagaatttcttcataaacagaggagatatgaaatgattcttacaaacctggcggcagcgcaaaagatg

SEQ ID NO: 213424 - DNA, 103 bp, Artificial Sequence
  Synthetic Polynucleotide
taatacgactcactatagggaacaggagtatgggtaacgacatgtaagaaaacagaggagattcttaatggtcgttaccaacctggcggcagcgcaaaagatg

SEQ ID NO: 213425 - DNA, 103 bp, Artificial Sequence
  Synthetic Polynucleotide
taatacgactcactatagggttgttgatgcagacgacctgatgggttaataacagaggagaattaacatgtcaggtcgtaacctggcggcagcgcaaaagatg

SEQ ID NO: 213426 - DNA, 103 bp, Artificial Sequence
  Synthetic Polynucleotide
taatacgactcactatagggacagtcttaaaacaggagtatgggtaacgaaacagaggagatcgttaatgatactcctgaacctggcggcagcgcaaaagatg

SEQ ID NO: 213427 - DNA, 103 bp, Artificial Sequence
  Synthetic Polynucleotide
taatacgactcactatagggatcaatgaagacagtcttaaaacaggagtaaacagaggagatactccatgtttaagactaacctggcggcagcgcaaaagatg

SEQ ID NO: 213428 - DNA, 103 bp, Artificial Sequence
  Synthetic Polynucleotide
taatacgactcactatagggcataagcctcatcaatgaagacagtcttaaaacagaggagattaagaatgtcttcattgaacctggcggcagcgcaaaagatg

SEQ ID NO: 213429 - DNA, 103 bp, Artificial Sequence
  Synthetic Polynucleotide
taatacgactcactataggggccacttcaacataagcctcatcaatgaagaacagaggagacttcatatgtgaggcttaaacctggcggcagcgcaaaagatg

SEQ ID NO: 213430 - DNA, 103 bp, Artificial Sequence
  Synthetic Polynucleotide
taatacgactcactatagggagcataagcagccacttcaacataagcctcaacagaggagagaggctatggttgaagtgaacctggcggcagcgcaaaagatg

SEQ ID NO: 213431 - DNA, 103 bp, Artificial Sequence
  Synthetic Polynucleotide
taatacgactcactatagggtgctcatggaagcataagcagccacttcaaaacagaggagattgaagatgctgcttatgaacctggcggcagcgcaaaagatg

SEQ ID NO: 213432 - DNA, 103 bp, Artificial Sequence
  Synthetic Polynucleotide
taatacgactcactataggggtgctaaaaatgctcatggaagcataagcaaacagaggagatgcttaatgttccatgagaacctggcggcagcgcaaaagatg

SEQ ID NO: 213433 - DNA, 103 bp, Artificial Sequence
  Synthetic Polynucleotide
taatacgactcactatagggtaaaagatttgtgctaaaaatgctcatggaaacagaggagatccatgatgatttttagcaacctggcggcagcgcaaaagatg

SEQ ID NO: 213434 - DNA, 103 bp, Artificial Sequence
  Synthetic Polynucleotide
taatacgactcactatagggtggcactgtgtaaaagatttgtgctaaaaaaacagaggagatttttaatgcaaatctttaacctggcggcagcgcaaaagatg

SEQ ID NO: 213435 - DNA, 103 bp, Artificial Sequence
  Synthetic Polynucleotide
taatacgactcactatagggtctataatcatggcactgtgtaaaagatttaacagaggagaaaatctatgacacagtgcaacctggcggcagcgcaaaagatg

SEQ ID NO: 213436 - DNA, 103 bp, Artificial Sequence
  Synthetic Polynucleotide
taatacgactcactatagggctccgtctgctcctccgccagcgccgccataacagaggagaatggcgatgctggcggagaacctggcggcagcgcaaaagatg

SEQ ID NO: 213437 - DNA, 103 bp, Artificial Sequence
  Synthetic Polynucleotide
taatacgactcactatagggggtagtgccgccgctaccctcgcctgcgccaacagaggagaggcgcaatggagggtagcaacctggcggcagcgcaaaagatg

SEQ ID NO: 213438 - DNA, 103 bp, Artificial Sequence
  Synthetic Polynucleotide
taatacgactcactataggggtcaatgtagaggtgctcctgaactatgttaacagaggagaaacataatgcaggagcacaacctggcggcagcgcaaaagatg

SEQ ID NO: 213439 - DNA, 103 bp, Artificial Sequence
  Synthetic Polynucleotide
taatacgactcactatagggcatcaaagatgtcaatgtagaggtgctcctaacagaggagaaggagcatgtctacattgaacctggcggcagcgcaaaagatg

SEQ ID NO: 213440 - DNA, 103 bp, Artificial Sequence
  Synthetic Polynucleotide
taatacgactcactatagggcgcggcatcccatcaaagatgtcaatgtagaacagaggagactacatatgcatctttgaaacctggcggcagcgcaaaagatg

SEQ ID NO: 213441 - DNA, 103 bp, Artificial Sequence
  Synthetic Polynucleotide
taatacgactcactatagggttgcttactacgcggcatcccatcaaagataacagaggagaatctttatggggatgccgaacctggcggcagcgcaaaagatg

SEQ ID NO: 213442 - DNA, 103 bp, Artificial Sequence
  Synthetic Polynucleotide
taatacgactcactatagggcatctatctgttgcttactacgcggcatccaacagaggagaggatgcatggtagtaagcaacctggcggcagcgcaaaagatg

SEQ ID NO: 213443 - DNA, 103 bp, Artificial Sequence
  Synthetic Polynucleotide
taatacgactcactatagggcccaccatcgcatctatctgttgcttactaaacagaggagatagtaaatgacagatagaaacctggcggcagcgcaaaagatg

SEQ ID NO: 213444 - DNA, 103 bp, Artificial Sequence
  Synthetic Polynucleotide
taatacgactcactatagggtgccaaacttcccaccatcgcatctatctgaacagaggagacagataatggcgatggtgaacctggcggcagcgcaaaagatg

SEQ ID NO: 213445 - DNA, 103 bp, Artificial Sequence
  Synthetic Polynucleotide
taatacgactcactatagggtagcctctcctgccaaacttcccaccatcgaacagaggagacgatggatggaagtttggaacctggcggcagcgcaaaagatg

SEQ ID NO: 213446 - DNA, 103 bp, Artificial Sequence
  Synthetic Polynucleotide
taatacgactcactataggggcctctcgtttagcctctcctgccaaacttaacagaggagaaagtttatgaggagaggcaacctggcggcagcgcaaaagatg

SEQ ID NO: 213447 - DNA, 103 bp, Artificial Sequence
  Synthetic Polynucleotide
taatacgactcactatagggtgatttgtttgcctctcgtttagcctctccaacagaggagaggagagatgaaacgagagaacctggcggcagcgcaaaagatg

SEQ ID NO: 213448 - DNA, 103 bp, Artificial Sequence
  Synthetic Polynucleotide
taatacgactcactatagggggccgttgttggtagtgccgccgctaccctaacagaggagaagggtaatggcggcactaaacctggcggcagcgcaaaagatg

SEQ ID NO: 213449 - DNA, 103 bp, Artificial Sequence
  Synthetic Polynucleotide
taatacgactcactatagggaaaatacctttgatttgtttgcctctcgttaacagaggagaaacgagatgcaaacaaataacctggcggcagcgcaaaagatg

SEQ ID NO: 213450 - DNA, 103 bp, Artificial Sequence
  Synthetic Polynucleotide
taatacgactcactatagggaataaaccaaaaaatacctttgatttgtttaacagaggagaaaacaaatgaaaggtattaacctggcggcagcgcaaaagatg

SEQ ID NO: 213451 - DNA, 103 bp, Artificial Sequence
  Synthetic Polynucleotide
taatacgactcactatagggtggttcttttaataaaccaaaaaataccttaacagaggagaaaggtaatgtttggtttaaacctggcggcagcgcaaaagatg

SEQ ID NO: 213452 - DNA, 103 bp, Artificial Sequence
  Synthetic Polynucleotide
taatacgactcactatagggcctcaatttctggttcttttaataaaccaaaacagaggagattggttatgtaaaagaacaacctggcggcagcgcaaaagatg

SEQ ID NO: 213453 - DNA, 103 bp, Artificial Sequence
  Synthetic Polynucleotide
taatacgactcactatagggtccaaaggtacctcaatttctggttcttttaacagaggagaaaaagaatgagaaattgaaacctggcggcagcgcaaaagatg

SEQ ID NO: 213454 - DNA, 103 bp, Artificial Sequence
  Synthetic Polynucleotide
taatacgactcactatagggatcctcgtcatccaaaggtacctcaatttcaacagaggagagaaattatggtacctttgaacctggcggcagcgcaaaagatg

SEQ ID NO: 213455 - DNA, 103 bp, Artificial Sequence
  Synthetic Polynucleotide
taatacgactcactatagggctccctcttcatcctcgtcatccaaaggtaaacagaggagataccttatgatgacgaggaacctggcggcagcgcaaaagatg

SEQ ID NO: 213456 - DNA, 103 bp, Artificial Sequence
  Synthetic Polynucleotide
taatacgactcactatagggtcttcattttctccctcttcatcctcgtcaaacagaggagatgacgaatgtgaagagggaacctggcggcagcgcaaaagatg

SEQ ID NO: 213457 - DNA, 103 bp, Artificial Sequence
  Synthetic Polynucleotide
taatacgactcactatagggaggttttccttcttcattttctccctcttcaacagaggagagaagagatggaaaatgaaaacctggcggcagcgcaaaagatg

SEQ ID NO: 213458 - DNA, 103 bp, Artificial Sequence
  Synthetic Polynucleotide
taatacgactcactatagggtcttctttttaggttttccttcttcattttaacagaggagaaaaatgatgaaggaaaacaacctggcggcagcgcaaaagatg

SEQ ID NO: 213459 - DNA, 103 bp, Artificial Sequence
  Synthetic Polynucleotide
taatacgactcactatagggccgccgttggggccgttgttggtagtgccgaacagaggagacggcacatgcaacaacggaacctggcggcagcgcaaaagatg

SEQ ID NO: 213460 - DNA, 103 bp, Artificial Sequence
  Synthetic Polynucleotide
taatacgactcactatagggtttttaggcttcttctttttaggttttcctaacagaggagaaggaaaatgtaaaaagaaaacctggcggcagcgcaaaagatg

SEQ ID NO: 213461 - DNA, 103 bp, Artificial Sequence
  Synthetic Polynucleotide
taatacgactcactatagggaatactatcttttttaggcttcttctttttaacagaggagaaaaaagatgaagcctaaaaacctggcggcagcgcaaaagatg

SEQ ID NO: 213462 - DNA, 103 bp, Artificial Sequence
  Synthetic Polynucleotide
taatacgactcactatagggttttggatccaatactatcttttttaggctaacagaggagaagcctaatgaagatagtaaacctggcggcagcgcaaaagatg

SEQ ID NO: 213463 - DNA, 103 bp, Artificial Sequence
  Synthetic Polynucleotide
taatacgactcactatagggtgttttttgcttttggatccaatactatctaacagaggagaagatagatgtggatccaaaacctggcggcagcgcaaaagatg

SEQ ID NO: 213464 - DNA, 103 bp, Artificial Sequence
  Synthetic Polynucleotide
taatacgactcactatagggattgggatcttgttttttgcttttggatccaacagaggagaggatccatgagcaaaaaaaacctggcggcagcgcaaaagatg

SEQ ID NO: 213465 - DNA, 103 bp, Artificial Sequence
  Synthetic Polynucleotide
taatacgactcactataggggaggtggagcattgggatcttgttttttgcaacagaggagagcaaaaatgaagatcccaaacctggcggcagcgcaaaagatg

SEQ ID NO: 213466 - DNA, 103 bp, Artificial Sequence
  Synthetic Polynucleotide
taatacgactcactatagggattctgttctgaggtggagcattgggatctaacagaggagaagatccatgtgctccaccaacctggcggcagcgcaaaagatg

SEQ ID NO: 213467 - DNA, 103 bp, Artificial Sequence
  Synthetic Polynucleotide
taatacgactcactatagggaggaagagggattctgttctgaggtggagcaacagaggagagctccaatgcagaacagaaacctggcggcagcgcaaaagatg

SEQ ID NO: 213468 - DNA, 103 bp, Artificial Sequence
  Synthetic Polynucleotide
taatacgactcactatagggctttcaactcaggaagagggattctgttctaacagaggagaagaacaatgtccctcttcaacctggcggcagcgcaaaagatg

SEQ ID NO: 213469 - DNA, 103 bp, Artificial Sequence
  Synthetic Polynucleotide
taatacgactcactatagggttatctgaatctttcaactcaggaagagggaacagaggagaccctctatgtgagttgaaaacctggcggcagcgcaaaagatg

SEQ ID NO: 213470 - DNA, 103 bp, Artificial Sequence
  Synthetic Polynucleotide
taatacgactcactataggggttcccgccgccgccgttggggccgttgttaacagaggagaaacaacatgcccaacggcaacctggcggcagcgcaaaagatg

SEQ ID NO: 213471 - DNA, 103 bp, Artificial Sequence
  Synthetic Polynucleotide
taatacgactcactatagggcttatccaacttatctgaatctttcaactcaacagaggagagagttgatggattcagataacctggcggcagcgcaaaagatg

SEQ ID NO: 213472 - DNA, 103 bp, Artificial Sequence
  Synthetic Polynucleotide
taatacgactcactatagggtattcattatcttatccaacttatctgaataacagaggagaattcagatgagttggataaacctggcggcagcgcaaaagatg

SEQ ID NO: 213473 - DNA, 103 bp, Artificial Sequence
  Synthetic Polynucleotide
taatacgactcactataggggtttctttcatattcattatcttatccaacaacagaggagagttggaatggataatgaaaacctggcggcagcgcaaaagatg

SEQ ID NO: 213474 - DNA, 103 bp, Artificial Sequence
  Synthetic Polynucleotide
taatacgactcactatagggtcgtttggtggtttctttcatattcattataacagaggagaataatgatgatgaaagaaaacctggcggcagcgcaaaagatg

SEQ ID NO: 213475 - DNA, 103 bp, Artificial Sequence
  Synthetic Polynucleotide
taatacgactcactatagggcaaggcgcactcgtttggtggtttctttcaaacagaggagatgaaagatgccaccaaacaacctggcggcagcgcaaaagatg

SEQ ID NO: 213476 - DNA, 103 bp, Artificial Sequence
  Synthetic Polynucleotide
taatacgactcactatagggcagtccggcccaaggcgcactcgtttggtgaacagaggagacaccaaatgagtgcgcctaacctggcggcagcgcaaaagatg

SEQ ID NO: 213477 - DNA, 103 bp, Artificial Sequence
  Synthetic Polynucleotide
taatacgactcactatagggggagggtaagcagtccggcccaaggcgcacaacagaggagagtgcgcatggggccggacaacctggcggcagcgcaaaagatg

SEQ ID NO: 213478 - DNA, 103 bp, Artificial Sequence
  Synthetic Polynucleotide
taatacgactcactatagggagaaacaaatggagggtaagcagtccggccaacagaggagaggccggatggcttaccctaacctggcggcagcgcaaaagatg

SEQ ID NO: 213479 - DNA, 103 bp, Artificial Sequence
  Synthetic Polynucleotide
taatacgactcactatagggagaaatgtatagaaacaaatggagggtaagaacagaggagacttaccatgcatttgtttaacctggcggcagcgcaaaagatg

SEQ ID NO: 213480 - DNA, 103 bp, Artificial Sequence
  Synthetic Polynucleotide
taatacgactcactataggggtaagcattgagaaatgtatagaaacaaataacagaggagaatttgtatgtatacatttaacctggcggcagcgcaaaagatg

SEQ ID NO: 213481 - DNA, 103 bp, Artificial Sequence
  Synthetic Polynucleotide
taatacgactcactatagggacgccgcaacgttcccgccgccgccgttggaacagaggagaccaacgatggcggcgggaaacctggcggcagcgcaaaagatg

SEQ ID NO: 213482 - DNA, 103 bp, Artificial Sequence
  Synthetic Polynucleotide
taatacgactcactatagggtgagaccctggtaagcattgagaaatgtataacagaggagaatacatatgtcaatgcttaacctggcggcagcgcaaaagatg

SEQ ID NO: 213483 - DNA, 103 bp, Artificial Sequence
  Synthetic Polynucleotide
taatacgactcactatagggtccactgcagtgagaccctggtaagcattgaacagaggagacaatgcatgccagggtctaacctggcggcagcgcaaaagatg

SEQ ID NO: 213484 - DNA, 103 bp, Artificial Sequence
  Synthetic Polynucleotide
taatacgactcactatagggatcagtgacatccactgcagtgagaccctgaacagaggagacagggtatgactgcagtgaacctggcggcagcgcaaaagatg

SEQ ID NO: 213485 - DNA, 103 bp, Artificial Sequence
  Synthetic Polynucleotide
taatacgactcactataggggactagaatcatcagtgacatccactgcagaacagaggagactgcagatgatgtcactgaacctggcggcagcgcaaaagatg

SEQ ID NO: 213486 - DNA, 103 bp, Artificial Sequence
  Synthetic Polynucleotide
taatacgactcactatagggccagcaatcagactagaatcatcagtgacaaacagaggagatgtcacatgtgattctagaacctggcggcagcgcaaaagatg

SEQ ID NO: 213487 - DNA, 103 bp, Artificial Sequence
  Synthetic Polynucleotide
taatacgactcactatagggtgcaaaacctccagcaatcagactagaatcaacagaggagagattctatgctgattgctaacctggcggcagcgcaaaagatg

SEQ ID NO: 213488 - DNA, 103 bp, Artificial Sequence
  Synthetic Polynucleotide
taatacgactcactatagggcagttgaatctgcaaaacctccagcaatcaaacagaggagatgattgatggaggttttgaacctggcggcagcgcaaaagatg

SEQ ID NO: 213489 - DNA, 103 bp, Artificial Sequence
  Synthetic Polynucleotide
taatacgactcactatagggcacactctgacagttgaatctgcaaaacctaacagaggagaaggtttatgagattcaacaacctggcggcagcgcaaaagatg

SEQ ID NO: 213490 - DNA, 103 bp, Artificial Sequence
  Synthetic Polynucleotide
taatacgactcactatagggtgttaccgaccacactctgacagttgaatcaacagaggagagattcaatggtcagagtgaacctggcggcagcgcaaaagatg

SEQ ID NO: 213491 - DNA, 103 bp, Artificial Sequence
  Synthetic Polynucleotide
taatacgactcactataggggctttttgggtgttaccgaccacactctgaaacagaggagatcagagatgggtcggtaaaacctggcggcagcgcaaaagatg

SEQ ID NO: 213492 - DNA, 103 bp, Artificial Sequence
  Synthetic Polynucleotide
taatacgactcactataggggtggacgacgacgccgcaacgttcccgccgaacagaggagacggcggatgcgttgcggcaacctggcggcagcgcaaaagatg

SEQ ID NO: 213493 - DNA, 103 bp, Artificial Sequence
  Synthetic Polynucleotide
taatacgactcactatagggacactacgaagctttttgggtgttaccgacaacagaggagagtcggtatgacccaaaaaaacctggcggcagcgcaaaagatg

SEQ ID NO: 213494 - DNA, 103 bp, Artificial Sequence
  Synthetic Polynucleotide
taatacgactcactatagggtgcttgtttgacactacgaagctttttgggaacagaggagacccaaaatgcttcgtagtaacctggcggcagcgcaaaagatg

SEQ ID NO: 213495 - DNA, 103 bp, Artificial Sequence
  Synthetic Polynucleotide
taatacgactcactatagggtaagatctgatgcttgtttgacactacgaaaacagaggagattcgtaatgtcaaacaagaacctggcggcagcgcaaaagatg

SEQ ID NO: 213496 - DNA, 103 bp, Artificial Sequence
  Synthetic Polynucleotide
taatacgactcactatagggtctataagactaagatctgatgcttgtttgaacagaggagacaaacaatgatcagatctaacctggcggcagcgcaaaagatg

SEQ ID NO: 213497 - DNA, 103 bp, Artificial Sequence
  Synthetic Polynucleotide
taatacgactcactatagggtgattctttgtctataagactaagatctgaaacagaggagatcagatatgagtcttataaacctggcggcagcgcaaaagatg

SEQ ID NO: 213498 - DNA, 103 bp, Artificial Sequence
  Synthetic Polynucleotide
taatacgactcactatagggagacatcatctgattctttgtctataagacaacagaggagagtcttaatgacaaagaataacctggcggcagcgcaaaagatg

SEQ ID NO: 213499 - DNA, 103 bp, Artificial Sequence
  Synthetic Polynucleotide
taatacgactcactatagggattctttctaagacatcatctgattctttgaacagaggagacaaagaatgagatgatgtaacctggcggcagcgcaaaagatg

SEQ ID NO: 213500 - DNA, 103 bp, Artificial Sequence
  Synthetic Polynucleotide
taatacgactcactatagggctcatccatgattctttctaagacatcatcaacagaggagagatgatatgttagaaagaaacctggcggcagcgcaaaagatg

SEQ ID NO: 213501 - DNA, 103 bp, Artificial Sequence
  Synthetic Polynucleotide
taatacgactcactatagggttgctgttttctcatccatgattctttctaaacagaggagatagaaaatgtcatggatgaacctggcggcagcgcaaaagatg

SEQ ID NO: 213502 - DNA, 103 bp, Artificial Sequence
  Synthetic Polynucleotide
taatacgactcactatagggttcaactcacttgctgttttctcatccatgaacagaggagacatggaatggaaaacagcaacctggcggcagcgcaaaagatg

SEQ ID NO: 213503 - DNA, 103 bp, Artificial Sequence
  Synthetic Polynucleotide
taatacgactcactatagggatccccgccagtggacgacgacgccgcaacaacagaggagagttgcgatgtcgtcgtccaacctggcggcagcgcaaaagatg

SEQ ID NO: 213504 - DNA, 103 bp, Artificial Sequence
  Synthetic Polynucleotide
taatacgactcactatagggatacaaaatcttcaactcacttgctgttttaacagaggagaaaaacaatgagtgagttgaacctggcggcagcgcaaaagatg

SEQ ID NO: 213505 - DNA, 103 bp, Artificial Sequence
  Synthetic Polynucleotide
taatacgactcactatagggcactgtgaccatacaaaatcttcaactcacaacagaggagagtgagtatgagattttgtaacctggcggcagcgcaaaagatg

SEQ ID NO: 213506 - DNA, 103 bp, Artificial Sequence
  Synthetic Polynucleotide
taatacgactcactatagggtagacaggcccactgtgaccatacaaaatcaacagaggagagattttatgtggtcacagaacctggcggcagcgcaaaagatg

SEQ ID NO: 213507 - DNA, 103 bp, Artificial Sequence
  Synthetic Polynucleotide
taatacgactcactataggggctggctccgtagacaggcccactgtgaccaacagaggagaggtcacatggggcctgtcaacctggcggcagcgcaaaagatg

SEQ ID NO: 213508 - DNA, 103 bp, Artificial Sequence
  Synthetic Polynucleotide
taatacgactcactatagggccggactgaagctggctccgtagacaggccaacagaggagaggcctgatgacggagccaaacctggcggcagcgcaaaagatg

SEQ ID NO: 213509 - DNA, 103 bp, Artificial Sequence
  Synthetic Polynucleotide
taatacgactcactatagggtagttcctatccggactgaagctggctccgaacagaggagacggagcatgcttcagtccaacctggcggcagcgcaaaagatg

SEQ ID NO: 213510 - DNA, 103 bp, Artificial Sequence
  Synthetic Polynucleotide
taatacgactcactatagggggaaagcagatagttcctatccggactgaaaacagaggagattcagtatggataggaacaacctggcggcagcgcaaaagatg

SEQ ID NO: 213511 - DNA, 103 bp, Artificial Sequence
  Synthetic Polynucleotide
taatacgactcactatagggcctctgaagaggaaagcagatagttcctataacagaggagaataggaatgatctgctttaacctggcggcagcgcaaaagatg

SEQ ID NO: 213512 - DNA, 103 bp, Artificial Sequence
  Synthetic Polynucleotide
taatacgactcactatagggacagttccgtcctctgaagaggaaagcagaaacagaggagatctgctatgctcttcagaaacctggcggcagcgcaaaagatg

SEQ ID NO: 213513 - DNA, 103 bp, Artificial Sequence
  Synthetic Polynucleotide
taatacgactcactatagggccacaatctaacagttccgtcctctgaagaaacagaggagatcttcaatggacggaactaacctggcggcagcgcaaaagatg

SEQ ID NO: 213514 - DNA, 103 bp, Artificial Sequence
  Synthetic Polynucleotide
taatacgactcactataggggggtcccgccatccccgccagtggacgacgaacagaggagacgtcgtatgctggcggggaacctggcggcagcgcaaaagatg

SEQ ID NO: 213515 - DNA, 103 bp, Artificial Sequence
  Synthetic Polynucleotide
taatacgactcactatagggtttgaaggctccacaatctaacagttccgtaacagaggagaacggaaatgttagattgtaacctggcggcagcgcaaaagatg

SEQ ID NO: 213516 - DNA, 103 bp, Artificial Sequence
  Synthetic Polynucleotide
taatacgactcactatagggcaagtaaatgtttgaaggctccacaatctaaacagaggagatagattatggagccttcaaacctggcggcagcgcaaaagatg

SEQ ID NO: 213517 - DNA, 103 bp, Artificial Sequence
  Synthetic Polynucleotide
taatacgactcactatagggtcccaccaaacaagtaaatgtttgaaggctaacagaggagaagccttatgacatttactaacctggcggcagcgcaaaagatg

SEQ ID NO: 213518 - DNA, 103 bp, Artificial Sequence
  Synthetic Polynucleotide
taatacgactcactataggggtcctttatatcccaccaaacaagtaaatgaacagaggagacatttaatggtttggtggaacctggcggcagcgcaaaagatg

SEQ ID NO: 213519 - DNA, 103 bp, Artificial Sequence
  Synthetic Polynucleotide
taatacgactcactatagggggatagttgtgtcctttatatcccaccaaaaacagaggagatttggtatgatataaaggaacctggcggcagcgcaaaagatg

SEQ ID NO: 213520 - DNA, 103 bp, Artificial Sequence
  Synthetic Polynucleotide
taatacgactcactataggggtcccatactggatagttgtgtcctttataaacagaggagatataaaatgcacaactataacctggcggcagcgcaaaagatg

SEQ ID NO: 213521 - DNA, 103 bp, Artificial Sequence
  Synthetic Polynucleotide
taatacgactcactatagggaaaattgtgtgtcccatactggatagttgtaacagaggagaacaactatgcagtatgggaacctggcggcagcgcaaaagatg

SEQ ID NO: 213522 - DNA, 103 bp, Artificial Sequence
  Synthetic Polynucleotide
taatacgactcactatagggccatatggagaaaattgtgtgtcccatactaacagaggagaagtatgatgcacacaattaacctggcggcagcgcaaaagatg

SEQ ID NO: 213523 - DNA, 103 bp, Artificial Sequence
  Synthetic Polynucleotide
taatacgactcactatagggaaaataatatccatatggagaaaattgtgtaacagaggagaacacaaatgtctccatataacctggcggcagcgcaaaagatg

SEQ ID NO: 213524 - DNA, 103 bp, Artificial Sequence
  Synthetic Polynucleotide
taatacgactcactatagggcccctgacacaaaataatatccatatggagaacagaggagactccatatggatattattaacctggcggcagcgcaaaagatg

SEQ ID NO: 213525 - DNA, 103 bp, Artificial Sequence
  Synthetic Polynucleotide
taatacgactcactataggggtgggcttgggggtcccgccatccccgccaaacagaggagatggcggatgtggcgggacaacctggcggcagcgcaaaagatg

SEQ ID NO: 213526 - DNA, 103 bp, Artificial Sequence
  Synthetic Polynucleotide
taatacgactcactatagggcggtcatggccccctgacacaaaataatataacagaggagaatattaatgtgtgtcaggaacctggcggcagcgcaaaagatg

SEQ ID NO: 213527 - DNA, 103 bp, Artificial Sequence
  Synthetic Polynucleotide
taatacgactcactatagggccgagctactcggtcatggccccctgacacaacagaggagagtgtcaatgggccatgacaacctggcggcagcgcaaaagatg

SEQ ID NO: 213528 - DNA, 103 bp, Artificial Sequence
  Synthetic Polynucleotide
taatacgactcactatagggtagcccagagccgagctactcggtcatggcaacagaggagagccatgatggagtagctcaacctggcggcagcgcaaaagatg

SEQ ID NO: 213529 - DNA, 103 bp, Artificial Sequence
  Synthetic Polynucleotide
taatacgactcactatagggtagtggtctgtagcccagagccgagctactaacagaggagaagtagcatggctctgggcaacctggcggcagcgcaaaagatg

SEQ ID NO: 213530 - DNA, 103 bp, Artificial Sequence
  Synthetic Polynucleotide
taatacgactcactatagggtaaaggctgatagtggtctgtagcccagagaacagaggagactctggatgacagaccacaacctggcggcagcgcaaaagatg

SEQ ID NO: 213531 - DNA, 103 bp, Artificial Sequence
  Synthetic Polynucleotide
taatacgactcactatagggcaaatattcttaaaggctgatagtggtctgaacagaggagacagaccatgatcagccttaacctggcggcagcgcaaaagatg

SEQ ID NO: 213532 - DNA, 103 bp, Artificial Sequence
  Synthetic Polynucleotide
taatacgactcactatagggagatggccggcaaatattcttaaaggctgaaacagaggagatcagccatgaagaatattaacctggcggcagcgcaaaagatg

SEQ ID NO: 213533 - DNA, 103 bp, Artificial Sequence
  Synthetic Polynucleotide
taatacgactcactatagggcacatcagcaagatggccggcaaatattctaacagaggagaagaataatggccggccataacctggcggcagcgcaaaagatg

SEQ ID NO: 213534 - DNA, 103 bp, Artificial Sequence
  Synthetic Polynucleotide
taatacgactcactatagggtggtacaattcacatcagcaagatggccggaacagaggagaccggccatgttgctgatgaacctggcggcagcgcaaaagatg

SEQ ID NO: 213535 - DNA, 103 bp, Artificial Sequence
  Synthetic Polynucleotide
taatacgactcactatagggggatggaatctggtacaattcacatcagcaaacagaggagatgctgaatggaattgtacaacctggcggcagcgcaaaagatg

SEQ ID NO: 213536 - DNA, 103 bp, Artificial Sequence
  Synthetic Polynucleotide
taatacgactcactataggggacagccaccgtgggcttgggggtcccgccaacagaggagaggcgggatgcccaagcccaacctggcggcagcgcaaaagatg

SEQ ID NO: 213537 - DNA, 103 bp, Artificial Sequence
  Synthetic Polynucleotide
taatacgactcactatagggattagaatttggatggaatctggtacaattaacagaggagaaattgtatgagattccataacctggcggcagcgcaaaagatg

SEQ ID NO: 213538 - DNA, 103 bp, Artificial Sequence
  Synthetic Polynucleotide
taatacgactcactatagggtagcaacataattagaatttggatggaatcaacagaggagagattccatgcaaattctaaacctggcggcagcgcaaaagatg

SEQ ID NO: 213539 - DNA, 103 bp, Artificial Sequence
  Synthetic Polynucleotide
taatacgactcactataggggcagagcccgtagcaacataattagaatttaacagaggagaaaattcatgttatgttgcaacctggcggcagcgcaaaagatg

SEQ ID NO: 213540 - DNA, 103 bp, Artificial Sequence
  Synthetic Polynucleotide
taatacgactcactatagggagttctgtctgcagagcccgtagcaacataaacagaggagatatgttatgacgggctctaacctggcggcagcgcaaaagatg

SEQ ID NO: 213541 - DNA, 103 bp, Artificial Sequence
  Synthetic Polynucleotide
taatacgactcactatagggagagccgcacagttctgtctgcagagcccgaacagaggagacgggctatgcagacagaaaacctggcggcagcgcaaaagatg

SEQ ID NO: 213542 - DNA, 103 bp, Artificial Sequence
  Synthetic Polynucleotide
taatacgactcactatagggaggacgtcccagagccgcacagttctgtctaacagaggagaagacagatgtgtgcggctaacctggcggcagcgcaaaagatg

SEQ ID NO: 213543 - DNA, 103 bp, Artificial Sequence
  Synthetic Polynucleotide
taatacgactcactataggggttaccattcaggacgtcccagagccgcacaacagaggagagtgcggatgtgggacgtcaacctggcggcagcgcaaaagatg

SEQ ID NO: 213544 - DNA, 103 bp, Artificial Sequence
  Synthetic Polynucleotide
taatacgactcactatagggtccttacacagttaccattcaggacgtcccaacagaggagagggacgatgtgaatggtaaacctggcggcagcgcaaaagatg

SEQ ID NO: 213545 - DNA, 103 bp, Artificial Sequence
  Synthetic Polynucleotide
taatacgactcactatagggccagtgaagatccttacacagttaccattcaacagaggagagaatggatgctgtgtaagaacctggcggcagcgcaaaagatg

SEQ ID NO: 213546 - DNA, 103 bp, Artificial Sequence
  Synthetic Polynucleotide
taatacgactcactatagggtcccttgtgtccagtgaagatccttacacaaacagaggagatgtgtaatgatcttcactaacctggcggcagcgcaaaagatg

SEQ ID NO: 213547 - DNA, 103 bp, Artificial Sequence
  Synthetic Polynucleotide
taatacgactcactatagggtgaccgccacctccgtctgctcctccgccaaacagaggagatggcggatgagcagacggaacctggcggcagcgcaaaagatg

SEQ ID NO: 213548 - DNA, 103 bp, Artificial Sequence
  Synthetic Polynucleotide
taatacgactcactatagggcagcggcggagacagccaccgtgggcttggaacagaggagaccaagcatgcggtggctgaacctggcggcagcgcaaaagatg

SEQ ID NO: 213549 - DNA, 103 bp, Artificial Sequence
  Synthetic Polynucleotide
taatacgactcactatagggaatgaattggtcccttgtgtccagtgaagaaacagaggagatcttcaatggacacaaggaacctggcggcagcgcaaaagatg

SEQ ID NO: 213550 - DNA, 103 bp, Artificial Sequence
  Synthetic Polynucleotide
taatacgactcactatagggaatgtcaaggaatgaattggtcccttgtgtaacagaggagaacacaaatgaccaattcaaacctggcggcagcgcaaaagatg

SEQ ID NO: 213551 - DNA, 103 bp, Artificial Sequence
  Synthetic Polynucleotide
taatacgactcactatagggattgggagaaaatgtcaaggaatgaattggaacagaggagaccaattatgtccttgacaaacctggcggcagcgcaaaagatg

SEQ ID NO: 213552 - DNA, 103 bp, Artificial Sequence
  Synthetic Polynucleotide
taatacgactcactatagggggaatctcccattgggagaaaatgtcaaggaacagaggagaccttgaatgtttctcccaaacctggcggcagcgcaaaagatg

SEQ ID NO: 213553 - DNA, 103 bp, Artificial Sequence
  Synthetic Polynucleotide
taatacgactcactatagggcctgtagccaggaatctcccattgggagaaaacagaggagattctccatgtgggagattaacctggcggcagcgcaaaagatg

SEQ ID NO: 213554 - DNA, 103 bp, Artificial Sequence
  Synthetic Polynucleotide
taatacgactcactatagggatctgttgctcctgtagccaggaatctcccaacagaggagagggagaatgctggctacaaacctggcggcagcgcaaaagatg

SEQ ID NO: 213555 - DNA, 103 bp, Artificial Sequence
  Synthetic Polynucleotide
taatacgactcactataggggcactctgccatctgttgctcctgtagccaaacagaggagatggctaatggagcaacagaacctggcggcagcgcaaaagatg

SEQ ID NO: 213556 - DNA, 103 bp, Artificial Sequence
  Synthetic Polynucleotide
taatacgactcactatagggtcccaaagaagcactctgccatctgttgctaacagaggagaagcaacatgtggcagagtaacctggcggcagcgcaaaagatg

SEQ ID NO: 213557 - DNA, 103 bp, Artificial Sequence
  Synthetic Polynucleotide
taatacgactcactatagggatgtccaatatcccaaagaagcactctgccaacagaggagaggcagaatgcttctttggaacctggcggcagcgcaaaagatg

SEQ ID NO: 213558 - DNA, 103 bp, Artificial Sequence
  Synthetic Polynucleotide
taatacgactcactatagggccatcaaaccatgtccaatatcccaaagaaaacagaggagattctttatgatattggacaacctggcggcagcgcaaaagatg

SEQ ID NO: 213559 - DNA, 103 bp, Artificial Sequence
  Synthetic Polynucleotide
taatacgactcactatagggcccgccggggcagcggcggagacagccaccaacagaggagaggtggcatgctccgccgcaacctggcggcagcgcaaaagatg

SEQ ID NO: 213560 - DNA, 103 bp, Artificial Sequence
  Synthetic Polynucleotide
taatacgactcactatagggaattctccaaccatcaaaccatgtccaataaacagaggagatattggatgtggtttgataacctggcggcagcgcaaaagatg

SEQ ID NO: 213561 - DNA, 103 bp, Artificial Sequence
  Synthetic Polynucleotide
taatacgactcactataggggtggccttttaattctccaaccatcaaaccaacagaggagaggtttgatggttggagaaaacctggcggcagcgcaaaagatg

SEQ ID NO: 213562 - DNA, 103 bp, Artificial Sequence
  Synthetic Polynucleotide
taatacgactcactatagggctgtatcagtgtggccttttaattctccaaaacagaggagattggagatgtaaaaggccaacctggcggcagcgcaaaagatg

SEQ ID NO: 213563 - DNA, 103 bp, Artificial Sequence
  Synthetic Polynucleotide
taatacgactcactatagggagtgaacagactgtatcagtgtggccttttaacagaggagaaaaaggatgcactgatacaacctggcggcagcgcaaaagatg

SEQ ID NO: 213564 - DNA, 103 bp, Artificial Sequence
  Synthetic Polynucleotide
taatacgactcactatagggactaaacctaagtgaacagactgtatcagtaacagaggagaactgatatggtctgttcaaacctggcggcagcgcaaaagatg

SEQ ID NO: 213565 - DNA, 103 bp, Artificial Sequence
  Synthetic Polynucleotide
taatacgactcactatagggcaccatctctactaaacctaagtgaacagaaacagaggagatctgttatgttaggtttaaacctggcggcagcgcaaaagatg

SEQ ID NO: 213566 - DNA, 103 bp, Artificial Sequence
  Synthetic Polynucleotide
taatacgactcactataggggccaaaatttcaccatctctactaaacctaaacagaggagataggttatgtagagatggaacctggcggcagcgcaaaagatg

SEQ ID NO: 213567 - DNA, 103 bp, Artificial Sequence
  Synthetic Polynucleotide
taatacgactcactatagggtgaacctgatgccaaaatttcaccatctctaacagaggagaagagatatggaaattttgaacctggcggcagcgcaaaagatg

SEQ ID NO: 213568 - DNA, 103 bp, Artificial Sequence
  Synthetic Polynucleotide
taatacgactcactatagggtattatccattgaacctgatgccaaaatttaacagaggagaaaatttatgcatcaggttaacctggcggcagcgcaaaagatg

SEQ ID NO: 213569 - DNA, 103 bp, Artificial Sequence
  Synthetic Polynucleotide
taatacgactcactatagggaatcgaactgtattatccattgaacctgataacagaggagaatcaggatgaatggataaaacctggcggcagcgcaaaagatg

SEQ ID NO: 213570 - DNA, 103 bp, Artificial Sequence
  Synthetic Polynucleotide
taatacgactcactatagggcggggccgcccccgccggggcagcggcggaaacagaggagatccgccatggccccggcgaacctggcggcagcgcaaaagatg

SEQ ID NO: 213571 - DNA, 103 bp, Artificial Sequence
  Synthetic Polynucleotide
taatacgactcactatagggagcatcccataatcgaactgtattatccataacagaggagaatggatatgacagttcgaaacctggcggcagcgcaaaagatg

SEQ ID NO: 213572 - DNA, 103 bp, Artificial Sequence
  Synthetic Polynucleotide
taatacgactcactatagggaggctttgatagcatcccataatcgaactgaacagaggagacagttcatgtatgggatgaacctggcggcagcgcaaaagatg

SEQ ID NO: 213573 - DNA, 103 bp, Artificial Sequence
  Synthetic Polynucleotide
taatacgactcactatagggaaatcttcaaaggctttgatagcatcccataacagaggagaatgggaatgtatcaaagcaacctggcggcagcgcaaaagatg

SEQ ID NO: 213574 - DNA, 103 bp, Artificial Sequence
  Synthetic Polynucleotide
taatacgactcactatagggatcggtctctaaatcttcaaaggctttgataacagaggagaatcaaaatgtttgaagataacctggcggcagcgcaaaagatg

SEQ ID NO: 213575 - DNA, 103 bp, Artificial Sequence
  Synthetic Polynucleotide
taatacgactcactatagggtagtaaagtcatcggtctctaaatcttcaaaacagaggagattgaagatgtagagaccgaacctggcggcagcgcaaaagatg

SEQ ID NO: 213576 - DNA, 103 bp, Artificial Sequence
  Synthetic Polynucleotide
taatacgactcactatagggccagtggctgtagtaaagtcatcggtctctaacagaggagaagagacatgtgactttacaacctggcggcagcgcaaaagatg

SEQ ID NO: 213577 - DNA, 103 bp, Artificial Sequence
  Synthetic Polynucleotide
taatacgactcactatagggatttatatgcccagtggctgtagtaaagtcaacagaggagagactttatgacagccactaacctggcggcagcgcaaaagatg

SEQ ID NO: 213578 - DNA, 103 bp, Artificial Sequence
  Synthetic Polynucleotide
taatacgactcactatagggtctcaggtaaatttatatgcccagtggctgaacagaggagacagccaatgggcatataaaacctggcggcagcgcaaaagatg

SEQ ID NO: 213579 - DNA, 103 bp, Artificial Sequence
  Synthetic Polynucleotide
taatacgactcactatagggtcctgtgaattctcaggtaaatttatatgcaacagaggagagcatatatgtttacctgaaacctggcggcagcgcaaaagatg

SEQ ID NO: 213580 - DNA, 103 bp, Artificial Sequence
  Synthetic Polynucleotide
taatacgactcactatagggcaacaataactcctgtgaattctcaggtaaaacagaggagattacctatgaattcacagaacctggcggcagcgcaaaagatg

SEQ ID NO: 213581 - DNA, 103 bp, Artificial Sequence
  Synthetic Polynucleotide
taatacgactcactatagggcggcgggcaccggggccgcccccgccggggaacagaggagaccccggatggggcggcccaacctggcggcagcgcaaaagatg

SEQ ID NO: 213582 - DNA, 103 bp, Artificial Sequence
  Synthetic Polynucleotide
taatacgactcactatagggtatatgttcccaacaataactcctgtgaataacagaggagaattcacatgagttattgtaacctggcggcagcgcaaaagatg

SEQ ID NO: 213583 - DNA, 103 bp, Artificial Sequence
  Synthetic Polynucleotide
taatacgactcactataggggatttggtcatatatgttcccaacaataacaacagaggagagttattatggggaacataaacctggcggcagcgcaaaagatg

SEQ ID NO: 213584 - DNA, 103 bp, Artificial Sequence
  Synthetic Polynucleotide
taatacgactcactatagggaactggtgttgatttggtcatatatgttccaacagaggagaggaacaatgatgaccaaaaacctggcggcagcgcaaaagatg

SEQ ID NO: 213585 - DNA, 103 bp, Artificial Sequence
  Synthetic Polynucleotide
taatacgactcactataggggaaggtgtacaactggtgttgatttggtcaaacagaggagatgaccaatgcaacaccagaacctggcggcagcgcaaaagatg

SEQ ID NO: 213586 - DNA, 103 bp, Artificial Sequence
  Synthetic Polynucleotide
taatacgactcactatagggcgagtaaaatgaaggtgtacaactggtgttaacagaggagaaacaccatgtgtacacctaacctggcggcagcgcaaaagatg

SEQ ID NO: 213587 - DNA, 103 bp, Artificial Sequence
  Synthetic Polynucleotide
taatacgactcactatagggcaggtttcttcgagtaaaatgaaggtgtacaacagaggagagtacacatgcattttactaacctggcggcagcgcaaaagatg

SEQ ID NO: 213588 - DNA, 103 bp, Artificial Sequence
  Synthetic Polynucleotide
taatacgactcactatagggcagctagaaccaggtttcttcgagtaaaataacagaggagaattttaatggaagaaaccaacctggcggcagcgcaaaagatg

SEQ ID NO: 213589 - DNA, 103 bp, Artificial Sequence
  Synthetic Polynucleotide
taatacgactcactatagggtaagctcctgcagctagaaccaggtttcttaacagaggagaaagaaaatgggttctagcaacctggcggcagcgcaaaagatg

SEQ ID NO: 213590 - DNA, 103 bp, Artificial Sequence
  Synthetic Polynucleotide
taatacgactcactatagggttgtggactataagctcctgcagctagaacaacagaggagagttctaatggcaggagctaacctggcggcagcgcaaaagatg

SEQ ID NO: 213591 - DNA, 103 bp, Artificial Sequence
  Synthetic Polynucleotide
taatacgactcactatagggtccggagcagcggcgggcaccggggccgccaacagaggagaggcggcatgggtgcccgcaacctggcggcagcgcaaaagatg

SEQ ID NO: 213592 - DNA, 103 bp, Artificial Sequence
  Synthetic Polynucleotide
taatacgactcactatagggagcgccggcgtccggagcagcggcgggcacaacagaggagagtgcccatggctgctccgaacctggcggcagcgcaaaagatg

SEQ ID NO: 213593 - DNA, 103 bp, Artificial Sequence
  Synthetic Polynucleotide
taatacgactcactatagggggtcatgcggagcgccggcgtccggagcagaacagaggagactgctcatgacgccggcgaacctggcggcagcgcaaaagatg

SEQ ID NO: 213594 - DNA, 103 bp, Artificial Sequence
  Synthetic Polynucleotide
taatacgactcactatagggagagtctgtcggtcatgcggagcgccggcgaacagaggagacgccggatgtccgcatgaaacctggcggcagcgcaaaagatg

SEQ ID NO: 213595 - DNA, 103 bp, Artificial Sequence
  Synthetic Polynucleotide
taatacgactcactatagggcacggccagtagagtctgtcggtcatgcggaacagaggagaccgcatatgcgacagactaacctggcggcagcgcaaaagatg

SEQ ID NO: 213596 - DNA, 103 bp, Artificial Sequence
  Synthetic Polynucleotide
taatacgactcactatagggggaactgcagcacggccagtagagtctgtcaacagaggagagacagaatgtactggccgaacctggcggcagcgcaaaagatg

SEQ ID NO: 213597 - DNA, 103 bp, Artificial Sequence
  Synthetic Polynucleotide
taatacgactcactatagggggctctagcttgaccgccacctccgtctgcaacagaggagagcagacatgggtggcggtaacctggcggcagcgcaaaagatg

SEQ ID NO: 213598 - DNA, 103 bp, Artificial Sequence
  Synthetic Polynucleotide
taatacgactcactatagggctctgccgtaggaactgcagcacggccagtaacagaggagaactggcatggctgcagttaacctggcggcagcgcaaaagatg

SEQ ID NO: 213599 - DNA, 103 bp, Artificial Sequence
  Synthetic Polynucleotide
taatacgactcactataggggcggagtttgctctgccgtaggaactgcagaacagaggagactgcagatgctacggcagaacctggcggcagcgcaaaagatg

SEQ ID NO: 213600 - DNA, 103 bp, Artificial Sequence
  Synthetic Polynucleotide
taatacgactcactatagggcttcggcctcgcggagtttgctctgccgtaaacagaggagatacggcatggcaaactccaacctggcggcagcgcaaaagatg

SEQ ID NO: 213601 - DNA, 103 bp, Artificial Sequence
  Synthetic Polynucleotide
taatacgactcactatagggcgcagcgcctcttcggcctcgcggagtttgaacagaggagacaaactatgcgaggccgaaacctggcggcagcgcaaaagatg

SEQ ID NO: 213602 - DNA, 103 bp, Artificial Sequence
  Synthetic Polynucleotide
taatacgactcactatagggggcctcacggcgcagcgcctcttcggcctcaacagaggagagaggccatggaggcgctgaacctggcggcagcgcaaaagatg

SEQ ID NO: 213603 - DNA, 103 bp, Artificial Sequence
  Synthetic Polynucleotide
taatacgactcactatagggccagcagcccggcctcacggcgcagcgcctaacagaggagaaggcgcatggccgtgaggaacctggcggcagcgcaaaagatg

SEQ ID NO: 213604 - DNA, 103 bp, Artificial Sequence
  Synthetic Polynucleotide
taatacgactcactatagggactgcctcctccagcagcccggcctcacggaacagaggagaccgtgaatgcgggctgctaacctggcggcagcgcaaaagatg

SEQ ID NO: 213605 - DNA, 103 bp, Artificial Sequence
  Synthetic Polynucleotide
taatacgactcactatagggggagcccgccactgcctcctccagcagcccaacagaggagagggctgatggaggaggcaaacctggcggcagcgcaaaagatg

SEQ ID NO: 213606 - DNA, 103 bp, Artificial Sequence
  Synthetic Polynucleotide
taatacgactcactatagggccggggctccggagcccgccactgcctcctaacagaggagaaggaggatgtggcgggctaacctggcggcagcgcaaaagatg

SEQ ID NO: 213607 - DNA, 103 bp, Artificial Sequence
  Synthetic Polynucleotide
taatacgactcactatagggtccacctctcccggggctccggagcccgccaacagaggagaggcgggatgcggagccccaacctggcggcagcgcaaaagatg

SEQ ID NO: 213608 - DNA, 103 bp, Artificial Sequence
  Synthetic Polynucleotide
taatacgactcactatagggcggtccctcaggctctagcttgaccgccacaacagaggagagtggcgatgaagctagagaacctggcggcagcgcaaaagatg

SEQ ID NO: 213609 - DNA, 103 bp, Artificial Sequence
  Synthetic Polynucleotide
taatacgactcactataggggccggcgctgtccacctctcccggggctccaacagaggagaggagccatgggagaggtgaacctggcggcagcgcaaaagatg

SEQ ID NO: 213610 - DNA, 103 bp, Artificial Sequence
  Synthetic Polynucleotide
taatacgactcactatagggtcacctcagcgccggcgctgtccacctctcaacagaggagagagaggatgacagcgccgaacctggcggcagcgcaaaagatg

SEQ ID NO: 213611 - DNA, 103 bp, Artificial Sequence
  Synthetic Polynucleotide
taatacgactcactatagggagcgcgctggtcacctcagcgccggcgctgaacagaggagacagcgcatgcgctgaggtaacctggcggcagcgcaaaagatg

SEQ ID NO: 213612 - DNA, 103 bp, Artificial Sequence
  Synthetic Polynucleotide
taatacgactcactatagggccggctgagaagcgcgctggtcacctcagcaacagaggagagctgagatgaccagcgcgaacctggcggcagcgcaaaagatg

SEQ ID NO: 213613 - DNA, 103 bp, Artificial Sequence
  Synthetic Polynucleotide
taatacgactcactatagggaggcggtcacccggctgagaagcgcgctggaacagaggagaccagcgatgttctcagccaacctggcggcagcgcaaaagatg

SEQ ID NO: 213614 - DNA, 103 bp, Artificial Sequence
  Synthetic Polynucleotide
taatacgactcactatagggccaggggccgaggcggtcacccggctgagaaacagaggagatctcagatgggtgaccgcaacctggcggcagcgcaaaagatg

SEQ ID NO: 213615 - DNA, 103 bp, Artificial Sequence
  Synthetic Polynucleotide
taatacgactcactatagggggccgcagggccaggggccgaggcggtcacaacagaggagagtgaccatgtcggcccctaacctggcggcagcgcaaaagatg

SEQ ID NO: 213616 - DNA, 103 bp, Artificial Sequence
  Synthetic Polynucleotide
taatacgactcactataggggagggtcgggggccgcagggccaggggccgaacagaggagacggcccatggccctgcggaacctggcggcagcgcaaaagatg

SEQ ID NO: 213617 - DNA, 103 bp, Artificial Sequence
  Synthetic Polynucleotide
taatacgactcactatagggccagtgcccggagggtcgggggccgcagggaacagaggagaccctgcatgccccgacccaacctggcggcagcgcaaaagatg

SEQ ID NO: 213618 - DNA, 103 bp, Artificial Sequence
  Synthetic Polynucleotide
taatacgactcactatagggccccgaagcgccagtgcccggagggtcgggaacagaggagacccgacatgccgggcactaacctggcggcagcgcaaaagatg

SEQ ID NO: 213619 - DNA, 103 bp, Artificial Sequence
  Synthetic Polynucleotide
taatacgactcactataggggcagcgttggcggtccctcaggctctagctaacagaggagaagctagatgctgagggacaacctggcggcagcgcaaaagatg

SEQ ID NO: 213620 - DNA, 103 bp, Artificial Sequence
  Synthetic Polynucleotide
taatacgactcactatagggcgaccgtggcccccgaagcgccagtgcccgaacagaggagacgggcaatggcgcttcggaacctggcggcagcgcaaaagatg

SEQ ID NO: 213621 - DNA, 103 bp, Artificial Sequence
  Synthetic Polynucleotide
taatacgactcactataggggaacctgagacgaccgtggcccccgaagcgaacagaggagacgcttcatgggccacggtaacctggcggcagcgcaaaagatg

SEQ ID NO: 213622 - DNA, 103 bp, Artificial Sequence
  Synthetic Polynucleotide
taatacgactcactatagggacctgaggctgaacctgagacgaccgtggcaacagaggagagccacgatggtctcaggtaacctggcggcagcgcaaaagatg

SEQ ID NO: 213623 - DNA, 103 bp, Artificial Sequence
  Synthetic Polynucleotide
taatacgactcactataggggagccgcaggacctgaggctgaacctgagaaacagaggagatctcagatgcagcctcagaacctggcggcagcgcaaaagatg

SEQ ID NO: 213624 - DNA, 103 bp, Artificial Sequence
  Synthetic Polynucleotide
taatacgactcactatagggactttacccggagccgcaggacctgaggctaacagaggagaagcctcatgtcctgcggcaacctggcggcagcgcaaaagatg

SEQ ID NO: 213625 - DNA, 103 bp, Artificial Sequence
  Synthetic Polynucleotide
taatacgactcactatagggaacacttccaactttacccggagccgcaggaacagaggagacctgcgatgccgggtaaaaacctggcggcagcgcaaaagatg

SEQ ID NO: 213626 - DNA, 103 bp, Artificial Sequence
  Synthetic Polynucleotide
taatacgactcactatagggcttccacagcaacacttccaactttacccgaacagaggagacgggtaatgttggaagtgaacctggcggcagcgcaaaagatg

SEQ ID NO: 213627 - DNA, 103 bp, Artificial Sequence
  Synthetic Polynucleotide
taatacgactcactatagggtctggctggtcttccacagcaacacttccaaacagaggagatggaagatgtgctgtggaaacctggcggcagcgcaaaagatg

SEQ ID NO: 213628 - DNA, 103 bp, Artificial Sequence
  Synthetic Polynucleotide
taatacgactcactatagggggcactgacatctggctggtcttccacagcaacagaggagagctgtgatggaccagccaaacctggcggcagcgcaaaagatg

SEQ ID NO: 213629 - DNA, 103 bp, Artificial Sequence
  Synthetic Polynucleotide
taatacgactcactatagggctgacaacacggcactgacatctggctggtaacagaggagaaccagcatgatgtcagtgaacctggcggcagcgcaaaagatg

SEQ ID NO: 213630 - DNA, 103 bp, Artificial Sequence
  Synthetic Polynucleotide
taatacgactcactatagggtgcggaggtagcagcgttggcggtccctcaaacagaggagatgagggatggccaacgctaacctggcggcagcgcaaaagatg

SEQ ID NO: 213631 - DNA, 103 bp, Artificial Sequence
  Synthetic Polynucleotide
taatacgactcactatagggtggttgtaggctgacaacacggcactgacaaacagaggagatgtcagatgcgtgttgtcaacctggcggcagcgcaaaagatg

SEQ ID NO: 213632 - DNA, 103 bp, Artificial Sequence
  Synthetic Polynucleotide
taatacgactcactatagggatctccttgttggttgtaggctgacaacacaacagaggagagtgttgatggcctacaacaacctggcggcagcgcaaaagatg

SEQ ID NO: 213633 - DNA, 103 bp, Artificial Sequence
  Synthetic Polynucleotide
taatacgactcactatagggacattgtgggatctccttgttggttgtaggaacagaggagacctacaatgaacaaggagaacctggcggcagcgcaaaagatg

SEQ ID NO: 213634 - DNA, 103 bp, Artificial Sequence
  Synthetic Polynucleotide
taatacgactcactatagggtattcttcatacattgtgggatctccttgtaacagaggagaacaaggatgtcccacaataacctggcggcagcgcaaaagatg

SEQ ID NO: 213635 - DNA, 103 bp, Artificial Sequence
  Synthetic Polynucleotide
taatacgactcactatagggtccactatagtattcttcatacattgtgggaacagaggagacccacaatgtatgaagaaaacctggcggcagcgcaaaagatg

SEQ ID NO: 213636 - DNA, 103 bp, Artificial Sequence
  Synthetic Polynucleotide
taatacgactcactatagggagtgtttcagtccactatagtattcttcataacagaggagaatgaagatgactatagtgaacctggcggcagcgcaaaagatg

SEQ ID NO: 213637 - DNA, 103 bp, Artificial Sequence
  Synthetic Polynucleotide
taatacgactcactatagggcattcaatgaagtgtttcagtccactatagaacagaggagactatagatgactgaaacaaacctggcggcagcgcaaaagatg

SEQ ID NO: 213638 - DNA, 103 bp, Artificial Sequence
  Synthetic Polynucleotide
taatacgactcactataggggtccagggaacattcaatgaagtgtttcagaacagaggagactgaaaatgttcattgaaaacctggcggcagcgcaaaagatg

SEQ ID NO: 213639 - DNA, 103 bp, Artificial Sequence
  Synthetic Polynucleotide
taatacgactcactatagggcccgatggcagtccagggaacattcaatgaaacagaggagatcattgatggttccctggaacctggcggcagcgcaaaagatg

SEQ ID NO: 213640 - DNA, 103 bp, Artificial Sequence
  Synthetic Polynucleotide
taatacgactcactataggggacaactctgcccgatggcagtccagggaaaacagaggagattccctatgctgccatcgaacctggcggcagcgcaaaagatg

SEQ ID NO: 213641 - DNA, 103 bp, Artificial Sequence
  Synthetic Polynucleotide
taatacgactcactataggggtcccccgcctgcggaggtagcagcgttggaacagaggagaccaacgatgctacctccgaacctggcggcagcgcaaaagatg

SEQ ID NO: 213642 - DNA, 103 bp, Artificial Sequence
  Synthetic Polynucleotide
taatacgactcactatagggaaaaagttgggacaactctgcccgatggcaaacagaggagatgccatatggcagagttgaacctggcggcagcgcaaaagatg

SEQ ID NO: 213643 - DNA, 103 bp, Artificial Sequence
  Synthetic Polynucleotide
taatacgactcactatagggacagaggataaaaaagttgggacaactctgaacagaggagacagagtatgcccaactttaacctggcggcagcgcaaaagatg

SEQ ID NO: 213644 - DNA, 103 bp, Artificial Sequence
  Synthetic Polynucleotide
taatacgactcactatagggatgtgcacaaacagaggataaaaaagttggaacagaggagaccaactatgttatcctctaacctggcggcagcgcaaaagatg

SEQ ID NO: 213645 - DNA, 103 bp, Artificial Sequence
  Synthetic Polynucleotide
taatacgactcactatagggctccaagtacatgtgcacaaacagaggataaacagaggagatatcctatgtttgtgcacaacctggcggcagcgcaaaagatg

SEQ ID NO: 213646 - DNA, 103 bp, Artificial Sequence
  Synthetic Polynucleotide
taatacgactcactatagggtgtagactagctccaagtacatgtgcacaaaacagaggagattgtgcatgtgtacttggaacctggcggcagcgcaaaagatg

SEQ ID NO: 213647 - DNA, 103 bp, Artificial Sequence
  Synthetic Polynucleotide
taatacgactcactatagggtcatgttgattgtagactagctccaagtacaacagaggagagtacttatggctagtctaaacctggcggcagcgcaaaagatg

SEQ ID NO: 213648 - DNA, 103 bp, Artificial Sequence
  Synthetic Polynucleotide
taatacgactcactatagggtgcttcattctcatgttgattgtagactagaacagaggagactagtcatgaatcaacataacctggcggcagcgcaaaagatg

SEQ ID NO: 213649 - DNA, 103 bp, Artificial Sequence
  Synthetic Polynucleotide
taatacgactcactatagggagaatgactttgcttcattctcatgttgataacagaggagaatcaacatgagaatgaagaacctggcggcagcgcaaaagatg

SEQ ID NO: 213650 - DNA, 103 bp, Artificial Sequence
  Synthetic Polynucleotide
taatacgactcactatagggaacttctcaaagaatgactttgcttcattcaacagaggagagaatgaatgaaagtcattaacctggcggcagcgcaaaagatg

SEQ ID NO: 213651 - DNA, 103 bp, Artificial Sequence
  Synthetic Polynucleotide
taatacgactcactatagggatctccatggaacttctcaaagaatgacttaacagaggagaaagtcaatgtttgagaagaacctggcggcagcgcaaaagatg

SEQ ID NO: 213652 - DNA, 103 bp, Artificial Sequence
  Synthetic Polynucleotide
taatacgactcactatagggcgcctgcgccgtcccccgcctgcggaggtaaacagaggagatacctcatgaggcgggggaacctggcggcagcgcaaaagatg

SEQ ID NO: 213653 - DNA, 103 bp, Artificial Sequence
  Synthetic Polynucleotide
taatacgactcactatagggaacattcctgatctccatggaacttctcaaaacagaggagattgagaatgtccatggagaacctggcggcagcgcaaaagatg

SEQ ID NO: 213654 - DNA, 103 bp, Artificial Sequence
  Synthetic Polynucleotide
taatacgactcactatagggtcctggtaataacattcctgatctccatggaacagaggagaccatggatgtcaggaatgaacctggcggcagcgcaaaagatg

SEQ ID NO: 213655 - DNA, 103 bp, Artificial Sequence
  Synthetic Polynucleotide
taatacgactcactatagggtcgtaggtcatcctggtaataacattcctgaacagaggagacaggaaatgtattaccagaacctggcggcagcgcaaaagatg

SEQ ID NO: 213656 - DNA, 103 bp, Artificial Sequence
  Synthetic Polynucleotide
taatacgactcactatagggtagataatactcgtaggtcatcctggtaataacagaggagaattaccatgatgacctacaacctggcggcagcgcaaaagatg

SEQ ID NO: 213657 - DNA, 103 bp, Artificial Sequence
  Synthetic Polynucleotide
taatacgactcactatagggttggtaagactagataatactcgtaggtcaaacagaggagatgacctatgagtattatcaacctggcggcagcgcaaaagatg

SEQ ID NO: 213658 - DNA, 103 bp, Artificial Sequence
  Synthetic Polynucleotide
taatacgactcactataggggtgttcctttttggtaagactagataatacaacagaggagagtattaatgagtcttaccaacctggcggcagcgcaaaagatg

SEQ ID NO: 213659 - DNA, 103 bp, Artificial Sequence
  Synthetic Polynucleotide
taatacgactcactatagggtccctttcatgtgttcctttttggtaagacaacagaggagagtcttaatgaaaaggaacaacctggcggcagcgcaaaagatg

SEQ ID NO: 213660 - DNA, 103 bp, Artificial Sequence
  Synthetic Polynucleotide
taatacgactcactatagggatggtctcattccctttcatgtgttcctttaacagaggagaaaaggaatgcatgaaaggaacctggcggcagcgcaaaagatg

SEQ ID NO: 213661 - DNA, 103 bp, Artificial Sequence
  Synthetic Polynucleotide
taatacgactcactatagggaaaatccaacatggtctcattccctttcataacagaggagaatgaaaatgaatgagaccaacctggcggcagcgcaaaagatg

SEQ ID NO: 213662 - DNA, 103 bp, Artificial Sequence
  Synthetic Polynucleotide
taatacgactcactatagggtacttgttcgaaaatccaacatggtctcataacagaggagaatgagaatgtgttggattaacctggcggcagcgcaaaagatg

SEQ ID NO: 213663 - DNA, 103 bp, Artificial Sequence
  Synthetic Polynucleotide
taatacgactcactatagggccgctaccctcgcctgcgccgtcccccgccaacagaggagaggcgggatgcggcgcaggaacctggcggcagcgcaaaagatg

SEQ ID NO: 213664 - DNA, 103 bp, Artificial Sequence
  Synthetic Polynucleotide
taatacgactcactatagggagaacaaatttacttgttcgaaaatccaacaacagaggagagttggaatgtcgaacaagaacctggcggcagcgcaaaagatg

SEQ ID NO: 213665 - DNA, 103 bp, Artificial Sequence
  Synthetic Polynucleotide
taatacgactcactatagggggaaatacgcagaacaaatttacttgttcgaacagaggagacgaacaatgaaatttgttaacctggcggcagcgcaaaagatg

SEQ ID NO: 213666 - DNA, 103 bp, Artificial Sequence
  Synthetic Polynucleotide
taatacgactcactatagggacgagtcacgggaaatacgcagaacaaattaacagaggagaaatttgatgtgcgtatttaacctggcggcagcgcaaaagatg

SEQ ID NO: 213667 - DNA, 103 bp, Artificial Sequence
  Synthetic Polynucleotide
taatacgactcactatagggaagagttggtacgagtcacgggaaatacgcaacagaggagagcgtatatgccgtgactcaacctggcggcagcgcaaaagatg

SEQ ID NO: 213668 - DNA, 103 bp, Artificial Sequence
  Synthetic Polynucleotide
taatacgactcactatagggatgcctcttcaagagttggtacgagtcacgaacagaggagacgtgacatgtaccaactcaacctggcggcagcgcaaaagatg

SEQ ID NO: 213669 - DNA, 103 bp, Artificial Sequence
  Synthetic Polynucleotide
taatacgactcactatagggtctcctgaagatgcctcttcaagagttggtaacagaggagaaccaacatgtgaagaggcaacctggcggcagcgcaaaagatg

SEQ ID NO: 213670 - DNA, 103 bp, Artificial Sequence
  Synthetic Polynucleotide
taatacgactcactatagggttgttctgtttctcctgaagatgcctcttcaacagaggagagaagagatgtcttcaggaaacctggcggcagcgcaaaagatg

SEQ ID NO: 213671 - DNA, 103 bp, Artificial Sequence
  Synthetic Polynucleotide
taatacgactcactatagggccatatctgattgttctgtttctcctgaagaacagaggagacttcagatgaaacagaacaacctggcggcagcgcaaaagatg

SEQ ID NO: 213672 - DNA, 103 bp, Artificial Sequence
  Synthetic Polynucleotide
taatacgactcactataggggaactatgttccatatctgattgttctgttaacagaggagaaacagaatgatcagatataacctggcggcagcgcaaaagatg

SEQ ID NO: 213673 - DNA, 103 bp, Artificial Sequence
  Synthetic Polynucleotide
taatacgactcactatagggaggtgctcctgaactatgttccatatctgaaacagaggagatcagatatggaacatagtaacctggcggcagcgcaaaagatg

SEQ ID NO: 213674 - DNA, 103 bp, Artificial Sequence
  Synthetic Polynucleotide
taatacgactcactataggggtgaggagcatcatctttgcttttactcataacagaggagaatgagtatgagcaaagataacctggcggcagcgcaaaagatg

SEQ ID NO: 213675 - DNA, 103 bp, Artificial Sequence
  Synthetic Polynucleotide
taatacgactcactatagggcttgaggttgacatgaccagactgtactgcaacagaggagagcagtaatgtctggtcataacctggcggcagcgcaaaagatg

SEQ ID NO: 213676 - DNA, 103 bp, Artificial Sequence
  Synthetic Polynucleotide
taatacgactcactatagggttgcaaagagctgagttgctccttttctcgaacagaggagacgagaaatggagcaactcaacctggcggcagcgcaaaagatg

SEQ ID NO: 213677 - DNA, 103 bp, Artificial Sequence
  Synthetic Polynucleotide
taatacgactcactatagggctagctcctcttgcaaagagctgagttgctaacagaggagaagcaacatggctctttgcaacctggcggcagcgcaaaagatg

SEQ ID NO: 213678 - DNA, 103 bp, Artificial Sequence
  Synthetic Polynucleotide
taatacgactcactatagggaggagtgattctagctcctcttgcaaagagaacagaggagactctttatgagaggagctaacctggcggcagcgcaaaagatg

SEQ ID NO: 213679 - DNA, 103 bp, Artificial Sequence
  Synthetic Polynucleotide
taatacgactcactatagggttacttctctaggagtgattctagctcctcaacagaggagagaggagatggaatcactcaacctggcggcagcgcaaaagatg

SEQ ID NO: 213680 - DNA, 103 bp, Artificial Sequence
  Synthetic Polynucleotide
taatacgactcactatagggtcagtctgtccttgaggttgacatgaccagaacagaggagactggtcatgtcaacctcaaacctggcggcagcgcaaaagatg

SEQ ID NO: 213681 - DNA, 103 bp, Artificial Sequence
  Synthetic Polynucleotide
taatacgactcactatagggaactcaattgtcagtctgtccttgaggttgaacagaggagacaacctatgggacagactaacctggcggcagcgcaaaagatg

SEQ ID NO: 213682 - DNA, 103 bp, Artificial Sequence
  Synthetic Polynucleotide
taatacgactcactatagggatcaggatgtaactcaattgtcagtctgtcaacagaggagagacagaatgacaattgagaacctggcggcagcgcaaaagatg

SEQ ID NO: 213683 - DNA, 103 bp, Artificial Sequence
  Synthetic Polynucleotide
taatacgactcactatagggcatgacgcccatcaggatgtaactcaattgaacagaggagacaattgatgtacatcctgaacctggcggcagcgcaaaagatg

SEQ ID NO: 213684 - DNA, 103 bp, Artificial Sequence
  Synthetic Polynucleotide
taatacgactcactatagggctgacgattccatgacgcccatcaggatgtaacagaggagaacatccatgtgggcgtcaaacctggcggcagcgcaaaagatg

SEQ ID NO: 213685 - DNA, 103 bp, Artificial Sequence
  Synthetic Polynucleotide
taatacgactcactatagggacggtccactctgacgattccatgacgcccaacagaggagagggcgtatgggaatcgtcaacctggcggcagcgcaaaagatg

SEQ ID NO: 213686 - DNA, 103 bp, Artificial Sequence
  Synthetic Polynucleotide
taatacgactcactatagggccaatggaacacggtccactctgacgattcaacagaggagagaatcgatggagtggaccaacctggcggcagcgcaaaagatg

SEQ ID NO: 213687 - DNA, 103 bp, Artificial Sequence
  Synthetic Polynucleotide
taatacgactcactatagggaattttgaggccaatggaacacggtccactaacagaggagaagtggaatgtgttccattaacctggcggcagcgcaaaagatg

SEQ ID NO: 213688 - DNA, 103 bp, Artificial Sequence
  Synthetic Polynucleotide
taatacgactcactatagggcaggtctactaattttgaggccaatggaacaacagaggagagttccaatggcctcaaaaaacctggcggcagcgcaaaagatg

SEQ ID NO: 213689 - DNA, 103 bp, Artificial Sequence
  Synthetic Polynucleotide
taatacgactcactatagggtctccagttcgtgaggagcatcatctttgcaacagaggagagcaaagatgatgctcctcaacctggcggcagcgcaaaagatg

SEQ ID NO: 213690 - DNA, 103 bp, Artificial Sequence
  Synthetic Polynucleotide
taatacgactcactatagggtaacacagggcaggtctactaattttgaggaacagaggagacctcaaatgtagtagaccaacctggcggcagcgcaaaagatg

SEQ ID NO: 213691 - DNA, 103 bp, Artificial Sequence
  Synthetic Polynucleotide
taatacgactcactatagggaagctttccataacacagggcaggtctactaacagaggagaagtagaatggccctgtgtaacctggcggcagcgcaaaagatg

SEQ ID NO: 213692 - DNA, 103 bp, Artificial Sequence
  Synthetic Polynucleotide
taatacgactcactatagggaatggttttcaagctttccataacacagggaacagaggagaccctgtatgatggaaagcaacctggcggcagcgcaaaagatg

SEQ ID NO: 213693 - DNA, 103 bp, Artificial Sequence
  Synthetic Polynucleotide
taatacgactcactatagggtttttttatcaatggttttcaagctttccaaacagaggagatggaaaatgtgaaaaccaaacctggcggcagcgcaaaagatg

SEQ ID NO: 213694 - DNA, 103 bp, Artificial Sequence
  Synthetic Polynucleotide
taatacgactcactatagggttgtaaaaagtttttttatcaatggttttcaacagaggagagaaaacatgtgataaaaaaacctggcggcagcgcaaaagatg

SEQ ID NO: 213695 - DNA, 103 bp, Artificial Sequence
  Synthetic Polynucleotide
taatacgactcactatagggatcagctgtcttgtaaaaagtttttttatcaacagaggagagataaaatgactttttacaacctggcggcagcgcaaaagatg

SEQ ID NO: 213696 - DNA, 103 bp, Artificial Sequence
  Synthetic Polynucleotide
taatacgactcactatagggtctgacagatatcagctgtcttgtaaaaagaacagaggagactttttatgagacagctgaacctggcggcagcgcaaaagatg

SEQ ID NO: 213697 - DNA, 103 bp, Artificial Sequence
  Synthetic Polynucleotide
taatacgactcactataggggatacaagcatctgacagatatcagctgtcaacagaggagagacagcatgtatctgtcaaacctggcggcagcgcaaaagatg

SEQ ID NO: 213698 - DNA, 103 bp, Artificial Sequence
  Synthetic Polynucleotide
taatacgactcactatagggatcaactgtggatacaagcatctgacagataacagaggagaatctgtatgatgcttgtaaacctggcggcagcgcaaaagatg

SEQ ID NO: 213699 - DNA, 103 bp, Artificial Sequence
  Synthetic Polynucleotide
taatacgactcactatagggagagatcaccatcaactgtggatacaagcaaacagaggagatgcttgatgccacagttgaacctggcggcagcgcaaaagatg

SEQ ID NO: 213700 - DNA, 103 bp, Artificial Sequence
  Synthetic Polynucleotide
taatacgactcactatagggataaactggctctccagttcgtgaggagcaaacagaggagatgctccatgcgaactggaaacctggcggcagcgcaaaagatg

SEQ ID NO: 213701 - DNA, 103 bp, Artificial Sequence
  Synthetic Polynucleotide
taatacgactcactatagggacaggaggatagagatcaccatcaactgtgaacagaggagacacagtatgtggtgatctaacctggcggcagcgcaaaagatg

SEQ ID NO: 213702 - DNA, 103 bp, Artificial Sequence
  Synthetic Polynucleotide
taatacgactcactatagggtggctcctccacaggaggatagagatcaccaacagaggagaggtgatatgtatcctcctaacctggcggcagcgcaaaagatg

SEQ ID NO: 213703 - DNA, 103 bp, Artificial Sequence
  Synthetic Polynucleotide
taatacgactcactatagggtgctagcaactggctcctccacaggaggataacagaggagaatcctcatgtggaggagcaacctggcggcagcgcaaaagatg

SEQ ID NO: 213704 - DNA, 103 bp, Artificial Sequence
  Synthetic Polynucleotide
taatacgactcactatagggttaggatcagtgctagcaactggctcctccaacagaggagaggaggaatgagttgctagaacctggcggcagcgcaaaagatg

SEQ ID NO: 213705 - DNA, 103 bp, Artificial Sequence
  Synthetic Polynucleotide
taatacgactcactatagggcttgcttgctttaggatcagtgctagcaacaacagaggagagttgctatgactgatcctaacctggcggcagcgcaaaagatg

SEQ ID NO: 213706 - DNA, 103 bp, Artificial Sequence
  Synthetic Polynucleotide
taatacgactcactatagggtatcctttttcttgcttgctttaggatcagaacagaggagactgatcatgaagcaagcaaacctggcggcagcgcaaaagatg

SEQ ID NO: 213707 - DNA, 103 bp, Artificial Sequence
  Synthetic Polynucleotide
taatacgactcactatagggtctttgtccttatcctttttcttgcttgctaacagaggagaagcaagatggaaaaaggaaacctggcggcagcgcaaaagatg

SEQ ID NO: 213708 - DNA, 103 bp, Artificial Sequence
  Synthetic Polynucleotide
taatacgactcactatagggaaactttttctctttgtccttatcctttttaacagaggagaaaaaagatgaaggacaaaaacctggcggcagcgcaaaagatg

SEQ ID NO: 213709 - DNA, 103 bp, Artificial Sequence
  Synthetic Polynucleotide
taatacgactcactatagggggttccagataaactttttctctttgtcctaacagaggagaaggacaatgagaaaaagtaacctggcggcagcgcaaaagatg

SEQ ID NO: 213710 - DNA, 103 bp, Artificial Sequence
  Synthetic Polynucleotide
taatacgactcactataggggtaattccgtggttccagataaactttttcaacagaggagagaaaaaatgtatctggaaaacctggcggcagcgcaaaagatg

SEQ ID NO: 213711 - DNA, 103 bp, Artificial Sequence
  Synthetic Polynucleotide
taatacgactcactatagggcagacgtaagataaactggctctccagttcaacagaggagagaactgatgagccagtttaacctggcggcagcgcaaaagatg

SEQ ID NO: 213712 - DNA, 103 bp, Artificial Sequence
  Synthetic Polynucleotide
taatacgactcactatagggtagaggcagagtaattccgtggttccagataacagaggagaatctggatgcacggaattaacctggcggcagcgcaaaagatg

SEQ ID NO: 213713 - DNA, 103 bp, Artificial Sequence
  Synthetic Polynucleotide
taatacgactcactatagggtgacattctttagaggcagagtaattccgtaacagaggagaacggaaatgctctgcctcaacctggcggcagcgcaaaagatg

SEQ ID NO: 213714 - DNA, 103 bp, Artificial Sequence
  Synthetic Polynucleotide
taatacgactcactatagggcttctcttcctgacattctttagaggcagaaacagaggagatctgccatgaaagaatgtaacctggcggcagcgcaaaagatg

SEQ ID NO: 213715 - DNA, 103 bp, Artificial Sequence
  Synthetic Polynucleotide
taatacgactcactatagggcttccggaaccttctcttcctgacattcttaacagaggagaaagaatatgaggaagagaaacctggcggcagcgcaaaagatg

SEQ ID NO: 213716 - DNA, 103 bp, Artificial Sequence
  Synthetic Polynucleotide
taatacgactcactatagggtctttgctgtcttccggaaccttctcttccaacagaggagaggaagaatgggttccggaaacctggcggcagcgcaaaagatg

SEQ ID NO: 213717 - DNA, 103 bp, Artificial Sequence
  Synthetic Polynucleotide
taatacgactcactatagggatatatttcttctttgctgtcttccggaacaacagaggagagttccgatggacagcaaaaacctggcggcagcgcaaaagatg

SEQ ID NO: 213718 - DNA, 103 bp, Artificial Sequence
  Synthetic Polynucleotide
taatacgactcactatagggtggagattcaatatatttcttctttgctgtaacagaggagaacagcaatgaagaaatataacctggcggcagcgcaaaagatg

SEQ ID NO: 213719 - DNA, 103 bp, Artificial Sequence
  Synthetic Polynucleotide
taatacgactcactatagggtttcaacatctggagattcaatatatttctaacagaggagaagaaatatgttgaatctcaacctggcggcagcgcaaaagatg

SEQ ID NO: 213720 - DNA, 103 bp, Artificial Sequence
  Synthetic Polynucleotide
taatacgactcactatagggttcacttctttttcaacatctggagattcaaacagaggagatgaatcatgagatgttgaaacctggcggcagcgcaaaagatg

SEQ ID NO: 213721 - DNA, 103 bp, Artificial Sequence
  Synthetic Polynucleotide
taatacgactcactatagggcagcaatcgtttcacttctttttcaacatcaacagaggagagatgttatgaaagaagtgaacctggcggcagcgcaaaagatg

SEQ ID NO: 213722 - DNA, 103 bp, Artificial Sequence
  Synthetic Polynucleotide
taatacgactcactatagggattctggaggcagacgtaagataaactggcaacagaggagagccagtatgtcttacgtcaacctggcggcagcgcaaaagatg

SEQ ID NO: 213723 - DNA, 103 bp, Artificial Sequence
  Synthetic Polynucleotide
taatacgactcactatagggcatctgtactcagcaatcgtttcacttcttaacagaggagaaagaagatgaacgattgcaacctggcggcagcgcaaaagatg

SEQ ID NO: 213724 - DNA, 103 bp, Artificial Sequence
  Synthetic Polynucleotide
taatacgactcactatagggacagcttcagcatctgtactcagcaatcgtaacagaggagaacgattatggagtacagaaacctggcggcagcgcaaaagatg

SEQ ID NO: 213725 - DNA, 103 bp, Artificial Sequence
  Synthetic Polynucleotide
taatacgactcactatagggccgagtactaacagcttcagcatctgtactaacagaggagaagtacaatggctgaagctaacctggcggcagcgcaaaagatg

SEQ ID NO: 213726 - DNA, 103 bp, Artificial Sequence
  Synthetic Polynucleotide
taatacgactcactatagggttatttcccaccgagtactaacagcttcagaacagaggagactgaagatgttagtactcaacctggcggcagcgcaaaagatg

SEQ ID NO: 213727 - DNA, 103 bp, Artificial Sequence
  Synthetic Polynucleotide
taatacgactcactatagggtcttcggcaattatttcccaccgagtactaaacagaggagatagtacatggtgggaaataacctggcggcagcgcaaaagatg

SEQ ID NO: 213728 - DNA, 103 bp, Artificial Sequence
  Synthetic Polynucleotide
taatacgactcactatagggctttgtttcatcttcggcaattatttcccaaacagaggagatgggaaatgattgccgaaaacctggcggcagcgcaaaagatg

SEQ ID NO: 213729 - DNA, 103 bp, Artificial Sequence
  Synthetic Polynucleotide
taatacgactcactatagggtttctgcctcctttgtttcatcttcggcaaaacagaggagattgccgatgatgaaacaaaacctggcggcagcgcaaaagatg

SEQ ID NO: 213730 - DNA, 103 bp, Artificial Sequence
  Synthetic Polynucleotide
taatacgactcactatagggaggccttgattttctgcctcctttgtttcaaacagaggagatgaaacatgggaggcagaaacctggcggcagcgcaaaagatg

SEQ ID NO: 213731 - DNA, 103 bp, Artificial Sequence
  Synthetic Polynucleotide
taatacgactcactatagggagagatatccaggccttgattttctgcctcaacagaggagagaggcaatgaatcaaggcaacctggcggcagcgcaaaagatg

SEQ ID NO: 213732 - DNA, 103 bp, Artificial Sequence
  Synthetic Polynucleotide
taatacgactcactatagggttcctggagaagagatatccaggccttgataacagaggagaatcaagatgtggatatctaacctggcggcagcgcaaaagatg

SEQ ID NO: 213733 - DNA, 103 bp, Artificial Sequence
  Synthetic Polynucleotide
taatacgactcactataggggtagaggcatattctggaggcagacgtaagaacagaggagacttacgatggcctccagaaacctggcggcagcgcaaaagatg

SEQ ID NO: 213734 - DNA, 103 bp, Artificial Sequence
  Synthetic Polynucleotide
taatacgactcactatagggtgaccagacattcctggagaagagatatccaacagaggagaggatatatgttctccaggaacctggcggcagcgcaaaagatg

SEQ ID NO: 213735 - DNA, 103 bp, Artificial Sequence
  Synthetic Polynucleotide
taatacgactcactataggggccctgcctgtgaccagacattcctggagaaacagaggagatctccaatgatgtctggtaacctggcggcagcgcaaaagatg

SEQ ID NO: 213736 - DNA, 103 bp, Artificial Sequence
  Synthetic Polynucleotide
taatacgactcactatagggatgagtcatggccctgcctgtgaccagacaaacagaggagatgtctgatgacaggcaggaacctggcggcagcgcaaaagatg

SEQ ID NO: 213737 - DNA, 103 bp, Artificial Sequence
  Synthetic Polynucleotide
taatacgactcactatagggtcatgttctaatgagtcatggccctgcctgaacagaggagacaggcaatgccatgactcaacctggcggcagcgcaaaagatg

SEQ ID NO: 213738 - DNA, 103 bp, Artificial Sequence
  Synthetic Polynucleotide
taatacgactcactatagggccgaagctcatcatgttctaatgagtcatgaacagaggagacatgacatgttagaacataacctggcggcagcgcaaaagatg

SEQ ID NO: 213739 - DNA, 103 bp, Artificial Sequence
  Synthetic Polynucleotide
taatacgactcactatagggtgaatatctcccgaagctcatcatgttctaaacagaggagatagaacatgatgagcttcaacctggcggcagcgcaaaagatg

SEQ ID NO: 213740 - DNA, 103 bp, Artificial Sequence
  Synthetic Polynucleotide
taatacgactcactatagggctgaggtcattgaatatctcccgaagctcaaacagaggagatgagctatgggagatattaacctggcggcagcgcaaaagatg

SEQ ID NO: 213741 - DNA, 103 bp, Artificial Sequence
  Synthetic Polynucleotide
taatacgactcactatagggactgctgctgctgaggtcattgaatatctcaacagaggagagagataatgaatgacctcaacctggcggcagcgcaaaagatg

SEQ ID NO: 213742 - DNA, 103 bp, Artificial Sequence
  Synthetic Polynucleotide
taatacgactcactatagggcttcatcctcactgctgctgctgaggtcataacagaggagaatgaccatggcagcagcaaacctggcggcagcgcaaaagatg

SEQ ID NO: 213743 - DNA, 103 bp, Artificial Sequence
  Synthetic Polynucleotide
taatacgactcactatagggtgggtctcatcttcatcctcactgctgctgaacagaggagacagcagatgtgaggatgaaacctggcggcagcgcaaaagatg

SEQ ID NO: 213744 - DNA, 103 bp, Artificial Sequence
  Synthetic Polynucleotide
taatacgactcactatagggccttctcacagtagaggcatattctggaggaacagaggagacctccaatgtatgcctctaacctggcggcagcgcaaaagatg

SEQ ID NO: 213745 - DNA, 103 bp, Artificial Sequence
  Synthetic Polynucleotide
taatacgactcactatagggatcttgatgctgggtctcatcttcatcctcaacagaggagagaggatatggatgagaccaacctggcggcagcgcaaaagatg

SEQ ID NO: 213746 - DNA, 103 bp, Artificial Sequence
  Synthetic Polynucleotide
taatacgactcactatagggtatcttcttcatcttgatgctgggtctcataacagaggagaatgagaatgagcatcaagaacctggcggcagcgcaaaagatg

SEQ ID NO: 213747 - DNA, 103 bp, Artificial Sequence
  Synthetic Polynucleotide
taatacgactcactatagggatgatgtttatatcttcttcatcttgatgcaacagaggagagcatcaatgtgaagaagaaacctggcggcagcgcaaaagatg

SEQ ID NO: 213748 - DNA, 103 bp, Artificial Sequence
  Synthetic Polynucleotide
taatacgactcactatagggctccgtgtcaatgatgtttatatcttcttcaacagaggagagaagaaatgataaacatcaacctggcggcagcgcaaaagatg

SEQ ID NO: 213749 - DNA, 103 bp, Artificial Sequence
  Synthetic Polynucleotide
taatacgactcactatagggccagatcttcctccgtgtcaatgatgtttaaacagaggagataaacaatgttgacacggaacctggcggcagcgcaaaagatg

SEQ ID NO: 213750 - DNA, 103 bp, Artificial Sequence
  Synthetic Polynucleotide
taatacgactcactatagggagctgtctctccagatcttcctccgtgtcaaacagaggagatgacacatgggaagatctaacctggcggcagcgcaaaagatg

SEQ ID NO: 213751 - DNA, 103 bp, Artificial Sequence
  Synthetic Polynucleotide
taatacgactcactatagggcttgtcctgtagctgtctctccagatcttcaacagaggagagaagatatggagagacagaacctggcggcagcgcaaaagatg

SEQ ID NO: 213752 - DNA, 103 bp, Artificial Sequence
  Synthetic Polynucleotide
taatacgactcactatagggattcatttagcttgtcctgtagctgtctctaacagaggagaagagacatgtacaggacaaacctggcggcagcgcaaaagatg

SEQ ID NO: 213753 - DNA, 103 bp, Artificial Sequence
  Synthetic Polynucleotide
taatacgactcactatagggtgttcatctgattcatttagcttgtcctgtaacagaggagaacaggaatggctaaatgaaacctggcggcagcgcaaaagatg

SEQ ID NO: 213754 - DNA, 103 bp, Artificial Sequence
  Synthetic Polynucleotide
taatacgactcactatagggttcctggtgctgttcatctgattcatttagaacagaggagactaaatatgtcagatgaaaacctggcggcagcgcaaaagatg

SEQ ID NO: 213755 - DNA, 103 bp, Artificial Sequence
  Synthetic Polynucleotide
taatacgactcactatagggactgtactgcccttctcacagtagaggcataacagaggagaatgcctatgctgtgagaaaacctggcggcagcgcaaaagatg

SEQ ID NO: 213756 - DNA, 103 bp, Artificial Sequence
  Synthetic Polynucleotide
taatacgactcactatagggttccttcattttcctggtgctgttcatctgaacagaggagacagatgatgagcaccaggaacctggcggcagcgcaaaagatg

SEQ ID NO: 213757 - DNA, 103 bp, Artificial Sequence
  Synthetic Polynucleotide
taatacgactcactatagggagctgattggttccttcattttcctggtgcaacagaggagagcaccaatgaaatgaaggaacctggcggcagcgcaaaagatg

SEQ ID NO: 213758 - DNA, 103 bp, Artificial Sequence
  Synthetic Polynucleotide
taatacgactcactatagggtcccataaccagctgattggttccttcattaacagaggagaaatgaaatgaccaatcagaacctggcggcagcgcaaaagatg

SEQ ID NO: 213759 - DNA, 103 bp, Artificial Sequence
  Synthetic Polynucleotide
taatacgactcactataggggcttctgaattcccataaccagctgattggaacagaggagaccaatcatgtggttatggaacctggcggcagcgcaaaagatg

SEQ ID NO: 213760 - DNA, 103 bp, Artificial Sequence
  Synthetic Polynucleotide
taatacgactcactatagggttgtcaatctgcttctgaattcccataaccaacagaggagaggttatatgaattcagaaaacctggcggcagcgcaaaagatg

SEQ ID NO: 213761 - DNA, 103 bp, Artificial Sequence
  Synthetic Polynucleotide
taatacgactcactataggggcctttcatgttgtcaatctgcttctgaataacagaggagaattcagatgcagattgacaacctggcggcagcgcaaaagatg

SEQ ID NO: 213762 - DNA, 103 bp, Artificial Sequence
  Synthetic Polynucleotide
taatacgactcactatagggcttggagcttgcctttcatgttgtcaatctaacagaggagaagattgatgacatgaaagaacctggcggcagcgcaaaagatg

SEQ ID NO: 213763 - DNA, 103 bp, Artificial Sequence
  Synthetic Polynucleotide
taatacgactcactatagggtcctgggtctcttggagcttgcctttcatgaacagaggagacatgaaatgcaagctccaaacctggcggcagcgcaaaagatg

SEQ ID NO: 213764 - DNA, 103 bp, Artificial Sequence
  Synthetic Polynucleotide
taatacgactcactatagggttttgccctgtcctgggtctcttggagcttaacagaggagaaagctcatggagacccagaacctggcggcagcgcaaaagatg

SEQ ID NO: 213765 - DNA, 103 bp, Artificial Sequence
  Synthetic Polynucleotide
taatacgactcactatagggcctcttgtcgttttgccctgtcctgggtctaacagaggagaagacccatgacagggcaaaacctggcggcagcgcaaaagatg

SEQ ID NO: 213766 - DNA, 103 bp, Artificial Sequence
  Synthetic Polynucleotide
taatacgactcactatagggacatgaccagactgtactgcccttctcacaaacagaggagatgtgagatgggcagtacaaacctggcggcagcgcaaaagatg

SEQ ID NO: 213767 - DNA, 103 bp, Artificial Sequence
  Synthetic Polynucleotide
taatacgactcactatagggatgatgagatcctcttgtcgttttgccctgaacagaggagacagggcatgacgacaagaaacctggcggcagcgcaaaagatg

SEQ ID NO: 213768 - DNA, 103 bp, Artificial Sequence
  Synthetic Polynucleotide
taatacgactcactatagggttccactttcatgatgagatcctcttgtcgaacagaggagacgacaaatggatctcatcaacctggcggcagcgcaaaagatg

SEQ ID NO: 213769 - DNA, 103 bp, Artificial Sequence
  Synthetic Polynucleotide
taatacgactcactataggggagccagattttccactttcatgatgagataacagaggagaatctcaatgtgaaagtggaacctggcggcagcgcaaaagatg

SEQ ID NO: 213770 - DNA, 103 bp, Artificial Sequence
  Synthetic Polynucleotide
taatacgactcactatagggctgttcttgagagccagattttccactttcaacagaggagagaaagtatgaaatctggcaacctggcggcagcgcaaaagatg

SEQ ID NO: 213771 - DNA, 103 bp, Artificial Sequence
  Synthetic Polynucleotide
taatacgactcactatagggagcctgaaatctgttcttgagagccagattaacagaggagaaatctgatgctcaagaacaacctggcggcagcgcaaaagatg

SEQ ID NO: 213772 - DNA, 103 bp, Artificial Sequence
  Synthetic Polynucleotide
taatacgactcactatagggcatccagtacagcctgaaatctgttcttgaaacagaggagatcaagaatggatttcaggaacctggcggcagcgcaaaagatg

SEQ ID NO: 213773 - DNA, 103 bp, Artificial Sequence
  Synthetic Polynucleotide
taatacgactcactatagggtgtttgagctcatccagtacagcctgaaataacagaggagaatttcaatgtgtactggaaacctggcggcagcgcaaaagatg

SEQ ID NO: 213774 - DNA, 103 bp, Artificial Sequence
  Synthetic Polynucleotide
taatacgactcactataggggtcttccttttgtttgagctcatccagtacaacagaggagagtactgatggagctcaaaaacctggcggcagcgcaaaagatg

SEQ ID NO: 213775 - DNA, 103 bp, Artificial Sequence
  Synthetic Polynucleotide
taatacgactcactatagggccttttctcggtcttccttttgtttgagctaacagaggagaagctcaatgaaaaggaagaacctggcggcagcgcaaaagatg

SEQ ID NO: 213776 - DNA, 103 bp, Artificial Sequence
  Synthetic Polynucleotide
taatacgactcactatagggctgagttgctccttttctcggtcttcctttaacagaggagaaaaggaatgccgagaaaaaacctggcggcagcgcaaaagatg

SEQ ID NO: 213777 - DNA, 103 bp, Artificial Sequence
  Synthetic Polynucleotide
taatacgactcactatagggatcaggaacttcatcctggctttcactcataacagaggagaatgagtatgagccaggataacctggcggcagcgcaaaagatg

SEQ ID NO: 213778 - DNA, 103 bp, Artificial Sequence
  Synthetic Polynucleotide
taatacgactcactatagggcttcatcttgacactttgagaacgtgctagaacagaggagactagcaatgtctcaaagtaacctggcggcagcgcaaaagatg

SEQ ID NO: 213779 - DNA, 103 bp, Artificial Sequence
  Synthetic Polynucleotide
taatacgactcactatagggttagtttatccttcatcttgacactttgagaacagaggagactcaaaatgtcaagatgaaacctggcggcagcgcaaaagatg

SEQ ID NO: 213780 - DNA, 103 bp, Artificial Sequence
  Synthetic Polynucleotide
taatacgactcactatagggaagtcaatttttagtttatccttcatcttgaacagaggagacaagatatgggataaactaacctggcggcagcgcaaaagatg

SEQ ID NO: 213781 - DNA, 103 bp, Artificial Sequence
  Synthetic Polynucleotide
taatacgactcactatagggatcaggcaataagtcaatttttagtttatcaacagaggagagataaaatgaaaattgacaacctggcggcagcgcaaaagatg

SEQ ID NO: 213782 - DNA, 103 bp, Artificial Sequence
  Synthetic Polynucleotide
taatacgactcactatagggcatggcgcccatcaggcaataagtcaatttaacagaggagaaaattgatgtattgcctgaacctggcggcagcgcaaaagatg

SEQ ID NO: 213783 - DNA, 103 bp, Artificial Sequence
  Synthetic Polynucleotide
taatacgactcactatagggtcaacaactgcatggcgcccatcaggcaataacagaggagaattgccatgtgggcgccaaacctggcggcagcgcaaaagatg

SEQ ID NO: 213784 - DNA, 103 bp, Artificial Sequence
  Synthetic Polynucleotide
taatacgactcactatagggatcttctacttcaacaactgcatggcgcccaacagaggagagggcgcatggcagttgttaacctggcggcagcgcaaaagatg

SEQ ID NO: 213785 - DNA, 103 bp, Artificial Sequence
  Synthetic Polynucleotide
taatacgactcactatagggctagtgggacatcttctacttcaacaactgaacagaggagacagttgatgaagtagaagaacctggcggcagcgcaaaagatg

SEQ ID NO: 213786 - DNA, 103 bp, Artificial Sequence
  Synthetic Polynucleotide
taatacgactcactatagggagcttagcagctagtgggacatcttctactaacagaggagaagtagaatgtgtcccactaacctggcggcagcgcaaaagatg

SEQ ID NO: 213787 - DNA, 103 bp, Artificial Sequence
  Synthetic Polynucleotide
taatacgactcactatagggcaagtcaaccagcttagcagctagtgggacaacagaggagagtcccaatggctgctaagaacctggcggcagcgcaaaagatg

SEQ ID NO: 213788 - DNA, 103 bp, Artificial Sequence
  Synthetic Polynucleotide
taatacgactcactatagggtctcaacttcatcaggaacttcatcctggcaacagaggagagccaggatgaagttcctgaacctggcggcagcgcaaaagatg

SEQ ID NO: 213789 - DNA, 103 bp, Artificial Sequence
  Synthetic Polynucleotide
taatacgactcactatagggtaacacaaggcaagtcaaccagcttagcagaacagaggagactgctaatgtggttgactaacctggcggcagcgcaaaagatg

SEQ ID NO: 213790 - DNA, 103 bp, Artificial Sequence
  Synthetic Polynucleotide
taatacgactcactatagggaggctttcaataacacaaggcaagtcaaccaacagaggagaggttgaatggccttgtgtaacctggcggcagcgcaaaagatg

SEQ ID NO: 213791 - DNA, 103 bp, Artificial Sequence
  Synthetic Polynucleotide
taatacgactcactatagggaagcgttctcaggctttcaataacacaaggaacagaggagaccttgtatgattgaaagcaacctggcggcagcgcaaaagatg

SEQ ID NO: 213792 - DNA, 103 bp, Artificial Sequence
  Synthetic Polynucleotide
taatacgactcactatagggtttttttatcaagcgttctcaggctttcaaaacagaggagattgaaaatgtgagaacgcaacctggcggcagcgcaaaagatg

SEQ ID NO: 213793 - DNA, 103 bp, Artificial Sequence
  Synthetic Polynucleotide
taatacgactcactatagggttataaaaggtttttttatcaagcgttctcaacagaggagagagaacatgtgataaaaaaacctggcggcagcgcaaaagatg

SEQ ID NO: 213794 - DNA, 103 bp, Artificial Sequence
  Synthetic Polynucleotide
taatacgactcactataggggtctgctgttttataaaaggtttttttatcaacagaggagagataaaatgaccttttataacctggcggcagcgcaaaagatg

SEQ ID NO: 213795 - DNA, 103 bp, Artificial Sequence
  Synthetic Polynucleotide
taatacgactcactatagggtctgagaaatgtctgctgttttataaaaggaacagaggagaccttttatgaaacagcagaacctggcggcagcgcaaaagatg

SEQ ID NO: 213796 - DNA, 103 bp, Artificial Sequence
  Synthetic Polynucleotide
taatacgactcactatagggcacacaagcatctgagaaatgtctgctgttaacagaggagaaacagcatgcatttctcaaacctggcggcagcgcaaaagatg

SEQ ID NO: 213797 - DNA, 103 bp, Artificial Sequence
  Synthetic Polynucleotide
taatacgactcactatagggatcagcagtgcacacaagcatctgagaaataacagaggagaatttctatgatgcttgtgaacctggcggcagcgcaaaagatg

SEQ ID NO: 213798 - DNA, 103 bp, Artificial Sequence
  Synthetic Polynucleotide
taatacgactcactatagggggatatcaccatcagcagtgcacacaagcaaacagaggagatgcttgatggcactgctgaacctggcggcagcgcaaaagatg

SEQ ID NO: 213799 - DNA, 103 bp, Artificial Sequence
  Synthetic Polynucleotide
taatacgactcactatagggataaactggttctcaacttcatcaggaactaacagaggagaagttccatgtgaagttgaaacctggcggcagcgcaaaagatg

SEQ ID NO: 213800 - DNA, 103 bp, Artificial Sequence
  Synthetic Polynucleotide
taatacgactcactatagggggagaaaggtggatatcaccatcagcagtgaacagaggagacactgcatgtggtgatataacctggcggcagcgcaaaagatg

SEQ ID NO: 213801 - DNA, 103 bp, Artificial Sequence
  Synthetic Polynucleotide
taatacgactcactatagggtggttcttctggagaaaggtggatatcaccaacagaggagaggtgatatgcacctttctaacctggcggcagcgcaaaagatg

SEQ ID NO: 213802 - DNA, 103 bp, Artificial Sequence
  Synthetic Polynucleotide
taatacgactcactatagggtagaggcagctggttcttctggagaaaggtaacagaggagaacctttatgcagaagaacaacctggcggcagcgcaaaagatg

SEQ ID NO: 213803 - DNA, 103 bp, Artificial Sequence
  Synthetic Polynucleotide
taatacgactcactatagggttaggatcagtagaggcagctggttcttctaacagaggagaagaagaatgagctgcctcaacctggcggcagcgcaaaagatg

SEQ ID NO: 213804 - DNA, 103 bp, Artificial Sequence
  Synthetic Polynucleotide
taatacgactcactatagggcctgactatattaggatcagtagaggcagcaacagaggagagctgccatgactgatcctaacctggcggcagcgcaaaagatg

SEQ ID NO: 213805 - DNA, 103 bp, Artificial Sequence
  Synthetic Polynucleotide
taatacgactcactatagggtttcttttttcctgactatattaggatcagaacagaggagactgatcatgatatagtcaaacctggcggcagcgcaaaagatg

SEQ ID NO: 213806 - DNA, 103 bp, Artificial Sequence
  Synthetic Polynucleotide
taatacgactcactatagggtctctccccctttcttttttcctgactataaacagaggagatatagtatggaaaaaagaaacctggcggcagcgcaaaagatg

SEQ ID NO: 213807 - DNA, 103 bp, Artificial Sequence
  Synthetic Polynucleotide
taatacgactcactatagggacatttttcttctctccccctttcttttttaacagaggagaaaaaaaatgagggggagaaacctggcggcagcgcaaaagatg

SEQ ID NO: 213808 - DNA, 103 bp, Artificial Sequence
  Synthetic Polynucleotide
taatacgactcactataggggcttccagacacatttttcttctctcccccaacagaggagagggggaatgaagaaaaataacctggcggcagcgcaaaagatg

SEQ ID NO: 213809 - DNA, 103 bp, Artificial Sequence
  Synthetic Polynucleotide
taatacgactcactataggggtaatgccatgcttccagacacatttttctaacagaggagaagaaaaatgtgtctggaaaacctggcggcagcgcaaaagatg

SEQ ID NO: 213810 - DNA, 103 bp, Artificial Sequence
  Synthetic Polynucleotide
taatacgactcactatagggcagacgcaatataaactggttctcaacttcaacagaggagagaagttatgaaccagtttaacctggcggcagcgcaaaagatg

SEQ ID NO: 213811 - DNA, 103 bp, Artificial Sequence
  Synthetic Polynucleotide
taatacgactcactatagggaagtggtggcgtaatgccatgcttccagacaacagaggagagtctggatgcatggcattaacctggcggcagcgcaaaagatg

SEQ ID NO: 213812 - DNA, 103 bp, Artificial Sequence
  Synthetic Polynucleotide
taatacgactcactatagggtgacattcttaagtggtggcgtaatgccataacagaggagaatggcaatgcgccaccacaacctggcggcagcgcaaaagatg

SEQ ID NO: 213813 - DNA, 103 bp, Artificial Sequence
  Synthetic Polynucleotide
taatacgactcactatagggcttttctttctgacattcttaagtggtggcaacagaggagagccaccatgtaagaatgtaacctggcggcagcgcaaaagatg

SEQ ID NO: 213814 - DNA, 103 bp, Artificial Sequence
  Synthetic Polynucleotide
taatacgactcactatagggtttccggaaccttttctttctgacattcttaacagaggagaaagaatatgagaaagaaaaacctggcggcagcgcaaaagatg

SEQ ID NO: 213815 - DNA, 103 bp, Artificial Sequence
  Synthetic Polynucleotide
taatacgactcactatagggttttttgtgttttccggaaccttttctttcaacagaggagagaaagaatgggttccggaaacctggcggcagcgcaaaagatg

SEQ ID NO: 213816 - DNA, 103 bp, Artificial Sequence
  Synthetic Polynucleotide
taatacgactcactatagggtcagggacctttttttgtgttttccggaacaacagaggagagttccgatgaacacaaaaaacctggcggcagcgcaaaagatg

SEQ ID NO: 213817 - DNA, 103 bp, Artificial Sequence
  Synthetic Polynucleotide
taatacgactcactatagggttctttgacatcagggacctttttttgtgtaacagaggagaacacaaatgaaggtccctaacctggcggcagcgcaaaagatg

SEQ ID NO: 213818 - DNA, 103 bp, Artificial Sequence
  Synthetic Polynucleotide
taatacgactcactatagggttttttccatttctttgacatcagggacctaacagaggagaaggtccatgatgtcaaagaacctggcggcagcgcaaaagatg

SEQ ID NO: 213819 - DNA, 103 bp, Artificial Sequence
  Synthetic Polynucleotide
taatacgactcactataggggtaaagctgcttttttccatttctttgacaaacagaggagatgtcaaatgaatggaaaaaacctggcggcagcgcaaaagatg

SEQ ID NO: 213820 - DNA, 103 bp, Artificial Sequence
  Synthetic Polynucleotide
taatacgactcactatagggaatgtactcagtaaagctgcttttttccataacagaggagaatggaaatgagcagctttaacctggcggcagcgcaaaagatg

SEQ ID NO: 213821 - DNA, 103 bp, Artificial Sequence
  Synthetic Polynucleotide
taatacgactcactataggggttccagaggcagacgcaatataaactggtaacagaggagaaccagtatgtattgcgtcaacctggcggcagcgcaaaagatg

SEQ ID NO: 213822 - DNA, 103 bp, Artificial Sequence
  Synthetic Polynucleotide
taatacgactcactatagggctggagattcaatgtactcagtaaagctgcaacagaggagagcagctatgctgagtacaaacctggcggcagcgcaaaagatg

SEQ ID NO: 213823 - DNA, 103 bp, Artificial Sequence
  Synthetic Polynucleotide
taatacgactcactatagggttttccacgtctggagattcaatgtactcaaacagaggagatgagtaatgtgaatctccaacctggcggcagcgcaaaagatg

SEQ ID NO: 213824 - DNA, 103 bp, Artificial Sequence
  Synthetic Polynucleotide
taatacgactcactatagggctttacttcattttccacgtctggagattcaacagaggagagaatctatggacgtggaaaacctggcggcagcgcaaaagatg

SEQ ID NO: 213825 - DNA, 103 bp, Artificial Sequence
  Synthetic Polynucleotide
taatacgactcactataggggcagcagtctctttacttcattttccacgtaacagaggagaacgtggatgatgaagtaaaacctggcggcagcgcaaaagatg

SEQ ID NO: 213826 - DNA, 103 bp, Artificial Sequence
  Synthetic Polynucleotide
taatacgactcactataggggcatccgaacgcagcagtctctttacttcaaacagaggagatgaagtatggagactgctaacctggcggcagcgcaaaagatg

SEQ ID NO: 213827 - DNA, 103 bp, Artificial Sequence
  Synthetic Polynucleotide
taatacgactcactatagggtacggcttcagcatccgaacgcagcagtctaacagaggagaagactgatgcgttcggataacctggcggcagcgcaaaagatg

SEQ ID NO: 213828 - DNA, 103 bp, Artificial Sequence
  Synthetic Polynucleotide
taatacgactcactatagggaacgggtacttacggcttcagcatccgaacaacagaggagagttcggatgctgaagccgaacctggcggcagcgcaaaagatg

SEQ ID NO: 213829 - DNA, 103 bp, Artificial Sequence
  Synthetic Polynucleotide
taatacgactcactatagggatgacttcccaacgggtacttacggcttcaaacagaggagatgaagcatgaagtacccgaacctggcggcagcgcaaaagatg

SEQ ID NO: 213830 - DNA, 103 bp, Artificial Sequence
  Synthetic Polynucleotide
taatacgactcactatagggatcttcagcaatgacttcccaacgggtactaacagaggagaagtaccatgtgggaagtcaacctggcggcagcgcaaaagatg

SEQ ID NO: 213831 - DNA, 103 bp, Artificial Sequence
  Synthetic Polynucleotide
taatacgactcactatagggccttggttccatcttcagcaatgacttcccaacagaggagagggaagatgttgctgaagaacctggcggcagcgcaaaagatg

SEQ ID NO: 213832 - DNA, 103 bp, Artificial Sequence
  Synthetic Polynucleotide
taatacgactcactataggggtacaagcatgttccagaggcagacgcaataacagaggagaattgcgatggcctctggaaacctggcggcagcgcaaaagatg

SEQ ID NO: 213833 - DNA, 103 bp, Artificial Sequence
  Synthetic Polynucleotide
taatacgactcactatagggctttctatttccttggttccatcttcagcaaacagaggagatgctgaatgtggaaccaaaacctggcggcagcgcaaaagatg

SEQ ID NO: 213834 - DNA, 103 bp, Artificial Sequence
  Synthetic Polynucleotide
taatacgactcactatagggggagccttgactttctatttccttggttccaacagaggagaggaaccatggaaatagaaaacctggcggcagcgcaaaagatg

SEQ ID NO: 213835 - DNA, 103 bp, Artificial Sequence
  Synthetic Polynucleotide
taatacgactcactatagggatcctgggatggagccttgactttctatttaacagaggagaaaatagatggtcaaggctaacctggcggcagcgcaaaagatg

SEQ ID NO: 213836 - DNA, 103 bp, Artificial Sequence
  Synthetic Polynucleotide
taatacgactcactataggggatatcaaaaatcctgggatggagccttgaaacagaggagatcaaggatgcatcccaggaacctggcggcagcgcaaaagatg

SEQ ID NO: 213837 - DNA, 103 bp, Artificial Sequence
  Synthetic Polynucleotide
taatacgactcactatagggcattcccgaggatatcaaaaatcctgggataacagaggagaatcccaatgtttttgataaacctggcggcagcgcaaaagatg

SEQ ID NO: 213838 - DNA, 103 bp, Artificial Sequence
  Synthetic Polynucleotide
taatacgactcactatagggtgtggctgctcattcccgaggatatcaaaaaacagaggagattttgaatgcctcgggaaaacctggcggcagcgcaaaagatg

SEQ ID NO: 213839 - DNA, 103 bp, Artificial Sequence
  Synthetic Polynucleotide
taatacgactcactatagggtgaccctgcttgtggctgctcattcccgagaacagaggagactcgggatggagcagccaaacctggcggcagcgcaaaagatg

SEQ ID NO: 213840 - DNA, 103 bp, Artificial Sequence
  Synthetic Polynucleotide
taatacgactcactatagggtgacgaggtatgaccctgcttgtggctgctaacagaggagaagcagcatgaagcagggtaacctggcggcagcgcaaaagatg

SEQ ID NO: 213841 - DNA, 103 bp, Artificial Sequence
  Synthetic Polynucleotide
taatacgactcactatagggtttccatgactgacgaggtatgaccctgctaacagaggagaagcaggatgatacctcgtaacctggcggcagcgcaaaagatg

SEQ ID NO: 213842 - DNA, 103 bp, Artificial Sequence
  Synthetic Polynucleotide
taatacgactcactatagggtgcttctgaatttccatgactgacgaggtaaacagaggagatacctcatgagtcatggaaacctggcggcagcgcaaaagatg

SEQ ID NO: 213843 - DNA, 103 bp, Artificial Sequence
  Synthetic Polynucleotide
taatacgactcactataggggttcctgacagtacaagcatgttccagaggaacagaggagacctctgatgcatgcttgtaacctggcggcagcgcaaaagatg

SEQ ID NO: 213844 - DNA, 103 bp, Artificial Sequence
  Synthetic Polynucleotide
taatacgactcactatagggtttctcaatctgcttctgaatttccatgacaacagaggagagtcatgatgattcagaagaacctggcggcagcgcaaaagatg

SEQ ID NO: 213845 - DNA, 103 bp, Artificial Sequence
  Synthetic Polynucleotide
taatacgactcactatagggttttctcctttttctcaatctgcttctgaaaacagaggagattcagaatgagattgagaaacctggcggcagcgcaaaagatg

SEQ ID NO: 213846 - DNA, 103 bp, Artificial Sequence
  Synthetic Polynucleotide
taatacgactcactatagggttatggagctttttctcctttttctcaatcaacagaggagagattgaatgaaaggagaaaacctggcggcagcgcaaaagatg

SEQ ID NO: 213847 - DNA, 103 bp, Artificial Sequence
  Synthetic Polynucleotide
taatacgactcactatagggattctgaatcttatggagctttttctccttaacagaggagaaaggagatgaagctccataacctggcggcagcgcaaaagatg

SEQ ID NO: 213848 - DNA, 103 bp, Artificial Sequence
  Synthetic Polynucleotide
taatacgactcactatagggtttgtgctttattctgaatcttatggagctaacagaggagaagctccatgagattcagaaacctggcggcagcgcaaaagatg

SEQ ID NO: 213849 - DNA, 103 bp, Artificial Sequence
  Synthetic Polynucleotide
taatacgactcactatagggtccttctgtctttgtgctttattctgaatcaacagaggagagattcaatgtaaagcacaaacctggcggcagcgcaaaagatg

SEQ ID NO: 213850 - DNA, 103 bp, Artificial Sequence
  Synthetic Polynucleotide
taatacgactcactatagggcatgatgagatccttctgtctttgtgctttaacagaggagaaaagcaatgagacagaagaacctggcggcagcgcaaaagatg

SEQ ID NO: 213851 - DNA, 103 bp, Artificial Sequence
  Synthetic Polynucleotide
taatacgactcactatagggtttccactttcatgatgagatccttctgtcaacagaggagagacagaatgatctcatcaaacctggcggcagcgcaaaagatg

SEQ ID NO: 213852 - DNA, 103 bp, Artificial Sequence
  Synthetic Polynucleotide
taatacgactcactatagggagtgtcaggttttccactttcatgatgagaaacagaggagatctcatatggaaagtggaaacctggcggcagcgcaaaagatg

SEQ ID NO: 213853 - DNA, 103 bp, Artificial Sequence
  Synthetic Polynucleotide
taatacgactcactatagggatgattcttgagtgtcaggttttccactttaacagaggagaaaagtgatgaacctgacaaacctggcggcagcgcaaaagatg

SEQ ID NO: 213854 - DNA, 103 bp, Artificial Sequence
  Synthetic Polynucleotide
taatacgactcactatagggaacgtgctaggttcctgacagtacaagcataacagaggagaatgcttatgctgtcaggaaacctggcggcagcgcaaaagatg

SEQ ID NO: 213855 - DNA, 103 bp, Artificial Sequence
  Synthetic Polynucleotide
taatacgactcactatagggcagactgaaaatgattcttgagtgtcaggtaacagaggagaacctgaatgtcaagaatcaacctggcggcagcgcaaaagatg

SEQ ID NO: 213856 - DNA, 103 bp, Artificial Sequence
  Synthetic Polynucleotide
taatacgactcactatagggtgctccagcacagactgaaaatgattcttgaacagaggagacaagaaatgttttcagtcaacctggcggcagcgcaaaagatg

SEQ ID NO: 213857 - DNA, 103 bp, Artificial Sequence
  Synthetic Polynucleotide
taatacgactcactatagggtaactcaagctgctccagcacagactgaaaaacagaggagatttcagatggtgctggagaacctggcggcagcgcaaaagatg

SEQ ID NO: 213858 - DNA, 103 bp, Artificial Sequence
  Synthetic Polynucleotide
taatacgactcactataggggtttttcctgtaactcaagctgctccagcaaacagaggagatgctggatgagcttgagtaacctggcggcagcgcaaaagatg

SEQ ID NO: 213859 - DNA, 103 bp, Artificial Sequence
  Synthetic Polynucleotide
taatacgactcactatagggtcatttttttgtttttcctgtaactcaagcaacagaggagagcttgaatgacaggaaaaaacctggcggcagcgcaaaagatg

SEQ ID NO: 213860 - DNA, 103 bp, Artificial Sequence
  Synthetic Polynucleotide
taatacgactcactatagggaatgagcttctcatttttttgtttttcctgaacagaggagacaggaaatgcaaaaaaataacctggcggcagcgcaaaagatg

SEQ ID NO: 213861 - DNA, 103 bp, Artificial Sequence
  Synthetic Polynucleotide
taatacgactcactatagggcctgtagggaaatgagcttctcatttttttaacagaggagaaaaaaaatgagaagctcaaacctggcggcagcgcaaaagatg

SEQ ID NO: 213862 - DNA, 103 bp, Artificial Sequence
  Synthetic Polynucleotide
taatacgactcactatagggtgcaactgttcctgtagggaaatgagcttcaacagaggagagaagctatgttccctacaaacctggcggcagcgcaaaagatg

SEQ ID NO: 213863 - DNA, 103 bp, Artificial Sequence
  Synthetic Polynucleotide
taatacgactcactatagggcagaaaacgctgcaactgttcctgtagggaaacagaggagatccctaatggaacagttgaacctggcggcagcgcaaaagatg

SEQ ID NO: 213864 - DNA, 103 bp, Artificial Sequence
  Synthetic Polynucleotide
taatacgactcactatagggacactttgagaacgtgctaggttcctgacaaacagaggagatgtcagatgcctagcacgaacctggcggcagcgcaaaagatg

SEQ ID NO: 213865 - DNA, 103 bp, Artificial Sequence
  Synthetic Polynucleotide
taatacgactcactatagggcttgggagaagccgtcttgccagactccataacagaggagaatggagatgggcaagacgaacctggcggcagcgcaaaagatg

SEQ ID NO: 213866 - DNA, 103 bp, Artificial Sequence
  Synthetic Polynucleotide
taatacgactcactatagggcaacatctgatttataactcttggctcataaacagaggagatatgagatgagagttataaacctggcggcagcgcaaaagatg

SEQ ID NO: 213867 - DNA, 103 bp, Artificial Sequence
  Synthetic Polynucleotide
taatacgactcactatagggaggcaaactccaacatctgatttataactcaacagaggagagagttaatgatcagatgtaacctggcggcagcgcaaaagatg

SEQ ID NO: 213868 - DNA, 103 bp, Artificial Sequence
  Synthetic Polynucleotide
taatacgactcactatagggacatatcggaaggcaaactccaacatctgaaacagaggagatcagatatgggagtttgcaacctggcggcagcgcaaaagatg

SEQ ID NO: 213869 - DNA, 103 bp, Artificial Sequence
  Synthetic Polynucleotide
taatacgactcactatagggaattgtggtcacatatcggaaggcaaactcaacagaggagagagtttatgttccgatataacctggcggcagcgcaaaagatg

SEQ ID NO: 213870 - DNA, 103 bp, Artificial Sequence
  Synthetic Polynucleotide
taatacgactcactatagggcatcatctagaattgtggtcacatatcggaaacagaggagatccgatatgtgaccacaaaacctggcggcagcgcaaaagatg

SEQ ID NO: 213871 - DNA, 103 bp, Artificial Sequence
  Synthetic Polynucleotide
taatacgactcactatagggtaaatttttgcatcatctagaattgtggtcaacagaggagagaccacatgtctagatgaaacctggcggcagcgcaaaagatg

SEQ ID NO: 213872 - DNA, 103 bp, Artificial Sequence
  Synthetic Polynucleotide
taatacgactcactatagggatggcttgaataaatttttgcatcatctagaacagaggagactagatatggcaaaaattaacctggcggcagcgcaaaagatg

SEQ ID NO: 213873 - DNA, 103 bp, Artificial Sequence
  Synthetic Polynucleotide
taatacgactcactatagggctttcttagcatggcttgaataaatttttgaacagaggagacaaaaaatgattcaagccaacctggcggcagcgcaaaagatg

SEQ ID NO: 213874 - DNA, 103 bp, Artificial Sequence
  Synthetic Polynucleotide
taatacgactcactatagggtcaacagtagctttcttagcatggcttgaaaacagaggagattcaagatgtgctaagaaaacctggcggcagcgcaaaagatg

SEQ ID NO: 213875 - DNA, 103 bp, Artificial Sequence
  Synthetic Polynucleotide
taatacgactcactatagggatcatctgcatcaacagtagctttcttagcaacagaggagagctaagatggctactgttaacctggcggcagcgcaaaagatg

SEQ ID NO: 213876 - DNA, 103 bp, Artificial Sequence
  Synthetic Polynucleotide
taatacgactcactatagggtcggcatgctcttgggagaagccgtcttgcaacagaggagagcaagaatgcttctcccaaacctggcggcagcgcaaaagatg

SEQ ID NO: 213877 - DNA, 103 bp, Artificial Sequence
  Synthetic Polynucleotide
taatacgactcactatagggccaatcgcacatcatctgcatcaacagtagaacagaggagactactgatgatgcagatgaacctggcggcagcgcaaaagatg

SEQ ID NO: 213878 - DNA, 103 bp, Artificial Sequence
  Synthetic Polynucleotide
taatacgactcactatagggcactggattgccaatcgcacatcatctgcaaacagaggagatgcagaatgtgtgcgattaacctggcggcagcgcaaaagatg

SEQ ID NO: 213879 - DNA, 103 bp, Artificial Sequence
  Synthetic Polynucleotide
taatacgactcactatagggatcagcgcggcactggattgccaatcgcacaacagaggagagtgcgaatggcaatccagaacctggcggcagcgcaaaagatg

SEQ ID NO: 213880 - DNA, 103 bp, Artificial Sequence
  Synthetic Polynucleotide
taatacgactcactatagggtaaaagactgatcagcgcggcactggattgaacagaggagacaatccatggccgcgctgaacctggcggcagcgcaaaagatg

SEQ ID NO: 213881 - DNA, 103 bp, Artificial Sequence
  Synthetic Polynucleotide
taatacgactcactatagggggaggagaggtaaaagactgatcagcgcggaacagaggagaccgcgcatgtcagtctttaacctggcggcagcgcaaaagatg

SEQ ID NO: 213882 - DNA, 103 bp, Artificial Sequence
  Synthetic Polynucleotide
taatacgactcactatagggatctcttgggggaggagaggtaaaagactgaacagaggagacagtctatgacctctcctaacctggcggcagcgcaaaagatg

SEQ ID NO: 213883 - DNA, 103 bp, Artificial Sequence
  Synthetic Polynucleotide
taatacgactcactatagggctaataaaaaatctcttgggggaggagaggaacagaggagacctctcatgccccaagagaacctggcggcagcgcaaaagatg

SEQ ID NO: 213884 - DNA, 103 bp, Artificial Sequence
  Synthetic Polynucleotide
taatacgactcactatagggcttgcaatatctaataaaaaatctcttgggaacagaggagacccaagatgttttttattaacctggcggcagcgcaaaagatg

SEQ ID NO: 213885 - DNA, 103 bp, Artificial Sequence
  Synthetic Polynucleotide
taatacgactcactatagggatttctttgccttgcaatatctaataaaaaaacagaggagatttttaatggatattgcaaacctggcggcagcgcaaaagatg

SEQ ID NO: 213886 - DNA, 103 bp, Artificial Sequence
  Synthetic Polynucleotide
taatacgactcactatagggaaggggtttgatttctttgccttgcaatataacagaggagaatattgatgggcaaagaaaacctggcggcagcgcaaaagatg

SEQ ID NO: 213887 - DNA, 103 bp, Artificial Sequence
  Synthetic Polynucleotide
taatacgactcactatagggtgtgcatctttcggcatgctcttgggagaaaacagaggagattctccatggagcatgccaacctggcggcagcgcaaaagatg

SEQ ID NO: 213888 - DNA, 103 bp, Artificial Sequence
  Synthetic Polynucleotide
taatacgactcactatagggatcaatggcaaaggggtttgatttctttgcaacagaggagagcaaagatgtcaaaccccaacctggcggcagcgcaaaagatg

SEQ ID NO: 213889 - DNA, 103 bp, Artificial Sequence
  Synthetic Polynucleotide
taatacgactcactatagggatatggcttgatcaatggcaaaggggtttgaacagaggagacaaaccatgttgccattgaacctggcggcagcgcaaaagatg

SEQ ID NO: 213890 - DNA, 103 bp, Artificial Sequence
  Synthetic Polynucleotide
taatacgactcactatagggtaggacctgaatatggcttgatcaatggcaaacagaggagatgccatatgtcaagccataacctggcggcagcgcaaaagatg

SEQ ID NO: 213891 - DNA, 103 bp, Artificial Sequence
  Synthetic Polynucleotide
taatacgactcactatagggggtggcaacctaggacctgaatatggcttgaacagaggagacaagccatgttcaggtccaacctggcggcagcgcaaaagatg

SEQ ID NO: 213892 - DNA, 103 bp, Artificial Sequence
  Synthetic Polynucleotide
taatacgactcactataggggtatctatcaggtggcaacctaggacctgaaacagaggagatcaggtatgaggttgccaaacctggcggcagcgcaaaagatg

SEQ ID NO: 213893 - DNA, 103 bp, Artificial Sequence
  Synthetic Polynucleotide
taatacgactcactatagggctgttaagcagtatctatcaggtggcaaccaacagaggagaggttgcatgctgatagataacctggcggcagcgcaaaagatg

SEQ ID NO: 213894 - DNA, 103 bp, Artificial Sequence
  Synthetic Polynucleotide
taatacgactcactatagggtagtttggagctgttaagcagtatctatcaaacagaggagatgatagatgctgcttaacaacctggcggcagcgcaaaagatg

SEQ ID NO: 213895 - DNA, 103 bp, Artificial Sequence
  Synthetic Polynucleotide
taatacgactcactatagggtttcagcctatagtttggagctgttaagcaaacagaggagatgcttaatggctccaaacaacctggcggcagcgcaaaagatg

SEQ ID NO: 213896 - DNA, 103 bp, Artificial Sequence
  Synthetic Polynucleotide
taatacgactcactatagggtctgtaaagatttcagcctatagtttggagaacagaggagactccaaatgataggctgaaacctggcggcagcgcaaaagatg

SEQ ID NO: 213897 - DNA, 103 bp, Artificial Sequence
  Synthetic Polynucleotide
taatacgactcactataggggatgcctttttctgtaaagatttcagcctaaacagaggagataggctatgatctttacaaacctggcggcagcgcaaaagatg

SEQ ID NO: 213898 - DNA, 103 bp, Artificial Sequence
  Synthetic Polynucleotide
taatacgactcactatagggtgccatcatctgtgcatctttcggcatgctaacagaggagaagcatgatgaaagatgcaaacctggcggcagcgcaaaagatg

SEQ ID NO: 213899 - DNA, 103 bp, Artificial Sequence
  Synthetic Polynucleotide
taatacgactcactatagggcgcagaagttgatgcctttttctgtaaagaaacagaggagatctttaatgaaaaaggcaaacctggcggcagcgcaaaagatg

SEQ ID NO: 213900 - DNA, 103 bp, Artificial Sequence
  Synthetic Polynucleotide
taatacgactcactatagggttattcttcccgcagaagttgatgccttttaacagaggagaaaaaggatgcaacttctgaacctggcggcagcgcaaaagatg

SEQ ID NO: 213901 - DNA, 103 bp, Artificial Sequence
  Synthetic Polynucleotide
taatacgactcactatagggcgcgggactgttattcttcccgcagaagttaacagaggagaaacttcatggggaagaataacctggcggcagcgcaaaagatg

SEQ ID NO: 213902 - DNA, 103 bp, Artificial Sequence
  Synthetic Polynucleotide
taatacgactcactatagggaacacttaaccgcgggactgttattcttccaacagaggagaggaagaatgacagtcccgaacctggcggcagcgcaaaagatg

SEQ ID NO: 213903 - DNA, 103 bp, Artificial Sequence
  Synthetic Polynucleotide
taatacgactcactatagggtaactgaaccaacacttaaccgcgggactgaacagaggagacagtccatgggttaagtgaacctggcggcagcgcaaaagatg

SEQ ID NO: 213904 - DNA, 103 bp, Artificial Sequence
  Synthetic Polynucleotide
taatacgactcactatagggggtctgctagtaactgaaccaacacttaacaacagaggagagttaagatgtggttcagtaacctggcggcagcgcaaaagatg

SEQ ID NO: 213905 - DNA, 103 bp, Artificial Sequence
  Synthetic Polynucleotide
taatacgactcactataggggggagtacttggtctgctagtaactgaaccaacagaggagaggttcaatgactagcagaaacctggcggcagcgcaaaagatg

SEQ ID NO: 213906 - DNA, 103 bp, Artificial Sequence
  Synthetic Polynucleotide
taatacgactcactatagggtgcctagtgtgggagtacttggtctgctagaacagaggagactagcaatgcaagtactcaacctggcggcagcgcaaaagatg

SEQ ID NO: 213907 - DNA, 103 bp, Artificial Sequence
  Synthetic Polynucleotide
taatacgactcactatagggggggttggtgtgcctagtgtgggagtacttaacagaggagaaagtacatgcacactaggaacctggcggcagcgcaaaagatg

SEQ ID NO: 213908 - DNA, 103 bp, Artificial Sequence
  Synthetic Polynucleotide
taatacgactcactatagggcatggtctgtggggttggtgtgcctagtgtaacagaggagaacactaatgacaccaaccaacctggcggcagcgcaaaagatg

SEQ ID NO: 213909 - DNA, 103 bp, Artificial Sequence
  Synthetic Polynucleotide
taatacgactcactatagggtcaggatttgtgccatcatctgtgcatcttaacagaggagaaagatgatgagatgatggaacctggcggcagcgcaaaagatg

SEQ ID NO: 213910 - DNA, 103 bp, Artificial Sequence
  Synthetic Polynucleotide
taatacgactcactatagggttgaaacagacatggtctgtggggttggtgaacagaggagacaccaaatgcacagaccaaacctggcggcagcgcaaaagatg

SEQ ID NO: 213911 - DNA, 103 bp, Artificial Sequence
  Synthetic Polynucleotide
taatacgactcactatagggcctactttagttgaaacagacatggtctgtaacagaggagaacagacatggtctgtttcaacctggcggcagcgcaaaagatg

SEQ ID NO: 213912 - DNA, 103 bp, Artificial Sequence
  Synthetic Polynucleotide
taatacgactcactatagggcatgggagtccctactttagttgaaacagaaacagaggagatctgttatgactaaagtaaacctggcggcagcgcaaaagatg

SEQ ID NO: 213913 - DNA, 103 bp, Artificial Sequence
  Synthetic Polynucleotide
taatacgactcactatagggctgtgagggacatgggagtccctactttagaacagaggagactaaagatgggactcccaaacctggcggcagcgcaaaagatg

SEQ ID NO: 213914 - DNA, 103 bp, Artificial Sequence
  Synthetic Polynucleotide
taatacgactcactatagggaacctttgacctgtgagggacatgggagtcaacagaggagagactccatggtccctcacaacctggcggcagcgcaaaagatg

SEQ ID NO: 213915 - DNA, 103 bp, Artificial Sequence
  Synthetic Polynucleotide
taatacgactcactatagggctgtactgtaaacctttgacctgtgagggaaacagaggagatccctcatgggtcaaaggaacctggcggcagcgcaaaagatg

SEQ ID NO: 213916 - DNA, 103 bp, Artificial Sequence
  Synthetic Polynucleotide
taatacgactcactatagggaagtaggcatctgtactgtaaacctttgacaacagaggagagtcaaaatgttacagtacaacctggcggcagcgcaaaagatg

SEQ ID NO: 213917 - DNA, 103 bp, Artificial Sequence
  Synthetic Polynucleotide
taatacgactcactatagggggagactgagaagtaggcatctgtactgtaaacagaggagatacagtatggatgcctacaacctggcggcagcgcaaaagatg

SEQ ID NO: 213918 - DNA, 103 bp, Artificial Sequence
  Synthetic Polynucleotide
taatacgactcactatagggttttacagctggagactgagaagtaggcataacagaggagaatgcctatgtctcagtctaacctggcggcagcgcaaaagatg

SEQ ID NO: 213919 - DNA, 103 bp, Artificial Sequence
  Synthetic Polynucleotide
taatacgactcactataggggaattgaagcttttacagctggagactgagaacagaggagactcagtatgcagctgtaaaacctggcggcagcgcaaaagatg

SEQ ID NO: 213920 - DNA, 103 bp, Artificial Sequence
  Synthetic Polynucleotide
taatacgactcactatagggcccatatccttcaggatttgtgccatcatcaacagaggagagatgatatgacaaatcctaacctggcggcagcgcaaaagatg

SEQ ID NO: 213921 - DNA, 103 bp, Artificial Sequence
  Synthetic Polynucleotide
taatacgactcactataggggaggttgcaggaattgaagcttttacagctaacagaggagaagctgtatgagcttcaataacctggcggcagcgcaaaagatg

SEQ ID NO: 213922 - DNA, 103 bp, Artificial Sequence
  Synthetic Polynucleotide
taatacgactcactatagggctgaactgctgaggttgcaggaattgaagcaacagaggagagcttcaatgcctgcaaccaacctggcggcagcgcaaaagatg

SEQ ID NO: 213923 - DNA, 103 bp, Artificial Sequence
  Synthetic Polynucleotide
taatacgactcactatagggtcagaacattctgaactgctgaggttgcagaacagaggagactgcaaatgcagcagttcaacctggcggcagcgcaaaagatg

SEQ ID NO: 213924 - DNA, 103 bp, Artificial Sequence
  Synthetic Polynucleotide
taatacgactcactataggggatggattaatcagaacattctgaactgctaacagaggagaagcagtatggaatgttctaacctggcggcagcgcaaaagatg

SEQ ID NO: 213925 - DNA, 103 bp, Artificial Sequence
  Synthetic Polynucleotide
taatacgactcactatagggcccgattaatgatggattaatcagaacattaacagaggagaaatgttatgattaatccaaacctggcggcagcgcaaaagatg

SEQ ID NO: 213926 - DNA, 103 bp, Artificial Sequence
  Synthetic Polynucleotide
taatacgactcactatagggtgtttttggacccgattaatgatggattaaaacagaggagattaatcatgcattaatcgaacctggcggcagcgcaaaagatg

SEQ ID NO: 213927 - DNA, 103 bp, Artificial Sequence
  Synthetic Polynucleotide
taatacgactcactataggggtaataagaatgtttttggacccgattaataacagaggagaattaatatggtccaaaaaaacctggcggcagcgcaaaagatg

SEQ ID NO: 213928 - DNA, 103 bp, Artificial Sequence
  Synthetic Polynucleotide
taatacgactcactatagggcatattagtggtaataagaatgtttttggaaacagaggagatccaaaatgattcttattaacctggcggcagcgcaaaagatg

SEQ ID NO: 213929 - DNA, 103 bp, Artificial Sequence
  Synthetic Polynucleotide
taatacgactcactataggggtgatgacatcatattagtggtaataagaaaacagaggagattcttaatgccactaataaacctggcggcagcgcaaaagatg

SEQ ID NO: 213930 - DNA, 103 bp, Artificial Sequence
  Synthetic Polynucleotide
taatacgactcactataggggcagtattttgtgatgacatcatattagtgaacagaggagacactaaatggatgtcatcaacctggcggcagcgcaaaagatg

SEQ ID NO: 213931 - DNA, 103 bp, Artificial Sequence
  Synthetic Polynucleotide
taatacgactcactatagggttctgtaatccccatatccttcaggatttgaacagaggagacaaatcatgaaggatatgaacctggcggcagcgcaaaagatg

SEQ ID NO: 213932 - DNA, 103 bp, Artificial Sequence
  Synthetic Polynucleotide
taatacgactcactatagggtgattcattggcagtattttgtgatgacataacagaggagaatgtcaatgcaaaatactaacctggcggcagcgcaaaagatg

SEQ ID NO: 213933 - DNA, 103 bp, Artificial Sequence
  Synthetic Polynucleotide
taatacgactcactatagggatgcatttgatgattcattggcagtattttaacagaggagaaaaataatgccaatgaataacctggcggcagcgcaaaagatg

SEQ ID NO: 213934 - DNA, 103 bp, Artificial Sequence
  Synthetic Polynucleotide
taatacgactcactatagggtttcttttcaatgcatttgatgattcattgaacagaggagacaatgaatgatcaaatgcaacctggcggcagcgcaaaagatg

SEQ ID NO: 213935 - DNA, 103 bp, Artificial Sequence
  Synthetic Polynucleotide
taatacgactcactatagggatcttcacgttttcttttcaatgcatttgaaacagaggagatcaaatatgttgaaaagaaacctggcggcagcgcaaaagatg

SEQ ID NO: 213936 - DNA, 103 bp, Artificial Sequence
  Synthetic Polynucleotide
taatacgactcactatagggcatcatcatcatcttcacgttttcttttcaaacagaggagatgaaaaatgaacgtgaagaacctggcggcagcgcaaaagatg

SEQ ID NO: 213937 - DNA, 103 bp, Artificial Sequence
  Synthetic Polynucleotide
taatacgactcactatagggtcatcatcgtcatcatcatcatcttcacgtaacagaggagaacgtgaatgtgatgatgaaacctggcggcagcgcaaaagatg

SEQ ID NO: 213938 - DNA, 103 bp, Artificial Sequence
  Synthetic Polynucleotide
taatacgactcactataggggtcatcatcatcatcatcgtcatcatcatcaacagaggagagatgatatggacgatgataacctggcggcagcgcaaaagatg

SEQ ID NO: 213939 - DNA, 103 bp, Artificial Sequence
  Synthetic Polynucleotide
taatacgactcactataggggattatcatagtcatcatcatcatcatcgtaacagaggagaacgatgatgatgatgatgaacctggcggcagcgcaaaagatg

SEQ ID NO: 213940 - DNA, 103 bp, Artificial Sequence
  Synthetic Polynucleotide
taatacgactcactatagggttggctcatattctgtaatccccatatcctaacagaggagaaggataatgggattacagaacctggcggcagcgcaaaagatg

SEQ ID NO: 213941 - DNA, 103 bp, Artificial Sequence
  Synthetic Polynucleotide
taatacgactcactatagggtttataactcttggctcatattctgtaatcaacagaggagagattacatgatatgagccaacctggcggcagcgcaaaagatg

SEQ ID NO: 213942 - DNA, 103 bp, Artificial Sequence
  Synthetic Polynucleotide
taatacgactcactatagggcttgggaggcgccatcttgcccgactccataacagaggagaatggagatgggcaagatgaacctggcggcagcgcaaaagatg

SEQ ID NO: 213943 - DNA, 103 bp, Artificial Sequence
  Synthetic Polynucleotide
taatacgactcactatagggcaacatttgatttataacccttggttcataaacagaggagatatgaaatgagggttataaacctggcggcagcgcaaaagatg

SEQ ID NO: 213944 - DNA, 103 bp, Artificial Sequence
  Synthetic Polynucleotide
taatacgactcactatagggaagcaaattccaacatttgatttataacccaacagaggagagggttaatgatcaaatgtaacctggcggcagcgcaaaagatg

SEQ ID NO: 213945 - DNA, 103 bp, Artificial Sequence
  Synthetic Polynucleotide
taatacgactcactatagggacataacggaaagcaaattccaacatttgaaacagaggagatcaaatatgggaatttgcaacctggcggcagcgcaaaagatg

SEQ ID NO: 213946 - DNA, 103 bp, Artificial Sequence
  Synthetic Polynucleotide
taatacgactcactatagggaattgtagtcacataacggaaagcaaattcaacagaggagagaatttatgttccgttataacctggcggcagcgcaaaagatg

SEQ ID NO: 213947 - DNA, 103 bp, Artificial Sequence
  Synthetic Polynucleotide
taatacgactcactatagggcatcatccagaattgtagtcacataacggaaacagaggagatccgttatgtgactacaaaacctggcggcagcgcaaaagatg

SEQ ID NO: 213948 - DNA, 103 bp, Artificial Sequence
  Synthetic Polynucleotide
taatacgactcactatagggtaaatttttgcatcatccagaattgtagtcaacagaggagagactacatgtctggatgaaacctggcggcagcgcaaaagatg

SEQ ID NO: 213949 - DNA, 103 bp, Artificial Sequence
  Synthetic Polynucleotide
taatacgactcactatagggatggctcgaataaatttttgcatcatccagaacagaggagactggatatggcaaaaattaacctggcggcagcgcaaaagatg

SEQ ID NO: 213950 - DNA, 103 bp, Artificial Sequence
  Synthetic Polynucleotide
taatacgactcactataggggtttcttagcatggctcgaataaatttttgaacagaggagacaaaaaatgattcgagccaacctggcggcagcgcaaaagatg

SEQ ID NO: 213951 - DNA, 103 bp, Artificial Sequence
  Synthetic Polynucleotide
taatacgactcactatagggtcaacattaggtttcttagcatggctcgaaaacagaggagattcgagatgtgctaagaaaacctggcggcagcgcaaaagatg

SEQ ID NO: 213952 - DNA, 103 bp, Artificial Sequence
  Synthetic Polynucleotide
taatacgactcactatagggatcatctgcatcaacattaggtttcttagcaacagaggagagctaagatgcctaatgttaacctggcggcagcgcaaaagatg

SEQ ID NO: 213953 - DNA, 103 bp, Artificial Sequence
  Synthetic Polynucleotide
taatacgactcactatagggtcggagcgttcttgggaggcgccatcttgcaacagaggagagcaagaatgcgcctcccaaacctggcggcagcgcaaaagatg

SEQ ID NO: 213954 - DNA, 103 bp, Artificial Sequence
  Synthetic Polynucleotide
taatacgactcactatagggccagtctcacatcatctgcatcaacattagaacagaggagactaatgatgatgcagatgaacctggcggcagcgcaaaagatg

SEQ ID NO: 213955 - DNA, 103 bp, Artificial Sequence
  Synthetic Polynucleotide
taatacgactcactatagggcactggattgccagtctcacatcatctgcaaacagaggagatgcagaatgtgtgagactaacctggcggcagcgcaaaagatg

SEQ ID NO: 213956 - DNA, 103 bp, Artificial Sequence
  Synthetic Polynucleotide
taatacgactcactataggggtcagcacgacactggattgccagtctcacaacagaggagagtgagaatggcaatccagaacctggcggcagcgcaaaagatg

SEQ ID NO: 213957 - DNA, 103 bp, Artificial Sequence
  Synthetic Polynucleotide
taatacgactcactatagggtaaaagattggtcagcacgacactggattgaacagaggagacaatccatggtcgtgctgaacctggcggcagcgcaaaagatg

SEQ ID NO: 213958 - DNA, 103 bp, Artificial Sequence
  Synthetic Polynucleotide
taatacgactcactatagggggaggagaggtaaaagattggtcagcacgaaacagaggagatcgtgcatgccaatctttaacctggcggcagcgcaaaagatg

SEQ ID NO: 213959 - DNA, 103 bp, Artificial Sequence
  Synthetic Polynucleotide
taatacgactcactatagggatctcttgggggaggagaggtaaaagattgaacagaggagacaatctatgacctctcctaacctggcggcagcgcaaaagatg

SEQ ID NO: 213960 - DNA, 103 bp, Artificial Sequence
  Synthetic Polynucleotide
taatacgactcactatagggccagtaaaaaatctcttgggggaggagaggaacagaggagacctctcatgccccaagagaacctggcggcagcgcaaaagatg

SEQ ID NO: 213961 - DNA, 103 bp, Artificial Sequence
  Synthetic Polynucleotide
taatacgactcactatagggcttgcgatatccagtaaaaaatctcttgggaacagaggagacccaagatgttttttactaacctggcggcagcgcaaaagatg

SEQ ID NO: 213962 - DNA, 103 bp, Artificial Sequence
  Synthetic Polynucleotide
taatacgactcactatagggatttttctgccttgcgatatccagtaaaaaaacagaggagatttttaatggatatcgcaaacctggcggcagcgcaaaagatg

SEQ ID NO: 213963 - DNA, 103 bp, Artificial Sequence
  Synthetic Polynucleotide
taatacgactcactatagggaaggggtttgatttttctgccttgcgatataacagaggagaatatcgatgggcagaaaaaacctggcggcagcgcaaaagatg

SEQ ID NO: 213964 - DNA, 103 bp, Artificial Sequence
  Synthetic Polynucleotide
taatacgactcactatagggaaggcatctctcggagcgttcttgggaggcaacagaggagagcctccatggaacgctccaacctggcggcagcgcaaaagatg

SEQ ID NO: 213965 - DNA, 103 bp, Artificial Sequence
  Synthetic Polynucleotide
taatacgactcactatagggatcagtggcaaaggggtttgatttttctgcaacagaggagagcagaaatgtcaaaccccaacctggcggcagcgcaaaagatg

SEQ ID NO: 213966 - DNA, 103 bp, Artificial Sequence
  Synthetic Polynucleotide
taatacgactcactatagggatatggcttaatcagtggcaaaggggtttgaacagaggagacaaaccatgttgccactgaacctggcggcagcgcaaaagatg

SEQ ID NO: 213967 - DNA, 103 bp, Artificial Sequence
  Synthetic Polynucleotide
taatacgactcactatagggtaggtcctgcatatggcttaatcagtggcaaacagaggagatgccacatgttaagccataacctggcggcagcgcaaaagatg

SEQ ID NO: 213968 - DNA, 103 bp, Artificial Sequence
  Synthetic Polynucleotide
taatacgactcactatagggggtggcagtctaggtcctgcatatggcttaaacagaggagataagccatgtgcaggaccaacctggcggcagcgcaaaagatg

SEQ ID NO: 213969 - DNA, 103 bp, Artificial Sequence
  Synthetic Polynucleotide
taatacgactcactataggggtatctatcaggtggcagtctaggtcctgcaacagaggagagcaggaatgagactgccaaacctggcggcagcgcaaaagatg

SEQ ID NO: 213970 - DNA, 103 bp, Artificial Sequence
  Synthetic Polynucleotide
taatacgactcactatagggctgttaagcagtatctatcaggtggcagtcaacagaggagagactgcatgctgatagataacctggcggcagcgcaaaagatg

SEQ ID NO: 213971 - DNA, 103 bp, Artificial Sequence; identical to SEQ ID NO: 213894
  Synthetic Polynucleotide

SEQ ID NO: 213972 - DNA, 103 bp, Artificial Sequence
  Synthetic Polynucleotide
taatacgactcactatagggcttcagcctatagtttggagctgttaagcaaacagaggagatgcttaatggctccaaacaacctggcggcagcgcaaaagatg

SEQ ID NO: 213973 - DNA, 103 bp, Artificial Sequence
  Synthetic Polynucleotide
taatacgactcactatagggtaattaaggacttcagcctatagtttggagaacagaggagactccaaatgataggctgaaacctggcggcagcgcaaaagatg

SEQ ID NO: 213974 - DNA, 103 bp, Artificial Sequence
  Synthetic Polynucleotide
taatacgactcactatagggggtccctttttaattaaggacttcagcctaaacagaggagataggctatggtccttaataacctggcggcagcgcaaaagatg

SEQ ID NO: 213975 - DNA, 103 bp, Artificial Sequence
  Synthetic Polynucleotide
taatacgactcactatagggtgccatcaccaaggcatctctcggagcgttaacagaggagaaacgctatgagagatgccaacctggcggcagcgcaaaagatg

SEQ ID NO: 213976 - DNA, 103 bp, Artificial Sequence
  Synthetic Polynucleotide
taatacgactcactatagggcccttggttaggtccctttttaattaaggaaacagaggagatccttaatgaaaaagggaaacctggcggcagcgcaaaagatg

SEQ ID NO: 213977 - DNA, 103 bp, Artificial Sequence
  Synthetic Polynucleotide
taatacgactcactataggggaactagtctcccttggttaggtcccttttaacagaggagaaaaaggatgctaaccaagaacctggcggcagcgcaaaagatg

SEQ ID NO: 213978 - DNA, 103 bp, Artificial Sequence
  Synthetic Polynucleotide
taatacgactcactatagggcttaatcgtggaactagtctcccttggttaaacagaggagataaccaatggagactagtaacctggcggcagcgcaaaagatg

SEQ ID NO: 213979 - DNA, 103 bp, Artificial Sequence
  Synthetic Polynucleotide
taatacgactcactatagggagcaccaacacttaatcgtggaactagtctaacagaggagaagactaatgccacgattaaacctggcggcagcgcaaaagatg

SEQ ID NO: 213980 - DNA, 103 bp, Artificial Sequence
  Synthetic Polynucleotide
taatacgactcactatagggtgctactaacagcaccaacacttaatcgtgaacagaggagacacgatatggtgttggtgaacctggcggcagcgcaaaagatg

SEQ ID NO: 213981 - DNA, 103 bp, Artificial Sequence
  Synthetic Polynucleotide
taatacgactcactataggggtagtaggtttgctactaacagcaccaacaaacagaggagatgttggatgtgttagtagaacctggcggcagcgcaaaagatg

SEQ ID NO: 213982 - DNA, 103 bp, Artificial Sequence
  Synthetic Polynucleotide
taatacgactcactatagggtatagtaggagtagtaggtttgctactaacaacagaggagagttagtatgaaacctactaacctggcggcagcgcaaaagatg

SEQ ID NO: 213983 - DNA, 103 bp, Artificial Sequence
  Synthetic Polynucleotide
taatacgactcactataggggtggggttgctatagtaggagtagtaggttaacagaggagaaacctaatgctcctactaaacctggcggcagcgcaaaagatg

SEQ ID NO: 213984 - DNA, 103 bp, Artificial Sequence
  Synthetic Polynucleotide
taatacgactcactataggggacaccgtttgtggggttgctatagtaggaaacagaggagatcctacatgagcaaccccaacctggcggcagcgcaaaagatg

SEQ ID NO: 213985 - DNA, 103 bp, Artificial Sequence
  Synthetic Polynucleotide
taatacgactcactatagggatttgggacagacaccgtttgtggggttgcaacagaggagagcaaccatgcaaacggtgaacctggcggcagcgcaaaagatg

SEQ ID NO: 213986 - DNA, 103 bp, Artificial Sequence
  Synthetic Polynucleotide
taatacgactcactatagggtcaggatctgtgccatcaccaaggcatctcaacagaggagagagatgatgtggtgatggaacctggcggcagcgcaaaagatg

SEQ ID NO: 213987 - DNA, 103 bp, Artificial Sequence
  Synthetic Polynucleotide
taatacgactcactatagggttgcaactttatttgggacagacaccgtttaacagaggagaaaacggatgctgtcccaaaacctggcggcagcgcaaaagatg

SEQ ID NO: 213988 - DNA, 103 bp, Artificial Sequence
  Synthetic Polynucleotide
taatacgactcactataggggacattggagttgcaactttatttgggacaaacagaggagatgtcccatgtaaagttgcaacctggcggcagcgcaaaagatg

SEQ ID NO: 213989 - DNA, 103 bp, Artificial Sequence
  Synthetic Polynucleotide
taatacgactcactataggggcttgtcactgacattggagttgcaactttaacagaggagaaaagttatgactccaatgaacctggcggcagcgcaaaagatg

SEQ ID NO: 213990 - DNA, 103 bp, Artificial Sequence
  Synthetic Polynucleotide
taatacgactcactatagggtaaatctttggcttgtcactgacattggagaacagaggagactccaaatgcagtgacaaaacctggcggcagcgcaaaagatg

SEQ ID NO: 213991 - DNA, 103 bp, Artificial Sequence
  Synthetic Polynucleotide
taatacgactcactatagggatctgcaccgtaaatctttggcttgtcactaacagaggagaagtgacatgccaaagattaacctggcggcagcgcaaaagatg

SEQ ID NO: 213992 - DNA, 103 bp, Artificial Sequence
  Synthetic Polynucleotide
taatacgactcactatagggagaaggtggaatctgcaccgtaaatctttgaacagaggagacaaagaatgacggtgcagaacctggcggcagcgcaaaagatg

SEQ ID NO: 213993 - DNA, 103 bp, Artificial Sequence
  Synthetic Polynucleotide
taatacgactcactataggggtgtggactgagaaggtggaatctgcaccgaacagaggagacggtgcatgttccaccttaacctggcggcagcgcaaaagatg

SEQ ID NO: 213994 - DNA, 103 bp, Artificial Sequence
  Synthetic Polynucleotide
taatacgactcactatagggggtttgacaggtgtggactgagaaggtggaaacagaggagatccaccatgtcagtccacaacctggcggcagcgcaaaagatg

SEQ ID NO: 213995 - DNA, 103 bp, Artificial Sequence
  Synthetic Polynucleotide
taatacgactcactatagggtgcaggaactggtttgacaggtgtggactgaacagaggagacagtccatgcctgtcaaaaacctggcggcagcgcaaaagatg

SEQ ID NO: 213996 - DNA, 103 bp, Artificial Sequence
  Synthetic Polynucleotide
taatacgactcactatagggctgcagttgttgcaggaactggtttgacagaacagaggagactgtcaatgcagttcctgaacctggcggcagcgcaaaagatg

SEQ ID NO: 213997 - DNA, 103 bp, Artificial Sequence
  Synthetic Polynucleotide
taatacgactcactatagggcccatatccttcaggatctgtgccatcaccaacagaggagaggtgatatgacagatcctaacctggcggcagcgcaaaagatg

SEQ ID NO: 213998 - DNA, 103 bp, Artificial Sequence
  Synthetic Polynucleotide
taatacgactcactatagggacattttgaactgcagttgttgcaggaactaacagaggagaagttccatgaacaactgcaacctggcggcagcgcaaaagatg

SEQ ID NO: 213999 - DNA, 103 bp, Artificial Sequence
  Synthetic Polynucleotide
taatacgactcactatagggattaatcagaacattttgaactgcagttgtaacagaggagaacaactatggttcaaaataacctggcggcagcgcaaaagatg

SEQ ID NO: 214000 - DNA, 103 bp, Artificial Sequence
  Synthetic Polynucleotide
taatacgactcactatagggtcattgaaggattaatcagaacattttgaaaacagaggagattcaaaatgttctgattaaacctggcggcagcgcaaaagatg

SEQ ID NO: 214001 - DNA, 103 bp, Artificial Sequence
  Synthetic Polynucleotide
taatacgactcactatagggttgggcccaatcattgaaggattaatcagaaacagaggagatctgatatgtccttcaataacctggcggcagcgcaaaagatg

SEQ ID NO: 214002 - DNA, 103 bp, Artificial Sequence
  Synthetic Polynucleotide
taatacgactcactatagggaagaatatttttgggcccaatcattgaaggaacagaggagaccttcaatgattgggcccaacctggcggcagcgcaaaagatg

SEQ ID NO: 214003 - DNA, 103 bp, Artificial Sequence
  Synthetic Polynucleotide
taatacgactcactatagggtggtggtaataagaatatttttgggcccaaaacagaggagattgggcatgaaaatattcaacctggcggcagcgcaaaagatg

SEQ ID NO: 214004 - DNA, 103 bp, Artificial Sequence
  Synthetic Polynucleotide
taatacgactcactataggggaaaccatgttggtggtaataagaatatttaacagaggagaaaatatatgtattaccacaacctggcggcagcgcaaaagatg

SEQ ID NO: 214005 - DNA, 103 bp, Artificial Sequence
  Synthetic Polynucleotide
taatacgactcactataggggttctgtgacgaaaccatgttggtggtaataacagaggagaattaccatgaacatggttaacctggcggcagcgcaaaagatg

SEQ ID NO: 214006 - DNA, 103 bp, Artificial Sequence
  Synthetic Polynucleotide
taatacgactcactatagggcattggctgtgttctgtgacgaaaccatgtaacagaggagaacatggatgcgtcacagaaacctggcggcagcgcaaaagatg

SEQ ID NO: 214007 - DNA, 103 bp, Artificial Sequence
  Synthetic Polynucleotide
taatacgactcactataggggggtttgcttcattggctgtgttctgtgacaacagaggagagtcacaatgcacagccaaaacctggcggcagcgcaaaagatg

SEQ ID NO: 214008 - DNA, 103 bp, Artificial Sequence
  Synthetic Polynucleotide
taatacgactcactatagggctctgtgattcccatatccttcaggatctgaacagaggagacagatcatgaaggatatgaacctggcggcagcgcaaaagatg

SEQ ID NO: 214009 - DNA, 103 bp, Artificial Sequence
  Synthetic Polynucleotide
taatacgactcactatagggtctcttcagtgggtttgcttcattggctgtaacagaggagaacagccatggaagcaaacaacctggcggcagcgcaaaagatg

SEQ ID NO: 214010 - DNA, 103 bp, Artificial Sequence
  Synthetic Polynucleotide
taatacgactcactatagggcttcatgttttctcttcagtgggtttgcttaacagaggagaaagcaaatgcactgaagaaacctggcggcagcgcaaaagatg

SEQ ID NO: 214011 - DNA, 103 bp, Artificial Sequence
  Synthetic Polynucleotide
taatacgactcactatagggtcatcatcatcttcatgttttctcttcagtaacagaggagaactgaaatgaaaacatgaaacctggcggcagcgcaaaagatg

SEQ ID NO: 214012 - DNA, 103 bp, Artificial Sequence
  Synthetic Polynucleotide
taatacgactcactatagggaatatcattgtcatcatcatcttcatgtttaacagaggagaaaacatatggatgatgataacctggcggcagcgcaaaagatg

SEQ ID NO: 214013 - DNA, 103 bp, Artificial Sequence
  Synthetic Polynucleotide
taatacgactcactatagggttggttcatactctgtgattcccatatcctaacagaggagaaggataatggaatcacagaacctggcggcagcgcaaaagatg

SEQ ID NO: 214014 - DNA, 103 bp, Artificial Sequence
  Synthetic Polynucleotide
taatacgactcactatagggtttataacccttggttcatactctgtgattaacagaggagaaatcacatggtatgaaccaacctggcggcagcgcaaaagatg

SEQ ID NO: 214015 - DNA, 103 bp, Artificial Sequence
  Synthetic Polynucleotide
taatacgactcactatagggagccgcctcgctcggcggccgctcggtcataacagaggagaatgaccatgcggccgccgaacctggcggcagcgcaaaagatg

SEQ ID NO: 214016 - DNA, 103 bp, Artificial Sequence
  Synthetic Polynucleotide
taatacgactcactatagggctccttggcgacgccgttcagcaggaccagaacagaggagactggtcatgctgaacggcaacctggcggcagcgcaaaagatg

SEQ ID NO: 214017 - DNA, 103 bp, Artificial Sequence
  Synthetic Polynucleotide
taatacgactcactatagggcgcggctcgtctccttggcgacgccgttcaaacagaggagatgaacgatgtcgccaaggaacctggcggcagcgcaaaagatg

SEQ ID NO: 214018 - DNA, 103 bp, Artificial Sequence
  Synthetic Polynucleotide
taatacgactcactataggggctgcggccgcgcggctcgtctccttggcgaacagaggagacgccaaatggacgagccgaacctggcggcagcgcaaaagatg

SEQ ID NO: 214019 - DNA, 103 bp, Artificial Sequence
  Synthetic Polynucleotide
taatacgactcactatagggtgggggctccgctgcggccgcgcggctcgtaacagaggagaacgagcatggcggccgcaaacctggcggcagcgcaaaagatg

SEQ ID NO: 214020 - DNA, 103 bp, Artificial Sequence
  Synthetic Polynucleotide
taatacgactcactataggggttcgatgactgggggctccgctgcggccgaacagaggagacggccgatgcggagccccaacctggcggcagcgcaaaagatg

SEQ ID NO: 214021 - DNA, 103 bp, Artificial Sequence
  Synthetic Polynucleotide
taatacgactcactatagggcgcgcgcccagttcgatgactgggggctccaacagaggagaggagccatgagtcatcgaaacctggcggcagcgcaaaagatg

SEQ ID NO: 214022 - DNA, 103 bp, Artificial Sequence
  Synthetic Polynucleotide
taatacgactcactatagggcgggcctccgcgcgcgcccagttcgatgacaacagaggagagtcatcatgctgggcgcgaacctggcggcagcgcaaaagatg

SEQ ID NO: 214023 - DNA, 103 bp, Artificial Sequence
  Synthetic Polynucleotide
taatacgactcactatagggggccgccccccgggcctccgcgcgcgcccaaacagaggagatgggcgatggcggaggccaacctggcggcagcgcaaaagatg

SEQ ID NO: 214024 - DNA, 103 bp, Artificial Sequence
  Synthetic Polynucleotide
taatacgactcactatagggccaccggcagggccgccccccgggcctccgaacagaggagacggaggatgggggggcggaacctggcggcagcgcaaaagatg

SEQ ID NO: 214025 - DNA, 103 bp, Artificial Sequence
  Synthetic Polynucleotide
taatacgactcactatagggggcgccgcccccaccggcagggccgcccccaacagaggagagggggcatgcctgccggtaacctggcggcagcgcaaaagatg

SEQ ID NO: 214026 - DNA, 103 bp, Artificial Sequence
  Synthetic Polynucleotide
taatacgactcactatagggggtcactgcgagccgcctcgctcggcggccaacagaggagaggccgcatggcgaggcggaacctggcggcagcgcaaaagatg

SEQ ID NO: 214027 - DNA, 103 bp, Artificial Sequence
  Synthetic Polynucleotide
taatacgactcactatagggagtctctcgcggcgccgcccccaccggcagaacagaggagactgccgatgggggcggcgaacctggcggcagcgcaaaagatg

SEQ ID NO: 214028 - DNA, 103 bp, Artificial Sequence
  Synthetic Polynucleotide
taatacgactcactatagggcggccctttaagtctctcgcggcgccgcccaacagaggagagggcggatgcgcgagagaaacctggcggcagcgcaaaagatg

SEQ ID NO: 214029 - DNA, 103 bp, Artificial Sequence
  Synthetic Polynucleotide
taatacgactcactatagggcgccgcgtcgcggccctttaagtctctcgcaacagaggagagcgagaatgttaaagggcaacctggcggcagcgcaaaagatg

SEQ ID NO: 214030 - DNA, 103 bp, Artificial Sequence
  Synthetic Polynucleotide
taatacgactcactatagggcttcggccgtcgccgcgtcgcggccctttaaacagaggagataaaggatggcgacgcggaacctggcggcagcgcaaaagatg

SEQ ID NO: 214031 - DNA, 103 bp, Artificial Sequence
  Synthetic Polynucleotide
taatacgactcactatagggcgatggcgcgcttcggccgtcgccgcgtcgaacagaggagacgacgcatggacggccgaaacctggcggcagcgcaaaagatg

SEQ ID NO: 214032 - DNA, 103 bp, Artificial Sequence
  Synthetic Polynucleotide
taatacgactcactatagggggtgggcacccgatggcgcgcttcggccgtaacagaggagaacggccatggcgcgccataacctggcggcagcgcaaaagatg

SEQ ID NO: 214033 - DNA, 103 bp, Artificial Sequence
  Synthetic Polynucleotide
taatacgactcactatagggacagctcggtggtgggcacccgatggcgcgaacagaggagacgcgccatggggtgcccaaacctggcggcagcgcaaaagatg

SEQ ID NO: 214034 - DNA, 103 bp, Artificial Sequence
  Synthetic Polynucleotide
taatacgactcactatagggggaggtctgcacagctcggtggtgggcaccaacagaggagaggtgccatgcaccgagctaacctggcggcagcgcaaaagatg

SEQ ID NO: 214035 - DNA, 103 bp, Artificial Sequence
  Synthetic Polynucleotide
taatacgactcactatagggggcgggcccgggaggtctgcacagctcggtaacagaggagaaccgagatgtgcagacctaacctggcggcagcgcaaaagatg

SEQ ID NO: 214036 - DNA, 103 bp, Artificial Sequence
  Synthetic Polynucleotide
taatacgactcactatagggcgggggccggggcgggcccgggaggtctgcaacagaggagagcagacatgccgggcccgaacctggcggcagcgcaaaagatg

SEQ ID NO: 214037 - DNA, 103 bp, Artificial Sequence
  Synthetic Polynucleotide
taatacgactcactatagggtctagctgggggtcactgcgagccgcctcgaacagaggagacgaggcatgtcgcagtgaaacctggcggcagcgcaaaagatg

SEQ ID NO: 214038 - DNA, 103 bp, Artificial Sequence
  Synthetic Polynucleotide
taatacgactcactataggggaggcgggcgcgggggccggggcgggcccgaacagaggagacgggccatgcccggccccaacctggcggcagcgcaaaagatg

SEQ ID NO: 214039 - DNA, 103 bp, Artificial Sequence
  Synthetic Polynucleotide
taatacgactcactatagggcgctgtaaccgaggcgggcgcgggggccggaacagaggagaccggccatggcgcccgccaacctggcggcagcgcaaaagatg

SEQ ID NO: 214040 - DNA, 103 bp, Artificial Sequence
  Synthetic Polynucleotide
taatacgactcactatagggcgggcagctccgctgtaaccgaggcgggcgaacagaggagacgcccgatgcggttacagaacctggcggcagcgcaaaagatg

SEQ ID NO: 214041 - DNA, 103 bp, Artificial Sequence
  Synthetic Polynucleotide
taatacgactcactatagggcggccgtcgccgggcagctccgctgtaaccaacagaggagaggttacatgggagctgccaacctggcggcagcgcaaaagatg

SEQ ID NO: 214042 - DNA, 103 bp, Artificial Sequence
  Synthetic Polynucleotide
taatacgactcactatagggctgcaccatgcggccgtcgccgggcagctcaacagaggagagagctgatgggcgacggcaacctggcggcagcgcaaaagatg

SEQ ID NO: 214043 - DNA, 103 bp, Artificial Sequence
  Synthetic Polynucleotide
taatacgactcactataggggaggactcagctgcaccatgcggccgtcgcaacagaggagagcgacgatggcatggtgcaacctggcggcagcgcaaaagatg

SEQ ID NO: 214044 - DNA, 103 bp, Artificial Sequence
  Synthetic Polynucleotide
taatacgactcactataggggccagcgcgggaggactcagctgcaccatgaacagaggagacatggtatggctgagtccaacctggcggcagcgcaaaagatg

SEQ ID NO: 214045 - DNA, 103 bp, Artificial Sequence
  Synthetic Polynucleotide
taatacgactcactatagggggcgggggcagccagcgcgggaggactcagaacagaggagactgagtatgcccgcgctgaacctggcggcagcgcaaaagatg

SEQ ID NO: 214046 - DNA, 103 bp, Artificial Sequence
  Synthetic Polynucleotide
taatacgactcactatagggggccgggggcggcgggggcagccagcgcggaacagaggagaccgcgcatgctgcccccgaacctggcggcagcgcaaaagatg

SEQ ID NO: 214047 - DNA, 103 bp, Artificial Sequence
  Synthetic Polynucleotide
taatacgactcactatagggagcagcgcgcggccgggggcggcgggggcaaacagaggagatgccccatgcgcccccggaacctggcggcagcgcaaaagatg

SEQ ID NO: 214048 - DNA, 103 bp, Artificial Sequence
  Synthetic Polynucleotide
taatacgactcactataggggtcccgtccctctagctgggggtcactgcgaacagaggagacgcagtatgccccagctaaacctggcggcagcgcaaaagatg

SEQ ID NO: 214049 - DNA, 103 bp, Artificial Sequence
  Synthetic Polynucleotide
taatacgactcactataggggaggctgtagagcagcgcgcggccgggggcaacagaggagagcccccatgcgcgcgctgaacctggcggcagcgcaaaagatg

SEQ ID NO: 214050 - DNA, 103 bp, Artificial Sequence
  Synthetic Polynucleotide
taatacgactcactataggggcggctggctgaggctgtagagcagcgcgcaacagaggagagcgcgcatgtctacagccaacctggcggcagcgcaaaagatg

SEQ ID NO: 214051 - DNA, 103 bp, Artificial Sequence
  Synthetic Polynucleotide
taatacgactcactatagggagagaggccagcggctggctgaggctgtagaacagaggagactacagatgcagccagccaacctggcggcagcgcaaaagatg

SEQ ID NO: 214052 - DNA, 103 bp, Artificial Sequence
  Synthetic Polynucleotide
taatacgactcactatagggcccgctgccgagagaggccagcggctggctaacagaggagaagccagatgctggcctctaacctggcggcagcgcaaaagatg

SEQ ID NO: 214053 - DNA, 103 bp, Artificial Sequence
  Synthetic Polynucleotide
taatacgactcactatagggccccaaagaacccgctgccgagagaggccaaacagaggagatggcctatgtcggcagcgaacctggcggcagcgcaaaagatg

SEQ ID NO: 214054 - DNA, 103 bp, Artificial Sequence
  Synthetic Polynucleotide
taatacgactcactataggggcatccggctccccaaagaacccgctgccgaacagaggagacggcagatggttctttggaacctggcggcagcgcaaaagatg

SEQ ID NO: 214055 - DNA, 103 bp, Artificial Sequence
  Synthetic Polynucleotide
taatacgactcactatagggcatagggaaggcatccggctccccaaagaaaacagaggagattctttatggagccggataacctggcggcagcgcaaaagatg

SEQ ID NO: 214056 - DNA, 103 bp, Artificial Sequence
  Synthetic Polynucleotide
taatacgactcactatagggtggtggtgaacatagggaaggcatccggctaacagaggagaagccggatgccttccctaaacctggcggcagcgcaaaagatg

SEQ ID NO: 214057 - DNA, 103 bp, Artificial Sequence
  Synthetic Polynucleotide
taatacgactcactatagggactcgattgttggtggtgaacatagggaagaacagaggagacttcccatggttcaccacaacctggcggcagcgcaaaagatg

SEQ ID NO: 214058 - DNA, 103 bp, Artificial Sequence
  Synthetic Polynucleotide
taatacgactcactatagggtctcctcttcactcgattgttggtggtgaaaacagaggagattcaccatgaacaatcgaaacctggcggcagcgcaaaagatg

SEQ ID NO: 214059 - DNA, 103 bp, Artificial Sequence
  Synthetic Polynucleotide
taatacgactcactatagggcctcggccgcgtcccgtccctctagctgggaacagaggagacccagcatgagggacgggaacctggcggcagcgcaaaagatg

SEQ ID NO: 214060 - DNA, 103 bp, Artificial Sequence
  Synthetic Polynucleotide
taatacgactcactatagggagggggaaggtctcctcttcactcgattgtaacagaggagaacaatcatgtgaagaggaaacctggcggcagcgcaaaagatg

SEQ ID NO: 214061 - DNA, 103 bp, Artificial Sequence
  Synthetic Polynucleotide
taatacgactcactatagggtccatctcatagggggaaggtctcctcttcaacagaggagagaagagatgaccttccccaacctggcggcagcgcaaaagatg

SEQ ID NO: 214062 - DNA, 103 bp, Artificial Sequence
  Synthetic Polynucleotide
taatacgactcactatagggatcagtaatctccatctcatagggggaaggaacagaggagaccttccatgtatgagatgaacctggcggcagcgcaaaagatg

SEQ ID NO: 214063 - DNA, 103 bp, Artificial Sequence
  Synthetic Polynucleotide
taatacgactcactatagggtgtggggaccatcagtaatctccatctcataacagaggagaatgagaatgagattactgaacctggcggcagcgcaaaagatg

SEQ ID NO: 214064 - DNA, 103 bp, Artificial Sequence
  Synthetic Polynucleotide
taatacgactcactatagggacaactttggtgtggggaccatcagtaatcaacagaggagagattacatgtggtccccaaacctggcggcagcgcaaaagatg

SEQ ID NO: 214065 - DNA, 103 bp, Artificial Sequence
  Synthetic Polynucleotide
taatacgactcactataggggatacgccgcacaactttggtgtggggaccaacagaggagaggtcccatgaccaaagttaacctggcggcagcgcaaaagatg

SEQ ID NO: 214066 - DNA, 103 bp, Artificial Sequence
  Synthetic Polynucleotide
taatacgactcactatagggtgttggtgaagatacgccgcacaactttggaacagaggagaccaaagatgtgcggcgtaaacctggcggcagcgcaaaagatg

SEQ ID NO: 214067 - DNA, 103 bp, Artificial Sequence
  Synthetic Polynucleotide
taatacgactcactatagggcgctcccggctgttggtgaagatacgccgcaacagaggagagcggcgatgcttcaccaaaacctggcggcagcgcaaaagatg

SEQ ID NO: 214068 - DNA, 103 bp, Artificial Sequence
  Synthetic Polynucleotide
taatacgactcactatagggctgccgccatcgctcccggctgttggtgaaaacagaggagattcaccatgagccgggagaacctggcggcagcgcaaaagatg

SEQ ID NO: 214069 - DNA, 103 bp, Artificial Sequence
  Synthetic Polynucleotide
taatacgactcactatagggtcacattctgctgccgccatcgctcccggcaacagaggagagccgggatggatggcggcaacctggcggcagcgcaaaagatg

SEQ ID NO: 214070 - DNA, 103 bp, Artificial Sequence
  Synthetic Polynucleotide
taatacgactcactataggggccatgctggcctcggccgcgtcccgtcccaacagaggagagggacgatgcgcggccgaaacctggcggcagcgcaaaagatg

SEQ ID NO: 214071 - DNA, 103 bp, Artificial Sequence
  Synthetic Polynucleotide
taatacgactcactatagggaaggccccgttcacattctgctgccgccataacagaggagaatggcgatggcagaatgtaacctggcggcagcgcaaaagatg

SEQ ID NO: 214072 - DNA, 103 bp, Artificial Sequence
  Synthetic Polynucleotide
taatacgactcactataggggagctcggcaaaggccccgttcacattctgaacagaggagacagaatatgaacggggccaacctggcggcagcgcaaaagatg

SEQ ID NO: 214073 - DNA, 103 bp, Artificial Sequence
  Synthetic Polynucleotide
taatacgactcactatagggtcagcttgcggagctcggcaaaggccccgtaacagaggagaacggggatgttgccgagcaacctggcggcagcgcaaaagatg

SEQ ID NO: 214074 - DNA, 103 bp, Artificial Sequence
  Synthetic Polynucleotide
taatacgactcactatagggtgtgtggggatcagcttgcggagctcggcaaacagaggagatgccgaatgccgcaagctaacctggcggcagcgcaaaagatg

SEQ ID NO: 214075 - DNA, 103 bp, Artificial Sequence
  Synthetic Polynucleotide
taatacgactcactataggggtccgggggatgtgtggggatcagcttgcgaacagaggagacgcaagatgatccccacaaacctggcggcagcgcaaaagatg

SEQ ID NO: 214076 - DNA, 103 bp, Artificial Sequence
  Synthetic Polynucleotide
taatacgactcactatagggtgagcttcttgtccgggggatgtgtggggaaacagaggagatccccaatgatcccccggaacctggcggcagcgcaaaagatg

SEQ ID NO: 214077 - DNA, 103 bp, Artificial Sequence
  Synthetic Polynucleotide
taatacgactcactatagggtcattcttgctgagcttcttgtccgggggaaacagaggagatcccccatgcaagaagctaacctggcggcagcgcaaaagatg

SEQ ID NO: 214078 - DNA, 103 bp, Artificial Sequence
  Synthetic Polynucleotide
taatacgactcactataggggcggaggatctcattcttgctgagcttcttaacagaggagaaagaagatgagcaagaataacctggcggcagcgcaaaagatg

SEQ ID NO: 214079 - DNA, 103 bp, Artificial Sequence
  Synthetic Polynucleotide
taatacgactcactatagggtcatggccaggcggaggatctcattcttgcaacagaggagagcaagaatgagatcctccaacctggcggcagcgcaaaagatg

SEQ ID NO: 214080 - DNA, 103 bp, Artificial Sequence
  Synthetic Polynucleotide
taatacgactcactatagggttgatatacttcatggccaggcggaggatcaacagaggagagatcctatgcctggccataacctggcggcagcgcaaaagatg

SEQ ID NO: 214081 - DNA, 103 bp, Artificial Sequence
  Synthetic Polynucleotide
taatacgactcactataggggtgcgggggggccatgctggcctcggccgcaacagaggagagcggccatggccagcatgaacctggcggcagcgcaaaagatg

SEQ ID NO: 214082 - DNA, 103 bp, Artificial Sequence
  Synthetic Polynucleotide
taatacgactcactatagggggccaagaagttgatatacttcatggccagaacagaggagactggccatgaagtatatcaacctggcggcagcgcaaaagatg

SEQ ID NO: 214083 - DNA, 103 bp, Artificial Sequence
  Synthetic Polynucleotide
taatacgactcactatagggtgagcagcttggccaagaagttgatatactaacagaggagaagtataatgacttcttggaacctggcggcagcgcaaaagatg

SEQ ID NO: 214084 - DNA, 103 bp, Artificial Sequence
  Synthetic Polynucleotide
taatacgactcactatagggtcctggtcattgagcagcttggccaagaagaacagaggagacttcttatgcaagctgctaacctggcggcagcgcaaaagatg

SEQ ID NO: 214085 - DNA, 103 bp, Artificial Sequence
  Synthetic Polynucleotide
taatacgactcactataggggccctcctcctcctggtcattgagcagcttaacagaggagaaagctgatgaatgaccagaacctggcggcagcgcaaaagatg

SEQ ID NO: 214086 - DNA, 103 bp, Artificial Sequence
  Synthetic Polynucleotide
taatacgactcactatagggcccgctgggtgccctcctcctcctggtcataacagaggagaatgaccatgaggaggaggaacctggcggcagcgcaaaagatg

SEQ ID NO: 214087 - DNA, 103 bp, Artificial Sequence
  Synthetic Polynucleotide
taatacgactcactatagggccagtcttggcccgctgggtgccctcctccaacagaggagaggaggaatgcacccagcgaacctggcggcagcgcaaaagatg

SEQ ID NO: 214088 - DNA, 103 bp, Artificial Sequence
  Synthetic Polynucleotide
taatacgactcactatagggagggtccttgccagtcttggcccgctgggtaacagaggagaacccagatggccaagactaacctggcggcagcgcaaaagatg

SEQ ID NO: 214089 - DNA, 103 bp, Artificial Sequence
  Synthetic Polynucleotide
taatacgactcactatagggcccccaccacagggtccttgccagtcttggaacagaggagaccaagaatggcaaggaccaacctggcggcagcgcaaaagatg

SEQ ID NO: 214090 - DNA, 103 bp, Artificial Sequence
  Synthetic Polynucleotide
taatacgactcactatagggcccccaccagcccccaccacagggtccttgaacagaggagacaaggaatgtgtggtgggaacctggcggcagcgcaaaagatg

SEQ ID NO: 214091 - DNA, 103 bp, Artificial Sequence
  Synthetic Polynucleotide
taatacgactcactatagggcccacctccacccccaccagcccccaccacaacagaggagagtggtgatggctggtgggaacctggcggcagcgcaaaagatg

SEQ ID NO: 214092 - DNA, 103 bp, Artificial Sequence
  Synthetic Polynucleotide
taatacgactcactataggggcaggaccaggtgcgggggggccatgctggaacagaggagaccagcaatgcccccccgcaacctggcggcagcgcaaaagatg

SEQ ID NO: 214093 - DNA, 103 bp, Artificial Sequence
  Synthetic Polynucleotide
taatacgactcactatagggcgccccctcccccacctccacccccaccagaacagaggagactggtgatggtggaggtgaacctggcggcagcgcaaaagatg

SEQ ID NO: 214094 - DNA, 103 bp, Artificial Sequence
  Synthetic Polynucleotide
taatacgactcactataggggggggcgcgccgccccctcccccacctccaaacagaggagatggaggatggggagggggaacctggcggcagcgcaaaagatg

SEQ ID NO: 214095 - DNA, 103 bp, Artificial Sequence
  Synthetic Polynucleotide
taatacgactcactataggggaggtcatctgggggcgcgccgccccctccaacagaggagaggagggatgggcgcgcccaacctggcggcagcgcaaaagatg

SEQ ID NO: 214096 - DNA, 103 bp, Artificial Sequence
  Synthetic Polynucleotide
taatacgactcactatagggcgtcttgcaggaggtcatctgggggcgcgcaacagaggagagcgcgcatgcagatgaccaacctggcggcagcgcaaaagatg

SEQ ID NO: 214097 - DNA, 103 bp, Artificial Sequence
  Synthetic Polynucleotide
taatacgactcactatagggggggaaagcacgtcttgcaggaggtcatctaacagaggagaagatgaatgcctgcaagaaacctggcggcagcgcaaaagatg

SEQ ID NO: 214098 - DNA, 103 bp, Artificial Sequence
  Synthetic Polynucleotide
taatacgactcactataggggctggagttgggggaaagcacgtcttgcagaacagaggagactgcaaatggtgctttccaacctggcggcagcgcaaaagatg

SEQ ID NO: 214099 - DNA, 103 bp, Artificial Sequence
  Synthetic Polynucleotide
taatacgactcactatagggagctgccgcagctggagttgggggaaagcaaacagaggagatgctttatgccaactccaaacctggcggcagcgcaaaagatg

SEQ ID NO: 214100 - DNA, 103 bp, Artificial Sequence
  Synthetic Polynucleotide
taatacgactcactatagggccatccagggagctgccgcagctggagttgaacagaggagacaactcatgctgcggcagaacctggcggcagcgcaaaagatg

SEQ ID NO: 214101 - DNA, 103 bp, Artificial Sequence
  Synthetic Polynucleotide
taatacgactcactataggggctggctgccccatccagggagctgccgcaaacagaggagatgcggcatgtccctggataacctggcggcagcgcaaaagatg

SEQ ID NO: 214102 - DNA, 103 bp, Artificial Sequence
  Synthetic Polynucleotide
taatacgactcactatagggagctgtccgggctggctgccccatccagggaacagaggagaccctggatggggcagccaaacctggcggcagcgcaaaagatg

SEQ ID NO: 214103 - DNA, 103 bp, Artificial Sequence
  Synthetic Polynucleotide
taatacgactcactatagggacgccgttcagcaggaccaggtgcggggggaacagaggagaccccccatgcctggtcctaacctggcggcagcgcaaaagatg

SEQ ID NO: 214104 - DNA, 103 bp, Artificial Sequence
  Synthetic Polynucleotide
taatacgactcactatagggtcctccgtgtagctgtccgggctggctgccaacagaggagaggcagcatgcccggacagaacctggcggcagcgcaaaagatg

SEQ ID NO: 214105 - DNA, 103 bp, Artificial Sequence
  Synthetic Polynucleotide
taatacgactcactataggggggcgcgggctcctccgtgtagctgtccggaacagaggagaccggacatgtacacggagaacctggcggcagcgcaaaagatg

SEQ ID NO: 214106 - DNA, 103 bp, Artificial Sequence
  Synthetic Polynucleotide
taatacgactcactatagggccgtgtgcttgggcgcgggctcctccgtgtaacagaggagaacacggatgagcccgcgcaacctggcggcagcgcaaaagatg

SEQ ID NO: 214107 - DNA, 103 bp, Artificial Sequence
  Synthetic Polynucleotide
taatacgactcactatagggaggctgcgggccgtgtgcttgggcgcgggcaacagaggagagcccgcatgcaagcacacaacctggcggcagcgcaaaagatg

SEQ ID NO: 214108 - DNA, 103 bp, Artificial Sequence
  Synthetic Polynucleotide
taatacgactcactatagggggcaggatggaggctgcgggccgtgtgcttaacagaggagaaagcacatggcccgcagcaacctggcggcagcgcaaaagatg

SEQ ID NO: 214109 - DNA, 103 bp, Artificial Sequence
  Synthetic Polynucleotide
taatacgactcactatagggcaggcagcatggcaggatggaggctgcgggaacagaggagacccgcaatgtccatcctgaacctggcggcagcgcaaaagatg

SEQ ID NO: 214110 - DNA, 103 bp, Artificial Sequence
  Synthetic Polynucleotide
taatacgactcactatagggccatcggcggcaggcagcatggcaggatggaacagaggagaccatccatgcatgctgccaacctggcggcagcgcaaaagatg

SEQ ID NO: 214111 - DNA, 103 bp, Artificial Sequence
  Synthetic Polynucleotide
taatacgactcactatagggagggccggctccatcggcggcaggcagcataacagaggagaatgctgatggccgccgataacctggcggcagcgcaaaagatg

SEQ ID NO: 214112 - DNA, 103 bp, Artificial Sequence
  Synthetic Polynucleotide
taatacgactcactatagggcctggtatttgtgaagatcttcctggtcataacagaggagaatgaccatgaagatcttcaacctggcggcagcgcaaaagatg

SEQ ID NO: 214113 - DNA, 103 bp, Artificial Sequence
  Synthetic Polynucleotide
taatacgactcactatagggtttgctcagctttttgtctggagggtgagtaacagaggagaactcacatgccagacaaaaacctggcggcagcgcaaaagatg

SEQ ID NO: 214114 - DNA, 103 bp, Artificial Sequence
  Synthetic Polynucleotide
taatacgactcactataggggcgtttcatttttgctcagctttttgtctgaacagaggagacagacaatgagctgagcaaacctggcggcagcgcaaaagatg

SEQ ID NO: 214115 - DNA, 103 bp, Artificial Sequence
  Synthetic Polynucleotide
taatacgactcactataggggccaggcgaagcgtttcatttttgctcagcaacagaggagagctgagatgaaatgaaacaacctggcggcagcgcaaaagatg

SEQ ID NO: 214116 - DNA, 103 bp, Artificial Sequence
  Synthetic Polynucleotide
taatacgactcactatagggatacctcattgccaggcgaagcgtttcattaacagaggagaaatgaaatgcttcgcctgaacctggcggcagcgcaaaagatg

SEQ ID NO: 214117 - DNA, 103 bp, Artificial Sequence
  Synthetic Polynucleotide
taatacgactcactatagggagaagttgatatacctcattgccaggcgaaaacagaggagattcgccatgcaatgaggtaacctggcggcagcgcaaaagatg

SEQ ID NO: 214118 - DNA, 103 bp, Artificial Sequence
  Synthetic Polynucleotide
taatacgactcactatagggaccttgaccaagaagttgatatacctcattaacagaggagaaatgagatgtatcaacttaacctggcggcagcgcaaaagatg

SEQ ID NO: 214119 - DNA, 103 bp, Artificial Sequence
  Synthetic Polynucleotide
taatacgactcactatagggctcccccaagaccttgaccaagaagttgataacagaggagaatcaacatgttggtcaagaacctggcggcagcgcaaaagatg

SEQ ID NO: 214120 - DNA, 103 bp, Artificial Sequence
  Synthetic Polynucleotide
taatacgactcactataggggcaggctttgctcccccaagaccttgaccaaacagaggagatggtcaatgtcttgggggaacctggcggcagcgcaaaagatg

SEQ ID NO: 214121 - DNA, 103 bp, Artificial Sequence
  Synthetic Polynucleotide
taatacgactcactatagggcccgtttgttgcaggctttgctcccccaagaacagaggagacttgggatggcaaagcctaacctggcggcagcgcaaaagatg

SEQ ID NO: 214122 - DNA, 103 bp, Artificial Sequence
  Synthetic Polynucleotide
taatacgactcactatagggagcagccactcccgtttgttgcaggctttgaacagaggagacaaagcatgcaacaaacgaacctggcggcagcgcaaaagatg

SEQ ID NO: 214123 - DNA, 103 bp, Artificial Sequence
  Synthetic Polynucleotide
taatacgactcactatagggtccaccgctccctggtatttgtgaagatctaacagaggagaagatctatgcaaataccaaacctggcggcagcgcaaaagatg

SEQ ID NO: 214124 - DNA, 103 bp, Artificial Sequence
  Synthetic Polynucleotide
taatacgactcactatagggtgttcccctgagcagccactcccgtttgttaacagaggagaaacaaaatggagtggctgaacctggcggcagcgcaaaagatg

SEQ ID NO: 214125 - DNA, 103 bp, Artificial Sequence
  Synthetic Polynucleotide
taatacgactcactatagggagccccagaatgttcccctgagcagccactaacagaggagaagtggcatgtcaggggaaaacctggcggcagcgcaaaagatg

SEQ ID NO: 214126 - DNA, 103 bp, Artificial Sequence
  Synthetic Polynucleotide
taatacgactcactatagggttgagggaagagccccagaatgttcccctgaacagaggagacaggggatgattctggggaacctggcggcagcgcaaaagatg

SEQ ID NO: 214127 - DNA, 103 bp, Artificial Sequence
  Synthetic Polynucleotide
taatacgactcactatagggggtggggtccttgagggaagagccccagaaaacagaggagattctggatgtcttccctcaacctggcggcagcgcaaaagatg

SEQ ID NO: 214128 - DNA, 103 bp, Artificial Sequence
  Synthetic Polynucleotide
taatacgactcactatagggaggcctggcaggtggggtccttgagggaagaacagaggagacttcccatgaggaccccaaacctggcggcagcgcaaaagatg

SEQ ID NO: 214129 - DNA, 103 bp, Artificial Sequence
  Synthetic Polynucleotide
taatacgactcactatagggtctgtcctccaggcctggcaggtggggtccaacagaggagaggacccatgctgccaggcaacctggcggcagcgcaaaagatg

SEQ ID NO: 214130 - DNA, 103 bp, Artificial Sequence
  Synthetic Polynucleotide
taatacgactcactatagggcaagcagagttctgtcctccaggcctggcaaacagaggagatgccagatgtggaggacaaacctggcggcagcgcaaaagatg

SEQ ID NO: 214131 - DNA, 103 bp, Artificial Sequence
  Synthetic Polynucleotide
taatacgactcactatagggtggtagttctcaagcagagttctgtcctccaacagaggagaggaggaatgaactctgctaacctggcggcagcgcaaaagatg

SEQ ID NO: 214132 - DNA, 103 bp, Artificial Sequence
  Synthetic Polynucleotide
taatacgactcactatagggtgaaggaacctggtagttctcaagcagagtaacagaggagaactctgatggagaactacaacctggcggcagcgcaaaagatg

SEQ ID NO: 214133 - DNA, 103 bp, Artificial Sequence
  Synthetic Polynucleotide
taatacgactcactatagggttggaccaggtgaaggaacctggtagttctaacagaggagaagaactatgaggttccttaacctggcggcagcgcaaaagatg

SEQ ID NO: 214134 - DNA, 103 bp, Artificial Sequence
  Synthetic Polynucleotide
taatacgactcactatagggttctgctgcctccaccgctccctggtatttaacagaggagaaaatacatgggagcggtgaacctggcggcagcgcaaaagatg

SEQ ID NO: 214135 - DNA, 103 bp, Artificial Sequence
  Synthetic Polynucleotide
taatacgactcactatagggatgtggtggcttggaccaggtgaaggaaccaacagaggagaggttccatgacctggtccaacctggcggcagcgcaaaagatg

SEQ ID NO: 214136 - DNA, 103 bp, Artificial Sequence
  Synthetic Polynucleotide
taatacgactcactataggggctgttgacattctgctgcctccaccgctcaacagaggagagagcggatgaggcagcagaacctggcggcagcgcaaaagatg

SEQ ID NO: 214137 - DNA, 103 bp, Artificial Sequence
  Synthetic Polynucleotide
taatacgactcactatagggtggcaaaggcgctgttgacattctgctgccaacagaggagaggcagcatgatgtcaacaaacctggcggcagcgcaaaagatg

SEQ ID NO: 214138 - DNA, 103 bp, Artificial Sequence
  Synthetic Polynucleotide
taatacgactcactatagggttcctcagcttggcaaaggcgctgttgacaaacagaggagatgtcaaatgcgcctttgcaacctggcggcagcgcaaaagatg

SEQ ID NO: 214139 - DNA, 103 bp, Artificial Sequence
  Synthetic Polynucleotide
taatacgactcactatagggggggatgagcttcctcagcttggcaaaggcaacagaggagagcctttatgaagctgaggaacctggcggcagcgcaaaagatg

SEQ ID NO: 214140 - DNA, 103 bp, Artificial Sequence
  Synthetic Polynucleotide
taatacgactcactataggggagggtgagtggggatgagcttcctcagctaacagaggagaagctgaatgagctcatccaacctggcggcagcgcaaaagatg

SEQ ID NO: 214141 - DNA, 103 bp, Artificial Sequence
  Synthetic Polynucleotide
taatacgactcactatagggtttttgtctggagggtgagtggggatgagcaacagaggagagctcatatgcactcacccaacctggcggcagcgcaaaagatg

SEQ ID NO: 214142 - DNA, 103 bp, Artificial Sequence
  Synthetic Polynucleotide
taatacgactcactatagggcgatgaagaggcgccagcgagctcggtcataacagaggagaatgaccatgctcgctggcaacctggcggcagcgcaaaagatg

SEQ ID NO: 214143 - DNA, 103 bp, Artificial Sequence
  Synthetic Polynucleotide
taatacgactcactataggggaagtgggaaccaccctctctccctcgcaaaacagaggagattgcgaatgagagagggtaacctggcggcagcgcaaaagatg

SEQ ID NO: 214144 - DNA, 103 bp, Artificial Sequence
  Synthetic Polynucleotide
taatacgactcactatagggctttcggttccatttcaaggcaaagatgggaacagaggagacccatcatggccttgaaaaacctggcggcagcgcaaaagatg

SEQ ID NO: 214145 - DNA, 103 bp, Artificial Sequence
  Synthetic Polynucleotide
taatacgactcactatagggtgtaattcccctttcggttccatttcaaggaacagaggagaccttgaatgggaaccgaaaacctggcggcagcgcaaaagatg

SEQ ID NO: 214146 - DNA, 103 bp, Artificial Sequence
  Synthetic Polynucleotide
taatacgactcactataggggcactcaaaatgtaattcccctttcggttcaacagaggagagaaccgatgggggaattaaacctggcggcagcgcaaaagatg

SEQ ID NO: 214147 - DNA, 103 bp, Artificial Sequence
  Synthetic Polynucleotide
taatacgactcactataggggtctacaccagcactcaaaatgtaattcccaacagaggagagggaatatgattttgagtaacctggcggcagcgcaaaagatg

SEQ ID NO: 214148 - DNA, 103 bp, Artificial Sequence
  Synthetic Polynucleotide
taatacgactcactatagggttgttgttttgtctacaccagcactcaaaaaacagaggagattttgaatgctggtgtagaacctggcggcagcgcaaaagatg

SEQ ID NO: 214149 - DNA, 103 bp, Artificial Sequence
  Synthetic Polynucleotide
taatacgactcactatagggtcccaaattattgttgttttgtctacaccaaacagaggagatggtgtatgcaaaacaacaacctggcggcagcgcaaaagatg

SEQ ID NO: 214150 - DNA, 103 bp, Artificial Sequence
  Synthetic Polynucleotide
taatacgactcactatagggtgtgtgggcatcccaaattattgttgttttaacagaggagaaaaacaatgataatttggaacctggcggcagcgcaaaagatg

SEQ ID NO: 214151 - DNA, 103 bp, Artificial Sequence
  Synthetic Polynucleotide
taatacgactcactatagggtggcttctcctgtgtgggcatcccaaattaaacagaggagataatttatgatgcccacaaacctggcggcagcgcaaaagatg

SEQ ID NO: 214152 - DNA, 103 bp, Artificial Sequence
  Synthetic Polynucleotide
taatacgactcactatagggaactgctgtttggcttctcctgtgtgggcaaacagaggagatgcccaatgaggagaagcaacctggcggcagcgcaaaagatg

SEQ ID NO: 214153 - DNA, 103 bp, Artificial Sequence
  Synthetic Polynucleotide
taatacgactcactatagggatgaaaaggaaactgctgtttggcttctccaacagaggagaggagaaatgaaacagcagaacctggcggcagcgcaaaagatg

SEQ ID NO: 214154 - DNA, 103 bp, Artificial Sequence
  Synthetic Polynucleotide
taatacgactcactatagggaggtgttgatgaagtgggaaccaccctctcaacagaggagagagaggatggttcccactaacctggcggcagcgcaaaagatg

SEQ ID NO: 214155 - DNA, 103 bp, Artificial Sequence
  Synthetic Polynucleotide
taatacgactcactatagggcaggggctgaatgaaaaggaaactgctgttaacagaggagaaacagcatgttccttttcaacctggcggcagcgcaaaagatg

SEQ ID NO: 214156 - DNA, 103 bp, Artificial Sequence
  Synthetic Polynucleotide
taatacgactcactatagggacatcaagggcaggggctgaatgaaaaggaaacagaggagatcctttatgttcagccccaacctggcggcagcgcaaaagatg

SEQ ID NO: 214157 - DNA, 103 bp, Artificial Sequence
  Synthetic Polynucleotide
taatacgactcactatagggctgccagtccacatcaagggcaggggctgaaacagaggagatcagccatggcccttgataacctggcggcagcgcaaaagatg

SEQ ID NO: 214158 - DNA, 103 bp, Artificial Sequence
  Synthetic Polynucleotide
taatacgactcactatagggtcgtgttgttctgccagtccacatcaagggaacagaggagacccttgatgtggactggcaacctggcggcagcgcaaaagatg

SEQ ID NO: 214159 - DNA, 103 bp, Artificial Sequence
  Synthetic Polynucleotide
taatacgactcactataggggaggcaaaggtcgtgttgttctgccagtccaacagaggagaggactgatggaacaacacaacctggcggcagcgcaaaagatg

SEQ ID NO: 214160 - DNA, 103 bp, Artificial Sequence
  Synthetic Polynucleotide
taatacgactcactatagggtgtgctacaggaggcaaaggtcgtgttgttaacagaggagaaacaacatgacctttgccaacctggcggcagcgcaaaagatg

SEQ ID NO: 214161 - DNA, 103 bp, Artificial Sequence
  Synthetic Polynucleotide
taatacgactcactatagggtacacatgtctgtgctacaggaggcaaaggaacagaggagacctttgatgcctgtagcaaacctggcggcagcgcaaaagatg

SEQ ID NO: 214162 - DNA, 103 bp, Artificial Sequence
  Synthetic Polynucleotide
taatacgactcactatagggcacacatggatacacatgtctgtgctacagaacagaggagactgtagatgagacatgtgaacctggcggcagcgcaaaagatg

SEQ ID NO: 214163 - DNA, 103 bp, Artificial Sequence
  Synthetic Polynucleotide
taatacgactcactataggggccgagcctgcacacatggatacacatgtcaacagaggagagacatgatgatccatgtgaacctggcggcagcgcaaaagatg

SEQ ID NO: 214164 - DNA, 103 bp, Artificial Sequence
  Synthetic Polynucleotide
taatacgactcactatagggggcggtcacagccgagcctgcacacatggaaacagaggagatccatgatggcaggctcgaacctggcggcagcgcaaaagatg

SEQ ID NO: 214165 - DNA, 103 bp, Artificial Sequence
  Synthetic Polynucleotide
taatacgactcactatagggcgcggcgatgaggtgttgatgaagtgggaaaacagaggagattcccaatgcatcaacacaacctggcggcagcgcaaaagatg

SEQ ID NO: 214166 - DNA, 103 bp, Artificial Sequence
  Synthetic Polynucleotide
taatacgactcactataggggttttgactgggcggtcacagccgagcctgaacagaggagacaggctatgctgtgaccgaacctggcggcagcgcaaaagatg

SEQ ID NO: 214167 - DNA, 103 bp, Artificial Sequence
  Synthetic Polynucleotide
taatacgactcactatagggtccctggaaggttttgactgggcggtcacaaacagaggagatgtgacatgccagtcaaaaacctggcggcagcgcaaaagatg

SEQ ID NO: 214168 - DNA, 103 bp, Artificial Sequence
  Synthetic Polynucleotide
taatacgactcactatagggcgtttgtgtgtccctggaaggttttgactgaacagaggagacagtcaatgccttccaggaacctggcggcagcgcaaaagatg

SEQ ID NO: 214169 - DNA, 103 bp, Artificial Sequence
  Synthetic Polynucleotide
taatacgactcactataggggcgttgacctcgtttgtgtgtccctggaagaacagaggagacttccaatgacacacaaaaacctggcggcagcgcaaaagatg

SEQ ID NO: 214170 - DNA, 103 bp, Artificial Sequence
  Synthetic Polynucleotide
taatacgactcactatagggccatttgatggcgttgacctcgtttgtgtgaacagaggagacacacaatggaggtcaacaacctggcggcagcgcaaaagatg

SEQ ID NO: 214171 - DNA, 103 bp, Artificial Sequence
  Synthetic Polynucleotide
taatacgactcactatagggcagacggatcccatttgatggcgttgacctaacagaggagaaggtcaatgccatcaaataacctggcggcagcgcaaaagatg

SEQ ID NO: 214172 - DNA, 103 bp, Artificial Sequence
  Synthetic Polynucleotide
taatacgactcactatagggagcaacattccagacggatcccatttgatgaacagaggagacatcaaatgggatccgtcaacctggcggcagcgcaaaagatg

SEQ ID NO: 214173 - DNA, 103 bp, Artificial Sequence
  Synthetic Polynucleotide
taatacgactcactataggggcaggatgccagcaacattccagacggatcaacagaggagagatccgatgggaatgttgaacctggcggcagcgcaaaagatg

SEQ ID NO: 214174 - DNA, 103 bp, Artificial Sequence
  Synthetic Polynucleotide
taatacgactcactatagggtgtcatccgagcaggatgccagcaacattcaacagaggagagaatgtatgtggcatcctaacctggcggcagcgcaaaagatg

SEQ ID NO: 214175 - DNA, 103 bp, Artificial Sequence
  Synthetic Polynucleotide
taatacgactcactatagggttcaatgtcatgtcatccgagcaggatgccaacagaggagaggcatcatgctcggatgaaacctggcggcagcgcaaaagatg

SEQ ID NO: 214176 - DNA, 103 bp, Artificial Sequence
  Synthetic Polynucleotide
taatacgactcactatagggagcctcacctcgcggcgatgaggtgttgataacagaggagaatcaacatgtcatcgccgaacctggcggcagcgcaaaagatg

SEQ ID NO: 214177 - DNA, 103 bp, Artificial Sequence
  Synthetic Polynucleotide
taatacgactcactataggggctccagatcttcaatgtcatgtcatccgaaacagaggagatcggatatgatgacattgaacctggcggcagcgcaaaagatg

SEQ ID NO: 214178 - DNA, 103 bp, Artificial Sequence
  Synthetic Polynucleotide
taatacgactcactatagggcctgtttcatgctccagatcttcaatgtcaaacagaggagatgacatatgagatctggaaacctggcggcagcgcaaaagatg

SEQ ID NO: 214179 - DNA, 103 bp, Artificial Sequence
  Synthetic Polynucleotide
taatacgactcactatagggatgcacacctcctgtttcatgctccagatcaacagaggagagatctgatgcatgaaacaaacctggcggcagcgcaaaagatg

SEQ ID NO: 214180 - DNA, 103 bp, Artificial Sequence
  Synthetic Polynucleotide
taatacgactcactatagggaagatcatggatgcacacctcctgtttcataacagaggagaatgaaaatggaggtgtgcaacctggcggcagcgcaaaagatg

SEQ ID NO: 214181 - DNA, 103 bp, Artificial Sequence
  Synthetic Polynucleotide
taatacgactcactatagggtgtgagcctgaagatcatggatgcacacctaacagaggagaaggtgtatgtccatgatcaacctggcggcagcgcaaaagatg

SEQ ID NO: 214182 - DNA, 103 bp, Artificial Sequence
  Synthetic Polynucleotide
taatacgactcactatagggatctctttattgtgagcctgaagatcatggaacagaggagaccatgaatgtcaggctcaaacctggcggcagcgcaaaagatg

SEQ ID NO: 214183 - DNA, 103 bp, Artificial Sequence
  Synthetic Polynucleotide
taatacgactcactataggggatggtgtagatctctttattgtgagcctgaacagaggagacaggctatgaataaagagaacctggcggcagcgcaaaagatg

SEQ ID NO: 214184 - DNA, 103 bp, Artificial Sequence
  Synthetic Polynucleotide
taatacgactcactatagggggctccacttgatggtgtagatctctttataacagaggagaataaagatgtctacaccaaacctggcggcagcgcaaaagatg

SEQ ID NO: 214185 - DNA, 103 bp, Artificial Sequence
  Synthetic Polynucleotide
taatacgactcactatagggggcccagtggggctccacttgatggtgtagaacagaggagactacacatgcaagtggagaacctggcggcagcgcaaaagatg

SEQ ID NO: 214186 - DNA, 103 bp, Artificial Sequence
  Synthetic Polynucleotide
taatacgactcactataggggctggtggcgggcccagtggggctccacttaacagaggagaaagtggatgcccactgggaacctggcggcagcgcaaaagatg

SEQ ID NO: 214187 - DNA, 103 bp, Artificial Sequence
  Synthetic Polynucleotide
taatacgactcactatagggtgctcatcttagcctcacctcgcggcgatgaacagaggagacatcgcatggaggtgaggaacctggcggcagcgcaaaagatg

SEQ ID NO: 214188 - DNA, 103 bp, Artificial Sequence
  Synthetic Polynucleotide
taatacgactcactatagggagtttgggttgctggtggcgggcccagtggaacagaggagaccactgatgccgccaccaaacctggcggcagcgcaaaagatg

SEQ ID NO: 214189 - DNA, 103 bp, Artificial Sequence
  Synthetic Polynucleotide
taatacgactcactatagggatgatgttggagtttgggttgctggtggcgaacagaggagacgccacatgcaacccaaaaacctggcggcagcgcaaaagatg

SEQ ID NO: 214190 - DNA, 103 bp, Artificial Sequence
  Synthetic Polynucleotide
taatacgactcactatagggacttgccaacatgatgttggagtttgggttaacagaggagaaacccaatgtccaacatcaacctggcggcagcgcaaaagatg

SEQ ID NO: 214191 - DNA, 103 bp, Artificial Sequence
  Synthetic Polynucleotide
taatacgactcactatagggcaaacgaagcacttgccaacatgatgttggaacagaggagaccaacaatgtgttggcaaaacctggcggcagcgcaaaagatg

SEQ ID NO: 214192 - DNA, 103 bp, Artificial Sequence
  Synthetic Polynucleotide
taatacgactcactatagggaccgtagaatcaaacgaagcacttgccaacaacagaggagagttggcatgtgcttcgttaacctggcggcagcgcaaaagatg

SEQ ID NO: 214193 - DNA, 103 bp, Artificial Sequence
  Synthetic Polynucleotide
taatacgactcactatagggccacagtcgcaccgtagaatcaaacgaagcaacagaggagagcttcgatggattctacgaacctggcggcagcgcaaaagatg

SEQ ID NO: 214194 - DNA, 103 bp, Artificial Sequence
  Synthetic Polynucleotide
taatacgactcactataggggttctatgtcccacagtcgcaccgtagaataacagaggagaattctaatgtgcgactgtaacctggcggcagcgcaaaagatg

SEQ ID NO: 214195 - DNA, 103 bp, Artificial Sequence
  Synthetic Polynucleotide
taatacgactcactatagggcagacgcctcgttctatgtcccacagtcgcaacagaggagagcgactatgggacatagaaacctggcggcagcgcaaaagatg

SEQ ID NO: 214196 - DNA, 103 bp, Artificial Sequence
  Synthetic Polynucleotide
taatacgactcactatagggcgtgtgggtgcagacgcctcgttctatgtcaacagaggagagacataatgcgaggcgtcaacctggcggcagcgcaaaagatg

SEQ ID NO: 214197 - DNA, 103 bp, Artificial Sequence
  Synthetic Polynucleotide
taatacgactcactataggggcttcgtgagcgtgtgggtgcagacgcctcaacagaggagagaggcgatggcacccacaaacctggcggcagcgcaaaagatg

SEQ ID NO: 214198 - DNA, 103 bp, Artificial Sequence
  Synthetic Polynucleotide
taatacgactcactatagggtcactggttatgctcatcttagcctcacctaacagaggagaaggtgaatgtaagatgagaacctggcggcagcgcaaaagatg

SEQ ID NO: 214199 - DNA, 103 bp, Artificial Sequence
  Synthetic Polynucleotide
taatacgactcactatagggggctcctgatgcttcgtgagcgtgtgggtgaacagaggagacacccaatggctcacgaaaacctggcggcagcgcaaaagatg

SEQ ID NO: 214200 - DNA, 103 bp, Artificial Sequence
  Synthetic Polynucleotide
taatacgactcactataggggctatagacaggctcctgatgcttcgtgagaacagaggagactcacgatgcatcaggagaacctggcggcagcgcaaaagatg

SEQ ID NO: 214201 - DNA, 103 bp, Artificial Sequence
  Synthetic Polynucleotide
taatacgactcactatagggtgaaagctacgctatagacaggctcctgataacagaggagaatcaggatgctgtctataaacctggcggcagcgcaaaagatg

SEQ ID NO: 214202 - DNA, 103 bp, Artificial Sequence
  Synthetic Polynucleotide
taatacgactcactatagggccatcagggctgaaagctacgctatagacaaacagaggagatgtctaatgcgtagctttaacctggcggcagcgcaaaagatg

SEQ ID NO: 214203 - DNA, 103 bp, Artificial Sequence
  Synthetic Polynucleotide
taatacgactcactatagggcaagtacttcccatcagggctgaaagctacaacagaggagagtagctatgagccctgataacctggcggcagcgcaaaagatg

SEQ ID NO: 214204 - DNA, 103 bp, Artificial Sequence
  Synthetic Polynucleotide
taatacgactcactatagggatccactggccaagtacttcccatcagggcaacagaggagagccctgatgggaagtactaacctggcggcagcgcaaaagatg

SEQ ID NO: 214205 - DNA, 103 bp, Artificial Sequence
  Synthetic Polynucleotide
taatacgactcactatagggttgtcgaaggatccactggccaagtacttcaacagaggagagaagtaatgggccagtggaacctggcggcagcgcaaaagatg

SEQ ID NO: 214206 - DNA, 103 bp, Artificial Sequence
  Synthetic Polynucleotide
taatacgactcactatagggatggacgcacttgtcgaaggatccactggcaacagaggagagccagtatgtccttcgacaacctggcggcagcgcaaaagatg

SEQ ID NO: 214207 - DNA, 103 bp, Artificial Sequence
  Synthetic Polynucleotide
taatacgactcactatagggtattccagatatggacgcacttgtcgaaggaacagaggagaccttcgatgagtgcgtccaacctggcggcagcgcaaaagatg

SEQ ID NO: 214208 - DNA, 103 bp, Artificial Sequence
  Synthetic Polynucleotide
taatacgactcactatagggccactctgagtattccagatatggacgcacaacagaggagagtgcgtatgtatctggaaaacctggcggcagcgcaaaagatg

SEQ ID NO: 214209 - DNA, 103 bp, Artificial Sequence
  Synthetic Polynucleotide
taatacgactcactataggggttcacctcgtcactggttatgctcatcttaacagaggagaaagatgatgataaccagtaacctggcggcagcgcaaaagatg

SEQ ID NO: 214210 - DNA, 103 bp, Artificial Sequence
  Synthetic Polynucleotide
taatacgactcactataggggacaagatttccactctgagtattccagataacagaggagaatctggatgactcagagtaacctggcggcagcgcaaaagatg

SEQ ID NO: 214211 - DNA, 103 bp, Artificial Sequence
  Synthetic Polynucleotide
taatacgactcactatagggggtagctgtggacaagatttccactctgagaacagaggagactcagaatggaaatcttgaacctggcggcagcgcaaaagatg

SEQ ID NO: 214212 - DNA, 103 bp, Artificial Sequence
  Synthetic Polynucleotide
taatacgactcactatagggccagtgcctcggtagctgtggacaagatttaacagaggagaaaatctatgccacagctaaacctggcggcagcgcaaaagatg

SEQ ID NO: 214213 - DNA, 103 bp, Artificial Sequence
  Synthetic Polynucleotide
taatacgactcactataggggaagatgccgccagtgcctcggtagctgtgaacagaggagacacagcatgcgaggcactaacctggcggcagcgcaaaagatg

SEQ ID NO: 214214 - DNA, 103 bp, Artificial Sequence
  Synthetic Polynucleotide
taatacgactcactatagggagcacacctcgaagatgccgccagtgcctcaacagaggagagaggcaatggcggcatctaacctggcggcagcgcaaaagatg

SEQ ID NO: 214215 - DNA, 103 bp, Artificial Sequence
  Synthetic Polynucleotide
taatacgactcactatagggcgggcgttccagcacacctcgaagatgccgaacagaggagacggcatatgcgaggtgtgaacctggcggcagcgcaaaagatg

SEQ ID NO: 214216 - DNA, 103 bp, Artificial Sequence
  Synthetic Polynucleotide
taatacgactcactatagggtttgtctcctcgggcgttccagcacacctcaacagaggagagaggtgatgtggaacgccaacctggcggcagcgcaaaagatg

SEQ ID NO: 214217 - DNA, 103 bp, Artificial Sequence
  Synthetic Polynucleotide
taatacgactcactatagggtggcacccactttgtctcctcgggcgttccaacagaggagaggaacgatggaggagacaaacctggcggcagcgcaaaagatg

SEQ ID NO: 214218 - DNA, 103 bp, Artificial Sequence
  Synthetic Polynucleotide
taatacgactcactatagggtcggacgcgctggcacccactttgtctcctaacagaggagaaggagaatgagtgggtgcaacctggcggcagcgcaaaagatg

SEQ ID NO: 214219 - DNA, 103 bp, Artificial Sequence
  Synthetic Polynucleotide
taatacgactcactatagggcacagagccgtcggacgcgctggcacccacaacagaggagagtgggtatgagcgcgtccaacctggcggcagcgcaaaagatg

SEQ ID NO: 214220 - DNA, 103 bp, Artificial Sequence
  Synthetic Polynucleotide
taatacgactcactatagggacaccagaaagttcacctcgtcactggttaaacagaggagataaccaatgacgaggtgaaacctggcggcagcgcaaaagatg

SEQ ID NO: 214221 - DNA, 103 bp, Artificial Sequence
  Synthetic Polynucleotide
taatacgactcactatagggccaaaacacacacagagccgtcggacgcgcaacagaggagagcgcgtatgacggctctgaacctggcggcagcgcaaaagatg

SEQ ID NO: 214222 - DNA, 103 bp, Artificial Sequence
  Synthetic Polynucleotide
taatacgactcactatagggttccgcagatccaaaacacacacagagccgaacagaggagacggctcatggtgtgttttaacctggcggcagcgcaaaagatg

SEQ ID NO: 214223 - DNA, 103 bp, Artificial Sequence
  Synthetic Polynucleotide
taatacgactcactatagggagataccgatacaccagaaagttcacctcgaacagaggagacgaggtatgctttctggtaacctggcggcagcgcaaaagatg

SEQ ID NO: 214224 - DNA, 103 bp, Artificial Sequence
  Synthetic Polynucleotide
taatacgactcactatagggtgactcctggagataccgatacaccagaaaaacagaggagatttctgatgtatcggtataacctggcggcagcgcaaaagatg

SEQ ID NO: 214225 - DNA, 103 bp, Artificial Sequence
  Synthetic Polynucleotide
taatacgactcactatagggggtggcagcacgatgaagaggcgccagcgaaacagaggagatcgctgatgcctcttcataacctggcggcagcgcaaaagatg

SEQ ID NO: 214226 - DNA, 103 bp, Artificial Sequence
  Synthetic Polynucleotide
taatacgactcactataggggggaaaaacctgactcctggagataccgataacagaggagaatcggtatgtccaggagtaacctggcggcagcgcaaaagatg

SEQ ID NO: 214227 - DNA, 103 bp, Artificial Sequence
  Synthetic Polynucleotide
taatacgactcactatagggaaagccgagtgggaaaaacctgactcctggaacagaggagaccaggaatgaggtttttcaacctggcggcagcgcaaaagatg

SEQ ID NO: 214228 - DNA, 103 bp, Artificial Sequence
  Synthetic Polynucleotide
taatacgactcactatagggcccaaacgtgaaagccgagtgggaaaaaccaacagaggagaggttttatgcactcggctaacctggcggcagcgcaaaagatg

SEQ ID NO: 214229 - DNA, 103 bp, Artificial Sequence
  Synthetic Polynucleotide
taatacgactcactatagggggctctcaatcccaaacgtgaaagccgagtaacagaggagaactcggatgtcacgtttgaacctggcggcagcgcaaaagatg

SEQ ID NO: 214230 - DNA, 103 bp, Artificial Sequence
  Synthetic Polynucleotide
taatacgactcactatagggtggctgatgtggctctcaatcccaaacgtgaacagaggagacacgttatggattgagagaacctggcggcagcgcaaaagatg

SEQ ID NO: 214231 - DNA, 103 bp, Artificial Sequence
  Synthetic Polynucleotide
taatacgactcactataggggatgttggactggctgatgtggctctcaataacagaggagaattgagatgcacatcagcaacctggcggcagcgcaaaagatg

SEQ ID NO: 214232 - DNA, 103 bp, Artificial Sequence
  Synthetic Polynucleotide
taatacgactcactataggggcgtcccattgatgttggactggctgatgtaacagaggagaacatcaatgagtccaacaaacctggcggcagcgcaaaagatg

SEQ ID NO: 214233 - DNA, 103 bp, Artificial Sequence
  Synthetic Polynucleotide
taatacgactcactatagggggtggcactagcgtcccattgatgttggacaacagaggagagtccaaatgcaatgggacaacctggcggcagcgcaaaagatg

SEQ ID NO: 214234 - DNA, 103 bp, Artificial Sequence
  Synthetic Polynucleotide
taatacgactcactataggggagggcggccggtggcactagcgtcccattaacagaggagaaatgggatgctagtgccaaacctggcggcagcgcaaaagatg

SEQ ID NO: 214235 - DNA, 103 bp, Artificial Sequence
  Synthetic Polynucleotide
taatacgactcactataggggaatggagatgagggcggccggtggcactaaacagaggagatagtgcatgcggccgcccaacctggcggcagcgcaaaagatg

SEQ ID NO: 214236 - DNA, 103 bp, Artificial Sequence
  Synthetic Polynucleotide
taatacgactcactatagggcctgcagggcggtggcagcacgatgaagagaacagaggagactcttcatggtgctgccaaacctggcggcagcgcaaaagatg

SEQ ID NO: 214237 - DNA, 103 bp, Artificial Sequence
  Synthetic Polynucleotide
taatacgactcactatagggcccttctggagaatggagatgagggcggccaacagaggagaggccgcatgcatctccataacctggcggcagcgcaaaagatg

SEQ ID NO: 214238 - DNA, 103 bp, Artificial Sequence
  Synthetic Polynucleotide
taatacgactcactatagggatactgcaggcccttctggagaatggagataacagaggagaatctccatgctccagaagaacctggcggcagcgcaaaagatg

SEQ ID NO: 214239 - DNA, 103 bp, Artificial Sequence
  Synthetic Polynucleotide
taatacgactcactatagggcggcctctacatactgcaggcccttctggaaacagaggagatccagaatggcctgcagtaacctggcggcagcgcaaaagatg

SEQ ID NO: 214240 - DNA, 103 bp, Artificial Sequence
  Synthetic Polynucleotide
taatacgactcactatagggatactgatctcggcctctacatactgcaggaacagaggagacctgcaatgtgtagaggcaacctggcggcagcgcaaaagatg

SEQ ID NO: 214241 - DNA, 103 bp, Artificial Sequence
  Synthetic Polynucleotide
taatacgactcactatagggatcctcgttgatactgatctcggcctctacaacagaggagagtagagatggagatcagtaacctggcggcagcgcaaaagatg

SEQ ID NO: 214242 - DNA, 103 bp, Artificial Sequence
  Synthetic Polynucleotide
taatacgactcactatagggacactgtgccatcctcgttgatactgatctaacagaggagaagatcaatgtcaacgaggaacctggcggcagcgcaaaagatg

SEQ ID NO: 214243 - DNA, 103 bp, Artificial Sequence
  Synthetic Polynucleotide
taatacgactcactatagggcggccgtcgaacactgtgccatcctcgttgaacagaggagacaacgaatgtggcacagtaacctggcggcagcgcaaaagatg

SEQ ID NO: 214244 - DNA, 103 bp, Artificial Sequence
  Synthetic Polynucleotide
taatacgactcactatagggctctatggggcggccgtcgaacactgtgccaacagaggagaggcacaatgttcgacggcaacctggcggcagcgcaaaagatg

SEQ ID NO: 214245 - DNA, 103 bp, Artificial Sequence
  Synthetic Polynucleotide
taatacgactcactataggggtgacagggactctatggggcggccgtcgaaacagaggagatcgacgatggccccatagaacctggcggcagcgcaaaagatg

SEQ ID NO: 214246 - DNA, 103 bp, Artificial Sequence
  Synthetic Polynucleotide
taatacgactcactataggggcgtctatcagtgacagggactctatggggaacagaggagaccccatatggtccctgtcaacctggcggcagcgcaaaagatg

SEQ ID NO: 214247 - DNA, 103 bp, Artificial Sequence
  Synthetic Polynucleotide
taatacgactcactatagggggcccctcttcctgcagggcggtggcagcaaacagaggagatgctgcatgcgccctgcaaacctggcggcagcgcaaaagatg

SEQ ID NO: 214248 - DNA, 103 bp, Artificial Sequence
  Synthetic Polynucleotide
taatacgactcactataggggggcatcacggcgtctatcagtgacagggaaacagaggagatccctgatgctgatagacaacctggcggcagcgcaaaagatg

SEQ ID NO: 214249 - DNA, 103 bp, Artificial Sequence
  Synthetic Polynucleotide
taatacgactcactataggggcaccacgtcgggcatcacggcgtctatcaaacagaggagatgatagatgccgtgatgcaacctggcggcagcgcaaaagatg

SEQ ID NO: 214250 - DNA, 103 bp, Artificial Sequence
  Synthetic Polynucleotide
taatacgactcactatagggtgccgcgtctgcaccacgtcgggcatcacgaacagaggagacgtgatatgcgacgtggtaacctggcggcagcgcaaaagatg

SEQ ID NO: 214251 - DNA, 103 bp, Artificial Sequence
  Synthetic Polynucleotide
taatacgactcactataggggaatgcctgctgccgcgtctgcaccacgtcaacagaggagagacgtgatgcagacgcggaacctggcggcagcgcaaaagatg

SEQ ID NO: 214252 - DNA, 103 bp, Artificial Sequence
  Synthetic Polynucleotide
taatacgactcactataggggcttctctcggaatgcctgctgccgcgtctaacagaggagaagacgcatgagcaggcataacctggcggcagcgcaaaagatg

SEQ ID NO: 214253 - DNA, 103 bp, Artificial Sequence
  Synthetic Polynucleotide
taatacgactcactatagggtgctgagcgagcttctctcggaatgcctgcaacagaggagagcaggcatgccgagagaaaacctggcggcagcgcaaaagatg

SEQ ID NO: 214254 - DNA, 103 bp, Artificial Sequence
  Synthetic Polynucleotide
taatacgactcactatagggactggcttgctgctgagcgagcttctctcgaacagaggagacgagagatgctcgctcagaacctggcggcagcgcaaaagatg

SEQ ID NO: 214255 - DNA, 103 bp, Artificial Sequence
  Synthetic Polynucleotide
taatacgactcactatagggccgccgccgcactggcttgctgctgagcgaaacagaggagatcgctcatgagcaagccaaacctggcggcagcgcaaaagatg

SEQ ID NO: 214256 - DNA, 103 bp, Artificial Sequence
  Synthetic Polynucleotide
taatacgactcactataggggcagccgccgccgccgccgcactggcttgcaacagaggagagcaagcatgtgcggcggcaacctggcggcagcgcaaaagatg

SEQ ID NO: 214257 - DNA, 103 bp, Artificial Sequence
  Synthetic Polynucleotide
taatacgactcactatagggtgccgtggccgcagccgccgccgccgccgcaacagaggagagcggcgatggcggcggctaacctggcggcagcgcaaaagatg

SEQ ID NO: 214258 - DNA, 103 bp, Artificial Sequence
  Synthetic Polynucleotide
taatacgactcactatagggctgactgcatggcccctcttcctgcagggcaacagaggagagccctgatggaagaggggaacctggcggcagcgcaaaagatg

SEQ ID NO: 214259 - DNA, 103 bp, Artificial Sequence
  Synthetic Polynucleotide
taatacgactcactatagggctgtcgctgctgccgtggccgcagccgccgaacagaggagacggcggatgcggccacggaacctggcggcagcgcaaaagatg

SEQ ID NO: 214260 - DNA, 103 bp, Artificial Sequence
  Synthetic Polynucleotide
taatacgactcactataggggtggtggctgctgtcgctgctgccgtggccaacagaggagaggccacatgagcagcgacaacctggcggcagcgcaaaagatg

SEQ ID NO: 214261 - DNA, 103 bp, Artificial Sequence
  Synthetic Polynucleotide
taatacgactcactatagggggctgaggtcgtggtggctgctgtcgctgcaacagaggagagcagcgatggcagccaccaacctggcggcagcgcaaaagatg

SEQ ID NO: 214262 - DNA, 103 bp, Artificial Sequence
  Synthetic Polynucleotide
taatacgactcactataggggggaaacgccggctgaggtcgtggtggctgaacagaggagacagccaatgcgacctcagaacctggcggcagcgcaaaagatg

SEQ ID NO: 214263 - DNA, 103 bp, Artificial Sequence
  Synthetic Polynucleotide
taatacgactcactatagggggattttggtgggaaacgccggctgaggtcaacagaggagagacctcatgcggcgtttcaacctggcggcagcgcaaaagatg

SEQ ID NO: 214264 - DNA, 103 bp, Artificial Sequence
  Synthetic Polynucleotide
taatacgactcactataggggttcttcgatggattttggtgggaaacgccaacagaggagaggcgttatgcaccaaaataacctggcggcagcgcaaaagatg

SEQ ID NO: 214265 - DNA, 103 bp, Artificial Sequence
  Synthetic Polynucleotide
taatacgactcactatagggtggcctctctgttcttcgatggattttggtaacagaggagaaccaaaatgcatcgaagaaacctggcggcagcgcaaaagatg

SEQ ID NO: 214266 - DNA, 103 bp, Artificial Sequence
  Synthetic Polynucleotide
taatacgactcactatagggccattcaccgtggcctctctgttcttcgataacagaggagaatcgaaatgcagagaggcaacctggcggcagcgcaaaagatg

SEQ ID NO: 214267 - DNA, 103 bp, Artificial Sequence
  Synthetic Polynucleotide
taatacgactcactataggggttctcttccccattcaccgtggcctctctaacagaggagaagagagatgacggtgaataacctggcggcagcgcaaaagatg

SEQ ID NO: 214268 - DNA, 103 bp, Artificial Sequence
  Synthetic Polynucleotide
taatacgactcactatagggaatgtgctctgttctcttccccattcaccgaacagaggagacggtgaatggggaagagaaacctggcggcagcgcaaaagatg

SEQ ID NO: 214269 - DNA, 103 bp, Artificial Sequence
  Synthetic Polynucleotide
taatacgactcactatagggtggtgcaagactgactgcatggcccctcttaacagaggagaaagaggatgcatgcagtcaacctggcggcagcgcaaaagatg

SEQ ID NO: 214270 - DNA, 103 bp, Artificial Sequence
  Synthetic Polynucleotide
taatacgactcactatagggttattgactgaatgtgctctgttctcttccaacagaggagaggaagaatgcagagcacaaacctggcggcagcgcaaaagatg

SEQ ID NO: 214271 - DNA, 103 bp, Artificial Sequence
  Synthetic Polynucleotide
taatacgactcactatagggcttcgcgtgattattgactgaatgtgctctaacagaggagaagagcaatgtcagtcaataacctggcggcagcgcaaaagatg

SEQ ID NO: 214272 - DNA, 103 bp, Artificial Sequence
  Synthetic Polynucleotide
taatacgactcactatagggtttccattggcttcgcgtgattattgactgaacagaggagacagtcaatgatcacgcgaaacctggcggcagcgcaaaagatg

SEQ ID NO: 214273 - DNA, 103 bp, Artificial Sequence
  Synthetic Polynucleotide
taatacgactcactatagggtctccatctatttccattggcttcgcgtgaaacagaggagatcacgcatggccaatggaaacctggcggcagcgcaaaagatg

SEQ ID NO: 214274 - DNA, 103 bp, Artificial Sequence
  Synthetic Polynucleotide
taatacgactcactatagggaatctcaacctctccatctatttccattggaacagaggagaccaatgatgatagatggaaacctggcggcagcgcaaaagatg

SEQ ID NO: 214275 - DNA, 103 bp, Artificial Sequence
  Synthetic Polynucleotide
taatacgactcactatagggtgctggatggaatctcaacctctccatctaaacagaggagatagatgatgaggttgagaaacctggcggcagcgcaaaagatg

SEQ ID NO: 214276 - DNA, 103 bp, Artificial Sequence
  Synthetic Polynucleotide
taatacgactcactatagggactgtggctttgctggatggaatctcaaccaacagaggagaggttgaatgtccatccagaacctggcggcagcgcaaaagatg

SEQ ID NO: 214277 - DNA, 103 bp, Artificial Sequence
  Synthetic Polynucleotide
taatacgactcactataggggccccgaaggactgtggctttgctggatggaacagaggagaccatccatgaaagccacaaacctggcggcagcgcaaaagatg

SEQ ID NO: 214278 - DNA, 103 bp, Artificial Sequence
  Synthetic Polynucleotide
taatacgactcactatagggcagactcatggccccgaaggactgtggcttaacagaggagaaagccaatgtccttcgggaacctggcggcagcgcaaaagatg

SEQ ID NO: 214279 - DNA, 103 bp, Artificial Sequence
  Synthetic Polynucleotide
taatacgactcactatagggatgaacacctcagactcatggccccgaaggaacagaggagaccttcgatgccatgagtcaacctggcggcagcgcaaaagatg

SEQ ID NO: 214280 - DNA, 103 bp, Artificial Sequence
  Synthetic Polynucleotide
taatacgactcactatagggacgttgaaagtggtgcaagactgactgcataacagaggagaatgcagatggtcttgcacaacctggcggcagcgcaaaagatg

SEQ ID NO: 214281 - DNA, 103 bp, Artificial Sequence
  Synthetic Polynucleotide
taatacgactcactatagggccaggcacaaatgaacacctcagactcatgaacagaggagacatgagatggaggtgttcaacctggcggcagcgcaaaagatg

SEQ ID NO: 214282 - DNA, 103 bp, Artificial Sequence
  Synthetic Polynucleotide
taatacgactcactatagggtgacaggattccaggcacaaatgaacacctaacagaggagaaggtgtatgtttgtgcctaacctggcggcagcgcaaaagatg

SEQ ID NO: 214283 - DNA, 103 bp, Artificial Sequence
  Synthetic Polynucleotide
taatacgactcactatagggagcaaatcactgacaggattccaggcacaaaacagaggagattgtgcatggaatcctgtaacctggcggcagcgcaaaagatg

SEQ ID NO: 214284 - DNA, 103 bp, Artificial Sequence
  Synthetic Polynucleotide
taatacgactcactatagggtccggaggctagcaaatcactgacaggattaacagaggagaaatcctatgagtgatttgaacctggcggcagcgcaaaagatg

SEQ ID NO: 214285 - DNA, 103 bp, Artificial Sequence
  Synthetic Polynucleotide
taatacgactcactatagggagtctccagatccggaggctagcaaatcacaacagaggagagtgattatgtagcctccgaacctggcggcagcgcaaaagatg

SEQ ID NO: 214286 - DNA, 103 bp, Artificial Sequence
  Synthetic Polynucleotide
taatacgactcactatagggcttgcagttgagtctccagatccggaggctaacagaggagaagcctcatgatctggagaaacctggcggcagcgcaaaagatg

SEQ ID NO: 214287 - DNA, 103 bp, Artificial Sequence
  Synthetic Polynucleotide
taatacgactcactataggggttccatatccttgcagttgagtctccagaaacagaggagatctggaatgtcaactgcaaacctggcggcagcgcaaaagatg

SEQ ID NO: 214288 - DNA, 103 bp, Artificial Sequence
  Synthetic Polynucleotide
taatacgactcactatagggtctcattcaggttccatatccttgcagttgaacagaggagacaactgatgggatatggaaacctggcggcagcgcaaaagatg

SEQ ID NO: 214289 - DNA, 103 bp, Artificial Sequence
  Synthetic Polynucleotide
taatacgactcactatagggccgttgctattctcattcaggttccatatcaacagaggagagatatgatgcctgaatgaaacctggcggcagcgcaaaagatg

SEQ ID NO: 214290 - DNA, 103 bp, Artificial Sequence
  Synthetic Polynucleotide
taatacgactcactatagggggtggagcccccgttgctattctcattcagaacagaggagactgaatatgaatagcaacaacctggcggcagcgcaaaagatg

SEQ ID NO: 214291 - DNA, 103 bp, Artificial Sequence
  Synthetic Polynucleotide
taatacgactcactatagggtccctcgcaaacgttgaaagtggtgcaagaaacagaggagatcttgcatgactttcaacaacctggcggcagcgcaaaagatg

SEQ ID NO: 214292 - DNA, 103 bp, Artificial Sequence
  Synthetic Polynucleotide
taatacgactcactatagggacacgagctgggtggagcccccgttgctataacagaggagaatagcaatgggggctccaaacctggcggcagcgcaaaagatg

SEQ ID NO: 214293 - DNA, 103 bp, Artificial Sequence
  Synthetic Polynucleotide
taatacgactcactatagggcagtgcctcaacacgagctgggtggagcccaacagaggagagggctcatgccagctcgtaacctggcggcagcgcaaaagatg

SEQ ID NO: 214294 - DNA, 103 bp, Artificial Sequence
  Synthetic Polynucleotide
taatacgactcactatagggctctcgtatacagtgcctcaacacgagctgaacagaggagacagctcatgttgaggcacaacctggcggcagcgcaaaagatg

SEQ ID NO: 214295 - DNA, 103 bp, Artificial Sequence
  Synthetic Polynucleotide
taatacgactcactatagggcatggcccccctctcgtatacagtgcctcaaacagaggagatgaggcatggtatacgagaacctggcggcagcgcaaaagatg

SEQ ID NO: 214296 - DNA, 103 bp, Artificial Sequence
  Synthetic Polynucleotide
taatacgactcactatagggctcgggacgtcatggcccccctctcgtataaacagaggagatatacgatgggggggccaaacctggcggcagcgcaaaagatg

SEQ ID NO: 214297 - DNA, 103 bp, Artificial Sequence
  Synthetic Polynucleotide
taatacgactcactataggggtctttgttactcgggacgtcatggcccccaacagaggagagggggcatggacgtcccgaacctggcggcagcgcaaaagatg

SEQ ID NO: 214298 - DNA, 103 bp, Artificial Sequence
  Synthetic Polynucleotide
taatacgactcactataggggtgaggtgacgtctttgttactcgggacgtaacagaggagaacgtccatggtaacaaagaacctggcggcagcgcaaaagatg

SEQ ID NO: 214299 - DNA, 103 bp, Artificial Sequence
  Synthetic Polynucleotide
taatacgactcactatagggttccagtccagtgaggtgacgtctttgttaaacagaggagataacaaatgcgtcacctcaacctggcggcagcgcaaaagatg

SEQ ID NO: 214300 - DNA, 103 bp, Artificial Sequence
  Synthetic Polynucleotide
taatacgactcactatagggtccattggtattccagtccagtgaggtgacaacagaggagagtcaccatgctggactggaacctggcggcagcgcaaaagatg

SEQ ID NO: 214301 - DNA, 103 bp, Artificial Sequence
  Synthetic Polynucleotide
taatacgactcactatagggccaagagtgttccattggtattccagtccaaacagaggagatggactatgataccaatgaacctggcggcagcgcaaaagatg

SEQ ID NO: 214302 - DNA, 103 bp, Artificial Sequence
  Synthetic Polynucleotide
taatacgactcactatagggccaccctctctccctcgcaaacgttgaaagaacagaggagactttcaatgtttgcgaggaacctggcggcagcgcaaaagatg

SEQ ID NO: 214303 - DNA, 103 bp, Artificial Sequence
  Synthetic Polynucleotide
taatacgactcactataggggaacccgtagccaagagtgttccattggtaaacagaggagataccaaatgaacactcttaacctggcggcagcgcaaaagatg

SEQ ID NO: 214304 - DNA, 103 bp, Artificial Sequence
  Synthetic Polynucleotide
taatacgactcactatagggaccgtcatatgaacccgtagccaagagtgtaacagaggagaacactcatggctacgggtaacctggcggcagcgcaaaagatg

SEQ ID NO: 214305 - DNA, 103 bp, Artificial Sequence
  Synthetic Polynucleotide
taatacgactcactatagggttcttgcaaaaccgtcatatgaacccgtagaacagaggagactacggatgcatatgacgaacctggcggcagcgcaaaagatg

SEQ ID NO: 214306 - DNA, 103 bp, Artificial Sequence
  Synthetic Polynucleotide
taatacgactcactatagggtccgtccatattcttgcaaaaccgtcatataacagaggagaatatgaatgttttgcaagaacctggcggcagcgcaaaagatg

SEQ ID NO: 214307 - DNA, 103 bp, Artificial Sequence
  Synthetic Polynucleotide
taatacgactcactataggggttaccatcttccgtccatattcttgcaaaaacagaggagatttgcaatgatatggacgaacctggcggcagcgcaaaagatg

SEQ ID NO: 214308 - DNA, 103 bp, Artificial Sequence
  Synthetic Polynucleotide
taatacgactcactatagggtgctggccaggttaccatcttccgtccataaacagaggagatatggaatgaagatggtaaacctggcggcagcgcaaaagatg

SEQ ID NO: 214309 - DNA, 103 bp, Artificial Sequence
  Synthetic Polynucleotide
taatacgactcactatagggtggcctaaggtgctggccaggttaccatctaacagaggagaagatggatgcctggccagaacctggcggcagcgcaaaagatg

SEQ ID NO: 214310 - DNA, 103 bp, Artificial Sequence
  Synthetic Polynucleotide
taatacgactcactataggggcctttatgttggcctaaggtgctggccagaacagaggagactggccatgaccttaggcaacctggcggcagcgcaaaagatg

SEQ ID NO: 214311 - DNA, 103 bp, Artificial Sequence
  Synthetic Polynucleotide
taatacgactcactatagggcaaagatggggcctttatgttggcctaaggaacagaggagaccttagatgaacataaagaacctggcggcagcgcaaaagatg

SEQ ID NO: 214312 - DNA, 103 bp, Artificial Sequence
  Synthetic Polynucleotide
taatacgactcactatagggcatttcaaggcaaagatggggcctttatgtaacagaggagaacataaatgccccatcttaacctggcggcagcgcaaaagatg

SEQ ID NO: 214313 - DNA, 103 bp, Artificial Sequence
  Synthetic Polynucleotide
taatacgactcactataggggaagttgacctcatcactgcttatactcataacagaggagaatgagtatgagcagtgataacctggcggcagcgcaaaagatg

SEQ ID NO: 214314 - DNA, 103 bp, Artificial Sequence
  Synthetic Polynucleotide
taatacgactcactatagggatttatattggactgactgatatggctttcaacagaggagagaaagcatgatcagtcagaacctggcggcagcgcaaaagatg

SEQ ID NO: 214315 - DNA, 103 bp, Artificial Sequence
  Synthetic Polynucleotide
taatacgactcactatagggtctgtcttgtcctaatttacagacatgaataacagaggagaattcatatgtgtaaattaaacctggcggcagcgcaaaagatg

SEQ ID NO: 214316 - DNA, 103 bp, Artificial Sequence
  Synthetic Polynucleotide
taatacgactcactatagggttttaataggtctgtcttgtcctaatttacaacagaggagagtaaatatggacaagacaaacctggcggcagcgcaaaagatg

SEQ ID NO: 214317 - DNA, 103 bp, Artificial Sequence
  Synthetic Polynucleotide
taatacgactcactatagggccttggaatgttttaataggtctgtcttgtaacagaggagaacaagaatgacctattaaaacctggcggcagcgcaaaagatg

SEQ ID NO: 214318 - DNA, 103 bp, Artificial Sequence
  Synthetic Polynucleotide
taatacgactcactatagggattcgtatgtccttggaatgttttaataggaacagaggagacctattatgacattccaaaacctggcggcagcgcaaaagatg

SEQ ID NO: 214319 - DNA, 103 bp, Artificial Sequence
  Synthetic Polynucleotide
taatacgactcactatagggcatttacttcattcgtatgtccttggaatgaacagaggagacattccatggacatacgaaacctggcggcagcgcaaaagatg

SEQ ID NO: 214320 - DNA, 103 bp, Artificial Sequence
  Synthetic Polynucleotide
taatacgactcactatagggcatttgatagcatttacttcattcgtatgtaacagaggagaacatacatgtgaagtaaaaacctggcggcagcgcaaaagatg

SEQ ID NO: 214321 - DNA, 103 bp, Artificial Sequence
  Synthetic Polynucleotide
taatacgactcactatagggagttgggtcccatttgatagcatttacttcaacagaggagagaagtaatggctatcaaaaacctggcggcagcgcaaaagatg

SEQ ID NO: 214322 - DNA, 103 bp, Artificial Sequence
  Synthetic Polynucleotide
taatacgactcactatagggagagattgccagttgggtcccatttgatagaacagaggagactatcaatggggacccaaaacctggcggcagcgcaaaagatg

SEQ ID NO: 214323 - DNA, 103 bp, Artificial Sequence
  Synthetic Polynucleotide
taatacgactcactatagggcaggaggccaagagattgccagttgggtccaacagaggagaggacccatgtggcaatctaacctggcggcagcgcaaaagatg

SEQ ID NO: 214324 - DNA, 103 bp, Artificial Sequence
  Synthetic Polynucleotide
taatacgactcactataggggtcgtcagaacaggaggccaagagattgccaacagaggagaggcaatatgttggcctccaacctggcggcagcgcaaaagatg

SEQ ID NO: 214325 - DNA, 103 bp, Artificial Sequence
  Synthetic Polynucleotide
taatacgactcactatagggcgagggcaccatttatattggactgactgaaacagaggagatcagtcatgccaatataaaacctggcggcagcgcaaaagatg

SEQ ID NO: 214326 - DNA, 103 bp, Artificial Sequence
  Synthetic Polynucleotide
taatacgactcactatagggttaaagtcatgtcgtcagaacaggaggccaaacagaggagatggcctatggttctgacgaacctggcggcagcgcaaaagatg

SEQ ID NO: 214327 - DNA, 103 bp, Artificial Sequence
  Synthetic Polynucleotide
taatacgactcactatagggctccatatctttaaagtcatgtcgtcagaaaacagaggagattctgaatgcatgactttaacctggcggcagcgcaaaagatg

SEQ ID NO: 214328 - DNA, 103 bp, Artificial Sequence
  Synthetic Polynucleotide
taatacgactcactatagggttgtttcatactccatatctttaaagtcataacagaggagaatgactatgaagatatggaacctggcggcagcgcaaaagatg

SEQ ID NO: 214329 - DNA, 103 bp, Artificial Sequence
  Synthetic Polynucleotide
taatacgactcactatagggcacaattgtcttgtttcatactccatatctaacagaggagaagatatatggtatgaaacaacctggcggcagcgcaaaagatg

SEQ ID NO: 214330 - DNA, 103 bp, Artificial Sequence
  Synthetic Polynucleotide
taatacgactcactatagggaaatcatggacacaattgtcttgtttcataaacagaggagatatgaaatgagacaattgaacctggcggcagcgcaaaagatg

SEQ ID NO: 214331 - DNA, 103 bp, Artificial Sequence
  Synthetic Polynucleotide
taatacgactcactatagggatgtgcttgcaaatcatggacacaattgtcaacagaggagagacaatatggtccatgataacctggcggcagcgcaaaagatg

SEQ ID NO: 214332 - DNA, 103 bp, Artificial Sequence
  Synthetic Polynucleotide
taatacgactcactatagggtttctttattatgtgcttgcaaatcatggaaacagaggagatccatgatgtgcaagcacaacctggcggcagcgcaaaagatg

SEQ ID NO: 214333 - DNA, 103 bp, Artificial Sequence
  Synthetic Polynucleotide
taatacgactcactatagggatagtataaatttctttattatgtgcttgcaacagaggagagcaagcatgtaataaagaaacctggcggcagcgcaaaagatg

SEQ ID NO: 214334 - DNA, 103 bp, Artificial Sequence
  Synthetic Polynucleotide
taatacgactcactatagggactccatttgatagtataaatttctttattaacagaggagaaataaaatgatttatactaacctggcggcagcgcaaaagatg

SEQ ID NO: 214335 - DNA, 103 bp, Artificial Sequence
  Synthetic Polynucleotide
taatacgactcactataggggtcctgttggactccatttgatagtataaaaacagaggagatttataatgtcaaatggaaacctggcggcagcgcaaaagatg

SEQ ID NO: 214336 - DNA, 103 bp, Artificial Sequence
  Synthetic Polynucleotide
taatacgactcactataggggcgggtgggacgagggcaccatttatattgaacagaggagacaatatatgtggtgccctaacctggcggcagcgcaaaagatg

SEQ ID NO: 214337 - DNA, 103 bp, Artificial Sequence
  Synthetic Polynucleotide
taatacgactcactatagggttagtccctggtcctgttggactccatttgaacagaggagacaaatgatgtccaacaggaacctggcggcagcgcaaaagatg

SEQ ID NO: 214338 - DNA, 103 bp, Artificial Sequence
  Synthetic Polynucleotide
taatacgactcactatagggatttggattattagtccctggtcctgttggaacagaggagaccaacaatgccagggactaacctggcggcagcgcaaaagatg

SEQ ID NO: 214339 - DNA, 103 bp, Artificial Sequence
  Synthetic Polynucleotide
taatacgactcactatagggtaaggttggcatttggattattagtccctgaacagaggagacagggaatgataatccaaaacctggcggcagcgcaaaagatg

SEQ ID NO: 214340 - DNA, 103 bp, Artificial Sequence
  Synthetic Polynucleotide
taatacgactcactatagggcttgctaacataaggttggcatttggattaaacagaggagataatccatgtgccaacctaacctggcggcagcgcaaaagatg

SEQ ID NO: 214341 - DNA, 103 bp, Artificial Sequence
  Synthetic Polynucleotide
taatacgactcactatagggaaaggatgcacttgctaacataaggttggcaacagaggagagccaacatgatgttagcaaacctggcggcagcgcaaaagatg

SEQ ID NO: 214342 - DNA, 103 bp, Artificial Sequence
  Synthetic Polynucleotide
taatacgactcactatagggcagtagaatcaaaggatgcacttgctaacaaacagaggagatgttagatggtgcatcctaacctggcggcagcgcaaaagatg

SEQ ID NO: 214343 - DNA, 103 bp, Artificial Sequence
  Synthetic Polynucleotide
taatacgactcactatagggcataacctaacagtagaatcaaaggatgcaaacagaggagatgcatcatgtgattctacaacctggcggcagcgcaaaagatg

SEQ ID NO: 214344 - DNA, 103 bp, Artificial Sequence
  Synthetic Polynucleotide
taatacgactcactataggggtctacatcccataacctaacagtagaatcaacagaggagagattctatggttaggttaaacctggcggcagcgcaaaagatg

SEQ ID NO: 214345 - DNA, 103 bp, Artificial Sequence
  Synthetic Polynucleotide
taatacgactcactatagggatatccctcggtctacatcccataacctaaaacagaggagattaggtatggggatgtagaacctggcggcagcgcaaaagatg

SEQ ID NO: 214346 - DNA, 103 bp, Artificial Sequence
  Synthetic Polynucleotide
taatacgactcactataggggtatggatgcatatccctcggtctacatccaacagaggagaggatgtatgccgagggataacctggcggcagcgcaaaagatg

SEQ ID NO: 214347 - DNA, 103 bp, Artificial Sequence
  Synthetic Polynucleotide
taatacgactcactatagggaatcaatgcagcgggtgggacgagggcaccaacagaggagaggtgccatggtcccacccaacctggcggcagcgcaaaagatg

SEQ ID NO: 214348 - DNA, 103 bp, Artificial Sequence
  Synthetic Polynucleotide
taatacgactcactatagggttttgtcaaggtatggatgcatatccctcgaacagaggagacgagggatgtgcatccataacctggcggcagcgcaaaagatg

SEQ ID NO: 214349 - DNA, 103 bp, Artificial Sequence
  Synthetic Polynucleotide
taatacgactcactataggggctcttggtgttttgtcaaggtatggatgcaacagaggagagcatccatgccttgacaaaacctggcggcagcgcaaaagatg

SEQ ID NO: 214350 - DNA, 103 bp, Artificial Sequence
  Synthetic Polynucleotide
taatacgactcactatagggctgtacacaggctcttggtgttttgtcaagaacagaggagacttgacatgacaccaagaaacctggcggcagcgcaaaagatg

SEQ ID NO: 214351 - DNA, 103 bp, Artificial Sequence
  Synthetic Polynucleotide
taatacgactcactataggggaaagctacactgtacacaggctcttggtgaacagaggagacaccaaatgcctgtgtacaacctggcggcagcgcaaaagatg

SEQ ID NO: 214352 - DNA, 103 bp, Artificial Sequence
  Synthetic Polynucleotide
taatacgactcactatagggcatcaggactgaaagctacactgtacacagaacagaggagactgtgtatggtgtagcttaacctggcggcagcgcaaaagatg

SEQ ID NO: 214353 - DNA, 103 bp, Artificial Sequence
  Synthetic Polynucleotide
taatacgactcactatagggagatacctgccatcaggactgaaagctacaaacagaggagatgtagcatgcagtcctgaaacctggcggcagcgcaaaagatg

SEQ ID NO: 214354 - DNA, 103 bp, Artificial Sequence
  Synthetic Polynucleotide
taatacgactcactatagggaccacttgccagatacctgccatcaggactaacagaggagaagtcctatgggcaggtataacctggcggcagcgcaaaagatg

SEQ ID NO: 214355 - DNA, 103 bp, Artificial Sequence
  Synthetic Polynucleotide
taatacgactcactatagggtgtcaaaagaaccacttgccagatacctgcaacagaggagagcaggtatgtggcaagtgaacctggcggcagcgcaaaagatg

SEQ ID NO: 214356 - DNA, 103 bp, Artificial Sequence
  Synthetic Polynucleotide
taatacgactcactatagggtgtacacatttgtcaaaagaaccacttgccaacagaggagaggcaagatgttcttttgaaacctggcggcagcgcaaaagatg

SEQ ID NO: 214357 - DNA, 103 bp, Artificial Sequence
  Synthetic Polynucleotide
taatacgactcactataggggttccagatgtgtacacatttgtcaaaagaaacagaggagatcttttatgaaatgtgtaaacctggcggcagcgcaaaagatg

SEQ ID NO: 214358 - DNA, 103 bp, Artificial Sequence
  Synthetic Polynucleotide
taatacgactcactatagggggatgatagaaatcaatgcagcgggtgggaaacagaggagatcccacatgctgcattgaaacctggcggcagcgcaaaagatg

SEQ ID NO: 214359 - DNA, 103 bp, Artificial Sequence
  Synthetic Polynucleotide
taatacgactcactatagggctgtctgcgtgttccagatgtgtacacattaacagaggagaaatgtgatgacatctggaaacctggcggcagcgcaaaagatg

SEQ ID NO: 214360 - DNA, 103 bp, Artificial Sequence
  Synthetic Polynucleotide
taatacgactcactatagggactagagcacctgtctgcgtgttccagatgaacagaggagacatctgatgcacgcagacaacctggcggcagcgcaaaagatg

SEQ ID NO: 214361 - DNA, 103 bp, Artificial Sequence
  Synthetic Polynucleotide
taatacgactcactatagggatagctgtgaactagagcacctgtctgcgtaacagaggagaacgcagatgggtgctctaaacctggcggcagcgcaaaagatg

SEQ ID NO: 214362 - DNA, 103 bp, Artificial Sequence
  Synthetic Polynucleotide
taatacgactcactatagggctgttcccctatagctgtgaactagagcacaacagaggagagtgctcatgttcacagctaacctggcggcagcgcaaaagatg

SEQ ID NO: 214363 - DNA, 103 bp, Artificial Sequence
  Synthetic Polynucleotide
taatacgactcactatagggaatattccacctgttcccctatagctgtgaaacagaggagatcacagatgtaggggaacaacctggcggcagcgcaaaagatg

SEQ ID NO: 214364 - DNA, 103 bp, Artificial Sequence
  Synthetic Polynucleotide
taatacgactcactataggggcaaacttcaaatattccacctgttcccctaacagaggagaaggggaatgggtggaataaacctggcggcagcgcaaaagatg

SEQ ID NO: 214365 - DNA, 103 bp, Artificial Sequence
  Synthetic Polynucleotide
taatacgactcactatagggctgcattccagcaaacttcaaatattccacaacagaggagagtggaaatgttgaagtttaacctggcggcagcgcaaaagatg

SEQ ID NO: 214366 - DNA, 103 bp, Artificial Sequence
  Synthetic Polynucleotide
taatacgactcactatagggttgtctcctgctgcattccagcaaacttcaaacagaggagatgaagtatgctggaatgcaacctggcggcagcgcaaaagatg

SEQ ID NO: 214367 - DNA, 103 bp, Artificial Sequence
  Synthetic Polynucleotide
taatacgactcactatagggggctccaactttgtctcctgctgcattccaaacagaggagatggaatatggcaggagacaacctggcggcagcgcaaaagatg

SEQ ID NO: 214368 - DNA, 103 bp, Artificial Sequence
  Synthetic Polynucleotide
taatacgactcactatagggctgatgcactggctccaactttgtctcctgaacagaggagacaggagatgaagttggagaacctggcggcagcgcaaaagatg

SEQ ID NO: 214369 - DNA, 103 bp, Artificial Sequence
  Synthetic Polynucleotide
taatacgactcactatagggagacctttctggatgatagaaatcaatgcaaacagaggagatgcattatgttctatcataacctggcggcagcgcaaaagatg

SEQ ID NO: 214370 - DNA, 103 bp, Artificial Sequence
  Synthetic Polynucleotide
taatacgactcactatagggactgaaccatctgatgcactggctccaactaacagaggagaagttggatgcagtgcatcaacctggcggcagcgcaaaagatg

SEQ ID NO: 214371 - DNA, 103 bp, Artificial Sequence
  Synthetic Polynucleotide
taatacgactcactatagggtaatacacaaactgaaccatctgatgcactaacagaggagaagtgcaatggatggttcaaacctggcggcagcgcaaaagatg

SEQ ID NO: 214372 - DNA, 103 bp, Artificial Sequence
  Synthetic Polynucleotide
taatacgactcactatagggtccgaaggtctaatacacaaactgaaccataacagaggagaatggttatgtttgtgtataacctggcggcagcgcaaaagatg

SEQ ID NO: 214373 - DNA, 103 bp, Artificial Sequence
  Synthetic Polynucleotide
taatacgactcactatagggtacatactgtagacctttctggatgatagaaacagaggagatctatcatgcagaaaggtaacctggcggcagcgcaaaagatg

SEQ ID NO: 214374 - DNA, 103 bp, Artificial Sequence
  Synthetic Polynucleotide
taatacgactcactatagggcttctgcttctacatactgtagacctttctaacagaggagaagaaagatgtacagtatgaacctggcggcagcgcaaaagatg

SEQ ID NO: 214375 - DNA, 103 bp, Artificial Sequence
  Synthetic Polynucleotide
taatacgactcactatagggttaatactaacttctgcttctacatactgtaacagaggagaacagtaatgagaagcagaaacctggcggcagcgcaaaagatg

SEQ ID NO: 214376 - DNA, 103 bp, Artificial Sequence
  Synthetic Polynucleotide
taatacgactcactatagggaccatcctcattaatactaacttctgcttcaacagaggagagaagcaatggttagtattaacctggcggcagcgcaaaagatg

SEQ ID NO: 214377 - DNA, 103 bp, Artificial Sequence
  Synthetic Polynucleotide
taatacgactcactatagggtatataccaagaagttgacctcatcactgcaacagaggagagcagtgatgaggtcaactaacctggcggcagcgcaaaagatg

SEQ ID NO: 214378 - DNA, 103 bp, Artificial Sequence
  Synthetic Polynucleotide
taatacgactcactatagggcaaacaaggtaccatcctcattaatactaaaacagaggagattagtaatgatgaggatgaacctggcggcagcgcaaaagatg

SEQ ID NO: 214379 - DNA, 103 bp, Artificial Sequence
  Synthetic Polynucleotide
taatacgactcactatagggggtcgaccatcaaacaaggtaccatcctcaaacagaggagatgaggaatgtaccttgttaacctggcggcagcgcaaaagatg

SEQ ID NO: 214380 - DNA, 103 bp, Artificial Sequence
  Synthetic Polynucleotide
taatacgactcactatagggagactctattggtcgaccatcaaacaaggtaacagaggagaaccttgatggatggtcgaaacctggcggcagcgcaaaagatg

SEQ ID NO: 214381 - DNA, 103 bp, Artificial Sequence
  Synthetic Polynucleotide
taatacgactcactatagggtcagggacagagactctattggtcgaccataacagaggagaatggtcatgcaatagagtaacctggcggcagcgcaaaagatg

SEQ ID NO: 214382 - DNA, 103 bp, Artificial Sequence
  Synthetic Polynucleotide
taatacgactcactatagggacggcatctatcagggacagagactctattaacagaggagaaatagaatgtctgtccctaacctggcggcagcgcaaaagatg

SEQ ID NO: 214383 - DNA, 103 bp, Artificial Sequence
  Synthetic Polynucleotide
taatacgactcactatagggatcaggcattacggcatctatcagggacagaacagaggagactgtccatgatagatgccaacctggcggcagcgcaaaagatg

SEQ ID NO: 214384 - DNA, 103 bp, Artificial Sequence
  Synthetic Polynucleotide
taatacgactcactatagggtttgtactacatcaggcattacggcatctaaacagaggagatagatgatgtaatgcctgaacctggcggcagcgcaaaagatg

SEQ ID NO: 214385 - DNA, 103 bp, Artificial Sequence
  Synthetic Polynucleotide
taatacgactcactatagggtgttgtcttgtttgtactacatcaggcattaacagaggagaaatgccatgtgtagtacaaacctggcggcagcgcaaaagatg

SEQ ID NO: 214386 - DNA, 103 bp, Artificial Sequence
  Synthetic Polynucleotide
taatacgactcactatagggtctataagcttgttgtcttgtttgtactacaacagaggagagtagtaatgacaagacaaaacctggcggcagcgcaaaagatg

SEQ ID NO: 214387 - DNA, 103 bp, Artificial Sequence
  Synthetic Polynucleotide
taatacgactcactatagggcaagcttatctctataagcttgttgtcttgaacagaggagacaagacatgaagcttataaacctggcggcagcgcaaaagatg

SEQ ID NO: 214388 - DNA, 103 bp, Artificial Sequence
  Synthetic Polynucleotide
taatacgactcactatagggtgcaagtatctatataccaagaagttgaccaacagaggagaggtcaaatgcttggtataaacctggcggcagcgcaaaagatg

SEQ ID NO: 214389 - DNA, 103 bp, Artificial Sequence
  Synthetic Polynucleotide
taatacgactcactatagggtgttgctgtgcaagcttatctctataagctaacagaggagaagcttaatgagataagctaacctggcggcagcgcaaaagatg

SEQ ID NO: 214390 - DNA, 103 bp, Artificial Sequence
  Synthetic Polynucleotide
taatacgactcactatagggagctgctgcctgttgctgtgcaagcttatcaacagaggagagataagatggcacagcaaaacctggcggcagcgcaaaagatg

SEQ ID NO: 214391 - DNA, 103 bp, Artificial Sequence
  Synthetic Polynucleotide
taatacgactcactatagggcagctgcagcagctgctgcctgttgctgtgaacagaggagacacagcatgaggcagcagaacctggcggcagcgcaaaagatg

SEQ ID NO: 214392 - DNA, 103 bp, Artificial Sequence
  Synthetic Polynucleotide
taatacgactcactataggggcagctgcggcagctgcagcagctgctgccaacagaggagaggcagcatgtgctgcagcaacctggcggcagcgcaaaagatg

SEQ ID NO: 214393 - DNA, 103 bp, Artificial Sequence
  Synthetic Polynucleotide
taatacgactcactatagggttggctggctgcagctgcggcagctgcagcaacagaggagagctgcaatggccgcagctaacctggcggcagcgcaaaagatg

SEQ ID NO: 214394 - DNA, 103 bp, Artificial Sequence
  Synthetic Polynucleotide
taatacgactcactatagggcagatccttgttggctggctgcagctgcggaacagaggagaccgcagatgcagccagccaacctggcggcagcgcaaaagatg

SEQ ID NO: 214395 - DNA, 103 bp, Artificial Sequence
  Synthetic Polynucleotide
taatacgactcactatagggccattttttgcagatccttgttggctggctaacagaggagaagccagatgacaaggatcaacctggcggcagcgcaaaagatg

SEQ ID NO: 214396 - DNA, 103 bp, Artificial Sequence
  Synthetic Polynucleotide
taatacgactcactatagggtgtgttttctccattttttgcagatccttgaacagaggagacaaggaatggcaaaaaataacctggcggcagcgcaaaagatg

SEQ ID NO: 214397 - DNA, 103 bp, Artificial Sequence
  Synthetic Polynucleotide
taatacgactcactatagggccccatttgctgtgttttctccattttttgaacagaggagacaaaaaatggagaaaacaaacctggcggcagcgcaaaagatg

SEQ ID NO: 214398 - DNA, 103 bp, Artificial Sequence
  Synthetic Polynucleotide
taatacgactcactatagggccattctcctccccatttgctgtgttttctaacagaggagaagaaaaatgagcaaatggaacctggcggcagcgcaaaagatg

SEQ ID NO: 214399 - DNA, 103 bp, Artificial Sequence
  Synthetic Polynucleotide
taatacgactcactatagggtcctgactcttgcaagtatctatataccaaaacagaggagattggtaatgagatacttgaacctggcggcagcgcaaaagatg

SEQ ID NO: 214400 - DNA, 103 bp, Artificial Sequence
  Synthetic Polynucleotide
taatacgactcactatagggagtatgtgctccattctcctccccatttgcaacagaggagagcaaatatggaggagaataacctggcggcagcgcaaaagatg

SEQ ID NO: 214401 - DNA, 103 bp, Artificial Sequence
  Synthetic Polynucleotide
taatacgactcactatagggtatttgctatagtatgtgctccattctcctaacagaggagaaggagaatggagcacataaacctggcggcagcgcaaaagatg

SEQ ID NO: 214402 - DNA, 103 bp, Artificial Sequence
  Synthetic Polynucleotide
taatacgactcactatagggtcagtatgattatttgctatagtatgtgctaacagaggagaagcacaatgtatagcaaaaacctggcggcagcgcaaaagatg

SEQ ID NO: 214403 - DNA, 103 bp, Artificial Sequence
  Synthetic Polynucleotide
taatacgactcactatagggttccatcatatcagtatgattatttgctataacagaggagaatagcaatgaatcatactaacctggcggcagcgcaaaagatg

SEQ ID NO: 214404 - DNA, 103 bp, Artificial Sequence
  Synthetic Polynucleotide
taatacgactcactatagggccccatccacttccatcatatcagtatgataacagaggagaatcataatgatatgatggaacctggcggcagcgcaaaagatg

SEQ ID NO: 214405 - DNA, 103 bp, Artificial Sequence
  Synthetic Polynucleotide
taatacgactcactatagggatttcaacatccccatccacttccatcataaacagaggagatatgatatgagtggatggaacctggcggcagcgcaaaagatg

SEQ ID NO: 214406 - DNA, 103 bp, Artificial Sequence
  Synthetic Polynucleotide
taatacgactcactatagggattaggagggatttcaacatccccatccacaacagaggagagtggatatggatgttgaaaacctggcggcagcgcaaaagatg

SEQ ID NO: 214407 - DNA, 103 bp, Artificial Sequence
  Synthetic Polynucleotide
taatacgactcactatagggcaacagctttattaggagggatttcaacataacagaggagaatgttgatgtccctcctaaacctggcggcagcgcaaaagatg

SEQ ID NO: 214408 - DNA, 103 bp, Artificial Sequence
  Synthetic Polynucleotide
taatacgactcactatagggccccgcaacacaacagctttattaggagggaacagaggagaccctccatgtaaagctgtaacctggcggcagcgcaaaagatg

SEQ ID NO: 214409 - DNA, 103 bp, Artificial Sequence
  Synthetic Polynucleotide
taatacgactcactatagggagattcatggccccgcaacacaacagctttaacagaggagaaaagctatggtgttgcggaacctggcggcagcgcaaaagatg

SEQ ID NO: 214410 - DNA, 103 bp, Artificial Sequence
  Synthetic Polynucleotide
taatacgactcactatagggaatgagaaaatcctgactcttgcaagtatcaacagaggagagatactatgaagagtcagaacctggcggcagcgcaaaagatg

SEQ ID NO: 214411 - DNA, 103 bp, Artificial Sequence
  Synthetic Polynucleotide
taatacgactcactatagggtaaaaacttcagattcatggccccgcaacaaacagaggagatgttgcatggccatgaataacctggcggcagcgcaaaagatg

SEQ ID NO: 214412 - DNA, 103 bp, Artificial Sequence
  Synthetic Polynucleotide
taatacgactcactatagggcaggcacagataaaaacttcagattcatggaacagaggagaccatgaatgtgaagttttaacctggcggcagcgcaaaagatg

SEQ ID NO: 214413 - DNA, 103 bp, Artificial Sequence
  Synthetic Polynucleotide
taatacgactcactatagggaacagggttccaggcacagataaaaacttcaacagaggagagaagttatgatctgtgccaacctggcggcagcgcaaaagatg

SEQ ID NO: 214414 - DNA, 103 bp, Artificial Sequence
  Synthetic Polynucleotide
taatacgactcactatagggggagatcactaacagggttccaggcacagaaacagaggagatctgtgatgggaaccctgaacctggcggcagcgcaaaagatg

SEQ ID NO: 214415 - DNA, 103 bp, Artificial Sequence
  Synthetic Polynucleotide
taatacgactcactatagggcctgatgctaggagatcactaacagggttcaacagaggagagaacccatgtagtgatctaacctggcggcagcgcaaaagatg

SEQ ID NO: 214416 - DNA, 103 bp, Artificial Sequence
  Synthetic Polynucleotide
taatacgactcactataggggtctccagaccctgatgctaggagatcactaacagaggagaagtgatatgctagcatcaaacctggcggcagcgcaaaagatg

SEQ ID NO: 214417 - DNA, 103 bp, Artificial Sequence
  Synthetic Polynucleotide
taatacgactcactatagggttgctgttgagtctccagaccctgatgctaaacagaggagatagcatatgggtctggagaacctggcggcagcgcaaaagatg

SEQ ID NO: 214418 - DNA, 103 bp, Artificial Sequence
  Synthetic Polynucleotide
taatacgactcactatagggttccatattcttgctgttgagtctccagacaacagaggagagtctggatgctcaacagcaacctggcggcagcgcaaaagatg

SEQ ID NO: 214419 - DNA, 103 bp, Artificial Sequence
  Synthetic Polynucleotide
taatacgactcactatagggctcactaagattccatattcttgctgttgaaacagaggagatcaacaatgagaatatggaacctggcggcagcgcaaaagatg

SEQ ID NO: 214420 - DNA, 103 bp, Artificial Sequence
  Synthetic Polynucleotide
taatacgactcactatagggtggtgctgttctcactaagattccatattcaacagaggagagaatatatgatcttagtgaacctggcggcagcgcaaaagatg

SEQ ID NO: 214421 - DNA, 103 bp, Artificial Sequence
  Synthetic Polynucleotide
taatacgactcactataggggtaaatgctgaatgagaaaatcctgactctaacagaggagaagagtcatgattttctcaaacctggcggcagcgcaaaagatg

SEQ ID NO: 214422 - DNA, 103 bp, Artificial Sequence
  Synthetic Polynucleotide
taatacgactcactataggggtagagccactggtgctgttctcactaagaaacagaggagatcttagatggaacagcacaacctggcggcagcgcaaaagatg

SEQ ID NO: 214423 - DNA, 103 bp, Artificial Sequence
  Synthetic Polynucleotide
taatacgactcactatagggtactaactgtgtagagccactggtgctgttaacagaggagaaacagcatgagtggctctaacctggcggcagcgcaaaagatg

SEQ ID NO: 214424 - DNA, 103 bp, Artificial Sequence
  Synthetic Polynucleotide
taatacgactcactatagggaatgtctaagtactaactgtgtagagccacaacagaggagagtggctatgcacagttagaacctggcggcagcgcaaaagatg

SEQ ID NO: 214425 - DNA, 103 bp, Artificial Sequence
  Synthetic Polynucleotide
taatacgactcactatagggtctcgtatacaatgtctaagtactaactgtaacagaggagaacagttatgacttagacaaacctggcggcagcgcaaaagatg

SEQ ID NO: 214426 - DNA, 103 bp, Artificial Sequence
  Synthetic Polynucleotide
taatacgactcactatagggttgccctccttctcgtatacaatgtctaagaacagaggagacttagaatgtgtatacgaaacctggcggcagcgcaaaagatg

SEQ ID NO: 214427 - DNA, 103 bp, Artificial Sequence
  Synthetic Polynucleotide
taatacgactcactatagggttggaacatcttgccctccttctcgtatacaacagaggagagtatacatgaaggagggcaacctggcggcagcgcaaaagatg

SEQ ID NO: 214428 - DNA, 103 bp, Artificial Sequence
  Synthetic Polynucleotide
taatacgactcactatagggtccttgttgcttggaacatcttgccctcctaacagaggagaaggaggatgagatgttccaacctggcggcagcgcaaaagatg

SEQ ID NO: 214429 - DNA, 103 bp, Artificial Sequence
  Synthetic Polynucleotide
taatacgactcactatagggagatgtgacatccttgttgcttggaacatcaacagaggagagatgttatgagcaacaagaacctggcggcagcgcaaaagatg

SEQ ID NO: 214430 - DNA, 103 bp, Artificial Sequence
  Synthetic Polynucleotide
taatacgactcactatagggtccaatctagagatgtgacatccttgttgcaacagaggagagcaacaatgatgtcacataacctggcggcagcgcaaaagatg

SEQ ID NO: 214431 - DNA, 103 bp, Artificial Sequence
  Synthetic Polynucleotide
taatacgactcactatagggccttcactattccaatctagagatgtgacaaacagaggagatgtcacatgtctagattgaacctggcggcagcgcaaaagatg

SEQ ID NO: 214432 - DNA, 103 bp, Artificial Sequence
  Synthetic Polynucleotide
taatacgactcactatagggtataccaaaggtaaatgctgaatgagaaaaaacagaggagattttctatgtcagcatttaacctggcggcagcgcaaaagatg

SEQ ID NO: 214433 - DNA, 103 bp, Artificial Sequence
  Synthetic Polynucleotide
taatacgactcactatagggtagaagtgtaccttcactattccaatctagaacagaggagactagatatgaatagtgaaaacctggcggcagcgcaaaagatg

SEQ ID NO: 214434 - DNA, 103 bp, Artificial Sequence
  Synthetic Polynucleotide
taatacgactcactatagggaaccagttgctagaagtgtaccttcactataacagaggagaatagtgatggtacacttcaacctggcggcagcgcaaaagatg

SEQ ID NO: 214435 - DNA, 103 bp, Artificial Sequence
  Synthetic Polynucleotide
taatacgactcactatagggccatcataggaaccagttgctagaagtgtaaacagaggagatacactatgagcaactggaacctggcggcagcgcaaaagatg

SEQ ID NO: 214436 - DNA, 103 bp, Artificial Sequence
  Synthetic Polynucleotide
taatacgactcactatagggtctggcaaacccatcataggaaccagttgcaacagaggagagcaactatgtcctatgataacctggcggcagcgcaaaagatg

SEQ ID NO: 214437 - DNA, 103 bp, Artificial Sequence
  Synthetic Polynucleotide
taatacgactcactatagggtagtccatattctggcaaacccatcataggaacagaggagacctatgatgggtttgccaaacctggcggcagcgcaaaagatg

SEQ ID NO: 214438 - DNA, 103 bp, Artificial Sequence
  Synthetic Polynucleotide
taatacgactcactatagggttaccatctttagtccatattctggcaaacaacagaggagagtttgcatgaatatggacaacctggcggcagcgcaaaagatg

SEQ ID NO: 214439 - DNA, 103 bp, Artificial Sequence
  Synthetic Polynucleotide
taatacgactcactataggggctagcaaggttaccatctttagtccatataacagaggagaatatggatgaaagatggtaacctggcggcagcgcaaaagatg

SEQ ID NO: 214440 - DNA, 103 bp, Artificial Sequence
  Synthetic Polynucleotide
taatacgactcactataggggccctaaggtgctagcaaggttaccatcttaacagaggagaaagatgatgaccttgctaaacctggcggcagcgcaaaagatg

SEQ ID NO: 214441 - DNA, 103 bp, Artificial Sequence
  Synthetic Polynucleotide
taatacgactcactatagggcctttatgctgccctaaggtgctagcaaggaacagaggagaccttgcatgcaccttaggaacctggcggcagcgcaaaagatg

SEQ ID NO: 214442 - DNA, 103 bp, Artificial Sequence
  Synthetic Polynucleotide
taatacgactcactatagggaaatatagggcctttatgctgccctaaggtaacagaggagaaccttaatgcagcataaaaacctggcggcagcgcaaaagatg

SEQ ID NO: 214443 - DNA, 103 bp, Artificial Sequence
  Synthetic Polynucleotide
taatacgactcactatagggtatggctttctataccaaaggtaaatgctgaacagaggagacagcatatgcctttggtaaacctggcggcagcgcaaaagatg

SEQ ID NO: 214444 - DNA, 103 bp, Artificial Sequence
  Synthetic Polynucleotide
taatacgactcactatagggattttaatgcaaatatagggcctttatgctaacagaggagaagcataatggccctatataacctggcggcagcgcaaaagatg

SEQ ID NO: 214445 - DNA, 103 bp, Artificial Sequence
  Synthetic Polynucleotide
taatacgactcactatagggttcttattccattttaatgcaaatatagggaacagaggagaccctatatgtgcattaaaaacctggcggcagcgcaaaagatg

SEQ ID NO: 214446 - DNA, 103 bp, Artificial Sequence
  Synthetic Polynucleotide
taatacgactcactataggggaaatttcctttcttattccattttaatgcaacagaggagagcattaatgtggaataagaacctggcggcagcgcaaaagatg

SEQ ID NO: 214447 - DNA, 103 bp, Artificial Sequence
  Synthetic Polynucleotide
taatacgactcactatagggcacttaggatgaaatttcctttcttattccaacagaggagaggaataatgaaggaaattaacctggcggcagcgcaaaagatg

SEQ ID NO: 214448 - DNA, 103 bp, Artificial Sequence
  Synthetic Polynucleotide
taatacgactcactatagggtctactccagcacttaggatgaaatttcctaacagaggagaaggaaaatgcatcctaagaacctggcggcagcgcaaaagatg

SEQ ID NO: 214449 - DNA, 103 bp, Artificial Sequence
  Synthetic Polynucleotide
taatacgactcactatagggtgtagtcttgtctactccagcacttaggataacagaggagaatcctaatggctggagtaaacctggcggcagcgcaaaagatg

SEQ ID NO: 214450 - DNA, 103 bp, Artificial Sequence
  Synthetic Polynucleotide
taatacgactcactatagggcccaaataattgtagtcttgtctactccagaacagaggagactggagatgacaagactaaacctggcggcagcgcaaaagatg

SEQ ID NO: 214451 - DNA, 103 bp, Artificial Sequence
  Synthetic Polynucleotide
taatacgactcactataggggtatgtgcgtcccaaataattgtagtcttgaacagaggagacaagacatgaattatttgaacctggcggcagcgcaaaagatg

SEQ ID NO: 214452 - DNA, 103 bp, Artificial Sequence
  Synthetic Polynucleotide
taatacgactcactatagggggcttcaccagtatgtgcgtcccaaataataacagaggagaattattatggacgcacataacctggcggcagcgcaaaagatg

SEQ ID NO: 214453 - DNA, 103 bp, Artificial Sequence
  Synthetic Polynucleotide
taatacgactcactatagggactgttgcttggcttcaccagtatgtgcgtaacagaggagaacgcacatgctggtgaagaacctggcggcagcgcaaaagatg

SEQ ID NO: 214454 - DNA, 103 bp, Artificial Sequence
  Synthetic Polynucleotide
taatacgactcactataggggactgactgatatggctttctataccaaagaacagaggagactttggatgagaaagccaaacctggcggcagcgcaaaagatg

SEQ ID NO: 214455 - DNA, 103 bp, Artificial Sequence
  Synthetic Polynucleotide
taatacgactcactatagggtgaaaaggaaactgttgcttggcttcaccaaacagaggagatggtgaatgcaagcaacaaacctggcggcagcgcaaaagatg

SEQ ID NO: 214456 - DNA, 103 bp, Artificial Sequence
  Synthetic Polynucleotide
taatacgactcactatagggtggtgctgaatgaaaaggaaactgttgcttaacagaggagaaagcaaatgtttccttttaacctggcggcagcgcaaaagatg

SEQ ID NO: 214457 - DNA, 103 bp, Artificial Sequence
  Synthetic Polynucleotide
taatacgactcactatagggcatccaatgctggtgctgaatgaaaaggaaaacagaggagattccttatgattcagcacaacctggcggcagcgcaaaagatg

SEQ ID NO: 214458 - DNA, 103 bp, Artificial Sequence
  Synthetic Polynucleotide
taatacgactcactatagggtgccaatcaacatccaatgctggtgctgaaaacagaggagattcagcatgagcattggaaacctggcggcagcgcaaaagatg

SEQ ID NO: 214459 - DNA, 103 bp, Artificial Sequence
  Synthetic Polynucleotide
taatacgactcactataggggttgttgctctgccaatcaacatccaatgcaacagaggagagcattgatggttgattggaacctggcggcagcgcaaaagatg

SEQ ID NO: 214460 - DNA, 103 bp, Artificial Sequence
  Synthetic Polynucleotide
taatacgactcactatagggaagcaaaggtgttgttgctctgccaatcaaaacagaggagattgattatgagagcaacaaacctggcggcagcgcaaaagatg

SEQ ID NO: 214461 - DNA, 103 bp, Artificial Sequence
  Synthetic Polynucleotide
taatacgactcactataggggtactacaagaagcaaaggtgttgttgctcaacagaggagagagcaaatgcacctttgcaacctggcggcagcgcaaaagatg

SEQ ID NO: 214462 - DNA, 103 bp, Artificial Sequence
  Synthetic Polynucleotide
taatacgactcactataggggcacatatctgtactacaagaagcaaaggtaacagaggagaacctttatgtcttgtagtaacctggcggcagcgcaaaagatg

SEQ ID NO: 214463 - DNA, 103 bp, Artificial Sequence
  Synthetic Polynucleotide
taatacgactcactatagggagacatgaatgcacatatctgtactacaagaacagaggagacttgtaatgcagatatgtaacctggcggcagcgcaaaagatg

SEQ ID NO: 214464 - DNA, 103 bp, Artificial Sequence
  Synthetic Polynucleotide
taatacgactcactatagggcctaatttacagacatgaatgcacatatctaacagaggagaagatatatgcattcatgtaacctggcggcagcgcaaaagatg

SEQ ID NO: 214465 - DNA, 103 bp, Artificial Sequence
  Synthetic Polynucleotide
taatacgactcactataggggtaaggtggcaggctgttgttctgatccataacagaggagaatggatatgaacaacagcaacctggcggcagcgcaaaagatg

SEQ ID NO: 214466 - DNA, 103 bp, Artificial Sequence
  Synthetic Polynucleotide
taatacgactcactatagggtggggtcagtccagtgccataaggcatcataacagaggagaatgatgatgtatggcactaacctggcggcagcgcaaaagatg

SEQ ID NO: 214467 - DNA, 103 bp, Artificial Sequence
  Synthetic Polynucleotide
taatacgactcactatagggttacgtcgtcttcctgaatccctttagaataacagaggagaattctaatgggattcaggaacctggcggcagcgcaaaagatg

SEQ ID NO: 214468 - DNA, 103 bp, Artificial Sequence
  Synthetic Polynucleotide
taatacgactcactataggggaataggctgtggggtcagtccagtgccataacagaggagaatggcaatggactgacccaacctggcggcagcgcaaaagatg

SEQ ID NO: 214469 - DNA, 103 bp, Artificial Sequence
  Synthetic Polynucleotide
taatacgactcactatagggttggtgttctgaataggctgtggggtcagtaacagaggagaactgacatgacagcctataacctggcggcagcgcaaaagatg

SEQ ID NO: 214470 - DNA, 103 bp, Artificial Sequence
  Synthetic Polynucleotide
taatacgactcactatagggagacagactattggtgttctgaataggctgaacagaggagacagcctatgcagaacaccaacctggcggcagcgcaaaagatg

SEQ ID NO: 214471 - DNA, 103 bp, Artificial Sequence
  Synthetic Polynucleotide
taatacgactcactatagggcttccaaaatagacagactattggtgttctaacagaggagaagaacaatgatagtctgtaacctggcggcagcgcaaaagatg

SEQ ID NO: 214472 - DNA, 103 bp, Artificial Sequence
  Synthetic Polynucleotide
taatacgactcactatagggctttgttgctcttccaaaatagacagactaaacagaggagatagtctatgtattttggaaacctggcggcagcgcaaaagatg

SEQ ID NO: 214473 - DNA, 103 bp, Artificial Sequence
  Synthetic Polynucleotide
taatacgactcactatagggctgctgctgcctttgttgctcttccaaaataacagaggagaattttgatggagcaacaaaacctggcggcagcgcaaaagatg

SEQ ID NO: 214474 - DNA, 103 bp, Artificial Sequence
  Synthetic Polynucleotide
taatacgactcactataggggttgttgttgctgctgctgcctttgttgctaacagaggagaagcaacatgggcagcagcaacctggcggcagcgcaaaagatg

SEQ ID NO: 214475 - DNA, 103 bp, Artificial Sequence
  Synthetic Polynucleotide
taatacgactcactatagggtgctgctgctgttgttgttgctgctgctgcaacagaggagagcagcaatggcaacaacaaacctggcggcagcgcaaaagatg

SEQ ID NO: 214476 - DNA, 103 bp, Artificial Sequence
  Synthetic Polynucleotide
taatacgactcactatagggctgctgctgctgctgctgctgttgttgttgaacagaggagacaacaaatgcagcagcagaacctggcggcagcgcaaaagatg

SEQ ID NO: 214477 - DNA, 103 bp, Artificial Sequence
  Synthetic Polynucleotide
taatacgactcactatagggagccctgagcgtaaggtggcaggctgttgtaacagaggagaacaacaatgtgccaccttaacctggcggcagcgcaaaagatg

SEQ ID NO: 214478 - DNA, 103 bp, Artificial Sequence; identical to SEQ ID NO: 123680
  Synthetic Polynucleotide

SEQ ID NO: 214479 - DNA, 103 bp, Artificial Sequence
  Synthetic Polynucleotide
taatacgactcactatagggtgctgctgttgctgttgctgctgctgctgcaacagaggagagcagcaatggcagcaacaaacctggcggcagcgcaaaagatg

SEQ ID NO: 214480 - DNA, 103 bp, Artificial Sequence
  Synthetic Polynucleotide
taatacgactcactatagggctgctgctgctgctgctgttgctgttgctgaacagaggagacagcaaatgcaacagcagaacctggcggcagcgcaaaagatg

SEQ ID NO: 214481 - DNA, 103 bp, Artificial Sequence; identical to SEQ ID NO: 141446
  Synthetic Polynucleotide

SEQ ID NO: 214482 - DNA, 103 bp, Artificial Sequence; identical to SEQ ID NO: 88553
  Synthetic Polynucleotide

SEQ ID NO: 214483 - DNA, 103 bp, Artificial Sequence; identical to SEQ ID NO: 88564
  Synthetic Polynucleotide

SEQ ID NO: 214484 - DNA, 103 bp, Artificial Sequence; identical to SEQ ID NO: 88576
  Synthetic Polynucleotide

SEQ ID NO: 214485 - DNA, 103 bp, Artificial Sequence
  Synthetic Polynucleotide
taatacgactcactatagggactgcctgttgctgctgctgctgctgctgcaacagaggagagcagcaatggcagcagcaaacctggcggcagcgcaaaagatg

SEQ ID NO: 214486 - DNA, 103 bp, Artificial Sequence
  Synthetic Polynucleotide
taatacgactcactatagggtgcagctgccactgcctgttgctgctgctgaacagaggagacagcagatgcaacaggcaaacctggcggcagcgcaaaagatg

SEQ ID NO: 214487 - DNA, 103 bp, Artificial Sequence
  Synthetic Polynucleotide
taatacgactcactataggggctgaacggctgcagctgccactgcctgttaacagaggagaaacaggatgtggcagctgaacctggcggcagcgcaaaagatg

SEQ ID NO: 214488 - DNA, 103 bp, Artificial Sequence
  Synthetic Polynucleotide
taatacgactcactatagggggggaggccaagccctgagcgtaaggtggcaacagaggagagccaccatgcgctcagggaacctggcggcagcgcaaaagatg

SEQ ID NO: 214489 - DNA, 103 bp, Artificial Sequence
  Synthetic Polynucleotide
taatacgactcactataggggacgttgactgctgaacggctgcagctgccaacagaggagaggcagcatgagccgttcaaacctggcggcagcgcaaaagatg

SEQ ID NO: 214490 - DNA, 103 bp, Artificial Sequence
  Synthetic Polynucleotide
taatacgactcactatagggtgcctgctgggacgttgactgctgaacggcaacagaggagagccgttatgcagtcaacgaacctggcggcagcgcaaaagatg

SEQ ID NO: 214491 - DNA, 103 bp, Artificial Sequence
  Synthetic Polynucleotide
taatacgactcactatagggttccctgtgttgcctgctgggacgttgactaacagaggagaagtcaaatgcccagcaggaacctggcggcagcgcaaaagatg

SEQ ID NO: 214492 - DNA, 103 bp, Artificial Sequence
  Synthetic Polynucleotide
taatacgactcactatagggtggcctgaggttccctgtgttgcctgctggaacagaggagaccagcaatgaacacagggaacctggcggcagcgcaaaagatg

SEQ ID NO: 214493 - DNA, 103 bp, Artificial Sequence
  Synthetic Polynucleotide
taatacgactcactatagggctgtggtgcctggcctgaggttccctgtgtaacagaggagaacacagatgacctcaggcaacctggcggcagcgcaaaagatg

SEQ ID NO: 214494 - DNA, 103 bp, Artificial Sequence
  Synthetic Polynucleotide
taatacgactcactatagggagtggaagagctgtggtgcctggcctgaggaacagaggagacctcagatgaggcaccacaacctggcggcagcgcaaaagatg

SEQ ID NO: 214495 - DNA, 103 bp, Artificial Sequence
  Synthetic Polynucleotide
taatacgactcactatagggagagtctgtgagtggaagagctgtggtgccaacagaggagaggcaccatggctcttccaaacctggcggcagcgcaaaagatg

SEQ ID NO: 214496 - DNA, 103 bp, Artificial Sequence
  Synthetic Polynucleotide
taatacgactcactatagggtgcagttgtgagagtctgtgagtggaagagaacagaggagactcttcatgtcacagactaacctggcggcagcgcaaaagatg

SEQ ID NO: 214497 - DNA, 103 bp, Artificial Sequence
  Synthetic Polynucleotide
taatacgactcactatagggccggcaagggtgcagttgtgagagtctgtgaacagaggagacacagaatgtcacaactgaacctggcggcagcgcaaaagatg

SEQ ID NO: 214498 - DNA, 103 bp, Artificial Sequence
  Synthetic Polynucleotide
taatacgactcactatagggggagtggtgcccggcaagggtgcagttgtgaacagaggagacacaacatgacccttgccaacctggcggcagcgcaaaagatg

SEQ ID NO: 214499 - DNA, 103 bp, Artificial Sequence
  Synthetic Polynucleotide
taatacgactcactatagggggcaccctgaggggaggccaagccctgagcaacagaggagagctcagatgttggcctccaacctggcggcagcgcaaaagatg

SEQ ID NO: 214500 - DNA, 103 bp, Artificial Sequence
  Synthetic Polynucleotide
taatacgactcactataggggggatacagtggagtggtgcccggcaagggaacagaggagacccttgatgggcaccactaacctggcggcagcgcaaaagatg

SEQ ID NO: 214501 - DNA, 103 bp, Artificial Sequence
  Synthetic Polynucleotide
taatacgactcactatagggtcatgggggagggatacagtggagtggtgcaacagaggagagcaccaatgcactgtatcaacctggcggcagcgcaaaagatg

SEQ ID NO: 214502 - DNA, 103 bp, Artificial Sequence
  Synthetic Polynucleotide
taatacgactcactataggggtcatgggagtcatgggggagggatacagtaacagaggagaactgtaatgctcccccataacctggcggcagcgcaaaagatg

SEQ ID NO: 214503 - DNA, 103 bp, Artificial Sequence
  Synthetic Polynucleotide
taatacgactcactatagggagtgatgggggtcatgggagtcatgggggaaacagaggagatcccccatgactcccatgaacctggcggcagcgcaaaagatg

SEQ ID NO: 214504 - DNA, 103 bp, Artificial Sequence
  Synthetic Polynucleotide
taatacgactcactataggggcgtggcaggagtgatgggggtcatgggagaacagaggagactcccaatgcccccatcaaacctggcggcagcgcaaaagatg

SEQ ID NO: 214505 - DNA, 103 bp, Artificial Sequence
  Synthetic Polynucleotide
taatacgactcactatagggtccgaagctggcgtggcaggagtgatggggaacagaggagaccccatatgtcctgccacaacctggcggcagcgcaaaagatg

SEQ ID NO: 214506 - DNA, 103 bp, Artificial Sequence
  Synthetic Polynucleotide
taatacgactcactatagggcccagaactctccgaagctggcgtggcaggaacagaggagacctgccatgccagcttcgaacctggcggcagcgcaaaagatg

SEQ ID NO: 214507 - DNA, 103 bp, Artificial Sequence
  Synthetic Polynucleotide
taatacgactcactataggggcggtacaatcccagaactctccgaagctgaacagaggagacagcttatgagagttctgaacctggcggcagcgcaaaagatg

SEQ ID NO: 214508 - DNA, 103 bp, Artificial Sequence
  Synthetic Polynucleotide
taatacgactcactatagggttttgcagctgcggtacaatcccagaactcaacagaggagagagttcatggattgtaccaacctggcggcagcgcaaaagatg

SEQ ID NO: 214509 - DNA, 103 bp, Artificial Sequence
  Synthetic Polynucleotide
taatacgactcactatagggggatacaatattttgcagctgcggtacaataacagaggagaattgtaatgcagctgcaaaacctggcggcagcgcaaaagatg

SEQ ID NO: 214510 - DNA, 103 bp, Artificial Sequence
  Synthetic Polynucleotide
taatacgactcactatagggcgggagtcatggcaccctgaggggaggccaaacagaggagatggcctatgctcagggtgaacctggcggcagcgcaaaagatg

SEQ ID NO: 214511 - DNA, 103 bp, Artificial Sequence
  Synthetic Polynucleotide
taatacgactcactataggggattcactgtggatacaatattttgcagctaacagaggagaagctgcatgatattgtataacctggcggcagcgcaaaagatg

SEQ ID NO: 214512 - DNA, 103 bp, Artificial Sequence
  Synthetic Polynucleotide
taatacgactcactatagggttacaaccaagattcactgtggatacaataaacagaggagatattgtatgcacagtgaaaacctggcggcagcgcaaaagatg

SEQ ID NO: 214513 - DNA, 103 bp, Artificial Sequence
  Synthetic Polynucleotide
taatacgactcactatagggtaggtcaagtttacaaccaagattcactgtaacagaggagaacagtgatgcttggttgtaacctggcggcagcgcaaaagatg

SEQ ID NO: 214514 - DNA, 103 bp, Artificial Sequence
  Synthetic Polynucleotide
taatacgactcactatagggcaatggtctttaggtcaagtttacaaccaaaacagaggagattggttatgaacttgaccaacctggcggcagcgcaaaagatg

SEQ ID NO: 214515 - DNA, 103 bp, Artificial Sequence
  Synthetic Polynucleotide
taatacgactcactataggggcacgaagtgcaatggtctttaggtcaagtaacagaggagaacttgaatgaaagaccataacctggcggcagcgcaaaagatg

SEQ ID NO: 214516 - DNA, 103 bp, Artificial Sequence
  Synthetic Polynucleotide
taatacgactcactatagggggcgtttcgggcacgaagtgcaatggtcttaacagaggagaaagaccatggcacttcgtaacctggcggcagcgcaaaagatg

SEQ ID NO: 214517 - DNA, 103 bp, Artificial Sequence
  Synthetic Polynucleotide
taatacgactcactataggggattatattcggcgtttcgggcacgaagtgaacagaggagacacttcatgcccgaaacgaacctggcggcagcgcaaaagatg

SEQ ID NO: 214518 - DNA, 103 bp, Artificial Sequence
  Synthetic Polynucleotide
taatacgactcactatagggaaccgcttgggattatattcggcgtttcggaacagaggagaccgaaaatgcgaatataaaacctggcggcagcgcaaaagatg

SEQ ID NO: 214519 - DNA, 103 bp, Artificial Sequence
  Synthetic Polynucleotide
taatacgactcactatagggtaccgcagcaaaccgcttgggattatattcaacagaggagagaatatatgcccaagcggaacctggcggcagcgcaaaagatg

SEQ ID NO: 214520 - DNA, 103 bp, Artificial Sequence
  Synthetic Polynucleotide
taatacgactcactatagggtcctcatgattaccgcagcaaaccgcttggaacagaggagaccaagcatgttgctgcggaacctggcggcagcgcaaaagatg

SEQ ID NO: 214521 - DNA, 103 bp, Artificial Sequence
  Synthetic Polynucleotide
taatacgactcactatagggatagggattccgggagtcatggcaccctgaaacagaggagatcagggatgcatgactccaacctggcggcagcgcaaaagatg

SEQ ID NO: 214522 - DNA, 103 bp, Artificial Sequence
  Synthetic Polynucleotide
taatacgactcactatagggggctctcttatcctcatgattaccgcagcaaacagaggagatgctgcatgaatcatgagaacctggcggcagcgcaaaagatg

SEQ ID NO: 214523 - DNA, 103 bp, Artificial Sequence
  Synthetic Polynucleotide
taatacgactcactatagggcgtggttcgtggctctcttatcctcatgataacagaggagaatcatgatgataagagagaacctggcggcagcgcaaaagatg

SEQ ID NO: 214524 - DNA, 103 bp, Artificial Sequence
  Synthetic Polynucleotide
taatacgactcactatagggaaatcagtgccgtggttcgtggctctcttaaacagaggagataagagatgcacgaaccaaacctggcggcagcgcaaaagatg

SEQ ID NO: 214525 - DNA, 103 bp, Artificial Sequence
  Synthetic Polynucleotide
taatacgactcactatagggccagaactgaaaatcagtgccgtggttcgtaacagaggagaacgaacatgggcactgataacctggcggcagcgcaaaagatg

SEQ ID NO: 214526 - DNA, 103 bp, Artificial Sequence
  Synthetic Polynucleotide
taatacgactcactatagggcaccattttcccagaactgaaaatcagtgcaacagaggagagcactgatgttcagttctaacctggcggcagcgcaaaagatg

SEQ ID NO: 214527 - DNA, 103 bp, Artificial Sequence
  Synthetic Polynucleotide
taatacgactcactatagggctcctgtgcacaccattttcccagaactgaaacagaggagatcagttatgggaaaatggaacctggcggcagcgcaaaagatg

SEQ ID NO: 214528 - DNA, 103 bp, Artificial Sequence
  Synthetic Polynucleotide
taatacgactcactatagggtcactcttggctcctgtgcacaccattttcaacagaggagagaaaatatggtgcacaggaacctggcggcagcgcaaaagatg

SEQ ID NO: 214529 - DNA, 103 bp, Artificial Sequence
  Synthetic Polynucleotide
taatacgactcactatagggggactgttcttcactcttggctcctgtgcaaacagaggagatgcacaatggccaagagtaacctggcggcagcgcaaaagatg

SEQ ID NO: 214530 - DNA, 103 bp, Artificial Sequence
  Synthetic Polynucleotide
taatacgactcactatagggctgccagtctggactgttcttcactcttggaacagaggagaccaagaatgaagaacagtaacctggcggcagcgcaaaagatg

SEQ ID NO: 214531 - DNA, 103 bp, Artificial Sequence
  Synthetic Polynucleotide
taatacgactcactatagggtattttcttgctgccagtctggactgttctaacagaggagaagaacaatgcagactggcaacctggcggcagcgcaaaagatg

SEQ ID NO: 214532 - DNA, 103 bp, Artificial Sequence
  Synthetic Polynucleotide
taatacgactcactatagggtggactaaagatagggattccgggagtcataacagaggagaatgactatgggaatccctaacctggcggcagcgcaaaagatg

SEQ ID NO: 214533 - DNA, 103 bp, Artificial Sequence
  Synthetic Polynucleotide
taatacgactcactatagggaactctagcatattttcttgctgccagtctaacagaggagaagactgatggcaagaaaaaacctggcggcagcgcaaaagatg

SEQ ID NO: 214534 - DNA, 103 bp, Artificial Sequence
  Synthetic Polynucleotide
taatacgactcactatagggacttctgtacaactctagcatattttcttgaacagaggagacaagaaatgatgctagagaacctggcggcagcgcaaaagatg

SEQ ID NO: 214535 - DNA, 103 bp, Artificial Sequence
  Synthetic Polynucleotide
taatacgactcactatagggggaaaacccaacttctgtacaactctagcaaacagaggagatgctagatgtgtacagaaaacctggcggcagcgcaaaagatg

SEQ ID NO: 214536 - DNA, 103 bp, Artificial Sequence
  Synthetic Polynucleotide
taatacgactcactataggggaacttagctggaaaacccaacttctgtacaacagaggagagtacagatgttgggttttaacctggcggcagcgcaaaagatg

SEQ ID NO: 214537 - DNA, 103 bp, Artificial Sequence
  Synthetic Polynucleotide
taatacgactcactatagggtgaagtccaagaacttagctggaaaacccaaacagaggagatgggttatgcagctaagtaacctggcggcagcgcaaaagatg

SEQ ID NO: 214538 - DNA, 103 bp, Artificial Sequence
  Synthetic Polynucleotide
taatacgactcactatagggttctgaatcttgaagtccaagaacttagctaacagaggagaagctaaatgcttggacttaacctggcggcagcgcaaaagatg

SEQ ID NO: 214539 - DNA, 103 bp, Artificial Sequence
  Synthetic Polynucleotide
taatacgactcactatagggccccaccatattctgaatcttgaagtccaaaacagaggagattggacatgaagattcagaacctggcggcagcgcaaaagatg

SEQ ID NO: 214540 - DNA, 103 bp, Artificial Sequence
  Synthetic Polynucleotide
taatacgactcactatagggcatcacagctccccaccatattctgaatctaacagaggagaagattcatgatatggtggaacctggcggcagcgcaaaagatg

SEQ ID NO: 214541 - DNA, 103 bp, Artificial Sequence
  Synthetic Polynucleotide
taatacgactcactatagggggaaacttcacatcacagctccccaccataaacagaggagatatggtatggagctgtgaaacctggcggcagcgcaaaagatg

SEQ ID NO: 214542 - DNA, 103 bp, Artificial Sequence
  Synthetic Polynucleotide
taatacgactcactatagggtaaccttataggaaacttcacatcacagctaacagaggagaagctgtatggtgaagtttaacctggcggcagcgcaaaagatg

SEQ ID NO: 214543 - DNA, 103 bp, Artificial Sequence
  Synthetic Polynucleotide
taatacgactcactatagggaaggcatcattggactaaagatagggattcaacagaggagagaatccatgtctttagtcaacctggcggcagcgcaaaagatg

SEQ ID NO: 214544 - DNA, 103 bp, Artificial Sequence
  Synthetic Polynucleotide
taatacgactcactatagggcaaggccttctaaccttataggaaacttcaaacagaggagatgaagtatgctataaggtaacctggcggcagcgcaaaagatg

SEQ ID NO: 214545 - DNA, 103 bp, Artificial Sequence
  Synthetic Polynucleotide
taatacgactcactatagggtgggtgagcacaaggccttctaaccttataaacagaggagatataagatgagaaggcctaacctggcggcagcgcaaaagatg

SEQ ID NO: 214546 - DNA, 103 bp, Artificial Sequence
  Synthetic Polynucleotide
taatacgactcactatagggaaattgttggtgggtgagcacaaggccttcaacagaggagagaaggcatggtgctcaccaacctggcggcagcgcaaaagatg

SEQ ID NO: 214547 - DNA, 103 bp, Artificial Sequence
  Synthetic Polynucleotide
taatacgactcactatagggcataactactaaattgttggtgggtgagcaaacagaggagatgctcaatgaccaacaataacctggcggcagcgcaaaagatg

SEQ ID NO: 214548 - DNA, 103 bp, Artificial Sequence
  Synthetic Polynucleotide
taatacgactcactatagggaactctggctcataactactaaattgttggaacagaggagaccaacaatgtagtagttaaacctggcggcagcgcaaaagatg

SEQ ID NO: 214549 - DNA, 103 bp, Artificial Sequence
  Synthetic Polynucleotide
taatacgactcactatagggaccaggaaataactctggctcataactactaacagaggagaagtagtatggagccagagaacctggcggcagcgcaaaagatg

SEQ ID NO: 214550 - DNA, 103 bp, Artificial Sequence
  Synthetic Polynucleotide
taatacgactcactatagggtgtagattaaaccaggaaataactctggctaacagaggagaagccagatgtatttcctgaacctggcggcagcgcaaaagatg

SEQ ID NO: 214551 - DNA, 103 bp, Artificial Sequence
  Synthetic Polynucleotide
taatacgactcactatagggttgatcattctgtagattaaaccaggaaataacagaggagaatttccatgtttaatctaaacctggcggcagcgcaaaagatg

SEQ ID NO: 214552 - DNA, 103 bp, Artificial Sequence
  Synthetic Polynucleotide
taatacgactcactatagggaattctgggtttgatcattctgtagattaaaacagaggagattaatcatgagaatgatcaacctggcggcagcgcaaaagatg

SEQ ID NO: 214553 - DNA, 103 bp, Artificial Sequence
  Synthetic Polynucleotide
taatacgactcactatagggtaaggagaacaattctgggtttgatcattcaacagaggagagaatgaatgaacccagaaaacctggcggcagcgcaaaagatg

SEQ ID NO: 214554 - DNA, 103 bp, Artificial Sequence
  Synthetic Polynucleotide
taatacgactcactatagggccagtgccataaggcatcattggactaaagaacagaggagactttagatgaatgatgccaacctggcggcagcgcaaaagatg

SEQ ID NO: 214555 - DNA, 103 bp, Artificial Sequence
  Synthetic Polynucleotide
taatacgactcactataggggaaacaaaaataaggagaacaattctgggtaacagaggagaacccagatgtgttctcctaacctggcggcagcgcaaaagatg

SEQ ID NO: 214556 - DNA, 103 bp, Artificial Sequence
  Synthetic Polynucleotide
taatacgactcactatagggaacttttccagaaacaaaaataaggagaacaacagaggagagttctcatgatttttgttaacctggcggcagcgcaaaagatg

SEQ ID NO: 214557 - DNA, 103 bp, Artificial Sequence
  Synthetic Polynucleotide
taatacgactcactatagggctgttaatacaacttttccagaaacaaaaaaacagaggagatttttgatgctggaaaagaacctggcggcagcgcaaaagatg

SEQ ID NO: 214558 - DNA, 103 bp, Artificial Sequence
  Synthetic Polynucleotide
taatacgactcactatagggactttagcacctgttaatacaacttttccaaacagaggagatggaaaatgtgtattaacaacctggcggcagcgcaaaagatg

SEQ ID NO: 214559 - DNA, 103 bp, Artificial Sequence
  Synthetic Polynucleotide
taatacgactcactatagggttctgctctgactttagcacctgttaatacaacagaggagagtattaatgggtgctaaaaacctggcggcagcgcaaaagatg

SEQ ID NO: 214560 - DNA, 103 bp, Artificial Sequence
  Synthetic Polynucleotide
taatacgactcactatagggcttcataaatttctgctctgactttagcacaacagaggagagtgctaatgtcagagcagaacctggcggcagcgcaaaagatg

SEQ ID NO: 214561 - DNA, 103 bp, Artificial Sequence
  Synthetic Polynucleotide
taatacgactcactatagggttttcaaatgcttcataaatttctgctctgaacagaggagacagagcatgaatttatgaaacctggcggcagcgcaaaagatg

SEQ ID NO: 214562 - DNA, 103 bp, Artificial Sequence
  Synthetic Polynucleotide
taatacgactcactatagggagggtagatgttttcaaatgcttcataaataacagaggagaatttatatggcatttgaaaacctggcggcagcgcaaaagatg

SEQ ID NO: 214563 - DNA, 103 bp, Artificial Sequence
  Synthetic Polynucleotide
taatacgactcactatagggcctttagaatagggtagatgttttcaaatgaacagaggagacatttgatgacatctaccaacctggcggcagcgcaaaagatg

SEQ ID NO: 214564 - DNA, 103 bp, Artificial Sequence
  Synthetic Polynucleotide
taatacgactcactatagggttcctgaatccctttagaatagggtagatgaacagaggagacatctaatgtattctaaaaacctggcggcagcgcaaaagatg

SEQ ID NO: 214565 - DNA, 103 bp, Artificial Sequence
  Synthetic Polynucleotide
taatacgactcactataggggtccaatgcaacatcactgtctgcatccataacagaggagaatggatatggacagtgataacctggcggcagcgcaaaagatg

SEQ ID NO: 214566 - DNA, 103 bp, Artificial Sequence
  Synthetic Polynucleotide
taatacgactcactatagggataaattacatttgctccttccaaagcaataacagaggagaattgctatggaaggagcaaacctggcggcagcgcaaaagatg

SEQ ID NO: 214567 - DNA, 103 bp, Artificial Sequence
  Synthetic Polynucleotide
taatacgactcactatagggcatcacgtttataaattacatttgctccttaacagaggagaaaggagatgatgtaatttaacctggcggcagcgcaaaagatg

SEQ ID NO: 214568 - DNA, 103 bp, Artificial Sequence
  Synthetic Polynucleotide
taatacgactcactatagggacttttccaacatcacgtttataaattacaaacagaggagatgtaatatgtaaacgtgaaacctggcggcagcgcaaaagatg

SEQ ID NO: 214569 - DNA, 103 bp, Artificial Sequence
  Synthetic Polynucleotide
taatacgactcactatagggcttcattaatacttttccaacatcacgtttaacagaggagaaaacgtatggttggaaaaaacctggcggcagcgcaaaagatg

SEQ ID NO: 214570 - DNA, 103 bp, Artificial Sequence
  Synthetic Polynucleotide
taatacgactcactataggggttttctaagcttcattaatacttttccaaaacagaggagattggaaatgtattaatgaaacctggcggcagcgcaaaagatg

SEQ ID NO: 214571 - DNA, 103 bp, Artificial Sequence
  Synthetic Polynucleotide
taatacgactcactataggggtaattctaggttttctaagcttcattaataacagaggagaattaatatggcttagaaaaacctggcggcagcgcaaaagatg

SEQ ID NO: 214572 - DNA, 103 bp, Artificial Sequence
  Synthetic Polynucleotide
taatacgactcactatagggaattgtagctgtaattctaggttttctaagaacagaggagacttagaatgcctagaattaacctggcggcagcgcaaaagatg

SEQ ID NO: 214573 - DNA, 103 bp, Artificial Sequence
  Synthetic Polynucleotide
taatacgactcactatagggctgaggaccaaattgtagctgtaattctagaacagaggagactagaaatgcagctacaaaacctggcggcagcgcaaaagatg

SEQ ID NO: 214574 - DNA, 103 bp, Artificial Sequence
  Synthetic Polynucleotide
taatacgactcactatagggataatttttcctgaggaccaaattgtagctaacagaggagaagctacatgttggtcctcaacctggcggcagcgcaaaagatg

SEQ ID NO: 214575 - DNA, 103 bp, Artificial Sequence
  Synthetic Polynucleotide
taatacgactcactatagggtccagtgcaaataatttttcctgaggaccaaacagaggagatggtccatgggaaaaattaacctggcggcagcgcaaaagatg

SEQ ID NO: 214576 - DNA, 103 bp, Artificial Sequence
  Synthetic Polynucleotide
taatacgactcactatagggtaattagaatgtccaatgcaacatcactgtaacagaggagaacagtgatgttgcattggaacctggcggcagcgcaaaagatg

SEQ ID NO: 214577 - DNA, 103 bp, Artificial Sequence
  Synthetic Polynucleotide
taatacgactcactatagggcacttgttgctccagtgcaaataatttttcaacagaggagagaaaaaatgtttgcactgaacctggcggcagcgcaaaagatg

SEQ ID NO: 214578 - DNA, 103 bp, Artificial Sequence
  Synthetic Polynucleotide
taatacgactcactataggggcttcttcttcacttgttgctccagtgcaaaacagaggagattgcacatgagcaacaagaacctggcggcagcgcaaaagatg

SEQ ID NO: 214579 - DNA, 103 bp, Artificial Sequence
  Synthetic Polynucleotide
taatacgactcactatagggaccaaatttagcttcttcttcacttgttgcaacagaggagagcaacaatggaagaagaaaacctggcggcagcgcaaaagatg

SEQ ID NO: 214580 - DNA, 103 bp, Artificial Sequence
  Synthetic Polynucleotide
taatacgactcactatagggagcgtctggcaccaaatttagcttcttcttaacagaggagaaagaagatgctaaatttgaacctggcggcagcgcaaaagatg

SEQ ID NO: 214581 - DNA, 103 bp, Artificial Sequence
  Synthetic Polynucleotide
taatacgactcactatagggctacgggctaagcgtctggcaccaaatttaaacagaggagataaattatgtgccagacgaacctggcggcagcgcaaaagatg

SEQ ID NO: 214582 - DNA, 103 bp, Artificial Sequence
  Synthetic Polynucleotide
taatacgactcactatagggtttctgcagactacgggctaagcgtctggcaacagaggagagccagaatgttagcccgtaacctggcggcagcgcaaaagatg

SEQ ID NO: 214583 - DNA, 103 bp, Artificial Sequence
  Synthetic Polynucleotide
taatacgactcactataggggaaaacctagtttctgcagactacgggctaaacagaggagatagcccatggtctgcagaaacctggcggcagcgcaaaagatg

SEQ ID NO: 214584 - DNA, 103 bp, Artificial Sequence
  Synthetic Polynucleotide
taatacgactcactatagggaatattacctgaaaacctagtttctgcagaaacagaggagatctgcaatgactaggtttaacctggcggcagcgcaaaagatg

SEQ ID NO: 214585 - DNA, 103 bp, Artificial Sequence
  Synthetic Polynucleotide
taatacgactcactatagggaaaatctgtaaatattacctgaaaacctagaacagaggagactaggtatgcaggtaataaacctggcggcagcgcaaaagatg

SEQ ID NO: 214586 - DNA, 103 bp, Artificial Sequence
  Synthetic Polynucleotide
taatacgactcactatagggtaacaaccttaaaatctgtaaatattacctaacagaggagaaggtaaatgttacagattaacctggcggcagcgcaaaagatg

SEQ ID NO: 214587 - DNA, 103 bp, Artificial Sequence
  Synthetic Polynucleotide
taatacgactcactatagggactacatttgtaattagaatgtccaatgcaaacagaggagatgcattatgcattctaataacctggcggcagcgcaaaagatg

SEQ ID NO: 214588 - DNA, 103 bp, Artificial Sequence
  Synthetic Polynucleotide
taatacgactcactataggggccagaacgttaacaaccttaaaatctgtaaacagaggagatacagaatgtaaggttgtaacctggcggcagcgcaaaagatg

SEQ ID NO: 214589 - DNA, 103 bp, Artificial Sequence
  Synthetic Polynucleotide
taatacgactcactataggggttacacactgccagaacgttaacaaccttaacagaggagaaaggttatgaacgttctgaacctggcggcagcgcaaaagatg

SEQ ID NO: 214590 - DNA, 103 bp, Artificial Sequence
  Synthetic Polynucleotide
taatacgactcactatagggcaaatggcatgttacacactgccagaacgtaacagaggagaacgttcatgcagtgtgtaaacctggcggcagcgcaaaagatg

SEQ ID NO: 214591 - DNA, 103 bp, Artificial Sequence
  Synthetic Polynucleotide
taatacgactcactatagggaaacggatttcaaatggcatgttacacactaacagaggagaagtgtgatgcatgccattaacctggcggcagcgcaaaagatg

SEQ ID NO: 214592 - DNA, 103 bp, Artificial Sequence
  Synthetic Polynucleotide
taatacgactcactataggggaattctggcaaacggatttcaaatggcataacagaggagaatgccaatggaaatccgtaacctggcggcagcgcaaaagatg

SEQ ID NO: 214593 - DNA, 103 bp, Artificial Sequence
  Synthetic Polynucleotide
taatacgactcactatagggtgttctttgtgaattctggcaaacggatttaacagaggagaaaatccatgtgccagaataacctggcggcagcgcaaaagatg

SEQ ID NO: 214594 - DNA, 103 bp, Artificial Sequence
  Synthetic Polynucleotide
taatacgactcactatagggtgaggtctattgttctttgtgaattctggcaacagaggagagccagaatgcacaaagaaaacctggcggcagcgcaaaagatg

SEQ ID NO: 214595 - DNA, 103 bp, Artificial Sequence
  Synthetic Polynucleotide
taatacgactcactataggggtaactggcatgaggtctattgttctttgtaacagaggagaacaaagatgaatagacctaacctggcggcagcgcaaaagatg

SEQ ID NO: 214596 - DNA, 103 bp, Artificial Sequence
  Synthetic Polynucleotide
taatacgactcactataggggttcaggttcgtaactggcatgaggtctataacagaggagaatagacatgatgccagttaacctggcggcagcgcaaaagatg

SEQ ID NO: 214597 - DNA, 103 bp, Artificial Sequence
  Synthetic Polynucleotide
taatacgactcactataggggcaggatgaagttcaggttcgtaactggcaaacagaggagatgccagatgcgaacctgaaacctggcggcagcgcaaaagatg

SEQ ID NO: 214598 - DNA, 103 bp, Artificial Sequence
  Synthetic Polynucleotide
taatacgactcactatagggaaaaacacagactacatttgtaattagaataacagaggagaattctaatgacaaatgtaaacctggcggcagcgcaaaagatg

SEQ ID NO: 214599 - DNA, 103 bp, Artificial Sequence
  Synthetic Polynucleotide
taatacgactcactatagggatagcacacagcaggatgaagttcaggttcaacagaggagagaacctatgcttcatcctaacctggcggcagcgcaaaagatg

SEQ ID NO: 214600 - DNA, 103 bp, Artificial Sequence
  Synthetic Polynucleotide
taatacgactcactatagggattttatccgatagcacacagcaggatgaaaacagaggagattcatcatgctgtgtgctaacctggcggcagcgcaaaagatg

SEQ ID NO: 214601 - DNA, 103 bp, Artificial Sequence
  Synthetic Polynucleotide
taatacgactcactataggggctcttagagattttatccgatagcacacaaacagaggagatgtgtgatgtcggataaaaacctggcggcagcgcaaaagatg

SEQ ID NO: 214602 - DNA, 103 bp, Artificial Sequence
  Synthetic Polynucleotide
taatacgactcactatagggctgtaatgtagctcttagagattttatccgaacagaggagacggataatgtctctaagaaacctggcggcagcgcaaaagatg

SEQ ID NO: 214603 - DNA, 103 bp, Artificial Sequence
  Synthetic Polynucleotide
taatacgactcactatagggttgaaaaaatctgtaatgtagctcttagagaacagaggagactctaaatgctacattacaacctggcggcagcgcaaaagatg

SEQ ID NO: 214604 - DNA, 103 bp, Artificial Sequence
  Synthetic Polynucleotide
taatacgactcactatagggatacttcctgttgaaaaaatctgtaatgtaaacagaggagatacattatggattttttcaacctggcggcagcgcaaaagatg

SEQ ID NO: 214605 - DNA, 103 bp, Artificial Sequence
  Synthetic Polynucleotide
taatacgactcactatagggtgttactgtgatacttcctgttgaaaaaataacagaggagaatttttatgacaggaagtaacctggcggcagcgcaaaagatg

SEQ ID NO: 214606 - DNA, 103 bp, Artificial Sequence
  Synthetic Polynucleotide
taatacgactcactatagggcattgggccctgttactgtgatacttcctgaacagaggagacaggaaatgtcacagtaaaacctggcggcagcgcaaaagatg

SEQ ID NO: 214607 - DNA, 103 bp, Artificial Sequence
  Synthetic Polynucleotide
taatacgactcactatagggacagcctttacattgggccctgttactgtgaacagaggagacacagtatgagggcccaaaacctggcggcagcgcaaaagatg

SEQ ID NO: 214608 - DNA, 103 bp, Artificial Sequence
  Synthetic Polynucleotide
taatacgactcactatagggagcagtagcaacagcctttacattgggcccaacagaggagagggcccatggtaaaggctaacctggcggcagcgcaaaagatg

SEQ ID NO: 214609 - DNA, 103 bp, Artificial Sequence
  Synthetic Polynucleotide
taatacgactcactatagggatcttgttctaaaaacacagactacatttgaacagaggagacaaatgatgtctgtgtttaacctggcggcagcgcaaaagatg

SEQ ID NO: 214610 - DNA, 103 bp, Artificial Sequence
  Synthetic Polynucleotide
taatacgactcactatagggtctgttccacagcagtagcaacagcctttaaacagaggagataaaggatgttgctactgaacctggcggcagcgcaaaagatg

SEQ ID NO: 214611 - DNA, 103 bp, Artificial Sequence
  Synthetic Polynucleotide
taatacgactcactatagggaatgggtaaatctgttccacagcagtagcaaacagaggagatgctacatgtgtggaacaaacctggcggcagcgcaaaagatg

SEQ ID NO: 214612 - DNA, 103 bp, Artificial Sequence
  Synthetic Polynucleotide
taatacgactcactatagggttcaaacacaaatgggtaaatctgttccacaacagaggagagtggaaatgatttacccaaacctggcggcagcgcaaaagatg

SEQ ID NO: 214613 - DNA, 103 bp, Artificial Sequence
  Synthetic Polynucleotide
taatacgactcactatagggctttcctgctttcaaacacaaatgggtaaaaacagaggagatttaccatgttgtgtttgaacctggcggcagcgcaaaagatg

SEQ ID NO: 214614 - DNA, 103 bp, Artificial Sequence
  Synthetic Polynucleotide
taatacgactcactatagggtataaaatttctttcctgctttcaaacacaaacagaggagatgtgttatgaagcaggaaaacctggcggcagcgcaaaagatg

SEQ ID NO: 214615 - DNA, 103 bp, Artificial Sequence
  Synthetic Polynucleotide
taatacgactcactatagggtttaaatgacatcttgttctaaaaacacagaacagaggagactgtgtatgtagaacaagaacctggcggcagcgcaaaagatg

SEQ ID NO: 214616 - DNA, 103 bp, Artificial Sequence
  Synthetic Polynucleotide
taatacgactcactatagggcttccttaagtttaaatgacatcttgttctaacagaggagaagaacaatgtgtcatttaaacctggcggcagcgcaaaagatg

SEQ ID NO: 214617 - DNA, 103 bp, Artificial Sequence
  Synthetic Polynucleotide
taatacgactcactatagggccaaagcaatcttccttaagtttaaatgacaacagaggagagtcattatgacttaaggaaacctggcggcagcgcaaaagatg

SEQ ID NO: 214618 - DNA, 103 bp, Artificial Sequence
  Synthetic Polynucleotide
taatacgactcactatagggtttgctccttccaaagcaatcttccttaagaacagaggagacttaagatggattgctttaacctggcggcagcgcaaaagatg

SEQ ID NO: 214619 - DNA, 103 bp, Artificial Sequence
  Synthetic Polynucleotide
taatacgactcactatagggaacccgctccggccagggcgcagaggccataacagaggagaatggccatggcgccctggaacctggcggcagcgcaaaagatg

SEQ ID NO: 214620 - DNA, 103 bp, Artificial Sequence
  Synthetic Polynucleotide
taatacgactcactatagggcaggtaggtctcctcctgctccatggaccgaacagaggagacggtccatggagcaggagaacctggcggcagcgcaaaagatg

SEQ ID NO: 214621 - DNA, 103 bp, Artificial Sequence
  Synthetic Polynucleotide
taatacgactcactatagggaagcaacacaattcgtggttttaccattctaacagaggagaagaatgatgaaaccacgaaacctggcggcagcgcaaaagatg

SEQ ID NO: 214622 - DNA, 103 bp, Artificial Sequence
  Synthetic Polynucleotide
taatacgactcactatagggatacaaagataagcaacacaattcgtggttaacagaggagaaaccacatgttgtgttgcaacctggcggcagcgcaaaagatg

SEQ ID NO: 214623 - DNA, 103 bp, Artificial Sequence
  Synthetic Polynucleotide
taatacgactcactatagggacttttccagatacaaagataagcaacacaaacagaggagatgtgttatgtatctttgtaacctggcggcagcgcaaaagatg

SEQ ID NO: 214624 - DNA, 103 bp, Artificial Sequence
  Synthetic Polynucleotide
taatacgactcactatagggtgtcaacacaacttttccagatacaaagataacagaggagaatctttatgtctggaaaaaacctggcggcagcgcaaaagatg

SEQ ID NO: 214625 - DNA, 103 bp, Artificial Sequence
  Synthetic Polynucleotide
taatacgactcactatagggctttggcacctgtcaacacaacttttccagaacagaggagactggaaatgttgtgttgaaacctggcggcagcgcaaaagatg

SEQ ID NO: 214626 - DNA, 103 bp, Artificial Sequence
  Synthetic Polynucleotide
taatacgactcactatagggtcagaacgttctttggcacctgtcaacacaaacagaggagatgtgttatgaggtgccaaaacctggcggcagcgcaaaagatg

SEQ ID NO: 214627 - DNA, 103 bp, Artificial Sequence
  Synthetic Polynucleotide
taatacgactcactatagggttcatagatctcagaacgttctttggcaccaacagaggagaggtgccatggaacgttctaacctggcggcagcgcaaaagatg

SEQ ID NO: 214628 - DNA, 103 bp, Artificial Sequence
  Synthetic Polynucleotide
taatacgactcactatagggtttcaaatgcttcatagatctcagaacgttaacagaggagaaacgttatgagatctatgaacctggcggcagcgcaaaagatg

SEQ ID NO: 214629 - DNA, 103 bp, Artificial Sequence
  Synthetic Polynucleotide
taatacgactcactatagggggatagatgttttcaaatgcttcatagatcaacagaggagagatctaatgagcatttgaaacctggcggcagcgcaaaagatg

SEQ ID NO: 214630 - DNA, 103 bp, Artificial Sequence
  Synthetic Polynucleotide
taatacgactcactatagggttttagaataggatagatgttttcaaatgcaacagaggagagcatttatgaacatctataacctggcggcagcgcaaaagatg

SEQ ID NO: 214631 - DNA, 103 bp, Artificial Sequence
  Synthetic Polynucleotide
taatacgactcactatagggggtagagctccaggtaggtctcctcctgctaacagaggagaagcaggatgagacctaccaacctggcggcagcgcaaaagatg

SEQ ID NO: 214632 - DNA, 103 bp, Artificial Sequence
  Synthetic Polynucleotide
taatacgactcactatagggttttaaaaccttttagaataggatagatgtaacagaggagaacatctatgctattctaaaacctggcggcagcgcaaaagatg

SEQ ID NO: 214633 - DNA, 103 bp, Artificial Sequence
  Synthetic Polynucleotide
taatacgactcactatagggcactggtccaggtagagctccaggtaggtcaacagaggagagacctaatgggagctctaaacctggcggcagcgcaaaagatg

SEQ ID NO: 214634 - DNA, 103 bp, Artificial Sequence
  Synthetic Polynucleotide
taatacgactcactatagggctgagcggcgcactggtccaggtagagctcaacagaggagagagctcatgctggaccagaacctggcggcagcgcaaaagatg

SEQ ID NO: 214635 - DNA, 103 bp, Artificial Sequence
  Synthetic Polynucleotide
taatacgactcactatagggcaaggccatcctgagcggcgcactggtccaaacagaggagatggaccatggcgccgctcaacctggcggcagcgcaaaagatg

SEQ ID NO: 214636 - DNA, 103 bp, Artificial Sequence
  Synthetic Polynucleotide
taatacgactcactatagggctgggtggggcaaggccatcctgagcggcgaacagaggagacgccgcatgggatggcctaacctggcggcagcgcaaaagatg

SEQ ID NO: 214637 - DNA, 103 bp, Artificial Sequence
  Synthetic Polynucleotide
taatacgactcactatagggcaggggagacctgggtggggcaaggccatcaacagaggagagatggcatggccccacccaacctggcggcagcgcaaaagatg

SEQ ID NO: 214638 - DNA, 103 bp, Artificial Sequence
  Synthetic Polynucleotide
taatacgactcactatagggctgggctgaacaggggagacctgggtggggaacagaggagaccccacatgggtctccccaacctggcggcagcgcaaaagatg

SEQ ID NO: 214639 - DNA, 103 bp, Artificial Sequence
  Synthetic Polynucleotide
taatacgactcactatagggtaaggtacaactgggctgaacaggggagacaacagaggagagtctccatggttcagcccaacctggcggcagcgcaaaagatg

SEQ ID NO: 214640 - DNA, 103 bp, Artificial Sequence
  Synthetic Polynucleotide
taatacgactcactataggggtacatatcataaggtacaactgggctgaaaacagaggagattcagcatggttgtacctaacctggcggcagcgcaaaagatg

SEQ ID NO: 214641 - DNA, 103 bp, Artificial Sequence
  Synthetic Polynucleotide
taatacgactcactataggggcagcctcggaacccgctccggccagggcgaacagaggagacgccctatgcggagcgggaacctggcggcagcgcaaaagatg

SEQ ID NO: 214642 - DNA, 103 bp, Artificial Sequence
  Synthetic Polynucleotide
taatacgactcactatagggcattcagtatgtacatatcataaggtacaaaacagaggagattgtacatgatgatatgtaacctggcggcagcgcaaaagatg

SEQ ID NO: 214643 - DNA, 103 bp, Artificial Sequence
  Synthetic Polynucleotide
taatacgactcactatagggggattggatgcattcagtatgtacatatcaaacagaggagatgatatatgcatactgaaaacctggcggcagcgcaaaagatg

SEQ ID NO: 214644 - DNA, 103 bp, Artificial Sequence
  Synthetic Polynucleotide
taatacgactcactatagggtgcagtatccggattggatgcattcagtataacagaggagaatactgatggcatccaataacctggcggcagcgcaaaagatg

SEQ ID NO: 214645 - DNA, 103 bp, Artificial Sequence
  Synthetic Polynucleotide
taatacgactcactatagggtcgaattaaatgcagtatccggattggatgaacagaggagacatccaatgcggatactgaacctggcggcagcgcaaaagatg

SEQ ID NO: 214646 - DNA, 103 bp, Artificial Sequence
  Synthetic Polynucleotide
taatacgactcactatagggacttcagggttcgaattaaatgcagtatccaacagaggagaggatacatgatttaattcaacctggcggcagcgcaaaagatg

SEQ ID NO: 214647 - DNA, 103 bp, Artificial Sequence
  Synthetic Polynucleotide
taatacgactcactatagggtgtttctttgacttcagggttcgaattaaaaacagaggagatttaatatgaaccctgaaaacctggcggcagcgcaaaagatg

SEQ ID NO: 214648 - DNA, 103 bp, Artificial Sequence
  Synthetic Polynucleotide
taatacgactcactatagggaatcaccagatgtttctttgacttcagggtaacagaggagaaccctgatgtcaaagaaaaacctggcggcagcgcaaaagatg

SEQ ID NO: 214649 - DNA, 103 bp, Artificial Sequence
  Synthetic Polynucleotide
taatacgactcactatagggacagatgagaaatcaccagatgtttctttgaacagaggagacaaagaatgatctggtgaaacctggcggcagcgcaaaagatg

SEQ ID NO: 214650 - DNA, 103 bp, Artificial Sequence
  Synthetic Polynucleotide
taatacgactcactataggggctaagatccacagatgagaaatcaccagaaacagaggagatctggtatgttctcatctaacctggcggcagcgcaaaagatg

SEQ ID NO: 214651 - DNA, 103 bp, Artificial Sequence
  Synthetic Polynucleotide
taatacgactcactatagggctggtaggaagctaagatccacagatgagaaacagaggagatctcatatgtggatcttaaacctggcggcagcgcaaaagatg

SEQ ID NO: 214652 - DNA, 103 bp, Artificial Sequence
  Synthetic Polynucleotide
taatacgactcactatagggcgcggagcgagcagcctcggaacccgctccaacagaggagaggagcgatgtccgaggctaacctggcggcagcgcaaaagatg

SEQ ID NO: 214653 - DNA, 103 bp, Artificial Sequence
  Synthetic Polynucleotide
taatacgactcactataggggtaacttcatctggtaggaagctaagatccaacagaggagaggatctatgcttcctaccaacctggcggcagcgcaaaagatg

SEQ ID NO: 214654 - DNA, 103 bp, Artificial Sequence
  Synthetic Polynucleotide
taatacgactcactatagggattttcctgggtaacttcatctggtaggaaaacagaggagattcctaatggatgaagttaacctggcggcagcgcaaaagatg

SEQ ID NO: 214655 - DNA, 103 bp, Artificial Sequence
  Synthetic Polynucleotide
taatacgactcactataggggctggtctttattttcctgggtaacttcataacagaggagaatgaagatgcccaggaaaaacctggcggcagcgcaaaagatg

SEQ ID NO: 214656 - DNA, 103 bp, Artificial Sequence
  Synthetic Polynucleotide
taatacgactcactatagggctaatgacaggctggtctttattttcctggaacagaggagaccaggaatgtaaagaccaaacctggcggcagcgcaaaagatg

SEQ ID NO: 214657 - DNA, 103 bp, Artificial Sequence
  Synthetic Polynucleotide
taatacgactcactatagggttcgtgtttgctaatgacaggctggtctttaacagaggagaaaagacatgcctgtcattaacctggcggcagcgcaaaagatg

SEQ ID NO: 214658 - DNA, 103 bp, Artificial Sequence
  Synthetic Polynucleotide
taatacgactcactatagggtttcttcagtttcgtgtttgctaatgacagaacagaggagactgtcaatggcaaacacgaacctggcggcagcgcaaaagatg

SEQ ID NO: 214659 - DNA, 103 bp, Artificial Sequence
  Synthetic Polynucleotide
taatacgactcactatagggctttcagaattttcttcagtttcgtgtttgaacagaggagacaaacaatgaactgaagaaacctggcggcagcgcaaaagatg

SEQ ID NO: 214660 - DNA, 103 bp, Artificial Sequence
  Synthetic Polynucleotide
taatacgactcactatagggtggactttggctttcagaattttcttcagtaacagaggagaactgaaatgaattctgaaaacctggcggcagcgcaaaagatg

SEQ ID NO: 214661 - DNA, 103 bp, Artificial Sequence
  Synthetic Polynucleotide
taatacgactcactatagggacctactttgtggactttggctttcagaataacagaggagaattctgatggccaaagtcaacctggcggcagcgcaaaagatg

SEQ ID NO: 214662 - DNA, 103 bp, Artificial Sequence
  Synthetic Polynucleotide
taatacgactcactatagggggtgatggcaacctactttgtggactttggaacagaggagaccaaagatgacaaagtagaacctggcggcagcgcaaaagatg

SEQ ID NO: 214663 - DNA, 103 bp, Artificial Sequence
  Synthetic Polynucleotide
taatacgactcactatagggagagggtaagcgcggagcgagcagcctcggaacagaggagaccgaggatgctcgctccgaacctggcggcagcgcaaaagatg

SEQ ID NO: 214664 - DNA, 103 bp, Artificial Sequence
  Synthetic Polynucleotide
taatacgactcactatagggctgttcgctgggtgatggcaacctactttgaacagaggagacaaagtatgttgccatcaaacctggcggcagcgcaaaagatg

SEQ ID NO: 214665 - DNA, 103 bp, Artificial Sequence
  Synthetic Polynucleotide
taatacgactcactataggggcccaacgtcctgttcgctgggtgatggcaaacagaggagatgccatatgccagcgaacaacctggcggcagcgcaaaagatg

SEQ ID NO: 214666 - DNA, 103 bp, Artificial Sequence
  Synthetic Polynucleotide
taatacgactcactatagggtttaagcccagcccaacgtcctgttcgctgaacagaggagacagcgaatgggacgttggaacctggcggcagcgcaaaagatg

SEQ ID NO: 214667 - DNA, 103 bp, Artificial Sequence
  Synthetic Polynucleotide
taatacgactcactatagggactgctgctgtttaagcccagcccaacgtcaacagaggagagacgttatgctgggcttaaacctggcggcagcgcaaaagatg

SEQ ID NO: 214668 - DNA, 103 bp, Artificial Sequence
  Synthetic Polynucleotide
taatacgactcactatagggaatttgacaaactgctgctgtttaagcccaaacagaggagatgggctatgacagcagcaaacctggcggcagcgcaaaagatg

SEQ ID NO: 214669 - DNA, 103 bp, Artificial Sequence
  Synthetic Polynucleotide
taatacgactcactatagggtgtgaatgggaatttgacaaactgctgctgaacagaggagacagcagatgtttgtcaaaaacctggcggcagcgcaaaagatg

SEQ ID NO: 214670 - DNA, 103 bp, Artificial Sequence
  Synthetic Polynucleotide
taatacgactcactatagggagggtgcagctgtgaatgggaatttgacaaaacagaggagattgtcaatgtcccattcaaacctggcggcagcgcaaaagatg

SEQ ID NO: 214671 - DNA, 103 bp, Artificial Sequence
  Synthetic Polynucleotide
taatacgactcactatagggcagtatcaccagggtgcagctgtgaatgggaacagaggagacccattatgagctgcaccaacctggcggcagcgcaaaagatg

SEQ ID NO: 214672 - DNA, 103 bp, Artificial Sequence
  Synthetic Polynucleotide
taatacgactcactatagggtggactgagtcagtatcaccagggtgcagcaacagaggagagctgcaatgtggtgatacaacctggcggcagcgcaaaagatg

SEQ ID NO: 214673 - DNA, 103 bp, Artificial Sequence
  Synthetic Polynucleotide
taatacgactcactatagggaggagagggctggactgagtcagtatcaccaacagaggagaggtgatatggactcagtcaacctggcggcagcgcaaaagatg

SEQ ID NO: 214674 - DNA, 103 bp, Artificial Sequence
  Synthetic Polynucleotide
taatacgactcactatagggggggcgggtaagagggtaagcgcggagcgaaacagaggagatcgctcatggcttaccctaacctggcggcagcgcaaaagatg

SEQ ID NO: 214675 - DNA, 103 bp, Artificial Sequence
  Synthetic Polynucleotide
taatacgactcactatagggttggtttctcaggagagggctggactgagtaacagaggagaactcagatgagccctctcaacctggcggcagcgcaaaagatg

SEQ ID NO: 214676 - DNA, 103 bp, Artificial Sequence
  Synthetic Polynucleotide
taatacgactcactataggggagtcggagtttggtttctcaggagagggcaacagaggagagccctcatgtgagaaaccaacctggcggcagcgcaaaagatg

SEQ ID NO: 214677 - DNA, 103 bp, Artificial Sequence
  Synthetic Polynucleotide
taatacgactcactatagggcagagacaaggagtcggagtttggtttctcaacagaggagagagaaaatgaactccgacaacctggcggcagcgcaaaagatg

SEQ ID NO: 214678 - DNA, 103 bp, Artificial Sequence
  Synthetic Polynucleotide
taatacgactcactatagggttatggatgccagagacaaggagtcggagtaacagaggagaactccgatgccttgtctcaacctggcggcagcgcaaaagatg

SEQ ID NO: 214679 - DNA, 103 bp, Artificial Sequence
  Synthetic Polynucleotide
taatacgactcactataggggtcatgggagttatggatgccagagacaagaacagaggagacttgtcatgggcatccataacctggcggcagcgcaaaagatg

SEQ ID NO: 214680 - DNA, 103 bp, Artificial Sequence
  Synthetic Polynucleotide
taatacgactcactatagggggtcattggtgtcatgggagttatggatgcaacagaggagagcatccatgactcccatgaacctggcggcagcgcaaaagatg

SEQ ID NO: 214681 - DNA, 103 bp, Artificial Sequence
  Synthetic Polynucleotide
taatacgactcactatagggctgaaataggggtcattggtgtcatgggagaacagaggagactcccaatgcaccaatgaaacctggcggcagcgcaaaagatg

SEQ ID NO: 214682 - DNA, 103 bp, Artificial Sequence
  Synthetic Polynucleotide
taatacgactcactatagggccacaacattctgaaataggggtcattggtaacagaggagaaccaatatgccctatttcaacctggcggcagcgcaaaagatg

SEQ ID NO: 214683 - DNA, 103 bp, Artificial Sequence
  Synthetic Polynucleotide
taatacgactcactatagggaggtacaattccacaacattctgaaataggaacagaggagacctattatggaatgttgtaacctggcggcagcgcaaaagatg

SEQ ID NO: 214684 - DNA, 103 bp, Artificial Sequence
  Synthetic Polynucleotide
taatacgactcactatagggtctgtagttgaggtacaattccacaacattaacagaggagaaatgttatggaattgtacaacctggcggcagcgcaaaagatg

SEQ ID NO: 214685 - DNA, 103 bp, Artificial Sequence
  Synthetic Polynucleotide
taatacgactcactataggggttgggggtgggggcgggtaagagggtaagaacagaggagacttaccatgttacccgccaacctggcggcagcgcaaaagatg

SEQ ID NO: 214686 - DNA, 103 bp, Artificial Sequence
  Synthetic Polynucleotide
taatacgactcactataggggaaactatattctgtagttgaggtacaattaacagaggagaaattgtatgtcaactacaaacctggcggcagcgcaaaagatg

SEQ ID NO: 214687 - DNA, 103 bp, Artificial Sequence
  Synthetic Polynucleotide
taatacgactcactataggggtttacagtggaaactatattctgtagttgaacagaggagacaactaatgaatatagttaacctggcggcagcgcaaaagatg

SEQ ID NO: 214688 - DNA, 103 bp, Artificial Sequence
  Synthetic Polynucleotide
taatacgactcactatagggtacaggccaggtttacagtggaaactatataacagaggagaatatagatgccactgtaaaacctggcggcagcgcaaaagatg

SEQ ID NO: 214689 - DNA, 103 bp, Artificial Sequence
  Synthetic Polynucleotide
taatacgactcactatagggagatccaacttacaggccaggtttacagtgaacagaggagacactgtatgcctggcctgaacctggcggcagcgcaaaagatg

SEQ ID NO: 214690 - DNA, 103 bp, Artificial Sequence
  Synthetic Polynucleotide
taatacgactcactatagggtattttcttcagatccaacttacaggccagaacagaggagactggccatgaagttggataacctggcggcagcgcaaaagatg

SEQ ID NO: 214691 - DNA, 103 bp, Artificial Sequence
  Synthetic Polynucleotide
taatacgactcactatagggcatgcaaagctattttcttcagatccaactaacagaggagaagttggatgtgaagaaaaaacctggcggcagcgcaaaagatg

SEQ ID NO: 214692 - DNA, 103 bp, Artificial Sequence
  Synthetic Polynucleotide
taatacgactcactataggggcattttttgcatgcaaagctattttcttcaacagaggagagaagaaatgagctttgcaaacctggcggcagcgcaaaagatg

SEQ ID NO: 214693 - DNA, 103 bp, Artificial Sequence
  Synthetic Polynucleotide
taatacgactcactataggggttatattctgcattttttgcatgcaaagcaacagaggagagctttgatggcaaaaaataacctggcggcagcgcaaaagatg

SEQ ID NO: 214694 - DNA, 103 bp, Artificial Sequence
  Synthetic Polynucleotide
taatacgactcactatagggacctctttgggttatattctgcattttttgaacagaggagacaaaaaatgcagaatataaacctggcggcagcgcaaaagatg

SEQ ID NO: 214695 - DNA, 103 bp, Artificial Sequence
  Synthetic Polynucleotide
taatacgactcactatagggacagcagcaaacctctttgggttatattctaacagaggagaagaataatgcccaaagagaacctggcggcagcgcaaaagatg

SEQ ID NO: 214696 - DNA, 103 bp, Artificial Sequence
  Synthetic Polynucleotide
taatacgactcactatagggtaatcccactgttgggggtgggggcgggtaaacagaggagatacccgatgccacccccaaacctggcggcagcgcaaaagatg

SEQ ID NO: 214697 - DNA, 103 bp, Artificial Sequence
  Synthetic Polynucleotide
taatacgactcactatagggcctcattatgacagcagcaaacctctttggaacagaggagaccaaagatgtttgctgctaacctggcggcagcgcaaaagatg

SEQ ID NO: 214698 - DNA, 103 bp, Artificial Sequence
  Synthetic Polynucleotide
taatacgactcactataggggctctcggatcctcattatgacagcagcaaaacagaggagattgctgatgtcataatgaaacctggcggcagcgcaaaagatg

SEQ ID NO: 214699 - DNA, 103 bp, Artificial Sequence
  Synthetic Polynucleotide
taatacgactcactataggggttgtcctgggctctcggatcctcattatgaacagaggagacataatatggatccgagaaacctggcggcagcgcaaaagatg

SEQ ID NO: 214700 - DNA, 103 bp, Artificial Sequence
  Synthetic Polynucleotide
taatacgactcactatagggtataagggctgttgtcctgggctctcggataacagaggagaatccgaatgcccaggacaaacctggcggcagcgcaaaagatg

SEQ ID NO: 214701 - DNA, 103 bp, Artificial Sequence
  Synthetic Polynucleotide
taatacgactcactatagggcagagctaaatataagggctgttgtcctggaacagaggagaccaggaatgcagcccttaaacctggcggcagcgcaaaagatg

SEQ ID NO: 214702 - DNA, 103 bp, Artificial Sequence
  Synthetic Polynucleotide
taatacgactcactatagggaccatcttcccagagctaaatataagggctaacagaggagaagccctatgatttagctcaacctggcggcagcgcaaaagatg

SEQ ID NO: 214703 - DNA, 103 bp, Artificial Sequence
  Synthetic Polynucleotide
taatacgactcactatagggtcccgtgcagaccatcttcccagagctaaaaacagaggagatttagcatggggaagatgaacctggcggcagcgcaaaagatg

SEQ ID NO: 214704 - DNA, 103 bp, Artificial Sequence
  Synthetic Polynucleotide
taatacgactcactatagggcacttttggctcccgtgcagaccatcttccaacagaggagaggaagaatgtctgcacggaacctggcggcagcgcaaaagatg

SEQ ID NO: 214705 - DNA, 103 bp, Artificial Sequence
  Synthetic Polynucleotide
taatacgactcactataggggactgctcttcacttttggctcccgtgcagaacagaggagactgcacatgagccaaaagaacctggcggcagcgcaaaagatg

SEQ ID NO: 214706 - DNA, 103 bp, Artificial Sequence
  Synthetic Polynucleotide
taatacgactcactatagggtgcaagtcgagactgctcttcacttttggcaacagaggagagccaaaatggaagagcagaacctggcggcagcgcaaaagatg

SEQ ID NO: 214707 - DNA, 103 bp, Artificial Sequence
  Synthetic Polynucleotide
taatacgactcactatagggccatggaccgtaatcccactgttgggggtgaacagaggagacaccccatgcagtgggataacctggcggcagcgcaaaagatg

SEQ ID NO: 214708 - DNA, 103 bp, Artificial Sequence
  Synthetic Polynucleotide
taatacgactcactatagggattttcttgctgcaagtcgagactgctcttaacagaggagaaagagcatgctcgacttgaacctggcggcagcgcaaaagatg

SEQ ID NO: 214709 - DNA, 103 bp, Artificial Sequence
  Synthetic Polynucleotide
taatacgactcactatagggacacgagcatattttcttgctgcaagtcgaaacagaggagatcgactatgagcaagaaaaacctggcggcagcgcaaaagatg

SEQ ID NO: 214710 - DNA, 103 bp, Artificial Sequence
  Synthetic Polynucleotide
taatacgactcactatagggcttctgcaccacacgagcatattttcttgcaacagaggagagcaagaatgtatgctcgtaacctggcggcagcgcaaaagatg

SEQ ID NO: 214711 - DNA, 103 bp, Artificial Sequence
  Synthetic Polynucleotide
taatacgactcactatagggggaacccaagcttctgcaccacacgagcataacagaggagaatgctcatgtggtgcagaaacctggcggcagcgcaaaagatg

SEQ ID NO: 214712 - DNA, 103 bp, Artificial Sequence
  Synthetic Polynucleotide
taatacgactcactatagggaatctggcagggaacccaagcttctgcaccaacagaggagaggtgcaatggcttgggttaacctggcggcagcgcaaaagatg

SEQ ID NO: 214713 - DNA, 103 bp, Artificial Sequence
  Synthetic Polynucleotide
taatacgactcactatagggaaaatcgaggaatctggcagggaacccaagaacagaggagacttgggatgcctgccagaaacctggcggcagcgcaaaagatg

SEQ ID NO: 214714 - DNA, 103 bp, Artificial Sequence
  Synthetic Polynucleotide
taatacgactcactatagggtctgaattttaaaatcgaggaatctggcagaacagaggagactgccaatgtcctcgattaacctggcggcagcgcaaaagatg

SEQ ID NO: 214715 - DNA, 103 bp, Artificial Sequence
  Synthetic Polynucleotide
taatacgactcactatagggccaaccatgttctgaattttaaaatcgaggaacagaggagacctcgaatgtaaaattcaaacctggcggcagcgcaaaagatg

SEQ ID NO: 214716 - DNA, 103 bp, Artificial Sequence
  Synthetic Polynucleotide
taatacgactcactatagggatcacagcttccaaccatgttctgaattttaacagaggagaaaaattatgaacatggttaacctggcggcagcgcaaaagatg

SEQ ID NO: 214717 - DNA, 103 bp, Artificial Sequence
  Synthetic Polynucleotide
taatacgactcactataggggaaatctcacatcacagcttccaaccatgtaacagaggagaacatggatggaagctgtgaacctggcggcagcgcaaaagatg

SEQ ID NO: 214718 - DNA, 103 bp, Artificial Sequence
  Synthetic Polynucleotide
taatacgactcactatagggtcctcctgctccatggaccgtaatcccactaacagaggagaagtgggatgacggtccataacctggcggcagcgcaaaagatg

SEQ ID NO: 214719 - DNA, 103 bp, Artificial Sequence
  Synthetic Polynucleotide
taatacgactcactatagggagcctgatgggaaatctcacatcacagcttaacagaggagaaagctgatgtgtgagattaacctggcggcagcgcaaaagatg

SEQ ID NO: 214720 - DNA, 103 bp, Artificial Sequence
  Synthetic Polynucleotide
taatacgactcactatagggcaaaccttccagcctgatgggaaatctcacaacagaggagagtgagaatgcccatcaggaacctggcggcagcgcaaaagatg

SEQ ID NO: 214721 - DNA, 103 bp, Artificial Sequence
  Synthetic Polynucleotide
taatacgactcactataggggggttagcaccaaaccttccagcctgatggaacagaggagaccatcaatgtggaaggttaacctggcggcagcgcaaaagatg

SEQ ID NO: 214722 - DNA, 103 bp, Artificial Sequence
  Synthetic Polynucleotide
taatacgactcactatagggaactgctgatgggttagcaccaaaccttccaacagaggagaggaaggatgggtgctaacaacctggcggcagcgcaaaagatg

SEQ ID NO: 214723 - DNA, 103 bp, Artificial Sequence
  Synthetic Polynucleotide
taatacgactcactataggggtaactactgaactgctgatgggttagcacaacagaggagagtgctaatgcatcagcagaacctggcggcagcgcaaaagatg

SEQ ID NO: 214724 - DNA, 103 bp, Artificial Sequence
  Synthetic Polynucleotide
taatacgactcactataggggttcaggctcgtaactactgaactgctgataacagaggagaatcagcatgtcagtagttaacctggcggcagcgcaaaagatg

SEQ ID NO: 214725 - DNA, 103 bp, Artificial Sequence
  Synthetic Polynucleotide
taatacgactcactatagggccaggaaacagttcaggctcgtaactactgaacagaggagacagtagatgcgagcctgaaacctggcggcagcgcaaaagatg

SEQ ID NO: 214726 - DNA, 103 bp, Artificial Sequence
  Synthetic Polynucleotide
taatacgactcactatagggataaataagaccaggaaacagttcaggctcaacagaggagagagcctatgctgtttcctaacctggcggcagcgcaaaagatg

SEQ ID NO: 214727 - DNA, 103 bp, Artificial Sequence
  Synthetic Polynucleotide
taatacgactcactatagggttaccattctataaataagaccaggaaacaaacagaggagatgtttcatggtcttatttaacctggcggcagcgcaaaagatg

SEQ ID NO: 214728 - DNA, 103 bp, Artificial Sequence
  Synthetic Polynucleotide
taatacgactcactatagggattcgtggttttaccattctataaataagaaacagaggagatcttatatgtagaatggtaacctggcggcagcgcaaaagatg

SEQ ID NO: 214729 - DNA, 103 bp, Artificial Sequence
  Synthetic Polynucleotide
taatacgactcactatagggagaaggagaaaggcagtgctccagctgcataacagaggagaatgcagatggagcactgcaacctggcggcagcgcaaaagatg

SEQ ID NO: 214730 - DNA, 103 bp, Artificial Sequence
  Synthetic Polynucleotide
taatacgactcactataggggataatgggatgatcgtgcaagacaagctcaacagaggagagagcttatgttgcacgataacctggcggcagcgcaaaagatg

SEQ ID NO: 214731 - DNA, 103 bp, Artificial Sequence
  Synthetic Polynucleotide
taatacgactcactatagggcaccacatgcaggcggggctggtacttgtgaacagaggagacacaagatgcagccccgcaacctggcggcagcgcaaaagatg

SEQ ID NO: 214732 - DNA, 103 bp, Artificial Sequence
  Synthetic Polynucleotide
taatacgactcactatagggcgttcacttccaccacatgcaggcggggctaacagaggagaagccccatgtgcatgtggaacctggcggcagcgcaaaagatg

SEQ ID NO: 214733 - DNA, 103 bp, Artificial Sequence
  Synthetic Polynucleotide
taatacgactcactataggggtgccgtcctcgttcacttccaccacatgcaacagaggagagcatgtatgggaagtgaaaacctggcggcagcgcaaaagatg

SEQ ID NO: 214734 - DNA, 103 bp, Artificial Sequence
  Synthetic Polynucleotide
taatacgactcactatagggagtgtcctccgtgccgtcctcgttcacttcaacagaggagagaagtgatggaggacggcaacctggcggcagcgcaaaagatg

SEQ ID NO: 214735 - DNA, 103 bp, Artificial Sequence
  Synthetic Polynucleotide
taatacgactcactatagggcgggctggctagtgtcctccgtgccgtcctaacagaggagaaggacgatgcggaggacaaacctggcggcagcgcaaaagatg

SEQ ID NO: 214736 - DNA, 103 bp, Artificial Sequence
  Synthetic Polynucleotide
taatacgactcactatagggtgcacgcggccgggctggctagtgtcctccaacagaggagaggaggaatgtagccagccaacctggcggcagcgcaaaagatg

SEQ ID NO: 214737 - DNA, 103 bp, Artificial Sequence
  Synthetic Polynucleotide
taatacgactcactatagggagtgaacgtctgcacgcggccgggctggctaacagaggagaagccagatgggccgcgtgaacctggcggcagcgcaaaagatg

SEQ ID NO: 214738 - DNA, 103 bp, Artificial Sequence
  Synthetic Polynucleotide
taatacgactcactatagggtctcagggaaagtgaacgtctgcacgcggcaacagaggagagccgcgatgagacgttcaaacctggcggcagcgcaaaagatg

SEQ ID NO: 214739 - DNA, 103 bp, Artificial Sequence
  Synthetic Polynucleotide
taatacgactcactatagggatgaactgagtctcagggaaagtgaacgtcaacagaggagagacgttatgtttccctgaaacctggcggcagcgcaaaagatg

SEQ ID NO: 214740 - DNA, 103 bp, Artificial Sequence
  Synthetic Polynucleotide
taatacgactcactatagggggtgacggcgatgaactgagtctcagggaaaacagaggagattccctatgactcagttcaacctggcggcagcgcaaaagatg

SEQ ID NO: 214741 - DNA, 103 bp, Artificial Sequence
  Synthetic Polynucleotide
taatacgactcactatagggcagtggtcgagataatgggatgatcgtgcaaacagaggagatgcacgatgatcccattaaacctggcggcagcgcaaaagatg

SEQ ID NO: 214742 - DNA, 103 bp, Artificial Sequence
  Synthetic Polynucleotide
taatacgactcactatagggtctggtaggcggtgacggcgatgaactgagaacagaggagactcagtatgtcgccgtcaaacctggcggcagcgcaaaagatg

SEQ ID NO: 214743 - DNA, 103 bp, Artificial Sequence
  Synthetic Polynucleotide
taatacgactcactatagggatatccgtgttctggtaggcggtgacggcgaacagaggagacgccgtatgcgcctaccaaacctggcggcagcgcaaaagatg

SEQ ID NO: 214744 - DNA, 103 bp, Artificial Sequence
  Synthetic Polynucleotide
taatacgactcactatagggcagttgtgtaatatccgtgttctggtaggcaacagaggagagcctacatgaacacggataacctggcggcagcgcaaaagatg

SEQ ID NO: 214745 - DNA, 103 bp, Artificial Sequence
  Synthetic Polynucleotide
taatacgactcactataggggatctattttcagttgtgtaatatccgtgtaacagaggagaacacggatgttacacaacaacctggcggcagcgcaaaagatg

SEQ ID NO: 214746 - DNA, 103 bp, Artificial Sequence
  Synthetic Polynucleotide
taatacgactcactatagggaaagggttgtgatctattttcagttgtgtaaacagaggagatacacaatggaaaatagaaacctggcggcagcgcaaaagatg

SEQ ID NO: 214747 - DNA, 103 bp, Artificial Sequence
  Synthetic Polynucleotide
taatacgactcactatagggtccttttgcaaaagggttgtgatctattttaacagaggagaaaaataatgcacaaccctaacctggcggcagcgcaaaagatg

SEQ ID NO: 214748 - DNA, 103 bp, Artificial Sequence
  Synthetic Polynucleotide
taatacgactcactatagggtatcccgaaatccttttgcaaaagggttgtaacagaggagaacaaccatgttgcaaaagaacctggcggcagcgcaaaagatg

SEQ ID NO: 214749 - DNA, 103 bp, Artificial Sequence
  Synthetic Polynucleotide
taatacgactcactataggggtgtcataattatcccgaaatccttttgcaaacagaggagatgcaaaatgatttcgggaaacctggcggcagcgcaaaagatg

SEQ ID NO: 214750 - DNA, 103 bp, Artificial Sequence
  Synthetic Polynucleotide
taatacgactcactatagggggtgtagatcgtgtcataattatcccgaaaaacagaggagatttcggatgaattatgacaacctggcggcagcgcaaaagatg

SEQ ID NO: 214751 - DNA, 103 bp, Artificial Sequence
  Synthetic Polynucleotide
taatacgactcactatagggtgtcacagccggtgtagatcgtgtcataataacagaggagaattatgatgcgatctacaaacctggcggcagcgcaaaagatg

SEQ ID NO: 214752 - DNA, 103 bp, Artificial Sequence
  Synthetic Polynucleotide
taatacgactcactatagggtccaggttgtcagtggtcgagataatgggaaacagaggagatcccatatgctcgaccacaacctggcggcagcgcaaaagatg

SEQ ID NO: 214753 - DNA, 103 bp, Artificial Sequence
  Synthetic Polynucleotide
taatacgactcactatagggaggcggtccatgtcacagccggtgtagatcaacagaggagagatctaatgcggctgtgaaacctggcggcagcgcaaaagatg

SEQ ID NO: 214754 - DNA, 103 bp, Artificial Sequence
  Synthetic Polynucleotide
taatacgactcactatagggcgagggggtcaggcggtccatgtcacagccaacagaggagaggctgtatgatggaccgcaacctggcggcagcgcaaaagatg

SEQ ID NO: 214755 - DNA, 103 bp, Artificial Sequence
  Synthetic Polynucleotide
taatacgactcactatagggagtcgttgggcgagggggtcaggcggtccaaacagaggagatggaccatgtgaccccctaacctggcggcagcgcaaaagatg

SEQ ID NO: 214756 - DNA, 103 bp, Artificial Sequence
  Synthetic Polynucleotide
taatacgactcactataggggagcgcggcgagtcgttgggcgagggggtcaacagaggagagaccccatggcccaacgaaacctggcggcagcgcaaaagatg

SEQ ID NO: 214757 - DNA, 103 bp, Artificial Sequence
  Synthetic Polynucleotide
taatacgactcactatagggcacgatctgcgagcgcggcgagtcgttgggaacagaggagacccaacatgtcgccgcgcaacctggcggcagcgcaaaagatg

SEQ ID NO: 214758 - DNA, 103 bp, Artificial Sequence
  Synthetic Polynucleotide
taatacgactcactataggggggccccgggcacgatctgcgagcgcggcgaacagaggagacgccgcatgcgcagatcgaacctggcggcagcgcaaaagatg

SEQ ID NO: 214759 - DNA, 103 bp, Artificial Sequence
  Synthetic Polynucleotide
taatacgactcactatagggatggcgtagcgggccccgggcacgatctgcaacagaggagagcagatatggcccggggcaacctggcggcagcgcaaaagatg

SEQ ID NO: 214760 - DNA, 103 bp, Artificial Sequence
  Synthetic Polynucleotide
taatacgactcactatagggagagccggccatggcgtagcgggccccgggaacagaggagacccgggatgcgctacgccaacctggcggcagcgcaaaagatg

SEQ ID NO: 214761 - DNA, 103 bp, Artificial Sequence
  Synthetic Polynucleotide
taatacgactcactatagggcctgcaggaaagagccggccatggcgtagcaacagaggagagctacgatgtggccggctaacctggcggcagcgcaaaagatg

SEQ ID NO: 214762 - DNA, 103 bp, Artificial Sequence
  Synthetic Polynucleotide
taatacgactcactatagggacgaactggtcctgcaggaaagagccggccaacagaggagaggccggatgtttcctgcaaacctggcggcagcgcaaaagatg

SEQ ID NO: 214763 - DNA, 103 bp, Artificial Sequence
  Synthetic Polynucleotide
taatacgactcactatagggtgaacttctctccaggttgtcagtggtcgaaacagaggagatcgaccatggacaacctgaacctggcggcagcgcaaaagatg

SEQ ID NO: 214764 - DNA, 103 bp, Artificial Sequence
  Synthetic Polynucleotide
taatacgactcactataggggtagttgctcacgaactggtcctgcaggaaaacagaggagattcctgatggaccagttcaacctggcggcagcgcaaaagatg

SEQ ID NO: 214765 - DNA, 103 bp, Artificial Sequence
  Synthetic Polynucleotide
taatacgactcactataggggggccttggcgtagttgctcacgaactggtaacagaggagaaccagtatgtgagcaactaacctggcggcagcgcaaaagatg

SEQ ID NO: 214766 - DNA, 103 bp, Artificial Sequence
  Synthetic Polynucleotide
taatacgactcactataggggggtggaagcgggccttggcgtagttgctcaacagaggagagagcaaatgcgccaaggcaacctggcggcagcgcaaaagatg

SEQ ID NO: 214767 - DNA, 103 bp, Artificial Sequence
  Synthetic Polynucleotide
taatacgactcactataggggcccgcgcccgggtggaagcgggccttggcaacagaggagagccaagatgcgcttccacaacctggcggcagcgcaaaagatg

SEQ ID NO: 214768 - DNA, 103 bp, Artificial Sequence
  Synthetic Polynucleotide
taatacgactcactatagggcggggcccgcgcccgcgcccgggtggaagcaacagaggagagcttccatgcgggcgcggaacctggcggcagcgcaaaagatg

SEQ ID NO: 214769 - DNA, 103 bp, Artificial Sequence
  Synthetic Polynucleotide
taatacgactcactataggggtacccggcccggggcccgcgcccgcgcccaacagaggagagggcgcatgcgcgggcccaacctggcggcagcgcaaaagatg

SEQ ID NO: 214770 - DNA, 103 bp, Artificial Sequence
  Synthetic Polynucleotide
taatacgactcactataggggctgcggtccgtacccggcccggggcccgcaacagaggagagcgggcatggggccgggtaacctggcggcagcgcaaaagatg

SEQ ID NO: 214771 - DNA, 103 bp, Artificial Sequence
  Synthetic Polynucleotide
taatacgactcactatagggtgtgcggcacgctgcggtccgtacccggccaacagaggagaggccggatgcggaccgcaaacctggcggcagcgcaaaagatg

SEQ ID NO: 214772 - DNA, 103 bp, Artificial Sequence
  Synthetic Polynucleotide
taatacgactcactatagggagcccgttggtgtgcggcacgctgcggtccaacagaggagaggaccgatgcgtgccgcaaacctggcggcagcgcaaaagatg

SEQ ID NO: 214773 - DNA, 103 bp, Artificial Sequence
  Synthetic Polynucleotide
taatacgactcactatagggcggcgacagcagcccgttggtgtgcggcacaacagaggagagtgccgatgaccaacgggaacctggcggcagcgcaaaagatg

SEQ ID NO: 214774 - DNA, 103 bp, Artificial Sequence
  Synthetic Polynucleotide
taatacgactcactatagggttttcaaaggtgaacttctctccaggttgtaacagaggagaacaaccatgagagaagttaacctggcggcagcgcaaaagatg

SEQ ID NO: 214775 - DNA, 103 bp, Artificial Sequence
  Synthetic Polynucleotide
taatacgactcactatagggcggcctgctgcggcgacagcagcccgttggaacagaggagaccaacgatgtgctgtcgcaacctggcggcagcgcaaaagatg

SEQ ID NO: 214776 - DNA, 103 bp, Artificial Sequence
  Synthetic Polynucleotide
taatacgactcactatagggcccgggtcctcggcctgctgcggcgacagcaacagaggagagctgtcatggcagcaggcaacctggcggcagcgcaaaagatg

SEQ ID NO: 214777 - DNA, 103 bp, Artificial Sequence
  Synthetic Polynucleotide
taatacgactcactatagggcgagggcgcgcccgggtcctcggcctgctgaacagaggagacagcagatggaggacccgaacctggcggcagcgcaaaagatg

SEQ ID NO: 214778 - DNA, 103 bp, Artificial Sequence
  Synthetic Polynucleotide
taatacgactcactatagggagcgttgcggcgagggcgcgcccgggtcctaacagaggagaaggaccatggcgcgccctaacctggcggcagcgcaaaagatg

SEQ ID NO: 214779 - DNA, 103 bp, Artificial Sequence
  Synthetic Polynucleotide
taatacgactcactataggggtcacaaaccagcgttgcggcgagggcgcgaacagaggagacgcgccatggccgcaacgaacctggcggcagcgcaaaagatg

SEQ ID NO: 214780 - DNA, 103 bp, Artificial Sequence
  Synthetic Polynucleotide
taatacgactcactataggggttggccggcgtcacaaaccagcgttgcggaacagaggagaccgcaaatgtggtttgtgaacctggcggcagcgcaaaagatg

SEQ ID NO: 214781 - DNA, 103 bp, Artificial Sequence
  Synthetic Polynucleotide
taatacgactcactatagggccagccggttgttggccggcgtcacaaaccaacagaggagaggtttgatgcgccggccaaacctggcggcagcgcaaaagatg

SEQ ID NO: 214782 - DNA, 103 bp, Artificial Sequence
  Synthetic Polynucleotide
taatacgactcactataggggccgcgaagtccagccggttgttggccggcaacagaggagagccggcatgcaaccggctaacctggcggcagcgcaaaagatg

SEQ ID NO: 214783 - DNA, 103 bp, Artificial Sequence
  Synthetic Polynucleotide
taatacgactcactatagggataggccgaggccgcgaagtccagccggttaacagaggagaaaccggatggacttcgcgaacctggcggcagcgcaaaagatg

SEQ ID NO: 214784 - DNA, 103 bp, Artificial Sequence
  Synthetic Polynucleotide
taatacgactcactatagggtggccgtgtcataggccgaggccgcgaagtaacagaggagaacttcgatgcctcggcctaacctggcggcagcgcaaaagatg

SEQ ID NO: 214785 - DNA, 103 bp, Artificial Sequence
  Synthetic Polynucleotide
taatacgactcactatagggctggtaatttttttcaaaggtgaacttctcaacagaggagagagaagatgacctttgaaaacctggcggcagcgcaaaagatg

SEQ ID NO: 214786 - DNA, 103 bp, Artificial Sequence
  Synthetic Polynucleotide
taatacgactcactataggggcgaagtccgtggccgtgtcataggccgagaacagaggagactcggcatgtgacacggcaacctggcggcagcgcaaaagatg

SEQ ID NO: 214787 - DNA, 103 bp, Artificial Sequence
  Synthetic Polynucleotide
taatacgactcactatagggcgcgttgcccgcgaagtccgtggccgtgtcaacagaggagagacacgatgacggacttcaacctggcggcagcgcaaaagatg

SEQ ID NO: 214788 - DNA, 103 bp, Artificial Sequence
  Synthetic Polynucleotide
taatacgactcactataggggcagcgtggccgcgttgcccgcgaagtccgaacagaggagacggactatgcgggcaacgaacctggcggcagcgcaaaagatg

SEQ ID NO: 214789 - DNA, 103 bp, Artificial Sequence
  Synthetic Polynucleotide
taatacgactcactataggggcgtaagagagcagcgtggccgcgttgcccaacagaggagagggcaaatgggccacgctaacctggcggcagcgcaaaagatg

SEQ ID NO: 214790 - DNA, 103 bp, Artificial Sequence
  Synthetic Polynucleotide
taatacgactcactataggggcccgccgccgcgtaagagagcagcgtggcaacagaggagagccacgatgctctcttacaacctggcggcagcgcaaaagatg

SEQ ID NO: 214791 - DNA, 103 bp, Artificial Sequence
  Synthetic Polynucleotide
taatacgactcactataggggcgccttcacgcccgccgccgcgtaagagaaacagaggagatctcttatgcggcggcggaacctggcggcagcgcaaaagatg

SEQ ID NO: 214792 - DNA, 103 bp, Artificial Sequence
  Synthetic Polynucleotide
taatacgactcactatagggtgcagcggcagcgccttcacgcccgccgccaacagaggagaggcggcatgcgtgaaggcaacctggcggcagcgcaaaagatg

SEQ ID NO: 214793 - DNA, 103 bp, Artificial Sequence
  Synthetic Polynucleotide
taatacgactcactataggggcctgcagcctgcagcggcagcgccttcacaacagaggagagtgaagatgctgccgctgaacctggcggcagcgcaaaagatg

SEQ ID NO: 214794 - DNA, 103 bp, Artificial Sequence
  Synthetic Polynucleotide
taatacgactcactatagggggccagtgcagcctgcagcctgcagcggcaaacagaggagatgccgcatgaggctgcagaacctggcggcagcgcaaaagatg

SEQ ID NO: 214795 - DNA, 103 bp, Artificial Sequence
  Synthetic Polynucleotide
taatacgactcactatagggccgagcgggcggccagtgcagcctgcagccaacagaggagaggctgcatgctgcactggaacctggcggcagcgcaaaagatg

SEQ ID NO: 214796 - DNA, 103 bp, Artificial Sequence
  Synthetic Polynucleotide
taatacgactcactatagggcgtcatccccctggtaatttttttcaaaggaacagaggagacctttgatgaaaattaccaacctggcggcagcgcaaaagatg

SEQ ID NO: 214797 - DNA, 103 bp, Artificial Sequence
  Synthetic Polynucleotide
taatacgactcactatagggggcgtagtagccgagcgggcggccagtgcaaacagaggagatgcactatgcgcccgctcaacctggcggcagcgcaaaagatg

SEQ ID NO: 214798 - DNA, 103 bp, Artificial Sequence
  Synthetic Polynucleotide
taatacgactcactatagggccgacgggtcggcgtagtagccgagcgggcaacagaggagagcccgcatggctactacgaacctggcggcagcgcaaaagatg

SEQ ID NO: 214799 - DNA, 103 bp, Artificial Sequence
  Synthetic Polynucleotide
taatacgactcactataggggcgccccagcccgacgggtcggcgtagtagaacagaggagactactaatgcgacccgtcaacctggcggcagcgcaaaagatg

SEQ ID NO: 214800 - DNA, 103 bp, Artificial Sequence
  Synthetic Polynucleotide
taatacgactcactataggggggactgcgggcgccccagcccgacgggtcaacagaggagagacccgatgggctggggcaacctggcggcagcgcaaaagatg

SEQ ID NO: 214801 - DNA, 103 bp, Artificial Sequence
  Synthetic Polynucleotide
taatacgactcactatagggagtactgcgggggactgcgggcgccccagcaacagaggagagctgggatgcccgcagtcaacctggcggcagcgcaaaagatg

SEQ ID NO: 214802 - DNA, 103 bp, Artificial Sequence
  Synthetic Polynucleotide
taatacgactcactatagggttggtgccgcagtactgcgggggactgcggaacagaggagaccgcagatgcccgcagtaaacctggcggcagcgcaaaagatg

SEQ ID NO: 214803 - DNA, 103 bp, Artificial Sequence
  Synthetic Polynucleotide
taatacgactcactatagggcgagcccgacttggtgccgcagtactgcggaacagaggagaccgcagatgtgcggcaccaacctggcggcagcgcaaaagatg

SEQ ID NO: 214804 - DNA, 103 bp, Artificial Sequence
  Synthetic Polynucleotide
taatacgactcactatagggagggcagcaccgagcccgacttggtgccgcaacagaggagagcggcaatgagtcgggctaacctggcggcagcgcaaaagatg

SEQ ID NO: 214805 - DNA, 103 bp, Artificial Sequence
  Synthetic Polynucleotide
taatacgactcactatagggttgggccagcagggcagcaccgagcccgacaacagaggagagtcgggatgggtgctgccaacctggcggcagcgcaaaagatg

SEQ ID NO: 214806 - DNA, 103 bp, Artificial Sequence
  Synthetic Polynucleotide
taatacgactcactatagggcgcggcgctgttgggccagcagggcagcacaacagaggagagtgctgatgtgctggcccaacctggcggcagcgcaaaagatg

SEQ ID NO: 214807 - DNA, 103 bp, Artificial Sequence
  Synthetic Polynucleotide
taatacgactcactatagggctgactgattcgtcatccccctggtaatttaacagaggagaaaattaatggggggatgaaacctggcggcagcgcaaaagatg

SEQ ID NO: 214808 - DNA, 103 bp, Artificial Sequence
  Synthetic Polynucleotide
taatacgactcactataggggcgcggcggccgcggcgctgttgggccagcaacagaggagagctggcatgacagcgccgaacctggcggcagcgcaaaagatg

SEQ ID NO: 214809 - DNA, 103 bp, Artificial Sequence
  Synthetic Polynucleotide
taatacgactcactatagggccggccatgcgcgcggcggccgcggcgctgaacagaggagacagcgcatgggccgccgcaacctggcggcagcgcaaaagatg

SEQ ID NO: 214810 - DNA, 103 bp, Artificial Sequence
  Synthetic Polynucleotide
taatacgactcactataggggggattggcgccggccatgcgcgcggcggcaacagaggagagccgccatgcgcatggccaacctggcggcagcgcaaaagatg

SEQ ID NO: 214811 - DNA, 103 bp, Artificial Sequence
  Synthetic Polynucleotide
taatacgactcactatagggcgcccaggtagggattggcgccggccatgcaacagaggagagcatggatggcgccaatcaacctggcggcagcgcaaaagatg

SEQ ID NO: 214812 - DNA, 103 bp, Artificial Sequence
  Synthetic Polynucleotide
taatacgactcactatagggtcggcctcctcgcccaggtagggattggcgaacagaggagacgccaaatgctacctgggaacctggcggcagcgcaaaagatg

SEQ ID NO: 214813 - DNA, 103 bp, Artificial Sequence
  Synthetic Polynucleotide
taatacgactcactatagggggccaggccctcggcctcctcgcccaggtaaacagaggagatacctgatggaggaggccaacctggcggcagcgcaaaagatg

SEQ ID NO: 214814 - DNA, 103 bp, Artificial Sequence
  Synthetic Polynucleotide
taatacgactcactatagggagcgctcggcggccaggccctcggcctcctaacagaggagaaggaggatgagggcctggaacctggcggcagcgcaaaagatg

SEQ ID NO: 214815 - DNA, 103 bp, Artificial Sequence
  Synthetic Polynucleotide
taatacgactcactatagggggcagcggcgagcgctcggcggccaggcccaacagaggagagggcctatgcgccgagcgaacctggcggcagcgcaaaagatg

SEQ ID NO: 214816 - DNA, 103 bp, Artificial Sequence
  Synthetic Polynucleotide
taatacgactcactatagggggcgccgggcggcagcggcgagcgctcggcaacagaggagagccgagatgtcgccgctgaacctggcggcagcgcaaaagatg

SEQ ID NO: 214817 - DNA, 103 bp, Artificial Sequence
  Synthetic Polynucleotide
taatacgactcactatagggcgtcctcggcggcgccgggcggcagcggcgaacagaggagacgccgcatgcgcccggcgaacctggcggcagcgcaaaagatg

SEQ ID NO: 214818 - DNA, 103 bp, Artificial Sequence
  Synthetic Polynucleotide
taatacgactcactatagggttgtctgtatctgactgattcgtcatccccaacagaggagaggggatatggaatcagtcaacctggcggcagcgcaaaagatg

SEQ ID NO: 214819 - DNA, 103 bp, Artificial Sequence
  Synthetic Polynucleotide
taatacgactcactatagggttgggcttggcgtcctcggcggcgccgggcaacagaggagagcccggatgcgccgaggaaacctggcggcagcgcaaaagatg

SEQ ID NO: 214820 - DNA, 103 bp, Artificial Sequence
  Synthetic Polynucleotide
taatacgactcactatagggggacaggtccttgggcttggcgtcctcggcaacagaggagagccgagatggccaagcccaacctggcggcagcgcaaaagatg

SEQ ID NO: 214821 - DNA, 103 bp, Artificial Sequence
  Synthetic Polynucleotide
taatacgactcactatagggagctggaatcggacaggtccttgggcttggaacagaggagaccaagcatgaggacctgtaacctggcggcagcgcaaaagatg

SEQ ID NO: 214822 - DNA, 103 bp, Artificial Sequence
  Synthetic Polynucleotide
taatacgactcactataggggtctcgatccagctggaatcggacaggtccaacagaggagaggacctatgcgattccagaacctggcggcagcgcaaaagatg

SEQ ID NO: 214823 - DNA, 103 bp, Artificial Sequence
  Synthetic Polynucleotide
taatacgactcactatagggcgaggagggcgtctcgatccagctggaatcaacagaggagagattccatgtggatcgagaacctggcggcagcgcaaaagatg

SEQ ID NO: 214824 - DNA, 103 bp, Artificial Sequence
  Synthetic Polynucleotide
taatacgactcactatagggtggacttgatcgaggagggcgtctcgatccaacagaggagaggatcgatgcgccctcctaacctggcggcagcgcaaaagatg

SEQ ID NO: 214825 - DNA, 103 bp, Artificial Sequence
  Synthetic Polynucleotide
taatacgactcactatagggctggagtcgatggacttgatcgaggagggcaacagaggagagccctcatggatcaagtcaacctggcggcagcgcaaaagatg

SEQ ID NO: 214826 - DNA, 103 bp, Artificial Sequence
  Synthetic Polynucleotide
taatacgactcactatagggccccgagtcgctggagtcgatggacttgataacagaggagaatcaagatgatcgactccaacctggcggcagcgcaaaagatg

SEQ ID NO: 214827 - DNA, 103 bp, Artificial Sequence
  Synthetic Polynucleotide
taatacgactcactataggggctcgtaaatccccgagtcgctggagtcgaaacagaggagatcgactatggcgactcggaacctggcggcagcgcaaaagatg

SEQ ID NO: 214828 - DNA, 103 bp, Artificial Sequence
  Synthetic Polynucleotide
taatacgactcactatagggcgcttggcctgctcgtaaatccccgagtcgaacagaggagacgactcatggatttacgaaacctggcggcagcgcaaaagatg

SEQ ID NO: 214829 - DNA, 103 bp, Artificial Sequence
  Synthetic Polynucleotide
taatacgactcactataggggtcaggaaaattgtctgtatctgactgattaacagaggagaaatcagatggatacagacaacctggcggcagcgcaaaagatg

SEQ ID NO: 214830 - DNA, 103 bp, Artificial Sequence
  Synthetic Polynucleotide
taatacgactcactataggggatccgcctccgcttggcctgctcgtaaataacagaggagaatttacatgcaggccaagaacctggcggcagcgcaaaagatg

SEQ ID NO: 214831 - DNA, 103 bp, Artificial Sequence
  Synthetic Polynucleotide
taatacgactcactatagggcggccggcgagatccgcctccgcttggcctaacagaggagaaggccaatgggaggcggaaacctggcggcagcgcaaaagatg

SEQ ID NO: 214832 - DNA, 103 bp, Artificial Sequence
  Synthetic Polynucleotide
taatacgactcactatagggacgggcgtgtcggccggcgagatccgcctcaacagaggagagaggcgatgctcgccggcaacctggcggcagcgcaaaagatg

SEQ ID NO: 214833 - DNA, 103 bp, Artificial Sequence
  Synthetic Polynucleotide
taatacgactcactatagggactctcggacacgggcgtgtcggccggcgaaacagaggagatcgccgatggacacgcccaacctggcggcagcgcaaaagatg

SEQ ID NO: 214834 - DNA, 103 bp, Artificial Sequence
  Synthetic Polynucleotide
taatacgactcactataggggcggggacgaactctcggacacgggcgtgtaacagaggagaacacgcatgtgtccgagaaacctggcggcagcgcaaaagatg

SEQ ID NO: 214835 - DNA, 103 bp, Artificial Sequence
  Synthetic Polynucleotide
taatacgactcactatagggtcgctcttgagcggggacgaactctcggacaacagaggagagtccgaatgttcgtccccaacctggcggcagcgcaaaagatg

SEQ ID NO: 214836 - DNA, 103 bp, Artificial Sequence
  Synthetic Polynucleotide
taatacgactcactatagggggccagcacctcgctcttgagcggggacgaaacagaggagatcgtccatgctcaagagcaacctggcggcagcgcaaaagatg

SEQ ID NO: 214837 - DNA, 103 bp, Artificial Sequence
  Synthetic Polynucleotide
taatacgactcactatagggagtcccgctgggccagcacctcgctcttgaaacagaggagatcaagaatgaggtgctggaacctggcggcagcgcaaaagatg

SEQ ID NO: 214838 - DNA, 103 bp, Artificial Sequence
  Synthetic Polynucleotide
taatacgactcactatagggttcttctcgcagtcccgctgggccagcaccaacagaggagaggtgctatgccagcgggaaacctggcggcagcgcaaaagatg

SEQ ID NO: 214839 - DNA, 103 bp, Artificial Sequence
  Synthetic Polynucleotide
taatacgactcactatagggcttggcgcagttcttctcgcagtcccgctgaacagaggagacagcggatgtgcgagaagaacctggcggcagcgcaaaagatg

SEQ ID NO: 214840 - DNA, 103 bp, Artificial Sequence
  Synthetic Polynucleotide
taatacgactcactatagggagagcatgatagaaggagaaaggcagtgctaacagaggagaagcactatgtttctccttaacctggcggcagcgcaaaagatg

SEQ ID NO: 214841 - DNA, 103 bp, Artificial Sequence
  Synthetic Polynucleotide
taatacgactcactatagggagtccttggagtcaggaaaattgtctgtataacagaggagaatacagatgattttcctgaacctggcggcagcgcaaaagatg

SEQ ID NO: 214842 - DNA, 103 bp, Artificial Sequence
  Synthetic Polynucleotide
taatacgactcactatagggcgctaatgtccttggcgcagttcttctcgcaacagaggagagcgagaatgactgcgccaaacctggcggcagcgcaaaagatg

SEQ ID NO: 214843 - DNA, 103 bp, Artificial Sequence
  Synthetic Polynucleotide
taatacgactcactatagggccatagtagccgctaatgtccttggcgcagaacagaggagactgcgcatgggacattagaacctggcggcagcgcaaaagatg

SEQ ID NO: 214844 - DNA, 103 bp, Artificial Sequence
  Synthetic Polynucleotide
taatacgactcactatagggcgagtagaagccatagtagccgctaatgtcaacagaggagagacattatgggctactataacctggcggcagcgcaaaagatg

SEQ ID NO: 214845 - DNA, 103 bp, Artificial Sequence
  Synthetic Polynucleotide
taatacgactcactatagggtcccctggtgagtccttggagtcaggaaaaaacagaggagattttccatgctccaaggaaacctggcggcagcgcaaaagatg

SEQ ID NO: 214846 - DNA, 103 bp, Artificial Sequence
  Synthetic Polynucleotide
taatacgactcactatagggtctctggacgtcccctggtgagtccttggaaacagaggagatccaagatgtcaccagggaacctggcggcagcgcaaaagatg

SEQ ID NO: 214847 - DNA, 103 bp, Artificial Sequence
  Synthetic Polynucleotide
taatacgactcactatagggagagtttacttctctggacgtcccctggtgaacagaggagacaccagatgacgtccagaaacctggcggcagcgcaaaagatg

SEQ ID NO: 214848 - DNA, 103 bp, Artificial Sequence
  Synthetic Polynucleotide
taatacgactcactatagggaagacaggagagagtttacttctctggacgaacagaggagacgtccaatgaagtaaactaacctggcggcagcgcaaaagatg

SEQ ID NO: 214849 - DNA, 103 bp, Artificial Sequence
  Synthetic Polynucleotide
taatacgactcactataggggaccccgtccaagacaggagagagtttactaacagaggagaagtaaaatgtctcctgtcaacctggcggcagcgcaaaagatg

SEQ ID NO: 214850 - DNA, 103 bp, Artificial Sequence
  Synthetic Polynucleotide
taatacgactcactataggggaagctcagagaccccgtccaagacaggagaacagaggagactcctgatgtggacggggaacctggcggcagcgcaaaagatg

SEQ ID NO: 214851 - DNA, 103 bp, Artificial Sequence
  Synthetic Polynucleotide
taatacgactcactatagggaaactgtgacgaagctcagagaccccgtccaacagaggagaggacggatgctctgagctaacctggcggcagcgcaaaagatg

SEQ ID NO: 214852 - DNA, 103 bp, Artificial Sequence
  Synthetic Polynucleotide
taatacgactcactatagggagagccatcgaaactgtgacgaagctcagaaacagaggagatctgagatgcgtcacagtaacctggcggcagcgcaaaagatg

SEQ ID NO: 214853 - DNA, 103 bp, Artificial Sequence
  Synthetic Polynucleotide
taatacgactcactataggggatctgcagcagagccatcgaaactgtgacaacagaggagagtcacaatgtcgatggctaacctggcggcagcgcaaaagatg

SEQ ID NO: 214854 - DNA, 103 bp, Artificial Sequence
  Synthetic Polynucleotide
taatacgactcactatagggaatttcttggagagcatgatagaaggagaaaacagaggagattctccatgtatcatgctaacctggcggcagcgcaaaagatg

SEQ ID NO: 214855 - DNA, 103 bp, Artificial Sequence
  Synthetic Polynucleotide
taatacgactcactatagggaggaggtagcgatctgcagcagagccatcgaacagaggagacgatggatgtgctgcagaaacctggcggcagcgcaaaagatg

SEQ ID NO: 214856 - DNA, 103 bp, Artificial Sequence
  Synthetic Polynucleotide
taatacgactcactatagggggactgagagaggaggtagcgatctgcagcaacagaggagagctgcaatgcgctacctcaacctggcggcagcgcaaaagatg

SEQ ID NO: 214857 - DNA, 103 bp, Artificial Sequence
  Synthetic Polynucleotide
taatacgactcactataggggtggctggctggactgagagaggaggtagcaacagaggagagctaccatgtctctcagtaacctggcggcagcgcaaaagatg

SEQ ID NO: 214858 - DNA, 103 bp, Artificial Sequence
  Synthetic Polynucleotide
taatacgactcactataggggccgcagactgtggctggctggactgagagaacagaggagactctcaatgcagccagccaacctggcggcagcgcaaaagatg

SEQ ID NO: 214859 - DNA, 103 bp, Artificial Sequence
  Synthetic Polynucleotide
taatacgactcactataggggggagcagtggccgcagactgtggctggctaacagaggagaagccagatgcagtctgcgaacctggcggcagcgcaaaagatg

SEQ ID NO: 214860 - DNA, 103 bp, Artificial Sequence
  Synthetic Polynucleotide
taatacgactcactatagggacatggcactgggagcagtggccgcagactaacagaggagaagtctgatgccactgctcaacctggcggcagcgcaaaagatg

SEQ ID NO: 214861 - DNA, 103 bp, Artificial Sequence
  Synthetic Polynucleotide
taatacgactcactataggggggtacgggaacatggcactgggagcagtgaacagaggagacactgcatgcagtgccataacctggcggcagcgcaaaagatg

SEQ ID NO: 214862 - DNA, 103 bp, Artificial Sequence
  Synthetic Polynucleotide
taatacgactcactataggggtgctggccggggtacgggaacatggcactaacagaggagaagtgccatgttcccgtacaacctggcggcagcgcaaaagatg

SEQ ID NO: 214863 - DNA, 103 bp, Artificial Sequence
  Synthetic Polynucleotide
taatacgactcactataggggcgccggtccgtgctggccggggtacgggaaacagaggagatcccgtatgccggccagcaacctggcggcagcgcaaaagatg

SEQ ID NO: 214864 - DNA, 103 bp, Artificial Sequence
  Synthetic Polynucleotide
taatacgactcactatagggaaggcggggtgcgccggtccgtgctggccgaacagaggagacggccaatgcggaccggcaacctggcggcagcgcaaaagatg

SEQ ID NO: 214865 - DNA, 103 bp, Artificial Sequence
  Synthetic Polynucleotide
taatacgactcactatagggcacattgagaaatttcttggagagcatgataacagaggagaatcatgatgtccaagaaaaacctggcggcagcgcaaaagatg

SEQ ID NO: 214866 - DNA, 103 bp, Artificial Sequence
  Synthetic Polynucleotide
taatacgactcactataggggccgatggagaaggcggggtgcgccggtccaacagaggagaggaccgatgcaccccgccaacctggcggcagcgcaaaagatg

SEQ ID NO: 214867 - DNA, 103 bp, Artificial Sequence
  Synthetic Polynucleotide
taatacgactcactatagggggctagggctgccgatggagaaggcggggtaacagaggagaaccccgatgtctccatcgaacctggcggcagcgcaaaagatg

SEQ ID NO: 214868 - DNA, 103 bp, Artificial Sequence
  Synthetic Polynucleotide
taatacgactcactataggggccatgtagcggctagggctgccgatggagaacagaggagactccatatgcagccctagaacctggcggcagcgcaaaagatg

SEQ ID NO: 214869 - DNA, 103 bp, Artificial Sequence
  Synthetic Polynucleotide
taatacgactcactatagggcgggtggtgggccatgtagcggctagggctaacagaggagaagccctatgcgctacatgaacctggcggcagcgcaaaagatg

SEQ ID NO: 214870 - DNA, 103 bp, Artificial Sequence
  Synthetic Polynucleotide
taatacgactcactatagggtggtgatgaccgggtggtgggccatgtagcaacagaggagagctacaatgcccaccaccaacctggcggcagcgcaaaagatg

SEQ ID NO: 214871 - DNA, 103 bp, Artificial Sequence
  Synthetic Polynucleotide
taatacgactcactatagggtaggctccgttggtgatgaccgggtggtggaacagaggagaccaccaatgggtcatcacaacctggcggcagcgcaaaagatg

SEQ ID NO: 214872 - DNA, 103 bp, Artificial Sequence
  Synthetic Polynucleotide
taatacgactcactataggggaggctgttgtaggctccgttggtgatgacaacagaggagagtcatcatgaacggagccaacctggcggcagcgcaaaagatg

SEQ ID NO: 214873 - DNA, 103 bp, Artificial Sequence
  Synthetic Polynucleotide
taatacgactcactatagggagttggacaggaggctgttgtaggctccgtaacagaggagaacggagatgacaacagccaacctggcggcagcgcaaaagatg

SEQ ID NO: 214874 - DNA, 103 bp, Artificial Sequence
  Synthetic Polynucleotide
taatacgactcactatagggtgcggcgaggagttggacaggaggctgttgaacagaggagacaacagatgcctgtccaaaacctggcggcagcgcaaaagatg

SEQ ID NO: 214875 - DNA, 103 bp, Artificial Sequence
  Synthetic Polynucleotide
taatacgactcactatagggggggtatccctgcggcgaggagttggacagaacagaggagactgtccatgtcctcgccgaacctggcggcagcgcaaaagatg

SEQ ID NO: 214876 - DNA, 103 bp, Artificial Sequence
  Synthetic Polynucleotide
taatacgactcactatagggagctgctgctcacattgagaaatttcttggaacagaggagaccaagaatgttctcaatgaacctggcggcagcgcaaaagatg

SEQ ID NO: 214877 - DNA, 103 bp, Artificial Sequence
  Synthetic Polynucleotide
taatacgactcactatagggagccggccgtggggtatccctgcggcgaggaacagaggagacctcgcatgagggataccaacctggcggcagcgcaaaagatg

SEQ ID NO: 214878 - DNA, 103 bp, Artificial Sequence
  Synthetic Polynucleotide
taatacgactcactataggggggtaggggtagccggccgtggggtatcccaacagaggagagggataatgcacggccggaacctggcggcagcgcaaaagatg

SEQ ID NO: 214879 - DNA, 103 bp, Artificial Sequence
  Synthetic Polynucleotide
taatacgactcactataggggtactgctgtgggtaggggtagccggccgtaacagaggagaacggccatgtacccctacaacctggcggcagcgcaaaagatg

SEQ ID NO: 214880 - DNA, 103 bp, Artificial Sequence
  Synthetic Polynucleotide
taatacgactcactatagggaggagtggccgtactgctgtgggtaggggtaacagaggagaacccctatgcacagcagtaacctggcggcagcgcaaaagatg

SEQ ID NO: 214881 - DNA, 103 bp, Artificial Sequence
  Synthetic Polynucleotide
taatacgactcactataggggctccttggtaggagtggccgtactgctgtaacagaggagaacagcaatgcggccactcaacctggcggcagcgcaaaagatg

SEQ ID NO: 214882 - DNA, 103 bp, Artificial Sequence
  Synthetic Polynucleotide
taatacgactcactataggggtagaacggagctccttggtaggagtggccaacagaggagaggccacatgtaccaaggaaacctggcggcagcgcaaaagatg

SEQ ID NO: 214883 - DNA, 103 bp, Artificial Sequence
  Synthetic Polynucleotide
taatacgactcactatagggaggagaactggtagaacggagctccttggtaacagaggagaaccaagatgctccgttctaacctggcggcagcgcaaaagatg

SEQ ID NO: 214884 - DNA, 103 bp, Artificial Sequence
  Synthetic Polynucleotide
taatacgactcactatagggggctgggtggaggagaactggtagaacggaaacagaggagatccgttatgccagttctcaacctggcggcagcgcaaaagatg

SEQ ID NO: 214885 - DNA, 103 bp, Artificial Sequence
  Synthetic Polynucleotide
taatacgactcactatagggcaccagccccggctgggtggaggagaactgaacagaggagacagttcatgtccacccagaacctggcggcagcgcaaaagatg

SEQ ID NO: 214886 - DNA, 103 bp, Artificial Sequence
  Synthetic Polynucleotide
taatacgactcactatagggctttgccgggcaccagccccggctgggtggaacagaggagaccacccatgcggggctggaacctggcggcagcgcaaaagatg

SEQ ID NO: 214887 - DNA, 103 bp, Artificial Sequence
  Synthetic Polynucleotide
taatacgactcactataggggaatgtgggtagctgctgctcacattgagaaacagaggagatctcaaatggagcagcagaacctggcggcagcgcaaaagatg

SEQ ID NO: 214888 - DNA, 103 bp, Artificial Sequence
  Synthetic Polynucleotide
taatacgactcactatagggtacacctgtgctttgccgggcaccagccccaacagaggagaggggctatggcccggcaaaacctggcggcagcgcaaaagatg

SEQ ID NO: 214889 - DNA, 103 bp, Artificial Sequence
  Synthetic Polynucleotide
taatacgactcactataggggttgcacaggtacacctgtgctttgccgggaacagaggagacccggcatggcacaggtgaacctggcggcagcgcaaaagatg

SEQ ID NO: 214890 - DNA, 103 bp, Artificial Sequence
  Synthetic Polynucleotide
taatacgactcactatagggaaaggggcctgttgcacaggtacacctgtgaacagaggagacacaggatgacctgtgcaaacctggcggcagcgcaaaagatg

SEQ ID NO: 214891 - DNA, 103 bp, Artificial Sequence
  Synthetic Polynucleotide
taatacgactcactatagggaatttcagccaaaggggcctgttgcacaggaacagaggagacctgtgatgcaggcccctaacctggcggcagcgcaaaagatg

SEQ ID NO: 214892 - DNA, 103 bp, Artificial Sequence
  Synthetic Polynucleotide
taatacgactcactataggggtgccggtgaaatttcagccaaaggggcctaacagaggagaaggcccatgtggctgaaaaacctggcggcagcgcaaaagatg

SEQ ID NO: 214893 - DNA, 103 bp, Artificial Sequence
  Synthetic Polynucleotide
taatacgactcactatagggtctccgtttggtgccggtgaaatttcagccaacagaggagaggctgaatgttcaccggcaacctggcggcagcgcaaaagatg

SEQ ID NO: 214894 - DNA, 103 bp, Artificial Sequence
  Synthetic Polynucleotide
taatacgactcactataggggtgatgatcatctccgtttggtgccggtgaaacagaggagatcaccgatgccaaacggaaacctggcggcagcgcaaaagatg

SEQ ID NO: 214895 - DNA, 103 bp, Artificial Sequence
  Synthetic Polynucleotide
taatacgactcactatagggtccctgtttggtgatgatcatctccgtttgaacagaggagacaaacgatgatgatcatcaacctggcggcagcgcaaaagatg

SEQ ID NO: 214896 - DNA, 103 bp, Artificial Sequence
  Synthetic Polynucleotide
taatacgactcactatagggacatgcgccttccctgtttggtgatgatcaaacagaggagatgatcaatgccaaacaggaacctggcggcagcgcaaaagatg

SEQ ID NO: 214897 - DNA, 103 bp, Artificial Sequence
  Synthetic Polynucleotide
taatacgactcactatagggaaaaaaggaaacatgcgccttccctgtttgaacagaggagacaaacaatgaaggcgcataacctggcggcagcgcaaaagatg

SEQ ID NO: 214898 - DNA, 103 bp, Artificial Sequence
  Synthetic Polynucleotide
taatacgactcactatagggggatccgcctgaatgtgggtagctgctgctaacagaggagaagcagcatgtacccacataacctggcggcagcgcaaaagatg

SEQ ID NO: 214899 - DNA, 103 bp, Artificial Sequence
  Synthetic Polynucleotide
taatacgactcactataggggttaaaacttaaaaaaggaaacatgcgcctaacagaggagaaggcgcatgtttccttttaacctggcggcagcgcaaaagatg

SEQ ID NO: 214900 - DNA, 103 bp, Artificial Sequence
  Synthetic Polynucleotide
taatacgactcactataggggaccagaaatgttaaaacttaaaaaaggaaaacagaggagattccttatgtaagttttaaacctggcggcagcgcaaaagatg

SEQ ID NO: 214901 - DNA, 103 bp, Artificial Sequence
  Synthetic Polynucleotide
taatacgactcactataggggtgggatcgagaccagaaatgttaaaacttaacagaggagaaagtttatgcatttctggaacctggcggcagcgcaaaagatg

SEQ ID NO: 214902 - DNA, 103 bp, Artificial Sequence
  Synthetic Polynucleotide
taatacgactcactataggggtaatgagccgtgggatcgagaccagaaataacagaggagaatttctatgctcgatcccaacctggcggcagcgcaaaagatg

SEQ ID NO: 214903 - DNA, 103 bp, Artificial Sequence
  Synthetic Polynucleotide
taatacgactcactatagggcaaaaatattgtaatgagccgtgggatcgaaacagaggagatcgatcatgcggctcattaacctggcggcagcgcaaaagatg

SEQ ID NO: 214904 - DNA, 103 bp, Artificial Sequence
  Synthetic Polynucleotide
taatacgactcactatagggatcacatccacaaaaatattgtaatgagccaacagaggagaggctcaatgcaatattttaacctggcggcagcgcaaaagatg

SEQ ID NO: 214905 - DNA, 103 bp, Artificial Sequence
  Synthetic Polynucleotide
taatacgactcactatagggatccgccaaaatcacatccacaaaaatattaacagaggagaaatattatggtggatgtgaacctggcggcagcgcaaaagatg

SEQ ID NO: 214906 - DNA, 103 bp, Artificial Sequence
  Synthetic Polynucleotide
taatacgactcactatagggagtgattgggatccgccaaaatcacatccaaacagaggagatggatgatgttttggcggaacctggcggcagcgcaaaagatg

SEQ ID NO: 214907 - DNA, 103 bp, Artificial Sequence
  Synthetic Polynucleotide
taatacgactcactatagggtgaaacctccagtgattgggatccgccaaaaacagaggagatttggcatgtcccaatcaaacctggcggcagcgcaaaagatg

SEQ ID NO: 214908 - DNA, 103 bp, Artificial Sequence
  Synthetic Polynucleotide
taatacgactcactatagggtttgcctccttgaaacctccagtgattgggaacagaggagacccaatatgtggaggtttaacctggcggcagcgcaaaagatg

SEQ ID NO: 214909 - DNA, 103 bp, Artificial Sequence
  Synthetic Polynucleotide
taatacgactcactatagggagacaagctcggatccgcctgaatgtgggtaacagaggagaacccacatgcaggcggataacctggcggcagcgcaaaagatg

SEQ ID NO: 214910 - DNA, 103 bp, Artificial Sequence
  Synthetic Polynucleotide
taatacgactcactatagggaaggaacccatttgcctccttgaaacctccaacagaggagaggaggtatgaaggaggcaaacctggcggcagcgcaaaagatg

SEQ ID NO: 214911 - DNA, 103 bp, Artificial Sequence
  Synthetic Polynucleotide
taatacgactcactataggggctttgccgcaaggaacccatttgcctcctaacagaggagaaggaggatgatgggttccaacctggcggcagcgcaaaagatg

SEQ ID NO: 214912 - DNA, 103 bp, Artificial Sequence
  Synthetic Polynucleotide
taatacgactcactatagggattggtgtccgctttgccgcaaggaacccaaacagaggagatgggttatgtgcggcaaaaacctggcggcagcgcaaaagatg

SEQ ID NO: 214913 - DNA, 103 bp, Artificial Sequence
  Synthetic Polynucleotide
taatacgactcactatagggttccttgcacattggtgtccgctttgccgcaacagaggagagcggcaatgcggacaccaaacctggcggcagcgcaaaagatg

SEQ ID NO: 214914 - DNA, 103 bp, Artificial Sequence
  Synthetic Polynucleotide
taatacgactcactatagggtagacccgatttccttgcacattggtgtccaacagaggagaggacacatgtgtgcaaggaacctggcggcagcgcaaaagatg

SEQ ID NO: 214915 - DNA, 103 bp, Artificial Sequence
  Synthetic Polynucleotide
taatacgactcactatagggcggatgcatatagacccgatttccttgcacaacagaggagagtgcaaatgaatcgggtcaacctggcggcagcgcaaaagatg

SEQ ID NO: 214916 - DNA, 103 bp, Artificial Sequence
  Synthetic Polynucleotide
taatacgactcactatagggtgggggaatccggatgcatatagacccgataacagaggagaatcgggatgatatgcatcaacctggcggcagcgcaaaagatg

SEQ ID NO: 214917 - DNA, 103 bp, Artificial Sequence
  Synthetic Polynucleotide
taatacgactcactataggggccccagtgttgggggaatccggatgcataaacagaggagatatgcaatgggattccccaacctggcggcagcgcaaaagatg

SEQ ID NO: 214918 - DNA, 103 bp, Artificial Sequence
  Synthetic Polynucleotide
taatacgactcactatagggcatccagtgagccccagtgttgggggaatcaacagaggagagattccatgaacactgggaacctggcggcagcgcaaaagatg

SEQ ID NO: 214919 - DNA, 103 bp, Artificial Sequence
  Synthetic Polynucleotide
taatacgactcactatagggtttcttggcgcatccagtgagccccagtgtaacagaggagaacactgatgctcactggaaacctggcggcagcgcaaaagatg

SEQ ID NO: 214920 - DNA, 103 bp, Artificial Sequence
  Synthetic Polynucleotide
taatacgactcactatagggtgatcgtgcaagacaagctcggatccgcctaacagaggagaaggcggatgcgagcttgtaacctggcggcagcgcaaaagatg

SEQ ID NO: 214921 - DNA, 103 bp, Artificial Sequence
  Synthetic Polynucleotide
taatacgactcactatagggccaaaagagatttcttggcgcatccagtgaaacagaggagatcactgatggcgccaagaaacctggcggcagcgcaaaagatg

SEQ ID NO: 214922 - DNA, 103 bp, Artificial Sequence
  Synthetic Polynucleotide
taatacgactcactatagggttttaattttccaaaagagatttcttggcgaacagaggagacgccaaatgatctcttttaacctggcggcagcgcaaaagatg

SEQ ID NO: 214923 - DNA, 103 bp, Artificial Sequence
  Synthetic Polynucleotide
taatacgactcactatagggtgttcgtaagttttaattttccaaaagagaaacagaggagatctcttatggaaaattaaaacctggcggcagcgcaaaagatg

SEQ ID NO: 214924 - DNA, 103 bp, Artificial Sequence
  Synthetic Polynucleotide
taatacgactcactataggggctcctttgttgttcgtaagttttaattttaacagaggagaaaaattatgacttacgaaaacctggcggcagcgcaaaagatg

SEQ ID NO: 214925 - DNA, 103 bp, Artificial Sequence
  Synthetic Polynucleotide
taatacgactcactataggggttatttgaagctcctttgttgttcgtaagaacagaggagacttacgatgaacaaaggaaacctggcggcagcgcaaaagatg

SEQ ID NO: 214926 - DNA, 103 bp, Artificial Sequence
  Synthetic Polynucleotide
taatacgactcactatagggtctgcccattgttatttgaagctcctttgtaacagaggagaacaaagatgcttcaaataaacctggcggcagcgcaaaagatg

SEQ ID NO: 214927 - DNA, 103 bp, Artificial Sequence
  Synthetic Polynucleotide
taatacgactcactatagggaaaaccaccatctgcccattgttatttgaaaacagaggagattcaaaatgcaatgggcaaacctggcggcagcgcaaaagatg

SEQ ID NO: 214928 - DNA, 103 bp, Artificial Sequence
  Synthetic Polynucleotide
taatacgactcactatagggcaaggactgtaaaaccaccatctgcccattaacagaggagaaatgggatgatggtggttaacctggcggcagcgcaaaagatg

SEQ ID NO: 214929 - DNA, 103 bp, Artificial Sequence
  Synthetic Polynucleotide
taatacgactcactatagggggtacttgtgcaaggactgtaaaaccaccaaacagaggagatggtggatgtacagtcctaacctggcggcagcgcaaaagatg

SEQ ID NO: 214930 - DNA, 103 bp, Artificial Sequence
  Synthetic Polynucleotide
taatacgactcactatagggaggcggggctggtacttgtgcaaggactgtaacagaggagaacagtcatggcacaagtaaacctggcggcagcgcaaaagatg

SEQ ID NO: 214931 - DNA, 103 bp, Artificial Sequence
  Synthetic Polynucleotide
taatacgactcactatagggggcgactgcagatcttctcctttcactcataacagaggagaatgagtatgaggagaagaaacctggcggcagcgcaaaagatg

SEQ ID NO: 214932 - DNA, 103 bp, Artificial Sequence
  Synthetic Polynucleotide
taatacgactcactatagggcagccccttctcctcccagtctcgcagtttaacagaggagaaaactgatggactgggagaacctggcggcagcgcaaaagatg

SEQ ID NO: 214933 - DNA, 103 bp, Artificial Sequence
  Synthetic Polynucleotide
taatacgactcactatagggctgcttctgcatggtggtgaagtcttcgaaaacagaggagattcgaaatgttcaccaccaacctggcggcagcgcaaaagatg

SEQ ID NO: 214934 - DNA, 103 bp, Artificial Sequence
  Synthetic Polynucleotide
taatacgactcactatagggtgcctccttgctgcttctgcatggtggtgaaacagaggagatcaccaatgtgcagaagcaacctggcggcagcgcaaaagatg

SEQ ID NO: 214935 - DNA, 103 bp, Artificial Sequence
  Synthetic Polynucleotide
taatacgactcactataggggtgcctgtgctgcctccttgctgcttctgcaacagaggagagcagaaatggcaaggaggaacctggcggcagcgcaaaagatg

SEQ ID NO: 214936 - DNA, 103 bp, Artificial Sequence
  Synthetic Polynucleotide
taatacgactcactatagggggttggggaagtgcctgtgctgcctccttgaacagaggagacaaggaatgagcacaggcaacctggcggcagcgcaaaagatg

SEQ ID NO: 214937 - DNA, 103 bp, Artificial Sequence
  Synthetic Polynucleotide
taatacgactcactatagggtgctggaggtggttggggaagtgcctgtgcaacagaggagagcacagatgcttccccaaaacctggcggcagcgcaaaagatg

SEQ ID NO: 214938 - DNA, 103 bp, Artificial Sequence
  Synthetic Polynucleotide
taatacgactcactatagggggtgtcccagtgctggaggtggttggggaaaacagaggagattccccatgcacctccagaacctggcggcagcgcaaaagatg

SEQ ID NO: 214939 - DNA, 103 bp, Artificial Sequence
  Synthetic Polynucleotide
taatacgactcactatagggcgaaggggatggtgtcccagtgctggaggtaacagaggagaacctccatgactgggacaaacctggcggcagcgcaaaagatg

SEQ ID NO: 214940 - DNA, 103 bp, Artificial Sequence
  Synthetic Polynucleotide
taatacgactcactataggggagaagaagccgaaggggatggtgtcccagaacagaggagactgggaatgcatccccttaacctggcggcagcgcaaaagatg

SEQ ID NO: 214941 - DNA, 103 bp, Artificial Sequence
  Synthetic Polynucleotide
taatacgactcactataggggataaaagatgagaagaagccgaaggggataacagaggagaatccccatgggcttcttcaacctggcggcagcgcaaaagatg

SEQ ID NO: 214942 - DNA, 103 bp, Artificial Sequence
  Synthetic Polynucleotide
taatacgactcactatagggacaggatggagataaaagatgagaagaagcaacagaggagagcttctatgcatcttttaaacctggcggcagcgcaaaagatg

SEQ ID NO: 214943 - DNA, 103 bp, Artificial Sequence
  Synthetic Polynucleotide
taatacgactcactatagggtagacaggtccagccccttctcctcccagtaacagaggagaactgggatgagaaggggcaacctggcggcagcgcaaaagatg

SEQ ID NO: 214944 - DNA, 103 bp, Artificial Sequence
  Synthetic Polynucleotide
taatacgactcactatagggttggaggagaacaggatggagataaaagataacagaggagaatctttatgctccatcctaacctggcggcagcgcaaaagatg

SEQ ID NO: 214945 - DNA, 103 bp, Artificial Sequence
  Synthetic Polynucleotide
taatacgactcactatagggagatgaaaagttggaggagaacaggatggaaacagaggagatccatcatgttctcctccaacctggcggcagcgcaaaagatg

SEQ ID NO: 214946 - DNA, 103 bp, Artificial Sequence
  Synthetic Polynucleotide
taatacgactcactataggggttgggggccagatgaaaagttggaggagaaacagaggagatctcctatgacttttcataacctggcggcagcgcaaaagatg

SEQ ID NO: 214947 - DNA, 103 bp, Artificial Sequence
  Synthetic Polynucleotide
taatacgactcactatagggcattgaaagtgttgggggccagatgaaaagaacagaggagacttttcatgtggcccccaaacctggcggcagcgcaaaagatg

SEQ ID NO: 214948 - DNA, 103 bp, Artificial Sequence
  Synthetic Polynucleotide
taatacgactcactatagggcggcagcccacattgaaagtgttgggggccaacagaggagaggccccatgcactttcaaaacctggcggcagcgcaaaagatg

SEQ ID NO: 214949 - DNA, 103 bp, Artificial Sequence
  Synthetic Polynucleotide
taatacgactcactatagggctggctttctcggcagcccacattgaaagtaacagaggagaactttcatggtgggctgcaacctggcggcagcgcaaaagatg

SEQ ID NO: 214950 - DNA, 103 bp, Artificial Sequence
  Synthetic Polynucleotide
taatacgactcactataggggattacacagctggctttctcggcagcccaaacagaggagatgggctatggagaaagccaacctggcggcagcgcaaaagatg

SEQ ID NO: 214951 - DNA, 103 bp, Artificial Sequence
  Synthetic Polynucleotide
taatacgactcactataggggagaggtttagattacacagctggctttctaacagaggagaagaaagatggctgtgtaaaacctggcggcagcgcaaaagatg

SEQ ID NO: 214952 - DNA, 103 bp, Artificial Sequence
  Synthetic Polynucleotide
taatacgactcactatagggtggataatcagagaggtttagattacacagaacagaggagactgtgtatgctaaacctcaacctggcggcagcgcaaaagatg

SEQ ID NO: 214953 - DNA, 103 bp, Artificial Sequence
  Synthetic Polynucleotide
taatacgactcactataggggggcacatggtggataatcagagaggtttaaacagaggagataaaccatgctgattatcaacctggcggcagcgcaaaagatg

SEQ ID NO: 214954 - DNA, 103 bp, Artificial Sequence
  Synthetic Polynucleotide
taatacgactcactatagggagcgcctccatagacaggtccagccccttcaacagaggagagaagggatgggacctgtcaacctggcggcagcgcaaaagatg

SEQ ID NO: 214955 - DNA, 103 bp, Artificial Sequence
  Synthetic Polynucleotide
taatacgactcactatagggatgttgcttcgggcacatggtggataatcaaacagaggagatgattaatgaccatgtgcaacctggcggcagcgcaaaagatg

SEQ ID NO: 214956 - DNA, 103 bp, Artificial Sequence
  Synthetic Polynucleotide
taatacgactcactatagggcaaggcagccatgttgcttcgggcacatggaacagaggagaccatgtatgcgaagcaacaacctggcggcagcgcaaaagatg

SEQ ID NO: 214957 - DNA, 103 bp, Artificial Sequence
  Synthetic Polynucleotide
taatacgactcactatagggggtagctctgcaaggcagccatgttgcttcaacagaggagagaagcaatgtggctgcctaacctggcggcagcgcaaaagatg

SEQ ID NO: 214958 - DNA, 103 bp, Artificial Sequence
  Synthetic Polynucleotide
taatacgactcactatagggctcagccctgggtagctctgcaaggcagccaacagaggagaggctgcatggcagagctaaacctggcggcagcgcaaaagatg

SEQ ID NO: 214959 - DNA, 103 bp, Artificial Sequence
  Synthetic Polynucleotide
taatacgactcactataggggccactgtcactcagccctgggtagctctgaacagaggagacagagcatgccagggctgaacctggcggcagcgcaaaagatg

SEQ ID NO: 214960 - DNA, 103 bp, Artificial Sequence
  Synthetic Polynucleotide
taatacgactcactataggggcctgttgtagccactgtcactcagccctgaacagaggagacagggcatggtgacagtgaacctggcggcagcgcaaaagatg

SEQ ID NO: 214961 - DNA, 103 bp, Artificial Sequence
  Synthetic Polynucleotide
taatacgactcactatagggccactctgaagcctgttgtagccactgtcaaacagaggagatgacagatgctacaacagaacctggcggcagcgcaaaagatg

SEQ ID NO: 214962 - DNA, 103 bp, Artificial Sequence
  Synthetic Polynucleotide
taatacgactcactatagggtgaagtggtgccactctgaagcctgttgtaaacagaggagatacaacatgcttcagagtaacctggcggcagcgcaaaagatg

SEQ ID NO: 214963 - DNA, 103 bp, Artificial Sequence
  Synthetic Polynucleotide
taatacgactcactataggggctgagtggctgaagtggtgccactctgaaaacagaggagattcagaatggcaccacttaacctggcggcagcgcaaaagatg

SEQ ID NO: 214964 - DNA, 103 bp, Artificial Sequence
  Synthetic Polynucleotide
taatacgactcactataggggtttcagagggctgagtggctgaagtggtgaacagaggagacaccacatgagccactcaaacctggcggcagcgcaaaagatg

SEQ ID NO: 214965 - DNA, 103 bp, Artificial Sequence
  Synthetic Polynucleotide
taatacgactcactatagggcgcggggctcagcgcctccatagacaggtcaacagaggagagacctgatgatggaggcgaacctggcggcagcgcaaaagatg

SEQ ID NO: 214966 - DNA, 103 bp, Artificial Sequence
  Synthetic Polynucleotide
taatacgactcactatagggaggcatgaaggtttcagagggctgagtggcaacagaggagagccactatgccctctgaaaacctggcggcagcgcaaaagatg

SEQ ID NO: 214967 - DNA, 103 bp, Artificial Sequence
  Synthetic Polynucleotide
taatacgactcactataggggagtcctctgaggcatgaaggtttcagaggaacagaggagacctctgatgccttcatgcaacctggcggcagcgcaaaagatg

SEQ ID NO: 214968 - DNA, 103 bp, Artificial Sequence
  Synthetic Polynucleotide
taatacgactcactatagggatcagggatggagtcctctgaggcatgaagaacagaggagacttcatatgtcagaggacaacctggcggcagcgcaaaagatg

SEQ ID NO: 214969 - DNA, 103 bp, Artificial Sequence
  Synthetic Polynucleotide
taatacgactcactatagggtattcctgagatcagggatggagtcctctgaacagaggagacagaggatgccatccctgaacctggcggcagcgcaaaagatg

SEQ ID NO: 214970 - DNA, 103 bp, Artificial Sequence
  Synthetic Polynucleotide
taatacgactcactataggggaggagttggtattcctgagatcagggatgaacagaggagacatcccatgtctcaggaaaacctggcggcagcgcaaaagatg

SEQ ID NO: 214971 - DNA, 103 bp, Artificial Sequence
  Synthetic Polynucleotide
taatacgactcactatagggggcaacgagggaggagttggtattcctgagaacagaggagactcaggatgaccaactccaacctggcggcagcgcaaaagatg

SEQ ID NO: 214972 - DNA, 103 bp, Artificial Sequence
  Synthetic Polynucleotide
taatacgactcactataggggctgttgccaggcaacgagggaggagttggaacagaggagaccaactatgccctcgttgaacctggcggcagcgcaaaagatg

SEQ ID NO: 214973 - DNA, 103 bp, Artificial Sequence
  Synthetic Polynucleotide
taatacgactcactatagggcttccatcttgctgttgccaggcaacgaggaacagaggagacctcgtatgctggcaacaaacctggcggcagcgcaaaagatg

SEQ ID NO: 214974 - DNA, 103 bp, Artificial Sequence
  Synthetic Polynucleotide
taatacgactcactatagggccaccgtaggcttccatcttgctgttgccaaacagaggagatggcaaatgcaagatggaaacctggcggcagcgcaaaagatg

SEQ ID NO: 214975 - DNA, 103 bp, Artificial Sequence
  Synthetic Polynucleotide
taatacgactcactatagggccccagctggccaccgtaggcttccatcttaacagaggagaaagatgatggcctacggtaacctggcggcagcgcaaaagatg

SEQ ID NO: 214976 - DNA, 103 bp, Artificial Sequence
  Synthetic Polynucleotide
taatacgactcactatagggcgagtgggcccgcggggctcagcgcctccaaacagaggagatggaggatgtgagccccgaacctggcggcagcgcaaaagatg

SEQ ID NO: 214977 - DNA, 103 bp, Artificial Sequence
  Synthetic Polynucleotide
taatacgactcactatagggtgggaaaggaccccagctggccaccgtaggaacagaggagacctacgatggccagctggaacctggcggcagcgcaaaagatg

SEQ ID NO: 214978 - DNA, 103 bp, Artificial Sequence
  Synthetic Polynucleotide
taatacgactcactatagggaactgggaagtgggaaaggaccccagctggaacagaggagaccagctatggtcctttccaacctggcggcagcgcaaaagatg

SEQ ID NO: 214979 - DNA, 103 bp, Artificial Sequence
  Synthetic Polynucleotide
taatacgactcactataggggacatactgaaactgggaagtgggaaaggaaacagaggagatcctttatgacttcccagaacctggcggcagcgcaaaagatg

SEQ ID NO: 214980 - DNA, 103 bp, Artificial Sequence
  Synthetic Polynucleotide
taatacgactcactatagggctgcctgcatgacatactgaaactgggaagaacagaggagacttcccatgttcagtatgaacctggcggcagcgcaaaagatg

SEQ ID NO: 214981 - DNA, 103 bp, Artificial Sequence
  Synthetic Polynucleotide
taatacgactcactataggggcagcattgcctgcctgcatgacatactgaaacagaggagatcagtaatgcatgcaggcaacctggcggcagcgcaaaagatg

SEQ ID NO: 214982 - DNA, 103 bp, Artificial Sequence
  Synthetic Polynucleotide
taatacgactcactatagggggagctggaggcagcattgcctgcctgcataacagaggagaatgcagatgggcaatgctaacctggcggcagcgcaaaagatg

SEQ ID NO: 214983 - DNA, 103 bp, Artificial Sequence
  Synthetic Polynucleotide
taatacgactcactataggggtggtgatgaggagctggaggcagcattgcaacagaggagagcaatgatgcctccagctaacctggcggcagcgcaaaagatg

SEQ ID NO: 214984 - DNA, 103 bp, Artificial Sequence
  Synthetic Polynucleotide
taatacgactcactatagggccgaacatgtgtggtgatgaggagctggagaacagaggagactccagatgctcatcaccaacctggcggcagcgcaaaagatg

SEQ ID NO: 214985 - DNA, 103 bp, Artificial Sequence
  Synthetic Polynucleotide
taatacgactcactataggggtggctgcccccgaacatgtgtggtgatgaaacagaggagatcatcaatgcacatgttcaacctggcggcagcgcaaaagatg

SEQ ID NO: 214986 - DNA, 103 bp, Artificial Sequence
  Synthetic Polynucleotide
taatacgactcactatagggtctgctgcatgtggctgcccccgaacatgtaacagaggagaacatgtatgggggcagccaacctggcggcagcgcaaaagatg

SEQ ID NO: 214987 - DNA, 103 bp, Artificial Sequence
  Synthetic Polynucleotide
taatacgactcactatagggtccgtgtctccgagtgggcccgcggggctcaacagaggagagagcccatggggcccactaacctggcggcagcgcaaaagatg

SEQ ID NO: 214988 - DNA, 103 bp, Artificial Sequence
  Synthetic Polynucleotide
taatacgactcactatagggttgtaggagctctgctgcatgtggctgcccaacagaggagagggcagatgcatgcagcaaacctggcggcagcgcaaaagatg

SEQ ID NO: 214989 - DNA, 103 bp, Artificial Sequence
  Synthetic Polynucleotide
taatacgactcactatagggggagaaggcattgtaggagctctgctgcataacagaggagaatgcagatgagctcctacaacctggcggcagcgcaaaagatg

SEQ ID NO: 214990 - DNA, 103 bp, Artificial Sequence
  Synthetic Polynucleotide
taatacgactcactatagggggttgtgaagggagaaggcattgtaggagcaacagaggagagctcctatgatgccttctaacctggcggcagcgcaaaagatg

SEQ ID NO: 214991 - DNA, 103 bp, Artificial Sequence
  Synthetic Polynucleotide
taatacgactcactatagggaggttgtaagggttgtgaagggagaaggcaaacagaggagatgccttatgccttcacaaaacctggcggcagcgcaaaagatg

SEQ ID NO: 214992 - DNA, 103 bp, Artificial Sequence
  Synthetic Polynucleotide
taatacgactcactataggggtatccatacaggttgtaagggttgtgaagaacagaggagacttcacatgccttacaacaacctggcggcagcgcaaaagatg

SEQ ID NO: 214993 - DNA, 103 bp, Artificial Sequence
  Synthetic Polynucleotide
taatacgactcactatagggtggggaaattgtatccatacaggttgtaagaacagaggagacttacaatgtgtatggataacctggcggcagcgcaaaagatg

SEQ ID NO: 214994 - DNA, 103 bp, Artificial Sequence
  Synthetic Polynucleotide
taatacgactcactatagggctaggggaagtggggaaattgtatccatacaacagaggagagtatggatgcaatttcccaacctggcggcagcgcaaaagatg

SEQ ID NO: 214995 - DNA, 103 bp, Artificial Sequence
  Synthetic Polynucleotide
taatacgactcactatagggtgcagctagcctaggggaagtggggaaattaacagaggagaaatttcatgacttcccctaacctggcggcagcgcaaaagatg

SEQ ID NO: 214996 - DNA, 103 bp, Artificial Sequence
  Synthetic Polynucleotide
taatacgactcactatagggtttccgggcttgcagctagcctaggggaagaacagaggagacttcccatgggctagctgaacctggcggcagcgcaaaagatg

SEQ ID NO: 214997 - DNA, 103 bp, Artificial Sequence
  Synthetic Polynucleotide
taatacgactcactataggggcgctcagtttttccgggcttgcagctagcaacagaggagagctagcatgaagcccggaaacctggcggcagcgcaaaagatg

SEQ ID NO: 214998 - DNA, 103 bp, Artificial Sequence
  Synthetic Polynucleotide
taatacgactcactatagggcgccgcgtcctccgtgtctccgagtgggccaacagaggagaggcccaatgggagacacgaacctggcggcagcgcaaaagatg

SEQ ID NO: 214999 - DNA, 103 bp, Artificial Sequence
  Synthetic Polynucleotide
taatacgactcactataggggctttgagaggcgctcagtttttccgggctaacagaggagaagcccgatgaaactgagcaacctggcggcagcgcaaaagatg

SEQ ID NO: 215000 - DNA, 103 bp, Artificial Sequence
  Synthetic Polynucleotide
taatacgactcactatagggagagtaaagtgctttgagaggcgctcagttaacagaggagaaactgaatgcctctcaaaaacctggcggcagcgcaaaagatg

SEQ ID NO: 215001 - DNA, 103 bp, Artificial Sequence
  Synthetic Polynucleotide
taatacgactcactatagggggagaagaacagagtaaagtgctttgagagaacagaggagactctcaatgcactttactaacctggcggcagcgcaaaagatg

SEQ ID NO: 215002 - DNA, 103 bp, Artificial Sequence
  Synthetic Polynucleotide
taatacgactcactatagggcccgttggaaggagaagaacagagtaaagtaacagaggagaactttaatgtgttcttctaacctggcggcagcgcaaaagatg

SEQ ID NO: 215003 - DNA, 103 bp, Artificial Sequence
  Synthetic Polynucleotide
taatacgactcactatagggctccaaaggccccgttggaaggagaagaacaacagaggagagttcttatgcttccaacgaacctggcggcagcgcaaaagatg

SEQ ID NO: 215004 - DNA, 103 bp, Artificial Sequence
  Synthetic Polynucleotide
taatacgactcactatagggtactgcctctctccaaaggccccgttggaaaacagaggagattccaaatgggcctttggaacctggcggcagcgcaaaagatg

SEQ ID NO: 215005 - DNA, 103 bp, Artificial Sequence
  Synthetic Polynucleotide
taatacgactcactatagggtgacggcaggtactgcctctctccaaaggcaacagaggagagcctttatggagaggcagaacctggcggcagcgcaaaagatg

SEQ ID NO: 215006 - DNA, 103 bp, Artificial Sequence
  Synthetic Polynucleotide
taatacgactcactataggggctccatccctgacggcaggtactgcctctaacagaggagaagaggcatgacctgccgtaacctggcggcagcgcaaaagatg

SEQ ID NO: 215007 - DNA, 103 bp, Artificial Sequence
  Synthetic Polynucleotide
taatacgactcactatagggtgcatgctgtgctccatccctgacggcaggaacagaggagacctgccatgagggatggaaacctggcggcagcgcaaaagatg

SEQ ID NO: 215008 - DNA, 103 bp, Artificial Sequence
  Synthetic Polynucleotide
taatacgactcactataggggctaatcatgtgcatgctgtgctccatcccaacagaggagagggatgatgcacagcatgaacctggcggcagcgcaaaagatg

SEQ ID NO: 215009 - DNA, 103 bp, Artificial Sequence
  Synthetic Polynucleotide
taatacgactcactatagggggccgtgtgccgccgcgtcctccgtgtctcaacagaggagagagacaatgaggacgcggaacctggcggcagcgcaaaagatg

SEQ ID NO: 215010 - DNA, 103 bp, Artificial Sequence
  Synthetic Polynucleotide
taatacgactcactatagggtgggtgaagggctaatcatgtgcatgctgtaacagaggagaacagcaatgacatgattaaacctggcggcagcgcaaaagatg

SEQ ID NO: 215011 - DNA, 103 bp, Artificial Sequence
  Synthetic Polynucleotide
taatacgactcactatagggtgttggttattgggtgaagggctaatcatgaacagaggagacatgatatgcccttcaccaacctggcggcagcgcaaaagatg

SEQ ID NO: 215012 - DNA, 103 bp, Artificial Sequence
  Synthetic Polynucleotide
taatacgactcactataggggttggttgcctgttggttattgggtgaaggaacagaggagaccttcaatgaataaccaaaacctggcggcagcgcaaaagatg

SEQ ID NO: 215013 - DNA, 103 bp, Artificial Sequence
  Synthetic Polynucleotide
taatacgactcactatagggcatcacaagtgttggttgcctgttggttataacagaggagaataaccatgaggcaaccaaacctggcggcagcgcaaaagatg

SEQ ID NO: 215014 - DNA, 103 bp, Artificial Sequence
  Synthetic Polynucleotide
taatacgactcactatagggtactgccggccatcacaagtgttggttgccaacagaggagaggcaacatgcacttgtgaaacctggcggcagcgcaaaagatg

SEQ ID NO: 215015 - DNA, 103 bp, Artificial Sequence
  Synthetic Polynucleotide
taatacgactcactatagggaactgccccatactgccggccatcacaagtaacagaggagaacttgtatgggccggcagaacctggcggcagcgcaaaagatg

SEQ ID NO: 215016 - DNA, 103 bp, Artificial Sequence
  Synthetic Polynucleotide
taatacgactcactatagggaggagcctggaactgccccatactgccggcaacagaggagagccggcatgatggggcagaacctggcggcagcgcaaaagatg

SEQ ID NO: 215017 - DNA, 103 bp, Artificial Sequence
  Synthetic Polynucleotide
taatacgactcactatagggatctgggaggaggagcctggaactgccccaaacagaggagatggggcatgtccaggctcaacctggcggcagcgcaaaagatg

SEQ ID NO: 215018 - DNA, 103 bp, Artificial Sequence
  Synthetic Polynucleotide
taatacgactcactataggggtgcacggacatctgggaggaggagcctggaacagaggagaccaggcatgtcctcccagaacctggcggcagcgcaaaagatg

SEQ ID NO: 215019 - DNA, 103 bp, Artificial Sequence
  Synthetic Polynucleotide
taatacgactcactatagggtgaggctccaggccgtgtgccgccgcgtccaacagaggagaggacgcatgggcacacggaacctggcggcagcgcaaaagatg

SEQ ID NO: 215020 - DNA, 103 bp, Artificial Sequence
  Synthetic Polynucleotide
taatacgactcactatagggagaatccgggtgaggctccaggccgtgtgcaacagaggagagcacacatgctggagcctaacctggcggcagcgcaaaagatg

SEQ ID NO: 215021 - DNA, 103 bp, Artificial Sequence
  Synthetic Polynucleotide
taatacgactcactataggggcgagctcagggcgactgcagatcttctccaacagaggagaggagaaatgctgcagtcgaacctggcggcagcgcaaaagatg

SEQ ID NO: 215022 - DNA, 103 bp, Artificial Sequence
  Synthetic Polynucleotide
taatacgactcactatagggtgctctgctcagaatccgggtgaggctccaaacagaggagatggagcatgacccggattaacctggcggcagcgcaaaagatg

SEQ ID NO: 215023 - DNA, 103 bp, Artificial Sequence
  Synthetic Polynucleotide
taatacgactcactatagggtctgaaccagtgctctgctcagaatccgggaacagaggagacccggaatgtgagcagagaacctggcggcagcgcaaaagatg

SEQ ID NO: 215024 - DNA, 103 bp, Artificial Sequence
  Synthetic Polynucleotide
taatacgactcactataggggacctcagaatctgaaccagtgctctgctcaacagaggagagagcagatgactggttcaaacctggcggcagcgcaaaagatg

SEQ ID NO: 215025 - DNA, 103 bp, Artificial Sequence
  Synthetic Polynucleotide
taatacgactcactataggggctcagtgaggacctcagaatctgaaccagaacagaggagactggttatgattctgaggaacctggcggcagcgcaaaagatg

SEQ ID NO: 215026 - DNA, 103 bp, Artificial Sequence
  Synthetic Polynucleotide
taatacgactcactatagggcaggaagtccgctcagtgaggacctcagaaaacagaggagattctgaatgcctcactgaaacctggcggcagcgcaaaagatg

SEQ ID NO: 215027 - DNA, 103 bp, Artificial Sequence
  Synthetic Polynucleotide
taatacgactcactatagggactgaaggagcaggaagtccgctcagtgagaacagaggagactcactatgcggacttccaacctggcggcagcgcaaaagatg

SEQ ID NO: 215028 - DNA, 103 bp, Artificial Sequence
  Synthetic Polynucleotide
taatacgactcactatagggcagtgtgagtactgaaggagcaggaagtccaacagaggagaggacttatggctccttcaaacctggcggcagcgcaaaagatg

SEQ ID NO: 215029 - DNA, 103 bp, Artificial Sequence
  Synthetic Polynucleotide
taatacgactcactataggggaggccaggtcagtgtgagtactgaaggagaacagaggagactccttatgtactcacacaacctggcggcagcgcaaaagatg

SEQ ID NO: 215030 - DNA, 103 bp, Artificial Sequence
  Synthetic Polynucleotide
taatacgactcactatagggtgcagcaccagaggccaggtcagtgtgagtaacagaggagaactcacatggacctggccaacctggcggcagcgcaaaagatg

SEQ ID NO: 215031 - DNA, 103 bp, Artificial Sequence
  Synthetic Polynucleotide
taatacgactcactataggggcacagggcctgcagcaccagaggccaggtaacagaggagaacctggatgctggtgctgaacctggcggcagcgcaaaagatg

SEQ ID NO: 215032 - DNA, 103 bp, Artificial Sequence
  Synthetic Polynucleotide
taatacgactcactataggggcatgtgctcgcgagctcagggcgactgcaaacagaggagatgcagtatgcctgagctcaacctggcggcagcgcaaaagatg

SEQ ID NO: 215033 - DNA, 103 bp, Artificial Sequence
  Synthetic Polynucleotide
taatacgactcactatagggatggcagcaggcacagggcctgcagcaccaaacagaggagatggtgcatgaggccctgtaacctggcggcagcgcaaaagatg

SEQ ID NO: 215034 - DNA, 103 bp, Artificial Sequence
  Synthetic Polynucleotide
taatacgactcactatagggcatggaagacatggcagcaggcacagggccaacagaggagaggccctatgcctgctgccaacctggcggcagcgcaaaagatg

SEQ ID NO: 215035 - DNA, 103 bp, Artificial Sequence
  Synthetic Polynucleotide
taatacgactcactataggggaatctcctccatggaagacatggcagcagaacagaggagactgctgatgtgtcttccaaacctggcggcagcgcaaaagatg

SEQ ID NO: 215036 - DNA, 103 bp, Artificial Sequence
  Synthetic Polynucleotide
taatacgactcactatagggagctccacctgaatctcctccatggaagacaacagaggagagtcttcatgggaggagataacctggcggcagcgcaaaagatg

SEQ ID NO: 215037 - DNA, 103 bp, Artificial Sequence
  Synthetic Polynucleotide
taatacgactcactatagggagcacattgcagctccacctgaatctcctcaacagaggagagaggagatgcaggtggagaacctggcggcagcgcaaaagatg

SEQ ID NO: 215038 - DNA, 103 bp, Artificial Sequence
  Synthetic Polynucleotide
taatacgactcactatagggtccagaggtcagcacattgcagctccacctaacagaggagaaggtggatgtgcaatgtgaacctggcggcagcgcaaaagatg

SEQ ID NO: 215039 - DNA, 103 bp, Artificial Sequence
  Synthetic Polynucleotide
taatacgactcactatagggtggaaccgcttccagaggtcagcacattgcaacagaggagagcaatgatgtgacctctgaacctggcggcagcgcaaaagatg

SEQ ID NO: 215040 - DNA, 103 bp, Artificial Sequence
  Synthetic Polynucleotide
taatacgactcactatagggtccaatatcatggaaccgcttccagaggtcaacagaggagagacctcatgaagcggttcaacctggcggcagcgcaaaagatg

SEQ ID NO: 215041 - DNA, 103 bp, Artificial Sequence
  Synthetic Polynucleotide
taatacgactcactatagggtcatttcagttccaatatcatggaaccgctaacagaggagaagcggtatgatgatattgaacctggcggcagcgcaaaagatg

SEQ ID NO: 215042 - DNA, 103 bp, Artificial Sequence
  Synthetic Polynucleotide
taatacgactcactatagggttggtgatgatcatttcagttccaatatcaaacagaggagatgatatatgaactgaaataacctggcggcagcgcaaaagatg

SEQ ID NO: 215043 - DNA, 103 bp, Artificial Sequence
  Synthetic Polynucleotide
taatacgactcactatagggaacggagaaggcatgtgctcgcgagctcagaacagaggagactgagcatgcgagcacataacctggcggcagcgcaaaagatg

SEQ ID NO: 215044 - DNA, 103 bp, Artificial Sequence
  Synthetic Polynucleotide
taatacgactcactatagggcctgcctgctttggtgatgatcatttcagtaacagaggagaactgaaatgatcatcaccaacctggcggcagcgcaaaagatg

SEQ ID NO: 215045 - DNA, 103 bp, Artificial Sequence
  Synthetic Polynucleotide
taatacgactcactataggggaaacatcctcctgcctgctttggtgatgaaacagaggagatcatcaatgaagcaggcaaacctggcggcagcgcaaaagatg

SEQ ID NO: 215046 - DNA, 103 bp, Artificial Sequence
  Synthetic Polynucleotide
taatacgactcactatagggctcatggcaggaaacatcctcctgcctgctaacagaggagaagcaggatggaggatgttaacctggcggcagcgcaaaagatg

SEQ ID NO: 215047 - DNA, 103 bp, Artificial Sequence
  Synthetic Polynucleotide
taatacgactcactataggggattttcactctcatggcaggaaacatcctaacagaggagaaggatgatgcctgccatgaacctggcggcagcgcaaaagatg

SEQ ID NO: 215048 - DNA, 103 bp, Artificial Sequence
  Synthetic Polynucleotide
taatacgactcactatagggctaggccagtgattttcactctcatggcagaacagaggagactgccaatggagtgaaaaaacctggcggcagcgcaaaagatg

SEQ ID NO: 215049 - DNA, 103 bp, Artificial Sequence
  Synthetic Polynucleotide
taatacgactcactatagggtgatgtggatctaggccagtgattttcactaacagaggagaagtgaaatgcactggcctaacctggcggcagcgcaaaagatg

SEQ ID NO: 215050 - DNA, 103 bp, Artificial Sequence
  Synthetic Polynucleotide
taatacgactcactataggggtagtactgctgatgtggatctaggccagtaacagaggagaactggcatggatccacataacctggcggcagcgcaaaagatg

SEQ ID NO: 215051 - DNA, 103 bp, Artificial Sequence
  Synthetic Polynucleotide
taatacgactcactatagggccattgctatgtagtactgctgatgtggataacagaggagaatccacatgagcagtactaacctggcggcagcgcaaaagatg

SEQ ID NO: 215052 - DNA, 103 bp, Artificial Sequence
  Synthetic Polynucleotide
taatacgactcactatagggggcacaatgtccattgctatgtagtactgcaacagaggagagcagtaatgcatagcaataacctggcggcagcgcaaaagatg

SEQ ID NO: 215053 - DNA, 103 bp, Artificial Sequence
  Synthetic Polynucleotide
taatacgactcactatagggattgtccacaggcacaatgtccattgctataacagaggagaatagcaatggacattgtgaacctggcggcagcgcaaaagatg

SEQ ID NO: 215054 - DNA, 103 bp, Artificial Sequence
  Synthetic Polynucleotide
taatacgactcactatagggtcaaggcttcaacggagaaggcatgtgctcaacagaggagagagcacatgccttctccgaacctggcggcagcgcaaaagatg

SEQ ID NO: 215055 - DNA, 103 bp, Artificial Sequence
  Synthetic Polynucleotide
taatacgactcactatagggtgtatcttttattgtccacaggcacaatgtaacagaggagaacattgatgctgtggacaaacctggcggcagcgcaaaagatg

SEQ ID NO: 215056 - DNA, 103 bp, Artificial Sequence
  Synthetic Polynucleotide
taatacgactcactatagggtacacatatctgtatcttttattgtccacaaacagaggagatgtggaatgtaaaagataaacctggcggcagcgcaaaagatg

SEQ ID NO: 215057 - DNA, 103 bp, Artificial Sequence
  Synthetic Polynucleotide
taatacgactcactatagggggagctatgatacacatatctgtatcttttaacagaggagaaaaagaatgagatatgtgaacctggcggcagcgcaaaagatg

SEQ ID NO: 215058 - DNA, 103 bp, Artificial Sequence
  Synthetic Polynucleotide
taatacgactcactatagggccatccacttggagctatgatacacatatcaacagaggagagatatgatgatcatagctaacctggcggcagcgcaaaagatg

SEQ ID NO: 215059 - DNA, 103 bp, Artificial Sequence
  Synthetic Polynucleotide
taatacgactcactatagggttgccagccaccatccacttggagctatgaaacagaggagatcatagatgcaagtggataacctggcggcagcgcaaaagatg

SEQ ID NO: 215060 - DNA, 103 bp, Artificial Sequence
  Synthetic Polynucleotide
taatacgactcactatagggggaatcagcattgccagccaccatccacttaacagaggagaaagtggatggtggctggcaacctggcggcagcgcaaaagatg

SEQ ID NO: 215061 - DNA, 103 bp, Artificial Sequence
  Synthetic Polynucleotide
taatacgactcactatagggggggcacaggggaatcagcattgccagccaaacagaggagatggctgatgatgctgattaacctggcggcagcgcaaaagatg

SEQ ID NO: 215062 - DNA, 103 bp, Artificial Sequence
  Synthetic Polynucleotide
taatacgactcactatagggtaaactcttgggggcacaggggaatcagcaaacagaggagatgctgaatgccctgtgccaacctggcggcagcgcaaaagatg

SEQ ID NO: 215063 - DNA, 103 bp, Artificial Sequence
  Synthetic Polynucleotide
taatacgactcactatagggagggtgtatataaactcttgggggcacaggaacagaggagacctgtgatgccaagagttaacctggcggcagcgcaaaagatg

SEQ ID NO: 215064 - DNA, 103 bp, Artificial Sequence
  Synthetic Polynucleotide
taatacgactcactatagggctagagaatcagggtgtatataaactcttgaacagaggagacaagagatgatatacaccaacctggcggcagcgcaaaagatg

SEQ ID NO: 215065 - DNA, 103 bp, Artificial Sequence
  Synthetic Polynucleotide
taatacgactcactatagggtttgagccgatcaaggcttcaacggagaagaacagaggagacttctcatgtgaagccttaacctggcggcagcgcaaaagatg

SEQ ID NO: 215066 - DNA, 103 bp, Artificial Sequence
  Synthetic Polynucleotide
taatacgactcactatagggtctccagaagctagagaatcagggtgtataaacagaggagatatacaatgtgattctctaacctggcggcagcgcaaaagatg

SEQ ID NO: 215067 - DNA, 103 bp, Artificial Sequence
  Synthetic Polynucleotide
taatacgactcactatagggcatccaggtgtctccagaagctagagaatcaacagaggagagattctatggcttctggaaacctggcggcagcgcaaaagatg

SEQ ID NO: 215068 - DNA, 103 bp, Artificial Sequence
  Synthetic Polynucleotide
taatacgactcactatagggccacctgtctcatccaggtgtctccagaagaacagaggagacttctgatgacacctggaaacctggcggcagcgcaaaagatg

SEQ ID NO: 215069 - DNA, 103 bp, Artificial Sequence
  Synthetic Polynucleotide
taatacgactcactatagggtcaaaactgaccacctgtctcatccaggtgaacagaggagacacctgatggagacaggtaacctggcggcagcgcaaaagatg

SEQ ID NO: 215070 - DNA, 103 bp, Artificial Sequence
  Synthetic Polynucleotide
taatacgactcactatagggcttgagtttgtcaaaactgaccacctgtctaacagaggagaagacagatggtcagttttaacctggcggcagcgcaaaagatg

SEQ ID NO: 215071 - DNA, 103 bp, Artificial Sequence
  Synthetic Polynucleotide
taatacgactcactatagggtgttggtaagcttgagtttgtcaaaactgaaacagaggagatcagttatgacaaactcaaacctggcggcagcgcaaaagatg

SEQ ID NO: 215072 - DNA, 103 bp, Artificial Sequence
  Synthetic Polynucleotide
taatacgactcactatagggtccaactcattgttggtaagcttgagtttgaacagaggagacaaactatggcttaccaaaacctggcggcagcgcaaaagatg

SEQ ID NO: 215073 - DNA, 103 bp, Artificial Sequence
  Synthetic Polynucleotide
taatacgactcactatagggtccttgatcatccaactcattgttggtaagaacagaggagacttaccatgaatgagttgaacctggcggcagcgcaaaagatg

SEQ ID NO: 215074 - DNA, 103 bp, Artificial Sequence
  Synthetic Polynucleotide
taatacgactcactataggggaatgatatgtccttgatcatccaactcataacagaggagaatgagtatgatgatcaagaacctggcggcagcgcaaaagatg

SEQ ID NO: 215075 - DNA, 103 bp, Artificial Sequence
  Synthetic Polynucleotide
taatacgactcactatagggatagagtgcagaatgatatgtccttgatcaaacagaggagatgatcaatgacatatcataacctggcggcagcgcaaaagatg

SEQ ID NO: 215076 - DNA, 103 bp, Artificial Sequence
  Synthetic Polynucleotide
taatacgactcactatagggccgttttttatttgagccgatcaaggcttcaacagaggagagaagccatgatcggctcaaacctggcggcagcgcaaaagatg

SEQ ID NO: 215077 - DNA, 103 bp, Artificial Sequence
  Synthetic Polynucleotide
taatacgactcactataggggtatttgtgcatagagtgcagaatgatatgaacagaggagacatatcatgctgcactctaacctggcggcagcgcaaaagatg

SEQ ID NO: 215078 - DNA, 103 bp, Artificial Sequence
  Synthetic Polynucleotide
taatacgactcactatagggctcgaggctggtatttgtgcatagagtgcaaacagaggagatgcactatgtgcacaaataacctggcggcagcgcaaaagatg

SEQ ID NO: 215079 - DNA, 103 bp, Artificial Sequence
  Synthetic Polynucleotide
taatacgactcactatagggatcacatgaactcgaggctggtatttgtgcaacagaggagagcacaaatgccagcctcgaacctggcggcagcgcaaaagatg

SEQ ID NO: 215080 - DNA, 103 bp, Artificial Sequence
  Synthetic Polynucleotide
taatacgactcactataggggtctttgcgaatcacatgaactcgaggctgaacagaggagacagcctatggttcatgtgaacctggcggcagcgcaaaagatg

SEQ ID NO: 215081 - DNA, 103 bp, Artificial Sequence
  Synthetic Polynucleotide
taatacgactcactatagggcactgctgaagtctttgcgaatcacatgaaaacagaggagattcatgatgttcgcaaagaacctggcggcagcgcaaaagatg

SEQ ID NO: 215082 - DNA, 103 bp, Artificial Sequence
  Synthetic Polynucleotide
taatacgactcactatagggggtgaaaggtcactgctgaagtctttgcgaaacagaggagatcgcaaatgcttcagcagaacctggcggcagcgcaaaagatg

SEQ ID NO: 215083 - DNA, 103 bp, Artificial Sequence
  Synthetic Polynucleotide
taatacgactcactatagggaggcttagtgggtgaaaggtcactgctgaaaacagaggagattcagcatggacctttcaaacctggcggcagcgcaaaagatg

SEQ ID NO: 215084 - DNA, 103 bp, Artificial Sequence
  Synthetic Polynucleotide
taatacgactcactatagggcaacaggaacaggcttagtgggtgaaaggtaacagaggagaacctttatgccactaagcaacctggcggcagcgcaaaagatg

SEQ ID NO: 215085 - DNA, 103 bp, Artificial Sequence
  Synthetic Polynucleotide
taatacgactcactatagggaccccatccccaacaggaacaggcttagtgaacagaggagacactaaatgtgttcctgtaacctggcggcagcgcaaaagatg

SEQ ID NO: 215086 - DNA, 103 bp, Artificial Sequence
  Synthetic Polynucleotide
taatacgactcactataggggaacgttttcaccccatccccaacaggaacaacagaggagagttcctatgggggatgggaacctggcggcagcgcaaaagatg

SEQ ID NO: 215087 - DNA, 103 bp, Artificial Sequence
  Synthetic Polynucleotide
taatacgactcactatagggctcgcagtttccgttttttatttgagccgaaacagaggagatcggctatgataaaaaacaacctggcggcagcgcaaaagatg

SEQ ID NO: 215088 - DNA, 103 bp, Artificial Sequence
  Synthetic Polynucleotide
taatacgactcactatagggcaggaaagttgaacgttttcaccccatcccaacagaggagagggatgatgtgaaaacgtaacctggcggcagcgcaaaagatg

SEQ ID NO: 215089 - DNA, 103 bp, Artificial Sequence
  Synthetic Polynucleotide
taatacgactcactatagggaacacagtctcaggaaagttgaacgttttcaacagaggagagaaaacatgcaactttccaacctggcggcagcgcaaaagatg

SEQ ID NO: 215090 - DNA, 103 bp, Artificial Sequence
  Synthetic Polynucleotide
taatacgactcactatagggaactgtggtgaacacagtctcaggaaagttaacagaggagaaactttatggagactgtgaacctggcggcagcgcaaaagatg

SEQ ID NO: 215091 - DNA, 103 bp, Artificial Sequence
  Synthetic Polynucleotide
taatacgactcactataggggataggccgtaactgtggtgaacacagtctaacagaggagaagactgatgtcaccacagaacctggcggcagcgcaaaagatg

SEQ ID NO: 215092 - DNA, 103 bp, Artificial Sequence
  Synthetic Polynucleotide
taatacgactcactatagggtgctgattctgataggccgtaactgtggtgaacagaggagacaccacatgtacggcctaaacctggcggcagcgcaaaagatg

SEQ ID NO: 215093 - DNA, 103 bp, Artificial Sequence
  Synthetic Polynucleotide
taatacgactcactatagggtctggtaatctgctgattctgataggccgtaacagaggagaacggccatgcagaatcagaacctggcggcagcgcaaaagatg

SEQ ID NO: 215094 - DNA, 103 bp, Artificial Sequence
  Synthetic Polynucleotide
taatacgactcactatagggcaatttttaatctggtaatctgctgattctaacagaggagaagaatcatgagattaccaaacctggcggcagcgcaaaagatg

SEQ ID NO: 215095 - DNA, 103 bp, Artificial Sequence
  Synthetic Polynucleotide
taatacgactcactataggggggtttcggtcaatttttaatctggtaatcaacagaggagagattacatgattaaaaataacctggcggcagcgcaaaagatg

SEQ ID NO: 215096 - DNA, 103 bp, Artificial Sequence
  Synthetic Polynucleotide
taatacgactcactatagggtttagcaaaagggtttcggtcaatttttaaaacagaggagattaaaaatggaccgaaacaacctggcggcagcgcaaaagatg

SEQ ID NO: 215097 - DNA, 103 bp, Artificial Sequence
  Synthetic Polynucleotide
taatacgactcactatagggctctgaatcctttagcaaaagggtttcggtaacagaggagaaccgaaatgcttttgctaaacctggcggcagcgcaaaagatg

SEQ ID NO: 215098 - DNA, 103 bp, Artificial Sequence
  Synthetic Polynucleotide
taatacgactcactatagggtcctcccagtctcgcagtttccgttttttaaacagaggagataaaaaatggaaactgcgaacctggcggcagcgcaaaagatg

SEQ ID NO: 215099 - DNA, 103 bp, Artificial Sequence
  Synthetic Polynucleotide
taatacgactcactatagggctcccagaatctctgaatcctttagcaaaaaacagaggagattttgcatgaggattcagaacctggcggcagcgcaaaagatg

SEQ ID NO: 215100 - DNA, 103 bp, Artificial Sequence
  Synthetic Polynucleotide
taatacgactcactatagggagttctgtttctcccagaatctctgaatccaacagaggagaggattcatggattctgggaacctggcggcagcgcaaaagatg

SEQ ID NO: 215101 - DNA, 103 bp, Artificial Sequence
  Synthetic Polynucleotide
taatacgactcactatagggcttcaagtccagttctgtttctcccagaataacagaggagaattctgatggaaacagaaaacctggcggcagcgcaaaagatg

SEQ ID NO: 215102 - DNA, 103 bp, Artificial Sequence
  Synthetic Polynucleotide
taatacgactcactatagggtccatgatggcttcaagtccagttctgtttaacagaggagaaaacagatgtggacttgaaacctggcggcagcgcaaaagatg

SEQ ID NO: 215103 - DNA, 103 bp, Artificial Sequence
  Synthetic Polynucleotide
taatacgactcactatagggtgcatatgtctccatgatggcttcaagtccaacagaggagaggacttatggccatcatgaacctggcggcagcgcaaaagatg

SEQ ID NO: 215104 - DNA, 103 bp, Artificial Sequence
  Synthetic Polynucleotide
taatacgactcactataggggtctccagaatgcatatgtctccatgatggaacagaggagaccatcaatgagacatatgaacctggcggcagcgcaaaagatg

SEQ ID NO: 215105 - DNA, 103 bp, Artificial Sequence
  Synthetic Polynucleotide
taatacgactcactatagggcgcacaggaggtctccagaatgcatatgtcaacagaggagagacataatgattctggagaacctggcggcagcgcaaaagatg

SEQ ID NO: 215106 - DNA, 103 bp, Artificial Sequence
  Synthetic Polynucleotide
taatacgactcactatagggggtgagtgtgcgcacaggaggtctccagaaaacagaggagattctggatgcctcctgtgaacctggcggcagcgcaaaagatg

SEQ ID NO: 215107 - DNA, 103 bp, Artificial Sequence
  Synthetic Polynucleotide
taatacgactcactatagggagtcttcgaaggtgagtgtgcgcacaggagaacagaggagactcctgatggcacactcaaacctggcggcagcgcaaaagatg

SEQ ID NO: 215108 - DNA, 103 bp, Artificial Sequence
  Synthetic Polynucleotide
taatacgactcactatagggatggtggtgaagtcttcgaaggtgagtgtgaacagaggagacacactatgcttcgaagaaacctggcggcagcgcaaaagatg

SEQ ID NO: 215109 - DNA, 103 bp, Artificial Sequence
  Synthetic Polynucleotide
taatacgactcactataggggcacggcgagccccttcgcttctcggccataacagaggagaatggccatgaagcgaaggaacctggcggcagcgcaaaagatg

SEQ ID NO: 215110 - DNA, 103 bp, Artificial Sequence
  Synthetic Polynucleotide
taatacgactcactatagggttttcgccgcttcttctgaagctgttgctgaacagaggagacagcaaatgcttcagaagaacctggcggcagcgcaaaagatg

SEQ ID NO: 215111 - DNA, 103 bp, Artificial Sequence
  Synthetic Polynucleotide
taatacgactcactatagggggcttccaaacccattctgttgcgcccggaaacagaggagatccgggatgaacagaatgaacctggcggcagcgcaaaagatg

SEQ ID NO: 215112 - DNA, 103 bp, Artificial Sequence
  Synthetic Polynucleotide
taatacgactcactatagggattccaccaaggcttccaaacccattctgtaacagaggagaacagaaatggtttggaagaacctggcggcagcgcaaaagatg

SEQ ID NO: 215113 - DNA, 103 bp, Artificial Sequence
  Synthetic Polynucleotide
taatacgactcactatagggaatgcatatgattccaccaaggcttccaaaaacagaggagatttggaatgcttggtggaaacctggcggcagcgcaaaagatg

SEQ ID NO: 215114 - DNA, 103 bp, Artificial Sequence
  Synthetic Polynucleotide
taatacgactcactatagggtggtcgccagaatgcatatgattccaccaaaacagaggagattggtgatgtcatatgcaaacctggcggcagcgcaaaagatg

SEQ ID NO: 215115 - DNA, 103 bp, Artificial Sequence
  Synthetic Polynucleotide
taatacgactcactatagggtccgtagtgatggtcgccagaatgcatatgaacagaggagacatatgatgtctggcgacaacctggcggcagcgcaaaagatg

SEQ ID NO: 215116 - DNA, 103 bp, Artificial Sequence
  Synthetic Polynucleotide
taatacgactcactatagggaaggtcagagtccgtagtgatggtcgccagaacagaggagactggcgatgatcactacgaacctggcggcagcgcaaaagatg

SEQ ID NO: 215117 - DNA, 103 bp, Artificial Sequence
  Synthetic Polynucleotide
taatacgactcactataggggatatcttcaaaggtcagagtccgtagtgaaacagaggagatcactaatgactctgaccaacctggcggcagcgcaaaagatg

SEQ ID NO: 215118 - DNA, 103 bp, Artificial Sequence
  Synthetic Polynucleotide
taatacgactcactataggggaattccagggatatcttcaaaggtcagagaacagaggagactctgaatgttgaagataaacctggcggcagcgcaaaagatg

SEQ ID NO: 215119 - DNA, 103 bp, Artificial Sequence
  Synthetic Polynucleotide
taatacgactcactatagggccttgcttgggaattccagggatatcttcaaacagaggagatgaagaatgccctggaataacctggcggcagcgcaaaagatg

SEQ ID NO: 215120 - DNA, 103 bp, Artificial Sequence
  Synthetic Polynucleotide
taatacgactcactatagggacttgcattgccttgcttgggaattccaggaacagaggagacctggaatgcccaagcaaaacctggcggcagcgcaaaagatg

SEQ ID NO: 215121 - DNA, 103 bp, Artificial Sequence
  Synthetic Polynucleotide
taatacgactcactatagggcggcgcccagttttcgccgcttcttctgaaaacagaggagattcagaatgagcggcgaaaacctggcggcagcgcaaaagatg

SEQ ID NO: 215122 - DNA, 103 bp, Artificial Sequence
  Synthetic Polynucleotide
taatacgactcactatagggaggtggaggaacttgcattgccttgcttggaacagaggagaccaagcatggcaatgcaaaacctggcggcagcgcaaaagatg

SEQ ID NO: 215123 - DNA, 103 bp, Artificial Sequence
  Synthetic Polynucleotide
taatacgactcactatagggccttggagcaaggtggaggaacttgcattgaacagaggagacaatgcatgttcctccacaacctggcggcagcgcaaaagatg

SEQ ID NO: 215124 - DNA, 103 bp, Artificial Sequence
  Synthetic Polynucleotide
taatacgactcactatagggattcccagtaccttggagcaaggtggaggaaacagaggagatcctccatgttgctccaaaacctggcggcagcgcaaaagatg

SEQ ID NO: 215125 - DNA, 103 bp, Artificial Sequence
  Synthetic Polynucleotide
taatacgactcactatagggcaggaacgccattcccagtaccttggagcaaacagaggagatgctccatggtactgggaaacctggcggcagcgcaaaagatg

SEQ ID NO: 215126 - DNA, 103 bp, Artificial Sequence
  Synthetic Polynucleotide
taatacgactcactataggggggtgagtggcaggaacgccattcccagtaaacagaggagatactggatgtggcgttccaacctggcggcagcgcaaaagatg

SEQ ID NO: 215127 - DNA, 103 bp, Artificial Sequence
  Synthetic Polynucleotide
taatacgactcactatagggcaaaaggtgagggtgagtggcaggaacgccaacagaggagaggcgttatggccactcacaacctggcggcagcgcaaaagatg

SEQ ID NO: 215128 - DNA, 103 bp, Artificial Sequence
  Synthetic Polynucleotide
taatacgactcactatagggaggagccagacaaaaggtgagggtgagtggaacagaggagaccactcatgctcacctttaacctggcggcagcgcaaaagatg

SEQ ID NO: 215129 - DNA, 103 bp, Artificial Sequence
  Synthetic Polynucleotide
taatacgactcactataggggaggagcaagaggagccagacaaaaggtgaaacagaggagatcacctatggtctggctcaacctggcggcagcgcaaaagatg

SEQ ID NO: 215130 - DNA, 103 bp, Artificial Sequence
  Synthetic Polynucleotide
taatacgactcactataggggaaggcaggagaggagcaagaggagccagaaacagaggagatctggcatgtcttgctccaacctggcggcagcgcaaaagatg

SEQ ID NO: 215131 - DNA, 103 bp, Artificial Sequence
  Synthetic Polynucleotide
taatacgactcactataggggccccagatggaaggcaggagaggagcaagaacagaggagacttgctatgctcctgcctaacctggcggcagcgcaaaagatg

SEQ ID NO: 215132 - DNA, 103 bp, Artificial Sequence
  Synthetic Polynucleotide
taatacgactcactataggggccgcctcttcggcgcccagttttcgccgcaacagaggagagcggcgatgactgggcgcaacctggcggcagcgcaaaagatg

SEQ ID NO: 215133 - DNA, 103 bp, Artificial Sequence
  Synthetic Polynucleotide
taatacgactcactatagggctggtgttgggccccagatggaaggcaggaaacagaggagatcctgcatgccatctgggaacctggcggcagcgcaaaagatg

SEQ ID NO: 215134 - DNA, 103 bp, Artificial Sequence
  Synthetic Polynucleotide
taatacgactcactatagggacacagctggctggtgttgggccccagatgaacagaggagacatctgatgcccaacaccaacctggcggcagcgcaaaagatg

SEQ ID NO: 215135 - DNA, 103 bp, Artificial Sequence
  Synthetic Polynucleotide
taatacgactcactataggggggccagactacacagctggctggtgttggaacagaggagaccaacaatggccagctgtaacctggcggcagcgcaaaagatg

SEQ ID NO: 215136 - DNA, 103 bp, Artificial Sequence
  Synthetic Polynucleotide
taatacgactcactatagggtagtcagcaggggccagactacacagctggaacagaggagaccagctatgtagtctggcaacctggcggcagcgcaaaagatg

SEQ ID NO: 215137 - DNA, 103 bp, Artificial Sequence
  Synthetic Polynucleotide
taatacgactcactatagggacaggcagaatagtcagcaggggccagactaacagaggagaagtctgatgcctgctgacaacctggcggcagcgcaaaagatg

SEQ ID NO: 215138 - DNA, 103 bp, Artificial Sequence
  Synthetic Polynucleotide
taatacgactcactatagggctgagcgggcacaggcagaatagtcagcagaacagaggagactgctgatgattctgcctaacctggcggcagcgcaaaagatg

SEQ ID NO: 215139 - DNA, 103 bp, Artificial Sequence
  Synthetic Polynucleotide
taatacgactcactatagggagggtgaggcctgagcgggcacaggcagaaaacagaggagattctgcatgtgcccgctcaacctggcggcagcgcaaaagatg

SEQ ID NO: 215140 - DNA, 103 bp, Artificial Sequence
  Synthetic Polynucleotide
taatacgactcactataggggtatcggttgagggtgaggcctgagcgggcaacagaggagagcccgcatgggcctcaccaacctggcggcagcgcaaaagatg

SEQ ID NO: 215141 - DNA, 103 bp, Artificial Sequence
  Synthetic Polynucleotide
taatacgactcactatagggaagatgtgctgtatcggttgagggtgaggcaacagaggagagcctcaatgtcaaccgataacctggcggcagcgcaaaagatg

SEQ ID NO: 215142 - DNA, 103 bp, Artificial Sequence
  Synthetic Polynucleotide
taatacgactcactataggggtctctgccaaagatgtgctgtatcggttgaacagaggagacaaccgatgcagcacatcaacctggcggcagcgcaaaagatg

SEQ ID NO: 215143 - DNA, 103 bp, Artificial Sequence
  Synthetic Polynucleotide
taatacgactcactatagggcacggcccccgccgcctcttcggcgcccagaacagaggagactgggcatggaagaggcgaacctggcggcagcgcaaaagatg

SEQ ID NO: 215144 - DNA, 103 bp, Artificial Sequence
  Synthetic Polynucleotide
taatacgactcactatagggcctgttgtaggtctctgccaaagatgtgctaacagaggagaagcacaatgttggcagagaacctggcggcagcgcaaaagatg

SEQ ID NO: 215145 - DNA, 103 bp, Artificial Sequence
  Synthetic Polynucleotide
taatacgactcactatagggggttggtgagcctgttgtaggtctctgccaaacagaggagatggcagatgcctacaacaaacctggcggcagcgcaaaagatg

SEQ ID NO: 215146 - DNA, 103 bp, Artificial Sequence
  Synthetic Polynucleotide
taatacgactcactatagggtcaccagcctggttggtgagcctgttgtagaacagaggagactacaaatggctcaccaaaacctggcggcagcgcaaaagatg

SEQ ID NO: 215147 - DNA, 103 bp, Artificial Sequence
  Synthetic Polynucleotide
taatacgactcactatagggggcaaaggtctcaccagcctggttggtgagaacagaggagactcaccatgcaggctggtaacctggcggcagcgcaaaagatg

SEQ ID NO: 215148 - DNA, 103 bp, Artificial Sequence
  Synthetic Polynucleotide
taatacgactcactatagggtcctgggcggggcaaaggtctcaccagcctaacagaggagaaggctgatgagacctttgaacctggcggcagcgcaaaagatg

SEQ ID NO: 215149 - DNA, 103 bp, Artificial Sequence
  Synthetic Polynucleotide
taatacgactcactatagggtaggagggagtcctgggcggggcaaaggtcaacagaggagagaccttatgcccgcccagaacctggcggcagcgcaaaagatg

SEQ ID NO: 215150 - DNA, 103 bp, Artificial Sequence
  Synthetic Polynucleotide
taatacgactcactatagggcacgcccacataggagggagtcctgggcggaacagaggagaccgcccatgactccctccaacctggcggcagcgcaaaagatg

SEQ ID NO: 215151 - DNA, 103 bp, Artificial Sequence
  Synthetic Polynucleotide
taatacgactcactatagggtgctgctgctcacgcccacataggagggagaacagaggagactccctatgatgtgggcgaacctggcggcagcgcaaaagatg

SEQ ID NO: 215152 - DNA, 103 bp, Artificial Sequence
  Synthetic Polynucleotide
taatacgactcactatagggttcacggaggtgctgctgctcacgcccacaaacagaggagatgtgggatggagcagcagaacctggcggcagcgcaaaagatg

SEQ ID NO: 215153 - DNA, 103 bp, Artificial Sequence
  Synthetic Polynucleotide
taatacgactcactatagggcatggacatgttcacggaggtgctgctgctaacagaggagaagcagcatgacctccgtgaacctggcggcagcgcaaaagatg

SEQ ID NO: 215154 - DNA, 103 bp, Artificial Sequence
  Synthetic Polynucleotide
taatacgactcactatagggctccgtcgtccacggcccccgccgcctcttaacagaggagaaagaggatgcgggggccgaacctggcggcagcgcaaaagatg

SEQ ID NO: 215155 - DNA, 103 bp, Artificial Sequence
  Synthetic Polynucleotide
taatacgactcactatagggcagtgccacccatggacatgttcacggaggaacagaggagacctccgatgacatgtccaaacctggcggcagcgcaaaagatg

SEQ ID NO: 215156 - DNA, 103 bp, Artificial Sequence
  Synthetic Polynucleotide
taatacgactcactataggggtgtccccatcagtgccacccatggacatgaacagaggagacatgtcatggggtggcacaacctggcggcagcgcaaaagatg

SEQ ID NO: 215157 - DNA, 103 bp, Artificial Sequence
  Synthetic Polynucleotide
taatacgactcactataggggcagctgaaggtgtccccatcagtgccaccaacagaggagaggtggcatggatggggacaacctggcggcagcgcaaaagatg

SEQ ID NO: 215158 - DNA, 103 bp, Artificial Sequence
  Synthetic Polynucleotide
taatacgactcactatagggtggtctgtgggcagctgaaggtgtccccataacagaggagaatggggatgccttcagctaacctggcggcagcgcaaaagatg

SEQ ID NO: 215159 - DNA, 103 bp, Artificial Sequence
  Synthetic Polynucleotide
taatacgactcactatagggatggataagctggtctgtgggcagctgaagaacagaggagacttcagatgcccacagacaacctggcggcagcgcaaaagatg

SEQ ID NO: 215160 - DNA, 103 bp, Artificial Sequence
  Synthetic Polynucleotide
taatacgactcactatagggcgaaatctgcatggataagctggtctgtggaacagaggagaccacagatgagcttatccaacctggcggcagcgcaaaagatg

SEQ ID NO: 215161 - DNA, 103 bp, Artificial Sequence
  Synthetic Polynucleotide
taatacgactcactataggggggacattcccgaaatctgcatggataagcaacagaggagagcttatatgtgcagatttaacctggcggcagcgcaaaagatg

SEQ ID NO: 215162 - DNA, 103 bp, Artificial Sequence
  Synthetic Polynucleotide
taatacgactcactatagggtggagctggggggacattcccgaaatctgcaacagaggagagcagatatggggaatgtcaacctggcggcagcgcaaaagatg

SEQ ID NO: 215163 - DNA, 103 bp, Artificial Sequence
  Synthetic Polynucleotide
taatacgactcactatagggcatgatatactggagctggggggacattccaacagaggagaggaatgatgccccagctcaacctggcggcagcgcaaaagatg

SEQ ID NO: 215164 - DNA, 103 bp, Artificial Sequence
  Synthetic Polynucleotide
taatacgactcactatagggagggtgatggcatgatatactggagctgggaacagaggagacccagcatgagtatatcaaacctggcggcagcgcaaaagatg

SEQ ID NO: 215165 - DNA, 103 bp, Artificial Sequence
  Synthetic Polynucleotide
taatacgactcactatagggcggctgcagcctccgtcgtccacggcccccaacagaggagagggggcatgggacgacggaacctggcggcagcgcaaaagatg

SEQ ID NO: 215166 - DNA, 103 bp, Artificial Sequence
  Synthetic Polynucleotide
taatacgactcactataggggcattgctggagggtgatggcatgatatacaacagaggagagtatatatggccatcaccaacctggcggcagcgcaaaagatg

SEQ ID NO: 215167 - DNA, 103 bp, Artificial Sequence
  Synthetic Polynucleotide
taatacgactcactatagggagtggcgaaggcattgctggagggtgatggaacagaggagaccatcaatgtccagcaataacctggcggcagcgcaaaagatg

SEQ ID NO: 215168 - DNA, 103 bp, Artificial Sequence
  Synthetic Polynucleotide
taatacgactcactataggggggtctggttagtggcgaaggcattgctggaacagaggagaccagcaatgccttcgccaaacctggcggcagcgcaaaagatg

SEQ ID NO: 215169 - DNA, 103 bp, Artificial Sequence
  Synthetic Polynucleotide
taatacgactcactataggggaaccctgatgggtctggttagtggcgaagaacagaggagacttcgcatgtaaccagacaacctggcggcagcgcaaaagatg

SEQ ID NO: 215170 - DNA, 103 bp, Artificial Sequence
  Synthetic Polynucleotide
taatacgactcactatagggagtattataggaaccctgatgggtctggttaacagaggagaaaccagatgcatcagggtaacctggcggcagcgcaaaagatg

SEQ ID NO: 215171 - DNA, 103 bp, Artificial Sequence
  Synthetic Polynucleotide
taatacgactcactataggggtaatctaaaagtattataggaaccctgataacagaggagaatcaggatgcctataataaacctggcggcagcgcaaaagatg

SEQ ID NO: 215172 - DNA, 103 bp, Artificial Sequence
  Synthetic Polynucleotide
taatacgactcactatagggcaggggctgtgtaatctaaaagtattatagaacagaggagactataaatgttttagattaacctggcggcagcgcaaaagatg

SEQ ID NO: 215173 - DNA, 103 bp, Artificial Sequence
  Synthetic Polynucleotide
taatacgactcactatagggatatagtgcacaggggctgtgtaatctaaaaacagaggagatttagaatgcacagccccaacctggcggcagcgcaaaagatg

SEQ ID NO: 215174 - DNA, 103 bp, Artificial Sequence
  Synthetic Polynucleotide
taatacgactcactatagggagttatatccatatagtgcacaggggctgtaacagaggagaacagccatggtgcactataacctggcggcagcgcaaaagatg

SEQ ID NO: 215175 - DNA, 103 bp, Artificial Sequence
  Synthetic Polynucleotide
taatacgactcactataggggatgtggagaagttatatccatatagtgcaaacagaggagatgcactatgtggatataaaacctggcggcagcgcaaaagatg

SEQ ID NO: 215176 - DNA, 103 bp, Artificial Sequence
  Synthetic Polynucleotide
taatacgactcactataggggccgccgccgcggctgcagcctccgtcgtcaacagaggagagacgacatgggctgcagcaacctggcggcagcgcaaaagatg

SEQ ID NO: 215177 - DNA, 103 bp, Artificial Sequence
  Synthetic Polynucleotide
taatacgactcactatagggcagtttgggggatgtggagaagttatatccaacagaggagaggatatatgttctccacaaacctggcggcagcgcaaaagatg

SEQ ID NO: 215178 - DNA, 103 bp, Artificial Sequence
  Synthetic Polynucleotide
taatacgactcactataggggactggcagccagtttgggggatgtggagaaacagaggagatctccaatgcccccaaacaacctggcggcagcgcaaaagatg

SEQ ID NO: 215179 - DNA, 103 bp, Artificial Sequence
  Synthetic Polynucleotide
taatacgactcactatagggattttctcaggactggcagccagtttggggaacagaggagaccccaaatgggctgccagaacctggcggcagcgcaaaagatg

SEQ ID NO: 215180 - DNA, 103 bp, Artificial Sequence
  Synthetic Polynucleotide
taatacgactcactatagggggaagaaacaattttctcaggactggcagcaacagaggagagctgccatgcctgagaaaaacctggcggcagcgcaaaagatg

SEQ ID NO: 215181 - DNA, 103 bp, Artificial Sequence
  Synthetic Polynucleotide
taatacgactcactatagggaacttccttgggaagaaacaattttctcagaacagaggagactgagaatgttgtttcttaacctggcggcagcgcaaaagatg

SEQ ID NO: 215182 - DNA, 103 bp, Artificial Sequence
  Synthetic Polynucleotide
taatacgactcactataggggaccccaagaaacttccttgggaagaaacaaacagaggagatgtttcatgccaaggaagaacctggcggcagcgcaaaagatg

SEQ ID NO: 215183 - DNA, 103 bp, Artificial Sequence
  Synthetic Polynucleotide
taatacgactcactatagggactcggtgaggaccccaagaaacttccttgaacagaggagacaaggaatgttcttggggaacctggcggcagcgcaaaagatg

SEQ ID NO: 215184 - DNA, 103 bp, Artificial Sequence
  Synthetic Polynucleotide
taatacgactcactatagggtcatggtcccactcggtgaggaccccaagaaacagaggagatcttggatgcctcaccgaaacctggcggcagcgcaaaagatg

SEQ ID NO: 215185 - DNA, 103 bp, Artificial Sequence
  Synthetic Polynucleotide
taatacgactcactatagggtgccgatccgtcatggtcccactcggtgagaacagaggagactcaccatgtgggaccataacctggcggcagcgcaaaagatg

SEQ ID NO: 215186 - DNA, 103 bp, Artificial Sequence
  Synthetic Polynucleotide
taatacgactcactataggggggcaacatctgccgatccgtcatggtcccaacagaggagagggaccatgacggatcggaacctggcggcagcgcaaaagatg

SEQ ID NO: 215187 - DNA, 103 bp, Artificial Sequence
  Synthetic Polynucleotide
taatacgactcactatagggtttcgcccgcgccgccgccgcggctgcagcaacagaggagagctgcaatggcggcggcgaacctggcggcagcgcaaaagatg

SEQ ID NO: 215188 - DNA, 103 bp, Artificial Sequence
  Synthetic Polynucleotide
taatacgactcactatagggcttccacagggggcaacatctgccgatccgaacagaggagacggatcatgagatgttgcaacctggcggcagcgcaaaagatg

SEQ ID NO: 215189 - DNA, 103 bp, Artificial Sequence
  Synthetic Polynucleotide
taatacgactcactatagggaggtgcactccttccacagggggcaacatcaacagaggagagatgttatgccctgtggaaacctggcggcagcgcaaaagatg

SEQ ID NO: 215190 - DNA, 103 bp, Artificial Sequence
  Synthetic Polynucleotide
taatacgactcactatagggactgctaagcaggtgcactccttccacaggaacagaggagacctgtgatgggagtgcacaacctggcggcagcgcaaaagatg

SEQ ID NO: 215191 - DNA, 103 bp, Artificial Sequence
  Synthetic Polynucleotide
taatacgactcactataggggctgacccccactgctaagcaggtgcactcaacagaggagagagtgcatgtgcttagcaaacctggcggcagcgcaaaagatg

SEQ ID NO: 215192 - DNA, 103 bp, Artificial Sequence
  Synthetic Polynucleotide
taatacgactcactatagggaagaaactctgctgacccccactgctaagcaacagaggagagcttagatgtgggggtcaaacctggcggcagcgcaaaagatg

SEQ ID NO: 215193 - DNA, 103 bp, Artificial Sequence
  Synthetic Polynucleotide
taatacgactcactatagggcctagagtcaaagaaactctgctgacccccaacagaggagagggggtatgcagagtttcaacctggcggcagcgcaaaagatg

SEQ ID NO: 215194 - DNA, 103 bp, Artificial Sequence
  Synthetic Polynucleotide
taatacgactcactatagggttcctagggtcctagagtcaaagaaactctaacagaggagaagagttatgttgactctaaacctggcggcagcgcaaaagatg

SEQ ID NO: 215195 - DNA, 103 bp, Artificial Sequence
  Synthetic Polynucleotide
taatacgactcactatagggagagttaagcttcctagggtcctagagtcaaacagaggagatgactcatggaccctaggaacctggcggcagcgcaaaagatg

SEQ ID NO: 215196 - DNA, 103 bp, Artificial Sequence
  Synthetic Polynucleotide
taatacgactcactatagggagatgatgacagagttaagcttcctagggtaacagaggagaaccctaatgagcttaactaacctggcggcagcgcaaaagatg

SEQ ID NO: 215197 - DNA, 103 bp, Artificial Sequence
  Synthetic Polynucleotide
taatacgactcactatagggcagatacttgagatgatgacagagttaagcaacagaggagagcttaaatgtgtcatcataacctggcggcagcgcaaaagatg

SEQ ID NO: 215198 - DNA, 103 bp, Artificial Sequence
  Synthetic Polynucleotide
taatacgactcactataggggaagaacccttttcgcccgcgccgccgccgaacagaggagacggcggatgcgcgggcgaaacctggcggcagcgcaaaagatg

SEQ ID NO: 215199 - DNA, 103 bp, Artificial Sequence
  Synthetic Polynucleotide
taatacgactcactatagggaccatatgtgcagatacttgagatgatgacaacagaggagagtcatcatgtcaagtatcaacctggcggcagcgcaaaagatg

SEQ ID NO: 215200 - DNA, 103 bp, Artificial Sequence
  Synthetic Polynucleotide
taatacgactcactataggggtctccctcagaagaacccttttcgcccgcaacagaggagagcgggcatgaagggttctaacctggcggcagcgcaaaagatg

SEQ ID NO: 215201 - DNA, 103 bp, Artificial Sequence
  Synthetic Polynucleotide
taatacgactcactatagggttagcatgctgcacggcgagccccttcgctaacagaggagaagcgaaatggctcgccgtaacctggcggcagcgcaaaagatg

SEQ ID NO: 215202 - DNA, 103 bp, Artificial Sequence
  Synthetic Polynucleotide
taatacgactcactatagggcagcgccttcgtctccctcagaagaaccctaacagaggagaagggttatgctgagggagaacctggcggcagcgcaaaagatg

SEQ ID NO: 215203 - DNA, 103 bp, Artificial Sequence
  Synthetic Polynucleotide
taatacgactcactatagggggcgggagcgcagcgccttcgtctccctcaaacagaggagatgagggatgcgaaggcgcaacctggcggcagcgcaaaagatg

SEQ ID NO: 215204 - DNA, 103 bp, Artificial Sequence
  Synthetic Polynucleotide
taatacgactcactatagggcccagccggcggcgggagcgcagcgccttcaacagaggagagaaggcatggcgctcccgaacctggcggcagcgcaaaagatg

SEQ ID NO: 215205 - DNA, 103 bp, Artificial Sequence
  Synthetic Polynucleotide
taatacgactcactatagggcagacgtcgccccagccggcggcgggagcgaacagaggagacgctccatgcgccggctgaacctggcggcagcgcaaaagatg

SEQ ID NO: 215206 - DNA, 103 bp, Artificial Sequence
  Synthetic Polynucleotide
taatacgactcactatagggcgagccggcccagacgtcgccccagccggcaacagaggagagccggcatgggcgacgtcaacctggcggcagcgcaaaagatg

SEQ ID NO: 215207 - DNA, 103 bp, Artificial Sequence
  Synthetic Polynucleotide
taatacgactcactatagggtgcgccactccgagccggcccagacgtcgcaacagaggagagcgacgatggggccggctaacctggcggcagcgcaaaagatg

SEQ ID NO: 215208 - DNA, 103 bp, Artificial Sequence
  Synthetic Polynucleotide
taatacgactcactataggggctccaggtctgcgccactccgagccggccaacagaggagaggccggatgggagtggcgaacctggcggcagcgcaaaagatg

SEQ ID NO: 215209 - DNA, 103 bp, Artificial Sequence
  Synthetic Polynucleotide
taatacgactcactataggggcggctccgcgctccaggtctgcgccactcaacagaggagagagtggatgagacctggaaacctggcggcagcgcaaaagatg

SEQ ID NO: 215210 - DNA, 103 bp, Artificial Sequence
  Synthetic Polynucleotide
taatacgactcactatagggacagccgcccgcggctccgcgctccaggtcaacagaggagagacctgatgcgcggagccaacctggcggcagcgcaaaagatg

SEQ ID NO: 215211 - DNA, 103 bp, Artificial Sequence
  Synthetic Polynucleotide
taatacgactcactatagggagccgtcctcacagccgcccgcggctccgcaacagaggagagcggagatgcgggcggctaacctggcggcagcgcaaaagatg

SEQ ID NO: 215212 - DNA, 103 bp, Artificial Sequence
  Synthetic Polynucleotide
taatacgactcactataggggccttgaggcttagcatgctgcacggcgagaacagaggagactcgccatgcagcatgctaacctggcggcagcgcaaaagatg

SEQ ID NO: 215213 - DNA, 103 bp, Artificial Sequence
  Synthetic Polynucleotide
taatacgactcactatagggccctgctggaagccgtcctcacagccgcccaacagaggagagggcggatgtgaggacggaacctggcggcagcgcaaaagatg

SEQ ID NO: 215214 - DNA, 103 bp, Artificial Sequence
  Synthetic Polynucleotide
taatacgactcactatagggaggggaagctccctgctggaagccgtcctcaacagaggagagaggacatgttccagcagaacctggcggcagcgcaaaagatg

SEQ ID NO: 215215 - DNA, 103 bp, Artificial Sequence
  Synthetic Polynucleotide
taatacgactcactataggggtgacgccagaggggaagctccctgctggaaacagaggagatccagcatggagcttcccaacctggcggcagcgcaaaagatg

SEQ ID NO: 215216 - DNA, 103 bp, Artificial Sequence
  Synthetic Polynucleotide
taatacgactcactataggggagcctcccggtgacgccagaggggaagctaacagaggagaagcttcatgtctggcgtcaacctggcggcagcgcaaaagatg

SEQ ID NO: 215217 - DNA, 103 bp, Artificial Sequence
  Synthetic Polynucleotide
taatacgactcactatagggccccttgggggagcctcccggtgacgccagaacagaggagactggcgatgccgggaggcaacctggcggcagcgcaaaagatg

SEQ ID NO: 215218 - DNA, 103 bp, Artificial Sequence
  Synthetic Polynucleotide
taatacgactcactataggggcgccggagaccccttgggggagcctcccgaacagaggagacgggagatgcccccaaggaacctggcggcagcgcaaaagatg

SEQ ID NO: 215219 - DNA, 103 bp, Artificial Sequence
  Synthetic Polynucleotide
taatacgactcactataggggccagggagcgcgccggagaccccttggggaacagaggagaccccaaatggtctccggcaacctggcggcagcgcaaaagatg

SEQ ID NO: 215220 - DNA, 103 bp, Artificial Sequence
  Synthetic Polynucleotide
taatacgactcactatagggcccgggccgggccagggagcgcgccggagaaacagaggagatctccgatgcgctccctgaacctggcggcagcgcaaaagatg

SEQ ID NO: 215221 - DNA, 103 bp, Artificial Sequence
  Synthetic Polynucleotide
taatacgactcactataggggcagaggggtcccgggccgggccagggagcaacagaggagagctcccatgcccggcccgaacctggcggcagcgcaaaagatg

SEQ ID NO: 215222 - DNA, 103 bp, Artificial Sequence
  Synthetic Polynucleotide
taatacgactcactatagggtgcggcgagggcagaggggtcccgggccggaacagaggagaccggccatggacccctctaacctggcggcagcgcaaaagatg

SEQ ID NO: 215223 - DNA, 103 bp, Artificial Sequence
  Synthetic Polynucleotide
taatacgactcactataggggaaagcgtgcgccttgaggcttagcatgctaacagaggagaagcatgatgagcctcaagaacctggcggcagcgcaaaagatg

SEQ ID NO: 215224 - DNA, 103 bp, Artificial Sequence
  Synthetic Polynucleotide
taatacgactcactatagggccgcggggcctgcggcgagggcagaggggtaacagaggagaacccctatgccctcgccgaacctggcggcagcgcaaaagatg

SEQ ID NO: 215225 - DNA, 103 bp, Artificial Sequence
  Synthetic Polynucleotide
taatacgactcactataggggcagatccacccgcggggcctgcggcgaggaacagaggagacctcgcatgaggccccgcaacctggcggcagcgcaaaagatg

SEQ ID NO: 215226 - DNA, 103 bp, Artificial Sequence
  Synthetic Polynucleotide
taatacgactcactatagggtcggctccctgcagatccacccgcggggccaacagaggagaggccccatgggtggatctaacctggcggcagcgcaaaagatg

SEQ ID NO: 215227 - DNA, 103 bp, Artificial Sequence
  Synthetic Polynucleotide
taatacgactcactatagggcttccagagctcggctccctgcagatccacaacagaggagagtggatatgcagggagccaacctggcggcagcgcaaaagatg

SEQ ID NO: 215228 - DNA, 103 bp, Artificial Sequence
  Synthetic Polynucleotide
taatacgactcactatagggcatgaaagcgcttccagagctcggctccctaacagaggagaagggagatgagctctggaaacctggcggcagcgcaaaagatg

SEQ ID NO: 215229 - DNA, 103 bp, Artificial Sequence
  Synthetic Polynucleotide
taatacgactcactataggggtgcctatctcatgaaagcgcttccagagcaacagaggagagctctgatggcgctttcaaacctggcggcagcgcaaaagatg

SEQ ID NO: 215230 - DNA, 103 bp, Artificial Sequence
  Synthetic Polynucleotide
taatacgactcactataggggatcatctcagtgcctatctcatgaaagcgaacagaggagacgctttatggagataggcaacctggcggcagcgcaaaagatg

SEQ ID NO: 215231 - DNA, 103 bp, Artificial Sequence
  Synthetic Polynucleotide
taatacgactcactatagggccttggtgatgatcatctcagtgcctatctaacagaggagaagatagatgctgagatgaaacctggcggcagcgcaaaagatg

SEQ ID NO: 215232 - DNA, 103 bp, Artificial Sequence
  Synthetic Polynucleotide
taatacgactcactatagggcgcctgccggccttggtgatgatcatctcaaacagaggagatgagatatgcatcaccaaaacctggcggcagcgcaaaagatg

SEQ ID NO: 215233 - DNA, 103 bp, Artificial Sequence
  Synthetic Polynucleotide
taatacgactcactatagggtggaaacatgcgcctgccggccttggtgataacagaggagaatcaccatggccggcaggaacctggcggcagcgcaaaagatg

SEQ ID NO: 215234 - DNA, 103 bp, Artificial Sequence
  Synthetic Polynucleotide
taatacgactcactatagggcctccaccgagaaagcgtgcgccttgaggcaacagaggagagcctcaatgcgcacgcttaacctggcggcagcgcaaaagatg

SEQ ID NO: 215235 - DNA, 103 bp, Artificial Sequence
  Synthetic Polynucleotide
taatacgactcactatagggctctcattgctggaaacatgcgcctgccggaacagaggagaccggcaatggcatgtttcaacctggcggcagcgcaaaagatg

SEQ ID NO: 215236 - DNA, 103 bp, Artificial Sequence
  Synthetic Polynucleotide
taatacgactcactataggggagatcttcactctcattgctggaaacatgaacagaggagacatgttatgagcaatgagaacctggcggcagcgcaaaagatg

SEQ ID NO: 215237 - DNA, 103 bp, Artificial Sequence
  Synthetic Polynucleotide
taatacgactcactatagggatctaatccagagatcttcactctcattgcaacagaggagagcaatgatggtgaagatcaacctggcggcagcgcaaaagatg

SEQ ID NO: 215238 - DNA, 103 bp, Artificial Sequence
  Synthetic Polynucleotide
taatacgactcactataggggctggtgaggatctaatccagagatcttcaaacagaggagatgaagaatgctggattagaacctggcggcagcgcaaaagatg

SEQ ID NO: 215239 - DNA, 103 bp, Artificial Sequence
  Synthetic Polynucleotide
taatacgactcactatagggatgtaatattgctggtgaggatctaatccaaacagaggagatggattatgtcctcaccaaacctggcggcagcgcaaaagatg

SEQ ID NO: 215240 - DNA, 103 bp, Artificial Sequence
  Synthetic Polynucleotide
taatacgactcactatagggatccatggcaatgtaatattgctggtgaggaacagaggagacctcacatgcaatattacaacctggcggcagcgcaaaagatg

SEQ ID NO: 215241 - DNA, 103 bp, Artificial Sequence
  Synthetic Polynucleotide
taatacgactcactatagggctggtacaatatccatggcaatgtaatattaacagaggagaaatattatgttgccatggaacctggcggcagcgcaaaagatg

SEQ ID NO: 215242 - DNA, 103 bp, Artificial Sequence
  Synthetic Polynucleotide
taatacgactcactatagggttgttgtccactggtacaatatccatggcaaacagaggagatgccatatgtattgtaccaacctggcggcagcgcaaaagatg

SEQ ID NO: 215243 - DNA, 103 bp, Artificial Sequence
  Synthetic Polynucleotide
taatacgactcactatagggcctgtatcttttgttgtccactggtacaataacagaggagaattgtaatggtggacaacaacctggcggcagcgcaaaagatg

SEQ ID NO: 215244 - DNA, 103 bp, Artificial Sequence
  Synthetic Polynucleotide
taatacgactcactatagggggtaaacatacctgtatcttttgttgtccaaacagaggagatggacaatgaaagatacaaacctggcggcagcgcaaaagatg

SEQ ID NO: 215245 - DNA, 103 bp, Artificial Sequence
  Synthetic Polynucleotide
taatacgactcactatagggccgatcagcgcctccaccgagaaagcgtgcaacagaggagagcacgcatgctcggtggaaacctggcggcagcgcaaaagatg

SEQ ID NO: 215246 - DNA, 103 bp, Artificial Sequence
  Synthetic Polynucleotide
taatacgactcactatagggttcgaactgtggtaaacatacctgtatcttaacagaggagaaagataatggtatgtttaaacctggcggcagcgcaaaagatg

SEQ ID NO: 215247 - DNA, 103 bp, Artificial Sequence
  Synthetic Polynucleotide
taatacgactcactatagggcaccatccatttcgaactgtggtaaacataaacagaggagatatgttatgcacagttcgaacctggcggcagcgcaaaagatg

SEQ ID NO: 215248 - DNA, 103 bp, Artificial Sequence
  Synthetic Polynucleotide
taatacgactcactatagggcattacctgccaccatccatttcgaactgtaacagaggagaacagttatgaatggatggaacctggcggcagcgcaaaagatg

SEQ ID NO: 215249 - DNA, 103 bp, Artificial Sequence
  Synthetic Polynucleotide
taatacgactcactatagggggcgagtcagcattacctgccaccatccataacagaggagaatggatatgggcaggtaaaacctggcggcagcgcaaaagatg

SEQ ID NO: 215250 - DNA, 103 bp, Artificial Sequence
  Synthetic Polynucleotide
taatacgactcactataggggggtggcacaggcgagtcagcattacctgcaacagaggagagcaggtatggctgactcgaacctggcggcagcgcaaaagatg

SEQ ID NO: 215251 - DNA, 103 bp, Artificial Sequence
  Synthetic Polynucleotide
taatacgactcactatagggtgtacacacggggtggcacaggcgagtcagaacagaggagactgactatgctgtgccacaacctggcggcagcgcaaaagatg

SEQ ID NO: 215252 - DNA, 103 bp, Artificial Sequence
  Synthetic Polynucleotide
taatacgactcactatagggtctggatgaatgtacacacggggtggcacaaacagaggagatgtgccatgccgtgtgtaaacctggcggcagcgcaaaagatg

SEQ ID NO: 215253 - DNA, 103 bp, Artificial Sequence
  Synthetic Polynucleotide
taatacgactcactatagggggcaggcgagtctggatgaatgtacacacgaacagaggagacgtgtgatgattcatccaaacctggcggcagcgcaaaagatg

SEQ ID NO: 215254 - DNA, 103 bp, Artificial Sequence
  Synthetic Polynucleotide
taatacgactcactatagggtctcccccgaggcaggcgagtctggatgaaaacagaggagattcatcatgactcgcctgaacctggcggcagcgcaaaagatg

SEQ ID NO: 215255 - DNA, 103 bp, Artificial Sequence
  Synthetic Polynucleotide
taatacgactcactatagggctcatccaagtctcccccgaggcaggcgagaacagaggagactcgccatgctcgggggaaacctggcggcagcgcaaaagatg

SEQ ID NO: 215256 - DNA, 103 bp, Artificial Sequence
  Synthetic Polynucleotide
taatacgactcactatagggcttctcggcgccgatcagcgcctccaccgaaacagaggagatcggtgatggcgctgatcaacctggcggcagcgcaaaagatg

SEQ ID NO: 215257 - DNA, 103 bp, Artificial Sequence
  Synthetic Polynucleotide
taatacgactcactataggggataacttgtctcatccaagtctcccccgaaacagaggagatcggggatgacttggatgaacctggcggcagcgcaaaagatg

SEQ ID NO: 215258 - DNA, 103 bp, Artificial Sequence
  Synthetic Polynucleotide
taatacgactcactatagggtgtcgaagctgataacttgtctcatccaagaacagaggagacttggaatggacaagttaaacctggcggcagcgcaaaagatg

SEQ ID NO: 215259 - DNA, 103 bp, Artificial Sequence
  Synthetic Polynucleotide
taatacgactcactatagggagcttcagcttgtcgaagctgataacttgtaacagaggagaacaagtatgcagcttcgaaacctggcggcagcgcaaaagatg

SEQ ID NO: 215260 - DNA, 103 bp, Artificial Sequence
  Synthetic Polynucleotide
taatacgactcactatagggattgttggtgagcttcagcttgtcgaagctaacagaggagaagcttcatgaagctgaagaacctggcggcagcgcaaaagatg

SEQ ID NO: 215261 - DNA, 103 bp, Artificial Sequence
  Synthetic Polynucleotide
taatacgactcactatagggcatccagttcattgttggtgagcttcagctaacagaggagaagctgaatgtcaccaacaaacctggcggcagcgcaaaagatg

SEQ ID NO: 215262 - DNA, 103 bp, Artificial Sequence
  Synthetic Polynucleotide
taatacgactcactatagggtggccttggtcatccagttcattgttggtgaacagaggagacaccaaatgtgaactggaaacctggcggcagcgcaaaagatg

SEQ ID NO: 215263 - DNA, 103 bp, Artificial Sequence
  Synthetic Polynucleotide
taatacgactcactatagggaagaataatatggccttggtcatccagttcaacagaggagagaactgatggaccaaggcaacctggcggcagcgcaaaagatg

SEQ ID NO: 215264 - DNA, 103 bp, Artificial Sequence
  Synthetic Polynucleotide
taatacgactcactataggggcatagaatgaagaataatatggccttggtaacagaggagaaccaagatgatattattcaacctggcggcagcgcaaaagatg

SEQ ID NO: 215265 - DNA, 103 bp, Artificial Sequence
  Synthetic Polynucleotide
taatacgactcactatagggtggtatttgtgcatagaatgaagaataataaacagaggagatattatatgtcattctataacctggcggcagcgcaaaagatg

SEQ ID NO: 215266 - DNA, 103 bp, Artificial Sequence
  Synthetic Polynucleotide
taatacgactcactatagggcactcgcggttggtatttgtgcatagaatgaacagaggagacattctatgcacaaatacaacctggcggcagcgcaaaagatg

SEQ ID NO: 215267 - DNA, 103 bp, Artificial Sequence
  Synthetic Polynucleotide
taatacgactcactataggggctgttgctgcttctcggcgccgatcagcgaacagaggagacgctgaatggcgccgagaaacctggcggcagcgcaaaagatg

SEQ ID NO: 215268 - DNA, 103 bp, Artificial Sequence
  Synthetic Polynucleotide
taatacgactcactatagggggatgacgtgcactcgcggttggtatttgtaacagaggagaacaaatatgaaccgcgagaacctggcggcagcgcaaaagatg

SEQ ID NO: 215269 - DNA, 103 bp, Artificial Sequence
  Synthetic Polynucleotide
taatacgactcactatagggcagtctttacggatgacgtgcactcgcggtaacagaggagaaccgcgatggcacgtcataacctggcggcagcgcaaaagatg

SEQ ID NO: 215270 - DNA, 103 bp, Artificial Sequence
  Synthetic Polynucleotide
taatacgactcactatagggatcgtctccacagtctttacggatgacgtgaacagaggagacacgtcatgcgtaaagacaacctggcggcagcgcaaaagatg

SEQ ID NO: 215271 - DNA, 103 bp, Artificial Sequence
  Synthetic Polynucleotide
taatacgactcactatagggtgggagaaagatcgtctccacagtctttacaacagaggagagtaaagatggtggagacgaacctggcggcagcgcaaaagatg

SEQ ID NO: 215272 - DNA, 103 bp, Artificial Sequence
  Synthetic Polynucleotide
taatacgactcactatagggacaggcttgatgggagaaagatcgtctccaaacagaggagatggagaatgtctttctccaacctggcggcagcgcaaaagatg

SEQ ID NO: 215273 - DNA, 103 bp, Artificial Sequence
  Synthetic Polynucleotide
taatacgactcactatagggcccggatggaacaggcttgatgggagaaagaacagaggagactttctatgatcaagcctaacctggcggcagcgcaaaagatg

SEQ ID NO: 215274 - DNA, 103 bp, Artificial Sequence
  Synthetic Polynucleotide
taatacgactcactatagggttactccctccccggatggaacaggcttgaaacagaggagatcaagcatgttccatccgaacctggcggcagcgcaaaagatg

SEQ ID NO: 215275 - DNA, 103 bp, Artificial Sequence
  Synthetic Polynucleotide
taatacgactcactataggggagaatgcctttactccctccccggatggaaacagaggagatccatcatgggagggagtaacctggcggcagcgcaaaagatg

SEQ ID NO: 215276 - DNA, 103 bp, Artificial Sequence
  Synthetic Polynucleotide
taatacgactcactatagggttctggaaaggagaatgcctttactccctcaacagaggagagagggaatgaaggcattcaacctggcggcagcgcaaaagatg

SEQ ID NO: 215277 - DNA, 103 bp, Artificial Sequence
  Synthetic Polynucleotide
taatacgactcactatagggtgaagacagtttctggaaaggagaatgcctaacagaggagaaggcatatgcctttccagaacctggcggcagcgcaaaagatg

SEQ ID NO: 215278 - DNA, 103 bp, Artificial Sequence
  Synthetic Polynucleotide
taatacgactcactatagggttcttctgaagctgttgctgcttctcggcgaacagaggagacgccgaatggcagcaacaaacctggcggcagcgcaaaagatg

SEQ ID NO: 215279 - DNA, 103 bp, Artificial Sequence
  Synthetic Polynucleotide
taatacgactcactataggggtgacggttgtgaagacagtttctggaaagaacagaggagactttccatgaactgtcttaacctggcggcagcgcaaaagatg

SEQ ID NO: 215280 - DNA, 103 bp, Artificial Sequence
  Synthetic Polynucleotide
taatacgactcactatagggctgataggcagtgacggttgtgaagacagtaacagaggagaactgtcatgacaaccgtcaacctggcggcagcgcaaaagatg

SEQ ID NO: 215281 - DNA, 103 bp, Artificial Sequence
  Synthetic Polynucleotide
taatacgactcactatagggtctgctgattctgataggcagtgacggttgaacagaggagacaaccgatgctgcctatcaacctggcggcagcgcaaaagatg

SEQ ID NO: 215282 - DNA, 103 bp, Artificial Sequence
  Synthetic Polynucleotide
taatacgactcactatagggaggcgagtaatctgctgattctgataggcaaacagaggagatgcctaatggaatcagcaaacctggcggcagcgcaaaagatg

SEQ ID NO: 215283 - DNA, 103 bp, Artificial Sequence
  Synthetic Polynucleotide
taatacgactcactatagggatctatcttcaggcgagtaatctgctgattaacagaggagaaatcagatgattactcgcaacctggcggcagcgcaaaagatg

SEQ ID NO: 215284 - DNA, 103 bp, Artificial Sequence
  Synthetic Polynucleotide
taatacgactcactatagggatggattcctatctatcttcaggcgagtaaaacagaggagattactcatgtgaagatagaacctggcggcagcgcaaaagatg

SEQ ID NO: 215285 - DNA, 103 bp, Artificial Sequence
  Synthetic Polynucleotide
taatacgactcactatagggcctttagcaaatggattcctatctatcttcaacagaggagagaagatatgtaggaatccaacctggcggcagcgcaaaagatg

SEQ ID NO: 215286 - DNA, 103 bp, Artificial Sequence
  Synthetic Polynucleotide
taatacgactcactataggggtctcggaagcctttagcaaatggattcctaacagaggagaaggaatatgtttgctaaaaacctggcggcagcgcaaaagatg

SEQ ID NO: 215287 - DNA, 103 bp, Artificial Sequence
  Synthetic Polynucleotide
taatacgactcactatagggtgcgcccggagtctcggaagcctttagcaaaacagaggagattgctaatggcttccgagaacctggcggcagcgcaaaagatg

SEQ ID NO: 215288 - DNA, 103 bp, Artificial Sequence
  Synthetic Polynucleotide
taatacgactcactatagggcccattctgttgcgcccggagtctcggaagaacagaggagacttccgatgctccgggcgaacctggcggcagcgcaaaagatg

SEQ ID NO: 215289 - DNA, 103 bp, Artificial Sequence
  Synthetic Polynucleotide
taatacgactcactatagggcttccgagtgcccagctcactcatggccataacagaggagaatggccatgagtgagctgaacctggcggcagcgcaaaagatg

SEQ ID NO: 215290 - DNA, 103 bp, Artificial Sequence
  Synthetic Polynucleotide
taatacgactcactatagggttgcttctccgtagggtcgcctttttccctaacagaggagaagggaaatgggcgaccctaacctggcggcagcgcaaaagatg

SEQ ID NO: 215291 - DNA, 103 bp, Artificial Sequence
  Synthetic Polynucleotide
taatacgactcactataggggggtacagacaggatgctggcatggggtgtaacagaggagaacacccatggccagcatcaacctggcggcagcgcaaaagatg

SEQ ID NO: 215292 - DNA, 103 bp, Artificial Sequence
  Synthetic Polynucleotide
taatacgactcactatagggcgttggtgtggggtacagacaggatgctggaacagaggagaccagcaatgtgtctgtacaacctggcggcagcgcaaaagatg

SEQ ID NO: 215293 - DNA, 103 bp, Artificial Sequence
  Synthetic Polynucleotide
taatacgactcactatagggttgattggtccgttggtgtggggtacagacaacagaggagagtctgtatgccacaccaaaacctggcggcagcgcaaaagatg

SEQ ID NO: 215294 - DNA, 103 bp, Artificial Sequence
  Synthetic Polynucleotide
taatacgactcactataggggggccctggattgattggtccgttggtgtgaacagaggagacacaccatgggaccaatcaacctggcggcagcgcaaaagatg

SEQ ID NO: 215295 - DNA, 103 bp, Artificial Sequence
  Synthetic Polynucleotide
taatacgactcactatagggggtaggggctgggccctggattgattggtcaacagaggagagaccaaatgatccagggcaacctggcggcagcgcaaaagatg

SEQ ID NO: 215296 - DNA, 103 bp, Artificial Sequence
  Synthetic Polynucleotide
taatacgactcactatagggcacaggcacgggtaggggctgggccctggaaacagaggagatccaggatgcagcccctaaacctggcggcagcgcaaaagatg

SEQ ID NO: 215297 - DNA, 103 bp, Artificial Sequence
  Synthetic Polynucleotide
taatacgactcactataggggctgatggtccacaggcacgggtaggggctaacagaggagaagccccatgccgtgcctgaacctggcggcagcgcaaaagatg

SEQ ID NO: 215298 - DNA, 103 bp, Artificial Sequence
  Synthetic Polynucleotide
taatacgactcactatagggcggcaccattgctgatggtccacaggcacgaacagaggagacgtgccatgggaccatcaaacctggcggcagcgcaaaagatg

SEQ ID NO: 215299 - DNA, 103 bp, Artificial Sequence
  Synthetic Polynucleotide
taatacgactcactatagggctggggcctccggcaccattgctgatggtcaacagaggagagaccatatgcaatggtgcaacctggcggcagcgcaaaagatg

SEQ ID NO: 215300 - DNA, 103 bp, Artificial Sequence
  Synthetic Polynucleotide
taatacgactcactataggggcctggcccactggggcctccggcaccattaacagaggagaaatggtatgggaggccccaacctggcggcagcgcaaaagatg

SEQ ID NO: 215301 - DNA, 103 bp, Artificial Sequence
  Synthetic Polynucleotide
taatacgactcactatagggtgatctgaagttgcttctccgtagggtcgcaacagaggagagcgaccatgcggagaagcaacctggcggcagcgcaaaagatg

SEQ ID NO: 215302 - DNA, 103 bp, Artificial Sequence
  Synthetic Polynucleotide
taatacgactcactataggggcacctccgggcctggcccactggggcctcaacagaggagagaggccatggtgggccagaacctggcggcagcgcaaaagatg

SEQ ID NO: 215303 - DNA, 103 bp, Artificial Sequence
  Synthetic Polynucleotide
taatacgactcactataggggtgctggcgtgcacctccgggcctggcccaaacagaggagatgggccatgcccggaggtaacctggcggcagcgcaaaagatg

SEQ ID NO: 215304 - DNA, 103 bp, Artificial Sequence
  Synthetic Polynucleotide
taatacgactcactatagggtgctcctggggtgctggcgtgcacctccggaacagaggagaccggagatgcacgccagcaacctggcggcagcgcaaaagatg

SEQ ID NO: 215305 - DNA, 103 bp, Artificial Sequence
  Synthetic Polynucleotide
taatacgactcactatagggcgaggagaaatgctcctggggtgctggcgtaacagaggagaacgccaatgccccaggagaacctggcggcagcgcaaaagatg

SEQ ID NO: 215306 - DNA, 103 bp, Artificial Sequence
  Synthetic Polynucleotide
taatacgactcactataggggctgggtttccgaggagaaatgctcctgggaacagaggagacccaggatgatttctcctaacctggcggcagcgcaaaagatg

SEQ ID NO: 215307 - DNA, 103 bp, Artificial Sequence
  Synthetic Polynucleotide
taatacgactcactatagggtgaagtcacagctgggtttccgaggagaaaaacagaggagatttctcatgggaaacccaaacctggcggcagcgcaaaagatg

SEQ ID NO: 215308 - DNA, 103 bp, Artificial Sequence
  Synthetic Polynucleotide
taatacgactcactatagggcagaagggggtgaagtcacagctgggtttcaacagaggagagaaaccatgctgtgacttaacctggcggcagcgcaaaagatg

SEQ ID NO: 215309 - DNA, 103 bp, Artificial Sequence
  Synthetic Polynucleotide
taatacgactcactataggggtggagagcacagaagggggtgaagtcacaaacagaggagatgtgacatgacccccttcaacctggcggcagcgcaaaagatg

SEQ ID NO: 215310 - DNA, 103 bp, Artificial Sequence
  Synthetic Polynucleotide
taatacgactcactataggggggtgcttgggtggagagcacagaagggggaacagaggagaccccctatggtgctctccaacctggcggcagcgcaaaagatg

SEQ ID NO: 215311 - DNA, 103 bp, Artificial Sequence
  Synthetic Polynucleotide
taatacgactcactatagggcagccgaagtgggtgcttgggtggagagcaaacagaggagatgctctatgcccaagcacaacctggcggcagcgcaaaagatg

SEQ ID NO: 215312 - DNA, 103 bp, Artificial Sequence
  Synthetic Polynucleotide
taatacgactcactatagggtcctccaggatgatctgaagttgcttctccaacagaggagaggagaaatgacttcagataacctggcggcagcgcaaaagatg

SEQ ID NO: 215313 - DNA, 103 bp, Artificial Sequence
  Synthetic Polynucleotide
taatacgactcactatagggacctccacaccagccgaagtgggtgcttggaacagaggagaccaagcatgcacttcggcaacctggcggcagcgcaaaagatg

SEQ ID NO: 215314 - DNA, 103 bp, Artificial Sequence
  Synthetic Polynucleotide
taatacgactcactatagggctcccccagaacctccacaccagccgaagtaacagaggagaacttcgatgggtgtggagaacctggcggcagcgcaaaagatg

SEQ ID NO: 215315 - DNA, 103 bp, Artificial Sequence
  Synthetic Polynucleotide
taatacgactcactatagggttagcgagggctcccccagaacctccacacaacagaggagagtgtggatgttctgggggaacctggcggcagcgcaaaagatg

SEQ ID NO: 215316 - DNA, 103 bp, Artificial Sequence
  Synthetic Polynucleotide
taatacgactcactataggggcaatgctggttagcgagggctcccccagaaacagaggagatctgggatggccctcgctaacctggcggcagcgcaaaagatg

SEQ ID NO: 215317 - DNA, 103 bp, Artificial Sequence
  Synthetic Polynucleotide
taatacgactcactatagggggtggacacagcaatgctggttagcgagggaacagaggagaccctcgatgaccagcattaacctggcggcagcgcaaaagatg

SEQ ID NO: 215318 - DNA, 103 bp, Artificial Sequence
  Synthetic Polynucleotide
taatacgactcactatagggctgctgtccaggtggacacagcaatgctggaacagaggagaccagcaatgctgtgtccaaacctggcggcagcgcaaaagatg

SEQ ID NO: 215319 - DNA, 103 bp, Artificial Sequence
  Synthetic Polynucleotide
taatacgactcactatagggtgcgaggccactgctgtccaggtggacacaaacagaggagatgtgtcatgctggacagcaacctggcggcagcgcaaaagatg

SEQ ID NO: 215320 - DNA, 103 bp, Artificial Sequence
  Synthetic Polynucleotide
taatacgactcactatagggcgcgaagggatgcgaggccactgctgtccaaacagaggagatggacaatggtggcctcgaacctggcggcagcgcaaaagatg

SEQ ID NO: 215321 - DNA, 103 bp, Artificial Sequence
  Synthetic Polynucleotide
taatacgactcactatagggcaccccagcccgcgaagggatgcgaggccaaacagaggagatggcctatgatcccttcgaacctggcggcagcgcaaaagatg

SEQ ID NO: 215322 - DNA, 103 bp, Artificial Sequence
  Synthetic Polynucleotide
taatacgactcactataggggctcctgggccaccccagcccgcgaagggaaacagaggagatcccttatggggctggggaacctggcggcagcgcaaaagatg

SEQ ID NO: 215323 - DNA, 103 bp, Artificial Sequence
  Synthetic Polynucleotide
taatacgactcactataggggagaggtgcatcctccaggatgatctgaagaacagaggagacttcagatgatcctggagaacctggcggcagcgcaaaagatg

SEQ ID NO: 215324 - DNA, 103 bp, Artificial Sequence
  Synthetic Polynucleotide
taatacgactcactataggggtgcccacccgctcctgggccaccccagccaacagaggagaggctggatgggcccaggaaacctggcggcagcgcaaaagatg

SEQ ID NO: 215325 - DNA, 103 bp, Artificial Sequence
  Synthetic Polynucleotide
taatacgactcactatagggaaggagaatggtgcccacccgctcctgggcaacagaggagagcccagatgcgggtgggcaacctggcggcagcgcaaaagatg

SEQ ID NO: 215326 - DNA, 103 bp, Artificial Sequence
  Synthetic Polynucleotide
taatacgactcactatagggtccagtgaggaaggagaatggtgcccacccaacagaggagagggtggatgccattctccaacctggcggcagcgcaaaagatg

SEQ ID NO: 215327 - DNA, 103 bp, Artificial Sequence
  Synthetic Polynucleotide
taatacgactcactatagggatctctgccagagaggtgcatcctccaggaaacagaggagatcctggatgatgcacctcaacctggcggcagcgcaaaagatg

SEQ ID NO: 215328 - DNA, 103 bp, Artificial Sequence
  Synthetic Polynucleotide
taatacgactcactatagggacttccttgaatctctgccagagaggtgcaaacagaggagatgcaccatgctggcagagaacctggcggcagcgcaaaagatg

SEQ ID NO: 215329 - DNA, 103 bp, Artificial Sequence
  Synthetic Polynucleotide
taatacgactcactatagggctcattagtgacttccttgaatctctgccaaacagaggagatggcagatgttcaaggaaaacctggcggcagcgcaaaagatg

SEQ ID NO: 215330 - DNA, 103 bp, Artificial Sequence
  Synthetic Polynucleotide
taatacgactcactatagggtcacaatcatctcattagtgacttccttgaaacagaggagatcaaggatgtcactaatgaacctggcggcagcgcaaaagatg

SEQ ID NO: 215331 - DNA, 103 bp, Artificial Sequence
  Synthetic Polynucleotide
taatacgactcactatagggccattcttggtcacaatcatctcattagtgaacagaggagacactaaatggatgattgtaacctggcggcagcgcaaaagatg

SEQ ID NO: 215332 - DNA, 103 bp, Artificial Sequence
  Synthetic Polynucleotide
taatacgactcactatagggcatccgtctgccattcttggtcacaatcataacagaggagaatgattatgaccaagaataacctggcggcagcgcaaaagatg

SEQ ID NO: 215333 - DNA, 103 bp, Artificial Sequence
  Synthetic Polynucleotide
taatacgactcactatagggcatcgctgggcttccgagtgcccagctcacaacagaggagagtgagcatggcactcggaaacctggcggcagcgcaaaagatg

SEQ ID NO: 215334 - DNA, 103 bp, Artificial Sequence
  Synthetic Polynucleotide
taatacgactcactatagggggactggaaacatccgtctgccattcttggaacagaggagaccaagaatggcagacggaaacctggcggcagcgcaaaagatg

SEQ ID NO: 215335 - DNA, 103 bp, Artificial Sequence
  Synthetic Polynucleotide
taatacgactcactatagggctaatctttaggactggaaacatccgtctgaacagaggagacagacgatggtttccagtaacctggcggcagcgcaaaagatg

SEQ ID NO: 215336 - DNA, 103 bp, Artificial Sequence
  Synthetic Polynucleotide
taatacgactcactatagggccctgtgacactaatctttaggactggaaaaacagaggagatttccaatgctaaagattaacctggcggcagcgcaaaagatg

SEQ ID NO: 215337 - DNA, 103 bp, Artificial Sequence
  Synthetic Polynucleotide
taatacgactcactatagggtggggtccaaccctgtgacactaatctttaaacagaggagataaagaatggtgtcacagaacctggcggcagcgcaaaagatg

SEQ ID NO: 215338 - DNA, 103 bp, Artificial Sequence
  Synthetic Polynucleotide
taatacgactcactatagggtacatggcattggggtccaaccctgtgacaaacagaggagatgtcacatggttggacccaacctggcggcagcgcaaaagatg

SEQ ID NO: 215339 - DNA, 103 bp, Artificial Sequence
  Synthetic Polynucleotide
taatacgactcactatagggcaggagggagtacatggcattggggtccaaaacagaggagattggacatgaatgccatgaacctggcggcagcgcaaaagatg

SEQ ID NO: 215340 - DNA, 103 bp, Artificial Sequence
  Synthetic Polynucleotide
taatacgactcactatagggcaaagtccagcaggagggagtacatggcataacagaggagaatgccaatgactccctccaacctggcggcagcgcaaaagatg

SEQ ID NO: 215341 - DNA, 103 bp, Artificial Sequence
  Synthetic Polynucleotide
taatacgactcactatagggtccgtagggacaaagtccagcaggagggagaacagaggagactccctatggctggacttaacctggcggcagcgcaaaagatg

SEQ ID NO: 215342 - DNA, 103 bp, Artificial Sequence
  Synthetic Polynucleotide
taatacgactcactataggggcggtgactgtccgtagggacaaagtccagaacagaggagactggacatggtccctacgaacctggcggcagcgcaaaagatg

SEQ ID NO: 215343 - DNA, 103 bp, Artificial Sequence
  Synthetic Polynucleotide
taatacgactcactatagggcgtacttccagcggtgactgtccgtagggaaacagaggagatccctaatgacagtcaccaacctggcggcagcgcaaaagatg

SEQ ID NO: 215344 - DNA, 103 bp, Artificial Sequence
  Synthetic Polynucleotide
taatacgactcactataggggaaacagtgccatcgctgggcttccgagtgaacagaggagacactcgatggcccagcgaaacctggcggcagcgcaaaagatg

SEQ ID NO: 215345 - DNA, 103 bp, Artificial Sequence
  Synthetic Polynucleotide
taatacgactcactatagggtccccgttgacgtacttccagcggtgactgaacagaggagacagtcaatgctggaagtaaacctggcggcagcgcaaaagatg

SEQ ID NO: 215346 - DNA, 103 bp, Artificial Sequence
  Synthetic Polynucleotide
taatacgactcactataggggggcacccattccccgttgacgtacttccaaacagaggagatggaagatggtcaacgggaacctggcggcagcgcaaaagatg

SEQ ID NO: 215347 - DNA, 103 bp, Artificial Sequence
  Synthetic Polynucleotide
taatacgactcactataggggcttgccagcgggcacccattccccgttgaaacagaggagatcaacgatgaatgggtgcaacctggcggcagcgcaaaagatg

SEQ ID NO: 215348 - DNA, 103 bp, Artificial Sequence
  Synthetic Polynucleotide
taatacgactcactataggggagacctctggcttgccagcgggcacccataacagaggagaatgggtatgcgctggcaaaacctggcggcagcgcaaaagatg

SEQ ID NO: 215349 - DNA, 103 bp, Artificial Sequence
  Synthetic Polynucleotide
taatacgactcactataggggctgtggctggagacctctggcttgccagcaacagaggagagctggcatgccagaggtcaacctggcggcagcgcaaaagatg

SEQ ID NO: 215350 - DNA, 103 bp, Artificial Sequence
  Synthetic Polynucleotide
taatacgactcactatagggtgtagacgcagctgtggctggagacctctgaacagaggagacagaggatgccagccacaaacctggcggcagcgcaaaagatg

SEQ ID NO: 215351 - DNA, 103 bp, Artificial Sequence
  Synthetic Polynucleotide
taatacgactcactatagggtccgggtgaatgtagacgcagctgtggctgaacagaggagacagccaatgctgcgtctaaacctggcggcagcgcaaaagatg

SEQ ID NO: 215352 - DNA, 103 bp, Artificial Sequence
  Synthetic Polynucleotide
taatacgactcactataggggttgggggagtccgggtgaatgtagacgcaaacagaggagatgcgtcatgattcacccgaacctggcggcagcgcaaaagatg

SEQ ID NO: 215353 - DNA, 103 bp, Artificial Sequence
  Synthetic Polynucleotide
taatacgactcactataggggggccccaaagttgggggagtccgggtgaaaacagaggagattcaccatgactcccccaaacctggcggcagcgcaaaagatg

SEQ ID NO: 215354 - DNA, 103 bp, Artificial Sequence
  Synthetic Polynucleotide
taatacgactcactatagggttcatccagtgggccccaaagttgggggagaacagaggagactccccatgctttggggcaacctggcggcagcgcaaaagatg

SEQ ID NO: 215355 - DNA, 103 bp, Artificial Sequence
  Synthetic Polynucleotide
taatacgactcactataggggagcagatgagaaacagtgccatcgctgggaacagaggagacccagcatgggcactgttaacctggcggcagcgcaaaagatg

SEQ ID NO: 215356 - DNA, 103 bp, Artificial Sequence
  Synthetic Polynucleotide
taatacgactcactataggggatgggagctttcatccagtgggccccaaaaacagaggagatttgggatgcactggatgaacctggcggcagcgcaaaagatg

SEQ ID NO: 215357 - DNA, 103 bp, Artificial Sequence
  Synthetic Polynucleotide
taatacgactcactatagggtgctgaaggagatgggagctttcatccagtaacagaggagaactggaatgaagctcccaaacctggcggcagcgcaaaagatg

SEQ ID NO: 215358 - DNA, 103 bp, Artificial Sequence
  Synthetic Polynucleotide
taatacgactcactatagggagcttcactttgctgaaggagatgggagctaacagaggagaagctccatgctccttcagaacctggcggcagcgcaaaagatg

SEQ ID NO: 215359 - DNA, 103 bp, Artificial Sequence
  Synthetic Polynucleotide
taatacgactcactatagggcttgttggtcagcttcactttgctgaaggaaacagaggagatccttcatgaaagtgaagaacctggcggcagcgcaaaagatg

SEQ ID NO: 215360 - DNA, 103 bp, Artificial Sequence
  Synthetic Polynucleotide
taatacgactcactatagggctccattgagcttgttggtcagcttcacttaacagaggagaaagtgaatgtgaccaacaaacctggcggcagcgcaaaagatg

SEQ ID NO: 215361 - DNA, 103 bp, Artificial Sequence
  Synthetic Polynucleotide
taatacgactcactatagggatctgcccgcctccattgagcttgttggtcaacagaggagagaccaaatggctcaatggaacctggcggcagcgcaaaagatg

SEQ ID NO: 215362 - DNA, 103 bp, Artificial Sequence
  Synthetic Polynucleotide
taatacgactcactatagggattcaacattatctgcccgcctccattgagaacagaggagactcaatatgggcgggcagaacctggcggcagcgcaaaagatg

SEQ ID NO: 215363 - DNA, 103 bp, Artificial Sequence
  Synthetic Polynucleotide
taatacgactcactatagggtatgcagagaattcaacattatctgcccgcaacagaggagagcgggcatgtaatgttgaaacctggcggcagcgcaaaagatg

SEQ ID NO: 215364 - DNA, 103 bp, Artificial Sequence
  Synthetic Polynucleotide
taatacgactcactatagggggttcatatttatgcagagaattcaacattaacagaggagaaatgttatgttctctgcaaacctggcggcagcgcaaaagatg

SEQ ID NO: 215365 - DNA, 103 bp, Artificial Sequence
  Synthetic Polynucleotide
taatacgactcactataggggtgaacctggggttcatatttatgcagagaaacagaggagatctctgatgaaatatgaaaacctggcggcagcgcaaaagatg

SEQ ID NO: 215366 - DNA, 103 bp, Artificial Sequence
  Synthetic Polynucleotide
taatacgactcactatagggccaccacattgagcagatgagaaacagtgcaacagaggagagcactgatgctcatctgcaacctggcggcagcgcaaaagatg

SEQ ID NO: 215367 - DNA, 103 bp, Artificial Sequence
  Synthetic Polynucleotide
taatacgactcactatagggcacgcactatgtgaacctggggttcatattaacagaggagaaatatgatgcccaggttcaacctggcggcagcgcaaaagatg

SEQ ID NO: 215368 - DNA, 103 bp, Artificial Sequence
  Synthetic Polynucleotide
taatacgactcactataggggcacttccaacacgcactatgtgaacctggaacagaggagaccaggtatgcatagtgcgaacctggcggcagcgcaaaagatg

SEQ ID NO: 215369 - DNA, 103 bp, Artificial Sequence
  Synthetic Polynucleotide
taatacgactcactatagggcattcgatgggcacttccaacacgcactataacagaggagaatagtgatggttggaagtaacctggcggcagcgcaaaagatg

SEQ ID NO: 215370 - DNA, 103 bp, Artificial Sequence
  Synthetic Polynucleotide
taatacgactcactatagggagtttgttaccattcgatgggcacttccaaaacagaggagattggaaatgcccatcgaaaacctggcggcagcgcaaaagatg

SEQ ID NO: 215371 - DNA, 103 bp, Artificial Sequence
  Synthetic Polynucleotide
taatacgactcactataggggggaaggagcagtttgttaccattcgatggaacagaggagaccatcgatgggtaacaaaaacctggcggcagcgcaaaagatg

SEQ ID NO: 215372 - DNA, 103 bp, Artificial Sequence
  Synthetic Polynucleotide
taatacgactcactatagggctgggtttcagggaaggagcagtttgttacaacagaggagagtaacaatgtgctccttcaacctggcggcagcgcaaaagatg

SEQ ID NO: 215373 - DNA, 103 bp, Artificial Sequence
  Synthetic Polynucleotide
taatacgactcactatagggcggctatgaactgggtttcagggaaggagcaacagaggagagctcctatgctgaaacccaacctggcggcagcgcaaaagatg

SEQ ID NO: 215374 - DNA, 103 bp, Artificial Sequence
  Synthetic Polynucleotide
taatacgactcactatagggtaggcagtcacggctatgaactgggtttcaaacagaggagatgaaacatggttcatagcaacctggcggcagcgcaaaagatg

SEQ ID NO: 215375 - DNA, 103 bp, Artificial Sequence
  Synthetic Polynucleotide
taatacgactcactatagggctcattctgataggcagtcacggctatgaaaacagaggagattcataatggtgactgccaacctggcggcagcgcaaaagatg

SEQ ID NO: 215376 - DNA, 103 bp, Artificial Sequence
  Synthetic Polynucleotide
taatacgactcactatagggccgttatctcctcattctgataggcagtcaaacagaggagatgactgatgatcagaatgaacctggcggcagcgcaaaagatg

SEQ ID NO: 215377 - DNA, 103 bp, Artificial Sequence
  Synthetic Polynucleotide
taatacgactcactatagggagctcactctccaccacattgagcagatgaaacagaggagatcatctatgcaatgtggtaacctggcggcagcgcaaaagatg

SEQ ID NO: 215378 - DNA, 103 bp, Artificial Sequence
  Synthetic Polynucleotide
taatacgactcactatagggattttgagagccgttatctcctcattctgaaacagaggagatcagaaatgggagataacaacctggcggcagcgcaaaagatg

SEQ ID NO: 215379 - DNA, 103 bp, Artificial Sequence
  Synthetic Polynucleotide
taatacgactcactatagggattgtacttgattttgagagccgttatctcaacagaggagagagataatggctctcaaaaacctggcggcagcgcaaaagatg

SEQ ID NO: 215380 - DNA, 103 bp, Artificial Sequence
  Synthetic Polynucleotide
taatacgactcactatagggtggcaaaaggattgtacttgattttgagagaacagaggagactctcaatgtcaagtacaaacctggcggcagcgcaaaagatg

SEQ ID NO: 215381 - DNA, 103 bp, Artificial Sequence
  Synthetic Polynucleotide
taatacgactcactatagggaagaaggctttggcaaaaggattgtacttgaacagaggagacaagtaatgtccttttgcaacctggcggcagcgcaaaagatg

SEQ ID NO: 215382 - DNA, 103 bp, Artificial Sequence
  Synthetic Polynucleotide
taatacgactcactatagggcttggcatccaagaaggctttggcaaaaggaacagaggagaccttttatgaaagccttcaacctggcggcagcgcaaaagatg

SEQ ID NO: 215383 - DNA, 103 bp, Artificial Sequence
  Synthetic Polynucleotide
taatacgactcactataggggatttctttccttggcatccaagaaggcttaacagaggagaaagcctatgtggatgccaaacctggcggcagcgcaaaagatg

SEQ ID NO: 215384 - DNA, 103 bp, Artificial Sequence
  Synthetic Polynucleotide
taatacgactcactatagggtctcttaggtgatttctttccttggcatccaacagaggagaggatgcatgggaaagaaaaacctggcggcagcgcaaaagatg

SEQ ID NO: 215385 - DNA, 103 bp, Artificial Sequence
  Synthetic Polynucleotide
taatacgactcactatagggctccggtacgtctcttaggtgatttctttcaacagaggagagaaagaatgcacctaagaaacctggcggcagcgcaaaagatg

SEQ ID NO: 215386 - DNA, 103 bp, Artificial Sequence
  Synthetic Polynucleotide
taatacgactcactatagggcagagatagcctccggtacgtctcttaggtaacagaggagaacctaaatgacgtaccggaacctggcggcagcgcaaaagatg

SEQ ID NO: 215387 - DNA, 103 bp, Artificial Sequence
  Synthetic Polynucleotide
taatacgactcactatagggtgctggctctcagagatagcctccggtacgaacagaggagacgtaccatgggctatctcaacctggcggcagcgcaaaagatg

SEQ ID NO: 215388 - DNA, 103 bp, Artificial Sequence
  Synthetic Polynucleotide
taatacgactcactatagggccctgcctgaagctcactctccaccacattaacagaggagaaatgtgatggagagtgagaacctggcggcagcgcaaaagatg

SEQ ID NO: 215389 - DNA, 103 bp, Artificial Sequence
  Synthetic Polynucleotide
taatacgactcactatagggataggtcacatgctggctctcagagatagcaacagaggagagctatcatggagagccagaacctggcggcagcgcaaaagatg

SEQ ID NO: 215390 - DNA, 103 bp, Artificial Sequence
  Synthetic Polynucleotide
taatacgactcactatagggccaagtgagaataggtcacatgctggctctaacagaggagaagagccatgatgtgacctaacctggcggcagcgcaaaagatg

SEQ ID NO: 215391 - DNA, 103 bp, Artificial Sequence
  Synthetic Polynucleotide
taatacgactcactatagggatccagcctcccaagtgagaataggtcacaaacagaggagatgtgacatgttctcacttaacctggcggcagcgcaaaagatg

SEQ ID NO: 215392 - DNA, 103 bp, Artificial Sequence
  Synthetic Polynucleotide
taatacgactcactatagggattggaaaagatccagcctcccaagtgagaaacagaggagatctcacatgggaggctggaacctggcggcagcgcaaaagatg

SEQ ID NO: 215393 - DNA, 103 bp, Artificial Sequence
  Synthetic Polynucleotide
taatacgactcactatagggctccatctggattggaaaagatccagcctcaacagaggagagaggctatgtcttttccaaacctggcggcagcgcaaaagatg

SEQ ID NO: 215394 - DNA, 103 bp, Artificial Sequence
  Synthetic Polynucleotide
taatacgactcactataggggctgtgcacactccatctggattggaaaagaacagaggagacttttcatgtccagatggaacctggcggcagcgcaaaagatg

SEQ ID NO: 215395 - DNA, 103 bp, Artificial Sequence
  Synthetic Polynucleotide
taatacgactcactatagggggagtttcctgctgtgcacactccatctggaacagaggagaccagatatggtgtgcacaaacctggcggcagcgcaaaagatg

SEQ ID NO: 215396 - DNA, 103 bp, Artificial Sequence
  Synthetic Polynucleotide
taatacgactcactatagggactggtaattggagtttcctgctgtgcacaaacagaggagatgtgcaatgcaggaaactaacctggcggcagcgcaaaagatg

SEQ ID NO: 215397 - DNA, 103 bp, Artificial Sequence
  Synthetic Polynucleotide
taatacgactcactatagggggagcggcatactggtaattggagtttcctaacagaggagaaggaaaatgcaattaccaaacctggcggcagcgcaaaagatg

SEQ ID NO: 215398 - DNA, 103 bp, Artificial Sequence
  Synthetic Polynucleotide
taatacgactcactatagggcagaggcagaggagcggcatactggtaattaacagaggagaaattacatgtatgccgctaacctggcggcagcgcaaaagatg

SEQ ID NO: 215399 - DNA, 103 bp, Artificial Sequence
  Synthetic Polynucleotide
taatacgactcactatagggctttttccctccctgcctgaagctcactctaacagaggagaagagtgatgttcaggcagaacctggcggcagcgcaaaagatg

SEQ ID NO: 215400 - DNA, 103 bp, Artificial Sequence
  Synthetic Polynucleotide
taatacgactcactatagggggggagcaggcagaggcagaggagcggcataacagaggagaatgccgatgctctgcctcaacctggcggcagcgcaaaagatg

SEQ ID NO: 215401 - DNA, 103 bp, Artificial Sequence
  Synthetic Polynucleotide
taatacgactcactatagggtggtgggtgtggggagcaggcagaggcagaaacagaggagatctgccatggcctgctccaacctggcggcagcgcaaaagatg

SEQ ID NO: 215402 - DNA, 103 bp, Artificial Sequence
  Synthetic Polynucleotide
taatacgactcactatagggctcacagccatggtgggtgtggggagcaggaacagaggagacctgctatgcacacccacaacctggcggcagcgcaaaagatg

SEQ ID NO: 215403 - DNA, 103 bp, Artificial Sequence
  Synthetic Polynucleotide
taatacgactcactatagggccgaatagtgctcacagccatggtgggtgtaacagaggagaacacccatgatggctgtgaacctggcggcagcgcaaaagatg

SEQ ID NO: 215404 - DNA, 103 bp, Artificial Sequence
  Synthetic Polynucleotide
taatacgactcactatagggcctcggagacccgaatagtgctcacagccaaacagaggagatggctgatggcactattcaacctggcggcagcgcaaaagatg

SEQ ID NO: 215405 - DNA, 103 bp, Artificial Sequence
  Synthetic Polynucleotide
taatacgactcactatagggctgccggtgtcctcggagacccgaatagtgaacagaggagacactatatgggtctccgaaacctggcggcagcgcaaaagatg

SEQ ID NO: 215406 - DNA, 103 bp, Artificial Sequence
  Synthetic Polynucleotide
taatacgactcactatagggggtagggagcctgccggtgtcctcggagacaacagaggagagtctccatggacaccggcaacctggcggcagcgcaaaagatg

SEQ ID NO: 215407 - DNA, 103 bp, Artificial Sequence
  Synthetic Polynucleotide
taatacgactcactatagggtacgcagaagggtagggagcctgccggtgtaacagaggagaacaccgatgggctccctaaacctggcggcagcgcaaaagatg

SEQ ID NO: 215408 - DNA, 103 bp, Artificial Sequence
  Synthetic Polynucleotide
taatacgactcactatagggtctgtgcatgtacgcagaagggtagggagcaacagaggagagctcccatgccttctgcgaacctggcggcagcgcaaaagatg

SEQ ID NO: 215409 - DNA, 103 bp, Artificial Sequence
  Synthetic Polynucleotide
taatacgactcactataggggagaatggtttctgtgcatgtacgcagaagaacagaggagacttctgatgacatgcacaaacctggcggcagcgcaaaagatg

SEQ ID NO: 215410 - DNA, 103 bp, Artificial Sequence
  Synthetic Polynucleotide
taatacgactcactataggggtagggtcgcctttttccctccctgcctgaaacagaggagatcaggcatggagggaaaaaacctggcggcagcgcaaaagatg

SEQ ID NO: 215411 - DNA, 103 bp, Artificial Sequence
  Synthetic Polynucleotide
taatacgactcactatagggttcactgagggagaatggtttctgtgcatgaacagaggagacatgcaatgaaaccattcaacctggcggcagcgcaaaagatg

SEQ ID NO: 215412 - DNA, 103 bp, Artificial Sequence
  Synthetic Polynucleotide
taatacgactcactatagggttctatcaaattcactgagggagaatggttaacagaggagaaaccatatgccctcagtgaacctggcggcagcgcaaaagatg

SEQ ID NO: 215413 - DNA, 103 bp, Artificial Sequence
  Synthetic Polynucleotide
taatacgactcactatagggtgcttgagctttctatcaaattcactgaggaacagaggagacctcagatgatttgatagaacctggcggcagcgcaaaagatg

SEQ ID NO: 215414 - DNA, 103 bp, Artificial Sequence
  Synthetic Polynucleotide
taatacgactcactatagggtgcagattattgcttgagctttctatcaaaaacagaggagatttgatatgaagctcaagaacctggcggcagcgcaaaagatg

SEQ ID NO: 215415 - DNA, 103 bp, Artificial Sequence
  Synthetic Polynucleotide
taatacgactcactatagggcgagaaaacttgcagattattgcttgagctaacagaggagaagctcaatgaataatctgaacctggcggcagcgcaaaagatg

SEQ ID NO: 215416 - DNA, 103 bp, Artificial Sequence
  Synthetic Polynucleotide
taatacgactcactatagggtgtcaggtcccgagaaaacttgcagattataacagaggagaataatcatgaagttttctaacctggcggcagcgcaaaagatg

SEQ ID NO: 215417 - DNA, 103 bp, Artificial Sequence
  Synthetic Polynucleotide
taatacgactcactataggggaagtccagctgtcaggtcccgagaaaactaacagaggagaagttttatggggacctgaaacctggcggcagcgcaaaagatg

SEQ ID NO: 215418 - DNA, 103 bp, Artificial Sequence
  Synthetic Polynucleotide
taatacgactcactatagggggaggataaggaagtccagctgtcaggtccaacagaggagaggacctatgagctggactaacctggcggcagcgcaaaagatg

SEQ ID NO: 215419 - DNA, 103 bp, Artificial Sequence
  Synthetic Polynucleotide
taatacgactcactatagggcatggggtgtggaggataaggaagtccagcaacagaggagagctggaatgccttatcctaacctggcggcagcgcaaaagatg

SEQ ID NO: 215420 - DNA, 103 bp, Artificial Sequence
  Synthetic Polynucleotide
taatacgactcactatagggaggatgctggcatggggtgtggaggataagaacagaggagacttatcatgcacaccccaaacctggcggcagcgcaaaagatg

SEQ ID NO: 215421 - DNA, 103 bp, Artificial Sequence
  Synthetic Polynucleotide
taatacgactcactatagggggcgctggccgccagcgccggctctctcataacagaggagaatgagaatgccggcgctgaacctggcggcagcgcaaaagatg

SEQ ID NO: 215422 - DNA, 103 bp, Artificial Sequence
  Synthetic Polynucleotide
taatacgactcactatagggtgccgggaagaaggagggctgcgccgccgcaacagaggagagcggcgatgcagccctccaacctggcggcagcgcaaaagatg

SEQ ID NO: 215423 - DNA, 103 bp, Artificial Sequence
  Synthetic Polynucleotide
taatacgactcactatagggcgctgcgcccggggaggtgggtggttcccgaacagaggagacgggaaatgcccacctccaacctggcggcagcgcaaaagatg

SEQ ID NO: 215424 - DNA, 103 bp, Artificial Sequence
  Synthetic Polynucleotide
taatacgactcactataggggcggactgggcgctgcgcccggggaggtggaacagaggagaccacctatgcgggcgcagaacctggcggcagcgcaaaagatg

SEQ ID NO: 215425 - DNA, 103 bp, Artificial Sequence
  Synthetic Polynucleotide
taatacgactcactatagggtgcaggcgcagcggactgggcgctgcgcccaacagaggagagggcgcatggcccagtccaacctggcggcagcgcaaaagatg

SEQ ID NO: 215426 - DNA, 103 bp, Artificial Sequence
  Synthetic Polynucleotide
taatacgactcactatagggtcgggcccggtgcaggcgcagcggactgggaacagaggagacccagtatgctgcgcctgaacctggcggcagcgcaaaagatg

SEQ ID NO: 215427 - DNA, 103 bp, Artificial Sequence
  Synthetic Polynucleotide
taatacgactcactatagggtctcctcagctcgggcccggtgcaggcgcaaacagaggagatgcgccatgaccgggcccaacctggcggcagcgcaaaagatg

SEQ ID NO: 215428 - DNA, 103 bp, Artificial Sequence
  Synthetic Polynucleotide
taatacgactcactataggggcgcacgacttctcctcagctcgggcccggaacagaggagaccgggcatgagctgaggaaacctggcggcagcgcaaaagatg

SEQ ID NO: 215429 - DNA, 103 bp, Artificial Sequence
  Synthetic Polynucleotide
taatacgactcactataggggctgtccgcggcgcacgacttctcctcagcaacagaggagagctgagatgaagtcgtgcaacctggcggcagcgcaaaagatg

SEQ ID NO: 215430 - DNA, 103 bp, Artificial Sequence
  Synthetic Polynucleotide
taatacgactcactataggggctccgggtcgctgtccgcggcgcacgactaacagaggagaagtcgtatgccgcggacaaacctggcggcagcgcaaaagatg

SEQ ID NO: 215431 - DNA, 103 bp, Artificial Sequence
  Synthetic Polynucleotide
taatacgactcactatagggaaccgctcaggctccgggtcgctgtccgcgaacagaggagacgcggaatgcgacccggaaacctggcggcagcgcaaaagatg

SEQ ID NO: 215432 - DNA, 103 bp, Artificial Sequence
  Synthetic Polynucleotide
taatacgactcactatagggctcctcgctcaaccgctcaggctccgggtcaacagaggagagacccgatgcctgagcggaacctggcggcagcgcaaaagatg

SEQ ID NO: 215433 - DNA, 103 bp, Artificial Sequence
  Synthetic Polynucleotide
taatacgactcactataggggcagcgcgagtgccgggaagaaggagggctaacagaggagaagccctatgtcttcccggaacctggcggcagcgcaaaagatg

SEQ ID NO: 215434 - DNA, 103 bp, Artificial Sequence
  Synthetic Polynucleotide
taatacgactcactatagggcccccgcacgctcctcgctcaaccgctcagaacagaggagactgagcatgtgagcgaggaacctggcggcagcgcaaaagatg

SEQ ID NO: 215435 - DNA, 103 bp, Artificial Sequence
  Synthetic Polynucleotide
taatacgactcactatagggcctagcggcgcccccgcacgctcctcgctcaacagaggagagagcgaatggcgtgcgggaacctggcggcagcgcaaaagatg

SEQ ID NO: 215436 - DNA, 103 bp, Artificial Sequence
  Synthetic Polynucleotide
taatacgactcactatagggcgggctgcggcctagcggcgcccccgcacgaacagaggagacgtgcgatggcgccgctaaacctggcggcagcgcaaaagatg

SEQ ID NO: 215437 - DNA, 103 bp, Artificial Sequence
  Synthetic Polynucleotide
taatacgactcactatagggtgtctggagccgggctgcggcctagcggcgaacagaggagacgccgcatggccgcagccaacctggcggcagcgcaaaagatg

SEQ ID NO: 215438 - DNA, 103 bp, Artificial Sequence
  Synthetic Polynucleotide
taatacgactcactataggggggctggcgctgtctggagccgggctgcggaacagaggagaccgcagatgggctccagaaacctggcggcagcgcaaaagatg

SEQ ID NO: 215439 - DNA, 103 bp, Artificial Sequence
  Synthetic Polynucleotide
taatacgactcactatagggcaagcgagtggggctggcgctgtctggagcaacagaggagagctccaatgagcgccagcaacctggcggcagcgcaaaagatg

SEQ ID NO: 215440 - DNA, 103 bp, Artificial Sequence
  Synthetic Polynucleotide
taatacgactcactatagggcgggttcggtcaagcgagtggggctggcgcaacagaggagagcgccaatgccactcgctaacctggcggcagcgcaaaagatg

SEQ ID NO: 215441 - DNA, 103 bp, Artificial Sequence
  Synthetic Polynucleotide
taatacgactcactatagggcgggcgcgctcgggttcggtcaagcgagtgaacagaggagacactcgatggaccgaaccaacctggcggcagcgcaaaagatg

SEQ ID NO: 215442 - DNA, 103 bp, Artificial Sequence
  Synthetic Polynucleotide
taatacgactcactatagggacgccgctcccgggcgcgctcgggttcggtaacagaggagaaccgaaatggagcgcgccaacctggcggcagcgcaaaagatg

SEQ ID NO: 215443 - DNA, 103 bp, Artificial Sequence
  Synthetic Polynucleotide
taatacgactcactatagggtctcgggactacgccgctcccgggcgcgctaacagaggagaagcgcgatggggagcggcaacctggcggcagcgcaaaagatg

SEQ ID NO: 215444 - DNA, 103 bp, Artificial Sequence
  Synthetic Polynucleotide
taatacgactcactataggggcgccgggcggcagcgcgagtgccgggaagaacagaggagacttcccatgactcgcgctaacctggcggcagcgcaaaagatg

SEQ ID NO: 215445 - DNA, 103 bp, Artificial Sequence
  Synthetic Polynucleotide
taatacgactcactatagggtccttgcccctctcgggactacgccgctccaacagaggagaggagcgatgtagtcccgaaacctggcggcagcgcaaaagatg

SEQ ID NO: 215446 - DNA, 103 bp, Artificial Sequence
  Synthetic Polynucleotide
taatacgactcactatagggctcggccggctccttgcccctctcgggactaacagaggagaagtcccatgaggggcaagaacctggcggcagcgcaaaagatg

SEQ ID NO: 215447 - DNA, 103 bp, Artificial Sequence
  Synthetic Polynucleotide
taatacgactcactatagggccccgccgctctcggccggctccttgccccaacagaggagaggggcaatgagccggccgaacctggcggcagcgcaaaagatg

SEQ ID NO: 215448 - DNA, 103 bp, Artificial Sequence
  Synthetic Polynucleotide
taatacgactcactatagggaacgggccgtccccgccgctctcggccggcaacagaggagagccggcatggagcggcggaacctggcggcagcgcaaaagatg

SEQ ID NO: 215449 - DNA, 103 bp, Artificial Sequence
  Synthetic Polynucleotide
taatacgactcactatagggcctcaggccgaacgggccgtccccgccgctaacagaggagaagcggcatggacggcccgaacctggcggcagcgcaaaagatg

SEQ ID NO: 215450 - DNA, 103 bp, Artificial Sequence
  Synthetic Polynucleotide
taatacgactcactatagggtctccaggctcctcaggccgaacgggccgtaacagaggagaacggccatgtcggcctgaaacctggcggcagcgcaaaagatg

SEQ ID NO: 215451 - DNA, 103 bp, Artificial Sequence
  Synthetic Polynucleotide
taatacgactcactataggggcgcgctccttctccaggctcctcaggccgaacagaggagacggcctatggagcctggaaacctggcggcagcgcaaaagatg

SEQ ID NO: 215452 - DNA, 103 bp, Artificial Sequence
  Synthetic Polynucleotide
taatacgactcactatagggccgagcttcggcgcgctccttctccaggctaacagaggagaagcctgatgaaggagcgcaacctggcggcagcgcaaaagatg

SEQ ID NO: 215453 - DNA, 103 bp, Artificial Sequence
  Synthetic Polynucleotide
taatacgactcactatagggcgtccttcctccgagcttcggcgcgctcctaacagaggagaaggagcatgccgaagctcaacctggcggcagcgcaaaagatg

SEQ ID NO: 215454 - DNA, 103 bp, Artificial Sequence
  Synthetic Polynucleotide
taatacgactcactatagggttgcgcccctcgtccttcctccgagcttcgaacagaggagacgaagcatggaggaaggaaacctggcggcagcgcaaaagatg

SEQ ID NO: 215455 - DNA, 103 bp, Artificial Sequence
  Synthetic Polynucleotide
taatacgactcactatagggcttggccagcgcgccgggcggcagcgcgagaacagaggagactcgcgatgccgcccggcaacctggcggcagcgcaaaagatg

SEQ ID NO: 215456 - DNA, 103 bp, Artificial Sequence
  Synthetic Polynucleotide
taatacgactcactatagggggccgcctccttgcgcccctcgtccttcctaacagaggagaaggaagatggaggggcgcaacctggcggcagcgcaaaagatg

SEQ ID NO: 215457 - DNA, 103 bp, Artificial Sequence
  Synthetic Polynucleotide
taatacgactcactatagggccttgccctcggccgcctccttgcgcccctaacagaggagaaggggcatgaggaggcggaacctggcggcagcgcaaaagatg

SEQ ID NO: 215458 - DNA, 103 bp, Artificial Sequence
  Synthetic Polynucleotide
taatacgactcactatagggaggccctgctccttgccctcggccgcctccaacagaggagaggaggcatgcgagggcaaaacctggcggcagcgcaaaagatg

SEQ ID NO: 215459 - DNA, 103 bp, Artificial Sequence
  Synthetic Polynucleotide
taatacgactcactatagggcagcggcgccaggccctgctccttgccctcaacagaggagagagggcatggagcagggcaacctggcggcagcgcaaaagatg

SEQ ID NO: 215460 - DNA, 103 bp, Artificial Sequence
  Synthetic Polynucleotide
taatacgactcactatagggtctgcaccaccagcggcgccaggccctgctaacagaggagaagcaggatgtggcgccgcaacctggcggcagcgcaaaagatg

SEQ ID NO: 215461 - DNA, 103 bp, Artificial Sequence
  Synthetic Polynucleotide
taatacgactcactataggggcactgtctgtctgcaccaccagcggcgccaacagaggagaggcgccatgggtggtgcaaacctggcggcagcgcaaaagatg

SEQ ID NO: 215462 - DNA, 103 bp, Artificial Sequence
  Synthetic Polynucleotide
taatacgactcactatagggcaggggggacgcactgtctgtctgcaccacaacagaggagagtggtgatgacagacagtaacctggcggcagcgcaaaagatg

SEQ ID NO: 215463 - DNA, 103 bp, Artificial Sequence
  Synthetic Polynucleotide
taatacgactcactataggggtccggcgcccaggggggacgcactgtctgaacagaggagacagacaatgcgtccccccaacctggcggcagcgcaaaagatg

SEQ ID NO: 215464 - DNA, 103 bp, Artificial Sequence
  Synthetic Polynucleotide
taatacgactcactatagggccgggcaggtgtccggcgcccaggggggacaacagaggagagtccccatggggcgccggaacctggcggcagcgcaaaagatg

SEQ ID NO: 215465 - DNA, 103 bp, Artificial Sequence
  Synthetic Polynucleotide
taatacgactcactatagggaaaggccaggccgggcaggtgtccggcgccaacagaggagaggcgccatgcacctgcccaacctggcggcagcgcaaaagatg

SEQ ID NO: 215466 - DNA, 103 bp, Artificial Sequence
  Synthetic Polynucleotide
taatacgactcactatagggcgggcagcggcttggccagcgcgccgggcgaacagaggagacgcccgatgcgctggccaaacctggcggcagcgcaaaagatg

SEQ ID NO: 215467 - DNA, 103 bp, Artificial Sequence
  Synthetic Polynucleotide
taatacgactcactatagggagtggctggaaaaggccaggccgggcaggtaacagaggagaacctgcatggcctggcctaacctggcggcagcgcaaaagatg

SEQ ID NO: 215468 - DNA, 103 bp, Artificial Sequence
  Synthetic Polynucleotide
taatacgactcactatagggtgcccgtgcaagtggctggaaaaggccaggaacagaggagacctggcatgttccagccaaacctggcggcagcgcaaaagatg

SEQ ID NO: 215469 - DNA, 103 bp, Artificial Sequence
  Synthetic Polynucleotide
taatacgactcactatagggaaagaactgctgcccgtgcaagtggctggaaacagaggagatccagcatgttgcacgggaacctggcggcagcgcaaaagatg

SEQ ID NO: 215470 - DNA, 103 bp, Artificial Sequence
  Synthetic Polynucleotide
taatacgactcactatagggccagcggcccaaagaactgctgcccgtgcaaacagaggagatgcacgatgagcagttctaacctggcggcagcgcaaaagatg

SEQ ID NO: 215471 - DNA, 103 bp, Artificial Sequence
  Synthetic Polynucleotide
taatacgactcactatagggtggccggctcccagcggcccaaagaactgcaacagaggagagcagttatgtgggccgctaacctggcggcagcgcaaaagatg

SEQ ID NO: 215472 - DNA, 103 bp, Artificial Sequence
  Synthetic Polynucleotide
taatacgactcactataggggaagagcggctggccggctcccagcggcccaacagaggagagggccgatgggagccggcaacctggcggcagcgcaaaagatg

SEQ ID NO: 215473 - DNA, 103 bp, Artificial Sequence
  Synthetic Polynucleotide
taatacgactcactatagggcagggtgcaggaagagcggctggccggctcaacagaggagagagccgatgagccgctctaacctggcggcagcgcaaaagatg

SEQ ID NO: 215474 - DNA, 103 bp, Artificial Sequence
  Synthetic Polynucleotide
taatacgactcactataggggtgaactgtccagggtgcaggaagagcggcaacagaggagagccgctatgcctgcacccaacctggcggcagcgcaaaagatg

SEQ ID NO: 215475 - DNA, 103 bp, Artificial Sequence
  Synthetic Polynucleotide
taatacgactcactatagggagggcccatggtgaactgtccagggtgcagaacagaggagactgcacatgggacagttcaacctggcggcagcgcaaaagatg

SEQ ID NO: 215476 - DNA, 103 bp, Artificial Sequence
  Synthetic Polynucleotide
taatacgactcactatagggagaaggcgccagggcccatggtgaactgtcaacagaggagagacagtatgccatgggccaacctggcggcagcgcaaaagatg

SEQ ID NO: 215477 - DNA, 103 bp, Artificial Sequence
  Synthetic Polynucleotide
taatacgactcactatagggaggcccgggtcgggcagcggcttggccagcaacagaggagagctggcatggccgctgccaacctggcggcagcgcaaaagatg

SEQ ID NO: 215478 - DNA, 103 bp, Artificial Sequence
  Synthetic Polynucleotide
taatacgactcactatagggcccatggcggagaaggcgccagggcccatgaacagaggagacatgggatgtggcgccttaacctggcggcagcgcaaaagatg

SEQ ID NO: 215479 - DNA, 103 bp, Artificial Sequence
  Synthetic Polynucleotide
taatacgactcactataggggtgacccatgcccatggcggagaaggcgccaacagaggagaggcgccatgtccgccatgaacctggcggcagcgcaaaagatg

SEQ ID NO: 215480 - DNA, 103 bp, Artificial Sequence
  Synthetic Polynucleotide
taatacgactcactatagggaggccagtaggtgacccatgcccatggcggaacagaggagaccgccaatggcatgggtcaacctggcggcagcgcaaaagatg

SEQ ID NO: 215481 - DNA, 103 bp, Artificial Sequence
  Synthetic Polynucleotide
taatacgactcactatagggcctgccaccgaggccagtaggtgacccatgaacagaggagacatgggatgcctactggcaacctggcggcagcgcaaaagatg

SEQ ID NO: 215482 - DNA, 103 bp, Artificial Sequence
  Synthetic Polynucleotide
taatacgactcactataggggttgccgccgcctgccaccgaggccagtagaacagaggagactactgatgtcggtggcaaacctggcggcagcgcaaaagatg

SEQ ID NO: 215483 - DNA, 103 bp, Artificial Sequence
  Synthetic Polynucleotide
taatacgactcactatagggcacctccgccgttgccgccgcctgccaccgaacagaggagacggtggatggcggcggcaaacctggcggcagcgcaaaagatg

SEQ ID NO: 215484 - DNA, 103 bp, Artificial Sequence
  Synthetic Polynucleotide
taatacgactcactatagggccaggcccgccacctccgccgttgccgccgaacagaggagacggcggatgcggcggaggaacctggcggcagcgcaaaagatg

SEQ ID NO: 215485 - DNA, 103 bp, Artificial Sequence
  Synthetic Polynucleotide
taatacgactcactatagggcgcggcggtcccaggcccgccacctccgccaacagaggagaggcggaatgggcgggcctaacctggcggcagcgcaaaagatg

SEQ ID NO: 215486 - DNA, 103 bp, Artificial Sequence
  Synthetic Polynucleotide
taatacgactcactatagggcgtccagccccgcggcggtcccaggcccgcaacagaggagagcgggcatgggaccgccgaacctggcggcagcgcaaaagatg

SEQ ID NO: 215487 - DNA, 103 bp, Artificial Sequence
  Synthetic Polynucleotide
taatacgactcactatagggagcccgcctgcgtccagccccgcggcggtcaacagaggagagaccgcatgggggctggaaacctggcggcagcgcaaaagatg

SEQ ID NO: 215488 - DNA, 103 bp, Artificial Sequence
  Synthetic Polynucleotide
taatacgactcactatagggcgcccccgccaggcccgggtcgggcagcggaacagaggagaccgctgatggacccgggcaacctggcggcagcgcaaaagatg

SEQ ID NO: 215489 - DNA, 103 bp, Artificial Sequence
  Synthetic Polynucleotide
taatacgactcactatagggcgcgggacccagcccgcctgcgtccagcccaacagaggagagggctgatggcaggcgggaacctggcggcagcgcaaaagatg

SEQ ID NO: 215490 - DNA, 103 bp, Artificial Sequence
  Synthetic Polynucleotide
taatacgactcactatagggctgcgctggccgcgggacccagcccgcctgaacagaggagacaggcgatgtgggtcccgaacctggcggcagcgcaaaagatg

SEQ ID NO: 215491 - DNA, 103 bp, Artificial Sequence
  Synthetic Polynucleotide
taatacgactcactataggggcggtgcttgctgcgctggccgcgggacccaacagaggagagggtccatgggccagcgcaacctggcggcagcgcaaaagatg

SEQ ID NO: 215492 - DNA, 103 bp, Artificial Sequence
  Synthetic Polynucleotide
taatacgactcactataggggaagggcgcggcggtgcttgctgcgctggcaacagaggagagccagcatggcaagcaccaacctggcggcagcgcaaaagatg

SEQ ID NO: 215493 - DNA, 103 bp, Artificial Sequence
  Synthetic Polynucleotide
taatacgactcactatagggggtggaacgggaagggcgcggcggtgcttgaacagaggagacaagcaatgccgcgccctaacctggcggcagcgcaaaagatg

SEQ ID NO: 215494 - DNA, 103 bp, Artificial Sequence
  Synthetic Polynucleotide
taatacgactcactatagggtgctgggagaggtggaacgggaagggcgcgaacagaggagacgcgccatgcccgttccaaacctggcggcagcgcaaaagatg

SEQ ID NO: 215495 - DNA, 103 bp, Artificial Sequence
  Synthetic Polynucleotide
taatacgactcactatagggtgccagcatgtgctgggagaggtggaacggaacagaggagaccgttcatgctctcccagaacctggcggcagcgcaaaagatg

SEQ ID NO: 215496 - DNA, 103 bp, Artificial Sequence
  Synthetic Polynucleotide
taatacgactcactatagggttccctgagatgccagcatgtgctgggagaaacagaggagatctcccatgacatgctggaacctggcggcagcgcaaaagatg

SEQ ID NO: 215497 - DNA, 103 bp, Artificial Sequence
  Synthetic Polynucleotide
taatacgactcactatagggggcattggaattccctgagatgccagcatgaacagaggagacatgctatgatctcagggaacctggcggcagcgcaaaagatg

SEQ ID NO: 215498 - DNA, 103 bp, Artificial Sequence
  Synthetic Polynucleotide
taatacgactcactatagggtccgaaagtgggcattggaattccctgagaaacagaggagatctcagatgattccaatgaacctggcggcagcgcaaaagatg

SEQ ID NO: 215499 - DNA, 103 bp, Artificial Sequence
  Synthetic Polynucleotide
taatacgactcactatagggccgcggccgccgcccccgccaggcccgggtaacagaggagaacccggatgtggcgggggaacctggcggcagcgcaaaagatg

SEQ ID NO: 215500 - DNA, 103 bp, Artificial Sequence
  Synthetic Polynucleotide
taatacgactcactatagggggaagaggcctccgaaagtgggcattggaaaacagaggagattccaaatgccactttcgaacctggcggcagcgcaaaagatg

SEQ ID NO: 215501 - DNA, 103 bp, Artificial Sequence
  Synthetic Polynucleotide
taatacgactcactatagggtaggggtaggggaagaggcctccgaaagtgaacagaggagacactttatgaggcctcttaacctggcggcagcgcaaaagatg

SEQ ID NO: 215502 - DNA, 103 bp, Artificial Sequence
  Synthetic Polynucleotide
taatacgactcactatagggcatgtaggtgtaggggtaggggaagaggccaacagaggagaggcctcatgccctaccccaacctggcggcagcgcaaaagatg

SEQ ID NO: 215503 - DNA, 103 bp, Artificial Sequence
  Synthetic Polynucleotide
taatacgactcactatagggctgctgctgccatgtaggtgtaggggtaggaacagaggagacctaccatgacacctacaaacctggcggcagcgcaaaagatg

SEQ ID NO: 215504 - DNA, 103 bp, Artificial Sequence
  Synthetic Polynucleotide
taatacgactcactataggggcggctgcggctgctgctgccatgtaggtgaacagaggagacacctaatgggcagcagcaacctggcggcagcgcaaaagatg

SEQ ID NO: 215505 - DNA, 103 bp, Artificial Sequence
  Synthetic Polynucleotide
taatacgactcactatagggcaaagccgaggcggctgcggctgctgctgcaacagaggagagcagcaatggccgcagccaacctggcggcagcgcaaaagatg

SEQ ID NO: 215506 - DNA, 103 bp, Artificial Sequence
  Synthetic Polynucleotide
taatacgactcactatagggtagtggcgggcaaagccgaggcggctgcggaacagaggagaccgcagatgcctcggcttaacctggcggcagcgcaaaagatg

SEQ ID NO: 215507 - DNA, 103 bp, Artificial Sequence
  Synthetic Polynucleotide
taatacgactcactataggggctgcagcactagtggcgggcaaagccgagaacagaggagactcggcatggcccgccacaacctggcggcagcgcaaaagatg

SEQ ID NO: 215508 - DNA, 103 bp, Artificial Sequence
  Synthetic Polynucleotide
taatacgactcactatagggggcggcggcagctgcagcactagtggcgggaacagaggagacccgccatgagtgctgcaaacctggcggcagcgcaaaagatg

SEQ ID NO: 215509 - DNA, 103 bp, Artificial Sequence
  Synthetic Polynucleotide
taatacgactcactatagggcggcggctgcggcggcggcagctgcagcacaacagaggagagtgctgatgctgccgccgaacctggcggcagcgcaaaagatg

SEQ ID NO: 215510 - DNA, 103 bp, Artificial Sequence
  Synthetic Polynucleotide
taatacgactcactataggggccgccgccgccgcggccgccgcccccgccaacagaggagaggcgggatgggcggccgcaacctggcggcagcgcaaaagatg

SEQ ID NO: 215511 - DNA, 103 bp, Artificial Sequence
  Synthetic Polynucleotide
taatacgactcactataggggagagggagccggcggctgcggcggcggcaaacagaggagatgccgcatgcgcagccgcaacctggcggcagcgcaaaagatg

SEQ ID NO: 215512 - DNA, 103 bp, Artificial Sequence
  Synthetic Polynucleotide
taatacgactcactatagggggggctccgggagagggagccggcggctgcaacagaggagagcagccatgggctccctcaacctggcggcagcgcaaaagatg

SEQ ID NO: 215513 - DNA, 103 bp, Artificial Sequence
  Synthetic Polynucleotide
taatacgactcactatagggtgcccaggaaggggctccgggagagggagcaacagaggagagctcccatgcccggagccaacctggcggcagcgcaaaagatg

SEQ ID NO: 215514 - DNA, 103 bp, Artificial Sequence
  Synthetic Polynucleotide
taatacgactcactatagggggccgggcactgcccaggaaggggctccggaacagaggagaccggagatgcttcctgggaacctggcggcagcgcaaaagatg

SEQ ID NO: 215515 - DNA, 103 bp, Artificial Sequence
  Synthetic Polynucleotide
taatacgactcactatagggacgcagtcggggccgggcactgcccaggaaaacagaggagattcctgatgagtgcccggaacctggcggcagcgcaaaagatg

SEQ ID NO: 215516 - DNA, 103 bp, Artificial Sequence
  Synthetic Polynucleotide
taatacgactcactatagggaggggctgaaacgcagtcggggccgggcacaacagaggagagtgcccatgcccgactgcaacctggcggcagcgcaaaagatg

SEQ ID NO: 215517 - DNA, 103 bp, Artificial Sequence
  Synthetic Polynucleotide
taatacgactcactataggggggatctgataggggctgaaacgcagtcggaacagaggagaccgactatgtttcagcccaacctggcggcagcgcaaaagatg

SEQ ID NO: 215518 - DNA, 103 bp, Artificial Sequence
  Synthetic Polynucleotide
taatacgactcactataggggatggtgaccgggatctgataggggctgaaaacagaggagattcagcatgtatcagatcaacctggcggcagcgcaaaagatg

SEQ ID NO: 215519 - DNA, 103 bp, Artificial Sequence
  Synthetic Polynucleotide
taatacgactcactatagggtgctaggcgggatggtgaccgggatctgataacagaggagaatcagaatgcggtcaccaaacctggcggcagcgcaaaagatg

SEQ ID NO: 215520 - DNA, 103 bp, Artificial Sequence
  Synthetic Polynucleotide
taatacgactcactatagggaggaggctagtgctaggcgggatggtgaccaacagaggagaggtcacatgcccgcctagaacctggcggcagcgcaaaagatg

SEQ ID NO: 215521 - DNA, 103 bp, Artificial Sequence
  Synthetic Polynucleotide
taatacgactcactatagggcgctgctgccgccgccgccgccgcggccgcaacagaggagagcggccatggcggcggcgaacctggcggcagcgcaaaagatg

SEQ ID NO: 215522 - DNA, 103 bp, Artificial Sequence
  Synthetic Polynucleotide
taatacgactcactatagggcccggtggtgaggaggctagtgctaggcggaacagaggagaccgcctatgactagcctcaacctggcggcagcgcaaaagatg

SEQ ID NO: 215523 - DNA, 103 bp, Artificial Sequence
  Synthetic Polynucleotide
taatacgactcactatagggcagaggccagcccggtggtgaggaggctagaacagaggagactagccatgtcaccaccgaacctggcggcagcgcaaaagatg

SEQ ID NO: 215524 - DNA, 103 bp, Artificial Sequence
  Synthetic Polynucleotide
taatacgactcactatagggttggagccctcagaggccagcccggtggtgaacagaggagacaccacatggctggcctcaacctggcggcagcgcaaaagatg

SEQ ID NO: 215525 - DNA, 103 bp, Artificial Sequence
  Synthetic Polynucleotide
taatacgactcactatagggaccagcggccttggagccctcagaggccagaacagaggagactggccatggagggctccaacctggcggcagcgcaaaagatg

SEQ ID NO: 215526 - DNA, 103 bp, Artificial Sequence
  Synthetic Polynucleotide
taatacgactcactatagggggctgtttccaccagcggccttggagccctaacagaggagaagggctatgaggccgctgaacctggcggcagcgcaaaagatg

SEQ ID NO: 215527 - DNA, 103 bp, Artificial Sequence
  Synthetic Polynucleotide
taatacgactcactatagggctaggctcccggctgtttccaccagcggccaacagaggagaggccgcatgtggaaacagaacctggcggcagcgcaaaagatg

SEQ ID NO: 215528 - DNA, 103 bp, Artificial Sequence
  Synthetic Polynucleotide
taatacgactcactataggggggcagggggctaggctcccggctgtttccaacagaggagaggaaacatgcgggagcctaacctggcggcagcgcaaaagatg

SEQ ID NO: 215529 - DNA, 103 bp, Artificial Sequence
  Synthetic Polynucleotide
taatacgactcactataggggagccagctcgggcagggggctaggctcccaacagaggagagggagcatggccccctgcaacctggcggcagcgcaaaagatg

SEQ ID NO: 215530 - DNA, 103 bp, Artificial Sequence
  Synthetic Polynucleotide
taatacgactcactatagggactttgcggagagccagctcgggcagggggaacagaggagaccccctatgcgagctggcaacctggcggcagcgcaaaagatg

SEQ ID NO: 215531 - DNA, 103 bp, Artificial Sequence
  Synthetic Polynucleotide
taatacgactcactatagggtggggcccctactttgcggagagccagctcaacagaggagagagctgatgctccgcaaaaacctggcggcagcgcaaaagatg

SEQ ID NO: 215532 - DNA, 103 bp, Artificial Sequence
  Synthetic Polynucleotide
taatacgactcactatagggggtaagccatggcgctggccgccagcgccgaacagaggagacggcgcatgcggccagcgaacctggcggcagcgcaaaagatg

SEQ ID NO: 215533 - DNA, 103 bp, Artificial Sequence
  Synthetic Polynucleotide
taatacgactcactatagggccgcctcggccgctgctgccgccgccgccgaacagaggagacggcggatgcggcagcagaacctggcggcagcgcaaaagatg

SEQ ID NO: 215534 - DNA, 103 bp, Artificial Sequence
  Synthetic Polynucleotide
taatacgactcactatagggcaccgcgggatggggcccctactttgcggaaacagaggagatccgcaatgtaggggcccaacctggcggcagcgcaaaagatg

SEQ ID NO: 215535 - DNA, 103 bp, Artificial Sequence
  Synthetic Polynucleotide
taatacgactcactatagggggcgacagggcaccgcgggatggggcccctaacagaggagaaggggcatgatcccgcggaacctggcggcagcgcaaaagatg

SEQ ID NO: 215536 - DNA, 103 bp, Artificial Sequence
  Synthetic Polynucleotide
taatacgactcactatagggcgagccactgggcgacagggcaccgcgggaaacagaggagatcccgcatggccctgtcgaacctggcggcagcgcaaaagatg

SEQ ID NO: 215537 - DNA, 103 bp, Artificial Sequence
  Synthetic Polynucleotide
taatacgactcactatagggcctccttggccgagccactgggcgacagggaacagaggagaccctgtatgccagtggctaacctggcggcagcgcaaaagatg

SEQ ID NO: 215538 - DNA, 103 bp, Artificial Sequence
  Synthetic Polynucleotide
taatacgactcactatagggtcattggccgcctccttggccgagccactgaacagaggagacagtggatgggccaaggaaacctggcggcagcgcaaaagatg

SEQ ID NO: 215539 - DNA, 103 bp, Artificial Sequence
  Synthetic Polynucleotide
taatacgactcactataggggctctgcagttcattggccgcctccttggcaacagaggagagccaagatggcggccaataacctggcggcagcgcaaaagatg

SEQ ID NO: 215540 - DNA, 103 bp, Artificial Sequence
  Synthetic Polynucleotide
taatacgactcactataggggtctctggatgctctgcagttcattggccgaacagaggagacggccaatgaactgcagaaacctggcggcagcgcaaaagatg

SEQ ID NO: 215541 - DNA, 103 bp, Artificial Sequence
  Synthetic Polynucleotide
taatacgactcactatagggccactcaccagtctctggatgctctgcagtaacagaggagaactgcaatgcatccagagaacctggcggcagcgcaaaagatg

SEQ ID NO: 215542 - DNA, 103 bp, Artificial Sequence
  Synthetic Polynucleotide
taatacgactcactataggggctctccagcccactcaccagtctctggataacagaggagaatccagatgctggtgagtaacctggcggcagcgcaaaagatg

SEQ ID NO: 215543 - DNA, 103 bp, Artificial Sequence
  Synthetic Polynucleotide
taatacgactcactataggggggctcgctggctctccagcccactcaccaaacagaggagatggtgaatgggctggagaaacctggcggcagcgcaaaagatg

SEQ ID NO: 215544 - DNA, 103 bp, Artificial Sequence
  Synthetic Polynucleotide
taatacgactcactatagggacgtgcagccccgcctcggccgctgctgccaacagaggagaggcagcatgggccgaggcaacctggcggcagcgcaaaagatg

SEQ ID NO: 215545 - DNA, 103 bp, Artificial Sequence
  Synthetic Polynucleotide
taatacgactcactatagggcctggggagagggctcgctggctctccagcaacagaggagagctggaatgccagcgagcaacctggcggcagcgcaaaagatg

SEQ ID NO: 215546 - DNA, 103 bp, Artificial Sequence
  Synthetic Polynucleotide
taatacgactcactatagggcgactcccggcctggggagagggctcgctgaacagaggagacagcgaatgctctccccaaacctggcggcagcgcaaaagatg

SEQ ID NO: 215547 - DNA, 103 bp, Artificial Sequence
  Synthetic Polynucleotide
taatacgactcactatagggcagtgccgagacgtgcagccccgcctcggcaacagaggagagccgagatggggctgcacaacctggcggcagcgcaaaagatg

SEQ ID NO: 215548 - DNA, 103 bp, Artificial Sequence
  Synthetic Polynucleotide
taatacgactcactatagggggtgcgggcccagtgccgagacgtgcagccaacagaggagaggctgcatgtctcggcacaacctggcggcagcgcaaaagatg

SEQ ID NO: 215549 - DNA, 103 bp, Artificial Sequence
  Synthetic Polynucleotide
taatacgactcactataggggcggcgggcgggtgcgggcccagtgccgagaacagaggagactcggcatggggcccgcaaacctggcggcagcgcaaaagatg

SEQ ID NO: 215550 - DNA, 103 bp, Artificial Sequence
  Synthetic Polynucleotide
taatacgactcactataggggcgcagatgcgcggcgggcgggtgcgggccaacagaggagaggcccgatgccgcccgccaacctggcggcagcgcaaaagatg

SEQ ID NO: 215551 - DNA, 103 bp, Artificial Sequence
  Synthetic Polynucleotide
taatacgactcactatagggtcttgagggagcgcagatgcgcggcgggcgaacagaggagacgcccgatgcgcatctgcaacctggcggcagcgcaaaagatg

SEQ ID NO: 215552 - DNA, 103 bp, Artificial Sequence
  Synthetic Polynucleotide
taatacgactcactatagggggctccaggctcttgagggagcgcagatgcaacagaggagagcatctatgctccctcaaaacctggcggcagcgcaaaagatg

SEQ ID NO: 215553 - DNA, 103 bp, Artificial Sequence
  Synthetic Polynucleotide
taatacgactcactatagggctcgtcctcgggctccaggctcttgagggaaacagaggagatccctcatgagcctggagaacctggcggcagcgcaaaagatg

SEQ ID NO: 215554 - DNA, 103 bp, Artificial Sequence
  Synthetic Polynucleotide
taatacgactcactatagggcgtcctccacctcgtcctcgggctccaggcaacagaggagagcctggatgccgaggacgaacctggcggcagcgcaaaagatg

SEQ ID NO: 215555 - DNA, 103 bp, Artificial Sequence
  Synthetic Polynucleotide
taatacgactcactatagggtggaacgggtggtaagccatggcgctggccaacagaggagaggccagatgcatggcttaaacctggcggcagcgcaaaagatg

SEQ ID NO: 215556 - DNA, 103 bp, Artificial Sequence
  Synthetic Polynucleotide
taatacgactcactatagggaccttggggtcgtcctccacctcgtcctcgaacagaggagacgaggaatgggtggaggaaacctggcggcagcgcaaaagatg

SEQ ID NO: 215557 - DNA, 103 bp, Artificial Sequence
  Synthetic Polynucleotide
taatacgactcactatagggctccagcgtcaccttggggtcgtcctccacaacagaggagagtggagatggaccccaagaacctggcggcagcgcaaaagatg

SEQ ID NO: 215558 - DNA, 103 bp, Artificial Sequence
  Synthetic Polynucleotide
taatacgactcactataggggctccttggcctccagcgtcaccttggggtaacagaggagaaccccaatgtgacgctggaacctggcggcagcgcaaaagatg

SEQ ID NO: 215559 - DNA, 103 bp, Artificial Sequence
  Synthetic Polynucleotide
taatacgactcactatagggtggtcccacagctccttggcctccagcgtcaacagaggagagacgctatgggccaaggaaacctggcggcagcgcaaaagatg

SEQ ID NO: 215560 - DNA, 103 bp, Artificial Sequence
  Synthetic Polynucleotide
taatacgactcactatagggcttgtggaactggtcccacagctccttggcaacagaggagagccaagatgctgtgggacaacctggcggcagcgcaaaagatg

SEQ ID NO: 215561 - DNA, 103 bp, Artificial Sequence
  Synthetic Polynucleotide
taatacgactcactatagggccgtgcctagcttgtggaactggtcccacaaacagaggagatgtgggatgagttccacaaacctggcggcagcgcaaaagatg

SEQ ID NO: 215562 - DNA, 103 bp, Artificial Sequence
  Synthetic Polynucleotide
taatacgactcactatagggatgaccatctccgtgcctagcttgtggaacaacagaggagagttccaatggctaggcacaacctggcggcagcgcaaaagatg

SEQ ID NO: 215563 - DNA, 103 bp, Artificial Sequence
  Synthetic Polynucleotide
taatacgactcactatagggggacttggtgatgaccatctccgtgcctagaacagaggagactaggcatggagatggtcaacctggcggcagcgcaaaagatg

SEQ ID NO: 215564 - DNA, 103 bp, Artificial Sequence
  Synthetic Polynucleotide
taatacgactcactatagggtccgcctcccggacttggtgatgaccatctaacagaggagaagatggatgtcaccaagtaacctggcggcagcgcaaaagatg

SEQ ID NO: 215565 - DNA, 103 bp, Artificial Sequence
  Synthetic Polynucleotide
taatacgactcactatagggggggggaacatccgcctcccggacttggtgaacagaggagacaccaaatgcgggaggcgaacctggcggcagcgcaaaagatg

SEQ ID NO: 215566 - DNA, 103 bp, Artificial Sequence
  Synthetic Polynucleotide
taatacgactcactatagggccgtggcgcgtggaacgggtggtaagccataacagaggagaatggctatgcacccgttcaacctggcggcagcgcaaaagatg

SEQ ID NO: 215567 - DNA, 103 bp, Artificial Sequence
  Synthetic Polynucleotide
taatacgactcactatagggcaccttgaagggggggaacatccgcctcccaacagaggagagggaggatgatgttccccaacctggcggcagcgcaaaagatg

SEQ ID NO: 215568 - DNA, 103 bp, Artificial Sequence
  Synthetic Polynucleotide
taatacgactcactatagggcgctgactcgcaccttgaagggggggaacaaacagaggagatgttccatgccttcaaggaacctggcggcagcgcaaaagatg

SEQ ID NO: 215569 - DNA, 103 bp, Artificial Sequence
  Synthetic Polynucleotide
taatacgactcactatagggttgtccaggccgctgactcgcaccttgaagaacagaggagacttcaaatggcgagtcagaacctggcggcagcgcaaaagatg

SEQ ID NO: 215570 - DNA, 103 bp, Artificial Sequence
  Synthetic Polynucleotide
taatacgactcactatagggcttggccttcttgtccaggccgctgactcgaacagaggagacgagtcatgggcctggacaacctggcggcagcgcaaaagatg

SEQ ID NO: 215571 - DNA, 103 bp, Artificial Sequence
  Synthetic Polynucleotide
taatacgactcactataggggcaggatatacttggccttcttgtccaggcaacagaggagagcctggatgagaaggccaaacctggcggcagcgcaaaagatg

SEQ ID NO: 215572 - DNA, 103 bp, Artificial Sequence
  Synthetic Polynucleotide
taatacgactcactatagggatgtccatcagcaggatatacttggccttcaacagaggagagaaggcatggtatatcctaacctggcggcagcgcaaaagatg

SEQ ID NO: 215573 - DNA, 103 bp, Artificial Sequence
  Synthetic Polynucleotide
taatacgactcactatagggagcggctacaatgtccatcagcaggatataaacagaggagatatatcatgctgatggacaacctggcggcagcgcaaaagatg

SEQ ID NO: 215574 - DNA, 103 bp, Artificial Sequence
  Synthetic Polynucleotide
taatacgactcactatagggggcaatcgtcagcggctacaatgtccatcaaacagaggagatgatggatgttgtagccgaacctggcggcagcgcaaaagatg

SEQ ID NO: 215575 - DNA, 103 bp, Artificial Sequence
  Synthetic Polynucleotide
taatacgactcactatagggaacttatagcggcaatcgtcagcggctacaaacagaggagatgtagcatgtgacgattgaacctggcggcagcgcaaaagatg

SEQ ID NO: 215576 - DNA, 103 bp, Artificial Sequence
  Synthetic Polynucleotide
taatacgactcactatagggcgagttgtggaacttatagcggcaatcgtcaacagaggagagacgatatgcgctataagaacctggcggcagcgcaaaagatg

SEQ ID NO: 215577 - DNA, 103 bp, Artificial Sequence
  Synthetic Polynucleotide
taatacgactcactatagggagtcggcgggccgtggcgcgtggaacgggtaacagaggagaacccgtatgacgcgccacaacctggcggcagcgcaaaagatg

SEQ ID NO: 215578 - DNA, 103 bp, Artificial Sequence
  Synthetic Polynucleotide
taatacgactcactatagggccatccagcgcgagttgtggaacttatagcaacagaggagagctataatgtccacaactaacctggcggcagcgcaaaagatg

SEQ ID NO: 215579 - DNA, 103 bp, Artificial Sequence
  Synthetic Polynucleotide
taatacgactcactatagggttgcccgccaccatccagcgcgagttgtggaacagaggagaccacaaatggcgctggataacctggcggcagcgcaaaagatg

SEQ ID NO: 215580 - DNA, 103 bp, Artificial Sequence
  Synthetic Polynucleotide
taatacgactcactatagggagggtcggccttgcccgccaccatccagcgaacagaggagacgctggatggtggcgggcaacctggcggcagcgcaaaagatg

SEQ ID NO: 215581 - DNA, 103 bp, Artificial Sequence
  Synthetic Polynucleotide
taatacgactcactatagggtgggcatctcagggtcggccttgcccgccaaacagaggagatggcggatgaggccgaccaacctggcggcagcgcaaaagatg

SEQ ID NO: 215582 - DNA, 103 bp, Artificial Sequence
  Synthetic Polynucleotide
taatacgactcactatagggtacatgcgtttgggcatctcagggtcggccaacagaggagaggccgaatgtgagatgccaacctggcggcagcgcaaaagatg

SEQ ID NO: 215583 - DNA, 103 bp, Artificial Sequence
  Synthetic Polynucleotide
taatacgactcactatagggtgggtggatgtacatgcgtttgggcatctcaacagaggagagagatgatgaaacgcatgaacctggcggcagcgcaaaagatg

SEQ ID NO: 215584 - DNA, 103 bp, Artificial Sequence
  Synthetic Polynucleotide
taatacgactcactatagggctgggctgtctgggtggatgtacatgcgttaacagaggagaaacgcaatgacatccaccaacctggcggcagcgcaaaagatg

SEQ ID NO: 215585 - DNA, 103 bp, Artificial Sequence
  Synthetic Polynucleotide
taatacgactcactatagggtcccccgtggctgggctgtctgggtggatgaacagaggagacatccaatgagacagcccaacctggcggcagcgcaaaagatg

SEQ ID NO: 215586 - DNA, 103 bp, Artificial Sequence
  Synthetic Polynucleotide
taatacgactcactatagggcatccactgctcccccgtggctgggctgtcaacagaggagagacagcatggccacggggaacctggcggcagcgcaaaagatg

SEQ ID NO: 215587 - DNA, 103 bp, Artificial Sequence
  Synthetic Polynucleotide
taatacgactcactatagggcaggcttagccatccactgctcccccgtggaacagaggagaccacggatgagcagtggaaacctggcggcagcgcaaaagatg

SEQ ID NO: 215588 - DNA, 103 bp, Artificial Sequence
  Synthetic Polynucleotide
taatacgactcactataggggacatggggaagtcggcgggccgtggcgcgaacagaggagacgcgccatggcccgccgaaacctggcggcagcgcaaaagatg

SEQ ID NO: 215589 - DNA, 103 bp, Artificial Sequence
  Synthetic Polynucleotide
taatacgactcactatagggtggaaggccacaggcttagccatccactgcaacagaggagagcagtgatgggctaagccaacctggcggcagcgcaaaagatg

SEQ ID NO: 215590 - DNA, 103 bp, Artificial Sequence
  Synthetic Polynucleotide
taatacgactcactatagggcttcagcttgtggaaggccacaggcttagcaacagaggagagctaagatggtggccttcaacctggcggcagcgcaaaagatg

SEQ ID NO: 215591 - DNA, 103 bp, Artificial Sequence
  Synthetic Polynucleotide
taatacgactcactatagggtgttggtcagcttcagcttgtggaaggccaaacagaggagatggcctatgacaagctgaaacctggcggcagcgcaaaagatg

SEQ ID NO: 215592 - DNA, 103 bp, Artificial Sequence
  Synthetic Polynucleotide
taatacgactcactatagggtcagagatgttgttggtcagcttcagcttgaacagaggagacaagctatggctgaccaaaacctggcggcagcgcaaaagatg

SEQ ID NO: 215593 - DNA, 103 bp, Artificial Sequence
  Synthetic Polynucleotide
taatacgactcactataggggccgtgcttgtcagagatgttgttggtcagaacagaggagactgaccatgaacatctctaacctggcggcagcgcaaaagatg

SEQ ID NO: 215594 - DNA, 103 bp, Artificial Sequence
  Synthetic Polynucleotide
taatacgactcactatagggggatggtgaagccgtgcttgtcagagatgtaacagaggagaacatctatgacaagcacgaacctggcggcagcgcaaaagatg

SEQ ID NO: 215595 - DNA, 103 bp, Artificial Sequence
  Synthetic Polynucleotide
taatacgactcactatagggatggagtttaggatggtgaagccgtgcttgaacagaggagacaagcaatgcttcaccataacctggcggcagcgcaaaagatg

SEQ ID NO: 215596 - DNA, 103 bp, Artificial Sequence
  Synthetic Polynucleotide
taatacgactcactataggggtacttgtgcatggagtttaggatggtgaaaacagaggagattcaccatgctaaactccaacctggcggcagcgcaaaagatg

SEQ ID NO: 215597 - DNA, 103 bp, Artificial Sequence
  Synthetic Polynucleotide
taatacgactcactatagggagcgcggctggtacttgtgcatggagtttaaacagaggagataaactatgtgcacaagtaacctggcggcagcgcaaaagatg

SEQ ID NO: 215598 - DNA, 103 bp, Artificial Sequence
  Synthetic Polynucleotide
taatacgactcactatagggactatgtggaagcgcggctggtacttgtgcaacagaggagagcacaaatgccagccgcgaacctggcggcagcgcaaaagatg

SEQ ID NO: 215599 - DNA, 103 bp, Artificial Sequence
  Synthetic Polynucleotide
taatacgactcactatagggcagaaaggcggacatggggaagtcggcgggaacagaggagacccgccatgttccccatgaacctggcggcagcgcaaaagatg

SEQ ID NO: 215600 - DNA, 103 bp, Artificial Sequence
  Synthetic Polynucleotide
taatacgactcactataggggttggctcgcactatgtggaagcgcggctgaacagaggagacagccgatgttccacataaacctggcggcagcgcaaaagatg

SEQ ID NO: 215601 - DNA, 103 bp, Artificial Sequence
  Synthetic Polynucleotide
taatacgactcactatagggtcaggatgtcgttggctcgcactatgtggaaacagaggagatccacaatgtgcgagccaaacctggcggcagcgcaaaagatg

SEQ ID NO: 215602 - DNA, 103 bp, Artificial Sequence
  Synthetic Polynucleotide
taatacgactcactatagggtaaggcagcttcaggatgtcgttggctcgcaacagaggagagcgagcatgcgacatcctaacctggcggcagcgcaaaagatg

SEQ ID NO: 215603 - DNA, 103 bp, Artificial Sequence
  Synthetic Polynucleotide
taatacgactcactataggggaaggtgctgtaaggcagcttcaggatgtcaacagaggagagacatcatgaagctgcctaacctggcggcagcgcaaaagatg

SEQ ID NO: 215604 - DNA, 103 bp, Artificial Sequence
  Synthetic Polynucleotide
taatacgactcactatagggcgtaggtgcggaaggtgctgtaaggcagctaacagaggagaagctgcatgacagcacctaacctggcggcagcgcaaaagatg

SEQ ID NO: 215605 - DNA, 103 bp, Artificial Sequence
  Synthetic Polynucleotide
taatacgactcactatagggtccgggaacacgtaggtgcggaaggtgctgaacagaggagacagcacatgccgcacctaaacctggcggcagcgcaaaagatg

SEQ ID NO: 215606 - DNA, 103 bp, Artificial Sequence
  Synthetic Polynucleotide
taatacgactcactataggggaagtcggtctccgggaacacgtaggtgcgaacagaggagacgcaccatggtgttcccgaacctggcggcagcgcaaaagatg

SEQ ID NO: 215607 - DNA, 103 bp, Artificial Sequence
  Synthetic Polynucleotide
taatacgactcactatagggtgacggcgatgaagtcggtctccgggaacaaacagaggagatgttccatgagaccgactaacctggcggcagcgcaaaagatg

SEQ ID NO: 215608 - DNA, 103 bp, Artificial Sequence
  Synthetic Polynucleotide
taatacgactcactatagggtggtaggcagtgacggcgatgaagtcggtcaacagaggagagaccgaatgcatcgccgtaacctggcggcagcgcaaaagatg

SEQ ID NO: 215609 - DNA, 103 bp, Artificial Sequence
  Synthetic Polynucleotide
taatacgactcactatagggcttgtcattctggtaggcagtgacggcgataacagaggagaatcgccatgactgcctacaacctggcggcagcgcaaaagatg

SEQ ID NO: 215610 - DNA, 103 bp, Artificial Sequence
  Synthetic Polynucleotide
taatacgactcactataggggcgccgccgccagaaaggcggacatggggaaacagaggagatccccaatgccgcctttcaacctggcggcagcgcaaaagatg

SEQ ID NO: 215611 - DNA, 103 bp, Artificial Sequence
  Synthetic Polynucleotide
taatacgactcactataggggctgtgtgatcttgtcattctggtaggcagaacagaggagactgcctatgagaatgacaaacctggcggcagcgcaaaagatg

SEQ ID NO: 215612 - DNA, 103 bp, Artificial Sequence
  Synthetic Polynucleotide
taatacgactcactatagggtcgatcttcagctgtgtgatcttgtcattcaacagaggagagaatgaatggatcacacaaacctggcggcagcgcaaaagatg

SEQ ID NO: 215613 - DNA, 103 bp, Artificial Sequence
  Synthetic Polynucleotide
taatacgactcactatagggcgggttgttgtcgatcttcagctgtgtgataacagaggagaatcacaatgctgaagatcaacctggcggcagcgcaaaagatg

SEQ ID NO: 215614 - DNA, 103 bp, Artificial Sequence
  Synthetic Polynucleotide
taatacgactcactatagggccttggcaaacgggttgttgtcgatcttcaaacagaggagatgaagaatgacaacaaccaacctggcggcagcgcaaaagatg

SEQ ID NO: 215615 - DNA, 103 bp, Artificial Sequence
  Synthetic Polynucleotide
taatacgactcactatagggtcccggaagcccttggcaaacgggttgttgaacagaggagacaacaaatggtttgccaaaacctggcggcagcgcaaaagatg

SEQ ID NO: 215616 - DNA, 103 bp, Artificial Sequence
  Synthetic Polynucleotide
taatacgactcactataggggttcccggtgtcccggaagcccttggcaaaaacagaggagatttgccatgggcttccggaacctggcggcagcgcaaaagatg

SEQ ID NO: 215617 - DNA, 103 bp, Artificial Sequence
  Synthetic Polynucleotide
taatacgactcactatagggcccgccggccgttcccggtgtcccggaagcaacagaggagagcttccatgacaccgggaaacctggcggcagcgcaaaagatg

SEQ ID NO: 215618 - DNA, 103 bp, Artificial Sequence
  Synthetic Polynucleotide
taatacgactcactatagggttccttttctcccgccggccgttcccggtgaacagaggagacaccggatgcggccggcgaacctggcggcagcgcaaaagatg

SEQ ID NO: 215619 - DNA, 103 bp, Artificial Sequence
  Synthetic Polynucleotide
taatacgactcactatagggcgtcagctgcttccttttctcccgccggccaacagaggagaggccggatggagaaaaggaacctggcggcagcgcaaaagatg

SEQ ID NO: 215620 - DNA, 103 bp, Artificial Sequence
  Synthetic Polynucleotide
taatacgactcactataggggagacggcagcgtcagctgcttccttttctaacagaggagaagaaaaatgagcagctgaaacctggcggcagcgcaaaagatg

SEQ ID NO: 215621 - DNA, 103 bp, Artificial Sequence
  Synthetic Polynucleotide
taatacgactcactatagggaaggagggctgcgccgccgccagaaaggcgaacagaggagacgccttatgggcggcggcaacctggcggcagcgcaaaagatg

SEQ ID NO: 215622 - DNA, 103 bp, Artificial Sequence
  Synthetic Polynucleotide
taatacgactcactatagggtacaagcgtagagacggcagcgtcagctgcaacagaggagagcagctatggctgccgtcaacctggcggcagcgcaaaagatg

SEQ ID NO: 215623 - DNA, 103 bp, Artificial Sequence
  Synthetic Polynucleotide
taatacgactcactataggggtgctcctcgtacaagcgtagagacggcagaacagaggagactgccgatgctacgcttgaacctggcggcagcgcaaaagatg

SEQ ID NO: 215624 - DNA, 103 bp, Artificial Sequence
  Synthetic Polynucleotide
taatacgactcactatagggcgggtttgcagtgctcctcgtacaagcgtaaacagaggagatacgctatgacgaggagcaacctggcggcagcgcaaaagatg

SEQ ID NO: 215625 - DNA, 103 bp, Artificial Sequence
  Synthetic Polynucleotide
taatacgactcactatagggccatcgcgctcgggtttgcagtgctcctcgaacagaggagacgaggaatgctgcaaaccaacctggcggcagcgcaaaagatg

SEQ ID NO: 215626 - DNA, 103 bp, Artificial Sequence
  Synthetic Polynucleotide
taatacgactcactatagggtgactccgcgccatcgcgctcgggtttgcaaacagaggagatgcaaaatggagcgcgataacctggcggcagcgcaaaagatg

SEQ ID NO: 215627 - DNA, 103 bp, Artificial Sequence
  Synthetic Polynucleotide
taatacgactcactatagggacgaggcgtctgactccgcgccatcgcgctaacagaggagaagcgcgatggcgcggagtaacctggcggcagcgcaaaagatg

SEQ ID NO: 215628 - DNA, 103 bp, Artificial Sequence
  Synthetic Polynucleotide
taatacgactcactataggggggtcgcacgacgaggcgtctgactccgcgaacagaggagacgcggaatgagacgcctcaacctggcggcagcgcaaaagatg

SEQ ID NO: 215629 - DNA, 103 bp, Artificial Sequence
  Synthetic Polynucleotide
taatacgactcactatagggcgcggggggagggtcgcacgacgaggcgtcaacagaggagagacgccatgtcgtgcgacaacctggcggcagcgcaaaagatg

SEQ ID NO: 215630 - DNA, 103 bp, Artificial Sequence
  Synthetic Polynucleotide
taatacgactcactataggggtggttcccgcgcggggggagggtcgcacgaacagaggagacgtgcgatgctccccccgaacctggcggcagcgcaaaagatg

SEQ ID NO: 215631 - DNA, 103 bp, Artificial Sequence
  Synthetic Polynucleotide
taatacgactcactatagggggggaggtgggtggttcccgcgcggggggaaacagaggagatcccccatggcgggaaccaacctggcggcagcgcaaaagatg

SEQ ID NO: 215632 - DNA, 103 bp, Artificial Sequence
  Synthetic Polynucleotide
taatacgactcactatagggttggggcttgggggacgccgtgaactccataacagaggagaatggagatgacggcgtccaacctggcggcagcgcaaaagatg

SEQ ID NO: 215633 - DNA, 103 bp, Artificial Sequence
  Synthetic Polynucleotide
taatacgactcactatagggtttgattgtgttctccgtcgcctccttctcaacagaggagagagaagatggcgacggagaacctggcggcagcgcaaaagatg

SEQ ID NO: 215634 - DNA, 103 bp, Artificial Sequence
  Synthetic Polynucleotide
taatacgactcactatagggtgttgtaaaggctgaccctcgatttggggtaacagaggagaaccccaatgcgagggtcaaacctggcggcagcgcaaaagatg

SEQ ID NO: 215635 - DNA, 103 bp, Artificial Sequence
  Synthetic Polynucleotide
taatacgactcactatagggaattatcagatgttgtaaaggctgaccctcaacagaggagagagggtatgcctttacaaaacctggcggcagcgcaaaagatg

SEQ ID NO: 215636 - DNA, 103 bp, Artificial Sequence
  Synthetic Polynucleotide
taatacgactcactatagggctgagagacaaattatcagatgttgtaaagaacagaggagactttacatgatctgataaaacctggcggcagcgcaaaagatg

SEQ ID NO: 215637 - DNA, 103 bp, Artificial Sequence
  Synthetic Polynucleotide
taatacgactcactatagggtacccaggagctgagagacaaattatcagaaacagaggagatctgatatgttgtctctcaacctggcggcagcgcaaaagatg

SEQ ID NO: 215638 - DNA, 103 bp, Artificial Sequence
  Synthetic Polynucleotide
taatacgactcactatagggaagaagatgatacccaggagctgagagacaaacagaggagatgtctcatggctcctgggaacctggcggcagcgcaaaagatg

SEQ ID NO: 215639 - DNA, 103 bp, Artificial Sequence
  Synthetic Polynucleotide
taatacgactcactatagggggaaaactggaagaagatgatacccaggagaacagaggagactcctgatgatcatcttcaacctggcggcagcgcaaaagatg

SEQ ID NO: 215640 - DNA, 103 bp, Artificial Sequence
  Synthetic Polynucleotide
taatacgactcactatagggctgaaacccaggaaaactggaagaagatgaaacagaggagatcatctatgtccagttttaacctggcggcagcgcaaaagatg

SEQ ID NO: 215641 - DNA, 103 bp, Artificial Sequence
  Synthetic Polynucleotide
taatacgactcactatagggactgtgggtgctgaaacccaggaaaactggaacagaggagaccagttatgctgggtttcaacctggcggcagcgcaaaagatg

SEQ ID NO: 215642 - DNA, 103 bp, Artificial Sequence
  Synthetic Polynucleotide
taatacgactcactataggggcagtcagggactgtgggtgctgaaacccaaacagaggagatgggttatggcacccacaaacctggcggcagcgcaaaagatg

SEQ ID NO: 215643 - DNA, 103 bp, Artificial Sequence
  Synthetic Polynucleotide
taatacgactcactatagggggtgccaagagcagtcagggactgtgggtgaacagaggagacacccaatgtccctgactaacctggcggcagcgcaaaagatg

SEQ ID NO: 215644 - DNA, 103 bp, Artificial Sequence
  Synthetic Polynucleotide
taatacgactcactataggggctccaggggtttgattgtgttctccgtcgaacagaggagacgacggatgacacaatcaaacctggcggcagcgcaaaagatg

SEQ ID NO: 215645 - DNA, 103 bp, Artificial Sequence
  Synthetic Polynucleotide
taatacgactcactatagggatgctgtgctggtgccaagagcagtcagggaacagaggagaccctgaatgctcttggcaaacctggcggcagcgcaaaagatg

SEQ ID NO: 215646 - DNA, 103 bp, Artificial Sequence
  Synthetic Polynucleotide
taatacgactcactataggggttgctatggatgctgtgctggtgccaagaaacagaggagatcttggatgcagcacagcaacctggcggcagcgcaaaagatg

SEQ ID NO: 215647 - DNA, 103 bp, Artificial Sequence
  Synthetic Polynucleotide
taatacgactcactatagggaggaatgggtgttgctatggatgctgtgctaacagaggagaagcacaatgtccatagcaaacctggcggcagcgcaaaagatg

SEQ ID NO: 215648 - DNA, 103 bp, Artificial Sequence
  Synthetic Polynucleotide
taatacgactcactatagggggatggggtgaggaatgggtgttgctatggaacagaggagaccatagatgcacccattcaacctggcggcagcgcaaaagatg

SEQ ID NO: 215649 - DNA, 103 bp, Artificial Sequence
  Synthetic Polynucleotide
taatacgactcactatagggagagaaccctggatggggtgaggaatgggtaacagaggagaacccatatgtcaccccataacctggcggcagcgcaaaagatg

SEQ ID NO: 215650 - DNA, 103 bp, Artificial Sequence
  Synthetic Polynucleotide
taatacgactcactatagggatatggtggcagagaaccctggatggggtgaacagaggagacaccccatgcagggttctaacctggcggcagcgcaaaagatg

SEQ ID NO: 215651 - DNA, 103 bp, Artificial Sequence
  Synthetic Polynucleotide
taatacgactcactatagggccagtcggctatatggtggcagagaaccctaacagaggagaagggttatgtgccaccataacctggcggcagcgcaaaagatg

SEQ ID NO: 215652 - DNA, 103 bp, Artificial Sequence
  Synthetic Polynucleotide
taatacgactcactatagggagaggcattcccagtcggctatatggtggcaacagaggagagccaccatgtagccgactaacctggcggcagcgcaaaagatg

SEQ ID NO: 215653 - DNA, 103 bp, Artificial Sequence
  Synthetic Polynucleotide
taatacgactcactatagggcgatggtgtcagaggcattcccagtcggctaacagaggagaagccgaatgggaatgcctaacctggcggcagcgcaaaagatg

SEQ ID NO: 215654 - DNA, 103 bp, Artificial Sequence
  Synthetic Polynucleotide
taatacgactcactatagggtggcaatggccgatggtgtcagaggcattcaacagaggagagaatgcatgtgacaccataacctggcggcagcgcaaaagatg

SEQ ID NO: 215655 - DNA, 103 bp, Artificial Sequence
  Synthetic Polynucleotide
taatacgactcactatagggtccacaaattgctccaggggtttgattgtgaacagaggagacacaatatgacccctggaaacctggcggcagcgcaaaagatg

SEQ ID NO: 215656 - DNA, 103 bp, Artificial Sequence
  Synthetic Polynucleotide
taatacgactcactatagggtgcatggagctggcaatggccgatggtgtcaacagaggagagacaccatgggccattgcaacctggcggcagcgcaaaagatg

SEQ ID NO: 215657 - DNA, 103 bp, Artificial Sequence
  Synthetic Polynucleotide
taatacgactcactataggggccactcccttgcatggagctggcaatggcaacagaggagagccattatgagctccatgaacctggcggcagcgcaaaagatg

SEQ ID NO: 215658 - DNA, 103 bp, Artificial Sequence
  Synthetic Polynucleotide
taatacgactcactatagggggaatgtggggccactcccttgcatggagcaacagaggagagctccaatgaagggagtgaacctggcggcagcgcaaaagatg

SEQ ID NO: 215659 - DNA, 103 bp, Artificial Sequence
  Synthetic Polynucleotide
taatacgactcactatagggtggaatgaagggaatgtggggccactccctaacagaggagaagggagatgccccacattaacctggcggcagcgcaaaagatg

SEQ ID NO: 215660 - DNA, 103 bp, Artificial Sequence
  Synthetic Polynucleotide
taatacgactcactatagggtcgcggcatgtggaatgaagggaatgtgggaacagaggagacccacaatgccttcattcaacctggcggcagcgcaaaagatg

SEQ ID NO: 215661 - DNA, 103 bp, Artificial Sequence
  Synthetic Polynucleotide
taatacgactcactatagggagtgatggtatcgcggcatgtggaatgaagaacagaggagacttcatatgacatgccgcaacctggcggcagcgcaaaagatg

SEQ ID NO: 215662 - DNA, 103 bp, Artificial Sequence
  Synthetic Polynucleotide
taatacgactcactatagggtgctgaaaatagtgatggtatcgcggcatgaacagaggagacatgccatgataccatcaaacctggcggcagcgcaaaagatg

SEQ ID NO: 215663 - DNA, 103 bp, Artificial Sequence
  Synthetic Polynucleotide
taatacgactcactatagggatagggcccctgctgaaaatagtgatggtaaacagaggagataccatatgtattttcagaacctggcggcagcgcaaaagatg

SEQ ID NO: 215664 - DNA, 103 bp, Artificial Sequence
  Synthetic Polynucleotide
taatacgactcactataggggaatggcagcatagggcccctgctgaaaataacagaggagaattttcatgaggggccctaacctggcggcagcgcaaaagatg

SEQ ID NO: 215665 - DNA, 103 bp, Artificial Sequence
  Synthetic Polynucleotide
taatacgactcactatagggcgtagtccttgaatggcagcatagggccccaacagaggagaggggccatgtgctgccataacctggcggcagcgcaaaagatg

SEQ ID NO: 215666 - DNA, 103 bp, Artificial Sequence
  Synthetic Polynucleotide
taatacgactcactatagggggacgacttctccacaaattgctccaggggaacagaggagacccctgatgcaatttgtgaacctggcggcagcgcaaaagatg

SEQ ID NO: 215667 - DNA, 103 bp, Artificial Sequence
  Synthetic Polynucleotide
taatacgactcactatagggagaggaatggcgtagtccttgaatggcagcaacagaggagagctgccatgcaaggactaaacctggcggcagcgcaaaagatg

SEQ ID NO: 215668 - DNA, 103 bp, Artificial Sequence
  Synthetic Polynucleotide
taatacgactcactatagggtcatcacagcagaggaatggcgtagtccttaacagaggagaaaggacatggccattcctaacctggcggcagcgcaaaagatg

SEQ ID NO: 215669 - DNA, 103 bp, Artificial Sequence
  Synthetic Polynucleotide
taatacgactcactatagggacaaatggcgtcatcacagcagaggaatggaacagaggagaccattcatgtgctgtgataacctggcggcagcgcaaaagatg

SEQ ID NO: 215670 - DNA, 103 bp, Artificial Sequence
  Synthetic Polynucleotide
taatacgactcactataggggctgggcacaggacgacttctccacaaattaacagaggagaaatttgatgagaagtcgtaacctggcggcagcgcaaaagatg

SEQ ID NO: 215671 - DNA, 103 bp, Artificial Sequence
  Synthetic Polynucleotide
taatacgactcactatagggtcacccaggggctgggcacaggacgacttcaacagaggagagaagtcatgctgtgcccaaacctggcggcagcgcaaaagatg

SEQ ID NO: 215672 - DNA, 103 bp, Artificial Sequence
  Synthetic Polynucleotide
taatacgactcactataggggctggtcagctcacccaggggctgggcacaaacagaggagatgtgccatgcccctgggtaacctggcggcagcgcaaaagatg

SEQ ID NO: 215673 - DNA, 103 bp, Artificial Sequence
  Synthetic Polynucleotide
taatacgactcactataggggagcatccaggctggtcagctcacccagggaacagaggagaccctggatgagctgaccaaacctggcggcagcgcaaaagatg

SEQ ID NO: 215674 - DNA, 103 bp, Artificial Sequence
  Synthetic Polynucleotide
taatacgactcactatagggaactccccatgagcatccaggctggtcagcaacagaggagagctgacatgcctggatgcaacctggcggcagcgcaaaagatg

SEQ ID NO: 215675 - DNA, 103 bp, Artificial Sequence
  Synthetic Polynucleotide
taatacgactcactataggggcctccaccaaactccccatgagcatccagaacagaggagactggatatgcatggggagaacctggcggcagcgcaaaagatg

SEQ ID NO: 215676 - DNA, 103 bp, Artificial Sequence
  Synthetic Polynucleotide
taatacgactcactataggggagaggagagttggggcttgggggacgccgaacagaggagacggcgtatgccaagccccaacctggcggcagcgcaaaagatg

SEQ ID NO: 215677 - DNA, 103 bp, Artificial Sequence
  Synthetic Polynucleotide
taatacgactcactatagggtgctgccactgcctccaccaaactccccataacagaggagaatggggatgttggtggagaacctggcggcagcgcaaaagatg

SEQ ID NO: 215678 - DNA, 103 bp, Artificial Sequence
  Synthetic Polynucleotide
taatacgactcactataggggaggacgggctgctgccactgcctccaccaaacagaggagatggtggatgcagtggcagaacctggcggcagcgcaaaagatg

SEQ ID NO: 215679 - DNA, 103 bp, Artificial Sequence
  Synthetic Polynucleotide
taatacgactcactatagggcagagaggaggaggacgggctgctgccactaacagaggagaagtggcatgagcccgtccaacctggcggcagcgcaaaagatg

SEQ ID NO: 215680 - DNA, 103 bp, Artificial Sequence
  Synthetic Polynucleotide
taatacgactcactataggggctcagtgcacagagaggaggaggacgggcaacagaggagagcccgtatgcctcctctcaacctggcggcagcgcaaaagatg

SEQ ID NO: 215681 - DNA, 103 bp, Artificial Sequence
  Synthetic Polynucleotide
taatacgactcactataggggggatcagtggctcagtgcacagagaggagaacagaggagactcctcatggtgcactgaaacctggcggcagcgcaaaagatg

SEQ ID NO: 215682 - DNA, 103 bp, Artificial Sequence
  Synthetic Polynucleotide
taatacgactcactataggggggggtggtggggatcagtggctcagtgcaaacagaggagatgcactatgccactgatcaacctggcggcagcgcaaaagatg

SEQ ID NO: 215683 - DNA, 103 bp, Artificial Sequence
  Synthetic Polynucleotide
taatacgactcactatagggtggggatgatgggggtggtggggatcagtgaacagaggagacactgaatgccaccacccaacctggcggcagcgcaaaagatg

SEQ ID NO: 215684 - DNA, 103 bp, Artificial Sequence
  Synthetic Polynucleotide
taatacgactcactatagggatttcctcactggggatgatgggggtggtgaacagaggagacaccacatgcatcatcccaacctggcggcagcgcaaaagatg

SEQ ID NO: 215685 - DNA, 103 bp, Artificial Sequence
  Synthetic Polynucleotide
taatacgactcactatagggaattttggccatttcctcactggggatgataacagaggagaatcatcatgagtgaggaaaacctggcggcagcgcaaaagatg

SEQ ID NO: 215686 - DNA, 103 bp, Artificial Sequence
  Synthetic Polynucleotide
taatacgactcactatagggggctgcaggcaattttggccatttcctcacaacagaggagagtgaggatgtggccaaaaaacctggcggcagcgcaaaagatg

SEQ ID NO: 215687 - DNA, 103 bp, Artificial Sequence
  Synthetic Polynucleotide
taatacgactcactataggggcgttggcccgagaggagagttggggcttgaacagaggagacaagccatgactctcctcaacctggcggcagcgcaaaagatg

SEQ ID NO: 215688 - DNA, 103 bp, Artificial Sequence
  Synthetic Polynucleotide
taatacgactcactatagggttggtctccaggctgcaggcaattttggccaacagaggagaggccaaatgtgcctgcagaacctggcggcagcgcaaaagatg

SEQ ID NO: 215689 - DNA, 103 bp, Artificial Sequence
  Synthetic Polynucleotide
taatacgactcactatagggccaaagctccttggtctccaggctgcaggcaacagaggagagcctgcatgctggagaccaacctggcggcagcgcaaaagatg

SEQ ID NO: 215690 - DNA, 103 bp, Artificial Sequence
  Synthetic Polynucleotide
taatacgactcactatagggggaatttgtcccaaagctccttggtctccaaacagaggagatggagaatgaggagctttaacctggcggcagcgcaaaagatg

SEQ ID NO: 215691 - DNA, 103 bp, Artificial Sequence
  Synthetic Polynucleotide
taatacgactcactatagggcccagctcatggaatttgtcccaaagctccaacagaggagaggagctatgggacaaattaacctggcggcagcgcaaaagatg

SEQ ID NO: 215692 - DNA, 103 bp, Artificial Sequence
  Synthetic Polynucleotide
taatacgactcactatagggcatctcggtgcccagctcatggaatttgtcaacagaggagagacaaaatgcatgagctgaacctggcggcagcgcaaaagatg

SEQ ID NO: 215693 - DNA, 103 bp, Artificial Sequence
  Synthetic Polynucleotide
taatacgactcactatagggtggtgatgatcatctcggtgcccagctcataacagaggagaatgagcatggcaccgagaaacctggcggcagcgcaaaagatg

SEQ ID NO: 215694 - DNA, 103 bp, Artificial Sequence
  Synthetic Polynucleotide
taatacgactcactatagggctgcccgacttggtgatgatcatctcggtgaacagaggagacaccgaatggatcatcacaacctggcggcagcgcaaaagatg

SEQ ID NO: 215695 - DNA, 103 bp, Artificial Sequence
  Synthetic Polynucleotide
taatacgactcactatagggaaacatcctcctgcccgacttggtgatgataacagaggagaatcatcatgaagtcgggcaacctggcggcagcgcaaaagatg

SEQ ID NO: 215696 - DNA, 103 bp, Artificial Sequence
  Synthetic Polynucleotide
taatacgactcactatagggggatggttggaaacatcctcctgcccgactaacagaggagaagtcggatgggaggatgtaacctggcggcagcgcaaaagatg

SEQ ID NO: 215697 - DNA, 103 bp, Artificial Sequence
  Synthetic Polynucleotide
taatacgactcactatagggaaggacacccggatggttggaaacatcctcaacagaggagagaggatatgtccaaccataacctggcggcagcgcaaaagatg

SEQ ID NO: 215698 - DNA, 103 bp, Artificial Sequence
  Synthetic Polynucleotide
taatacgactcactatagggaatggagaaggcgttggcccgagaggagagaacagaggagactctccatgcgggccaacaacctggcggcagcgcaaaagatg

SEQ ID NO: 215699 - DNA, 103 bp, Artificial Sequence
  Synthetic Polynucleotide
taatacgactcactatagggcacccccgaaaaggacacccggatggttggaacagaggagaccaaccatgcgggtgtccaacctggcggcagcgcaaaagatg

SEQ ID NO: 215700 - DNA, 103 bp, Artificial Sequence
  Synthetic Polynucleotide
taatacgactcactatagggcctcaggatccacccccgaaaaggacacccaacagaggagagggtgtatgtttcgggggaacctggcggcagcgcaaaagatg

SEQ ID NO: 215701 - DNA, 103 bp, Artificial Sequence
  Synthetic Polynucleotide
taatacgactcactatagggatgtacttggcctcaggatccacccccgaaaacagaggagattcgggatgggatcctgaaacctggcggcagcgcaaaagatg

SEQ ID NO: 215702 - DNA, 103 bp, Artificial Sequence
  Synthetic Polynucleotide
taatacgactcactatagggcatcaggactatgtacttggcctcaggatcaacagaggagagatcctatggccaagtacaacctggcggcagcgcaaaagatg

SEQ ID NO: 215703 - DNA, 103 bp, Artificial Sequence
  Synthetic Polynucleotide
taatacgactcactatagggggacgatgtccatcaggactatgtacttggaacagaggagaccaagtatgtagtcctgaaacctggcggcagcgcaaaagatg

SEQ ID NO: 215704 - DNA, 103 bp, Artificial Sequence
  Synthetic Polynucleotide
taatacgactcactatagggttgtccacagggacgatgtccatcaggactaacagaggagaagtcctatgggacatcgtaacctggcggcagcgcaaaagatg

SEQ ID NO: 215705 - DNA, 103 bp, Artificial Sequence
  Synthetic Polynucleotide
taatacgactcactataggggtacctcttgttgtccacagggacgatgtcaacagaggagagacatcatgcctgtggacaacctggcggcagcgcaaaagatg

SEQ ID NO: 215706 - DNA, 103 bp, Artificial Sequence
  Synthetic Polynucleotide
taatacgactcactatagggaggcgtagcggtacctcttgttgtccacagaacagaggagactgtggatgacaagaggtaacctggcggcagcgcaaaagatg

SEQ ID NO: 215707 - DNA, 103 bp, Artificial Sequence
  Synthetic Polynucleotide
taatacgactcactataggggaccggtggtaggcgtagcggtacctcttgaacagaggagacaagagatgccgctacgcaacctggcggcagcgcaaaagatg

SEQ ID NO: 215708 - DNA, 103 bp, Artificial Sequence
  Synthetic Polynucleotide
taatacgactcactatagggcagccaggaggaccggtggtaggcgtagcgaacagaggagacgctacatgtaccaccggaacctggcggcagcgcaaaagatg

SEQ ID NO: 215709 - DNA, 103 bp, Artificial Sequence
  Synthetic Polynucleotide
taatacgactcactatagggtgagcgcggcaatggagaaggcgttggcccaacagaggagagggccaatgccttctccaaacctggcggcagcgcaaaagatg

SEQ ID NO: 215710 - DNA, 103 bp, Artificial Sequence
  Synthetic Polynucleotide
taatacgactcactatagggtgccagccaccagccaggaggaccggtggtaacagaggagaaccaccatgcctcctggcaacctggcggcagcgcaaaagatg

SEQ ID NO: 215711 - DNA, 103 bp, Artificial Sequence
  Synthetic Polynucleotide
taatacgactcactataggggggtcggccttgccagccaccagccaggagaacagaggagactcctgatgggtggctggaacctggcggcagcgcaaaagatg

SEQ ID NO: 215712 - DNA, 103 bp, Artificial Sequence
  Synthetic Polynucleotide
taatacgactcactatagggtggcaacggcgggtcggccttgccagccacaacagaggagagtggctatgaaggccgacaacctggcggcagcgcaaaagatg

SEQ ID NO: 215713 - DNA, 103 bp, Artificial Sequence
  Synthetic Polynucleotide
taatacgactcactatagggagagcctggctggcaacggcgggtcggcctaacagaggagaaggccgatgcgccgttgcaacctggcggcagcgcaaaagatg

SEQ ID NO: 215714 - DNA, 103 bp, Artificial Sequence
  Synthetic Polynucleotide
taatacgactcactatagggggatgcacatagagcctggctggcaacggcaacagaggagagccgttatgagccaggctaacctggcggcagcgcaaaagatg

SEQ ID NO: 215715 - DNA, 103 bp, Artificial Sequence
  Synthetic Polynucleotide
taatacgactcactatagggaggagaatctggatgcacatagagcctggcaacagaggagagccaggatgtatgtgcataacctggcggcagcgcaaaagatg

SEQ ID NO: 215716 - DNA, 103 bp, Artificial Sequence
  Synthetic Polynucleotide
taatacgactcactatagggcaccggtaaaaggagaatctggatgcacataacagaggagaatgtgcatgcagattctcaacctggcggcagcgcaaaagatg

SEQ ID NO: 215717 - DNA, 103 bp, Artificial Sequence
  Synthetic Polynucleotide
taatacgactcactatagggagtagttgctcaccggtaaaaggagaatctaacagaggagaagattcatgttttaccggaacctggcggcagcgcaaaagatg

SEQ ID NO: 215718 - DNA, 103 bp, Artificial Sequence
  Synthetic Polynucleotide
taatacgactcactatagggcatctgtttgagtagttgctcaccggtaaaaacagaggagatttaccatggagcaactaaacctggcggcagcgcaaaagatg

SEQ ID NO: 215719 - DNA, 103 bp, Artificial Sequence
  Synthetic Polynucleotide
taatacgactcactatagggcaaaagacaccatctgtttgagtagttgctaacagaggagaagcaacatgtcaaacagaaacctggcggcagcgcaaaagatg

SEQ ID NO: 215720 - DNA, 103 bp, Artificial Sequence
  Synthetic Polynucleotide
taatacgactcactatagggccgctcgacatgagcgcggcaatggagaagaacagaggagacttctcatgtgccgcgctaacctggcggcagcgcaaaagatg

SEQ ID NO: 215721 - DNA, 103 bp, Artificial Sequence
  Synthetic Polynucleotide
taatacgactcactatagggttcaccttttcaaaagacaccatctgtttgaacagaggagacaaacaatgggtgtctttaacctggcggcagcgcaaaagatg

SEQ ID NO: 215722 - DNA, 103 bp, Artificial Sequence
  Synthetic Polynucleotide
taatacgactcactataggggttggtgagtttcaccttttcaaaagacacaacagaggagagtgtctatggaaaaggtgaacctggcggcagcgcaaaagatg

SEQ ID NO: 215723 - DNA, 103 bp, Artificial Sequence
  Synthetic Polynucleotide
taatacgactcactatagggccagttcattgttggtgagtttcaccttttaacagaggagaaaaaggatgaactcaccaaacctggcggcagcgcaaaagatg

SEQ ID NO: 215724 - DNA, 103 bp, Artificial Sequence
  Synthetic Polynucleotide
taatacgactcactatagggccatgttgatccagttcattgttggtgagtaacagaggagaactcacatgcaatgaactaacctggcggcagcgcaaaagatg

SEQ ID NO: 215725 - DNA, 103 bp, Artificial Sequence
  Synthetic Polynucleotide
taatacgactcactatagggaattatatggccatgttgatccagttcattaacagaggagaaatgaaatggatcaacataacctggcggcagcgcaaaagatg

SEQ ID NO: 215726 - DNA, 103 bp, Artificial Sequence
  Synthetic Polynucleotide
taatacgactcactatagggttgagttcaaaattatatggccatgttgataacagaggagaatcaacatggccatataaaacctggcggcagcgcaaaagatg

SEQ ID NO: 215727 - DNA, 103 bp, Artificial Sequence
  Synthetic Polynucleotide
taatacgactcactatagggtacttatgcattgagttcaaaattatatggaacagaggagaccatatatgtttgaactcaacctggcggcagcgcaaaagatg

SEQ ID NO: 215728 - DNA, 103 bp, Artificial Sequence
  Synthetic Polynucleotide
taatacgactcactatagggccttggctggtacttatgcattgagttcaaaacagaggagattgaacatgatgcataagaacctggcggcagcgcaaaagatg

SEQ ID NO: 215729 - DNA, 103 bp, Artificial Sequence
  Synthetic Polynucleotide
taatacgactcactatagggtgatgtgcacccttggctggtacttatgcaaacagaggagatgcataatgaccagccaaaacctggcggcagcgcaaaagatg

SEQ ID NO: 215730 - DNA, 103 bp, Artificial Sequence
  Synthetic Polynucleotide
taatacgactcactatagggttcttcttaatgatgtgcacccttggctggaacagaggagaccagccatgggtgcacataacctggcggcagcgcaaaagatg

SEQ ID NO: 215731 - DNA, 103 bp, Artificial Sequence
  Synthetic Polynucleotide
taatacgactcactatagggcttagagccgccgctcgacatgagcgcggcaacagaggagagccgcgatgatgtcgagcaacctggcggcagcgcaaaagatg

SEQ ID NO: 215732 - DNA, 103 bp, Artificial Sequence
  Synthetic Polynucleotide
taatacgactcactatagggtgtgtggtctttcttcttaatgatgtgcacaacagaggagagtgcacatgattaagaagaacctggcggcagcgcaaaagatg

SEQ ID NO: 215733 - DNA, 103 bp, Artificial Sequence
  Synthetic Polynucleotide
taatacgactcactataggggcaatgaggctgtgtggtctttcttcttaaaacagaggagattaagaatgaagaccacaaacctggcggcagcgcaaaagatg

SEQ ID NO: 215734 - DNA, 103 bp, Artificial Sequence
  Synthetic Polynucleotide
taatacgactcactatagggttcaggttgagcaatgaggctgtgtggtctaacagaggagaagaccaatgagcctcattaacctggcggcagcgcaaaagatg

SEQ ID NO: 215735 - DNA, 103 bp, Artificial Sequence
  Synthetic Polynucleotide
taatacgactcactatagggttcttcagacttcaggttgagcaatgaggcaacagaggagagcctcaatgctcaacctgaacctggcggcagcgcaaaagatg

SEQ ID NO: 215736 - DNA, 103 bp, Artificial Sequence
  Synthetic Polynucleotide
taatacgactcactatagggaagttctaaattcttcagacttcaggttgaaacagaggagatcaaccatgagtctgaagaacctggcggcagcgcaaaagatg

SEQ ID NO: 215737 - DNA, 103 bp, Artificial Sequence
  Synthetic Polynucleotide
taatacgactcactatagggggaaagatgaaagttctaaattcttcagacaacagaggagagtctgaatgatttagaacaacctggcggcagcgcaaaagatg

SEQ ID NO: 215738 - DNA, 103 bp, Artificial Sequence
  Synthetic Polynucleotide
taatacgactcactatagggaactgtttctggaaagatgaaagttctaaaaacagaggagatttagaatgttcatctttaacctggcggcagcgcaaaagatg

SEQ ID NO: 215739 - DNA, 103 bp, Artificial Sequence
  Synthetic Polynucleotide
taatacgactcactatagggctgccgtaaaaactgtttctggaaagatgaaacagaggagatcatctatgcagaaacagaacctggcggcagcgcaaaagatg

SEQ ID NO: 215740 - DNA, 103 bp, Artificial Sequence
  Synthetic Polynucleotide
taatacgactcactatagggtaggcagtgactgccgtaaaaactgtttctaacagaggagaagaaacatgttttacggcaacctggcggcagcgcaaaagatg

SEQ ID NO: 215741 - DNA, 103 bp, Artificial Sequence
  Synthetic Polynucleotide
taatacgactcactatagggttgattctggtaggcagtgactgccgtaaaaacagaggagatttacgatggtcactgccaacctggcggcagcgcaaaagatg

SEQ ID NO: 215742 - DNA, 103 bp, Artificial Sequence
  Synthetic Polynucleotide
taatacgactcactatagggcctccttctccttagagccgccgctcgacaaacagaggagatgtcgaatggcggctctaaacctggcggcagcgcaaaagatg

SEQ ID NO: 215743 - DNA, 103 bp, Artificial Sequence
  Synthetic Polynucleotide
taatacgactcactatagggtcgttatcagttgattctggtaggcagtgaaacagaggagatcactgatgaccagaatcaacctggcggcagcgcaaaagatg

SEQ ID NO: 215744 - DNA, 103 bp, Artificial Sequence
  Synthetic Polynucleotide
taatacgactcactatagggattttcagcttcgttatcagttgattctggaacagaggagaccagaaatgactgataacaacctggcggcagcgcaaaagatg

SEQ ID NO: 215745 - DNA, 103 bp, Artificial Sequence
  Synthetic Polynucleotide
taatacgactcactatagggattgctatctattttcagcttcgttatcagaacagaggagactgataatgaagctgaaaaacctggcggcagcgcaaaagatg

SEQ ID NO: 215746 - DNA, 103 bp, Artificial Sequence
  Synthetic Polynucleotide
taatacgactcactatagggtggcaaaaggattgctatctattttcagctaacagaggagaagctgaatgtagatagcaaacctggcggcagcgcaaaagatg

SEQ ID NO: 215747 - DNA, 103 bp, Artificial Sequence
  Synthetic Polynucleotide
taatacgactcactatagggcggaatcctttggcaaaaggattgctatctaacagaggagaagatagatgtccttttgcaacctggcggcagcgcaaaagatg

SEQ ID NO: 215748 - DNA, 103 bp, Artificial Sequence
  Synthetic Polynucleotide
taatacgactcactatagggggaggaatcccggaatcctttggcaaaaggaacagaggagaccttttatgaaaggattcaacctggcggcagcgcaaaagatg

SEQ ID NO: 215749 - DNA, 103 bp, Artificial Sequence
  Synthetic Polynucleotide
taatacgactcactatagggcagtgagcctggaggaatcccggaatccttaacagaggagaaaggatatggggattcctaacctggcggcagcgcaaaagatg

SEQ ID NO: 215750 - DNA, 103 bp, Artificial Sequence
  Synthetic Polynucleotide
taatacgactcactatagggctctcaatgtcagtgagcctggaggaatccaacagaggagaggattcatgcaggctcacaacctggcggcagcgcaaaagatg

SEQ ID NO: 215751 - DNA, 103 bp, Artificial Sequence
  Synthetic Polynucleotide
taatacgactcactatagggcacactttccctctcaatgtcagtgagcctaacagaggagaaggctcatggacattgagaacctggcggcagcgcaaaagatg

SEQ ID NO: 215752 - DNA, 103 bp, Artificial Sequence
  Synthetic Polynucleotide
taatacgactcactatagggtcaggctctccacactttccctctcaatgtaacagaggagaacattgatggggaaagtgaacctggcggcagcgcaaaagatg

SEQ ID NO: 215753 - DNA, 103 bp, Artificial Sequence
  Synthetic Polynucleotide
taatacgactcactatagggttctccgtcgcctccttctccttagagccgaacagaggagacggctcatgggagaaggaaacctggcggcagcgcaaaagatg

SEQ ID NO: 215754 - DNA, 103 bp, Artificial Sequence
  Synthetic Polynucleotide
taatacgactcactatagggtgcttttgaatcaggctctccacactttccaacagaggagaggaaagatgggagagcctaacctggcggcagcgcaaaagatg

SEQ ID NO: 215755 - DNA, 103 bp, Artificial Sequence
  Synthetic Polynucleotide
taatacgactcactatagggtgcataggaatgcttttgaatcaggctctcaacagaggagagagagcatgattcaaaagaacctggcggcagcgcaaaagatg

SEQ ID NO: 215756 - DNA, 103 bp, Artificial Sequence
  Synthetic Polynucleotide
taatacgactcactatagggtgggtgagcgtgcataggaatgcttttgaaaacagaggagattcaaaatgattcctatgaacctggcggcagcgcaaaagatg

SEQ ID NO: 215757 - DNA, 103 bp, Artificial Sequence
  Synthetic Polynucleotide
taatacgactcactatagggtaggtacggatgggtgagcgtgcataggaaaacagaggagattcctaatgacgctcaccaacctggcggcagcgcaaaagatg

SEQ ID NO: 215758 - DNA, 103 bp, Artificial Sequence
  Synthetic Polynucleotide
taatacgactcactatagggttctcctccgtaggtacggatgggtgagcgaacagaggagacgctcaatgatccgtaccaacctggcggcagcgcaaaagatg

SEQ ID NO: 215759 - DNA, 103 bp, Artificial Sequence
  Synthetic Polynucleotide
taatacgactcactatagggagacatcttcttctcctccgtaggtacggaaacagaggagatccgtaatgacggaggagaacctggcggcagcgcaaaagatg

SEQ ID NO: 215760 - DNA, 103 bp, Artificial Sequence
  Synthetic Polynucleotide
taatacgactcactatagggtcatcccccaagacatcttcttctcctccgaacagaggagacggaggatgagaagatgtaacctggcggcagcgcaaaagatg

SEQ ID NO: 215761 - DNA, 103 bp, Artificial Sequence
  Synthetic Polynucleotide
taatacgactcactatagggtgtctgactctcatcccccaagacatcttcaacagaggagagaagatatgttgggggataacctggcggcagcgcaaaagatg

SEQ ID NO: 215762 - DNA, 103 bp, Artificial Sequence
  Synthetic Polynucleotide
taatacgactcactataggggatttggggttgtctgactctcatcccccaaacagaggagatgggggatgagagtcagaaacctggcggcagcgcaaaagatg

SEQ ID NO: 215763 - DNA, 103 bp, Artificial Sequence
  Synthetic Polynucleotide
taatacgactcactataggggctgaccctcgatttggggttgtctgactcaacagaggagagagtcaatgaaccccaaaaacctggcggcagcgcaaaagatg

SEQ ID NO: 215764 - DNA, 103 bp, Artificial Sequence
  Synthetic Polynucleotide
taatacgactcactataggggtctccgcaacccggctccacgatgcccataacagaggagaatgggcatggtggagccgaacctggcggcagcgcaaaagatg

SEQ ID NO: 215765 - DNA, 103 bp, Artificial Sequence
  Synthetic Polynucleotide
taatacgactcactatagggcggctccgggtagaagtagcggtgctgcggaacagaggagaccgcagatgcgctacttcaacctggcggcagcgcaaaagatg

SEQ ID NO: 215766 - DNA, 103 bp, Artificial Sequence
  Synthetic Polynucleotide
taatacgactcactatagggggggatgctggtgtcaacagatgtgtacataacagaggagaatgtacatgtctgttgacaacctggcggcagcgcaaaagatg

SEQ ID NO: 215767 - DNA, 103 bp, Artificial Sequence
  Synthetic Polynucleotide
taatacgactcactatagggcaggcggggaggggatgctggtgtcaacagaacagaggagactgttgatgccagcatccaacctggcggcagcgcaaaagatg

SEQ ID NO: 215768 - DNA, 103 bp, Artificial Sequence
  Synthetic Polynucleotide
taatacgactcactatagggcagttgggtccaggcggggaggggatgctgaacagaggagacagcatatgctccccgccaacctggcggcagcgcaaaagatg

SEQ ID NO: 215769 - DNA, 103 bp, Artificial Sequence
  Synthetic Polynucleotide
taatacgactcactatagggaaggaattgacagttgggtccaggcggggaaacagaggagatccccgatgggacccaacaacctggcggcagcgcaaaagatg

SEQ ID NO: 215770 - DNA, 103 bp, Artificial Sequence
  Synthetic Polynucleotide
taatacgactcactataggggatctcccccaaggaattgacagttgggtcaacagaggagagacccaatggtcaattccaacctggcggcagcgcaaaagatg

SEQ ID NO: 215771 - DNA, 103 bp, Artificial Sequence
  Synthetic Polynucleotide
taatacgactcactatagggggagagtagtgatctcccccaaggaattgaaacagaggagatcaattatgtgggggagaaacctggcggcagcgcaaaagatg

SEQ ID NO: 215772 - DNA, 103 bp, Artificial Sequence
  Synthetic Polynucleotide
taatacgactcactataggggggtaggagaggagagtagtgatctcccccaacagaggagagggggaatgcactactctaacctggcggcagcgcaaaagatg

SEQ ID NO: 215773 - DNA, 103 bp, Artificial Sequence
  Synthetic Polynucleotide
taatacgactcactataggggatactggttgggtaggagaggagagtagtaacagaggagaactactatgctctcctacaacctggcggcagcgcaaaagatg

SEQ ID NO: 215774 - DNA, 103 bp, Artificial Sequence
  Synthetic Polynucleotide
taatacgactcactatagggctgggaacaggatactggttgggtaggagaaacagaggagatctcctatgcaaccagtaaacctggcggcagcgcaaaagatg

SEQ ID NO: 215775 - DNA, 103 bp, Artificial Sequence
  Synthetic Polynucleotide
taatacgactcactataggggtagaagcggctgggaacaggatactggttaacagaggagaaaccagatgcctgttcccaacctggcggcagcgcaaaagatg

SEQ ID NO: 215776 - DNA, 103 bp, Artificial Sequence
  Synthetic Polynucleotide
taatacgactcactatagggcctgcgcgcccggctccgggtagaagtagcaacagaggagagctactatgacccggagcaacctggcggcagcgcaaaagatg

SEQ ID NO: 215777 - DNA, 103 bp, Artificial Sequence
  Synthetic Polynucleotide
taatacgactcactataggggaaggtcggggtagaagcggctgggaacagaacagaggagactgttcatggccgcttctaacctggcggcagcgcaaaagatg

SEQ ID NO: 215778 - DNA, 103 bp, Artificial Sequence
  Synthetic Polynucleotide
taatacgactcactataggggcctggccaggaaggtcggggtagaagcggaacagaggagaccgcttatgccccgacctaacctggcggcagcgcaaaagatg

SEQ ID NO: 215779 - DNA, 103 bp, Artificial Sequence
  Synthetic Polynucleotide
taatacgactcactatagggcacatccttcgcctggccaggaaggtcgggaacagaggagacccgacatgcctggccagaacctggcggcagcgcaaaagatg

SEQ ID NO: 215780 - DNA, 103 bp, Artificial Sequence
  Synthetic Polynucleotide
taatacgactcactatagggcctggggaaccacatccttcgcctggccagaacagaggagactggccatgcgaaggatgaacctggcggcagcgcaaaagatg

SEQ ID NO: 215781 - DNA, 103 bp, Artificial Sequence
  Synthetic Polynucleotide
taatacgactcactatagggagccagtaagcctggggaaccacatccttcaacagaggagagaaggaatgggttccccaaacctggcggcagcgcaaaagatg

SEQ ID NO: 215782 - DNA, 103 bp, Artificial Sequence
  Synthetic Polynucleotide
taatacgactcactataggggggggcccccagccagtaagcctggggaacaacagaggagagttcccatggcttactggaacctggcggcagcgcaaaagatg

SEQ ID NO: 215783 - DNA, 103 bp, Artificial Sequence
  Synthetic Polynucleotide
taatacgactcactatagggtgtggtcccggggggcccccagccagtaagaacagaggagacttactatgtgggggcccaacctggcggcagcgcaaaagatg

SEQ ID NO: 215784 - DNA, 103 bp, Artificial Sequence
  Synthetic Polynucleotide
taatacgactcactataggggcctcatagctgtggtcccggggggcccccaacagaggagagggggcatgccgggaccaaacctggcggcagcgcaaaagatg

SEQ ID NO: 215785 - DNA, 103 bp, Artificial Sequence
  Synthetic Polynucleotide
taatacgactcactatagggtcgaaactcagcctcatagctgtggtcccgaacagaggagacgggacatgagctatgagaacctggcggcagcgcaaaagatg

SEQ ID NO: 215786 - DNA, 103 bp, Artificial Sequence
  Synthetic Polynucleotide
taatacgactcactatagggtgctgactgctcgaaactcagcctcatagcaacagaggagagctatgatgctgagtttcaacctggcggcagcgcaaaagatg

SEQ ID NO: 215787 - DNA, 103 bp, Artificial Sequence
  Synthetic Polynucleotide
taatacgactcactatagggtcgtccgcgtcctgcgcgcccggctccgggaacagaggagacccggaatggggcgcgcaaacctggcggcagcgcaaaagatg

SEQ ID NO: 215788 - DNA, 103 bp, Artificial Sequence
  Synthetic Polynucleotide
taatacgactcactataggggcaggcttcatgctgactgctcgaaactcaaacagaggagatgagttatgagcagtcagaacctggcggcagcgcaaaagatg

SEQ ID NO: 215789 - DNA, 103 bp, Artificial Sequence
  Synthetic Polynucleotide
taatacgactcactataggggggcaagaatgcaggcttcatgctgactgcaacagaggagagcagtcatgatgaagcctaacctggcggcagcgcaaaagatg

SEQ ID NO: 215790 - DNA, 103 bp, Artificial Sequence
  Synthetic Polynucleotide
taatacgactcactatagggcaggggcagagggcaagaatgcaggcttcaaacagaggagatgaagcatgcattcttgcaacctggcggcagcgcaaaagatg

SEQ ID NO: 215791 - DNA, 103 bp, Artificial Sequence
  Synthetic Polynucleotide
taatacgactcactatagggatggtgggcccaggggcagagggcaagaataacagaggagaattcttatgctctgccccaacctggcggcagcgcaaaagatg

SEQ ID NO: 215792 - DNA, 103 bp, Artificial Sequence
  Synthetic Polynucleotide
taatacgactcactataggggtagtaggacatggtgggcccaggggcagaaacagaggagatctgccatggggcccaccaacctggcggcagcgcaaaagatg

SEQ ID NO: 215793 - DNA, 103 bp, Artificial Sequence
  Synthetic Polynucleotide
taatacgactcactatagggcctggcctcggtagtaggacatggtgggccaacagaggagaggcccaatgtgtcctactaacctggcggcagcgcaaaagatg

SEQ ID NO: 215794 - DNA, 103 bp, Artificial Sequence
  Synthetic Polynucleotide
taatacgactcactataggggccaggacctcctggcctcggtagtaggacaacagaggagagtcctaatgccgaggccaaacctggcggcagcgcaaaagatg

SEQ ID NO: 215795 - DNA, 103 bp, Artificial Sequence
  Synthetic Polynucleotide
taatacgactcactatagggagctccaggtgccaggacctcctggcctcgaacagaggagacgaggcatggaggtcctgaacctggcggcagcgcaaaagatg

SEQ ID NO: 215796 - DNA, 103 bp, Artificial Sequence
  Synthetic Polynucleotide
taatacgactcactatagggcaggccagccagctccaggtgccaggacctaacagaggagaaggtccatgcacctggagaacctggcggcagcgcaaaagatg

SEQ ID NO: 215797 - DNA, 103 bp, Artificial Sequence
  Synthetic Polynucleotide
taatacgactcactatagggtggggtgccacaggccagccagctccaggtaacagaggagaacctggatgtggctggccaacctggcggcagcgcaaaagatg

SEQ ID NO: 215798 - DNA, 103 bp, Artificial Sequence
  Synthetic Polynucleotide
taatacgactcactatagggcccgcgacgctcgtccgcgtcctgcgcgccaacagaggagaggcgcgatggacgcggacaacctggcggcagcgcaaaagatg

SEQ ID NO: 215799 - DNA, 103 bp, Artificial Sequence
  Synthetic Polynucleotide
taatacgactcactataggggggagggtactggggtgccacaggccagccaacagaggagaggctggatggtggcacccaacctggcggcagcgcaaaagatg

SEQ ID NO: 215800 - DNA, 103 bp, Artificial Sequence
  Synthetic Polynucleotide
taatacgactcactatagggggcccatcttgggagggtactggggtgccaaacagaggagatggcacatgagtaccctcaacctggcggcagcgcaaaagatg

SEQ ID NO: 215801 - DNA, 103 bp, Artificial Sequence
  Synthetic Polynucleotide
taatacgactcactatagggcagctggccgggcccatcttgggagggtacaacagaggagagtacccatgcaagatgggaacctggcggcagcgcaaaagatg

SEQ ID NO: 215802 - DNA, 103 bp, Artificial Sequence
  Synthetic Polynucleotide
taatacgactcactatagggagggcggaaccagctggccgggcccatcttaacagaggagaaagatgatgccggccagcaacctggcggcagcgcaaaagatg

SEQ ID NO: 215803 - DNA, 103 bp, Artificial Sequence
  Synthetic Polynucleotide
taatacgactcactataggggagtccgcatagggcggaaccagctggccgaacagaggagacggccaatgggttccgccaacctggcggcagcgcaaaagatg

SEQ ID NO: 215804 - DNA, 103 bp, Artificial Sequence
  Synthetic Polynucleotide
taatacgactcactatagggtccatgggcagagtccgcatagggcggaacaacagaggagagttccgatgtatgcggacaacctggcggcagcgcaaaagatg

SEQ ID NO: 215805 - DNA, 103 bp, Artificial Sequence
  Synthetic Polynucleotide
taatacgactcactatagggagggccgggttccatgggcagagtccgcataacagaggagaatgcggatgctgcccatgaacctggcggcagcgcaaaagatg

SEQ ID NO: 215806 - DNA, 103 bp, Artificial Sequence
  Synthetic Polynucleotide
taatacgactcactatagggctgagcctccagggccgggttccatgggcaaacagaggagatgcccaatgaacccggccaacctggcggcagcgcaaaagatg

SEQ ID NO: 215807 - DNA, 103 bp, Artificial Sequence
  Synthetic Polynucleotide
taatacgactcactatagggccccgtccctctgagcctccagggccgggtaacagaggagaacccggatgtggaggctcaacctggcggcagcgcaaaagatg

SEQ ID NO: 215808 - DNA, 103 bp, Artificial Sequence
  Synthetic Polynucleotide
taatacgactcactataggggtcctctggtccccgtccctctgagcctccaacagaggagaggaggcatggagggacggaacctggcggcagcgcaaaagatg

SEQ ID NO: 215809 - DNA, 103 bp, Artificial Sequence
  Synthetic Polynucleotide
taatacgactcactatagggggctgccgcccccgcgacgctcgtccgcgtaacagaggagaacgcggatgagcgtcgcgaacctggcggcagcgcaaaagatg

SEQ ID NO: 215810 - DNA, 103 bp, Artificial Sequence
  Synthetic Polynucleotide
taatacgactcactatagggggggaccctggtcctctggtccccgtccctaacagaggagaagggacatggaccagaggaacctggcggcagcgcaaaagatg

SEQ ID NO: 215811 - DNA, 103 bp, Artificial Sequence
  Synthetic Polynucleotide
taatacgactcactatagggcacaccaaggggggaccctggtcctctggtaacagaggagaaccagaatgccagggtccaacctggcggcagcgcaaaagatg

SEQ ID NO: 215812 - DNA, 103 bp, Artificial Sequence
  Synthetic Polynucleotide
taatacgactcactatagggaatctcagtccacaccaaggggggaccctgaacagaggagacagggtatgcccttggtgaacctggcggcagcgcaaaagatg

SEQ ID NO: 215813 - DNA, 103 bp, Artificial Sequence
  Synthetic Polynucleotide
taatacgactcactatagggggatgggggcaatctcagtccacaccaaggaacagaggagaccttggatgggactgagaaacctggcggcagcgcaaaagatg

SEQ ID NO: 215814 - DNA, 103 bp, Artificial Sequence
  Synthetic Polynucleotide
taatacgactcactataggggattccggccggatgggggcaatctcagtcaacagaggagagactgaatgtgcccccataacctggcggcagcgcaaaagatg

SEQ ID NO: 215815 - DNA, 103 bp, Artificial Sequence
  Synthetic Polynucleotide
taatacgactcactatagggtgaatcactggattccggccggatgggggcaacagaggagagcccccatgcggccggaaaacctggcggcagcgcaaaagatg

SEQ ID NO: 215816 - DNA, 103 bp, Artificial Sequence
  Synthetic Polynucleotide
taatacgactcactatagggcgcccagtcctgaatcactggattccggccaacagaggagaggccggatgccagtgattaacctggcggcagcgcaaaagatg

SEQ ID NO: 215817 - DNA, 103 bp, Artificial Sequence
  Synthetic Polynucleotide
taatacgactcactataggggagtctccttcgcccagtcctgaatcactgaacagaggagacagtgaatgaggactgggaacctggcggcagcgcaaaagatg

SEQ ID NO: 215818 - DNA, 103 bp, Artificial Sequence
  Synthetic Polynucleotide
taatacgactcactatagggcctcctcttagagtctccttcgcccagtccaacagaggagaggactgatggaaggagacaacctggcggcagcgcaaaagatg

SEQ ID NO: 215819 - DNA, 103 bp, Artificial Sequence
  Synthetic Polynucleotide
taatacgactcactataggggggacacgcgcctcctcttagagtctccttaacagaggagaaaggagatgctaagaggaaacctggcggcagcgcaaaagatg

SEQ ID NO: 215820 - DNA, 103 bp, Artificial Sequence
  Synthetic Polynucleotide
taatacgactcactatagggggagaccccaggctgccgcccccgcgacgcaacagaggagagcgtcgatggggcggcagaacctggcggcagcgcaaaagatg

SEQ ID NO: 215821 - DNA, 103 bp, Artificial Sequence
  Synthetic Polynucleotide
taatacgactcactataggggaaggatagggggacacgcgcctcctcttaaacagaggagataagagatggcgcgtgtcaacctggcggcagcgcaaaagatg

SEQ ID NO: 215822 - DNA, 103 bp, Artificial Sequence
  Synthetic Polynucleotide
taatacgactcactataggggtcaccactggaaggatagggggacacgcgaacagaggagacgcgtgatgccctatcctaacctggcggcagcgcaaaagatg

SEQ ID NO: 215823 - DNA, 103 bp, Artificial Sequence
  Synthetic Polynucleotide
taatacgactcactataggggggaggagctgtcaccactggaaggataggaacagaggagacctatcatgccagtggtgaacctggcggcagcgcaaaagatg

SEQ ID NO: 215824 - DNA, 103 bp, Artificial Sequence
  Synthetic Polynucleotide
taatacgactcactataggggccccagcaggggaggagctgtcaccactgaacagaggagacagtggatgcagctcctcaacctggcggcagcgcaaaagatg

SEQ ID NO: 215825 - DNA, 103 bp, Artificial Sequence
  Synthetic Polynucleotide
taatacgactcactatagggaggagaaggggccccagcaggggaggagctaacagaggagaagctccatgcctgctgggaacctggcggcagcgcaaaagatg

SEQ ID NO: 215826 - DNA, 103 bp, Artificial Sequence
  Synthetic Polynucleotide
taatacgactcactatagggccttatcaaaaggagaaggggccccagcagaacagaggagactgctgatgccccttctcaacctggcggcagcgcaaaagatg

SEQ ID NO: 215827 - DNA, 103 bp, Artificial Sequence
  Synthetic Polynucleotide
taatacgactcactatagggccttcagcttccttatcaaaaggagaagggaacagaggagacccttcatgttttgataaaacctggcggcagcgcaaaagatg

SEQ ID NO: 215828 - DNA, 103 bp, Artificial Sequence
  Synthetic Polynucleotide
taatacgactcactatagggataaaactgtccttcagcttccttatcaaaaacagaggagatttgatatggaagctgaaaacctggcggcagcgcaaaagatg

SEQ ID NO: 215829 - DNA, 103 bp, Artificial Sequence
  Synthetic Polynucleotide
taatacgactcactataggggaaaatagttataaaactgtccttcagcttaacagaggagaaagctgatggacagttttaacctggcggcagcgcaaaagatg

SEQ ID NO: 215830 - DNA, 103 bp, Artificial Sequence
  Synthetic Polynucleotide
taatacgactcactatagggccccgggtagggagaccccaggctgccgccaacagaggagaggcggcatgctggggtctaacctggcggcagcgcaaaagatg

SEQ ID NO: 215831 - DNA, 103 bp, Artificial Sequence
  Synthetic Polynucleotide
taatacgactcactatagggccaaggcgccccccgggtagggagaccccaaacagaggagatggggtatgcctacccggaacctggcggcagcgcaaaagatg

SEQ ID NO: 215832 - DNA, 103 bp, Artificial Sequence
  Synthetic Polynucleotide
taatacgactcactatagggggggcgggcaccaaggcgccccccgggtagaacagaggagactacccatggggcgccttaacctggcggcagcgcaaaagatg

SEQ ID NO: 215833 - DNA, 103 bp, Artificial Sequence
  Synthetic Polynucleotide
taatacgactcactataggggcggctcggcggggcgggcaccaaggcgccaacagaggagaggcgccatggtgcccgccaacctggcggcagcgcaaaagatg

SEQ ID NO: 215834 - DNA, 103 bp, Artificial Sequence
  Synthetic Polynucleotide
taatacgactcactatagggccgtcagcatgtctccgcaacccggctccaaacagaggagatggagcatggttgcggagaacctggcggcagcgcaaaagatg

SEQ ID NO: 215835 - DNA, 103 bp, Artificial Sequence
  Synthetic Polynucleotide
taatacgactcactatagggctccaaggaagcggctcggcggggcgggcaaacagaggagatgcccgatgcgccgagccaacctggcggcagcgcaaaagatg

SEQ ID NO: 215836 - DNA, 103 bp, Artificial Sequence
  Synthetic Polynucleotide
taatacgactcactatagggtaggcgtaggctccaaggaagcggctcggcaacagaggagagccgagatgcttccttggaacctggcggcagcgcaaaagatg

SEQ ID NO: 215837 - DNA, 103 bp, Artificial Sequence
  Synthetic Polynucleotide
taatacgactcactatagggtcgcggcgggtaggcgtaggctccaaggaaaacagaggagattccttatggcctacgccaacctggcggcagcgcaaaagatg

SEQ ID NO: 215838 - DNA, 103 bp, Artificial Sequence
  Synthetic Polynucleotide
taatacgactcactatagggccgcctggggtcgcggcgggtaggcgtaggaacagaggagacctacgatgacccgccgcaacctggcggcagcgcaaaagatg

SEQ ID NO: 215839 - DNA, 103 bp, Artificial Sequence
  Synthetic Polynucleotide
taatacgactcactataggggggaagccggccgcctggggtcgcggcgggaacagaggagacccgccatgaccccaggcaacctggcggcagcgcaaaagatg

SEQ ID NO: 215840 - DNA, 103 bp, Artificial Sequence
  Synthetic Polynucleotide
taatacgactcactataggggcccgcgccggggaagccggccgcctggggaacagaggagaccccagatggccggcttcaacctggcggcagcgcaaaagatg

SEQ ID NO: 215841 - DNA, 103 bp, Artificial Sequence
  Synthetic Polynucleotide
taatacgactcactatagggggaaggactcgcccgcgccggggaagccggaacagaggagaccggctatgccggcgcggaacctggcggcagcgcaaaagatg

SEQ ID NO: 215842 - DNA, 103 bp, Artificial Sequence
  Synthetic Polynucleotide
taatacgactcactataggggcgggcggcgggaaggactcgcccgcgccgaacagaggagacggcgcatgcgagtccttaacctggcggcagcgcaaaagatg

SEQ ID NO: 215843 - DNA, 103 bp, Artificial Sequence
  Synthetic Polynucleotide
taatacgactcactatagggctcggcgtccgcgggcggcgggaaggactcaacagaggagagagtccatgccgccgcccaacctggcggcagcgcaaaagatg

SEQ ID NO: 215844 - DNA, 103 bp, Artificial Sequence
  Synthetic Polynucleotide
taatacgactcactataggggctggtagccctcggcgtccgcgggcggcgaacagaggagacgccgcatgcggacgccgaacctggcggcagcgcaaaagatg

SEQ ID NO: 215845 - DNA, 103 bp, Artificial Sequence
  Synthetic Polynucleotide
taatacgactcactatagggggctcggtgcccgtcagcatgtctccgcaaaacagaggagattgcggatgcatgctgacaacctggcggcagcgcaaaagatg

SEQ ID NO: 215846 - DNA, 103 bp, Artificial Sequence
  Synthetic Polynucleotide
taatacgactcactatagggccctcgcccggctggtagccctcggcgtccaacagaggagaggacgcatggggctaccaaacctggcggcagcgcaaaagatg

SEQ ID NO: 215847 - DNA, 103 bp, Artificial Sequence
  Synthetic Polynucleotide
taatacgactcactatagggggcggcgtagccctcgcccggctggtagccaacagaggagaggctacatgccgggcgagaacctggcggcagcgcaaaagatg

SEQ ID NO: 215848 - DNA, 103 bp, Artificial Sequence
  Synthetic Polynucleotide
taatacgactcactataggggcgggtccggggcggcgtagccctcgcccgaacagaggagacgggcgatggctacgccgaacctggcggcagcgcaaaagatg

SEQ ID NO: 215849 - DNA, 103 bp, Artificial Sequence
  Synthetic Polynucleotide
taatacgactcactatagggagcccggcgcgcgggtccggggcggcgtagaacagaggagactacgcatgcccggacccaacctggcggcagcgcaaaagatg

SEQ ID NO: 215850 - DNA, 103 bp, Artificial Sequence
  Synthetic Polynucleotide
taatacgactcactatagggccccgggtagagcccggcgcgcgggtccggaacagaggagaccggacatgcgcgccgggaacctggcggcagcgcaaaagatg

SEQ ID NO: 215851 - DNA, 103 bp, Artificial Sequence
  Synthetic Polynucleotide
taatacgactcactatagggcctcacgcggccccgggtagagcccggcgcaacagaggagagcgccgatgtctacccggaacctggcggcagcgcaaaagatg

SEQ ID NO: 215852 - DNA, 103 bp, Artificial Sequence
  Synthetic Polynucleotide
taatacgactcactatagggagcgcgtagtcctcacgcggccccgggtagaacagaggagactacccatggccgcgtgaaacctggcggcagcgcaaaagatg

SEQ ID NO: 215853 - DNA, 103 bp, Artificial Sequence
  Synthetic Polynucleotide
taatacgactcactatagggtcccgcgggtagcgcgtagtcctcacgcggaacagaggagaccgcgtatggactacgcgaacctggcggcagcgcaaaagatg

SEQ ID NO: 215854 - DNA, 103 bp, Artificial Sequence
  Synthetic Polynucleotide
taatacgactcactatagggacacctccagtcccgcgggtagcgcgtagtaacagaggagaactacgatgtacccgcggaacctggcggcagcgcaaaagatg

SEQ ID NO: 215855 - DNA, 103 bp, Artificial Sequence
  Synthetic Polynucleotide
taatacgactcactatagggagtttccccgacacctccagtcccgcgggtaacagaggagaacccgcatgactggaggtaacctggcggcagcgcaaaagatg

SEQ ID NO: 215856 - DNA, 103 bp, Artificial Sequence
  Synthetic Polynucleotide
taatacgactcactatagggccccggcatcggctcggtgcccgtcagcataacagaggagaatgctgatgggcaccgagaacctggcggcagcgcaaaagatg

SEQ ID NO: 215857 - DNA, 103 bp, Artificial Sequence
  Synthetic Polynucleotide
taatacgactcactatagggcgcgaccctcagtttccccgacacctccagaacagaggagactggagatgtcggggaaaaacctggcggcagcgcaaaagatg

SEQ ID NO: 215858 - DNA, 103 bp, Artificial Sequence
  Synthetic Polynucleotide
taatacgactcactatagggggttgttgagcgcgaccctcagtttccccgaacagaggagacggggaatgtgagggtcgaacctggcggcagcgcaaaagatg

SEQ ID NO: 215859 - DNA, 103 bp, Artificial Sequence
  Synthetic Polynucleotide
taatacgactcactatagggcacaacaggtggttgttgagcgcgaccctcaacagaggagagagggtatggctcaacaaaacctggcggcagcgcaaaagatg

SEQ ID NO: 215860 - DNA, 103 bp, Artificial Sequence
  Synthetic Polynucleotide
taatacgactcactatagggaaacttggaccacaacaggtggttgttgagaacagaggagactcaacatgcacctgttgaacctggcggcagcgcaaaagatg

SEQ ID NO: 215861 - DNA, 103 bp, Artificial Sequence
  Synthetic Polynucleotide
taatacgactcactatagggggtgctgattaaacttggaccacaacaggtaacagaggagaacctgtatgggtccaagtaacctggcggcagcgcaaaagatg

SEQ ID NO: 215862 - DNA, 103 bp, Artificial Sequence
  Synthetic Polynucleotide
taatacgactcactatagggatctctgtctggtgctgattaaacttggacaacagaggagagtccaaatgtaatcagcaaacctggcggcagcgcaaaagatg

SEQ ID NO: 215863 - DNA, 103 bp, Artificial Sequence
  Synthetic Polynucleotide
taatacgactcactatagggggtgatgatcatctctgtctggtgctgattaacagaggagaaatcagatgcagacagagaacctggcggcagcgcaaaagatg

SEQ ID NO: 215864 - DNA, 103 bp, Artificial Sequence
  Synthetic Polynucleotide
taatacgactcactataggggtccctgcttggtgatgatcatctctgtctaacagaggagaagacagatgtgatcatcaaacctggcggcagcgcaaaagatg

SEQ ID NO: 215865 - DNA, 103 bp, Artificial Sequence
  Synthetic Polynucleotide
taatacgactcactatagggaacatccgccgtccctgcttggtgatgatcaacagaggagagatcatatgcaagcagggaacctggcggcagcgcaaaagatg

SEQ ID NO: 215866 - DNA, 103 bp, Artificial Sequence
  Synthetic Polynucleotide
taatacgactcactatagggcaggaatgggaacatccgccgtccctgcttaacagaggagaaagcagatgcggcggatgaacctggcggcagcgcaaaagatg

SEQ ID NO: 215867 - DNA, 103 bp, Artificial Sequence
  Synthetic Polynucleotide
taatacgactcactatagggcctcgtcgctccccggcatcggctcggtgcaacagaggagagcaccgatgcgatgccggaacctggcggcagcgcaaaagatg

SEQ ID NO: 215868 - DNA, 103 bp, Artificial Sequence
  Synthetic Polynucleotide
taatacgactcactatagggcagtaaatgacaggaatgggaacatccgccaacagaggagaggcggaatgtcccattccaacctggcggcagcgcaaaagatg

SEQ ID NO: 215869 - DNA, 103 bp, Artificial Sequence
  Synthetic Polynucleotide
taatacgactcactatagggagcccggccacagtaaatgacaggaatgggaacagaggagacccattatggtcatttacaacctggcggcagcgcaaaagatg

SEQ ID NO: 215870 - DNA, 103 bp, Artificial Sequence
  Synthetic Polynucleotide
taatacgactcactatagggggtgggctccagcccggccacagtaaatgaaacagaggagatcatttatggtggccgggaacctggcggcagcgcaaaagatg

SEQ ID NO: 215871 - DNA, 103 bp, Artificial Sequence
  Synthetic Polynucleotide
taatacgactcactatagggtgtagtggctggtgggctccagcccggccaaacagaggagatggccgatgtggagcccaaacctggcggcagcgcaaaagatg

SEQ ID NO: 215872 - DNA, 103 bp, Artificial Sequence
  Synthetic Polynucleotide
taatacgactcactatagggacaaacatcctgtagtggctggtgggctccaacagaggagaggagccatgcagccactaaacctggcggcagcgcaaaagatg

SEQ ID NO: 215873 - DNA, 103 bp, Artificial Sequence
  Synthetic Polynucleotide
taatacgactcactataggggaccacgtccacaaacatcctgtagtggctaacagaggagaagccacatgaggatgtttaacctggcggcagcgcaaaagatg

SEQ ID NO: 215874 - DNA, 103 bp, Artificial Sequence
  Synthetic Polynucleotide
taatacgactcactatagggggtccaccaagaccacgtccacaaacatccaacagaggagaggatgtatgtggacgtggaacctggcggcagcgcaaaagatg

SEQ ID NO: 215875 - DNA, 103 bp, Artificial Sequence
  Synthetic Polynucleotide
taatacgactcactatagggcagtggtgctggtccaccaagaccacgtccaacagaggagaggacgtatgcttggtggaaacctggcggcagcgcaaaagatg

SEQ ID NO: 215876 - DNA, 103 bp, Artificial Sequence
  Synthetic Polynucleotide
taatacgactcactatagggctggtaccgccagtggtgctggtccaccaaaacagaggagattggtgatgcagcaccacaacctggcggcagcgcaaaagatg

SEQ ID NO: 215877 - DNA, 103 bp, Artificial Sequence
  Synthetic Polynucleotide
taatacgactcactatagggacttgccgctctggtaccgccagtggtgctaacagaggagaagcaccatgggcggtaccaacctggcggcagcgcaaaagatg

SEQ ID NO: 215878 - DNA, 103 bp, Artificial Sequence
  Synthetic Polynucleotide
taatacgactcactatagggggcgcccggccctcgtcgctccccggcatcaacagaggagagatgccatggagcgacgaaacctggcggcagcgcaaaagatg

SEQ ID NO: 215879 - DNA, 103 bp, Artificial Sequence
  Synthetic Polynucleotide
taatacgactcactatagggcactgcacccacttgccgctctggtaccgcaacagaggagagcggtaatggagcggcaaaacctggcggcagcgcaaaagatg

SEQ ID NO: 215880 - DNA, 103 bp, Artificial Sequence
  Synthetic Polynucleotide
taatacgactcactatagggggcctttccacactgcacccacttgccgctaacagaggagaagcggcatgtgggtgcagaacctggcggcagcgcaaaagatg

SEQ ID NO: 215881 - DNA, 103 bp, Artificial Sequence
  Synthetic Polynucleotide
taatacgactcactatagggtgctgccctcggcctttccacactgcacccaacagaggagagggtgcatggtggaaaggaacctggcggcagcgcaaaagatg

SEQ ID NO: 215882 - DNA, 103 bp, Artificial Sequence
  Synthetic Polynucleotide
taatacgactcactatagggtttcctggcatgctgccctcggcctttccaaacagaggagatggaaaatgcgagggcagaacctggcggcagcgcaaaagatg

SEQ ID NO: 215883 - DNA, 103 bp, Artificial Sequence
  Synthetic Polynucleotide
taatacgactcactataggggtacaggcggtttcctggcatgctgccctcaacagaggagagagggcatgatgccaggaaacctggcggcagcgcaaaagatg

SEQ ID NO: 215884 - DNA, 103 bp, Artificial Sequence
  Synthetic Polynucleotide
taatacgactcactatagggccgggtggacgtacaggcggtttcctggcaaacagaggagatgccagatgaccgcctgtaacctggcggcagcgcaaaagatg

SEQ ID NO: 215885 - DNA, 103 bp, Artificial Sequence
  Synthetic Polynucleotide
taatacgactcactatagggttgggggagtccgggtggacgtacaggcggaacagaggagaccgcctatgcgtccacccaacctggcggcagcgcaaaagatg

SEQ ID NO: 215886 - DNA, 103 bp, Artificial Sequence
  Synthetic Polynucleotide
taatacgactcactatagggcgctcctgtgttgggggagtccgggtggacaacagaggagagtccacatggactcccccaacctggcggcagcgcaaaagatg

SEQ ID NO: 215887 - DNA, 103 bp, Artificial Sequence
  Synthetic Polynucleotide
taatacgactcactataggggcatccagtgcgctcctgtgttgggggagtaacagaggagaactcccatgacacaggagaacctggcggcagcgcaaaagatg

SEQ ID NO: 215888 - DNA, 103 bp, Artificial Sequence
  Synthetic Polynucleotide
taatacgactcactatagggacttcctggcgcatccagtgcgctcctgtgaacagaggagacacaggatggcactggataacctggcggcagcgcaaaagatg

SEQ ID NO: 215889 - DNA, 103 bp, Artificial Sequence
  Synthetic Polynucleotide
taatacgactcactataggggtcggcgccaggcgcccggccctcgtcgctaacagaggagaagcgacatgggccgggcgaacctggcggcagcgcaaaagatg

SEQ ID NO: 215890 - DNA, 103 bp, Artificial Sequence
  Synthetic Polynucleotide
taatacgactcactatagggcccaaatgaaacttcctggcgcatccagtgaacagaggagacactggatgcgccaggaaaacctggcggcagcgcaaaagatg

SEQ ID NO: 215891 - DNA, 103 bp, Artificial Sequence
  Synthetic Polynucleotide
taatacgactcactataggggctttagtttcccaaatgaaacttcctggcaacagaggagagccaggatgtttcatttgaacctggcggcagcgcaaaagatg

SEQ ID NO: 215892 - DNA, 103 bp, Artificial Sequence
  Synthetic Polynucleotide
taatacgactcactatagggttgtttgtgagctttagtttcccaaatgaaaacagaggagattcattatggaaactaaaaacctggcggcagcgcaaaagatg

SEQ ID NO: 215893 - DNA, 103 bp, Artificial Sequence
  Synthetic Polynucleotide
taatacgactcactatagggcgcccccttgttgtttgtgagctttagtttaacagaggagaaaactaatgctcacaaacaacctggcggcagcgcaaaagatg

SEQ ID NO: 215894 - DNA, 103 bp, Artificial Sequence
  Synthetic Polynucleotide
taatacgactcactatagggcattgttggacgcccccttgttgtttgtgaaacagaggagatcacaaatgacaagggggaacctggcggcagcgcaaaagatg

SEQ ID NO: 215895 - DNA, 103 bp, Artificial Sequence
  Synthetic Polynucleotide
taatacgactcactatagggatctgggtcacattgttggacgcccccttgaacagaggagacaagggatggtccaacaaaacctggcggcagcgcaaaagatg

SEQ ID NO: 215896 - DNA, 103 bp, Artificial Sequence
  Synthetic Polynucleotide
taatacgactcactataggggagcacaatcatctgggtcacattgttggaaacagaggagatccaacatggtgacccagaacctggcggcagcgcaaaagatg

SEQ ID NO: 215897 - DNA, 103 bp, Artificial Sequence
  Synthetic Polynucleotide
taatacgactcactatagggggagggactggagcacaatcatctgggtcaaacagaggagatgacccatgtgattgtgcaacctggcggcagcgcaaaagatg

SEQ ID NO: 215898 - DNA, 103 bp, Artificial Sequence
  Synthetic Polynucleotide
taatacgactcactatagggtggtacttatggagggactggagcacaatcaacagaggagagattgtatgccagtccctaacctggcggcagcgcaaaagatg

SEQ ID NO: 215899 - DNA, 103 bp, Artificial Sequence
  Synthetic Polynucleotide
taatacgactcactatagggcagccggggctggtacttatggagggactgaacagaggagacagtccatgcataagtacaacctggcggcagcgcaaaagatg

SEQ ID NO: 215900 - DNA, 103 bp, Artificial Sequence
  Synthetic Polynucleotide
taatacgactcactatagggggtgctgcgggtcggcgccaggcgcccggcaacagaggagagccgggatgctggcgccgaacctggcggcagcgcaaaagatg

SEQ ID NO: 215901 - DNA, 103 bp, Artificial Sequence
  Synthetic Polynucleotide
taatacgactcactatagggcaacgatatgcagccggggctggtacttataacagaggagaataagtatgagccccggcaacctggcggcagcgcaaaagatg

SEQ ID NO: 215902 - DNA, 103 bp, Artificial Sequence
  Synthetic Polynucleotide
taatacgactcactatagggtcgttcacctcaacgatatgcagccggggcaacagaggagagccccgatggcatatcgtaacctggcggcagcgcaaaagatg

SEQ ID NO: 215903 - DNA, 103 bp, Artificial Sequence
  Synthetic Polynucleotide
taatacgactcactatagggtggctctccgtcgttcacctcaacgatatgaacagaggagacatatcatggaggtgaacaacctggcggcagcgcaaaagatg

SEQ ID NO: 215904 - DNA, 103 bp, Artificial Sequence
  Synthetic Polynucleotide
taatacgactcactatagggaggctgcctctggctctccgtcgttcacctaacagaggagaaggtgaatgacggagagcaacctggcggcagcgcaaaagatg

SEQ ID NO: 215905 - DNA, 103 bp, Artificial Sequence
  Synthetic Polynucleotide
taatacgactcactataggggaagcgttgcaggctgcctctggctctccgaacagaggagacggagaatgagaggcagcaacctggcggcagcgcaaaagatg

SEQ ID NO: 215906 - DNA, 103 bp, Artificial Sequence
  Synthetic Polynucleotide
taatacgactcactatagggatgcgtgttggaagcgttgcaggctgcctcaacagaggagagaggcaatgtgcaacgctaacctggcggcagcgcaaaagatg

SEQ ID NO: 215907 - DNA, 103 bp, Artificial Sequence
  Synthetic Polynucleotide
taatacgactcactatagggaagtaaagatatgcgtgttggaagcgttgcaacagaggagagcaacgatgccaacacgcaacctggcggcagcgcaaaagatg

SEQ ID NO: 215908 - DNA, 103 bp, Artificial Sequence
  Synthetic Polynucleotide
taatacgactcactataggggtttcttggaaagtaaagatatgcgtgttgaacagaggagacaacacatgtatctttacaacctggcggcagcgcaaaagatg

SEQ ID NO: 215909 - DNA, 103 bp, Artificial Sequence
  Synthetic Polynucleotide
taatacgactcactatagggaatgaactgggtttcttggaaagtaaagataacagaggagaatctttatgttccaagaaaacctggcggcagcgcaaaagatg

SEQ ID NO: 215910 - DNA, 103 bp, Artificial Sequence
  Synthetic Polynucleotide
taatacgactcactatagggcagtcacggcaatgaactgggtttcttggaaacagaggagatccaagatgcccagttcaaacctggcggcagcgcaaaagatg

SEQ ID NO: 215911 - DNA, 103 bp, Artificial Sequence
  Synthetic Polynucleotide
taatacgactcactatagggtagaagtagcggtgctgcgggtcggcgccaaacagaggagatggcgcatgcccgcagcaaacctggcggcagcgcaaaagatg

SEQ ID NO: 215912 - DNA, 103 bp, Artificial Sequence
  Synthetic Polynucleotide
taatacgactcactatagggttctggtaggcagtcacggcaatgaactggaacagaggagaccagttatgtgccgtgacaacctggcggcagcgcaaaagatg

SEQ ID NO: 215913 - DNA, 103 bp, Artificial Sequence
  Synthetic Polynucleotide
taatacgactcactatagggaatctcggcattctggtaggcagtcacggcaacagaggagagccgtgatggcctaccagaacctggcggcagcgcaaaagatg

SEQ ID NO: 215914 - DNA, 103 bp, Artificial Sequence
  Synthetic Polynucleotide
taatacgactcactatagggtcagctgagtaatctcggcattctggtaggaacagaggagacctaccatgatgccgagaaacctggcggcagcgcaaaagatg

SEQ ID NO: 215915 - DNA, 103 bp, Artificial Sequence
  Synthetic Polynucleotide
taatacgactcactatagggttatcaattttcagctgagtaatctcggcaaacagaggagatgccgaatgtactcagctaacctggcggcagcgcaaaagatg

SEQ ID NO: 215916 - DNA, 103 bp, Artificial Sequence
  Synthetic Polynucleotide
taatacgactcactatagggaaaggggttattatcaattttcagctgagtaacagaggagaactcagatgaaaattgataacctggcggcagcgcaaaagatg

SEQ ID NO: 215917 - DNA, 103 bp, Artificial Sequence
  Synthetic Polynucleotide
taatacgactcactatagggatcctttggcaaaggggttattatcaatttaacagaggagaaaattgatgataacccctaacctggcggcagcgcaaaagatg

SEQ ID NO: 215918 - DNA, 103 bp, Artificial Sequence
  Synthetic Polynucleotide
taatacgactcactatagggttctcccggaatcctttggcaaaggggttaaacagaggagataacccatgtgccaaaggaacctggcggcagcgcaaaagatg

SEQ ID NO: 215919 - DNA, 103 bp, Artificial Sequence
  Synthetic Polynucleotide
taatacgactcactatagggggactcaaagttctcccggaatcctttggcaacagaggagagccaaaatgttccgggagaacctggcggcagcgcaaaagatg

SEQ ID NO: 215920 - DNA, 103 bp, Artificial Sequence
  Synthetic Polynucleotide
taatacgactcactatagggatgtgtacatggactcaaagttctcccggaaacagaggagatccgggatgactttgagtaacctggcggcagcgcaaaagatg

SEQ ID NO: 215921 - DNA, 103 bp, Artificial Sequence
  Synthetic Polynucleotide
taatacgactcactataggggtgtcaacagatgtgtacatggactcaaagaacagaggagactttgaatgcatgtacacaacctggcggcagcgcaaaagatg

SEQ ID NO: 215922 - DNA, 103 bp, Artificial Sequence
  Synthetic Polynucleotide
taatacgactcactataggggaaggcacgcgcccgagagctcagagccataacagaggagaatggctatgagctctcggaacctggcggcagcgcaaaagatg

SEQ ID NO: 215923 - DNA, 103 bp, Artificial Sequence
  Synthetic Polynucleotide
taatacgactcactataggggccctttttctcccgcagctcaggctgctcaacagaggagagagcagatggagctgcggaacctggcggcagcgcaaaagatg

SEQ ID NO: 215924 - DNA, 103 bp, Artificial Sequence
  Synthetic Polynucleotide
taatacgactcactatagggagaaagtaaggagttcaaaggagagggggcaacagaggagagcccccatgcctttgaacaacctggcggcagcgcaaaagatg

SEQ ID NO: 215925 - DNA, 103 bp, Artificial Sequence
  Synthetic Polynucleotide
taatacgactcactatagggagcaaagtggagaaagtaaggagttcaaagaacagaggagactttgaatgccttactttaacctggcggcagcgcaaaagatg

SEQ ID NO: 215926 - DNA, 103 bp, Artificial Sequence
  Synthetic Polynucleotide
taatacgactcactatagggataggtgaaaagcaaagtggagaaagtaagaacagaggagacttactatgtccactttgaacctggcggcagcgcaaaagatg

SEQ ID NO: 215927 - DNA, 103 bp, Artificial Sequence
  Synthetic Polynucleotide
taatacgactcactatagggtaaatgaaacataggtgaaaagcaaagtggaacagaggagaccacttatgttttcacctaacctggcggcagcgcaaaagatg

SEQ ID NO: 215928 - DNA, 103 bp, Artificial Sequence
  Synthetic Polynucleotide
taatacgactcactatagggagcttgtaggtaaatgaaacataggtgaaaaacagaggagatttcacatgtgtttcattaacctggcggcagcgcaaaagatg

SEQ ID NO: 215929 - DNA, 103 bp, Artificial Sequence
  Synthetic Polynucleotide
taatacgactcactatagggattccaagggagcttgtaggtaaatgaaacaacagaggagagtttcaatgacctacaagaacctggcggcagcgcaaaagatg

SEQ ID NO: 215930 - DNA, 103 bp, Artificial Sequence
  Synthetic Polynucleotide
taatacgactcactatagggtggacagggcattccaagggagcttgtaggaacagaggagacctacaatgtcccttggaaacctggcggcagcgcaaaagatg

SEQ ID NO: 215931 - DNA, 103 bp, Artificial Sequence
  Synthetic Polynucleotide
taatacgactcactatagggggtatgcctctggacagggcattccaagggaacagaggagacccttgatgtgccctgtcaacctggcggcagcgcaaaagatg

SEQ ID NO: 215932 - DNA, 103 bp, Artificial Sequence
  Synthetic Polynucleotide
taatacgactcactatagggacattgggcaggtatgcctctggacagggcaacagaggagagccctgatgagaggcataaacctggcggcagcgcaaaagatg

SEQ ID NO: 215933 - DNA, 103 bp, Artificial Sequence
  Synthetic Polynucleotide
taatacgactcactatagggaggcaggttgacattgggcaggtatgcctcaacagaggagagaggcaatgctgcccaataacctggcggcagcgcaaaagatg

SEQ ID NO: 215934 - DNA, 103 bp, Artificial Sequence
  Synthetic Polynucleotide
taatacgactcactatagggcttcctctccgccctttttctcccgcagctaacagaggagaagctgcatgagaaaaaggaacctggcggcagcgcaaaagatg

SEQ ID NO: 215935 - DNA, 103 bp, Artificial Sequence
  Synthetic Polynucleotide
taatacgactcactatagggtgtagcatagaggcaggttgacattgggcaaacagaggagatgcccaatgtcaacctgcaacctggcggcagcgcaaaagatg

SEQ ID NO: 215936 - DNA, 103 bp, Artificial Sequence
  Synthetic Polynucleotide
taatacgactcactatagggggacaaatcttgtagcatagaggcaggttgaacagaggagacaacctatgtctatgctaaacctggcggcagcgcaaaagatg

SEQ ID NO: 215937 - DNA, 103 bp, Artificial Sequence
  Synthetic Polynucleotide
taatacgactcactatagggaaaattagttggacaaatcttgtagcatagaacagaggagactatgcatgaagatttgtaacctggcggcagcgcaaaagatg

SEQ ID NO: 215938 - DNA, 103 bp, Artificial Sequence
  Synthetic Polynucleotide
taatacgactcactataggggctgttgccaaaaattagttggacaaatctaacagaggagaagatttatgcaactaattaacctggcggcagcgcaaaagatg

SEQ ID NO: 215939 - DNA, 103 bp, Artificial Sequence
  Synthetic Polynucleotide
taatacgactcactatagggacaagaggttgctgttgccaaaaattagttaacagaggagaaactaaatgttggcaacaaacctggcggcagcgcaaaagatg

SEQ ID NO: 215940 - DNA, 103 bp, Artificial Sequence
  Synthetic Polynucleotide
taatacgactcactatagggagccggtaaaacaagaggttgctgttgccaaacagaggagatggcaaatgcaacctcttaacctggcggcagcgcaaaagatg

SEQ ID NO: 215941 - DNA, 103 bp, Artificial Sequence
  Synthetic Polynucleotide
taatacgactcactataggggtctttcaggagccggtaaaacaagaggttaacagaggagaaacctcatgttttaccggaacctggcggcagcgcaaaagatg

SEQ ID NO: 215942 - DNA, 103 bp, Artificial Sequence
  Synthetic Polynucleotide
taatacgactcactatagggctgcttgctagtctttcaggagccggtaaaaacagaggagatttaccatgtcctgaaagaacctggcggcagcgcaaaagatg

SEQ ID NO: 215943 - DNA, 103 bp, Artificial Sequence
  Synthetic Polynucleotide
taatacgactcactatagggagaactgttgctgcttgctagtctttcaggaacagaggagacctgaaatgctagcaagcaacctggcggcagcgcaaaagatg

SEQ ID NO: 215944 - DNA, 103 bp, Artificial Sequence
  Synthetic Polynucleotide
taatacgactcactatagggctaaagactgagaactgttgctgcttgctaaacagaggagatagcaaatggcaacagttaacctggcggcagcgcaaaagatg

SEQ ID NO: 215945 - DNA, 103 bp, Artificial Sequence
  Synthetic Polynucleotide
taatacgactcactatagggctctcctcctcttcctctccgccctttttcaacagaggagagaaaaaatgcggagaggaaacctggcggcagcgcaaaagatg

SEQ ID NO: 215946 - DNA, 103 bp, Artificial Sequence
  Synthetic Polynucleotide
taatacgactcactatagggatgagtggggctaaagactgagaactgttgaacagaggagacaacagatgtcagtctttaacctggcggcagcgcaaaagatg

SEQ ID NO: 215947 - DNA, 103 bp, Artificial Sequence
  Synthetic Polynucleotide
taatacgactcactatagggcacttccatcatgagtggggctaaagactgaacagaggagacagtctatggccccactcaacctggcggcagcgcaaaagatg

SEQ ID NO: 215948 - DNA, 103 bp, Artificial Sequence
  Synthetic Polynucleotide
taatacgactcactatagggataacataggcacttccatcatgagtggggaacagaggagaccccacatgtgatggaagaacctggcggcagcgcaaaagatg

SEQ ID NO: 215949 - DNA, 103 bp, Artificial Sequence
  Synthetic Polynucleotide
taatacgactcactatagggcccagggaagataacataggcacttccatcaacagaggagagatggaatggcctatgttaacctggcggcagcgcaaaagatg

SEQ ID NO: 215950 - DNA, 103 bp, Artificial Sequence
  Synthetic Polynucleotide
taatacgactcactatagggattggtgacccccagggaagataacataggaacagaggagacctatgatgtcttccctgaacctggcggcagcgcaaaagatg

SEQ ID NO: 215951 - DNA, 103 bp, Artificial Sequence
  Synthetic Polynucleotide
taatacgactcactatagggcgctttttgaattggtgacccccagggaagaacagaggagacttcccatggggtcaccaaacctggcggcagcgcaaaagatg

SEQ ID NO: 215952 - DNA, 103 bp, Artificial Sequence
  Synthetic Polynucleotide
taatacgactcactatagggtcagatgaaccgctttttgaattggtgaccaacagaggagaggtcacatgttcaaaaagaacctggcggcagcgcaaaagatg

SEQ ID NO: 215953 - DNA, 103 bp, Artificial Sequence
  Synthetic Polynucleotide
taatacgactcactatagggactggagtcttcagatgaaccgctttttgaaacagaggagatcaaaaatgggttcatctaacctggcggcagcgcaaaagatg

SEQ ID NO: 215954 - DNA, 103 bp, Artificial Sequence
  Synthetic Polynucleotide
taatacgactcactataggggatactgatcactggagtcttcagatgaacaacagaggagagttcatatgaagactccaaacctggcggcagcgcaaaagatg

SEQ ID NO: 215955 - DNA, 103 bp, Artificial Sequence
  Synthetic Polynucleotide
taatacgactcactatagggggtgcttgtagatactgatcactggagtctaacagaggagaagactcatgtgatcagtaaacctggcggcagcgcaaaagatg

SEQ ID NO: 215956 - DNA, 103 bp, Artificial Sequence
  Synthetic Polynucleotide
taatacgactcactataggggctgctccttctctcctcctcttcctctccaacagaggagaggagagatggaggaggagaacctggcggcagcgcaaaagatg

SEQ ID NO: 215957 - DNA, 103 bp, Artificial Sequence
  Synthetic Polynucleotide
taatacgactcactatagggggtagaattaggtgcttgtagatactgatcaacagaggagagatcagatgctacaagcaaacctggcggcagcgcaaaagatg

SEQ ID NO: 215958 - DNA, 103 bp, Artificial Sequence
  Synthetic Polynucleotide
taatacgactcactatagggacatttgattggtagaattaggtgcttgtaaacagaggagatacaagatgctaattctaaacctggcggcagcgcaaaagatg

SEQ ID NO: 215959 - DNA, 103 bp, Artificial Sequence
  Synthetic Polynucleotide
taatacgactcactatagggaatccatataacatttgattggtagaattaaacagaggagataattcatgcaatcaaataacctggcggcagcgcaaaagatg

SEQ ID NO: 215960 - DNA, 103 bp, Artificial Sequence
  Synthetic Polynucleotide
taatacgactcactatagggaggtgactgtaatccatataacatttgattaacagaggagaaatcaaatgttatatggaaacctggcggcagcgcaaaagatg

SEQ ID NO: 215961 - DNA, 103 bp, Artificial Sequence
  Synthetic Polynucleotide
taatacgactcactatagggaaatatttccaggtgactgtaatccatataaacagaggagatatatgatgtacagtcacaacctggcggcagcgcaaaagatg

SEQ ID NO: 215962 - DNA, 103 bp, Artificial Sequence
  Synthetic Polynucleotide
taatacgactcactatagggtttggcagaaaaatatttccaggtgactgtaacagaggagaacagtcatgtggaaatataacctggcggcagcgcaaaagatg

SEQ ID NO: 215963 - DNA, 103 bp, Artificial Sequence
  Synthetic Polynucleotide
taatacgactcactatagggggtgatggagtttggcagaaaaatatttccaacagaggagaggaaatatgtttctgccaaacctggcggcagcgcaaaagatg

SEQ ID NO: 215964 - DNA, 103 bp, Artificial Sequence
  Synthetic Polynucleotide
taatacgactcactataggggtgcttctggggtgatggagtttggcagaaaacagaggagattctgcatgactccatcaaacctggcggcagcgcaaaagatg

SEQ ID NO: 215965 - DNA, 103 bp, Artificial Sequence
  Synthetic Polynucleotide
taatacgactcactataggggagcaactaagtgcttctggggtgatggagaacagaggagactccatatgcccagaagcaacctggcggcagcgcaaaagatg

SEQ ID NO: 215966 - DNA, 103 bp, Artificial Sequence
  Synthetic Polynucleotide
taatacgactcactatagggaggatgaaaggagcaactaagtgcttctggaacagaggagaccagaaatgcttagttgcaacctggcggcagcgcaaaagatg

SEQ ID NO: 215967 - DNA, 103 bp, Artificial Sequence
  Synthetic Polynucleotide
taatacgactcactatagggtccctgcagcgctgctccttctctcctcctaacagaggagaaggaggatggaaggagcaaacctggcggcagcgcaaaagatg

SEQ ID NO: 215968 - DNA, 103 bp, Artificial Sequence
  Synthetic Polynucleotide
taatacgactcactatagggagtcataggaaggatgaaaggagcaactaaaacagaggagattagttatgcctttcatcaacctggcggcagcgcaaaagatg

SEQ ID NO: 215969 - DNA, 103 bp, Artificial Sequence
  Synthetic Polynucleotide
taatacgactcactatagggtatctataaaagtcataggaaggatgaaagaacagaggagactttcaatgttcctatgaaacctggcggcagcgcaaaagatg

SEQ ID NO: 215970 - DNA, 103 bp, Artificial Sequence
  Synthetic Polynucleotide
taatacgactcactatagggagagaaattgtatctataaaagtcataggaaacagaggagatcctatatgttttatagaaacctggcggcagcgcaaaagatg

SEQ ID NO: 215971 - DNA, 103 bp, Artificial Sequence
  Synthetic Polynucleotide
taatacgactcactatagggtagatggcatagagaaattgtatctataaaaacagaggagatttataatgacaatttctaacctggcggcagcgcaaaagatg

SEQ ID NO: 215972 - DNA, 103 bp, Artificial Sequence
  Synthetic Polynucleotide
taatacgactcactatagggcttatcagtctagatggcatagagaaattgaacagaggagacaatttatgtatgccatcaacctggcggcagcgcaaaagatg

SEQ ID NO: 215973 - DNA, 103 bp, Artificial Sequence
  Synthetic Polynucleotide
taatacgactcactataggggttggaaccacttatcagtctagatggcataacagaggagaatgccaatgagactgataaacctggcggcagcgcaaaagatg

SEQ ID NO: 215974 - DNA, 103 bp, Artificial Sequence
  Synthetic Polynucleotide
taatacgactcactatagggctttaagatggttggaaccacttatcagtcaacagaggagagactgaatggtggttccaaacctggcggcagcgcaaaagatg

SEQ ID NO: 215975 - DNA, 103 bp, Artificial Sequence
  Synthetic Polynucleotide
taatacgactcactatagggtcgtcattcactttaagatggttggaaccaaacagaggagatggttcatgccatcttaaaacctggcggcagcgcaaaagatg

SEQ ID NO: 215976 - DNA, 103 bp, Artificial Sequence
  Synthetic Polynucleotide
taatacgactcactatagggaacttgactgtcgtcattcactttaagatgaacagaggagacatcttatggtgaatgacaacctggcggcagcgcaaaagatg

SEQ ID NO: 215977 - DNA, 103 bp, Artificial Sequence
  Synthetic Polynucleotide
taatacgactcactatagggctccaaaagaaacttgactgtcgtcattcaaacagaggagatgaatgatgacagtcaagaacctggcggcagcgcaaaagatg

SEQ ID NO: 215978 - DNA, 103 bp, Artificial Sequence
  Synthetic Polynucleotide
taatacgactcactatagggggctcgctcttccctgcagcgctgctccttaacagaggagaaaggagatgcgctgcaggaacctggcggcagcgcaaaagatg

SEQ ID NO: 215979 - DNA, 103 bp, Artificial Sequence
  Synthetic Polynucleotide
taatacgactcactatagggcatttgccttctccaaaagaaacttgactgaacagaggagacagtcaatgttcttttggaacctggcggcagcgcaaaagatg

SEQ ID NO: 215980 - DNA, 103 bp, Artificial Sequence
  Synthetic Polynucleotide
taatacgactcactatagggaacatgattacatttgccttctccaaaagaaacagaggagatcttttatggaaggcaaaaacctggcggcagcgcaaaagatg

SEQ ID NO: 215981 - DNA, 103 bp, Artificial Sequence
  Synthetic Polynucleotide
taatacgactcactataggggataccaatgaacatgattacatttgccttaacagaggagaaaggcaatggtaatcatgaacctggcggcagcgcaaaagatg

SEQ ID NO: 215982 - DNA, 103 bp, Artificial Sequence
  Synthetic Polynucleotide
taatacgactcactatagggttaattgctggataccaatgaacatgattaaacagaggagataatcaatgtcattggtaaacctggcggcagcgcaaaagatg

SEQ ID NO: 215983 - DNA, 103 bp, Artificial Sequence
  Synthetic Polynucleotide
taatacgactcactatagggaaggtaatggttaattgctggataccaatgaacagaggagacattggatgccagcaattaacctggcggcagcgcaaaagatg

SEQ ID NO: 215984 - DNA, 103 bp, Artificial Sequence
  Synthetic Polynucleotide
taatacgactcactatagggtttttcaagcggctcgctcttccctgcagcaacagaggagagctgcaatgaagagcgagaacctggcggcagcgcaaaagatg

SEQ ID NO: 215985 - DNA, 103 bp, Artificial Sequence
  Synthetic Polynucleotide
taatacgactcactatagggtcttaggttgtttttcaagcggctcgctctaacagaggagaagagcgatgcgcttgaaaaacctggcggcagcgcaaaagatg

SEQ ID NO: 215986 - DNA, 103 bp, Artificial Sequence
  Synthetic Polynucleotide
taatacgactcactataggggagggctctgtcttaggttgtttttcaagcaacagaggagagcttgaatgacaacctaaaacctggcggcagcgcaaaagatg

SEQ ID NO: 215987 - DNA, 103 bp, Artificial Sequence
  Synthetic Polynucleotide
taatacgactcactatagggagcagatgttgagggctctgtcttaggttgaacagaggagacaacctatgacagagcccaacctggcggcagcgcaaaagatg

SEQ ID NO: 215988 - DNA, 103 bp, Artificial Sequence
  Synthetic Polynucleotide
taatacgactcactatagggcttccacggagaaggcacgcgcccgagagcaacagaggagagctctcatgcgcgtgcctaacctggcggcagcgcaaaagatg

SEQ ID NO: 215989 - DNA, 103 bp, Artificial Sequence
  Synthetic Polynucleotide
taatacgactcactatagggagccagaggaagcagatgttgagggctctgaacagaggagacagagcatgcaacatctgaacctggcggcagcgcaaaagatg

SEQ ID NO: 215990 - DNA, 103 bp, Artificial Sequence
  Synthetic Polynucleotide
taatacgactcactatagggtcgctgccgcagccagaggaagcagatgttaacagaggagaaacatcatgttcctctggaacctggcggcagcgcaaaagatg

SEQ ID NO: 215991 - DNA, 103 bp, Artificial Sequence
  Synthetic Polynucleotide
taatacgactcactataggggtagccgctgtcgctgccgcagccagaggaaacagaggagatcctctatgtgcggcagcaacctggcggcagcgcaaaagatg

SEQ ID NO: 215992 - DNA, 103 bp, Artificial Sequence
  Synthetic Polynucleotide
taatacgactcactatagggagctgttgccgtagccgctgtcgctgccgcaacagaggagagcggcaatgacagcggctaacctggcggcagcgcaaaagatg

SEQ ID NO: 215993 - DNA, 103 bp, Artificial Sequence
  Synthetic Polynucleotide
taatacgactcactatagggagactttcagagctgttgccgtagccgctgaacagaggagacagcggatgcggcaacagaacctggcggcagcgcaaaagatg

SEQ ID NO: 215994 - DNA, 103 bp, Artificial Sequence
  Synthetic Polynucleotide
taatacgactcactatagggtttctcttccagactttcagagctgttgccaacagaggagaggcaacatgtctgaaagtaacctggcggcagcgcaaaagatg

SEQ ID NO: 215995 - DNA, 103 bp, Artificial Sequence
  Synthetic Polynucleotide
taatacgactcactatagggtttgaatatctttctcttccagactttcagaacagaggagactgaaaatgtggaagagaaacctggcggcagcgcaaaagatg

SEQ ID NO: 215996 - DNA, 103 bp, Artificial Sequence
  Synthetic Polynucleotide
taatacgactcactatagggtgaagctccatttgaatatctttctcttccaacagaggagaggaagaatgagatattcaaacctggcggcagcgcaaaagatg

SEQ ID NO: 215997 - DNA, 103 bp, Artificial Sequence
  Synthetic Polynucleotide
taatacgactcactatagggttcagatccttgaagctccatttgaatatcaacagaggagagatattatgatggagcttaacctggcggcagcgcaaaagatg

SEQ ID NO: 215998 - DNA, 103 bp, Artificial Sequence
  Synthetic Polynucleotide
taatacgactcactatagggttttccacagttcagatccttgaagctccaaacagaggagatggagcatgaaggatctgaacctggcggcagcgcaaaagatg

SEQ ID NO: 215999 - DNA, 103 bp, Artificial Sequence
  Synthetic Polynucleotide
taatacgactcactatagggcccaccaaggcttccacggagaaggcacgcaacagaggagagcgtgcatgctccgtggaaacctggcggcagcgcaaaagatg

SEQ ID NO: 216000 - DNA, 103 bp, Artificial Sequence
  Synthetic Polynucleotide
taatacgactcactatagggtcatggaatcttttccacagttcagatcctaacagaggagaaggatcatgactgtggaaaacctggcggcagcgcaaaagatg

SEQ ID NO: 216001 - DNA, 103 bp, Artificial Sequence
  Synthetic Polynucleotide
taatacgactcactatagggagtcccgatgtcatggaatcttttccacagaacagaggagactgtggatgagattccataacctggcggcagcgcaaaagatg

SEQ ID NO: 216002 - DNA, 103 bp, Artificial Sequence
  Synthetic Polynucleotide
taatacgactcactatagggtgatcatctcagtcccgatgtcatggaatcaacagaggagagattccatgacatcgggaaacctggcggcagcgcaaaagatg

SEQ ID NO: 216003 - DNA, 103 bp, Artificial Sequence
  Synthetic Polynucleotide
taatacgactcactataggggctttagtaatgatcatctcagtcccgatgaacagaggagacatcggatgtgagatgataacctggcggcagcgcaaaagatg

SEQ ID NO: 216004 - DNA, 103 bp, Artificial Sequence
  Synthetic Polynucleotide
taatacgactcactatagggccgcctgcccgctttagtaatgatcatctcaacagaggagagagatgatgattactaaaaacctggcggcagcgcaaaagatg

SEQ ID NO: 216005 - DNA, 103 bp, Artificial Sequence
  Synthetic Polynucleotide
taatacgactcactatagggaggggaacatccgcctgcccgctttagtaaaacagaggagattactaatgcgggcaggcaacctggcggcagcgcaaaagatg

SEQ ID NO: 216006 - DNA, 103 bp, Artificial Sequence
  Synthetic Polynucleotide
taatacgactcactatagggacccgaacagaggggaacatccgcctgcccaacagaggagagggcagatggatgttcccaacctggcggcagcgcaaaagatg

SEQ ID NO: 216007 - DNA, 103 bp, Artificial Sequence
  Synthetic Polynucleotide
taatacgactcactatagggtttcaccttgacccgaacagaggggaacataacagaggagaatgttcatgtctgttcggaacctggcggcagcgcaaaagatg

SEQ ID NO: 216008 - DNA, 103 bp, Artificial Sequence
  Synthetic Polynucleotide
taatacgactcactataggggatccaaccctttcaccttgacccgaacagaacagaggagactgttcatgtcaaggtgaaacctggcggcagcgcaaaagatg

SEQ ID NO: 216009 - DNA, 103 bp, Artificial Sequence
  Synthetic Polynucleotide
taatacgactcactatagggtgcttccctggatccaaccctttcaccttgaacagaggagacaaggtatgagggttggaaacctggcggcagcgcaaaagatg

SEQ ID NO: 216010 - DNA, 103 bp, Artificial Sequence
  Synthetic Polynucleotide
taatacgactcactataggggctgggtctccccaccaaggcttccacggaaacagaggagatccgtgatggccttggtgaacctggcggcagcgcaaaagatg

SEQ ID NO: 216011 - DNA, 103 bp, Artificial Sequence
  Synthetic Polynucleotide
taatacgactcactatagggcacatggtactgcttccctggatccaacccaacagaggagagggttgatgccagggaagaacctggcggcagcgcaaaagatg

SEQ ID NO: 216012 - DNA, 103 bp, Artificial Sequence
  Synthetic Polynucleotide
taatacgactcactatagggcatcgatggccacatggtactgcttccctgaacagaggagacagggaatgagtaccatgaacctggcggcagcgcaaaagatg

SEQ ID NO: 216013 - DNA, 103 bp, Artificial Sequence
  Synthetic Polynucleotide
taatacgactcactatagggaccggcaccacatcgatggccacatggtacaacagaggagagtaccaatgggccatcgaaacctggcggcagcgcaaaagatg

SEQ ID NO: 216014 - DNA, 103 bp, Artificial Sequence
  Synthetic Polynucleotide
taatacgactcactatagggtttggaatccaccggcaccacatcgatggcaacagaggagagccatcatggtggtgccgaacctggcggcagcgcaaaagatg

SEQ ID NO: 216015 - DNA, 103 bp, Artificial Sequence
  Synthetic Polynucleotide
taatacgactcactatagggacctatagcgtttggaatccaccggcaccaaacagaggagatggtgcatgtggattccaaacctggcggcagcgcaaaagatg

SEQ ID NO: 216016 - DNA, 103 bp, Artificial Sequence
  Synthetic Polynucleotide
taatacgactcactatagggtgatagacgtacctatagcgtttggaatccaacagaggagaggattcatgacgctatagaacctggcggcagcgcaaaagatg

SEQ ID NO: 216017 - DNA, 103 bp, Artificial Sequence
  Synthetic Polynucleotide
taatacgactcactatagggctgtgagctgtgatagacgtacctatagcgaacagaggagacgctatatgtacgtctataacctggcggcagcgcaaaagatg

SEQ ID NO: 216018 - DNA, 103 bp, Artificial Sequence
  Synthetic Polynucleotide
taatacgactcactatagggctaccatccactgtgagctgtgatagacgtaacagaggagaacgtctatgacagctcacaacctggcggcagcgcaaaagatg

SEQ ID NO: 216019 - DNA, 103 bp, Artificial Sequence
  Synthetic Polynucleotide
taatacgactcactataggggtattcccagctaccatccactgtgagctgaacagaggagacagctcatggtggatggtaacctggcggcagcgcaaaagatg

SEQ ID NO: 216020 - DNA, 103 bp, Artificial Sequence
  Synthetic Polynucleotide
taatacgactcactatagggcaaatggtctgtattcccagctaccatccaaacagaggagatggatgatggctgggaataacctggcggcagcgcaaaagatg

SEQ ID NO: 216021 - DNA, 103 bp, Artificial Sequence
  Synthetic Polynucleotide
taatacgactcactataggggttttcttttgctgggtctccccaccaaggaacagaggagaccttggatgggagacccaaacctggcggcagcgcaaaagatg

SEQ ID NO: 216022 - DNA, 103 bp, Artificial Sequence
  Synthetic Polynucleotide
taatacgactcactataggggaatgatgcacaaatggtctgtattcccagaacagaggagactgggaatgcagaccattaacctggcggcagcgcaaaagatg

SEQ ID NO: 216023 - DNA, 103 bp, Artificial Sequence
  Synthetic Polynucleotide
taatacgactcactatagggtagaatctaggaatgatgcacaaatggtctaacagaggagaagaccaatggtgcatcataacctggcggcagcgcaaaagatg

SEQ ID NO: 216024 - DNA, 103 bp, Artificial Sequence
  Synthetic Polynucleotide
taatacgactcactatagggcgggtgaacatagaatctaggaatgatgcaaacagaggagatgcatcatgcctagattcaacctggcggcagcgcaaaagatg

SEQ ID NO: 216025 - DNA, 103 bp, Artificial Sequence
  Synthetic Polynucleotide
taatacgactcactatagggagggtgagtccgggtgaacatagaatctagaacagaggagactagatatgatgttcaccaacctggcggcagcgcaaaagatg

SEQ ID NO: 216026 - DNA, 103 bp, Artificial Sequence
  Synthetic Polynucleotide
taatacgactcactatagggtctcccgagcagggtgagtccgggtgaacaaacagaggagatgttcaatgggactcaccaacctggcggcagcgcaaaagatg

SEQ ID NO: 216027 - DNA, 103 bp, Artificial Sequence
  Synthetic Polynucleotide
taatacgactcactatagggcatccaggtctctcccgagcagggtgagtcaacagaggagagactcaatgtgctcgggaaacctggcggcagcgcaaaagatg

SEQ ID NO: 216028 - DNA, 103 bp, Artificial Sequence
  Synthetic Polynucleotide
taatacgactcactatagggtgatctgccgcatccaggtctctcccgagcaacagaggagagctcggatgagacctggaaacctggcggcagcgcaaaagatg

SEQ ID NO: 216029 - DNA, 103 bp, Artificial Sequence
  Synthetic Polynucleotide
taatacgactcactatagggtcaaagctgatgatctgccgcatccaggtcaacagaggagagacctgatggcggcagataacctggcggcagcgcaaaagatg

SEQ ID NO: 216030 - DNA, 103 bp, Artificial Sequence
  Synthetic Polynucleotide
taatacgactcactatagggtttcatgcgatcaaagctgatgatctgccgaacagaggagacggcagatgatcagctttaacctggcggcagcgcaaaagatg

SEQ ID NO: 216031 - DNA, 103 bp, Artificial Sequence
  Synthetic Polynucleotide
taatacgactcactatagggtgttggtgagtttcatgcgatcaaagctgaaacagaggagatcagctatgatcgcatgaaacctggcggcagcgcaaaagatg

SEQ ID NO: 216032 - DNA, 103 bp, Artificial Sequence
  Synthetic Polynucleotide
taatacgactcactataggggggtcttggagttttcttttgctgggtctcaacagaggagagagaccatgcaaaagaaaaacctggcggcagcgcaaaagatg

SEQ ID NO: 216033 - DNA, 103 bp, Artificial Sequence
  Synthetic Polynucleotide
taatacgactcactatagggtccatctcattgttggtgagtttcatgcgaaacagaggagatcgcatatgactcaccaaaacctggcggcagcgcaaaagatg

SEQ ID NO: 216034 - DNA, 103 bp, Artificial Sequence
  Synthetic Polynucleotide
taatacgactcactataggggcctttgtcatccatctcattgttggtgagaacagaggagactcaccatgaatgagatgaacctggcggcagcgcaaaagatg

SEQ ID NO: 216035 - DNA, 103 bp, Artificial Sequence
  Synthetic Polynucleotide
taatacgactcactataggggaatgatgtggcctttgtcatccatctcataacagaggagaatgagaatgatgacaaagaacctggcggcagcgcaaaagatg

SEQ ID NO: 216036 - DNA, 103 bp, Artificial Sequence
  Synthetic Polynucleotide
taatacgactcactatagggatggattgcagaatgatgtggcctttgtcaaacagaggagatgacaaatgccacatcataacctggcggcagcgcaaaagatg

SEQ ID NO: 216037 - DNA, 103 bp, Artificial Sequence
  Synthetic Polynucleotide
taatacgactcactataggggtacttatgcatggattgcagaatgatgtgaacagaggagacacatcatgctgcaatccaacctggcggcagcgcaaaagatg

SEQ ID NO: 216038 - DNA, 103 bp, Artificial Sequence
  Synthetic Polynucleotide
taatacgactcactatagggctcggggtttgtacttatgcatggattgcaaacagaggagatgcaatatgtgcataagtaacctggcggcagcgcaaaagatg

SEQ ID NO: 216039 - DNA, 103 bp, Artificial Sequence
  Synthetic Polynucleotide
taatacgactcactatagggatcacgtgcactcggggtttgtacttatgcaacagaggagagcataaatgcaaaccccgaacctggcggcagcgcaaaagatg

SEQ ID NO: 216040 - DNA, 103 bp, Artificial Sequence
  Synthetic Polynucleotide
taatacgactcactataggggccttgctctatcacgtgcactcggggtttaacagaggagaaaacccatggtgcacgtgaacctggcggcagcgcaaaagatg

SEQ ID NO: 216041 - DNA, 103 bp, Artificial Sequence
  Synthetic Polynucleotide
taatacgactcactatagggcaacactgctgccttgctctatcacgtgcaaacagaggagatgcacgatgtagagcaagaacctggcggcagcgcaaaagatg

SEQ ID NO: 216042 - DNA, 103 bp, Artificial Sequence
  Synthetic Polynucleotide
taatacgactcactatagggtgggacaggtcaacactgctgccttgctctaacagaggagaagagcaatgcagcagtgtaacctggcggcagcgcaaaagatg

SEQ ID NO: 216043 - DNA, 103 bp, Artificial Sequence
  Synthetic Polynucleotide
taatacgactcactatagggcgcctgtattgggtcttggagttttcttttaacagaggagaaaaagaatgctccaagacaacctggcggcagcgcaaaagatg

SEQ ID NO: 216044 - DNA, 103 bp, Artificial Sequence
  Synthetic Polynucleotide
taatacgactcactatagggggactgaatctgggacaggtcaacactgctaacagaggagaagcagtatggacctgtccaacctggcggcagcgcaaaagatg

SEQ ID NO: 216045 - DNA, 103 bp, Artificial Sequence
  Synthetic Polynucleotide
taatacgactcactatagggcagtgggcaaggactgaatctgggacaggtaacagaggagaacctgtatgagattcagtaacctggcggcagcgcaaaagatg

SEQ ID NO: 216046 - DNA, 103 bp, Artificial Sequence
  Synthetic Polynucleotide
taatacgactcactatagggttaacaccttcagtgggcaaggactgaatcaacagaggagagattcaatgcttgcccacaacctggcggcagcgcaaaagatg

SEQ ID NO: 216047 - DNA, 103 bp, Artificial Sequence
  Synthetic Polynucleotide
taatacgactcactatagggggagaatgttttaacaccttcagtgggcaaaacagaggagattgcccatggaaggtgttaacctggcggcagcgcaaaagatg

SEQ ID NO: 216048 - DNA, 103 bp, Artificial Sequence
  Synthetic Polynucleotide
taatacgactcactatagggtttctttaaaggagaatgttttaacaccttaacagaggagaaaggtgatgaaacattctaacctggcggcagcgcaaaagatg

SEQ ID NO: 216049 - DNA, 103 bp, Artificial Sequence
  Synthetic Polynucleotide
taatacgactcactataggggtgaactcagtttctttaaaggagaatgttaacagaggagaaacattatgctttaaagaaacctggcggcagcgcaaaagatg

SEQ ID NO: 216050 - DNA, 103 bp, Artificial Sequence
  Synthetic Polynucleotide
taatacgactcactatagggcgttactgtggtgaactcagtttctttaaaaacagaggagatttaaaatgactgagttcaacctggcggcagcgcaaaagatg

SEQ ID NO: 216051 - DNA, 103 bp, Artificial Sequence
  Synthetic Polynucleotide
taatacgactcactatagggtttggtaagccgttactgtggtgaactcagaacagaggagactgagtatgccacagtaaaacctggcggcagcgcaaaagatg

SEQ ID NO: 216052 - DNA, 103 bp, Artificial Sequence
  Synthetic Polynucleotide
taatacgactcactatagggatctgttggttttggtaagccgttactgtgaacagaggagacacagtatgggcttaccaaacctggcggcagcgcaaaagatg

SEQ ID NO: 216053 - DNA, 103 bp, Artificial Sequence
  Synthetic Polynucleotide
taatacgactcactatagggtagtttcgtaatctgttggttttggtaagcaacagaggagagcttacatgaaccaacagaacctggcggcagcgcaaaagatg

SEQ ID NO: 216054 - DNA, 103 bp, Artificial Sequence
  Synthetic Polynucleotide
taatacgactcactatagggcaggctgctccgcctgtattgggtcttggaaacagaggagatccaagatgcaatacaggaacctggcggcagcgcaaaagatg

SEQ ID NO: 216055 - DNA, 103 bp, Artificial Sequence
  Synthetic Polynucleotide
taatacgactcactatagggtttctatttttagtttcgtaatctgttggtaacagaggagaaccaacatgttacgaaacaacctggcggcagcgcaaaagatg

SEQ ID NO: 216056 - DNA, 103 bp, Artificial Sequence
  Synthetic Polynucleotide
taatacgactcactatagggaaaggatttctttctatttttagtttcgtaaacagaggagatacgaaatgaaaaatagaaacctggcggcagcgcaaaagatg

SEQ ID NO: 216057 - DNA, 103 bp, Artificial Sequence
  Synthetic Polynucleotide
taatacgactcactatagggtcctttagcaaaaggatttctttctattttaacagaggagaaaaataatgagaaatcctaacctggcggcagcgcaaaagatg

SEQ ID NO: 216058 - DNA, 103 bp, Artificial Sequence
  Synthetic Polynucleotide
taatacgactcactatagggtatctctaaatcctttagcaaaaggatttcaacagaggagagaaatcatgttgctaaagaacctggcggcagcgcaaaagatg

SEQ ID NO: 216059 - DNA, 103 bp, Artificial Sequence
  Synthetic Polynucleotide
taatacgactcactatagggtttcttccagtatctctaaatcctttagcaaacagaggagatgctaaatgatttagagaaacctggcggcagcgcaaaagatg

SEQ ID NO: 216060 - DNA, 103 bp, Artificial Sequence
  Synthetic Polynucleotide
taatacgactcactatagggtacacccctgtttcttccagtatctctaaaaacagaggagatttagaatgactggaagaaacctggcggcagcgcaaaagatg

SEQ ID NO: 216061 - DNA, 103 bp, Artificial Sequence
  Synthetic Polynucleotide
taatacgactcactataggggcccatccaatacacccctgtttcttccagaacagaggagactggaaatgacaggggtgaacctggcggcagcgcaaaagatg

SEQ ID NO: 216062 - DNA, 103 bp, Artificial Sequence
  Synthetic Polynucleotide
taatacgactcactataggggtctctaaaagcccatccaatacacccctgaacagaggagacaggggatgattggatggaacctggcggcagcgcaaaagatg

SEQ ID NO: 216063 - DNA, 103 bp, Artificial Sequence
  Synthetic Polynucleotide
taatacgactcactatagggccatgggtaggtctctaaaagcccatccaaaacagaggagattggatatgcttttagagaacctggcggcagcgcaaaagatg

SEQ ID NO: 216064 - DNA, 103 bp, Artificial Sequence
  Synthetic Polynucleotide
taatacgactcactatagggaagaaggcctccatgggtaggtctctaaaaaacagaggagattttagatgcctacccataacctggcggcagcgcaaaagatg

SEQ ID NO: 216065 - DNA, 103 bp, Artificial Sequence
  Synthetic Polynucleotide
taatacgactcactatagggtcccgcagctcaggctgctccgcctgtattaacagaggagaaatacaatgggagcagccaacctggcggcagcgcaaaagatg

SEQ ID NO: 216066 - DNA, 103 bp, Artificial Sequence
  Synthetic Polynucleotide
taatacgactcactatagggtcgagagtgaaagaaggcctccatgggtagaacagaggagactacccatggaggccttcaacctggcggcagcgcaaaagatg

SEQ ID NO: 216067 - DNA, 103 bp, Artificial Sequence
  Synthetic Polynucleotide
taatacgactcactatagggggttttaaaatcgagagtgaaagaaggcctaacagaggagaaggcctatgttcactctcaacctggcggcagcgcaaaagatg

SEQ ID NO: 216068 - DNA, 103 bp, Artificial Sequence
  Synthetic Polynucleotide
taatacgactcactatagggctgcgccaaaggttttaaaatcgagagtgaaacagaggagatcactcatgattttaaaaaacctggcggcagcgcaaaagatg

SEQ ID NO: 216069 - DNA, 103 bp, Artificial Sequence
  Synthetic Polynucleotide
taatacgactcactatagggctttgtgtgtctgcgccaaaggttttaaaaaacagaggagattttaaatgctttggcgcaacctggcggcagcgcaaaagatg

SEQ ID NO: 216070 - DNA, 103 bp, Artificial Sequence
  Synthetic Polynucleotide
taatacgactcactatagggactgcttccactttgtgtgtctgcgccaaaaacagaggagatttggcatggacacacaaaacctggcggcagcgcaaaagatg

SEQ ID NO: 216071 - DNA, 103 bp, Artificial Sequence
  Synthetic Polynucleotide
taatacgactcactataggggagatgagccactgcttccactttgtgtgtaacagaggagaacacacatggtggaagcaaacctggcggcagcgcaaaagatg

SEQ ID NO: 216072 - DNA, 103 bp, Artificial Sequence
  Synthetic Polynucleotide
taatacgactcactataggggaggtcactggagatgagccactgcttccaaacagaggagatggaagatgtggctcatcaacctggcggcagcgcaaaagatg

SEQ ID NO: 216073 - DNA, 103 bp, Artificial Sequence
  Synthetic Polynucleotide
taatacgactcactatagggccctccactagaggtcactggagatgagccaacagaggagaggctcaatgccagtgaccaacctggcggcagcgcaaaagatg

SEQ ID NO: 216074 - DNA, 103 bp, Artificial Sequence
  Synthetic Polynucleotide
taatacgactcactataggggagagggggcccctccactagaggtcactgaacagaggagacagtgaatgctagtggagaacctggcggcagcgcaaaagatg

SEQ ID NO: 216075 - DNA, 103 bp, Artificial Sequence
  Synthetic Polynucleotide
taatacgactcactataggggagttcaaaggagagggggcccctccactaaacagaggagatagtggatgggccccctcaacctggcggcagcgcaaaagatg

SEQ ID NO: 216076 - DNA, 103 bp, Artificial Sequence
  Synthetic Polynucleotide
taatacgactcactatagggaatgaccggatctctcatggagaggctcataacagaggagaatgagcatgtccatgagaaacctggcggcagcgcaaaagatg

SEQ ID NO: 216077 - DNA, 103 bp, Artificial Sequence
  Synthetic Polynucleotide
taatacgactcactataggggaacggcggctggtgacccagcaccgcgctaacagaggagaagcgcgatgctgggtcacaacctggcggcagcgcaaaagatg

SEQ ID NO: 216078 - DNA, 103 bp, Artificial Sequence
  Synthetic Polynucleotide
taatacgactcactatagggggaggactcatcagaggtcccattctccttaacagaggagaaaggagatggggacctctaacctggcggcagcgcaaaagatg

SEQ ID NO: 216079 - DNA, 103 bp, Artificial Sequence
  Synthetic Polynucleotide
taatacgactcactatagggcttgttcactggaggactcatcagaggtccaacagaggagaggacctatgatgagtcctaacctggcggcagcgcaaaagatg

SEQ ID NO: 216080 - DNA, 103 bp, Artificial Sequence
  Synthetic Polynucleotide
taatacgactcactatagggttgaaagctgcttgttcactggaggactcaaacagaggagatgagtcatgcagtgaacaaacctggcggcagcgcaaaagatg

SEQ ID NO: 216081 - DNA, 103 bp, Artificial Sequence
  Synthetic Polynucleotide
taatacgactcactatagggggcgaagcagttgaaagctgcttgttcactaacagaggagaagtgaaatggcagctttcaacctggcggcagcgcaaaagatg

SEQ ID NO: 216082 - DNA, 103 bp, Artificial Sequence
  Synthetic Polynucleotide
taatacgactcactatagggaagaagcctgggcgaagcagttgaaagctgaacagaggagacagcttatgactgcttcgaacctggcggcagcgcaaaagatg

SEQ ID NO: 216083 - DNA, 103 bp, Artificial Sequence
  Synthetic Polynucleotide
taatacgactcactataggggcggctggagaagaagcctgggcgaagcagaacagaggagactgcttatgccaggcttcaacctggcggcagcgcaaaagatg

SEQ ID NO: 216084 - DNA, 103 bp, Artificial Sequence
  Synthetic Polynucleotide
taatacgactcactatagggtacagtggaggcggctggagaagaagcctgaacagaggagacaggctatgtctccagccaacctggcggcagcgcaaaagatg

SEQ ID NO: 216085 - DNA, 103 bp, Artificial Sequence
  Synthetic Polynucleotide
taatacgactcactatagggtcgatgtccctacagtggaggcggctggagaacagaggagactccagatgcctccactgaacctggcggcagcgcaaaagatg

SEQ ID NO: 216086 - DNA, 103 bp, Artificial Sequence
  Synthetic Polynucleotide
taatacgactcactatagggtctttgaggttcgatgtccctacagtggagaacagaggagactccacatgagggacatcaacctggcggcagcgcaaaagatg

SEQ ID NO: 216087 - DNA, 103 bp, Artificial Sequence
  Synthetic Polynucleotide
taatacgactcactataggggggacataaatctttgaggttcgatgtcccaacagaggagagggacaatgaacctcaaaaacctggcggcagcgcaaaagatg

SEQ ID NO: 216088 - DNA, 103 bp, Artificial Sequence
  Synthetic Polynucleotide
taatacgactcactataggggcgcggggaagaacggcggctggtgacccaaacagaggagatgggtcatgagccgccgtaacctggcggcagcgcaaaagatg

SEQ ID NO: 216089 - DNA, 103 bp, Artificial Sequence
  Synthetic Polynucleotide
taatacgactcactatagggcaccctcgctgggacataaatctttgaggtaacagaggagaacctcaatgatttatgtcaacctggcggcagcgcaaaagatg

SEQ ID NO: 216090 - DNA, 103 bp, Artificial Sequence
  Synthetic Polynucleotide
taatacgactcactataggggcgtcgctctcaccctcgctgggacataaaaacagaggagatttatgatgcagcgagggaacctggcggcagcgcaaaagatg

SEQ ID NO: 216091 - DNA, 103 bp, Artificial Sequence
  Synthetic Polynucleotide
taatacgactcactatagggctcggcctcggcgtcgctctcaccctcgctaacagaggagaagcgagatggagagcgacaacctggcggcagcgcaaaagatg

SEQ ID NO: 216092 - DNA, 103 bp, Artificial Sequence
  Synthetic Polynucleotide
taatacgactcactatagggcctctttgctctcggcctcggcgtcgctctaacagaggagaagagcgatgccgaggccgaacctggcggcagcgcaaaagatg

SEQ ID NO: 216093 - DNA, 103 bp, Artificial Sequence
  Synthetic Polynucleotide
taatacgactcactataggggggccatgctcctctttgctctcggcctcgaacagaggagacgaggcatggagcaaagaaacctggcggcagcgcaaaagatg

SEQ ID NO: 216094 - DNA, 103 bp, Artificial Sequence
  Synthetic Polynucleotide
taatacgactcactataggggcaggcctcggggccatgctcctctttgctaacagaggagaagcaaaatggagcatggcaacctggcggcagcgcaaaagatg

SEQ ID NO: 216095 - DNA, 103 bp, Artificial Sequence
  Synthetic Polynucleotide
taatacgactcactatagggtggccgcgtcgcaggcctcggggccatgctaacagaggagaagcatgatgccgaggcctaacctggcggcagcgcaaaagatg

SEQ ID NO: 216096 - DNA, 103 bp, Artificial Sequence
  Synthetic Polynucleotide
taatacgactcactataggggtggagatcttggccgcgtcgcaggcctcgaacagaggagacgaggcatgcgacgcggcaacctggcggcagcgcaaaagatg

SEQ ID NO: 216097 - DNA, 103 bp, Artificial Sequence
  Synthetic Polynucleotide
taatacgactcactatagggcgacgtggtggtggagatcttggccgcgtcaacagaggagagacgcgatgaagatctccaacctggcggcagcgcaaaagatg

SEQ ID NO: 216098 - DNA, 103 bp, Artificial Sequence
  Synthetic Polynucleotide
taatacgactcactatagggagggctcctccgacgtggtggtggagatctaacagaggagaagatctatgccaccacgtaacctggcggcagcgcaaaagatg

SEQ ID NO: 216099 - DNA, 103 bp, Artificial Sequence
  Synthetic Polynucleotide
taatacgactcactatagggggcagcgtcagcgcggggaagaacggcggcaacagaggagagccgccatgcttccccgcaacctggcggcagcgcaaaagatg

SEQ ID NO: 216100 - DNA, 103 bp, Artificial Sequence
  Synthetic Polynucleotide
taatacgactcactatagggttgtcacggcagggctcctccgacgtggtgaacagaggagacaccacatgggaggagccaacctggcggcagcgcaaaagatg

SEQ ID NO: 216101 - DNA, 103 bp, Artificial Sequence
  Synthetic Polynucleotide
taatacgactcactatagggggggctgcccttgtcacggcagggctcctcaacagaggagagaggagatgtgccgtgacaacctggcggcagcgcaaaagatg

SEQ ID NO: 216102 - DNA, 103 bp, Artificial Sequence
  Synthetic Polynucleotide
taatacgactcactatagggccttgaccgcggggctgcccttgtcacggcaacagaggagagccgtgatgagggcagccaacctggcggcagcgcaaaagatg

SEQ ID NO: 216103 - DNA, 103 bp, Artificial Sequence
  Synthetic Polynucleotide
taatacgactcactatagggaaaaggtgagccttgaccgcggggctgcccaacagaggagagggcagatgcgcggtcaaaacctggcggcagcgcaaaagatg

SEQ ID NO: 216104 - DNA, 103 bp, Artificial Sequence
  Synthetic Polynucleotide
taatacgactcactatagggctcagcagcgaaaaggtgagccttgaccgcaacagaggagagcggtcatggctcaccttaacctggcggcagcgcaaaagatg

SEQ ID NO: 216105 - DNA, 103 bp, Artificial Sequence
  Synthetic Polynucleotide
taatacgactcactatagggcccggggccgctcagcagcgaaaaggtgagaacagaggagactcaccatgtcgctgctgaacctggcggcagcgcaaaagatg

SEQ ID NO: 216106 - DNA, 103 bp, Artificial Sequence
  Synthetic Polynucleotide
taatacgactcactatagggcgcccgctgtcccggggccgctcagcagcgaacagaggagacgctgcatggcggccccgaacctggcggcagcgcaaaagatg

SEQ ID NO: 216107 - DNA, 103 bp, Artificial Sequence
  Synthetic Polynucleotide
taatacgactcactatagggtttgtccagccgcccgctgtcccggggccgaacagaggagacggcccatggacagcgggaacctggcggcagcgcaaaagatg

SEQ ID NO: 216108 - DNA, 103 bp, Artificial Sequence
  Synthetic Polynucleotide
taatacgactcactatagggcgggcgacgctttgtccagccgcccgctgtaacagaggagaacagcgatgggctggacaaacctggcggcagcgcaaaagatg

SEQ ID NO: 216109 - DNA, 103 bp, Artificial Sequence
  Synthetic Polynucleotide
taatacgactcactatagggtggcgtgagtcgggcgacgctttgtccagcaacagaggagagctggaatgagcgtcgccaacctggcggcagcgcaaaagatg

SEQ ID NO: 216110 - DNA, 103 bp, Artificial Sequence
  Synthetic Polynucleotide
taatacgactcactataggggccgttgggaggcagcgtcagcgcggggaaaacagaggagattccccatgctgacgctgaacctggcggcagcgcaaaagatg

SEQ ID NO: 216111 - DNA, 103 bp, Artificial Sequence
  Synthetic Polynucleotide
taatacgactcactatagggggcggggctatggcgtgagtcgggcgacgcaacagaggagagcgtcgatggactcacgcaacctggcggcagcgcaaaagatg

SEQ ID NO: 216112 - DNA, 103 bp, Artificial Sequence
  Synthetic Polynucleotide
taatacgactcactatagggacgagatggtggcggggctatggcgtgagtaacagaggagaactcacatgatagccccgaacctggcggcagcgcaaaagatg

SEQ ID NO: 216113 - DNA, 103 bp, Artificial Sequence
  Synthetic Polynucleotide
taatacgactcactatagggcgagtgctggacgagatggtggcggggctaaacagaggagatagcccatgcaccatctcaacctggcggcagcgcaaaagatg

SEQ ID NO: 216114 - DNA, 103 bp, Artificial Sequence
  Synthetic Polynucleotide
taatacgactcactataggggcccaggccgcgagtgctggacgagatggtaacagaggagaaccatcatgtccagcactaacctggcggcagcgcaaaagatg

SEQ ID NO: 216115 - DNA, 103 bp, Artificial Sequence
  Synthetic Polynucleotide
taatacgactcactataggggctcctccgcgcccaggccgcgagtgctggaacagaggagaccagcaatggcggcctggaacctggcggcagcgcaaaagatg

SEQ ID NO: 216116 - DNA, 103 bp, Artificial Sequence
  Synthetic Polynucleotide
taatacgactcactataggggggctcctgcgctcctccgcgcccaggccgaacagaggagacggcctatgcgcggaggaaacctggcggcagcgcaaaagatg

SEQ ID NO: 216117 - DNA, 103 bp, Artificial Sequence
  Synthetic Polynucleotide
taatacgactcactatagggctcgcgaaccgggctcctgcgctcctccgcaacagaggagagcggagatgcgcaggagcaacctggcggcagcgcaaaagatg

SEQ ID NO: 216118 - DNA, 103 bp, Artificial Sequence
  Synthetic Polynucleotide
taatacgactcactataggggcgctgtgccctcgcgaaccgggctcctgcaacagaggagagcaggaatgcggttcgcgaacctggcggcagcgcaaaagatg

SEQ ID NO: 216119 - DNA, 103 bp, Artificial Sequence
  Synthetic Polynucleotide
taatacgactcactatagggaccttggccggcgctgtgccctcgcgaaccaacagaggagaggttcgatggggcacagcaacctggcggcagcgcaaaagatg

SEQ ID NO: 216120 - DNA, 103 bp, Artificial Sequence
  Synthetic Polynucleotide
taatacgactcactatagggcgcctcttccaccttggccggcgctgtgccaacagaggagaggcacaatgccggccaagaacctggcggcagcgcaaaagatg

SEQ ID NO: 216121 - DNA, 103 bp, Artificial Sequence
  Synthetic Polynucleotide
taatacgactcactataggggcgccgccgcgccgttgggaggcagcgtcaaacagaggagatgacgcatgctcccaacgaacctggcggcagcgcaaaagatg

SEQ ID NO: 216122 - DNA, 103 bp, Artificial Sequence
  Synthetic Polynucleotide
taatacgactcactatagggggagcgcgcgcgcctcttccaccttggccgaacagaggagacggccaatgtggaagaggaacctggcggcagcgcaaaagatg

SEQ ID NO: 216123 - DNA, 103 bp, Artificial Sequence
  Synthetic Polynucleotide
taatacgactcactatagggtccttgcccgggagcgcgcgcgcctcttccaacagaggagaggaagaatggcgcgcgctaacctggcggcagcgcaaaagatg

SEQ ID NO: 216124 - DNA, 103 bp, Artificial Sequence
  Synthetic Polynucleotide
taatacgactcactatagggcgcgaaggcctccttgcccgggagcgcgcgaacagaggagacgcgcgatgccgggcaagaacctggcggcagcgcaaaagatg

SEQ ID NO: 216125 - DNA, 103 bp, Artificial Sequence
  Synthetic Polynucleotide
taatacgactcactatagggccgtgagcggcgcgaaggcctccttgcccgaacagaggagacgggcaatgaggccttcgaacctggcggcagcgcaaaagatg

SEQ ID NO: 216126 - DNA, 103 bp, Artificial Sequence
  Synthetic Polynucleotide
taatacgactcactatagggtccgtctgcaccgtgagcggcgcgaaggccaacagaggagaggccttatggccgctcacaacctggcggcagcgcaaaagatg

SEQ ID NO: 216127 - DNA, 103 bp, Artificial Sequence
  Synthetic Polynucleotide
taatacgactcactatagggggcggccgcgtccgtctgcaccgtgagcggaacagaggagaccgctcatggtgcagacgaacctggcggcagcgcaaaagatg

SEQ ID NO: 216128 - DNA, 103 bp, Artificial Sequence
  Synthetic Polynucleotide
taatacgactcactatagggccaggtgcgcggcggccgcgtccgtctgcaaacagaggagatgcagaatgacgcggccgaacctggcggcagcgcaaaagatg

SEQ ID NO: 216129 - DNA, 103 bp, Artificial Sequence
  Synthetic Polynucleotide
taatacgactcactataggggggccctgggccaggtgcgcggcggccgcgaacagaggagacgcggcatgcgcgcacctaacctggcggcagcgcaaaagatg

SEQ ID NO: 216130 - DNA, 103 bp, Artificial Sequence
  Synthetic Polynucleotide
taatacgactcactataggggccaggcagggggccctgggccaggtgcgcaacagaggagagcgcacatggcccagggcaacctggcggcagcgcaaaagatg

SEQ ID NO: 216131 - DNA, 103 bp, Artificial Sequence
  Synthetic Polynucleotide
taatacgactcactatagggcgaagccgaggccaggcagggggccctgggaacagaggagacccaggatgccctgcctgaacctggcggcagcgcaaaagatg

SEQ ID NO: 216132 - DNA, 103 bp, Artificial Sequence
  Synthetic Polynucleotide
taatacgactcactatagggggcagcgagagcgccgccgcgccgttgggaaacagaggagatcccaaatgcgcggcggcaacctggcggcagcgcaaaagatg

SEQ ID NO: 216133 - DNA, 103 bp, Artificial Sequence
  Synthetic Polynucleotide
taatacgactcactatagggaggcccggggcgaagccgaggccaggcaggaacagaggagacctgccatgcctcggcttaacctggcggcagcgcaaaagatg

SEQ ID NO: 216134 - DNA, 103 bp, Artificial Sequence
  Synthetic Polynucleotide
taatacgactcactatagggttggcccgccaggcccggggcgaagccgagaacagaggagactcggcatggccccgggcaacctggcggcagcgcaaaagatg

SEQ ID NO: 216135 - DNA, 103 bp, Artificial Sequence
  Synthetic Polynucleotide
taatacgactcactatagggtgaagaactgttggcccgccaggcccggggaacagaggagaccccggatgtggcgggccaacctggcggcagcgcaaaagatg

SEQ ID NO: 216136 - DNA, 103 bp, Artificial Sequence
  Synthetic Polynucleotide
taatacgactcactataggggggtgcccgttgaagaactgttggcccgccaacagaggagaggcgggatgacagttcttaacctggcggcagcgcaaaagatg

SEQ ID NO: 216137 - DNA, 103 bp, Artificial Sequence
  Synthetic Polynucleotide
taatacgactcactatagggcaggaagagcgggtgcccgttgaagaactgaacagaggagacagttcatgaacgggcacaacctggcggcagcgcaaaagatg

SEQ ID NO: 216138 - DNA, 103 bp, Artificial Sequence
  Synthetic Polynucleotide
taatacgactcactatagggggctggggtgcaggaagagcgggtgcccgtaacagaggagaacgggcatgcgctcttccaacctggcggcagcgcaaaagatg

SEQ ID NO: 216139 - DNA, 103 bp, Artificial Sequence
  Synthetic Polynucleotide
taatacgactcactatagggatggcaaactggctggggtgcaggaagagcaacagaggagagctcttatggcaccccagaacctggcggcagcgcaaaagatg

SEQ ID NO: 216140 - DNA, 103 bp, Artificial Sequence
  Synthetic Polynucleotide
taatacgactcactatagggggcgccccccatggcaaactggctggggtgaacagaggagacaccccatgcagtttgccaacctggcggcagcgcaaaagatg

SEQ ID NO: 216141 - DNA, 103 bp, Artificial Sequence
  Synthetic Polynucleotide
taatacgactcactatagggtgctggagaaggcgccccccatggcaaactaacagaggagaagtttgatgtggggggcgaacctggcggcagcgcaaaagatg

SEQ ID NO: 216142 - DNA, 103 bp, Artificial Sequence
  Synthetic Polynucleotide
taatacgactcactataggggcggccgccatgctggagaaggcgccccccaacagaggagaggggggatgcttctccagaacctggcggcagcgcaaaagatg

SEQ ID NO: 216143 - DNA, 103 bp, Artificial Sequence
  Synthetic Polynucleotide
taatacgactcactatagggcagggcgcccggcagcgagagcgccgccgcaacagaggagagcggcgatgctctcgctgaacctggcggcagcgcaaaagatg

SEQ ID NO: 216144 - DNA, 103 bp, Artificial Sequence
  Synthetic Polynucleotide
taatacgactcactatagggacccatgccagcggccgccatgctggagaaaacagaggagattctccatgatggcggccaacctggcggcagcgcaaaagatg

SEQ ID NO: 216145 - DNA, 103 bp, Artificial Sequence
  Synthetic Polynucleotide
taatacgactcactatagggccaggaggggacccatgccagcggccgccaaacagaggagatggcggatgctggcatggaacctggcggcagcgcaaaagatg

SEQ ID NO: 216146 - DNA, 103 bp, Artificial Sequence
  Synthetic Polynucleotide
taatacgactcactataggggaaaccgtggccaggaggggacccatgccaaacagaggagatggcatatgtcccctcctaacctggcggcagcgcaaaagatg

SEQ ID NO: 216147 - DNA, 103 bp, Artificial Sequence
  Synthetic Polynucleotide
taatacgactcactatagggggaggccccagaaaccgtggccaggaggggaacagaggagacccctcatggccacggttaacctggcggcagcgcaaaagatg

SEQ ID NO: 216148 - DNA, 103 bp, Artificial Sequence
  Synthetic Polynucleotide
taatacgactcactatagggagacaccggtggaggccccagaaaccgtggaacagaggagaccacggatgctggggcctaacctggcggcagcgcaaaagatg

SEQ ID NO: 216149 - DNA, 103 bp, Artificial Sequence
  Synthetic Polynucleotide
taatacgactcactatagggtccaggcccgagacaccggtggaggccccaaacagaggagatggggcatgcaccggtgtaacctggcggcagcgcaaaagatg

SEQ ID NO: 216150 - DNA, 103 bp, Artificial Sequence
  Synthetic Polynucleotide
taatacgactcactatagggggccgtggaatccaggcccgagacaccggtaacagaggagaaccggtatgtcgggcctgaacctggcggcagcgcaaaagatg

SEQ ID NO: 216151 - DNA, 103 bp, Artificial Sequence
  Synthetic Polynucleotide
taatacgactcactatagggcagaggccatggccgtggaatccaggcccgaacagaggagacgggccatgattccacggaacctggcggcagcgcaaaagatg

SEQ ID NO: 216152 - DNA, 103 bp, Artificial Sequence
  Synthetic Polynucleotide
taatacgactcactataggggccgcagcggcagaggccatggccgtggaaaacagaggagattccacatgcatggcctcaacctggcggcagcgcaaaagatg

SEQ ID NO: 216153 - DNA, 103 bp, Artificial Sequence
  Synthetic Polynucleotide
taatacgactcactatagggcagtccctgcgccgcagcggcagaggccataacagaggagaatggccatggccgctgcgaacctggcggcagcgcaaaagatg

SEQ ID NO: 216154 - DNA, 103 bp, Artificial Sequence
  Synthetic Polynucleotide
taatacgactcactatagggtcggcttggccagggcgcccggcagcgagaaacagaggagatctcgcatgcgggcgcccaacctggcggcagcgcaaaagatg

SEQ ID NO: 216155 - DNA, 103 bp, Artificial Sequence
  Synthetic Polynucleotide
taatacgactcactatagggacgccccggacagtccctgcgccgcagcggaacagaggagaccgctgatgcgcagggacaacctggcggcagcgcaaaagatg

SEQ ID NO: 216156 - DNA, 103 bp, Artificial Sequence
  Synthetic Polynucleotide
taatacgactcactataggggtggccgcggacgccccggacagtccctgcaacagaggagagcagggatggtccggggcaacctggcggcagcgcaaaagatg

SEQ ID NO: 216157 - DNA, 103 bp, Artificial Sequence
  Synthetic Polynucleotide
taatacgactcactataggggaagggcagggtggccgcggacgccccggaaacagaggagatccgggatgtccgcggccaacctggcggcagcgcaaaagatg

SEQ ID NO: 216158 - DNA, 103 bp, Artificial Sequence
  Synthetic Polynucleotide
taatacgactcactataggggctggaggtggaagggcagggtggccgcggaacagaggagaccgcggatgccctgccctaacctggcggcagcgcaaaagatg

SEQ ID NO: 216159 - DNA, 103 bp, Artificial Sequence
  Synthetic Polynucleotide
taatacgactcactatagggaggacgtgctgctggaggtggaagggcaggaacagaggagacctgccatgccacctccaaacctggcggcagcgcaaaagatg

SEQ ID NO: 216160 - DNA, 103 bp, Artificial Sequence
  Synthetic Polynucleotide
taatacgactcactatagggctgagaggccaggacgtgctgctggaggtgaacagaggagacacctcatgcagcacgtcaacctggcggcagcgcaaaagatg

SEQ ID NO: 216161 - DNA, 103 bp, Artificial Sequence
  Synthetic Polynucleotide
taatacgactcactatagggtggccaggccctgagaggccaggacgtgctaacagaggagaagcacgatgtggcctctcaacctggcggcagcgcaaaagatg

SEQ ID NO: 216162 - DNA, 103 bp, Artificial Sequence
  Synthetic Polynucleotide
taatacgactcactatagggaaaggggacatggccaggccctgagaggccaacagaggagaggcctcatggggcctggcaacctggcggcagcgcaaaagatg

SEQ ID NO: 216163 - DNA, 103 bp, Artificial Sequence
  Synthetic Polynucleotide
taatacgactcactatagggcaggcttccgaaaggggacatggccaggccaacagaggagaggcctgatgatgtcccctaacctggcggcagcgcaaaagatg

SEQ ID NO: 216164 - DNA, 103 bp, Artificial Sequence
  Synthetic Polynucleotide
taatacgactcactatagggggtaagggaacaggcttccgaaaggggacaaacagaggagatgtcccatgtcggaagccaacctggcggcagcgcaaaagatg

SEQ ID NO: 216165 - DNA, 103 bp, Artificial Sequence
  Synthetic Polynucleotide
taatacgactcactatagggtgatccatgatcggcttggccagggcgcccaacagaggagagggcgcatgggccaagccaacctggcggcagcgcaaaagatg

SEQ ID NO: 216166 - DNA, 103 bp, Artificial Sequence
  Synthetic Polynucleotide
taatacgactcactatagggtacgtgtaggggtaagggaacaggcttccgaacagaggagacggaagatggttcccttaaacctggcggcagcgcaaaagatg

SEQ ID NO: 216167 - DNA, 103 bp, Artificial Sequence
  Synthetic Polynucleotide
taatacgactcactatagggtgcggccatgtacgtgtaggggtaagggaaaacagaggagattccctatgccctacacgaacctggcggcagcgcaaaagatg

SEQ ID NO: 216168 - DNA, 103 bp, Artificial Sequence
  Synthetic Polynucleotide
taatacgactcactatagggcggccgccgctgcggccatgtacgtgtaggaacagaggagacctacaatgacatggccgaacctggcggcagcgcaaaagatg

SEQ ID NO: 216169 - DNA, 103 bp, Artificial Sequence
  Synthetic Polynucleotide
taatacgactcactataggggcagaggaggcggccgccgctgcggccatgaacagaggagacatggcatgagcggcggcaacctggcggcagcgcaaaagatg

SEQ ID NO: 216170 - DNA, 103 bp, Artificial Sequence
  Synthetic Polynucleotide
taatacgactcactatagggggaggctgccgcagaggaggcggccgccgcaacagaggagagcggcgatggcctcctctaacctggcggcagcgcaaaagatg

SEQ ID NO: 216171 - DNA, 103 bp, Artificial Sequence
  Synthetic Polynucleotide
taatacgactcactataggggcaccgagctggaggctgccgcagaggaggaacagaggagacctcctatgcggcagcctaacctggcggcagcgcaaaagatg

SEQ ID NO: 216172 - DNA, 103 bp, Artificial Sequence
  Synthetic Polynucleotide
taatacgactcactataggggggtggcggtgcaccgagctggaggctgccaacagaggagaggcagcatgcagctcggtaacctggcggcagcgcaaaagatg

SEQ ID NO: 216173 - DNA, 103 bp, Artificial Sequence
  Synthetic Polynucleotide
taatacgactcactatagggattgaggaaggggtggcggtgcaccgagctaacagaggagaagctcgatgcaccgccacaacctggcggcagcgcaaaagatg

SEQ ID NO: 216174 - DNA, 103 bp, Artificial Sequence
  Synthetic Polynucleotide
taatacgactcactatagggtggtgttcagattgaggaaggggtggcggtaacagaggagaaccgccatgccttcctcaaacctggcggcagcgcaaaagatg

SEQ ID NO: 216175 - DNA, 103 bp, Artificial Sequence
  Synthetic Polynucleotide
taatacgactcactatagggcgcgggcgcatggtgttcagattgaggaagaacagaggagacttcctatgtctgaacacaacctggcggcagcgcaaaagatg

SEQ ID NO: 216176 - DNA, 103 bp, Artificial Sequence
  Synthetic Polynucleotide
taatacgactcactatagggccccaccaattgatccatgatcggcttggcaacagaggagagccaagatgatcatggataacctggcggcagcgcaaaagatg

SEQ ID NO: 216177 - DNA, 103 bp, Artificial Sequence
  Synthetic Polynucleotide
taatacgactcactataggggtagcgcagccgcgggcgcatggtgttcagaacagaggagactgaacatgatgcgcccgaacctggcggcagcgcaaaagatg

SEQ ID NO: 216178 - DNA, 103 bp, Artificial Sequence
  Synthetic Polynucleotide
taatacgactcactatagggagtaggggctgtagcgcagccgcgggcgcaaacagaggagatgcgccatgggctgcgctaacctggcggcagcgcaaaagatg

SEQ ID NO: 216179 - DNA, 103 bp, Artificial Sequence
  Synthetic Polynucleotide
taatacgactcactatagggaccgggatggagtaggggctgtagcgcagcaacagaggagagctgcgatgcagcccctaaacctggcggcagcgcaaaagatg

SEQ ID NO: 216180 - DNA, 103 bp, Artificial Sequence
  Synthetic Polynucleotide
taatacgactcactatagggcgggaccggcaccgggatggagtaggggctaacagaggagaagccccatgtccatcccgaacctggcggcagcgcaaaagatg

SEQ ID NO: 216181 - DNA, 103 bp, Artificial Sequence
  Synthetic Polynucleotide
taatacgactcactatagggtgctgccgtccgggaccggcaccgggatggaacagaggagaccatccatgtgccggtccaacctggcggcagcgcaaaagatg

SEQ ID NO: 216182 - DNA, 103 bp, Artificial Sequence
  Synthetic Polynucleotide
taatacgactcactataggggtgagcagactgctgccgtccgggaccggcaacagaggagagccggtatgggacggcagaacctggcggcagcgcaaaagatg

SEQ ID NO: 216183 - DNA, 103 bp, Artificial Sequence
  Synthetic Polynucleotide
taatacgactcactatagggcagggcggtggtgagcagactgctgccgtcaacagaggagagacggcatgagtctgctcaacctggcggcagcgcaaaagatg

SEQ ID NO: 216184 - DNA, 103 bp, Artificial Sequence
  Synthetic Polynucleotide
taatacgactcactatagggccatggagggcagggcggtggtgagcagacaacagaggagagtctgcatgccaccgcccaacctggcggcagcgcaaaagatg

SEQ ID NO: 216185 - DNA, 103 bp, Artificial Sequence
  Synthetic Polynucleotide
taatacgactcactataggggcggccgccgccatggagggcagggcggtgaacagaggagacaccgcatggccctccataacctggcggcagcgcaaaagatg

SEQ ID NO: 216186 - DNA, 103 bp, Artificial Sequence
  Synthetic Polynucleotide
taatacgactcactatagggcaggggccccgcggccgccgccatggagggaacagaggagaccctccatggcggcggccaacctggcggcagcgcaaaagatg

SEQ ID NO: 216187 - DNA, 103 bp, Artificial Sequence
  Synthetic Polynucleotide
taatacgactcactatagggttgtcccaggaatgaccggatctctcatggaacagaggagaccatgaatgatccggtcaaacctggcggcagcgcaaaagatg

SEQ ID NO: 216188 - DNA, 103 bp, Artificial Sequence
  Synthetic Polynucleotide
taatacgactcactatagggtctcggccgcccccaccaattgatccatgaaacagaggagatcatggatgaattggtggaacctggcggcagcgcaaaagatg

SEQ ID NO: 216189 - DNA, 103 bp, Artificial Sequence
  Synthetic Polynucleotide
taatacgactcactatagggctttgccgtccaggggccccgcggccgccgaacagaggagacggcggatgcggggccccaacctggcggcagcgcaaaagatg

SEQ ID NO: 216190 - DNA, 103 bp, Artificial Sequence
  Synthetic Polynucleotide
taatacgactcactatagggagggcggcgactttgccgtccaggggccccaacagaggagaggggccatgggacggcaaaacctggcggcagcgcaaaagatg

SEQ ID NO: 216191 - DNA, 103 bp, Artificial Sequence
  Synthetic Polynucleotide
taatacgactcactataggggctggcggccagggcggcgactttgccgtcaacagaggagagacggcatggtcgccgccaacctggcggcagcgcaaaagatg

SEQ ID NO: 216192 - DNA, 103 bp, Artificial Sequence
  Synthetic Polynucleotide
taatacgactcactatagggccgaggccgggctggcggccagggcggcgaaacagaggagatcgccgatgtggccgccaaacctggcggcagcgcaaaagatg

SEQ ID NO: 216193 - DNA, 103 bp, Artificial Sequence
  Synthetic Polynucleotide
taatacgactcactatagggtccactgccaccgaggccgggctggcggccaacagaggagaggccgcatgcccggcctcaacctggcggcagcgcaaaagatg

SEQ ID NO: 216194 - DNA, 103 bp, Artificial Sequence
  Synthetic Polynucleotide
taatacgactcactatagggagagcccgagtccactgccaccgaggccggaacagaggagaccggccatggtggcagtgaacctggcggcagcgcaaaagatg

SEQ ID NO: 216195 - DNA, 103 bp, Artificial Sequence
  Synthetic Polynucleotide
taatacgactcactatagggtgttgagttcagagcccgagtccactgccaaacagaggagatggcagatgactcgggctaacctggcggcagcgcaaaagatg

SEQ ID NO: 216196 - DNA, 103 bp, Artificial Sequence
  Synthetic Polynucleotide
taatacgactcactataggggaggagcggctgttgagttcagagcccgagaacagaggagactcgggatgtgaactcaaaacctggcggcagcgcaaaagatg

SEQ ID NO: 216197 - DNA, 103 bp, Artificial Sequence
  Synthetic Polynucleotide
taatacgactcactatagggggagagcgtggaggagcggctgttgagttcaacagaggagagaactcatgagccgctccaacctggcggcagcgcaaaagatg

SEQ ID NO: 216198 - DNA, 103 bp, Artificial Sequence
  Synthetic Polynucleotide
taatacgactcactatagggtggagctggaggagagcgtggaggagcggcaacagaggagagccgctatgccacgctctaacctggcggcagcgcaaaagatg

SEQ ID NO: 216199 - DNA, 103 bp, Artificial Sequence
  Synthetic Polynucleotide
taatacgactcactataggggggatgccggtctcggccgcccccaccaataacagaggagaattggtatgggcggccgaaacctggcggcagcgcaaaagatg

SEQ ID NO: 216200 - DNA, 103 bp, Artificial Sequence
  Synthetic Polynucleotide
taatacgactcactataggggacaaggacatggagctggaggagagcgtgaacagaggagacacgctatgctccagctcaacctggcggcagcgcaaaagatg

SEQ ID NO: 216201 - DNA, 103 bp, Artificial Sequence
  Synthetic Polynucleotide
taatacgactcactataggggagtttgggcgacaaggacatggagctggaaacagaggagatccagcatgatgtccttgaacctggcggcagcgcaaaagatg

SEQ ID NO: 216202 - DNA, 103 bp, Artificial Sequence
  Synthetic Polynucleotide
taatacgactcactatagggtctccgcgcagagtttgggcgacaaggacaaacagaggagatgtcctatgcgcccaaacaacctggcggcagcgcaaaagatg

SEQ ID NO: 216203 - DNA, 103 bp, Artificial Sequence
  Synthetic Polynucleotide
taatacgactcactataggggccgcctctttctccgcgcagagtttgggcaacagaggagagcccaaatgctgcgcggaaacctggcggcagcgcaaaagatg

SEQ ID NO: 216204 - DNA, 103 bp, Artificial Sequence
  Synthetic Polynucleotide
taatacgactcactatagggttcgctggtggccgcctctttctccgcgcaaacagaggagatgcgcgatgaaagaggcgaacctggcggcagcgcaaaagatg

SEQ ID NO: 216205 - DNA, 103 bp, Artificial Sequence
  Synthetic Polynucleotide
taatacgactcactatagggtgctctgcagttcgctggtggccgcctcttaacagaggagaaagaggatgccaccagcgaacctggcggcagcgcaaaagatg

SEQ ID NO: 216206 - DNA, 103 bp, Artificial Sequence
  Synthetic Polynucleotide
taatacgactcactatagggaaccgctggatgctctgcagttcgctggtgaacagaggagacaccagatgactgcagagaacctggcggcagcgcaaaagatg

SEQ ID NO: 216207 - DNA, 103 bp, Artificial Sequence
  Synthetic Polynucleotide
taatacgactcactataggggccgctaaccaaccgctggatgctctgcagaacagaggagactgcagatgatccagcggaacctggcggcagcgcaaaagatg

SEQ ID NO: 216208 - DNA, 103 bp, Artificial Sequence
  Synthetic Polynucleotide
taatacgactcactatagggtggcttccaagccgctaaccaaccgctggaaacagaggagatccagcatgtggttagcgaacctggcggcagcgcaaaagatg

SEQ ID NO: 216209 - DNA, 103 bp, Artificial Sequence
  Synthetic Polynucleotide
taatacgactcactatagggctgtccggcttggcttccaagccgctaaccaacagaggagaggttagatgcttggaagcaacctggcggcagcgcaaaagatg

SEQ ID NO: 216210 - DNA, 103 bp, Artificial Sequence
  Synthetic Polynucleotide
taatacgactcactatagggggaggagaacgggatgccggtctcggccgcaacagaggagagcggccatgaccggcatcaacctggcggcagcgcaaaagatg

SEQ ID NO: 216211 - DNA, 103 bp, Artificial Sequence
  Synthetic Polynucleotide
taatacgactcactataggggctgcgggacctgtccggcttggcttccaaaacagaggagattggaaatgaagccggacaacctggcggcagcgcaaaagatg

SEQ ID NO: 216212 - DNA, 103 bp, Artificial Sequence
  Synthetic Polynucleotide
taatacgactcactatagggacggggacgcgctgcgggacctgtccggctaacagaggagaagccggatgggtcccgcaaacctggcggcagcgcaaaagatg

SEQ ID NO: 216213 - DNA, 103 bp, Artificial Sequence
  Synthetic Polynucleotide
taatacgactcactatagggggggccccagggaggagaacgggatgccggaacagaggagaccggcaatgcgttctcctaacctggcggcagcgcaaaagatg

SEQ ID NO: 216214 - DNA, 103 bp, Artificial Sequence
  Synthetic Polynucleotide
taatacgactcactatagggagatgcgcctggggccccagggaggagaacaacagaggagagttctcatgcctggggccaacctggcggcagcgcaaaagatg

SEQ ID NO: 216215 - DNA, 103 bp, Artificial Sequence
  Synthetic Polynucleotide
taatacgactcactatagggcaaaggcctcagatgcgcctggggccccagaacagaggagactggggatgcaggcgcataacctggcggcagcgcaaaagatg

SEQ ID NO: 216216 - DNA, 103 bp, Artificial Sequence
  Synthetic Polynucleotide
taatacgactcactatagggccatggtcttcaaaggcctcagatgcgcctaacagaggagaaggcgcatgtgaggccttaacctggcggcagcgcaaaagatg

SEQ ID NO: 216217 - DNA, 103 bp, Artificial Sequence
  Synthetic Polynucleotide
taatacgactcactatagggtcttcgggctccatggtcttcaaaggcctcaacagaggagagaggccatggaagaccataacctggcggcagcgcaaaagatg

SEQ ID NO: 216218 - DNA, 103 bp, Artificial Sequence
  Synthetic Polynucleotide
taatacgactcactatagggctccacctcttcttcgggctccatggtcttaacagaggagaaagaccatggagcccgaaaacctggcggcagcgcaaaagatg

SEQ ID NO: 216219 - DNA, 103 bp, Artificial Sequence
  Synthetic Polynucleotide
taatacgactcactatagggtggggtcgtcctccacctcttcttcgggctaacagaggagaagcccgatgaagaggtggaacctggcggcagcgcaaaagatg

SEQ ID NO: 216220 - DNA, 103 bp, Artificial Sequence
  Synthetic Polynucleotide
taatacgactcactatagggtaggccatgcttgtcccaggaatgaccggaaacagaggagatccggtatgtcctgggacaacctggcggcagcgcaaaagatg

SEQ ID NO: 216221 - DNA, 103 bp, Artificial Sequence
  Synthetic Polynucleotide
taatacgactcactatagggaggtgcaccttggggtcgtcctccacctctaacagaggagaagaggtatgggacgacccaacctggcggcagcgcaaaagatg

SEQ ID NO: 216222 - DNA, 103 bp, Artificial Sequence
  Synthetic Polynucleotide
taatacgactcactatagggtttagcctccaggtgcaccttggggtcgtcaacagaggagagacgacatgaaggtgcacaacctggcggcagcgcaaaagatg

SEQ ID NO: 216223 - DNA, 103 bp, Artificial Sequence
  Synthetic Polynucleotide
taatacgactcactatagggcccaaagttctttagcctccaggtgcacctaacagaggagaaggtgcatgtggaggctaaacctggcggcagcgcaaaagatg

SEQ ID NO: 216224 - DNA, 103 bp, Artificial Sequence
  Synthetic Polynucleotide
taatacgactcactatagggtgaaactgatcccaaagttctttagcctccaacagaggagaggaggcatgagaactttgaacctggcggcagcgcaaaagatg

SEQ ID NO: 216225 - DNA, 103 bp, Artificial Sequence
  Synthetic Polynucleotide
taatacgactcactataggggccccgcttgtgaaactgatcccaaagttcaacagaggagagaacttatggatcagtttaacctggcggcagcgcaaaagatg

SEQ ID NO: 216226 - DNA, 103 bp, Artificial Sequence
  Synthetic Polynucleotide
taatacgactcactatagggccatctcggtgccccgcttgtgaaactgataacagaggagaatcagtatgacaagcgggaacctggcggcagcgcaaaagatg

SEQ ID NO: 216227 - DNA, 103 bp, Artificial Sequence
  Synthetic Polynucleotide
taatacgactcactatagggttggtaatgaccatctcggtgccccgcttgaacagaggagacaagcgatgcaccgagataacctggcggcagcgcaaaagatg

SEQ ID NO: 216228 - DNA, 103 bp, Artificial Sequence
  Synthetic Polynucleotide
taatacgactcactatagggccttcccgacttggtaatgaccatctcggtaacagaggagaaccgagatggtcattaccaacctggcggcagcgcaaaagatg

SEQ ID NO: 216229 - DNA, 103 bp, Artificial Sequence
  Synthetic Polynucleotide
taatacgactcactataggggaaacattcgccttcccgacttggtaatgaaacagaggagatcattaatgagtcgggaaaacctggcggcagcgcaaaagatg

SEQ ID NO: 216230 - DNA, 103 bp, Artificial Sequence
  Synthetic Polynucleotide
taatacgactcactatagggttaaatggaggaaacattcgccttcccgacaacagaggagagtcgggatggcgaatgttaacctggcggcagcgcaaaagatg

SEQ ID NO: 216231 - DNA, 103 bp, Artificial Sequence
  Synthetic Polynucleotide
taatacgactcactataggggaacggatggtaggccatgcttgtcccaggaacagaggagacctgggatgagcatggccaacctggcggcagcgcaaaagatg

SEQ ID NO: 216232 - DNA, 103 bp, Artificial Sequence
  Synthetic Polynucleotide
taatacgactcactatagggacatctcactttaaatggaggaaacattcgaacagaggagacgaatgatgcctccatttaacctggcggcagcgcaaaagatg

SEQ ID NO: 216233 - DNA, 103 bp, Artificial Sequence
  Synthetic Polynucleotide
taatacgactcactatagggccagcccagaacatctcactttaaatggagaacagaggagactccatatgaagtgagataacctggcggcagcgcaaaagatg

SEQ ID NO: 216234 - DNA, 103 bp, Artificial Sequence
  Synthetic Polynucleotide
taatacgactcactataggggcttttttatccagcccagaacatctcactaacagaggagaagtgagatgttctgggctaacctggcggcagcgcaaaagatg

SEQ ID NO: 216235 - DNA, 103 bp, Artificial Sequence
  Synthetic Polynucleotide
taatacgactcactatagggaatgtatttggcttttttatccagcccagaaacagaggagatctgggatggataaaaaaaacctggcggcagcgcaaaagatg

SEQ ID NO: 216236 - DNA, 103 bp, Artificial Sequence
  Synthetic Polynucleotide
taatacgactcactatagggccatcaataaaatgtatttggcttttttataacagaggagaataaaaatgccaaatacaaacctggcggcagcgcaaaagatg

SEQ ID NO: 216237 - DNA, 103 bp, Artificial Sequence
  Synthetic Polynucleotide
taatacgactcactataggggctataatgtccatcaataaaatgtatttgaacagaggagacaaataatgtttattgataacctggcggcagcgcaaaagatg

SEQ ID NO: 216238 - DNA, 103 bp, Artificial Sequence
  Synthetic Polynucleotide
taatacgactcactataggggtcatcagcagctataatgtccatcaataaaacagaggagattattgatggacattataaacctggcggcagcgcaaaagatg

SEQ ID NO: 216239 - DNA, 103 bp, Artificial Sequence
  Synthetic Polynucleotide
taatacgactcactatagggtataacgacagtcatcagcagctataatgtaacagaggagaacattaatgctgctgatgaacctggcggcagcgcaaaagatg

SEQ ID NO: 216240 - DNA, 103 bp, Artificial Sequence
  Synthetic Polynucleotide
taatacgactcactatagggttgtgaaatttataacgacagtcatcagcaaacagaggagatgctgaatgctgtcgttaaacctggcggcagcgcaaaagatg

SEQ ID NO: 216241 - DNA, 103 bp, Artificial Sequence
  Synthetic Polynucleotide
taatacgactcactatagggccaccgagaattgtgaaatttataacgacaaacagaggagatgtcgtatgaaatttcacaacctggcggcagcgcaaaagatg

SEQ ID NO: 216242 - DNA, 103 bp, Artificial Sequence
  Synthetic Polynucleotide
taatacgactcactatagggggtgaggtaggaacggatggtaggccatgcaacagaggagagcatggatgaccatccgtaacctggcggcagcgcaaaagatg

SEQ ID NO: 216243 - DNA, 103 bp, Artificial Sequence
  Synthetic Polynucleotide
taatacgactcactatagggcagccaccatccaccgagaattgtgaaattaacagaggagaaatttcatgattctcggtaacctggcggcagcgcaaaagatg

SEQ ID NO: 216244 - DNA, 103 bp, Artificial Sequence
  Synthetic Polynucleotide
taatacgactcactatagggtcggccttaccagccaccatccaccgagaaaacagaggagattctcgatggatggtggcaacctggcggcagcgcaaaagatg

SEQ ID NO: 216245 - DNA, 103 bp, Artificial Sequence
  Synthetic Polynucleotide
taatacgactcactatagggcatttcggggtcggccttaccagccaccataacagaggagaatggtgatgggtaaggccaacctggcggcagcgcaaaagatg

SEQ ID NO: 216246 - DNA, 103 bp, Artificial Sequence
  Synthetic Polynucleotide
taatacgactcactatagggtcctctttggcatttcggggtcggccttacaacagaggagagtaaggatgaccccgaaaaacctggcggcagcgcaaaagatg

SEQ ID NO: 216247 - DNA, 103 bp, Artificial Sequence
  Synthetic Polynucleotide
taatacgactcactatagggtgaatgtacatcctctttggcatttcggggaacagaggagaccccgaatggccaaagagaacctggcggcagcgcaaaagatg

SEQ ID NO: 216248 - DNA, 103 bp, Artificial Sequence
  Synthetic Polynucleotide
taatacgactcactataggggctgtccgggtgaatgtacatcctctttggaacagaggagaccaaagatgatgtacattaacctggcggcagcgcaaaagatg

SEQ ID NO: 216249 - DNA, 103 bp, Artificial Sequence
  Synthetic Polynucleotide
taatacgactcactatagggcagtagcggggctgtccgggtgaatgtacaaacagaggagatgtacaatgacccggacaaacctggcggcagcgcaaaagatg

SEQ ID NO: 216250 - DNA, 103 bp, Artificial Sequence
  Synthetic Polynucleotide
taatacgactcactatagggcactgttccccagtagcggggctgtccgggaacagaggagacccggaatgccccgctacaacctggcggcagcgcaaaagatg

SEQ ID NO: 216251 - DNA, 103 bp, Artificial Sequence
  Synthetic Polynucleotide
taatacgactcactatagggtttggacatccactgttccccagtagcgggaacagaggagacccgctatgggggaacagaacctggcggcagcgcaaaagatg

SEQ ID NO: 216252 - DNA, 103 bp, Artificial Sequence
  Synthetic Polynucleotide
taatacgactcactatagggaagtgacgactttggacatccactgttcccaacagaggagagggaacatgggatgtccaaacctggcggcagcgcaaaagatg

SEQ ID NO: 216253 - DNA, 103 bp, Artificial Sequence
  Synthetic Polynucleotide
taatacgactcactatagggtccggcgcccggtgaggtaggaacggatggaacagaggagaccatccatgcctacctcaaacctggcggcagcgcaaaagatg

SEQ ID NO: 216254 - DNA, 103 bp, Artificial Sequence
  Synthetic Polynucleotide
taatacgactcactatagggagtttgtggaaagtgacgactttggacatcaacagaggagagatgtcatgagtcgtcacaacctggcggcagcgcaaaagatg

SEQ ID NO: 216255 - DNA, 103 bp, Artificial Sequence
  Synthetic Polynucleotide
taatacgactcactatagggggtgagtttcagtttgtggaaagtgacgacaacagaggagagtcgtcatgttccacaaaaacctggcggcagcgcaaaagatg

SEQ ID NO: 216256 - DNA, 103 bp, Artificial Sequence
  Synthetic Polynucleotide
taatacgactcactatagggaaatgttgttggtgagtttcagtttgtggaaacagaggagatccacaatgtgaaactcaaacctggcggcagcgcaaaagatg

SEQ ID NO: 216257 - DNA, 103 bp, Artificial Sequence
  Synthetic Polynucleotide
taatacgactcactatagggtgtttgtctgaaatgttgttggtgagtttcaacagaggagagaaactatgcaacaacataacctggcggcagcgcaaaagatg

SEQ ID NO: 216258 - DNA, 103 bp, Artificial Sequence
  Synthetic Polynucleotide
taatacgactcactatagggagtaaatccatgtttgtctgaaatgttgttaacagaggagaaacaacatgtcagacaaaaacctggcggcagcgcaaaagatg

SEQ ID NO: 216259 - DNA, 103 bp, Artificial Sequence
  Synthetic Polynucleotide
taatacgactcactatagggggaaggccaaagtaaatccatgtttgtctgaacagaggagacagacaatgatggatttaaacctggcggcagcgcaaaagatg

SEQ ID NO: 216260 - DNA, 103 bp, Artificial Sequence
  Synthetic Polynucleotide
taatacgactcactatagggtgatcacttgggaaggccaaagtaaatccaaacagaggagatggattatgtttggccttaacctggcggcagcgcaaaagatg

SEQ ID NO: 216261 - DNA, 103 bp, Artificial Sequence
  Synthetic Polynucleotide
taatacgactcactatagggccacgtagcgtgatcacttgggaaggccaaaacagaggagattggccatgccaagtgataacctggcggcagcgcaaaagatg

SEQ ID NO: 216262 - DNA, 103 bp, Artificial Sequence
  Synthetic Polynucleotide
taatacgactcactatagggaattcccctgccacgtagcgtgatcacttgaacagaggagacaagtgatgacgctacgtaacctggcggcagcgcaaaagatg

SEQ ID NO: 216263 - DNA, 103 bp, Artificial Sequence
  Synthetic Polynucleotide
taatacgactcactatagggccaaaactataattcccctgccacgtagcgaacagaggagacgctacatggcaggggaaaacctggcggcagcgcaaaagatg

SEQ ID NO: 216264 - DNA, 103 bp, Artificial Sequence
  Synthetic Polynucleotide
taatacgactcactatagggcatggcgaagtccggcgcccggtgaggtagaacagaggagactacctatgcgggcgccgaacctggcggcagcgcaaaagatg

SEQ ID NO: 216265 - DNA, 103 bp, Artificial Sequence
  Synthetic Polynucleotide
taatacgactcactatagggagtctgagtaccaaaactataattcccctgaacagaggagacaggggatgtatagttttaacctggcggcagcgcaaaagatg

SEQ ID NO: 216266 - DNA, 103 bp, Artificial Sequence
  Synthetic Polynucleotide
taatacgactcactatagggagttcaatatagtctgagtaccaaaactataacagaggagaatagttatggtactcagaaacctggcggcagcgcaaaagatg

SEQ ID NO: 216267 - DNA, 103 bp, Artificial Sequence
  Synthetic Polynucleotide
taatacgactcactatagggttgtgcatggagttcaatatagtctgagtaaacagaggagatactcaatgtatattgaaaacctggcggcagcgcaaaagatg

SEQ ID NO: 216268 - DNA, 103 bp, Artificial Sequence
  Synthetic Polynucleotide
taatacgactcactataggggggctggtatttgtgcatggagttcaatataacagaggagaatattgatgtccatgcacaacctggcggcagcgcaaaagatg

SEQ ID NO: 216269 - DNA, 103 bp, Artificial Sequence
  Synthetic Polynucleotide
taatacgactcactatagggtgtggaaccggggctggtatttgtgcatggaacagaggagaccatgcatgaataccagcaacctggcggcagcgcaaaagatg

SEQ ID NO: 216270 - DNA, 103 bp, Artificial Sequence
  Synthetic Polynucleotide
taatacgactcactataggggctcttacaatgtggaaccggggctggtataacagaggagaataccaatgccggttccaaacctggcggcagcgcaaaagatg

SEQ ID NO: 216271 - DNA, 103 bp, Artificial Sequence
  Synthetic Polynucleotide
taatacgactcactataggggatgtcattggctcttacaatgtggaaccgaacagaggagacggttcatgattgtaagaaacctggcggcagcgcaaaagatg

SEQ ID NO: 216272 - DNA, 103 bp, Artificial Sequence
  Synthetic Polynucleotide
taatacgactcactatagggggagtttcaagatgtcattggctcttacaaaacagaggagattgtaaatgccaatgacaaacctggcggcagcgcaaaagatg

SEQ ID NO: 216273 - DNA, 103 bp, Artificial Sequence
  Synthetic Polynucleotide
taatacgactcactataggggtactataagggagtttcaagatgtcattgaacagaggagacaatgaatgcttgaaactaacctggcggcagcgcaaaagatg

SEQ ID NO: 216274 - DNA, 103 bp, Artificial Sequence
  Synthetic Polynucleotide
taatacgactcactatagggtgtccgaaatgtactataagggagtttcaaaacagaggagattgaaaatgccttatagtaacctggcggcagcgcaaaagatg

SEQ ID NO: 216275 - DNA, 103 bp, Artificial Sequence
  Synthetic Polynucleotide
taatacgactcactataggggcaccgcgctcatggcgaagtccggcgcccaacagaggagagggcgcatgacttcgccaaacctggcggcagcgcaaaagatg

SEQ ID NO: 216276 - DNA, 103 bp, Artificial Sequence
  Synthetic Polynucleotide
taatacgactcactatagggggaacaagtatgtccgaaatgtactataagaacagaggagacttataatgcatttcggaaacctggcggcagcgcaaaagatg

SEQ ID NO: 216277 - DNA, 103 bp, Artificial Sequence
  Synthetic Polynucleotide
taatacgactcactatagggtcagtttcggggaacaagtatgtccgaaataacagaggagaatttcgatgatacttgttaacctggcggcagcgcaaaagatg

SEQ ID NO: 216278 - DNA, 103 bp, Artificial Sequence
  Synthetic Polynucleotide
taatacgactcactatagggagcgatgaattcagtttcggggaacaagtaaacagaggagatacttgatgcccgaaactaacctggcggcagcgcaaaagatg

SEQ ID NO: 216279 - DNA, 103 bp, Artificial Sequence
  Synthetic Polynucleotide
taatacgactcactatagggatgcagtcacagcgatgaattcagtttcggaacagaggagaccgaaaatgaattcatcgaacctggcggcagcgcaaaagatg

SEQ ID NO: 216280 - DNA, 103 bp, Artificial Sequence
  Synthetic Polynucleotide
taatacgactcactatagggtcattctggtatgcagtcacagcgatgaataacagaggagaattcatatgtgtgactgcaacctggcggcagcgcaaaagatg

SEQ ID NO: 216281 - DNA, 103 bp, Artificial Sequence
  Synthetic Polynucleotide
taatacgactcactatagggggttatcttatcattctggtatgcagtcacaacagaggagagtgactatgtaccagaataacctggcggcagcgcaaaagatg

SEQ ID NO: 216282 - DNA, 103 bp, Artificial Sequence
  Synthetic Polynucleotide
taatacgactcactatagggtttttaactgggttatcttatcattctggtaacagaggagaaccagaatgataagataaaacctggcggcagcgcaaaagatg

SEQ ID NO: 216283 - DNA, 103 bp, Artificial Sequence
  Synthetic Polynucleotide
taatacgactcactatagggttgttgtctatttttaactgggttatcttaaacagaggagataagatatgccagttaaaaacctggcggcagcgcaaaagatg

SEQ ID NO: 216284 - DNA, 103 bp, Artificial Sequence
  Synthetic Polynucleotide
taatacgactcactatagggtgcaaaagggttgttgtctatttttaactgaacagaggagacagttaatgatagacaacaacctggcggcagcgcaaaagatg

SEQ ID NO: 216285 - DNA, 103 bp, Artificial Sequence
  Synthetic Polynucleotide
taatacgactcactatagggggaaaccttttgcaaaagggttgttgtctaaacagaggagatagacaatgacccttttgaacctggcggcagcgcaaaagatg

SEQ ID NO: 216286 - DNA, 103 bp, Artificial Sequence
  Synthetic Polynucleotide
taatacgactcactatagggtggtgacccagcaccgcgctcatggcgaagaacagaggagacttcgcatggagcgcggtaacctggcggcagcgcaaaagatg

SEQ ID NO: 216287 - DNA, 103 bp, Artificial Sequence
  Synthetic Polynucleotide
taatacgactcactatagggccagtgtcccggaaaccttttgcaaaagggaacagaggagaccctttatgaaaaggtttaacctggcggcagcgcaaaagatg

SEQ ID NO: 216288 - DNA, 103 bp, Artificial Sequence
  Synthetic Polynucleotide
taatacgactcactatagggtcggccatttccagtgtcccggaaacctttaacagaggagaaaaggtatgcgggacactaacctggcggcagcgcaaaagatg

SEQ ID NO: 216289 - DNA, 103 bp, Artificial Sequence
  Synthetic Polynucleotide
taatacgactcactatagggttttttctcttcggccatttccagtgtcccaacagaggagagggacaatggaaatggccaacctggcggcagcgcaaaagatg

SEQ ID NO: 216290 - DNA, 103 bp, Artificial Sequence
  Synthetic Polynucleotide
taatacgactcactatagggagctgttttcttttttctcttcggccatttaacagaggagaaaatggatgaagagaaaaaacctggcggcagcgcaaaagatg

SEQ ID NO: 216291 - DNA, 103 bp, Artificial Sequence
  Synthetic Polynucleotide
taatacgactcactatagggctgcagggtgagctgttttcttttttctctaacagaggagaagagaaatgagaaaacagaacctggcggcagcgcaaaagatg

SEQ ID NO: 216292 - DNA, 103 bp, Artificial Sequence
  Synthetic Polynucleotide
taatacgactcactatagggccctcatggactgcagggtgagctgttttcaacagaggagagaaaacatgtcaccctgcaacctggcggcagcgcaaaagatg

SEQ ID NO: 216293 - DNA, 103 bp, Artificial Sequence
  Synthetic Polynucleotide
taatacgactcactatagggtcatcaaacaccctcatggactgcagggtgaacagaggagacaccctatggtccatgagaacctggcggcagcgcaaaagatg

SEQ ID NO: 216294 - DNA, 103 bp, Artificial Sequence
  Synthetic Polynucleotide
taatacgactcactatagggtttgtgtctttcatcaaacaccctcatggaaacagaggagatccatgatggtgtttgataacctggcggcagcgcaaaagatg

SEQ ID NO: 216295 - DNA, 103 bp, Artificial Sequence
  Synthetic Polynucleotide
taatacgactcactatagggcattctcctttttgtgtctttcatcaaacaaacagaggagatgtttgatgaaagacacaaacctggcggcagcgcaaaagatg

SEQ ID NO: 216296 - DNA, 103 bp, Artificial Sequence
  Synthetic Polynucleotide
taatacgactcactatagggtcagaggtcccattctcctttttgtgtcttaacagaggagaaagacaatgaaaggagaaaacctggcggcagcgcaaaagatg

SEQ ID NO: 216297 - DNA, 103 bp, Artificial Sequence
  Synthetic Polynucleotide
taatacgactcactatagggcaggccaaagccctcgtctgcgtcggccataacagaggagaatggccatggcagacgagaacctggcggcagcgcaaaagatg

SEQ ID NO: 216298 - DNA, 103 bp, Artificial Sequence
  Synthetic Polynucleotide
taatacgactcactatagggcgacggggacttgctgggggccccgagcgcaacagaggagagcgctcatggcccccagcaacctggcggcagcgcaaaagatg

SEQ ID NO: 216299 - DNA, 103 bp, Artificial Sequence
  Synthetic Polynucleotide
taatacgactcactatagggcttcttatagggatggtctgtggtggaacaaacagaggagatgttccatgacagaccataacctggcggcagcgcaaaagatg

SEQ ID NO: 216300 - DNA, 103 bp, Artificial Sequence
  Synthetic Polynucleotide
taatacgactcactatagggccatgtagggcttcttatagggatggtctgaacagaggagacagaccatgcctataagaaacctggcggcagcgcaaaagatg

SEQ ID NO: 216301 - DNA, 103 bp, Artificial Sequence
  Synthetic Polynucleotide
taatacgactcactatagggggtgatgtctccatgtagggcttcttatagaacagaggagactataaatggccctacataacctggcggcagcgcaaaagatg

SEQ ID NO: 216302 - DNA, 103 bp, Artificial Sequence
  Synthetic Polynucleotide
taatacgactcactatagggttcttcactgggtgatgtctccatgtagggaacagaggagaccctacatggagacatcaaacctggcggcagcgcaaaagatg

SEQ ID NO: 216303 - DNA, 103 bp, Artificial Sequence
  Synthetic Polynucleotide
taatacgactcactatagggagaaggaatcttcttcactgggtgatgtctaacagaggagaagacatatgccagtgaagaacctggcggcagcgcaaaagatg

SEQ ID NO: 216304 - DNA, 103 bp, Artificial Sequence
  Synthetic Polynucleotide
taatacgactcactatagggctagagcggtagaaggaatcttcttcactgaacagaggagacagtgaatgagattccttaacctggcggcagcgcaaaagatg

SEQ ID NO: 216305 - DNA, 103 bp, Artificial Sequence
  Synthetic Polynucleotide
taatacgactcactatagggctgtggatagctagagcggtagaaggaatcaacagaggagagattccatgtaccgctctaacctggcggcagcgcaaaagatg

SEQ ID NO: 216306 - DNA, 103 bp, Artificial Sequence
  Synthetic Polynucleotide
taatacgactcactatagggggccctgctgctgtggatagctagagcggtaacagaggagaaccgctatggctatccacaacctggcggcagcgcaaaagatg

SEQ ID NO: 216307 - DNA, 103 bp, Artificial Sequence
  Synthetic Polynucleotide
taatacgactcactataggggaggcacccaggccctgctgctgtggatagaacagaggagactatccatggcagcagggaacctggcggcagcgcaaaagatg

SEQ ID NO: 216308 - DNA, 103 bp, Artificial Sequence
  Synthetic Polynucleotide
taatacgactcactatagggtgtcctgtaggaggcacccaggccctgctgaacagaggagacagcagatgctgggtgccaacctggcggcagcgcaaaagatg

SEQ ID NO: 216309 - DNA, 103 bp, Artificial Sequence
  Synthetic Polynucleotide
taatacgactcactatagggcctgcggggacgacggggacttgctgggggaacagaggagacccccaatgagtccccgtaacctggcggcagcgcaaaagatg

SEQ ID NO: 216310 - DNA, 103 bp, Artificial Sequence
  Synthetic Polynucleotide
taatacgactcactataggggtgccgactctgtcctgtaggaggcacccaaacagaggagatgggtgatgcctacaggaaacctggcggcagcgcaaaagatg

SEQ ID NO: 216311 - DNA, 103 bp, Artificial Sequence
  Synthetic Polynucleotide
taatacgactcactataggggcttgccgctgtgccgactctgtcctgtagaacagaggagactacagatgagagtcggcaacctggcggcagcgcaaaagatg

SEQ ID NO: 216312 - DNA, 103 bp, Artificial Sequence
  Synthetic Polynucleotide
taatacgactcactatagggatacatgcaagcttgccgctgtgccgactcaacagaggagagagtcgatgcagcggcaaaacctggcggcagcgcaaaagatg

SEQ ID NO: 216313 - DNA, 103 bp, Artificial Sequence
  Synthetic Polynucleotide
taatacgactcactatagggcagagctggcatacatgcaagcttgccgctaacagaggagaagcggcatgcttgcatgtaacctggcggcagcgcaaaagatg

SEQ ID NO: 216314 - DNA, 103 bp, Artificial Sequence
  Synthetic Polynucleotide
taatacgactcactatagggctggggggcgcagagctggcatacatgcaaaacagaggagattgcatatgtgccagctcaacctggcggcagcgcaaaagatg

SEQ ID NO: 216315 - DNA, 103 bp, Artificial Sequence
  Synthetic Polynucleotide
taatacgactcactatagggcacaggctcgctggggggcgcagagctggcaacagaggagagccagcatggcgccccccaacctggcggcagcgcaaaagatg

SEQ ID NO: 216316 - DNA, 103 bp, Artificial Sequence
  Synthetic Polynucleotide
taatacgactcactatagggctaggctgggcacaggctcgctggggggcgaacagaggagacgccccatggcgagcctgaacctggcggcagcgcaaaagatg

SEQ ID NO: 216317 - DNA, 103 bp, Artificial Sequence
  Synthetic Polynucleotide
taatacgactcactatagggctgatgtcctctaggctgggcacaggctcgaacagaggagacgagccatggcccagcctaacctggcggcagcgcaaaagatg

SEQ ID NO: 216318 - DNA, 103 bp, Artificial Sequence
  Synthetic Polynucleotide
taatacgactcactatagggcgtgttgcagctgatgtcctctaggctgggaacagaggagacccagcatggaggacatcaacctggcggcagcgcaaaagatg

SEQ ID NO: 216319 - DNA, 103 bp, Artificial Sequence
  Synthetic Polynucleotide
taatacgactcactatagggtgcttggccacgtgttgcagctgatgtcctaacagaggagaaggacaatggctgcaacaaacctggcggcagcgcaaaagatg

SEQ ID NO: 216320 - DNA, 103 bp, Artificial Sequence
  Synthetic Polynucleotide
taatacgactcactataggggtgaaggcggcctgcggggacgacggggacaacagaggagagtccccatggtccccgcaaacctggcggcagcgcaaaagatg

SEQ ID NO: 216321 - DNA, 103 bp, Artificial Sequence
  Synthetic Polynucleotide
taatacgactcactatagggtaggaaggcatgcttggccacgtgttgcagaacagaggagactgcaaatggtggccaagaacctggcggcagcgcaaaagatg

SEQ ID NO: 216322 - DNA, 103 bp, Artificial Sequence
  Synthetic Polynucleotide
taatacgactcactataggggcagctgctgtaggaaggcatgcttggccaaacagaggagatggccaatgatgccttccaacctggcggcagcgcaaaagatg

SEQ ID NO: 216323 - DNA, 103 bp, Artificial Sequence
  Synthetic Polynucleotide
taatacgactcactatagggtggtgacggtgcagctgctgtaggaaggcaaacagaggagatgccttatgacagcagctaacctggcggcagcgcaaaagatg

SEQ ID NO: 216324 - DNA, 103 bp, Artificial Sequence
  Synthetic Polynucleotide
taatacgactcactatagggggctgcacggtggtgacggtgcagctgctgaacagaggagacagcagatgcaccgtcacaacctggcggcagcgcaaaagatg

SEQ ID NO: 216325 - DNA, 103 bp, Artificial Sequence
  Synthetic Polynucleotide
taatacgactcactatagggcctgtccatgggctgcacggtggtgacggtaacagaggagaaccgtcatgaccgtgcagaacctggcggcagcgcaaaagatg

SEQ ID NO: 216326 - DNA, 103 bp, Artificial Sequence
  Synthetic Polynucleotide
taatacgactcactatagggggtagggtagcctgtccatgggctgcacggaacagaggagaccgtgcatgccatggacaaacctggcggcagcgcaaaagatg

SEQ ID NO: 216327 - DNA, 103 bp, Artificial Sequence
  Synthetic Polynucleotide
taatacgactcactataggggagaagtgctggtagggtagcctgtccatgaacagaggagacatggaatggctaccctaaacctggcggcagcgcaaaagatg

SEQ ID NO: 216328 - DNA, 103 bp, Artificial Sequence
  Synthetic Polynucleotide
taatacgactcactataggggaagtgagcggagaagtgctggtagggtagaacagaggagactacccatgcagcacttcaacctggcggcagcgcaaaagatg

SEQ ID NO: 216329 - DNA, 103 bp, Artificial Sequence
  Synthetic Polynucleotide
taatacgactcactataggggccccgaggtgaagtgagcggagaagtgctaacagaggagaagcactatgccgctcactaacctggcggcagcgcaaaagatg

SEQ ID NO: 216330 - DNA, 103 bp, Artificial Sequence
  Synthetic Polynucleotide
taatacgactcactataggggggaccaggggccccgaggtgaagtgagcgaacagaggagacgctcaatgcacctcgggaacctggcggcagcgcaaaagatg

SEQ ID NO: 216331 - DNA, 103 bp, Artificial Sequence
  Synthetic Polynucleotide
taatacgactcactataggggccctgctgggtgaaggcggcctgcggggaaacagaggagatccccgatggccgccttcaacctggcggcagcgcaaaagatg

SEQ ID NO: 216332 - DNA, 103 bp, Artificial Sequence
  Synthetic Polynucleotide
taatacgactcactatagggagccagccgagggaccaggggccccgaggtaacagaggagaacctcgatgcccctggtcaacctggcggcagcgcaaaagatg

SEQ ID NO: 216333 - DNA, 103 bp, Artificial Sequence
  Synthetic Polynucleotide
taatacgactcactatagggtggccatgccagccagccgagggaccagggaacagaggagaccctggatgctcggctggaacctggcggcagcgcaaaagatg

SEQ ID NO: 216334 - DNA, 103 bp, Artificial Sequence
  Synthetic Polynucleotide
taatacgactcactataggggagccatggttggccatgccagccagccgaaacagaggagatcggctatgtggcatggcaacctggcggcagcgcaaaagatg

SEQ ID NO: 216335 - DNA, 103 bp, Artificial Sequence
  Synthetic Polynucleotide
taatacgactcactatagggcagctgtggggagccatggttggccatgccaacagaggagaggcatgatgaaccatggcaacctggcggcagcgcaaaagatg

SEQ ID NO: 216336 - DNA, 103 bp, Artificial Sequence
  Synthetic Polynucleotide
taatacgactcactatagggttccctctcccagctgtggggagccatggtaacagaggagaaccatgatgccccacagcaacctggcggcagcgcaaaagatg

SEQ ID NO: 216337 - DNA, 103 bp, Artificial Sequence
  Synthetic Polynucleotide
taatacgactcactatagggtgctggaacattccctctcccagctgtgggaacagaggagacccacaatggggagagggaacctggcggcagcgcaaaagatg

SEQ ID NO: 216338 - DNA, 103 bp, Artificial Sequence
  Synthetic Polynucleotide
taatacgactcactatagggggaggtctggtgctggaacattccctctccaacagaggagaggagagatgatgttccagaacctggcggcagcgcaaaagatg

SEQ ID NO: 216339 - DNA, 103 bp, Artificial Sequence
  Synthetic Polynucleotide
taatacgactcactatagggggtgggccacggaggtctggtgctggaacaaacagaggagatgttccatgaccagacctaacctggcggcagcgcaaaagatg

SEQ ID NO: 216340 - DNA, 103 bp, Artificial Sequence
  Synthetic Polynucleotide
taatacgactcactatagggaccacaggctggtgggccacggaggtctggaacagaggagaccagacatgcgtggcccaaacctggcggcagcgcaaaagatg

SEQ ID NO: 216341 - DNA, 103 bp, Artificial Sequence
  Synthetic Polynucleotide
taatacgactcactatagggacactgcctgaccacaggctggtgggccacaacagaggagagtggccatgcagcctgtgaacctggcggcagcgcaaaagatg

SEQ ID NO: 216342 - DNA, 103 bp, Artificial Sequence
  Synthetic Polynucleotide
taatacgactcactatagggttccctccatgccctgctgggtgaaggcggaacagaggagaccgcctatgcccagcaggaacctggcggcagcgcaaaagatg

SEQ ID NO: 216343 - DNA, 103 bp, Artificial Sequence
  Synthetic Polynucleotide
taatacgactcactatagggtctgaggcccacactgcctgaccacaggctaacagaggagaagcctgatgtcaggcagtaacctggcggcagcgcaaaagatg

SEQ ID NO: 216344 - DNA, 103 bp, Artificial Sequence
  Synthetic Polynucleotide
taatacgactcactatagggtgcaggccagtctgaggcccacactgcctgaacagaggagacaggcaatgtgggcctcaaacctggcggcagcgcaaaagatg

SEQ ID NO: 216345 - DNA, 103 bp, Artificial Sequence
  Synthetic Polynucleotide
taatacgactcactataggggccaggggactgcaggccagtctgaggcccaacagaggagagggcctatgactggcctgaacctggcggcagcgcaaaagatg

SEQ ID NO: 216346 - DNA, 103 bp, Artificial Sequence
  Synthetic Polynucleotide
taatacgactcactataggggctgaagggtgccaggggactgcaggccagaacagaggagactggccatgagtcccctgaacctggcggcagcgcaaaagatg

SEQ ID NO: 216347 - DNA, 103 bp, Artificial Sequence
  Synthetic Polynucleotide
taatacgactcactatagggaactcagggggctgaagggtgccaggggacaacagaggagagtccccatgcacccttcaaacctggcggcagcgcaaaagatg

SEQ ID NO: 216348 - DNA, 103 bp, Artificial Sequence
  Synthetic Polynucleotide
taatacgactcactatagggagagtagaggaactcagggggctgaagggtaacagaggagaacccttatgccccctgagaacctggcggcagcgcaaaagatg

SEQ ID NO: 216349 - DNA, 103 bp, Artificial Sequence
  Synthetic Polynucleotide
taatacgactcactataggggcacgccatgagagtagaggaactcaggggaacagaggagacccctgatgtcctctactaacctggcggcagcgcaaaagatg

SEQ ID NO: 216350 - DNA, 103 bp, Artificial Sequence
  Synthetic Polynucleotide
taatacgactcactatagggagagtccttggcacgccatgagagtagaggaacagaggagacctctaatgtcatggcgtaacctggcggcagcgcaaaagatg

SEQ ID NO: 216351 - DNA, 103 bp, Artificial Sequence
  Synthetic Polynucleotide
taatacgactcactatagggatgaggggatagagtccttggcacgccatgaacagaggagacatggcatgccaaggactaacctggcggcagcgcaaaagatg

SEQ ID NO: 216352 - DNA, 103 bp, Artificial Sequence
  Synthetic Polynucleotide
taatacgactcactatagggagtggtactgatgaggggatagagtccttgaacagaggagacaaggaatgtatcccctcaacctggcggcagcgcaaaagatg

SEQ ID NO: 216353 - DNA, 103 bp, Artificial Sequence
  Synthetic Polynucleotide
taatacgactcactatagggaacactttgattccctccatgccctgctggaacagaggagaccagcaatgcatggagggaacctggcggcagcgcaaaagatg

SEQ ID NO: 216354 - DNA, 103 bp, Artificial Sequence
  Synthetic Polynucleotide
taatacgactcactatagggccgtgcacagagtggtactgatgaggggataacagaggagaatccccatgtcagtaccaaacctggcggcagcgcaaaagatg

SEQ ID NO: 216355 - DNA, 103 bp, Artificial Sequence
  Synthetic Polynucleotide
taatacgactcactatagggcatgccaactccgtgcacagagtggtactgaacagaggagacagtacatgtctgtgcacaacctggcggcagcgcaaaagatg

SEQ ID NO: 216356 - DNA, 103 bp, Artificial Sequence
  Synthetic Polynucleotide
taatacgactcactatagggactctggcaccatgccaactccgtgcacagaacagaggagactgtgcatggagttggcaaacctggcggcagcgcaaaagatg

SEQ ID NO: 216357 - DNA, 103 bp, Artificial Sequence
  Synthetic Polynucleotide
taatacgactcactatagggttgtcgctccactctggcaccatgccaactaacagaggagaagttggatgggtgccagaaacctggcggcagcgcaaaagatg

SEQ ID NO: 216358 - DNA, 103 bp, Artificial Sequence
  Synthetic Polynucleotide
taatacgactcactatagggttcatggagaaacactttgattccctccataacagaggagaatggagatgatcaaagtgaacctggcggcagcgcaaaagatg

SEQ ID NO: 216359 - DNA, 103 bp, Artificial Sequence
  Synthetic Polynucleotide
taatacgactcactatagggacagttctctttcatggagaaacactttgaaacagaggagatcaaagatgttctccatgaacctggcggcagcgcaaaagatg

SEQ ID NO: 216360 - DNA, 103 bp, Artificial Sequence
  Synthetic Polynucleotide
taatacgactcactatagggaattttagccacagttctctttcatggagaaacagaggagatctccaatgaagagaactaacctggcggcagcgcaaaagatg

SEQ ID NO: 216361 - DNA, 103 bp, Artificial Sequence
  Synthetic Polynucleotide
taatacgactcactatagggcacttcgtggaattttagccacagttctctaacagaggagaagagaaatgtggctaaaaaacctggcggcagcgcaaaagatg

SEQ ID NO: 216362 - DNA, 103 bp, Artificial Sequence
  Synthetic Polynucleotide
taatacgactcactataggggcgtgtgcgccaggccaaagccctcgtctgaacagaggagacagacgatggctttggccaacctggcggcagcgcaaaagatg

SEQ ID NO: 216363 - DNA, 103 bp, Artificial Sequence
  Synthetic Polynucleotide
taatacgactcactatagggtttccgtgcccacttcgtggaattttagccaacagaggagaggctaaatgtccacgaagaacctggcggcagcgcaaaagatg

SEQ ID NO: 216364 - DNA, 103 bp, Artificial Sequence
  Synthetic Polynucleotide
taatacgactcactataggggttatgatcatttccgtgcccacttcgtggaacagaggagaccacgaatggggcacggaaacctggcggcagcgcaaaagatg

SEQ ID NO: 216365 - DNA, 103 bp, Artificial Sequence
  Synthetic Polynucleotide
taatacgactcactatagggtccagccttggttatgatcatttccgtgccaacagaggagaggcacgatgatgatcataaacctggcggcagcgcaaaagatg

SEQ ID NO: 216366 - DNA, 103 bp, Artificial Sequence
  Synthetic Polynucleotide
taatacgactcactatagggacatccgccttccagccttggttatgatcaaacagaggagatgatcaatgccaaggctgaacctggcggcagcgcaaaagatg

SEQ ID NO: 216367 - DNA, 103 bp, Artificial Sequence
  Synthetic Polynucleotide
taatacgactcactatagggtaactgggaaacatccgccttccagccttgaacagaggagacaaggcatgaaggcggataacctggcggcagcgcaaaagatg

SEQ ID NO: 216368 - DNA, 103 bp, Artificial Sequence
  Synthetic Polynucleotide
taatacgactcactatagggcttcactttgtaactgggaaacatccgcctaacagaggagaaggcggatgtttcccagtaacctggcggcagcgcaaaagatg

SEQ ID NO: 216369 - DNA, 103 bp, Artificial Sequence
  Synthetic Polynucleotide
taatacgactcactatagggggcccgtcaccttcactttgtaactgggaaaacagaggagattcccaatgacaaagtgaaacctggcggcagcgcaaaagatg

SEQ ID NO: 216370 - DNA, 103 bp, Artificial Sequence
  Synthetic Polynucleotide
taatacgactcactatagggttgggattaaggcccgtcaccttcactttgaacagaggagacaaagtatgggtgacgggaacctggcggcagcgcaaaagatg

SEQ ID NO: 216371 - DNA, 103 bp, Artificial Sequence
  Synthetic Polynucleotide
taatacgactcactataggggtacttcgttttgggattaaggcccgtcacaacagaggagagtgacgatgcttaatcccaacctggcggcagcgcaaaagatg

SEQ ID NO: 216372 - DNA, 103 bp, Artificial Sequence
  Synthetic Polynucleotide
taatacgactcactatagggtgagaagaatgtacttcgttttgggattaaaacagaggagattaatcatgaaacgaagtaacctggcggcagcgcaaaagatg

SEQ ID NO: 216373 - DNA, 103 bp, Artificial Sequence
  Synthetic Polynucleotide
taatacgactcactatagggggctccagaggcgtgtgcgccaggccaaagaacagaggagactttggatgggcgcacacaacctggcggcagcgcaaaagatg

SEQ ID NO: 216374 - DNA, 103 bp, Artificial Sequence
  Synthetic Polynucleotide
taatacgactcactatagggacaatgtccatgagaagaatgtacttcgttaacagaggagaaacgaaatgcattcttctaacctggcggcagcgcaaaagatg

SEQ ID NO: 216375 - DNA, 103 bp, Artificial Sequence
  Synthetic Polynucleotide
taatacgactcactataggggtcggcaggtacaatgtccatgagaagaataacagaggagaattcttatgatggacattaacctggcggcagcgcaaaagatg

SEQ ID NO: 216376 - DNA, 103 bp, Artificial Sequence
  Synthetic Polynucleotide
taatacgactcactatagggatctgtgatcgtcggcaggtacaatgtccaaacagaggagatggacaatgtacctgccgaacctggcggcagcgcaaaagatg

SEQ ID NO: 216377 - DNA, 103 bp, Artificial Sequence
  Synthetic Polynucleotide
taatacgactcactataggggcgaatttgtatctgtgatcgtcggcaggtaacagaggagaacctgcatgcgatcacagaacctggcggcagcgcaaaagatg

SEQ ID NO: 216378 - DNA, 103 bp, Artificial Sequence
  Synthetic Polynucleotide
taatacgactcactatagggtttattatctgcgaatttgtatctgtgatcaacagaggagagatcacatgtacaaattcaacctggcggcagcgcaaaagatg

SEQ ID NO: 216379 - DNA, 103 bp, Artificial Sequence
  Synthetic Polynucleotide
taatacgactcactatagggtcacagaccatttattatctgcgaatttgtaacagaggagaacaaatatgcagataataaacctggcggcagcgcaaaagatg

SEQ ID NO: 216380 - DNA, 103 bp, Artificial Sequence
  Synthetic Polynucleotide
taatacgactcactataggggctttgcccgtcacagaccatttattatctaacagaggagaagataaatgatggtctgtaacctggcggcagcgcaaaagatg

SEQ ID NO: 216381 - DNA, 103 bp, Artificial Sequence
  Synthetic Polynucleotide
taatacgactcactatagggggcgggctcagctttgcccgtcacagaccaaacagaggagatggtctatgacgggcaaaaacctggcggcagcgcaaaagatg

SEQ ID NO: 216382 - DNA, 103 bp, Artificial Sequence
  Synthetic Polynucleotide
taatacgactcactatagggggccaggcatggcgggctcagctttgcccgaacagaggagacgggcaatgctgagcccgaacctggcggcagcgcaaaagatg

SEQ ID NO: 216383 - DNA, 103 bp, Artificial Sequence
  Synthetic Polynucleotide
taatacgactcactatagggacgtacaggcggccaggcatggcgggctcaaacagaggagatgagccatgcatgcctggaacctggcggcagcgcaaaagatg

SEQ ID NO: 216384 - DNA, 103 bp, Artificial Sequence
  Synthetic Polynucleotide
taatacgactcactatagggttttgcgtcaggctccagaggcgtgtgcgcaacagaggagagcgcacatgcctctggagaacctggcggcagcgcaaaagatg

SEQ ID NO: 216385 - DNA, 103 bp, Artificial Sequence
  Synthetic Polynucleotide
taatacgactcactataggggtctgggtgcacgtacaggcggccaggcataacagaggagaatgcctatgcgcctgtacaacctggcggcagcgcaaaagatg

SEQ ID NO: 216386 - DNA, 103 bp, Artificial Sequence
  Synthetic Polynucleotide
taatacgactcactatagggtggcgggggagtctgggtgcacgtacaggcaacagaggagagcctgtatgtgcacccagaacctggcggcagcgcaaaagatg

SEQ ID NO: 216387 - DNA, 103 bp, Artificial Sequence
  Synthetic Polynucleotide
taatacgactcactatagggtgcgccccggtggcgggggagtctgggtgcaacagaggagagcacccatgctcccccgcaacctggcggcagcgcaaaagatg

SEQ ID NO: 216388 - DNA, 103 bp, Artificial Sequence
  Synthetic Polynucleotide
taatacgactcactatagggcctcatccaatgcgccccggtggcgggggaaacagaggagatcccccatgaccggggcgaacctggcggcagcgcaaaagatg

SEQ ID NO: 216389 - DNA, 103 bp, Artificial Sequence
  Synthetic Polynucleotide
taatacgactcactatagggagacgagctgcctcatccaatgcgccccggaacagaggagaccggggatgattggatgaaacctggcggcagcgcaaaagatg

SEQ ID NO: 216390 - DNA, 103 bp, Artificial Sequence
  Synthetic Polynucleotide
taatacgactcactatagggttctggaaggagacgagctgcctcatccaaaacagaggagattggatatggcagctcgtaacctggcggcagcgcaaaagatg

SEQ ID NO: 216391 - DNA, 103 bp, Artificial Sequence
  Synthetic Polynucleotide
taatacgactcactataggggagcttgagtttctggaaggagacgagctgaacagaggagacagctcatgtccttccagaacctggcggcagcgcaaaagatg

SEQ ID NO: 216392 - DNA, 103 bp, Artificial Sequence
  Synthetic Polynucleotide
taatacgactcactatagggggttgttggtgagcttgagtttctggaaggaacagaggagaccttccatgaactcaagcaacctggcggcagcgcaaaagatg

SEQ ID NO: 216393 - DNA, 103 bp, Artificial Sequence
  Synthetic Polynucleotide
taatacgactcactataggggggtccaggtggttgttggtgagcttgagtaacagaggagaactcaaatgcaccaacaaaacctggcggcagcgcaaaagatg

SEQ ID NO: 216394 - DNA, 103 bp, Artificial Sequence
  Synthetic Polynucleotide
taatacgactcactatagggatgcccaaatgggtccaggtggttgttggtaacagaggagaaccaacatgcacctggacaacctggcggcagcgcaaaagatg

SEQ ID NO: 216395 - DNA, 103 bp, Artificial Sequence
  Synthetic Polynucleotide
taatacgactcactatagggagggcaggtcttttgcgtcaggctccagagaacagaggagactctggatgctgacgcaaaacctggcggcagcgcaaaagatg

SEQ ID NO: 216396 - DNA, 103 bp, Artificial Sequence
  Synthetic Polynucleotide
taatacgactcactatagggttagaataatatgcccaaatgggtccaggtaacagaggagaacctggatgcatttgggcaacctggcggcagcgcaaaagatg

SEQ ID NO: 216397 - DNA, 103 bp, Artificial Sequence
  Synthetic Polynucleotide
taatacgactcactatagggtgcatggaatttagaataatatgcccaaataacagaggagaatttggatgtattattctaacctggcggcagcgcaaaagatg

SEQ ID NO: 216398 - DNA, 103 bp, Artificial Sequence
  Synthetic Polynucleotide
taatacgactcactatagggctggtatttgtgcatggaatttagaataataacagaggagaattattatgaattccatgaacctggcggcagcgcaaaagatg

SEQ ID NO: 216399 - DNA, 103 bp, Artificial Sequence
  Synthetic Polynucleotide
taatacgactcactataggggtaatctaggctggtatttgtgcatggaataacagaggagaattccaatgacaaataccaacctggcggcagcgcaaaagatg

SEQ ID NO: 216400 - DNA, 103 bp, Artificial Sequence
  Synthetic Polynucleotide
taatacgactcactatagggttcacgatgtgtaatctaggctggtatttgaacagaggagacaaataatggcctagattaacctggcggcagcgcaaaagatg

SEQ ID NO: 216401 - DNA, 103 bp, Artificial Sequence
  Synthetic Polynucleotide
taatacgactcactatagggttcatccgctttcacgatgtgtaatctaggaacagaggagacctagaatgcacatcgtgaacctggcggcagcgcaaaagatg

SEQ ID NO: 216402 - DNA, 103 bp, Artificial Sequence
  Synthetic Polynucleotide
taatacgactcactatagggatccattattttcatccgctttcacgatgtaacagaggagaacatcgatgaagcggatgaacctggcggcagcgcaaaagatg

SEQ ID NO: 216403 - DNA, 103 bp, Artificial Sequence
  Synthetic Polynucleotide
taatacgactcactatagggtttgagccaaatccattattttcatccgctaacagaggagaagcggaatgaaataatggaacctggcggcagcgcaaaagatg

SEQ ID NO: 216404 - DNA, 103 bp, Artificial Sequence
  Synthetic Polynucleotide
taatacgactcactatagggcgctgtattttttgagccaaatccattattaacagaggagaaataatatgtttggctcaaacctggcggcagcgcaaaagatg

SEQ ID NO: 216405 - DNA, 103 bp, Artificial Sequence
  Synthetic Polynucleotide
taatacgactcactataggggagtgcagaacgctgtattttttgagccaaaacagaggagattggctatgaaaatacagaacctggcggcagcgcaaaagatg

SEQ ID NO: 216406 - DNA, 103 bp, Artificial Sequence
  Synthetic Polynucleotide
taatacgactcactatagggttcgaatcgcagggcaggtcttttgcgtcaaacagaggagatgacgcatgagacctgccaacctggcggcagcgcaaaagatg

SEQ ID NO: 216407 - DNA, 103 bp, Artificial Sequence
  Synthetic Polynucleotide
taatacgactcactatagggggaaagacgtgagtgcagaacgctgtatttaacagaggagaaaatacatggttctgcacaacctggcggcagcgcaaaagatg

SEQ ID NO: 216408 - DNA, 103 bp, Artificial Sequence
  Synthetic Polynucleotide
taatacgactcactatagggcgcagtctcaggaaagacgtgagtgcagaaaacagaggagattctgcatgcacgtctttaacctggcggcagcgcaaaagatg

SEQ ID NO: 216409 - DNA, 103 bp, Artificial Sequence
  Synthetic Polynucleotide
taatacgactcactatagggctgctataaacgcagtctcaggaaagacgtaacagaggagaacgtctatgctgagactgaacctggcggcagcgcaaaagatg

SEQ ID NO: 216410 - DNA, 103 bp, Artificial Sequence
  Synthetic Polynucleotide
taatacgactcactatagggtaggaagtcactgctataaacgcagtctcaaacagaggagatgagacatggtttatagcaacctggcggcagcgcaaaagatg

SEQ ID NO: 216411 - DNA, 103 bp, Artificial Sequence
  Synthetic Polynucleotide
taatacgactcactataggggtggttctggtaggaagtcactgctataaaaacagaggagatttataatggtgacttccaacctggcggcagcgcaaaagatg

SEQ ID NO: 216412 - DNA, 103 bp, Artificial Sequence
  Synthetic Polynucleotide
taatacgactcactataggggcgtgatcttgtggttctggtaggaagtcaaacagaggagatgacttatgaccagaaccaacctggcggcagcgcaaaagatg

SEQ ID NO: 216413 - DNA, 103 bp, Artificial Sequence
  Synthetic Polynucleotide
taatacgactcactatagggatctttaattgcgtgatcttgtggttctggaacagaggagaccagaaatgcaagatcacaacctggcggcagcgcaaaagatg

SEQ ID NO: 216414 - DNA, 103 bp, Artificial Sequence
  Synthetic Polynucleotide
taatacgactcactatagggattattctcaatctttaattgcgtgatcttaacagaggagaaagatcatgcaattaaagaacctggcggcagcgcaaaagatg

SEQ ID NO: 216415 - DNA, 103 bp, Artificial Sequence
  Synthetic Polynucleotide
taatacgactcactatagggtggcaaagggattattctcaatctttaattaacagaggagaaattaaatgttgagaataaacctggcggcagcgcaaaagatg

SEQ ID NO: 216416 - DNA, 103 bp, Artificial Sequence
  Synthetic Polynucleotide
taatacgactcactatagggcgaaatcctttggcaaagggattattctcaaacagaggagatgagaaatgtccctttgcaacctggcggcagcgcaaaagatg

SEQ ID NO: 216417 - DNA, 103 bp, Artificial Sequence
  Synthetic Polynucleotide
taatacgactcactataggggctctcgggtttcgaatcgcagggcaggtcaacagaggagagacctgatgtgcgattcgaacctggcggcagcgcaaaagatg

SEQ ID NO: 216418 - DNA, 103 bp, Artificial Sequence
  Synthetic Polynucleotide
taatacgactcactatagggatcactgccccgaaatcctttggcaaagggaacagaggagaccctttatgaaaggatttaacctggcggcagcgcaaaagatg

SEQ ID NO: 216419 - DNA, 103 bp, Artificial Sequence
  Synthetic Polynucleotide
taatacgactcactataggggctccatgtcatcactgccccgaaatccttaacagaggagaaaggatatgggggcagtgaacctggcggcagcgcaaaagatg

SEQ ID NO: 216420 - DNA, 103 bp, Artificial Sequence
  Synthetic Polynucleotide
taatacgactcactatagggattctgtgcagctccatgtcatcactgcccaacagaggagagggcagatgtgacatggaaacctggcggcagcgcaaaagatg

SEQ ID NO: 216421 - DNA, 103 bp, Artificial Sequence
  Synthetic Polynucleotide
taatacgactcactatagggcattcttgacattctgtgcagctccatgtcaacagaggagagacatgatgctgcacagaaacctggcggcagcgcaaaagatg

SEQ ID NO: 216422 - DNA, 103 bp, Artificial Sequence
  Synthetic Polynucleotide
taatacgactcactatagggctttactttgcattcttgacattctgtgcaaacagaggagatgcacaatgtgtcaagaaaacctggcggcagcgcaaaagatg

SEQ ID NO: 216423 - DNA, 103 bp, Artificial Sequence
  Synthetic Polynucleotide
taatacgactcactatagggacgggatattctttactttgcattcttgacaacagaggagagtcaagatggcaaagtaaaacctggcggcagcgcaaaagatg

SEQ ID NO: 216424 - DNA, 103 bp, Artificial Sequence
  Synthetic Polynucleotide
taatacgactcactatagggcctggggaccacgggatattctttactttgaacagaggagacaaagtatggaatatcccaacctggcggcagcgcaaaagatg

SEQ ID NO: 216425 - DNA, 103 bp, Artificial Sequence
  Synthetic Polynucleotide
taatacgactcactatagggtcacggtgctcctggggaccacgggatattaacagaggagaaatatcatgtggtccccaaacctggcggcagcgcaaaagatg

SEQ ID NO: 216426 - DNA, 103 bp, Artificial Sequence
  Synthetic Polynucleotide
taatacgactcactatagggactttttgcctcacggtgctcctggggaccaacagaggagaggtcccatggagcaccgtaacctggcggcagcgcaaaagatg

SEQ ID NO: 216427 - DNA, 103 bp, Artificial Sequence
  Synthetic Polynucleotide
taatacgactcactataggggttggaggccactttttgcctcacggtgctaacagaggagaagcaccatgaggcaaaaaaacctggcggcagcgcaaaagatg

SEQ ID NO: 216428 - DNA, 103 bp, Artificial Sequence
  Synthetic Polynucleotide
taatacgactcactatagggccccgagcgcgctctcgggtttcgaatcgcaacagaggagagcgattatgaacccgagaaacctggcggcagcgcaaaagatg

SEQ ID NO: 216429 - DNA, 103 bp, Artificial Sequence
  Synthetic Polynucleotide
taatacgactcactatagggaaggactgtggttggaggccactttttgccaacagaggagaggcaaaatgtggcctccaaacctggcggcagcgcaaaagatg

SEQ ID NO: 216430 - DNA, 103 bp, Artificial Sequence
  Synthetic Polynucleotide
taatacgactcactatagggtcgctgctgaaaggactgtggttggaggccaacagaggagaggcctcatgccacagtccaacctggcggcagcgcaaaagatg

SEQ ID NO: 216431 - DNA, 103 bp, Artificial Sequence
  Synthetic Polynucleotide
taatacgactcactatagggagctcgagactcgctgctgaaaggactgtgaacagaggagacacagtatgttcagcagcaacctggcggcagcgcaaaagatg

SEQ ID NO: 216432 - DNA, 103 bp, Artificial Sequence
  Synthetic Polynucleotide
taatacgactcactatagggaggtggagagagctcgagactcgctgctgaaacagaggagatcagcaatgagtctcgagaacctggcggcagcgcaaaagatg

SEQ ID NO: 216433 - DNA, 103 bp, Artificial Sequence
  Synthetic Polynucleotide
taatacgactcactatagggaaattggatgaggtggagagagctcgagacaacagaggagagtctcgatgtctctccacaacctggcggcagcgcaaaagatg

SEQ ID NO: 216434 - DNA, 103 bp, Artificial Sequence
  Synthetic Polynucleotide
taatacgactcactatagggttgggaccccaaattggatgaggtggagagaacagaggagactctccatgtcatccaataacctggcggcagcgcaaaagatg

SEQ ID NO: 216435 - DNA, 103 bp, Artificial Sequence
  Synthetic Polynucleotide
taatacgactcactatagggcacactggtattgggaccccaaattggatgaacagaggagacatccaatgtggggtcccaacctggcggcagcgcaaaagatg

SEQ ID NO: 216436 - DNA, 103 bp, Artificial Sequence
  Synthetic Polynucleotide
taatacgactcactatagggacaccattctcacactggtattgggaccccaacagaggagaggggtcatgataccagtgaacctggcggcagcgcaaaagatg

SEQ ID NO: 216437 - DNA, 103 bp, Artificial Sequence
  Synthetic Polynucleotide
taatacgactcactatagggggggccggaaacaccattctcacactggtaaacagaggagataccagatggagaatggtaacctggcggcagcgcaaaagatg

SEQ ID NO: 216438 - DNA, 103 bp, Artificial Sequence
  Synthetic Polynucleotide
taatacgactcactatagggggtcctgggaggggccggaaacaccattctaacagaggagaagaatgatgtttccggccaacctggcggcagcgcaaaagatg

SEQ ID NO: 216439 - DNA, 103 bp, Artificial Sequence
  Synthetic Polynucleotide
taatacgactcactatagggttgctgggggccccgagcgcgctctcgggtaacagaggagaacccgaatgcgcgctcggaacctggcggcagcgcaaaagatg

SEQ ID NO: 216440 - DNA, 103 bp, Artificial Sequence
  Synthetic Polynucleotide
taatacgactcactatagggggaggcaggaggtcctgggaggggccggaaaacagaggagattccggatgctcccaggaaacctggcggcagcgcaaaagatg

SEQ ID NO: 216441 - DNA, 103 bp, Artificial Sequence
  Synthetic Polynucleotide
taatacgactcactatagggtgggttgggtggaggcaggaggtcctgggaaacagaggagatcccagatgctcctgcctaacctggcggcagcgcaaaagatg

SEQ ID NO: 216442 - DNA, 103 bp, Artificial Sequence
  Synthetic Polynucleotide
taatacgactcactataggggcagtgggtatgggttgggtggaggcaggaaacagaggagatcctgcatgcacccaaccaacctggcggcagcgcaaaagatg

SEQ ID NO: 216443 - DNA, 103 bp, Artificial Sequence
  Synthetic Polynucleotide
taatacgactcactatagggtgctcctggggcagtgggtatgggttgggtaacagaggagaacccaaatgatacccactaacctggcggcagcgcaaaagatg

SEQ ID NO: 216444 - DNA, 103 bp, Artificial Sequence
  Synthetic Polynucleotide
taatacgactcactatagggaatttggctatgctcctggggcagtgggtaaacagaggagatacccaatgccccaggagaacctggcggcagcgcaaaagatg

SEQ ID NO: 216445 - DNA, 103 bp, Artificial Sequence
  Synthetic Polynucleotide
taatacgactcactatagggtacaatggtaaatttggctatgctcctgggaacagaggagacccaggatgatagccaaaaacctggcggcagcgcaaaagatg

SEQ ID NO: 216446 - DNA, 103 bp, Artificial Sequence
  Synthetic Polynucleotide
taatacgactcactatagggttcctcttggtacaatggtaaatttggctaaacagaggagatagccaatgttaccattgaacctggcggcagcgcaaaagatg

SEQ ID NO: 216447 - DNA, 103 bp, Artificial Sequence
  Synthetic Polynucleotide
taatacgactcactatagggttcttcctctttcctcttggtacaatggtaaacagaggagataccatatgaccaagaggaacctggcggcagcgcaaaagatg

SEQ ID NO: 216448 - DNA, 103 bp, Artificial Sequence
  Synthetic Polynucleotide
taatacgactcactatagggtggtggaacattcttcctctttcctcttggaacagaggagaccaagaatgaagaggaagaacctggcggcagcgcaaaagatg

SEQ ID NO: 216449 - DNA, 103 bp, Artificial Sequence
  Synthetic Polynucleotide
taatacgactcactatagggggatggtctgtggtggaacattcttcctctaacagaggagaagaggaatgatgttccacaacctggcggcagcgcaaaagatg

SEQ ID NO: 216450 - DNA, 103 bp, Artificial Sequence
  Synthetic Polynucleotide
taatacgactcactatagggggacgggtacaattctcgtggatggtacataacagaggagaatgtacatgccacgagaaaacctggcggcagcgcaaaagatg

SEQ ID NO: 216451 - DNA, 103 bp, Artificial Sequence
  Synthetic Polynucleotide
taatacgactcactatagggttcggggtagcggtagccctccgctagggcaacagaggagagccctaatggagggctacaacctggcggcagcgcaaaagatg

SEQ ID NO: 216452 - DNA, 103 bp, Artificial Sequence
  Synthetic Polynucleotide
taatacgactcactatagggcagaggtgccggggcagcggtggcttccccaacagaggagaggggaaatgaccgctgccaacctggcggcagcgcaaaagatg

SEQ ID NO: 216453 - DNA, 103 bp, Artificial Sequence
  Synthetic Polynucleotide
taatacgactcactatagggggccaccacacagaggtgccggggcagcggaacagaggagaccgctgatgcggcacctcaacctggcggcagcgcaaaagatg

SEQ ID NO: 216454 - DNA, 103 bp, Artificial Sequence
  Synthetic Polynucleotide
taatacgactcactatagggtcagcactggggccaccacacagaggtgccaacagaggagaggcaccatggtgtggtggaacctggcggcagcgcaaaagatg

SEQ ID NO: 216455 - DNA, 103 bp, Artificial Sequence
  Synthetic Polynucleotide
taatacgactcactataggggaggtaggcctcagcactggggccaccacaaacagaggagatgtggtatgcccagtgctaacctggcggcagcgcaaaagatg

SEQ ID NO: 216456 - DNA, 103 bp, Artificial Sequence
  Synthetic Polynucleotide
taatacgactcactatagggcagggtgcaggaggtaggcctcagcactggaacagaggagaccagtgatgaggcctaccaacctggcggcagcgcaaaagatg

SEQ ID NO: 216457 - DNA, 103 bp, Artificial Sequence
  Synthetic Polynucleotide
taatacgactcactatagggtggaaagccgcagggtgcaggaggtaggccaacagaggagaggcctaatgcctgcacccaacctggcggcagcgcaaaagatg

SEQ ID NO: 216458 - DNA, 103 bp, Artificial Sequence
  Synthetic Polynucleotide
taatacgactcactataggggggggccccatggaaagccgcagggtgcagaacagaggagactgcacatggcggctttcaacctggcggcagcgcaaaagatg

SEQ ID NO: 216459 - DNA, 103 bp, Artificial Sequence
  Synthetic Polynucleotide
taatacgactcactataggggaaggtgactgggggccccatggaaagccgaacagaggagacggcttatgatggggcccaacctggcggcagcgcaaaagatg

SEQ ID NO: 216460 - DNA, 103 bp, Artificial Sequence
  Synthetic Polynucleotide
taatacgactcactatagggctcctggtgggaaggtgactgggggccccaaacagaggagatggggcatgcagtcacctaacctggcggcagcgcaaaagatg

SEQ ID NO: 216461 - DNA, 103 bp, Artificial Sequence
  Synthetic Polynucleotide
taatacgactcactataggggaagctggggctcctggtgggaaggtgactaacagaggagaagtcacatgcccaccaggaacctggcggcagcgcaaaagatg

SEQ ID NO: 216462 - DNA, 103 bp, Artificial Sequence
  Synthetic Polynucleotide
taatacgactcactataggggggtgtccagttcggggtagcggtagccctaacagaggagaagggctatggctaccccgaacctggcggcagcgcaaaagatg

SEQ ID NO: 216463 - DNA, 103 bp, Artificial Sequence
  Synthetic Polynucleotide
taatacgactcactataggggagcctccgggaagctggggctcctggtggaacagaggagaccaccaatggccccagctaacctggcggcagcgcaaaagatg

SEQ ID NO: 216464 - DNA, 103 bp, Artificial Sequence
  Synthetic Polynucleotide
taatacgactcactatagggccggagtctggagcctccgggaagctggggaacagaggagaccccagatgcccggaggcaacctggcggcagcgcaaaagatg

SEQ ID NO: 216465 - DNA, 103 bp, Artificial Sequence
  Synthetic Polynucleotide
taatacgactcactatagggggctgagcgcccggagtctggagcctccggaacagaggagaccggagatgccagactccaacctggcggcagcgcaaaagatg

SEQ ID NO: 216466 - DNA, 103 bp, Artificial Sequence
  Synthetic Polynucleotide
taatacgactcactatagggccgagtagggggctgagcgcccggagtctgaacagaggagacagactatgggcgctcagaacctggcggcagcgcaaaagatg

SEQ ID NO: 216467 - DNA, 103 bp, Artificial Sequence
  Synthetic Polynucleotide
taatacgactcactatagggagaaatgcagccgagtagggggctgagcgcaacagaggagagcgctcatgcccctactcaacctggcggcagcgcaaaagatg

SEQ ID NO: 216468 - DNA, 103 bp, Artificial Sequence
  Synthetic Polynucleotide
taatacgactcactatagggcggcagctccagaaatgcagccgagtagggaacagaggagaccctacatggctgcatttaacctggcggcagcgcaaaagatg

SEQ ID NO: 216469 - DNA, 103 bp, Artificial Sequence
  Synthetic Polynucleotide
taatacgactcactatagggctgacccgtgcggcagctccagaaatgcagaacagaggagactgcatatgtggagctgcaacctggcggcagcgcaaaagatg

SEQ ID NO: 216470 - DNA, 103 bp, Artificial Sequence
  Synthetic Polynucleotide
taatacgactcactatagggccggagccccctgacccgtgcggcagctccaacagaggagaggagctatggcacgggtcaacctggcggcagcgcaaaagatg

SEQ ID NO: 216471 - DNA, 103 bp, Artificial Sequence
  Synthetic Polynucleotide
taatacgactcactatagggcgctgggtacccggagccccctgacccgtgaacagaggagacacgggatggggggctccaacctggcggcagcgcaaaagatg

SEQ ID NO: 216472 - DNA, 103 bp, Artificial Sequence
  Synthetic Polynucleotide
taatacgactcactatagggccggtggagccgctgggtacccggagccccaacagaggagaggggctatgggtacccagaacctggcggcagcgcaaaagatg

SEQ ID NO: 216473 - DNA, 103 bp, Artificial Sequence
  Synthetic Polynucleotide
taatacgactcactatagggtccagtttaggggtgtccagttcggggtagaacagaggagactacccatgactggacacaacctggcggcagcgcaaaagatg

SEQ ID NO: 216474 - DNA, 103 bp, Artificial Sequence
  Synthetic Polynucleotide
taatacgactcactatagggaagggtaccgccggtggagccgctgggtacaacagaggagagtacccatgggctccaccaacctggcggcagcgcaaaagatg

SEQ ID NO: 216475 - DNA, 103 bp, Artificial Sequence
  Synthetic Polynucleotide
taatacgactcactataggggtgcggggcaaagggtaccgccggtggagcaacagaggagagctccaatggcggtacccaacctggcggcagcgcaaaagatg

SEQ ID NO: 216476 - DNA, 103 bp, Artificial Sequence
  Synthetic Polynucleotide
taatacgactcactatagggcttggagaaagtgcggggcaaagggtaccgaacagaggagacggtacatgttgccccgcaacctggcggcagcgcaaaagatg

SEQ ID NO: 216477 - DNA, 103 bp, Artificial Sequence
  Synthetic Polynucleotide
taatacgactcactatagggaaggggcccccttggagaaagtgcggggcaaacagaggagatgccccatgctttctccaaacctggcggcagcgcaaaagatg

SEQ ID NO: 216478 - DNA, 103 bp, Artificial Sequence
  Synthetic Polynucleotide
taatacgactcactatagggtggtagagggaaggggcccccttggagaaaaacagaggagatttctcatggggggccccaacctggcggcagcgcaaaagatg

SEQ ID NO: 216479 - DNA, 103 bp, Artificial Sequence
  Synthetic Polynucleotide
taatacgactcactataggggcgcggtgtatggtagagggaaggggccccaacagaggagaggggccatgtccctctacaacctggcggcagcgcaaaagatg

SEQ ID NO: 216480 - DNA, 103 bp, Artificial Sequence
  Synthetic Polynucleotide
taatacgactcactatagggtagcccccaggcgcggtgtatggtagagggaacagaggagaccctctatgatacaccgcaacctggcggcagcgcaaaagatg

SEQ ID NO: 216481 - DNA, 103 bp, Artificial Sequence
  Synthetic Polynucleotide
taatacgactcactatagggcacatccagatagcccccaggcgcggtgtaaacagaggagatacaccatgcctgggggcaacctggcggcagcgcaaaagatg

SEQ ID NO: 216482 - DNA, 103 bp, Artificial Sequence
  Synthetic Polynucleotide
taatacgactcactataggggtttggagcccacatccagatagcccccagaacagaggagactggggatgatctggatgaacctggcggcagcgcaaaagatg

SEQ ID NO: 216483 - DNA, 103 bp, Artificial Sequence
  Synthetic Polynucleotide
taatacgactcactatagggcagtacatgggtttggagcccacatccagaaacagaggagatctggaatggggctccaaaacctggcggcagcgcaaaagatg

SEQ ID NO: 216484 - DNA, 103 bp, Artificial Sequence
  Synthetic Polynucleotide
taatacgactcactataggggaggaagcaatccagtttaggggtgtccagaacagaggagactggacatgcctaaactgaacctggcggcagcgcaaaagatg

SEQ ID NO: 216485 - DNA, 103 bp, Artificial Sequence
  Synthetic Polynucleotide
taatacgactcactatagggccatcccggagaggaagcaatccagtttagaacagaggagactaaacatgattgcttccaacctggcggcagcgcaaaagatg

SEQ ID NO: 216486 - DNA, 103 bp, Artificial Sequence
  Synthetic Polynucleotide
taatacgactcactatagggggagcagcctccatcccggagaggaagcaaaacagaggagattgcttatgctccgggataacctggcggcagcgcaaaagatg

SEQ ID NO: 216487 - DNA, 103 bp, Artificial Sequence
  Synthetic Polynucleotide
taatacgactcactatagggcagggtgcggggagcagcctccatcccggaaacagaggagatccgggatggaggctgctaacctggcggcagcgcaaaagatg

SEQ ID NO: 216488 - DNA, 103 bp, Artificial Sequence
  Synthetic Polynucleotide
taatacgactcactatagggggtgcgcggccagggtgcggggagcagcctaacagaggagaaggctgatgcccgcacccaacctggcggcagcgcaaaagatg

SEQ ID NO: 216489 - DNA, 103 bp, Artificial Sequence
  Synthetic Polynucleotide
taatacgactcactatagggggcagaggtgggtgcgcggccagggtgcggaacagaggagaccgcacatgggccgcgcaaacctggcggcagcgcaaaagatg

SEQ ID NO: 216490 - DNA, 103 bp, Artificial Sequence
  Synthetic Polynucleotide
taatacgactcactataggggggcagaaggggcagaggtgggtgcgcggcaacagaggagagccgcgatgccacctctgaacctggcggcagcgcaaaagatg

SEQ ID NO: 216491 - DNA, 103 bp, Artificial Sequence
  Synthetic Polynucleotide
taatacgactcactatagggcggcccccagggacgggtacaattctcgtgaacagaggagacacgagatgtgtacccgtaacctggcggcagcgcaaaagatg

SEQ ID NO: 216492 - DNA, 103 bp, Artificial Sequence
  Synthetic Polynucleotide
taatacgactcactatagggccatggcagggggcagaaggggcagaggtgaacagaggagacacctcatgcccttctgcaacctggcggcagcgcaaaagatg

SEQ ID NO: 216493 - DNA, 103 bp, Artificial Sequence
  Synthetic Polynucleotide
taatacgactcactatagggggctcagtgcccatggcagggggcagaaggaacagaggagaccttctatgccctgccataacctggcggcagcgcaaaagatg

SEQ ID NO: 216494 - DNA, 103 bp, Artificial Sequence
  Synthetic Polynucleotide
taatacgactcactatagggtgatggggccggctcagtgcccatggcaggaacagaggagacctgccatgggcactgagaacctggcggcagcgcaaaagatg

SEQ ID NO: 216495 - DNA, 103 bp, Artificial Sequence
  Synthetic Polynucleotide
taatacgactcactatagggcctctggagctgatggggccggctcagtgcaacagaggagagcactgatgcggccccataacctggcggcagcgcaaaagatg

SEQ ID NO: 216496 - DNA, 103 bp, Artificial Sequence
  Synthetic Polynucleotide
taatacgactcactataggggaatggagggcctctggagctgatggggccaacagaggagaggccccatgagctccagaaacctggcggcagcgcaaaagatg

SEQ ID NO: 216497 - DNA, 103 bp, Artificial Sequence
  Synthetic Polynucleotide
taatacgactcactatagggccccgggagggaatggagggcctctggagcaacagaggagagctccaatggccctccataacctggcggcagcgcaaaagatg

SEQ ID NO: 216498 - DNA, 103 bp, Artificial Sequence
  Synthetic Polynucleotide
taatacgactcactatagggtcaggctgacccccgggagggaatggagggaacagaggagaccctccatgccctcccggaacctggcggcagcgcaaaagatg

SEQ ID NO: 216499 - DNA, 103 bp, Artificial Sequence
  Synthetic Polynucleotide
taatacgactcactatagggttctccaggctcaggctgacccccgggaggaacagaggagacctcccatgggtcagcctaacctggcggcagcgcaaaagatg

SEQ ID NO: 216500 - DNA, 103 bp, Artificial Sequence
  Synthetic Polynucleotide
taatacgactcactatagggtagctcccggttctccaggctcaggctgacaacagaggagagtcagcatgagcctggagaacctggcggcagcgcaaaagatg

SEQ ID NO: 216501 - DNA, 103 bp, Artificial Sequence
  Synthetic Polynucleotide
taatacgactcactatagggactccttccatagctcccggttctccaggcaacagaggagagcctggatgaccgggagcaacctggcggcagcgcaaaagatg

SEQ ID NO: 216502 - DNA, 103 bp, Artificial Sequence
  Synthetic Polynucleotide
taatacgactcactatagggaggcggtagccggcccccagggacgggtacaacagaggagagtacccatgcctgggggcaacctggcggcagcgcaaaagatg

SEQ ID NO: 216503 - DNA, 103 bp, Artificial Sequence
  Synthetic Polynucleotide
taatacgactcactatagggacagagctgaactccttccatagctcccggaacagaggagaccgggaatgatggaaggaaacctggcggcagcgcaaaagatg

SEQ ID NO: 216504 - DNA, 103 bp, Artificial Sequence
  Synthetic Polynucleotide
taatacgactcactatagggttctgttcccacagagctgaactccttccaaacagaggagatggaagatgttcagctctaacctggcggcagcgcaaaagatg

SEQ ID NO: 216505 - DNA, 103 bp, Artificial Sequence
  Synthetic Polynucleotide
taatacgactcactatagggtgatgatcatttctgttcccacagagctgaaacagaggagatcagctatgtgggaacagaacctggcggcagcgcaaaagatg

SEQ ID NO: 216506 - DNA, 103 bp, Artificial Sequence
  Synthetic Polynucleotide
taatacgactcactatagggccagctttggtgatgatcatttctgttcccaacagaggagagggaacatgaatgatcataacctggcggcagcgcaaaagatg

SEQ ID NO: 216507 - DNA, 103 bp, Artificial Sequence
  Synthetic Polynucleotide
taatacgactcactatagggcatgcgcctcccagctttggtgatgatcataacagaggagaatgatcatgaccaaagctaacctggcggcagcgcaaaagatg

SEQ ID NO: 216508 - DNA, 103 bp, Artificial Sequence
  Synthetic Polynucleotide
taatacgactcactatagggaggcagggaacatgcgcctcccagctttggaacagaggagaccaaagatgggaggcgcaaacctggcggcagcgcaaaagatg

SEQ ID NO: 216509 - DNA, 103 bp, Artificial Sequence
  Synthetic Polynucleotide
taatacgactcactataggggacactcggcaggcagggaacatgcgcctcaacagaggagagaggcgatggttccctgcaacctggcggcagcgcaaaagatg

SEQ ID NO: 216510 - DNA, 103 bp, Artificial Sequence
  Synthetic Polynucleotide
taatacgactcactataggggccagtgactgacactcggcaggcagggaaaacagaggagattccctatgtgccgagtgaacctggcggcagcgcaaaagatg

SEQ ID NO: 216511 - DNA, 103 bp, Artificial Sequence
  Synthetic Polynucleotide
taatacgactcactatagggcggggtccaggccagtgactgacactcggcaacagaggagagccgagatgcagtcactgaacctggcggcagcgcaaaagatg

SEQ ID NO: 216512 - DNA, 103 bp, Artificial Sequence
  Synthetic Polynucleotide
taatacgactcactatagggtagcgggcctcggggtccaggccagtgactaacagaggagaagtcacatgcctggacccaacctggcggcagcgcaaaagatg

SEQ ID NO: 216513 - DNA, 103 bp, Artificial Sequence
  Synthetic Polynucleotide
taatacgactcactatagggggcgggccccaggcggtagccggcccccagaacagaggagactggggatgggctaccgcaacctggcggcagcgcaaaagatg

SEQ ID NO: 216514 - DNA, 103 bp, Artificial Sequence
  Synthetic Polynucleotide
taatacgactcactatagggaagaaacaagtagcgggcctcggggtccagaacagaggagactggacatggaggcccgcaacctggcggcagcgcaaaagatg

SEQ ID NO: 216515 - DNA, 103 bp, Artificial Sequence
  Synthetic Polynucleotide
taatacgactcactatagggtcacatccagaagaaacaagtagcgggcctaacagaggagaaggcccatgacttgtttcaacctggcggcagcgcaaaagatg

SEQ ID NO: 216516 - DNA, 103 bp, Artificial Sequence
  Synthetic Polynucleotide
taatacgactcactatagggtccaccggaatcacatccagaagaaacaagaacagaggagacttgttatgtctggatgtaacctggcggcagcgcaaaagatg

SEQ ID NO: 216517 - DNA, 103 bp, Artificial Sequence
  Synthetic Polynucleotide
taatacgactcactataggggcgagccccatccaccggaatcacatccagaacagaggagactggatatgattccggtgaacctggcggcagcgcaaaagatg

SEQ ID NO: 216518 - DNA, 103 bp, Artificial Sequence
  Synthetic Polynucleotide
taatacgactcactataggggccagcggtagcgagccccatccaccggaaaacagaggagattccggatgatggggctcaacctggcggcagcgcaaaagatg

SEQ ID NO: 216519 - DNA, 103 bp, Artificial Sequence
  Synthetic Polynucleotide
taatacgactcactatagggcgccggccctgccagcggtagcgagccccaaacagaggagatggggcatgctaccgctgaacctggcggcagcgcaaaagatg

SEQ ID NO: 216520 - DNA, 103 bp, Artificial Sequence
  Synthetic Polynucleotide
taatacgactcactataggggggctcccagcgccggccctgccagcggtaaacagaggagataccgcatgcagggccggaacctggcggcagcgcaaaagatg

SEQ ID NO: 216521 - DNA, 103 bp, Artificial Sequence
  Synthetic Polynucleotide
taatacgactcactatagggccttgccgctgggctcccagcgccggccctaacagaggagaagggccatggctgggagcaacctggcggcagcgcaaaagatg

SEQ ID NO: 216522 - DNA, 103 bp, Artificial Sequence
  Synthetic Polynucleotide
taatacgactcactatagggcggggctctgccttgccgctgggctcccagaacagaggagactgggaatgcagcggcaaaacctggcggcagcgcaaaagatg

SEQ ID NO: 216523 - DNA, 103 bp, Artificial Sequence
  Synthetic Polynucleotide
taatacgactcactataggggtcaggcaggcggggctctgccttgccgctaacagaggagaagcggcatggcagagcccaacctggcggcagcgcaaaagatg

SEQ ID NO: 216524 - DNA, 103 bp, Artificial Sequence
  Synthetic Polynucleotide
taatacgactcactatagggccccaggttgggcgggccccaggcggtagcaacagaggagagctaccatgtggggcccgaacctggcggcagcgcaaaagatg

SEQ ID NO: 216525 - DNA, 103 bp, Artificial Sequence
  Synthetic Polynucleotide
taatacgactcactatagggtgtagacacggtcaggcaggcggggctctgaacagaggagacagagcatggcctgcctgaacctggcggcagcgcaaaagatg

SEQ ID NO: 216526 - DNA, 103 bp, Artificial Sequence
  Synthetic Polynucleotide
taatacgactcactatagggtcggggtgaatgtagacacggtcaggcaggaacagaggagacctgccatgccgtgtctaaacctggcggcagcgcaaaagatg

SEQ ID NO: 216527 - DNA, 103 bp, Artificial Sequence
  Synthetic Polynucleotide
taatacgactcactatagggggcaggagagtcggggtgaatgtagacacgaacagaggagacgtgtcatgattcaccccaacctggcggcagcgcaaaagatg

SEQ ID NO: 216528 - DNA, 103 bp, Artificial Sequence
  Synthetic Polynucleotide
taatacgactcactataggggtgcaccagtggcaggagagtcggggtgaaaacagaggagattcaccatgactctcctgaacctggcggcagcgcaaaagatg

SEQ ID NO: 216529 - DNA, 103 bp, Artificial Sequence
  Synthetic Polynucleotide
taatacgactcactatagggcgcatccaatgtgcaccagtggcaggagagaacagaggagactctccatgcactggtgcaacctggcggcagcgcaaaagatg

SEQ ID NO: 216530 - DNA, 103 bp, Artificial Sequence
  Synthetic Polynucleotide
taatacgactcactatagggcacaggctgccgcatccaatgtgcaccagtaacagaggagaactggtatgcattggatgaacctggcggcagcgcaaaagatg

SEQ ID NO: 216531 - DNA, 103 bp, Artificial Sequence
  Synthetic Polynucleotide
taatacgactcactataggggatggaaagacacaggctgccgcatccaataacagaggagaattggaatgggcagcctgaacctggcggcagcgcaaaagatg

SEQ ID NO: 216532 - DNA, 103 bp, Artificial Sequence
  Synthetic Polynucleotide
taatacgactcactatagggagcttgacacgatggaaagacacaggctgcaacagaggagagcagccatggtctttccaaacctggcggcagcgcaaaagatg

SEQ ID NO: 216533 - DNA, 103 bp, Artificial Sequence
  Synthetic Polynucleotide
taatacgactcactataggggctgttggtgagcttgacacgatggaaagaaacagaggagatctttcatgcgtgtcaagaacctggcggcagcgcaaaagatg

SEQ ID NO: 216534 - DNA, 103 bp, Artificial Sequence
  Synthetic Polynucleotide
taatacgactcactatagggggtccagcgtgctgttggtgagcttgacacaacagaggagagtgtcaatgtcaccaacaaacctggcggcagcgcaaaagatg

SEQ ID NO: 216535 - DNA, 103 bp, Artificial Sequence
  Synthetic Polynucleotide
taatacgactcactatagggctggagtcggccccaggttgggcgggccccaacagaggagaggggccatgccaacctggaacctggcggcagcgcaaaagatg

SEQ ID NO: 216536 - DNA, 103 bp, Artificial Sequence
  Synthetic Polynucleotide
taatacgactcactatagggtggccgtgggggtccagcgtgctgttggtgaacagaggagacaccaaatgcacgctggaaacctggcggcagcgcaaaagatg

SEQ ID NO: 216537 - DNA, 103 bp, Artificial Sequence
  Synthetic Polynucleotide
taatacgactcactatagggcaggatcaggtggccgtgggggtccagcgtaacagaggagaacgctgatgccccacggcaacctggcggcagcgcaaaagatg

SEQ ID NO: 216538 - DNA, 103 bp, Artificial Sequence
  Synthetic Polynucleotide
taatacgactcactataggggcatggagtgcaggatcaggtggccgtgggaacagaggagacccacgatgacctgatccaacctggcggcagcgcaaaagatg

SEQ ID NO: 216539 - DNA, 103 bp, Artificial Sequence
  Synthetic Polynucleotide
taatacgactcactatagggtggtacttgtgcatggagtgcaggatcaggaacagaggagacctgatatggcactccataacctggcggcagcgcaaaagatg

SEQ ID NO: 216540 - DNA, 103 bp, Artificial Sequence
  Synthetic Polynucleotide
taatacgactcactatagggtatgcggggttggtacttgtgcatggagtgaacagaggagacactccatgcacaagtacaacctggcggcagcgcaaaagatg

SEQ ID NO: 216541 - DNA, 103 bp, Artificial Sequence
  Synthetic Polynucleotide
taatacgactcactataggggaactaggtgtatgcggggttggtacttgtaacagaggagaacaagtatgaaccccgcaaacctggcggcagcgcaaaagatg

SEQ ID NO: 216542 - DNA, 103 bp, Artificial Sequence
  Synthetic Polynucleotide
taatacgactcactatagggtgggctgcccgaactaggtgtatgcggggtaacagaggagaaccccgatgacacctagtaacctggcggcagcgcaaaagatg

SEQ ID NO: 216543 - DNA, 103 bp, Artificial Sequence
  Synthetic Polynucleotide
taatacgactcactataggggctgcagagctgggctgcccgaactaggtgaacagaggagacacctaatgcgggcagccaacctggcggcagcgcaaaagatg

SEQ ID NO: 216544 - DNA, 103 bp, Artificial Sequence
  Synthetic Polynucleotide
taatacgactcactatagggcccagtgctggctgcagagctgggctgcccaacagaggagagggcagatgagctctgcaaacctggcggcagcgcaaaagatg

SEQ ID NO: 216545 - DNA, 103 bp, Artificial Sequence
  Synthetic Polynucleotide
taatacgactcactataggggccatgcccccccagtgctggctgcagagcaacagaggagagctctgatgccagcactgaacctggcggcagcgcaaaagatg

SEQ ID NO: 216546 - DNA, 103 bp, Artificial Sequence
  Synthetic Polynucleotide
taatacgactcactataggggggtgggaagctggagtcggccccaggttgaacagaggagacaacctatggccgactccaacctggcggcagcgcaaaagatg

SEQ ID NO: 216547 - DNA, 103 bp, Artificial Sequence
  Synthetic Polynucleotide
taatacgactcactataggggcggaaggaggccatgcccccccagtgctgaacagaggagacagcacatggggggcatgaacctggcggcagcgcaaaagatg

SEQ ID NO: 216548 - DNA, 103 bp, Artificial Sequence
  Synthetic Polynucleotide
taatacgactcactatagggtctcggggaagcggaaggaggccatgccccaacagaggagaggggcaatgcctccttccaacctggcggcagcgcaaaagatg

SEQ ID NO: 216549 - DNA, 103 bp, Artificial Sequence
  Synthetic Polynucleotide
taatacgactcactatagggatgaatgtggtctcggggaagcggaaggagaacagaggagactccttatgcttccccgaaacctggcggcagcgcaaaagatg

SEQ ID NO: 216550 - DNA, 103 bp, Artificial Sequence
  Synthetic Polynucleotide
taatacgactcactatagggtgtcacggagatgaatgtggtctcggggaaaacagaggagattccccatgaccacattcaacctggcggcagcgcaaaagatg

SEQ ID NO: 216551 - DNA, 103 bp, Artificial Sequence
  Synthetic Polynucleotide
taatacgactcactatagggtctggtaggctgtcacggagatgaatgtggaacagaggagaccacatatgtctccgtgaaacctggcggcagcgcaaaagatg

SEQ ID NO: 216552 - DNA, 103 bp, Artificial Sequence
  Synthetic Polynucleotide
taatacgactcactatagggatctgtgggttctggtaggctgtcacggagaacagaggagactccgtatgagcctaccaaacctggcggcagcgcaaaagatg

SEQ ID NO: 216553 - DNA, 103 bp, Artificial Sequence
  Synthetic Polynucleotide
taatacgactcactatagggcagttgtgtgatctgtgggttctggtaggcaacagaggagagcctacatgaacccacagaacctggcggcagcgcaaaagatg

SEQ ID NO: 216554 - DNA, 103 bp, Artificial Sequence
  Synthetic Polynucleotide
taatacgactcactatagggctgcaatcttcagttgtgtgatctgtgggtaacagaggagaacccacatgtcacacaacaacctggcggcagcgcaaaagatg

SEQ ID NO: 216555 - DNA, 103 bp, Artificial Sequence
  Synthetic Polynucleotide
taatacgactcactatagggaagggattggctgcaatcttcagttgtgtgaacagaggagacacacaatggaagattgcaacctggcggcagcgcaaaagatg

SEQ ID NO: 216556 - DNA, 103 bp, Artificial Sequence
  Synthetic Polynucleotide
taatacgactcactataggggcctttggcaaagggattggctgcaatcttaacagaggagaaagattatggccaatcccaacctggcggcagcgcaaaagatg

SEQ ID NO: 216557 - DNA, 103 bp, Artificial Sequence
  Synthetic Polynucleotide
taatacgactcactatagggccgctagggcgggtgggaagctggagtcggaacagaggagaccgactatggcttcccacaacctggcggcagcgcaaaagatg

SEQ ID NO: 216558 - DNA, 103 bp, Artificial Sequence
  Synthetic Polynucleotide
taatacgactcactatagggtctcccggaagcctttggcaaagggattggaacagaggagaccaatcatgttgccaaagaacctggcggcagcgcaaaagatg

SEQ ID NO: 216559 - DNA, 103 bp, Artificial Sequence
  Synthetic Polynucleotide
taatacgactcactatagggtttctgccgttctcccggaagcctttggcaaacagaggagatgccaaatgcttccgggaaacctggcggcagcgcaaaagatg

SEQ ID NO: 216560 - DNA, 103 bp, Artificial Sequence
  Synthetic Polynucleotide
taatacgactcactatagggcctcttacagtttctgccgttctcccggaaaacagaggagattccggatgaacggcagaaacctggcggcagcgcaaaagatg

SEQ ID NO: 216561 - DNA, 103 bp, Artificial Sequence
  Synthetic Polynucleotide
taatacgactcactatagggcgtctcgctccctcttacagtttctgccgtaacagaggagaacggcaatgactgtaagaaacctggcggcagcgcaaaagatg

SEQ ID NO: 216562 - DNA, 103 bp, Artificial Sequence
  Synthetic Polynucleotide
taatacgactcactatagggttcacacgggcgtctcgctccctcttacagaacagaggagactgtaaatgggagcgagaaacctggcggcagcgcaaaagatg

SEQ ID NO: 216563 - DNA, 103 bp, Artificial Sequence
  Synthetic Polynucleotide
taatacgactcactatagggcagtttcctcttcacacgggcgtctcgctcaacagaggagagagcgaatggcccgtgtgaacctggcggcagcgcaaaagatg

SEQ ID NO: 216564 - DNA, 103 bp, Artificial Sequence
  Synthetic Polynucleotide
taatacgactcactatagggctgggccccgcagtttcctcttcacacgggaacagaggagacccgtgatgagaggaaacaacctggcggcagcgcaaaagatg

SEQ ID NO: 216565 - DNA, 103 bp, Artificial Sequence
  Synthetic Polynucleotide
taatacgactcactataggggctgctggctctgggccccgcagtttcctcaacagaggagagaggaaatggcggggcccaacctggcggcagcgcaaaagatg

SEQ ID NO: 216566 - DNA, 103 bp, Artificial Sequence
  Synthetic Polynucleotide
taatacgactcactatagggggcctctgtggctgctggctctgggccccgaacagaggagacggggcatggagccagcaaacctggcggcagcgcaaaagatg

SEQ ID NO: 216567 - DNA, 103 bp, Artificial Sequence
  Synthetic Polynucleotide
taatacgactcactatagggcgctcccataggcctctgtggctgctggctaacagaggagaagccagatgccacagaggaacctggcggcagcgcaaaagatg

SEQ ID NO: 216568 - DNA, 103 bp, Artificial Sequence
  Synthetic Polynucleotide
taatacgactcactatagggcggtagccctccgctagggcgggtgggaagaacagaggagacttcccatgcgccctagcaacctggcggcagcgcaaaagatg

SEQ ID NO: 216569 - DNA, 103 bp, Artificial Sequence
  Synthetic Polynucleotide
taatacgactcactatagggggtgtgtctccgctcccataggcctctgtgaacagaggagacacagaatgctatgggagaacctggcggcagcgcaaaagatg

SEQ ID NO: 216570 - DNA, 103 bp, Artificial Sequence
  Synthetic Polynucleotide
taatacgactcactataggggggaccacctggtgtgtctccgctcccataaacagaggagatatgggatgggagacacaaacctggcggcagcgcaaaagatg

SEQ ID NO: 216571 - DNA, 103 bp, Artificial Sequence
  Synthetic Polynucleotide
taatacgactcactatagggtggagtcgcagggaccacctggtgtgtctcaacagaggagagagacaatgcaggtggtcaacctggcggcagcgcaaaagatg

SEQ ID NO: 216572 - DNA, 103 bp, Artificial Sequence
  Synthetic Polynucleotide
taatacgactcactatagggccacccagggtggagtcgcagggaccacctaacagaggagaaggtggatgctgcgactcaacctggcggcagcgcaaaagatg

SEQ ID NO: 216573 - DNA, 103 bp, Artificial Sequence
  Synthetic Polynucleotide
taatacgactcactatagggacgaatgtctccacccagggtggagtcgcaaacagaggagatgcgacatgaccctgggtaacctggcggcagcgcaaaagatg

SEQ ID NO: 216574 - DNA, 103 bp, Artificial Sequence
  Synthetic Polynucleotide
taatacgactcactataggggatctgattcacgaatgtctccacccagggaacagaggagaccctggatggagacattcaacctggcggcagcgcaaaagatg

SEQ ID NO: 216575 - DNA, 103 bp, Artificial Sequence
  Synthetic Polynucleotide
taatacgactcactataggggcctgttctggatctgattcacgaatgtctaacagaggagaagacatatgtgaatcagaaacctggcggcagcgcaaaagatg

SEQ ID NO: 216576 - DNA, 103 bp, Artificial Sequence
  Synthetic Polynucleotide
taatacgactcactataggggggggctggggcctgttctggatctgattcaacagaggagagaatcaatgccagaacagaacctggcggcagcgcaaaagatg

SEQ ID NO: 216577 - DNA, 103 bp, Artificial Sequence
  Synthetic Polynucleotide
taatacgactcactatagggtggcttccccgggggctggggcctgttctgaacagaggagacagaacatgccccagcccaacctggcggcagcgcaaaagatg

SEQ ID NO: 216578 - DNA, 103 bp, Artificial Sequence
  Synthetic Polynucleotide
taatacgactcactatagggggggcagcggtggcttccccgggggctgggaacagaggagacccagcatgcggggaagcaacctggcggcagcgcaaaagatg

SEQ ID NO: 216579 - DNA, 103 bp, Artificial Sequence
  Synthetic Polynucleotide
taatacgactcactatagggtcccgcgctctcggtgccaggggagctcataacagaggagaatgagcatgcctggcaccaacctggcggcagcgcaaaagatg

SEQ ID NO: 216580 - DNA, 103 bp, Artificial Sequence
  Synthetic Polynucleotide
taatacgactcactataggggcgctctgtggggtcgcccttctcgctgccaacagaggagaggcagcatgaagggcgacaacctggcggcagcgcaaaagatg

SEQ ID NO: 216581 - DNA, 103 bp, Artificial Sequence
  Synthetic Polynucleotide
taatacgactcactatagggtgggctggcattgtggctcacggggagcataacagaggagaatgctcatggtgagccacaacctggcggcagcgcaaaagatg

SEQ ID NO: 216582 - DNA, 103 bp, Artificial Sequence
  Synthetic Polynucleotide
taatacgactcactatagggagctggtaggtgggctggcattgtggctcaaacagaggagatgagccatgatgccagccaacctggcggcagcgcaaaagatg

SEQ ID NO: 216583 - DNA, 103 bp, Artificial Sequence
  Synthetic Polynucleotide
taatacgactcactatagggtactgactggagctggtaggtgggctggcaaacagaggagatgccagatgacctaccagaacctggcggcagcgcaaaagatg

SEQ ID NO: 216584 - DNA, 103 bp, Artificial Sequence
  Synthetic Polynucleotide
taatacgactcactatagggcaggctggggtactgactggagctggtaggaacagaggagacctaccatgtccagtcagaacctggcggcagcgcaaaagatg

SEQ ID NO: 216585 - DNA, 103 bp, Artificial Sequence
  Synthetic Polynucleotide
taatacgactcactatagggtcacagaccacaggctggggtactgactggaacagaggagaccagtcatgaccccagccaacctggcggcagcgcaaaagatg

SEQ ID NO: 216586 - DNA, 103 bp, Artificial Sequence
  Synthetic Polynucleotide
taatacgactcactataggggcgccgttgctcacagaccacaggctggggaacagaggagaccccagatggtggtctgtaacctggcggcagcgcaaaagatg

SEQ ID NO: 216587 - DNA, 103 bp, Artificial Sequence
  Synthetic Polynucleotide
taatacgactcactatagggcggggtgacggcgccgttgctcacagaccaaacagaggagatggtctatgagcaacggcaacctggcggcagcgcaaaagatg

SEQ ID NO: 216588 - DNA, 103 bp, Artificial Sequence
  Synthetic Polynucleotide
taatacgactcactatagggcctgggagcccggggtgacggcgccgttgcaacagaggagagcaacgatgccgtcacccaacctggcggcagcgcaaaagatg

SEQ ID NO: 216589 - DNA, 103 bp, Artificial Sequence
  Synthetic Polynucleotide
taatacgactcactatagggacggctgctgcctgggagcccggggtgacgaacagaggagacgtcacatggggctcccaaacctggcggcagcgcaaaagatg

SEQ ID NO: 216590 - DNA, 103 bp, Artificial Sequence
  Synthetic Polynucleotide
taatacgactcactatagggcccgttggacacggctgctgcctgggagccaacagaggagaggctccatggcagcagccaacctggcggcagcgcaaaagatg

SEQ ID NO: 216591 - DNA, 103 bp, Artificial Sequence
  Synthetic Polynucleotide
taatacgactcactatagggcgcgcagttcgcgctctgtggggtcgccctaacagaggagaagggcgatgccacagagcaacctggcggcagcgcaaaagatg

SEQ ID NO: 216592 - DNA, 103 bp, Artificial Sequence
  Synthetic Polynucleotide
taatacgactcactataggggggcccccagcccgttggacacggctgctgaacagaggagacagcagatgtgtccaacgaacctggcggcagcgcaaaagatg

SEQ ID NO: 216593 - DNA, 103 bp, Artificial Sequence
  Synthetic Polynucleotide
taatacgactcactatagggcggaagaactgggcccccagcccgttggacaacagaggagagtccaaatggctgggggcaacctggcggcagcgcaaaagatg

SEQ ID NO: 216594 - DNA, 103 bp, Artificial Sequence
  Synthetic Polynucleotide
taatacgactcactataggggggggagccccggaagaactgggcccccagaacagaggagactggggatgcagttcttcaacctggcggcagcgcaaaagatg

SEQ ID NO: 216595 - DNA, 103 bp, Artificial Sequence
  Synthetic Polynucleotide
taatacgactcactatagggtgtagtgcgcgggggagccccggaagaactaacagaggagaagttctatgggggctcccaacctggcggcagcgcaaaagatg

SEQ ID NO: 216596 - DNA, 103 bp, Artificial Sequence
  Synthetic Polynucleotide
taatacgactcactataggggtgaggggtgtgtagtgcgcgggggagcccaacagaggagagggctcatgcgcgcactaaacctggcggcagcgcaaaagatg

SEQ ID NO: 216597 - DNA, 103 bp, Artificial Sequence
  Synthetic Polynucleotide
taatacgactcactataggggaccggatgggtgaggggtgtgtagtgcgcaacagaggagagcgcacatgacacccctcaacctggcggcagcgcaaaagatg

SEQ ID NO: 216598 - DNA, 103 bp, Artificial Sequence
  Synthetic Polynucleotide
taatacgactcactatagggagggcgccgagaccggatgggtgaggggtgaacagaggagacaccccatgcccatccggaacctggcggcagcgcaaaagatg

SEQ ID NO: 216599 - DNA, 103 bp, Artificial Sequence
  Synthetic Polynucleotide
taatacgactcactatagggcccgaggaagagggcgccgagaccggatggaacagaggagaccatccatgctcggcgccaacctggcggcagcgcaaaagatg

SEQ ID NO: 216600 - DNA, 103 bp, Artificial Sequence
  Synthetic Polynucleotide
taatacgactcactatagggcagtggggatcccgaggaagagggcgccgaaacagaggagatcggcgatgtcttcctcgaacctggcggcagcgcaaaagatg

SEQ ID NO: 216601 - DNA, 103 bp, Artificial Sequence
  Synthetic Polynucleotide
taatacgactcactatagggccccttcgtacagtggggatcccgaggaagaacagaggagacttcctatggatccccacaacctggcggcagcgcaaaagatg

SEQ ID NO: 216602 - DNA, 103 bp, Artificial Sequence
  Synthetic Polynucleotide
taatacgactcactatagggtccaggcccacgcgcagttcgcgctctgtgaacagaggagacacagaatgcgaactgcgaacctggcggcagcgcaaaagatg

SEQ ID NO: 216603 - DNA, 103 bp, Artificial Sequence
  Synthetic Polynucleotide
taatacgactcactataggggccgcggccgccccttcgtacagtggggataacagaggagaatccccatggtacgaaggaacctggcggcagcgcaaaagatg

SEQ ID NO: 216604 - DNA, 103 bp, Artificial Sequence
  Synthetic Polynucleotide
taatacgactcactataggggatgtctgtggccgcggccgccccttcgtaaacagaggagatacgaaatggcggccgcgaacctggcggcagcgcaaaagatg

SEQ ID NO: 216605 - DNA, 103 bp, Artificial Sequence
  Synthetic Polynucleotide
taatacgactcactatagggggctgtccacgatgtctgtggccgcggccgaacagaggagacggccgatgccacagacaaacctggcggcagcgcaaaagatg

SEQ ID NO: 216606 - DNA, 103 bp, Artificial Sequence
  Synthetic Polynucleotide
taatacgactcactataggggcgtcgtactggctgtccacgatgtctgtgaacagaggagacacagaatgcgtggacagaacctggcggcagcgcaaaagatg

SEQ ID NO: 216607 - DNA, 103 bp, Artificial Sequence
  Synthetic Polynucleotide
taatacgactcactatagggttgggctgcggcgtcgtactggctgtccacaacagaggagagtggacatgcagtacgacaacctggcggcagcgcaaaagatg

SEQ ID NO: 216608 - DNA, 103 bp, Artificial Sequence
  Synthetic Polynucleotide
taatacgactcactatagggtgaggcggccttgggctgcggcgtcgtactaacagaggagaagtacgatgccgcagcccaacctggcggcagcgcaaaagatg

SEQ ID NO: 216609 - DNA, 103 bp, Artificial Sequence
  Synthetic Polynucleotide
taatacgactcactatagggcatgaggctatgaggcggccttgggctgcgaacagaggagacgcagcatgaggccgcctaacctggcggcagcgcaaaagatg

SEQ ID NO: 216610 - DNA, 103 bp, Artificial Sequence
  Synthetic Polynucleotide
taatacgactcactatagggcacaggtgtccatgaggctatgaggcggccaacagaggagaggccgcatgatagcctcaaacctggcggcagcgcaaaagatg

SEQ ID NO: 216611 - DNA, 103 bp, Artificial Sequence
  Synthetic Polynucleotide
taatacgactcactatagggaaggtggcgacacaggtgtccatgaggctaaacagaggagatagcctatgggacacctgaacctggcggcagcgcaaaagatg

SEQ ID NO: 216612 - DNA, 103 bp, Artificial Sequence
  Synthetic Polynucleotide
taatacgactcactatagggctcgctctcctccaggcccacgcgcagttcaacagaggagagaactgatggtgggcctgaacctggcggcagcgcaaaagatg

SEQ ID NO: 216613 - DNA, 103 bp, Artificial Sequence
  Synthetic Polynucleotide
taatacgactcactataggggcagccacagctcgctctcctccaggcccaaacagaggagatgggccatgaggagagcgaacctggcggcagcgcaaaagatg

SEQ ID NO: 216614 - DNA, 103 bp, Artificial Sequence
  Synthetic Polynucleotide
taatacgactcactatagggtccttgaagcgcagccacagctcgctctccaacagaggagaggagagatggctgtggctaacctggcggcagcgcaaaagatg

SEQ ID NO: 216615 - DNA, 103 bp, Artificial Sequence
  Synthetic Polynucleotide
taatacgactcactatagggattggtgagctccttgaagcgcagccacagaacagaggagactgtggatgcgcttcaagaacctggcggcagcgcaaaagatg

SEQ ID NO: 216616 - DNA, 103 bp, Artificial Sequence
  Synthetic Polynucleotide
taatacgactcactatagggcgatcatctcattggtgagctccttgaagcaacagaggagagcttcaatgagctcaccaaacctggcggcagcgcaaaagatg

SEQ ID NO: 216617 - DNA, 103 bp, Artificial Sequence
  Synthetic Polynucleotide
taatacgactcactatagggttcttggtcacgatcatctcattggtgagcaacagaggagagctcacatgtgagatgataacctggcggcagcgcaaaagatg

SEQ ID NO: 216618 - DNA, 103 bp, Artificial Sequence
  Synthetic Polynucleotide
taatacgactcactatagggcctcctgccgttcttggtcacgatcatctcaacagaggagagagatgatggtgaccaagaacctggcggcagcgcaaaagatg

SEQ ID NO: 216619 - DNA, 103 bp, Artificial Sequence
  Synthetic Polynucleotide
taatacgactcactataggggcaggctctttcccgcgctctcggtgccagaacagaggagactggcaatgagagcgcggaacctggcggcagcgcaaaagatg

SEQ ID NO: 216620 - DNA, 103 bp, Artificial Sequence
  Synthetic Polynucleotide
taatacgactcactatagggccggaaacatcctcctgccgttcttggtcaaacagaggagatgaccaatgacggcaggaaacctggcggcagcgcaaaagatg

SEQ ID NO: 216621 - DNA, 103 bp, Artificial Sequence
  Synthetic Polynucleotide
taatacgactcactatagggaccttcagcaccggaaacatcctcctgccgaacagaggagacggcagatggatgtttccaacctggcggcagcgcaaaagatg

SEQ ID NO: 216622 - DNA, 103 bp, Artificial Sequence
  Synthetic Polynucleotide
taatacgactcactatagggagacacgttcaccttcagcaccggaaacataacagaggagaatgtttatggtgctgaagaacctggcggcagcgcaaaagatg

SEQ ID NO: 216623 - DNA, 103 bp, Artificial Sequence
  Synthetic Polynucleotide
taatacgactcactatagggggtccaggccagacacgttcaccttcagcaaacagaggagatgctgaatgtgaacgtgtaacctggcggcagcgcaaaagatg

SEQ ID NO: 216624 - DNA, 103 bp, Artificial Sequence
  Synthetic Polynucleotide
taatacgactcactatagggatggcgttggggtccaggccagacacgttcaacagaggagagaacgtatgtggcctggaaacctggcggcagcgcaaaagatg

SEQ ID NO: 216625 - DNA, 103 bp, Artificial Sequence
  Synthetic Polynucleotide
taatacgactcactataggggaaggagtacatggcgttggggtccaggccaacagaggagaggcctgatgcccaacgccaacctggcggcagcgcaaaagatg

SEQ ID NO: 216626 - DNA, 103 bp, Artificial Sequence
  Synthetic Polynucleotide
taatacgactcactatagggagtccagcaggaaggagtacatggcgttggaacagaggagaccaacgatgtgtactcctaacctggcggcagcgcaaaagatg

SEQ ID NO: 216627 - DNA, 103 bp, Artificial Sequence
  Synthetic Polynucleotide
taatacgactcactataggggccgccacgaagtccagcaggaaggagtacaacagaggagagtactcatgcctgctggaaacctggcggcagcgcaaaagatg

SEQ ID NO: 216628 - DNA, 103 bp, Artificial Sequence
  Synthetic Polynucleotide
taatacgactcactataggggtggttgtccgccgccacgaagtccagcagaacagaggagactgctgatgttcgtggcgaacctggcggcagcgcaaaagatg

SEQ ID NO: 216629 - DNA, 103 bp, Artificial Sequence
  Synthetic Polynucleotide
taatacgactcactatagggacttccagcggtggttgtccgccgccacgaaacagaggagatcgtggatgcggacaaccaacctggcggcagcgcaaaagatg

SEQ ID NO: 216630 - DNA, 103 bp, Artificial Sequence
  Synthetic Polynucleotide
taatacgactcactatagggactcggtactgcaggctctttcccgcgctcaacagaggagagagcgcatgaaagagcctaacctggcggcagcgcaaaagatg

SEQ ID NO: 216631 - DNA, 103 bp, Artificial Sequence
  Synthetic Polynucleotide
taatacgactcactatagggccgttcacgtacttccagcggtggttgtccaacagaggagaggacaaatgccgctggaaaacctggcggcagcgcaaaagatg

SEQ ID NO: 216632 - DNA, 103 bp, Artificial Sequence
  Synthetic Polynucleotide
taatacgactcactatagggcacccattccccgttcacgtacttccagcgaacagaggagacgctggatgtacgtgaacaacctggcggcagcgcaaaagatg

SEQ ID NO: 216633 - DNA, 103 bp, Artificial Sequence
  Synthetic Polynucleotide
taatacgactcactatagggtgccccccggcacccattccccgttcacgtaacagaggagaacgtgaatggggaatgggaacctggcggcagcgcaaaagatg

SEQ ID NO: 216634 - DNA, 103 bp, Artificial Sequence
  Synthetic Polynucleotide
taatacgactcactatagggggctccggcttgccccccggcacccattccaacagaggagaggaatgatggccggggggaacctggcggcagcgcaaaagatg

SEQ ID NO: 216635 - DNA, 103 bp, Artificial Sequence
  Synthetic Polynucleotide
taatacgactcactataggggggcgcctgcggctccggcttgccccccggaacagaggagaccggggatgaagccggagaacctggcggcagcgcaaaagatg

SEQ ID NO: 216636 - DNA, 103 bp, Artificial Sequence
  Synthetic Polynucleotide
taatacgactcactatagggagacgcagctgggcgcctgcggctccggctaacagaggagaagccggatgcgcaggcgcaacctggcggcagcgcaaaagatg

SEQ ID NO: 216637 - DNA, 103 bp, Artificial Sequence
  Synthetic Polynucleotide
taatacgactcactataggggggtggatgtagacgcagctgggcgcctgcaacagaggagagcaggcatgcagctgcgtaacctggcggcagcgcaaaagatg

SEQ ID NO: 216638 - DNA, 103 bp, Artificial Sequence
  Synthetic Polynucleotide
taatacgactcactataggggggcgagtcggggtggatgtagacgcagctaacagaggagaagctgcatgtacatccacaacctggcggcagcgcaaaagatg

SEQ ID NO: 216639 - DNA, 103 bp, Artificial Sequence
  Synthetic Polynucleotide
taatacgactcactatagggccccgaagttgggcgagtcggggtggatgtaacagaggagaacatccatgccgactcgcaacctggcggcagcgcaaaagatg

SEQ ID NO: 216640 - DNA, 103 bp, Artificial Sequence
  Synthetic Polynucleotide
taatacgactcactatagggatccagtgggccccgaagttgggcgagtcgaacagaggagacgactcatgcaacttcggaacctggcggcagcgcaaaagatg

SEQ ID NO: 216641 - DNA, 103 bp, Artificial Sequence
  Synthetic Polynucleotide
taatacgactcactatagggcaggtggtccactcggtactgcaggctcttaacagaggagaaagagcatgcagtaccgaaacctggcggcagcgcaaaagatg

SEQ ID NO: 216642 - DNA, 103 bp, Artificial Sequence
  Synthetic Polynucleotide
taatacgactcactataggggggagccttcatccagtgggccccgaagttaacagaggagaaacttcatggcccactggaacctggcggcagcgcaaaagatg

SEQ ID NO: 216643 - DNA, 103 bp, Artificial Sequence
  Synthetic Polynucleotide
taatacgactcactatagggtgaaggagacgggagccttcatccagtgggaacagaggagacccactatgtgaaggctcaacctggcggcagcgcaaaagatg

SEQ ID NO: 216644 - DNA, 103 bp, Artificial Sequence
  Synthetic Polynucleotide
taatacgactcactatagggttgactttgctgaaggagacgggagccttcaacagaggagagaaggcatgcgtctccttaacctggcggcagcgcaaaagatg

SEQ ID NO: 216645 - DNA, 103 bp, Artificial Sequence
  Synthetic Polynucleotide
taatacgactcactataggggttggtgagcttgactttgctgaaggagacaacagaggagagtctccatgagcaaagtcaacctggcggcagcgcaaaagatg

SEQ ID NO: 216646 - DNA, 103 bp, Artificial Sequence
  Synthetic Polynucleotide
taatacgactcactatagggcgttgagcttgttggtgagcttgactttgcaacagaggagagcaaagatgagctcaccaaacctggcggcagcgcaaaagatg

SEQ ID NO: 216647 - DNA, 103 bp, Artificial Sequence
  Synthetic Polynucleotide
taatacgactcactatagggtggccccctccgttgagcttgttggtgagcaacagaggagagctcacatgcaagctcaaaacctggcggcagcgcaaaagatg

SEQ ID NO: 216648 - DNA, 103 bp, Artificial Sequence
  Synthetic Polynucleotide
taatacgactcactatagggcagcatgatctggccccctccgttgagcttaacagaggagaaagctcatgggagggggcaacctggcggcagcgcaaaagatg

SEQ ID NO: 216649 - DNA, 103 bp, Artificial Sequence
  Synthetic Polynucleotide
taatacgactcactataggggcaaggagttcagcatgatctggccccctcaacagaggagagaggggatgagatcatgcaacctggcggcagcgcaaaagatg

SEQ ID NO: 216650 - DNA, 103 bp, Artificial Sequence
  Synthetic Polynucleotide
taatacgactcactatagggtcatacttatgcaaggagttcagcatgatcaacagaggagagatcatatggaactccttaacctggcggcagcgcaaaagatg

SEQ ID NO: 216651 - DNA, 103 bp, Artificial Sequence
  Synthetic Polynucleotide
taatacgactcactataggggattcgaggctcatacttatgcaaggagttaacagaggagaaactccatgcataagtataacctggcggcagcgcaaaagatg

SEQ ID NO: 216652 - DNA, 103 bp, Artificial Sequence
  Synthetic Polynucleotide
taatacgactcactatagggcggcgctcagcaggtggtccactcggtactaacagaggagaagtaccatgtggaccaccaacctggcggcagcgcaaaagatg

SEQ ID NO: 216653 - DNA, 103 bp, Artificial Sequence
  Synthetic Polynucleotide
taatacgactcactatagggtcactatgtggattcgaggctcatacttataacagaggagaataagtatgagcctcgaaaacctggcggcagcgcaaaagatg

SEQ ID NO: 216654 - DNA, 103 bp, Artificial Sequence
  Synthetic Polynucleotide
taatacgactcactatagggcccccaactctcactatgtggattcgaggcaacagaggagagcctcgatgccacatagtaacctggcggcagcgcaaaagatg

SEQ ID NO: 216655 - DNA, 103 bp, Artificial Sequence
  Synthetic Polynucleotide
taatacgactcactataggggcgctgtggacccccaactctcactatgtgaacagaggagacacataatgagagttgggaacctggcggcagcgcaaaagatg

SEQ ID NO: 216656 - DNA, 103 bp, Artificial Sequence
  Synthetic Polynucleotide
taatacgactcactatagggtggtgatcatgcgctgtggacccccaactcaacagaggagagagttgatggtccacagcaacctggcggcagcgcaaaagatg

SEQ ID NO: 216657 - DNA, 103 bp, Artificial Sequence
  Synthetic Polynucleotide
taatacgactcactatagggaagcagtggctggtgatcatgcgctgtggaaacagaggagatccacaatgcatgatcacaacctggcggcagcgcaaaagatg

SEQ ID NO: 216658 - DNA, 103 bp, Artificial Sequence
  Synthetic Polynucleotide
taatacgactcactatagggggtctcagggaagcagtggctggtgatcataacagaggagaatgatcatgagccactgcaacctggcggcagcgcaaaagatg

SEQ ID NO: 216659 - DNA, 103 bp, Artificial Sequence
  Synthetic Polynucleotide
taatacgactcactatagggctatgaactgggtctcagggaagcagtggcaacagaggagagccactatgtccctgagaaacctggcggcagcgcaaaagatg

SEQ ID NO: 216660 - DNA, 103 bp, Artificial Sequence
  Synthetic Polynucleotide
taatacgactcactataggggcagtcaccgctatgaactgggtctcagggaacagaggagaccctgaatgccagttcataacctggcggcagcgcaaaagatg

SEQ ID NO: 216661 - DNA, 103 bp, Artificial Sequence
  Synthetic Polynucleotide
taatacgactcactataggggttctgataagcagtcaccgctatgaactgaacagaggagacagttcatggcggtgactaacctggcggcagcgcaaaagatg

SEQ ID NO: 216662 - DNA, 103 bp, Artificial Sequence
  Synthetic Polynucleotide
taatacgactcactatagggtgatctcctcgttctgataagcagtcaccgaacagaggagacggtgaatgcttatcagaaacctggcggcagcgcaaaagatg

SEQ ID NO: 216663 - DNA, 103 bp, Artificial Sequence
  Synthetic Polynucleotide
taatacgactcactatagggtcattctccacggcgctcagcaggtggtccaacagaggagaggaccaatggctgagcgcaacctggcggcagcgcaaaagatg

SEQ ID NO: 216664 - DNA, 103 bp, Artificial Sequence
  Synthetic Polynucleotide
taatacgactcactatagggttaagagctgtgatctcctcgttctgataaaacagaggagattatcaatgcgaggagataacctggcggcagcgcaaaagatg

SEQ ID NO: 216665 - DNA, 103 bp, Artificial Sequence
  Synthetic Polynucleotide
taatacgactcactataggggtacttaattttaagagctgtgatctcctcaacagaggagagaggagatgacagctcttaacctggcggcagcgcaaaagatg

SEQ ID NO: 216666 - DNA, 103 bp, Artificial Sequence
  Synthetic Polynucleotide
taatacgactcactatagggcaaatggattgtacttaattttaagagctgaacagaggagacagctcatgaaattaagtaacctggcggcagcgcaaaagatg

SEQ ID NO: 216667 - DNA, 103 bp, Artificial Sequence
  Synthetic Polynucleotide
taatacgactcactatagggaaagcttttgcaaatggattgtacttaattaacagaggagaaattaaatgcaatccattaacctggcggcagcgcaaaagatg

SEQ ID NO: 216668 - DNA, 103 bp, Artificial Sequence
  Synthetic Polynucleotide
taatacgactcactatagggtgcatcaaggaaagcttttgcaaatggattaacagaggagaaatccaatggcaaaagctaacctggcggcagcgcaaaagatg

SEQ ID NO: 216669 - DNA, 103 bp, Artificial Sequence
  Synthetic Polynucleotide
taatacgactcactatagggttctttcctttgcatcaaggaaagcttttgaacagaggagacaaaagatgtccttgatgaacctggcggcagcgcaaaagatg

SEQ ID NO: 216670 - DNA, 103 bp, Artificial Sequence
  Synthetic Polynucleotide
taatacgactcactatagggttgtgatcacttctttcctttgcatcaaggaacagaggagaccttgaatgaaaggaaagaacctggcggcagcgcaaaagatg

SEQ ID NO: 216671 - DNA, 103 bp, Artificial Sequence
  Synthetic Polynucleotide
taatacgactcactatagggcatcatctctttgtgatcacttctttccttaacagaggagaaaggaaatgagtgatcacaacctggcggcagcgcaaaagatg

SEQ ID NO: 216672 - DNA, 103 bp, Artificial Sequence
  Synthetic Polynucleotide
taatacgactcactatagggcgggttcctccatcatctctttgtgatcacaacagaggagagtgatcatgaagagatgaaacctggcggcagcgcaaaagatg

SEQ ID NO: 216673 - DNA, 103 bp, Artificial Sequence
  Synthetic Polynucleotide
taatacgactcactatagggtggctgtctccgggttcctccatcatctctaacagaggagaagagatatgggaggaaccaacctggcggcagcgcaaaagatg

SEQ ID NO: 216674 - DNA, 103 bp, Artificial Sequence
  Synthetic Polynucleotide
taatacgactcactatagggcgcctgcagctcattctccacggcgctcagaacagaggagactgagcatggtggagaataacctggcggcagcgcaaaagatg

SEQ ID NO: 216675 - DNA, 103 bp, Artificial Sequence
  Synthetic Polynucleotide
taatacgactcactatagggcccaggttgctggctgtctccgggttcctcaacagaggagagaggaaatgggagacagcaacctggcggcagcgcaaaagatg

SEQ ID NO: 216676 - DNA, 103 bp, Artificial Sequence
  Synthetic Polynucleotide
taatacgactcactatagggattgggagtacccaggttgctggctgtctcaacagaggagagagacaatgagcaacctgaacctggcggcagcgcaaaagatg

SEQ ID NO: 216677 - DNA, 103 bp, Artificial Sequence
  Synthetic Polynucleotide
taatacgactcactatagggagccacccccattgggagtacccaggttgcaacagaggagagcaaccatggtactcccaaacctggcggcagcgcaaaagatg

SEQ ID NO: 216678 - DNA, 103 bp, Artificial Sequence
  Synthetic Polynucleotide
taatacgactcactatagggtccaggaagaagccacccccattgggagtaaacagaggagatactccatgtgggggtggaacctggcggcagcgcaaaagatg

SEQ ID NO: 216679 - DNA, 103 bp, Artificial Sequence
  Synthetic Polynucleotide
taatacgactcactataggggggtgctggttccaggaagaagccacccccaacagaggagagggggtatgttcttcctgaacctggcggcagcgcaaaagatg

SEQ ID NO: 216680 - DNA, 103 bp, Artificial Sequence
  Synthetic Polynucleotide
taatacgactcactatagggggtggacacagggtgctggttccaggaagaaacagaggagatcttccatgaaccagcacaacctggcggcagcgcaaaagatg

SEQ ID NO: 216681 - DNA, 103 bp, Artificial Sequence
  Synthetic Polynucleotide
taatacgactcactatagggaggatttgcaggtggacacagggtgctggtaacagaggagaaccagcatgctgtgtccaaacctggcggcagcgcaaaagatg

SEQ ID NO: 216682 - DNA, 103 bp, Artificial Sequence
  Synthetic Polynucleotide
taatacgactcactatagggactgaggatgaggatttgcaggtggacacaaacagaggagatgtgtcatgctgcaaatcaacctggcggcagcgcaaaagatg

SEQ ID NO: 216683 - DNA, 103 bp, Artificial Sequence
  Synthetic Polynucleotide
taatacgactcactataggggcacctccaaactgaggatgaggatttgcaaacagaggagatgcaaaatgtcatcctcaaacctggcggcagcgcaaaagatg

SEQ ID NO: 216684 - DNA, 103 bp, Artificial Sequence
  Synthetic Polynucleotide
taatacgactcactataggggagggagagggcacctccaaactgaggatgaacagaggagacatcctatgtttggaggtaacctggcggcagcgcaaaagatg

SEQ ID NO: 216685 - DNA, 103 bp, Artificial Sequence
  Synthetic Polynucleotide
taatacgactcactatagggtctcgctgcccgcctgcagctcattctccaaacagaggagatggagaatgagctgcaggaacctggcggcagcgcaaaagatg

SEQ ID NO: 216686 - DNA, 103 bp, Artificial Sequence
  Synthetic Polynucleotide
taatacgactcactataggggcgtggaggggagggagagggcacctccaaaacagaggagattggagatgccctctcccaacctggcggcagcgcaaaagatg

SEQ ID NO: 216687 - DNA, 103 bp, Artificial Sequence
  Synthetic Polynucleotide
taatacgactcactatagggtcacagctgtgcgtggaggggagggagaggaacagaggagacctctcatgcccctccacaacctggcggcagcgcaaaagatg

SEQ ID NO: 216688 - DNA, 103 bp, Artificial Sequence
  Synthetic Polynucleotide
taatacgactcactatagggtgggtacctgtcacagctgtgcgtggagggaacagaggagaccctccatgcacagctgtaacctggcggcagcgcaaaagatg

SEQ ID NO: 216689 - DNA, 103 bp, Artificial Sequence
  Synthetic Polynucleotide
taatacgactcactatagggtcctcagggttgggtacctgtcacagctgtaacagaggagaacagctatgacaggtaccaacctggcggcagcgcaaaagatg

SEQ ID NO: 216690 - DNA, 103 bp, Artificial Sequence
  Synthetic Polynucleotide
taatacgactcactataggggaccggtggctcctcagggttgggtacctgaacagaggagacaggtaatgaaccctgagaacctggcggcagcgcaaaagatg

SEQ ID NO: 216691 - DNA, 103 bp, Artificial Sequence
  Synthetic Polynucleotide
taatacgactcactataggggtagggtgaggaccggtggctcctcagggtaacagaggagaaccctgatgagccaccggaacctggcggcagcgcaaaagatg

SEQ ID NO: 216692 - DNA, 103 bp, Artificial Sequence
  Synthetic Polynucleotide
taatacgactcactatagggaggggctggggtagggtgaggaccggtggcaacagaggagagccaccatgcctcaccctaacctggcggcagcgcaaaagatg

SEQ ID NO: 216693 - DNA, 103 bp, Artificial Sequence
  Synthetic Polynucleotide
taatacgactcactatagggcgatgagcataggggctggggtagggtgagaacagaggagactcaccatgccccagcccaacctggcggcagcgcaaaagatg

SEQ ID NO: 216694 - DNA, 103 bp, Artificial Sequence
  Synthetic Polynucleotide
taatacgactcactatagggagaattgttccgatgagcataggggctgggaacagaggagacccagcatgtatgctcataacctggcggcagcgcaaaagatg

SEQ ID NO: 216695 - DNA, 103 bp, Artificial Sequence
  Synthetic Polynucleotide
taatacgactcactatagggaataggttggagaattgttccgatgagcataacagaggagaatgctcatgggaacaattaacctggcggcagcgcaaaagatg

SEQ ID NO: 216696 - DNA, 103 bp, Artificial Sequence
  Synthetic Polynucleotide
taatacgactcactataggggggtcgcccttctcgctgcccgcctgcagcaacagaggagagctgcaatggggcagcgaaacctggcggcagcgcaaaagatg

SEQ ID NO: 216697 - DNA, 103 bp, Artificial Sequence
  Synthetic Polynucleotide
taatacgactcactataggggagttgtcagaataggttggagaattgttcaacagaggagagaacaaatgtccaacctaaacctggcggcagcgcaaaagatg

SEQ ID NO: 216698 - DNA, 103 bp, Artificial Sequence
  Synthetic Polynucleotide
taatacgactcactatagggacatgcaggtgagttgtcagaataggttggaacagaggagaccaaccatgtctgacaacaacctggcggcagcgcaaaagatg

SEQ ID NO: 216699 - DNA, 103 bp, Artificial Sequence
  Synthetic Polynucleotide
taatacgactcactataggggcatggataaacatgcaggtgagttgtcagaacagaggagactgacaatgcacctgcataacctggcggcagcgcaaaagatg

SEQ ID NO: 216700 - DNA, 103 bp, Artificial Sequence
  Synthetic Polynucleotide
taatacgactcactatagggtgggattgcagcatggataaacatgcaggtaacagaggagaacctgcatgtttatccataacctggcggcagcgcaaaagatg

SEQ ID NO: 216701 - DNA, 103 bp, Artificial Sequence
  Synthetic Polynucleotide
taatacgactcactatagggccaattgtcatgggattgcagcatggataaaacagaggagattatccatgctgcaatccaacctggcggcagcgcaaaagatg

SEQ ID NO: 216702 - DNA, 103 bp, Artificial Sequence
  Synthetic Polynucleotide
taatacgactcactatagggcaaggctggaccaattgtcatgggattgcaaacagaggagatgcaatatgatgacaattaacctggcggcagcgcaaaagatg

SEQ ID NO: 216703 - DNA, 103 bp, Artificial Sequence
  Synthetic Polynucleotide
taatacgactcactataggggcaggcattccaaggctggaccaattgtcaaacagaggagatgacaaatggtccagcctaacctggcggcagcgcaaaagatg

SEQ ID NO: 216704 - DNA, 103 bp, Artificial Sequence
  Synthetic Polynucleotide
taatacgactcactataggggctgggatgggcaggcattccaaggctggaaacagaggagatccagcatgggaatgcctaacctggcggcagcgcaaaagatg

SEQ ID NO: 216705 - DNA, 103 bp, Artificial Sequence
  Synthetic Polynucleotide
taatacgactcactatagggcggggagcatgctgggatgggcaggcattcaacagaggagagaatgcatgcccatcccaaacctggcggcagcgcaaaagatg

SEQ ID NO: 216706 - DNA, 103 bp, Artificial Sequence
  Synthetic Polynucleotide
taatacgactcactatagggttgtggctcacggggagcatgctgggatggaacagaggagaccatccatgcatgctcccaacctggcggcagcgcaaaagatg

SEQ ID NO: 216707 - DNA, 103 bp, Artificial Sequence
  Synthetic Polynucleotide
taatacgactcactatagggagcggccatgcgttgttgctggggattcataacagaggagaatgaatatgcagcaacaaaacctggcggcagcgcaaaagatg

SEQ ID NO: 216708 - DNA, 103 bp, Artificial Sequence
  Synthetic Polynucleotide
taatacgactcactatagggtgtagttggtctagttttcccactattaacaacagaggagagttaatatggggaaaactaacctggcggcagcgcaaaagatg

SEQ ID NO: 216709 - DNA, 103 bp, Artificial Sequence
  Synthetic Polynucleotide
taatacgactcactatagggtccaagtgcatcacctgtctgtgagcttccaacagaggagaggaagcatgcagacaggtaacctggcggcagcgcaaaagatg

SEQ ID NO: 216710 - DNA, 103 bp, Artificial Sequence
  Synthetic Polynucleotide
taatacgactcactatagggccaaagcctttccaagtgcatcacctgtctaacagaggagaagacagatgatgcacttgaacctggcggcagcgcaaaagatg

SEQ ID NO: 216711 - DNA, 103 bp, Artificial Sequence
  Synthetic Polynucleotide
taatacgactcactatagggtaaatagatgccaaagcctttccaagtgcaaacagaggagatgcactatgaaaggctttaacctggcggcagcgcaaaagatg

SEQ ID NO: 216712 - DNA, 103 bp, Artificial Sequence
  Synthetic Polynucleotide
taatacgactcactataggggtcaggagaataaatagatgccaaagccttaacagaggagaaaggctatggcatctattaacctggcggcagcgcaaaagatg

SEQ ID NO: 216713 - DNA, 103 bp, Artificial Sequence
  Synthetic Polynucleotide
taatacgactcactatagggtgctggtatggtcaggagaataaatagatgaacagaggagacatctaatgattctcctgaacctggcggcagcgcaaaagatg

SEQ ID NO: 216714 - DNA, 103 bp, Artificial Sequence
  Synthetic Polynucleotide
taatacgactcactatagggggaaaactactgctggtatggtcaggagaaaacagaggagattctccatgccataccagaacctggcggcagcgcaaaagatg

SEQ ID NO: 216715 - DNA, 103 bp, Artificial Sequence
  Synthetic Polynucleotide
taatacgactcactatagggtggatttgacggaaaactactgctggtatgaacagaggagacataccatgagtagttttaacctggcggcagcgcaaaagatg

SEQ ID NO: 216716 - DNA, 103 bp, Artificial Sequence
  Synthetic Polynucleotide
taatacgactcactatagggctggtgttgatggatttgacggaaaactacaacagaggagagtagttatgcgtcaaatcaacctggcggcagcgcaaaagatg

SEQ ID NO: 216717 - DNA, 103 bp, Artificial Sequence
  Synthetic Polynucleotide
taatacgactcactatagggggtgatccaactggtgttgatggatttgacaacagaggagagtcaaaatgatcaacaccaacctggcggcagcgcaaaagatg

SEQ ID NO: 216718 - DNA, 103 bp, Artificial Sequence
  Synthetic Polynucleotide
taatacgactcactataggggagaggtgaaggtgatccaactggtgttgaaacagaggagatcaacaatggttggatcaaacctggcggcagcgcaaaagatg

SEQ ID NO: 216719 - DNA, 103 bp, Artificial Sequence
  Synthetic Polynucleotide
taatacgactcactatagggtgcttcccagtgtagttggtctagttttccaacagaggagaggaaaaatggaccaactaaacctggcggcagcgcaaaagatg

SEQ ID NO: 216720 - DNA, 103 bp, Artificial Sequence
  Synthetic Polynucleotide
taatacgactcactatagggtggtacctgtgagaggtgaaggtgatccaaaacagaggagattggatatgcttcacctcaacctggcggcagcgcaaaagatg

SEQ ID NO: 216721 - DNA, 103 bp, Artificial Sequence
  Synthetic Polynucleotide
taatacgactcactatagggggccactgactggtacctgtgagaggtgaaaacagaggagattcaccatgcacaggtacaacctggcggcagcgcaaaagatg

SEQ ID NO: 216722 - DNA, 103 bp, Artificial Sequence
  Synthetic Polynucleotide
taatacgactcactatagggtccaggtcttggccactgactggtacctgtaacagaggagaacaggtatgagtcagtggaacctggcggcagcgcaaaagatg

SEQ ID NO: 216723 - DNA, 103 bp, Artificial Sequence
  Synthetic Polynucleotide
taatacgactcactataggggtgcttgccctccaggtcttggccactgacaacagaggagagtcagtatgcaagacctgaacctggcggcagcgcaaaagatg

SEQ ID NO: 216724 - DNA, 103 bp, Artificial Sequence
  Synthetic Polynucleotide
taatacgactcactatagggggggatgaaggtgcttgccctccaggtcttaacagaggagaaagaccatgagggcaagcaacctggcggcagcgcaaaagatg

SEQ ID NO: 216725 - DNA, 103 bp, Artificial Sequence
  Synthetic Polynucleotide
taatacgactcactatagggttcatagcttggggatgaaggtgcttgcccaacagaggagagggcaaatgccttcatccaacctggcggcagcgcaaaagatg

SEQ ID NO: 216726 - DNA, 103 bp, Artificial Sequence
  Synthetic Polynucleotide
taatacgactcactatagggggagtgagttttcatagcttggggatgaagaacagaggagacttcatatgcaagctatgaacctggcggcagcgcaaaagatg

SEQ ID NO: 216727 - DNA, 103 bp, Artificial Sequence
  Synthetic Polynucleotide
taatacgactcactatagggtgcagggagtggagtgagttttcatagcttaacagaggagaaagctaatgaaactcactaacctggcggcagcgcaaaagatg

SEQ ID NO: 216728 - DNA, 103 bp, Artificial Sequence
  Synthetic Polynucleotide
taatacgactcactatagggcattcgagactgcagggagtggagtgagttaacagaggagaaactcaatgcactccctgaacctggcggcagcgcaaaagatg

SEQ ID NO: 216729 - DNA, 103 bp, Artificial Sequence
  Synthetic Polynucleotide
taatacgactcactatagggaacgatcctccattcgagactgcagggagtaacagaggagaactcccatgagtctcgaaaacctggcggcagcgcaaaagatg

SEQ ID NO: 216730 - DNA, 103 bp, Artificial Sequence
  Synthetic Polynucleotide
taatacgactcactatagggctgaattgactgcttcccagtgtagttggtaacagaggagaaccaacatgactgggaagaacctggcggcagcgcaaaagatg

SEQ ID NO: 216731 - DNA, 103 bp, Artificial Sequence
  Synthetic Polynucleotide
taatacgactcactatagggagtctgtctaaacgatcctccattcgagacaacagaggagagtctcgatgggaggatcgaacctggcggcagcgcaaaagatg

SEQ ID NO: 216732 - DNA, 103 bp, Artificial Sequence
  Synthetic Polynucleotide
taatacgactcactatagggtgcatcatccagtctgtctaaacgatcctcaacagaggagagaggatatgttagacagaaacctggcggcagcgcaaaagatg

SEQ ID NO: 216733 - DNA, 103 bp, Artificial Sequence
  Synthetic Polynucleotide
taatacgactcactataggggcacatggattgcatcatccagtctgtctaaacagaggagatagacaatgtggatgatgaacctggcggcagcgcaaaagatg

SEQ ID NO: 216734 - DNA, 103 bp, Artificial Sequence
  Synthetic Polynucleotide
taatacgactcactatagggtggttccgcagcacatggattgcatcatccaacagaggagaggatgaatgaatccatgtaacctggcggcagcgcaaaagatg

SEQ ID NO: 216735 - DNA, 103 bp, Artificial Sequence
  Synthetic Polynucleotide
taatacgactcactatagggtcccacagcatggttccgcagcacatggataacagaggagaatccatatgctgcggaacaacctggcggcagcgcaaaagatg

SEQ ID NO: 216736 - DNA, 103 bp, Artificial Sequence
  Synthetic Polynucleotide
taatacgactcactatagggtggtggaaggtcccacagcatggttccgcaaacagaggagatgcggaatgatgctgtggaacctggcggcagcgcaaaagatg

SEQ ID NO: 216737 - DNA, 103 bp, Artificial Sequence
  Synthetic Polynucleotide
taatacgactcactataggggcaggcaaactggtggaaggtcccacagcaaacagaggagatgctgtatgaccttccacaacctggcggcagcgcaaaagatg

SEQ ID NO: 216738 - DNA, 103 bp, Artificial Sequence
  Synthetic Polynucleotide
taatacgactcactatagggactgtgaccagcaggcaaactggtggaaggaacagaggagaccttccatgagtttgcctaacctggcggcagcgcaaaagatg

SEQ ID NO: 216739 - DNA, 103 bp, Artificial Sequence
  Synthetic Polynucleotide
taatacgactcactatagggtatgtatatcactgtgaccagcaggcaaacaacagaggagagtttgcatgctggtcacaaacctggcggcagcgcaaaagatg

SEQ ID NO: 216740 - DNA, 103 bp, Artificial Sequence
  Synthetic Polynucleotide
taatacgactcactatagggcccaataaactatgtatatcactgtgaccaaacagaggagatggtcaatgtgatatacaaacctggcggcagcgcaaaagatg

SEQ ID NO: 216741 - DNA, 103 bp, Artificial Sequence
  Synthetic Polynucleotide
taatacgactcactatagggacctgatccactgaattgactgcttcccagaacagaggagactgggaatgagtcaattcaacctggcggcagcgcaaaagatg

SEQ ID NO: 216742 - DNA, 103 bp, Artificial Sequence
  Synthetic Polynucleotide
taatacgactcactatagggatgggatggtcccaataaactatgtatatcaacagaggagagatataatgagtttattgaacctggcggcagcgcaaaagatg

SEQ ID NO: 216743 - DNA, 103 bp, Artificial Sequence
  Synthetic Polynucleotide
taatacgactcactatagggttggtgcattatgggatggtcccaataaacaacagaggagagtttatatggaccatcccaacctggcggcagcgcaaaagatg

SEQ ID NO: 216744 - DNA, 103 bp, Artificial Sequence
  Synthetic Polynucleotide
taatacgactcactatagggaggcttccaattggtgcattatgggatggtaacagaggagaaccatcatgtaatgcaccaacctggcggcagcgcaaaagatg

SEQ ID NO: 216745 - DNA, 103 bp, Artificial Sequence
  Synthetic Polynucleotide
taatacgactcactataggggtttgaattgaggcttccaattggtgcattaacagaggagaaatgcaatgattggaagcaacctggcggcagcgcaaaagatg

SEQ ID NO: 216746 - DNA, 103 bp, Artificial Sequence
  Synthetic Polynucleotide
taatacgactcactatagggatcctccatagtttgaattgaggcttccaaaacagaggagattggaaatgtcaattcaaaacctggcggcagcgcaaaagatg

SEQ ID NO: 216747 - DNA, 103 bp, Artificial Sequence
  Synthetic Polynucleotide
taatacgactcactatagggacaaggcttgatcctccatagtttgaattgaacagaggagacaattcatgctatggaggaacctggcggcagcgcaaaagatg

SEQ ID NO: 216748 - DNA, 103 bp, Artificial Sequence
  Synthetic Polynucleotide
taatacgactcactatagggactgcttgcaacaaggcttgatcctccataaacagaggagatatggaatgtcaagccttaacctggcggcagcgcaaaagatg

SEQ ID NO: 216749 - DNA, 103 bp, Artificial Sequence
  Synthetic Polynucleotide
taatacgactcactatagggaagctgatcgactgcttgcaacaaggcttgaacagaggagacaagccatgttgcaagcaaacctggcggcagcgcaaaagatg

SEQ ID NO: 216750 - DNA, 103 bp, Artificial Sequence
  Synthetic Polynucleotide
taatacgactcactatagggccaaccattgaagctgatcgactgcttgcaaacagaggagatgcaagatgtcgatcagcaacctggcggcagcgcaaaagatg

SEQ ID NO: 216751 - DNA, 103 bp, Artificial Sequence
  Synthetic Polynucleotide
taatacgactcactatagggccgatgagttccaaccattgaagctgatcgaacagaggagacgatcaatgtcaatggttaacctggcggcagcgcaaaagatg

SEQ ID NO: 216752 - DNA, 103 bp, Artificial Sequence
  Synthetic Polynucleotide
taatacgactcactatagggtttcatcaatacctgatccactgaattgacaacagaggagagtcaatatggtggatcagaacctggcggcagcgcaaaagatg

SEQ ID NO: 216753 - DNA, 103 bp, Artificial Sequence
  Synthetic Polynucleotide
taatacgactcactatagggcagagtcttcccgatgagttccaaccattgaacagaggagacaatggatggaactcatcaacctggcggcagcgcaaaagatg

SEQ ID NO: 216754 - DNA, 103 bp, Artificial Sequence
  Synthetic Polynucleotide
taatacgactcactatagggttgagactgacagagtcttcccgatgagttaacagaggagaaactcaatgggaagactcaacctggcggcagcgcaaaagatg

SEQ ID NO: 216755 - DNA, 103 bp, Artificial Sequence
  Synthetic Polynucleotide
taatacgactcactatagggatgattgccattgagactgacagagtcttcaacagaggagagaagacatggtcagtctcaacctggcggcagcgcaaaagatg

SEQ ID NO: 216756 - DNA, 103 bp, Artificial Sequence
  Synthetic Polynucleotide
taatacgactcactatagggacaggactgaatgattgccattgagactgaaacagaggagatcagtcatgatggcaatcaacctggcggcagcgcaaaagatg

SEQ ID NO: 216757 - DNA, 103 bp, Artificial Sequence
  Synthetic Polynucleotide
taatacgactcactatagggactgtactagacaggactgaatgattgccaaacagaggagatggcaaatgttcagtcctaacctggcggcagcgcaaaagatg

SEQ ID NO: 216758 - DNA, 103 bp, Artificial Sequence
  Synthetic Polynucleotide
taatacgactcactatagggtgaagtagtgactgtactagacaggactgaaacagaggagatcagtcatgtctagtacaaacctggcggcagcgcaaaagatg

SEQ ID NO: 216759 - DNA, 103 bp, Artificial Sequence
  Synthetic Polynucleotide
taatacgactcactatagggggtctgtgcttgaagtagtgactgtactagaacagaggagactagtaatgtcactacttaacctggcggcagcgcaaaagatg

SEQ ID NO: 216760 - DNA, 103 bp, Artificial Sequence
  Synthetic Polynucleotide
taatacgactcactatagggttatggttcaggtctgtgcttgaagtagtgaacagaggagacactacatgaagcacagaaacctggcggcagcgcaaaagatg

SEQ ID NO: 216761 - DNA, 103 bp, Artificial Sequence
  Synthetic Polynucleotide
taatacgactcactatagggttcttgtgttttatggttcaggtctgtgctaacagaggagaagcacaatgctgaaccataacctggcggcagcgcaaaagatg

SEQ ID NO: 216762 - DNA, 103 bp, Artificial Sequence
  Synthetic Polynucleotide
taatacgactcactatagggctctataattttcttgtgttttatggttcaaacagaggagatgaaccatgaaacacaagaacctggcggcagcgcaaaagatg

SEQ ID NO: 216763 - DNA, 103 bp, Artificial Sequence
  Synthetic Polynucleotide
taatacgactcactataggggtacctcctctttcatcaatacctgatccaaacagaggagatggatcatgtattgatgaaacctggcggcagcgcaaaagatg

SEQ ID NO: 216764 - DNA, 103 bp, Artificial Sequence
  Synthetic Polynucleotide
taatacgactcactatagggtgcaagccacctctataattttcttgtgttaacagaggagaaacacaatgaaattatagaacctggcggcagcgcaaaagatg

SEQ ID NO: 216765 - DNA, 103 bp, Artificial Sequence
  Synthetic Polynucleotide
taatacgactcactatagggagactgactttgcaagccacctctataattaacagaggagaaattatatgggtggcttgaacctggcggcagcgcaaaagatg

SEQ ID NO: 216766 - DNA, 103 bp, Artificial Sequence
  Synthetic Polynucleotide
taatacgactcactatagggcaacagttccagactgactttgcaagccacaacagaggagagtggctatgaaagtcagtaacctggcggcagcgcaaaagatg

SEQ ID NO: 216767 - DNA, 103 bp, Artificial Sequence
  Synthetic Polynucleotide
taatacgactcactatagggtctgttgtaacaacagttccagactgacttaacagaggagaaagtcaatgtggaactgtaacctggcggcagcgcaaaagatg

SEQ ID NO: 216768 - DNA, 103 bp, Artificial Sequence
  Synthetic Polynucleotide
taatacgactcactatagggagtcttgatttctgttgtaacaacagttccaacagaggagaggaactatggttacaacaaacctggcggcagcgcaaaagatg

SEQ ID NO: 216769 - DNA, 103 bp, Artificial Sequence
  Synthetic Polynucleotide
taatacgactcactatagggctttgttttcagtcttgatttctgttgtaaaacagaggagattacaaatgaaatcaagaaacctggcggcagcgcaaaagatg

SEQ ID NO: 216770 - DNA, 103 bp, Artificial Sequence
  Synthetic Polynucleotide
taatacgactcactatagggtcatccttttctttgttttcagtcttgattaacagaggagaaatcaaatgtgaaaacaaaacctggcggcagcgcaaaagatg

SEQ ID NO: 216771 - DNA, 103 bp, Artificial Sequence
  Synthetic Polynucleotide
taatacgactcactatagggatgaaggttttcatccttttctttgttttcaacagaggagagaaaacatggaaaaggataacctggcggcagcgcaaaagatg

SEQ ID NO: 216772 - DNA, 103 bp, Artificial Sequence
  Synthetic Polynucleotide
taatacgactcactatagggaaggaggttcatgaaggttttcatccttttaacagaggagaaaaaggatgaaaaccttcaacctggcggcagcgcaaaagatg

SEQ ID NO: 216773 - DNA, 103 bp, Artificial Sequence
  Synthetic Polynucleotide
taatacgactcactatagggtcatctgatgaaggaggttcatgaaggtttaacagaggagaaaacctatgtgaacctccaacctggcggcagcgcaaaagatg

SEQ ID NO: 216774 - DNA, 103 bp, Artificial Sequence
  Synthetic Polynucleotide
taatacgactcactatagggccaagatgttgtacctcctctttcatcaataacagaggagaattgatatgagaggaggtaacctggcggcagcgcaaaagatg

SEQ ID NO: 216775 - DNA, 103 bp, Artificial Sequence
  Synthetic Polynucleotide
taatacgactcactatagggtgacttcatgtcatctgatgaaggaggttcaacagaggagagaacctatgtcatcagataacctggcggcagcgcaaaagatg

SEQ ID NO: 216776 - DNA, 103 bp, Artificial Sequence
  Synthetic Polynucleotide
taatacgactcactatagggattcatcatctgacttcatgtcatctgatgaacagaggagacatcagatgacatgaagtaacctggcggcagcgcaaaagatg

SEQ ID NO: 216777 - DNA, 103 bp, Artificial Sequence
  Synthetic Polynucleotide
taatacgactcactatagggttttgggaggattcatcatctgacttcatgaacagaggagacatgaaatgagatgatgaaacctggcggcagcgcaaaagatg

SEQ ID NO: 216778 - DNA, 103 bp, Artificial Sequence
  Synthetic Polynucleotide
taatacgactcactatagggcttgatatctttttgggaggattcatcatcaacagaggagagatgatatgtcctcccaaaacctggcggcagcgcaaaagatg

SEQ ID NO: 216779 - DNA, 103 bp, Artificial Sequence
  Synthetic Polynucleotide
taatacgactcactatagggtagatgaaaccttgatatctttttgggaggaacagaggagacctcccatgaagatatcaaacctggcggcagcgcaaaagatg

SEQ ID NO: 216780 - DNA, 103 bp, Artificial Sequence
  Synthetic Polynucleotide
taatacgactcactataggggttctgcctctagatgaaaccttgatatctaacagaggagaagatatatgggtttcatcaacctggcggcagcgcaaaagatg

SEQ ID NO: 216781 - DNA, 103 bp, Artificial Sequence
  Synthetic Polynucleotide
taatacgactcactatagggagtactgcttgttctgcctctagatgaaacaacagaggagagtttcaatgagaggcagaaacctggcggcagcgcaaaagatg

SEQ ID NO: 216782 - DNA, 103 bp, Artificial Sequence
  Synthetic Polynucleotide
taatacgactcactatagggcatcttcattagtactgcttgttctgcctcaacagaggagagaggcaatgcaagcagtaaacctggcggcagcgcaaaagatg

SEQ ID NO: 216783 - DNA, 103 bp, Artificial Sequence
  Synthetic Polynucleotide
taatacgactcactatagggttcaaatcctcatcttcattagtactgcttaacagaggagaaagcagatgtaatgaagaaacctggcggcagcgcaaaagatg

SEQ ID NO: 216784 - DNA, 103 bp, Artificial Sequence
  Synthetic Polynucleotide
taatacgactcactatagggctgttcagggttcaaatcctcatcttcattaacagaggagaaatgaaatggaggatttgaacctggcggcagcgcaaaagatg

SEQ ID NO: 216785 - DNA, 103 bp, Artificial Sequence
  Synthetic Polynucleotide
taatacgactcactatagggcacttgttccccaagatgttgtacctcctcaacagaggagagaggagatgcaacatcttaacctggcggcagcgcaaaagatg

SEQ ID NO: 216786 - DNA, 103 bp, Artificial Sequence
  Synthetic Polynucleotide
taatacgactcactatagggtttctatcttctgttcagggttcaaatcctaacagaggagaaggattatgaccctgaacaacctggcggcagcgcaaaagatg

SEQ ID NO: 216787 - DNA, 103 bp, Artificial Sequence
  Synthetic Polynucleotide
taatacgactcactatagggtccttctccctttctatcttctgttcagggaacagaggagaccctgaatggaagatagaaacctggcggcagcgcaaaagatg

SEQ ID NO: 216788 - DNA, 103 bp, Artificial Sequence
  Synthetic Polynucleotide
taatacgactcactatagggcatccgcctctccttctccctttctatcttaacagaggagaaagataatgagggagaagaacctggcggcagcgcaaaagatg

SEQ ID NO: 216789 - DNA, 103 bp, Artificial Sequence
  Synthetic Polynucleotide
taatacgactcactatagggcattgttagccatccgcctctccttctcccaacagaggagagggagaatgagaggcggaaacctggcggcagcgcaaaagatg

SEQ ID NO: 216790 - DNA, 103 bp, Artificial Sequence
  Synthetic Polynucleotide
taatacgactcactatagggcgttctctggcattgttagccatccgcctcaacagaggagagaggcgatgggctaacaaaacctggcggcagcgcaaaagatg

SEQ ID NO: 216791 - DNA, 103 bp, Artificial Sequence
  Synthetic Polynucleotide
taatacgactcactatagggcacgcgtaagcgttctctggcattgttagcaacagaggagagctaacatggccagagaaaacctggcggcagcgcaaaagatg

SEQ ID NO: 216792 - DNA, 103 bp, Artificial Sequence
  Synthetic Polynucleotide
taatacgactcactatagggtaatatcccgcacgcgtaagcgttctctggaacagaggagaccagagatggcttacgcgaacctggcggcagcgcaaaagatg

SEQ ID NO: 216793 - DNA, 103 bp, Artificial Sequence
  Synthetic Polynucleotide
taatacgactcactatagggaatgcttcattaatatcccgcacgcgtaagaacagaggagacttacgatggcgggatataacctggcggcagcgcaaaagatg

SEQ ID NO: 216794 - DNA, 103 bp, Artificial Sequence
  Synthetic Polynucleotide
taatacgactcactatagggaagctctttgaatgcttcattaatatcccgaacagaggagacgggatatgaatgaagcaaacctggcggcagcgcaaaagatg

SEQ ID NO: 216795 - DNA, 103 bp, Artificial Sequence
  Synthetic Polynucleotide
taatacgactcactatagggacattcggccaagctctttgaatgcttcataacagaggagaatgaagatgtcaaagagcaacctggcggcagcgcaaaagatg

SEQ ID NO: 216796 - DNA, 103 bp, Artificial Sequence
  Synthetic Polynucleotide
taatacgactcactatagggcttggttgaccacttgttccccaagatgttaacagaggagaaacatcatggggaacaagaacctggcggcagcgcaaaagatg

SEQ ID NO: 216797 - DNA, 103 bp, Artificial Sequence
  Synthetic Polynucleotide
taatacgactcactatagggtgaagctgacacattcggccaagctctttgaacagaggagacaaagaatgtggccgaataacctggcggcagcgcaaaagatg

SEQ ID NO: 216798 - DNA, 103 bp, Artificial Sequence
  Synthetic Polynucleotide
taatacgactcactatagggactcttcaagtgaagctgacacattcggccaacagaggagaggccgaatgtgtcagcttaacctggcggcagcgcaaaagatg

SEQ ID NO: 216799 - DNA, 103 bp, Artificial Sequence
  Synthetic Polynucleotide
taatacgactcactatagggggggtttttcactcttcaagtgaagctgacaacagaggagagtcagcatgacttgaagaaacctggcggcagcgcaaaagatg

SEQ ID NO: 216800 - DNA, 103 bp, Artificial Sequence
  Synthetic Polynucleotide
taatacgactcactatagggagttttgtttggggtttttcactcttcaagaacagaggagacttgaaatgtgaaaaaccaacctggcggcagcgcaaaagatg

SEQ ID NO: 216801 - DNA, 103 bp, Artificial Sequence
  Synthetic Polynucleotide
taatacgactcactatagggaagaataaggagttttgtttggggtttttcaacagaggagagaaaaaatgcaaacaaaaaacctggcggcagcgcaaaagatg

SEQ ID NO: 216802 - DNA, 103 bp, Artificial Sequence
  Synthetic Polynucleotide
taatacgactcactatagggcggcttgatgaagaataaggagttttgtttaacagaggagaaaacaaatgtccttattcaacctggcggcagcgcaaaagatg

SEQ ID NO: 216803 - DNA, 103 bp, Artificial Sequence
  Synthetic Polynucleotide
taatacgactcactatagggatgactgccacggcttgatgaagaataaggaacagaggagaccttatatgtcatcaagcaacctggcggcagcgcaaaagatg

SEQ ID NO: 216804 - DNA, 103 bp, Artificial Sequence
  Synthetic Polynucleotide
taatacgactcactatagggtagactaaggatgactgccacggcttgatgaacagaggagacatcaaatggtggcagtcaacctggcggcagcgcaaaagatg

SEQ ID NO: 216805 - DNA, 103 bp, Artificial Sequence
  Synthetic Polynucleotide
taatacgactcactatagggcttgctgttctagactaaggatgactgccaaacagaggagatggcagatgtccttagtcaacctggcggcagcgcaaaagatg

SEQ ID NO: 216806 - DNA, 103 bp, Artificial Sequence
  Synthetic Polynucleotide
taatacgactcactatagggctctctctgacttgctgttctagactaaggaacagaggagaccttagatgagaacagcaaacctggcggcagcgcaaaagatg

SEQ ID NO: 216807 - DNA, 103 bp, Artificial Sequence
  Synthetic Polynucleotide
taatacgactcactatagggataggaaggacttggttgaccacttgttccaacagaggagaggaacaatgggtcaaccaaacctggcggcagcgcaaaagatg

SEQ ID NO: 216808 - DNA, 103 bp, Artificial Sequence
  Synthetic Polynucleotide
taatacgactcactataggggttaaggttcctctctctgacttgctgttcaacagaggagagaacagatggtcagagagaacctggcggcagcgcaaaagatg

SEQ ID NO: 216809 - DNA, 103 bp, Artificial Sequence
  Synthetic Polynucleotide
taatacgactcactatagggctgctttggggttaaggttcctctctctgaaacagaggagatcagagatgggaaccttaaacctggcggcagcgcaaaagatg

SEQ ID NO: 216810 - DNA, 103 bp, Artificial Sequence
  Synthetic Polynucleotide
taatacgactcactatagggttaaggcaggctgctttggggttaaggttcaacagaggagagaacctatgccccaaagcaacctggcggcagcgcaaaagatg

SEQ ID NO: 216811 - DNA, 103 bp, Artificial Sequence
  Synthetic Polynucleotide
taatacgactcactatagggttcccttctcttaaggcaggctgctttgggaacagaggagacccaaaatggcctgccttaacctggcggcagcgcaaaagatg

SEQ ID NO: 216812 - DNA, 103 bp, Artificial Sequence
  Synthetic Polynucleotide
taatacgactcactatagggctttttcttcttcccttctcttaaggcaggaacagaggagacctgccatgagagaagggaacctggcggcagcgcaaaagatg

SEQ ID NO: 216813 - DNA, 103 bp, Artificial Sequence
  Synthetic Polynucleotide
taatacgactcactatagggacggcagaaactttttcttcttcccttctcaacagaggagagagaagatgagaagaaaaaacctggcggcagcgcaaaagatg

SEQ ID NO: 216814 - DNA, 103 bp, Artificial Sequence
  Synthetic Polynucleotide
taatacgactcactatagggctctgccgatacggcagaaactttttcttcaacagaggagagaagaaatggtttctgccaacctggcggcagcgcaaaagatg

SEQ ID NO: 216815 - DNA, 103 bp, Artificial Sequence
  Synthetic Polynucleotide
taatacgactcactatagggtggttggcggctctgccgatacggcagaaaaacagaggagatttctgatgtatcggcagaacctggcggcagcgcaaaagatg

SEQ ID NO: 216816 - DNA, 103 bp, Artificial Sequence
  Synthetic Polynucleotide
taatacgactcactatagggcctggcagtgtggttggcggctctgccgataacagaggagaatcggcatggccgccaacaacctggcggcagcgcaaaagatg

SEQ ID NO: 216817 - DNA, 103 bp, Artificial Sequence
  Synthetic Polynucleotide
taatacgactcactatagggaggatgggttcctggcagtgtggttggcggaacagaggagaccgccaatgacactgccaaacctggcggcagcgcaaaagatg

SEQ ID NO: 216818 - DNA, 103 bp, Artificial Sequence
  Synthetic Polynucleotide
taatacgactcactatagggcggtccctatagcggccatgcgttgttgctaacagaggagaagcaacatggcatggccgaacctggcggcagcgcaaaagatg

SEQ ID NO: 216819 - DNA, 103 bp, Artificial Sequence
  Synthetic Polynucleotide
taatacgactcactatagggtagatgaatcataggaaggacttggttgacaacagaggagagtcaacatggtccttcctaacctggcggcagcgcaaaagatg

SEQ ID NO: 216820 - DNA, 103 bp, Artificial Sequence
  Synthetic Polynucleotide
taatacgactcactatagggcactaagcccaggatgggttcctggcagtgaacagaggagacactgcatggaacccatcaacctggcggcagcgcaaaagatg

SEQ ID NO: 216821 - DNA, 103 bp, Artificial Sequence
  Synthetic Polynucleotide
taatacgactcactatagggttggtagtttcactaagcccaggatgggttaacagaggagaaacccaatgtgggcttagaacctggcggcagcgcaaaagatg

SEQ ID NO: 216822 - DNA, 103 bp, Artificial Sequence
  Synthetic Polynucleotide
taatacgactcactatagggacccatagggttggtagtttcactaagcccaacagaggagagggcttatggaaactaccaacctggcggcagcgcaaaagatg

SEQ ID NO: 216823 - DNA, 103 bp, Artificial Sequence
  Synthetic Polynucleotide
taatacgactcactataggggtaaaacctctagatgaatcataggaaggaaacagaggagatccttcatgtgattcatcaacctggcggcagcgcaaaagatg

SEQ ID NO: 216824 - DNA, 103 bp, Artificial Sequence
  Synthetic Polynucleotide
taatacgactcactatagggagggctgtctgtaaaacctctagatgaatcaacagaggagagattcaatgagaggttttaacctggcggcagcgcaaaagatg

SEQ ID NO: 216825 - DNA, 103 bp, Artificial Sequence
  Synthetic Polynucleotide
taatacgactcactatagggcactgtaatgagggctgtctgtaaaacctcaacagaggagagaggttatgcagacagccaacctggcggcagcgcaaaagatg

SEQ ID NO: 216826 - DNA, 103 bp, Artificial Sequence
  Synthetic Polynucleotide
taatacgactcactatagggttcaagtgatcactgtaatgagggctgtctaacagaggagaagacagatgtcattacagaacctggcggcagcgcaaaagatg

SEQ ID NO: 216827 - DNA, 103 bp, Artificial Sequence
  Synthetic Polynucleotide
taatacgactcactatagggtcgactgtcattcaagtgatcactgtaatgaacagaggagacattacatggatcacttgaacctggcggcagcgcaaaagatg

SEQ ID NO: 216828 - DNA, 103 bp, Artificial Sequence
  Synthetic Polynucleotide
taatacgactcactataggggggctcctaatcgactgtcattcaagtgataacagaggagaatcactatgatgacagtcaacctggcggcagcgcaaaagatg

SEQ ID NO: 216829 - DNA, 103 bp, Artificial Sequence
  Synthetic Polynucleotide
taatacgactcactatagggaagccttcatgggctcctaatcgactgtcaaacagaggagatgacagatgattaggagcaacctggcggcagcgcaaaagatg

SEQ ID NO: 216830 - DNA, 103 bp, Artificial Sequence
  Synthetic Polynucleotide
taatacgactcactatagggtgttggggacaagccttcatgggctcctaaaacagaggagattaggaatgcatgaaggcaacctggcggcagcgcaaaagatg

SEQ ID NO: 216831 - DNA, 103 bp, Artificial Sequence
  Synthetic Polynucleotide
taatacgactcactatagggtcatgaaaggtgttggggacaagccttcataacagaggagaatgaagatgtgtccccaaaacctggcggcagcgcaaaagatg

SEQ ID NO: 216832 - DNA, 103 bp, Artificial Sequence
  Synthetic Polynucleotide
taatacgactcactatagggagctccttgtcggtccctatagcggccatgaacagaggagacatggcatgtatagggacaacctggcggcagcgcaaaagatg

SEQ ID NO: 216833 - DNA, 103 bp, Artificial Sequence
  Synthetic Polynucleotide
taatacgactcactatagggagatttgagttcatgaaaggtgttggggacaacagaggagagtccccatgacctttcataacctggcggcagcgcaaaagatg

SEQ ID NO: 216834 - DNA, 103 bp, Artificial Sequence
  Synthetic Polynucleotide
taatacgactcactatagggttttcccatcagatttgagttcatgaaaggaacagaggagacctttcatgaactcaaataacctggcggcagcgcaaaagatg

SEQ ID NO: 216835 - DNA, 103 bp, Artificial Sequence
  Synthetic Polynucleotide
taatacgactcactatagggtctctgatgtttttcccatcagatttgagtaacagaggagaactcaaatgtgatgggaaaacctggcggcagcgcaaaagatg

SEQ ID NO: 216836 - DNA, 103 bp, Artificial Sequence
  Synthetic Polynucleotide
taatacgactcactatagggaatgagcctctctctgatgtttttcccatcaacagaggagagatgggatgaacatcagaaacctggcggcagcgcaaaagatg

SEQ ID NO: 216837 - DNA, 103 bp, Artificial Sequence
  Synthetic Polynucleotide
taatacgactcactataggggtacagggaaaatgagcctctctctgatgtaacagaggagaacatcaatgagaggctcaaacctggcggcagcgcaaaagatg

SEQ ID NO: 216838 - DNA, 103 bp, Artificial Sequence
  Synthetic Polynucleotide
taatacgactcactatagggtatctctgctgtacagggaaaatgagcctcaacagaggagagaggctatgtttccctgtaacctggcggcagcgcaaaagatg

SEQ ID NO: 216839 - DNA, 103 bp, Artificial Sequence
  Synthetic Polynucleotide
taatacgactcactatagggggtaatccagtatctctgctgtacagggaaaacagaggagattccctatgcagcagagaaacctggcggcagcgcaaaagatg

SEQ ID NO: 216840 - DNA, 103 bp, Artificial Sequence
  Synthetic Polynucleotide
taatacgactcactatagggttgacagcctggtaatccagtatctctgctaacagaggagaagcagaatgactggattaaacctggcggcagcgcaaaagatg

SEQ ID NO: 216841 - DNA, 103 bp, Artificial Sequence
  Synthetic Polynucleotide
taatacgactcactatagggggagactagattgacagcctggtaatccagaacagaggagactggatatgcaggctgtcaacctggcggcagcgcaaaagatg

SEQ ID NO: 216842 - DNA, 103 bp, Artificial Sequence
  Synthetic Polynucleotide
taatacgactcactatagggtcttgtctcaggagactagattgacagcctaacagaggagaaggctgatgatctagtctaacctggcggcagcgcaaaagatg

SEQ ID NO: 216843 - DNA, 103 bp, Artificial Sequence
  Synthetic Polynucleotide
taatacgactcactatagggtaggtcgctcagctccttgtcggtccctataacagaggagaatagggatggacaaggagaacctggcggcagcgcaaaagatg

SEQ ID NO: 216844 - DNA, 103 bp, Artificial Sequence
  Synthetic Polynucleotide
taatacgactcactatagggaagccccagatcttgtctcaggagactagaaacagaggagatctagtatgctgagacaaaacctggcggcagcgcaaaagatg

SEQ ID NO: 216845 - DNA, 103 bp, Artificial Sequence
  Synthetic Polynucleotide
taatacgactcactatagggctgggctcccaagccccagatcttgtctcaaacagaggagatgagacatgatctggggcaacctggcggcagcgcaaaagatg

SEQ ID NO: 216846 - DNA, 103 bp, Artificial Sequence
  Synthetic Polynucleotide
taatacgactcactataggggatagctgtgctgggctcccaagccccagaaacagaggagatctgggatgtgggagcccaacctggcggcagcgcaaaagatg

SEQ ID NO: 216847 - DNA, 103 bp, Artificial Sequence
  Synthetic Polynucleotide
taatacgactcactatagggtcctgaagaagatagctgtgctgggctcccaacagaggagagggagcatggcacagctaaacctggcggcagcgcaaaagatg

SEQ ID NO: 216848 - DNA, 103 bp, Artificial Sequence
  Synthetic Polynucleotide
taatacgactcactatagggtcccaggttttcctgaagaagatagctgtgaacagaggagacacagcatgcttcttcagaacctggcggcagcgcaaaagatg

SEQ ID NO: 216849 - DNA, 103 bp, Artificial Sequence
  Synthetic Polynucleotide
taatacgactcactatagggtagtatgctgtcccaggttttcctgaagaaaacagaggagattcttcatgaaaacctggaacctggcggcagcgcaaaagatg

SEQ ID NO: 216850 - DNA, 103 bp, Artificial Sequence
  Synthetic Polynucleotide
taatacgactcactatagggagagaatgaatagtatgctgtcccaggtttaacagaggagaaaacctatgacagcatacaacctggcggcagcgcaaaagatg

SEQ ID NO: 216851 - DNA, 103 bp, Artificial Sequence
  Synthetic Polynucleotide
taatacgactcactatagggaacttgtagcagagaatgaatagtatgctgaacagaggagacagcatatgattcattctaacctggcggcagcgcaaaagatg

SEQ ID NO: 216852 - DNA, 103 bp, Artificial Sequence
  Synthetic Polynucleotide
taatacgactcactatagggctcctcctggaacttgtagcagagaatgaaaacagaggagattcattatgtgctacaagaacctggcggcagcgcaaaagatg

SEQ ID NO: 216853 - DNA, 103 bp, Artificial Sequence
  Synthetic Polynucleotide
taatacgactcactatagggatggagtggtctcctcctggaacttgtagcaacagaggagagctacaatgtccaggaggaacctggcggcagcgcaaaagatg

SEQ ID NO: 216854 - DNA, 103 bp, Artificial Sequence
  Synthetic Polynucleotide
taatacgactcactatagggtgaagtccagtaggtcgctcagctccttgtaacagaggagaacaaggatgtgagcgaccaacctggcggcagcgcaaaagatg

SEQ ID NO: 216855 - DNA, 103 bp, Artificial Sequence
  Synthetic Polynucleotide
taatacgactcactatagggctgcagagtcatggagtggtctcctcctggaacagaggagaccaggaatggaccactccaacctggcggcagcgcaaaagatg

SEQ ID NO: 216856 - DNA, 103 bp, Artificial Sequence
  Synthetic Polynucleotide
taatacgactcactatagggggatcaagcgctgcagagtcatggagtggtaacagaggagaaccactatgtgactctgcaacctggcggcagcgcaaaagatg

SEQ ID NO: 216857 - DNA, 103 bp, Artificial Sequence
  Synthetic Polynucleotide
taatacgactcactatagggtgcttgcaagggatcaagcgctgcagagtcaacagaggagagactctatggcgcttgataacctggcggcagcgcaaaagatg

SEQ ID NO: 216858 - DNA, 103 bp, Artificial Sequence
  Synthetic Polynucleotide
taatacgactcactatagggtgactttttttgcttgcaagggatcaagcgaacagaggagacgcttgatgccttgcaagaacctggcggcagcgcaaaagatg

SEQ ID NO: 216859 - DNA, 103 bp, Artificial Sequence
  Synthetic Polynucleotide
taatacgactcactatagggggcacctttctgactttttttgcttgcaagaacagaggagacttgcaatgaaaaaaagtaacctggcggcagcgcaaaagatg

SEQ ID NO: 216860 - DNA, 103 bp, Artificial Sequence
  Synthetic Polynucleotide
taatacgactcactatagggcaaaccaggaggcacctttctgacttttttaacagaggagaaaaaaaatgagaaaggtgaacctggcggcagcgcaaaagatg

SEQ ID NO: 216861 - DNA, 103 bp, Artificial Sequence
  Synthetic Polynucleotide
taatacgactcactatagggcagaagaaggcaaaccaggaggcacctttcaacagaggagagaaaggatgctcctggttaacctggcggcagcgcaaaagatg

SEQ ID NO: 216862 - DNA, 103 bp, Artificial Sequence
  Synthetic Polynucleotide
taatacgactcactatagggggtgcatatacagaagaaggcaaaccaggaaacagaggagatcctggatggccttcttcaacctggcggcagcgcaaaagatg

SEQ ID NO: 216863 - DNA, 103 bp, Artificial Sequence
  Synthetic Polynucleotide
taatacgactcactatagggatttggggatggtgcatatacagaagaaggaacagaggagaccttctatggtatatgcaaacctggcggcagcgcaaaagatg

SEQ ID NO: 216864 - DNA, 103 bp, Artificial Sequence
  Synthetic Polynucleotide
taatacgactcactatagggaatcatctgaatttggggatggtgcatataaacagaggagatatatgatgcatccccaaaacctggcggcagcgcaaaagatg

SEQ ID NO: 216865 - DNA, 103 bp, Artificial Sequence
  Synthetic Polynucleotide
taatacgactcactatagggaacatcgcactgaagtccagtaggtcgctcaacagaggagagagcgaatgactggacttaacctggcggcagcgcaaaagatg

SEQ ID NO: 216866 - DNA, 103 bp, Artificial Sequence
  Synthetic Polynucleotide
taatacgactcactatagggtcacggttgaaatcatctgaatttggggataacagaggagaatccccatgttcagatgaaacctggcggcagcgcaaaagatg

SEQ ID NO: 216867 - DNA, 103 bp, Artificial Sequence
  Synthetic Polynucleotide
taatacgactcactatagggactaggagattcacggttgaaatcatctgaaacagaggagatcagatatgttcaaccgtaacctggcggcagcgcaaaagatg

SEQ ID NO: 216868 - DNA, 103 bp, Artificial Sequence
  Synthetic Polynucleotide
taatacgactcactataggggagatggataactaggagattcacggttgaaacagaggagatcaaccatgaatctcctaaacctggcggcagcgcaaaagatg

SEQ ID NO: 216869 - DNA, 103 bp, Artificial Sequence
  Synthetic Polynucleotide
taatacgactcactatagggggtggcttaggagatggataactaggagataacagaggagaatctccatgttatccatcaacctggcggcagcgcaaaagatg

SEQ ID NO: 216870 - DNA, 103 bp, Artificial Sequence
  Synthetic Polynucleotide
taatacgactcactatagggcatactggttggtggcttaggagatggataaacagaggagatatccaatgcctaagccaaacctggcggcagcgcaaaagatg

SEQ ID NO: 216871 - DNA, 103 bp, Artificial Sequence
  Synthetic Polynucleotide
taatacgactcactatagggtgctagcgaacatactggttggtggcttagaacagaggagactaagcatgcaaccagtaaacctggcggcagcgcaaaagatg

SEQ ID NO: 216872 - DNA, 103 bp, Artificial Sequence
  Synthetic Polynucleotide
taatacgactcactatagggataaagaaagtgctagcgaacatactggttaacagaggagaaaccagatggttcgctagaacctggcggcagcgcaaaagatg

SEQ ID NO: 216873 - DNA, 103 bp, Artificial Sequence
  Synthetic Polynucleotide
taatacgactcactatagggcccatcttgcataaagaaagtgctagcgaaaacagaggagattcgctatgactttctttaacctggcggcagcgcaaaagatg

SEQ ID NO: 216874 - DNA, 103 bp, Artificial Sequence
  Synthetic Polynucleotide
taatacgactcactatagggaattgtgggtcccatcttgcataaagaaagaacagaggagactttctatgtgcaagatgaacctggcggcagcgcaaaagatg

SEQ ID NO: 216875 - DNA, 103 bp, Artificial Sequence
  Synthetic Polynucleotide
taatacgactcactatagggaggtcagaagaattgtgggtcccatcttgcaacagaggagagcaagaatggacccacaaaacctggcggcagcgcaaaagatg

SEQ ID NO: 216876 - DNA, 103 bp, Artificial Sequence
  Synthetic Polynucleotide
taatacgactcactatagggaggtggggaaaacatcgcactgaagtccagaacagaggagactggacatgagtgcgatgaacctggcggcagcgcaaaagatg

SEQ ID NO: 216877 - DNA, 103 bp, Artificial Sequence
  Synthetic Polynucleotide
taatacgactcactatagggtgaactccaaaggtcagaagaattgtgggtaacagaggagaacccacatgtcttctgacaacctggcggcagcgcaaaagatg

SEQ ID NO: 216878 - DNA, 103 bp, Artificial Sequence
  Synthetic Polynucleotide
taatacgactcactatagggtcccatttgatgaactccaaaggtcagaagaacagaggagacttctgatgtttggagttaacctggcggcagcgcaaaagatg

SEQ ID NO: 216879 - DNA, 103 bp, Artificial Sequence
  Synthetic Polynucleotide
taatacgactcactatagggggctggctcatcccatttgatgaactccaaaacagaggagattggagatgatcaaatggaacctggcggcagcgcaaaagatg

SEQ ID NO: 216880 - DNA, 103 bp, Artificial Sequence
  Synthetic Polynucleotide
taatacgactcactatagggaccaaaaccaggctggctcatcccatttgaaacagaggagatcaaatatgatgagccagaacctggcggcagcgcaaaagatg

SEQ ID NO: 216881 - DNA, 103 bp, Artificial Sequence
  Synthetic Polynucleotide
taatacgactcactatagggccagaattccaccaaaaccaggctggctcaaacagaggagatgagccatgctggttttgaacctggcggcagcgcaaaagatg

SEQ ID NO: 216882 - DNA, 103 bp, Artificial Sequence
  Synthetic Polynucleotide
taatacgactcactataggggtggaggtccccagaattccaccaaaaccaaacagaggagatggtttatgtggaattctaacctggcggcagcgcaaaagatg

SEQ ID NO: 216883 - DNA, 103 bp, Artificial Sequence
  Synthetic Polynucleotide
taatacgactcactatagggcatgtgggaagtggaggtccccagaattccaacagaggagaggaattatggggacctccaacctggcggcagcgcaaaagatg

SEQ ID NO: 216884 - DNA, 103 bp, Artificial Sequence
  Synthetic Polynucleotide
taatacgactcactatagggtggattgagacatgtgggaagtggaggtccaacagaggagaggacctatgcttcccacaaacctggcggcagcgcaaaagatg

SEQ ID NO: 216885 - DNA, 103 bp, Artificial Sequence
  Synthetic Polynucleotide
taatacgactcactatagggccataactactggattgagacatgtgggaaaacagaggagattcccaatggtctcaatcaacctggcggcagcgcaaaagatg

SEQ ID NO: 216886 - DNA, 103 bp, Artificial Sequence
  Synthetic Polynucleotide
taatacgactcactatagggatgaaggttgccataactactggattgagaaacagaggagatctcaaatgagtagttataacctggcggcagcgcaaaagatg

SEQ ID NO: 216887 - DNA, 103 bp, Artificial Sequence
  Synthetic Polynucleotide
taatacgactcactatagggcactattaacaggtggggaaaacatcgcacaacagaggagagtgcgaatgtttccccacaacctggcggcagcgcaaaagatg

SEQ ID NO: 216888 - DNA, 103 bp, Artificial Sequence
  Synthetic Polynucleotide
taatacgactcactatagggggtcatgtgaatgaaggttgccataactacaacagaggagagtagttatggcaaccttcaacctggcggcagcgcaaaagatg

SEQ ID NO: 216889 - DNA, 103 bp, Artificial Sequence
  Synthetic Polynucleotide
taatacgactcactatagggtaactcaagcggtcatgtgaatgaaggttgaacagaggagacaacctatgttcacatgaaacctggcggcagcgcaaaagatg

SEQ ID NO: 216890 - DNA, 103 bp, Artificial Sequence
  Synthetic Polynucleotide
taatacgactcactataggggtgtggaggataactcaagcggtcatgtgaaacagaggagatcacatatgcgcttgagtaacctggcggcagcgcaaaagatg

SEQ ID NO: 216891 - DNA, 103 bp, Artificial Sequence
  Synthetic Polynucleotide
taatacgactcactataggggtgaaactgagtgtggaggataactcaagcaacagaggagagcttgaatgatcctccacaacctggcggcagcgcaaaagatg

SEQ ID NO: 216892 - DNA, 103 bp, Artificial Sequence
  Synthetic Polynucleotide
taatacgactcactatagggatgtctgttggtgaaactgagtgtggaggaaacagaggagatcctccatgctcagtttcaacctggcggcagcgcaaaagatg

SEQ ID NO: 216893 - DNA, 103 bp, Artificial Sequence
  Synthetic Polynucleotide
taatacgactcactatagggactcgtgtttatgtctgttggtgaaactgaaacagaggagatcagttatgccaacagacaacctggcggcagcgcaaaagatg

SEQ ID NO: 216894 - DNA, 103 bp, Artificial Sequence
  Synthetic Polynucleotide
taatacgactcactatagggttggtggaagactcgtgtttatgtctgttgaacagaggagacaacagatgtaaacacgaaacctggcggcagcgcaaaagatg

SEQ ID NO: 216895 - DNA, 103 bp, Artificial Sequence
  Synthetic Polynucleotide
taatacgactcactatagggaagctggacattggtggaagactcgtgtttaacagaggagaaaacacatgtcttccaccaacctggcggcagcgcaaaagatg

SEQ ID NO: 216896 - DNA, 103 bp, Artificial Sequence
  Synthetic Polynucleotide
taatacgactcactataggggccgcgatgaaagctggacattggtggaagaacagaggagacttccaatgatgtccagcaacctggcggcagcgcaaaagatg

SEQ ID NO: 216897 - DNA, 103 bp, Artificial Sequence
  Synthetic Polynucleotide
taatacgactcactatagggtgctggtactgccgcgatgaaagctggacaaacagaggagatgtccaatgttcatcgcgaacctggcggcagcgcaaaagatg

SEQ ID NO: 216898 - DNA, 103 bp, Artificial Sequence
  Synthetic Polynucleotide
taatacgactcactatagggctagttttcccactattaacaggtggggaaaacagaggagattccccatgtgttaatagaacctggcggcagcgcaaaagatg

SEQ ID NO: 216899 - DNA, 103 bp, Artificial Sequence
  Synthetic Polynucleotide
taatacgactcactatagggtaaggtgaactgctggtactgccgcgatgaaacagaggagatcatcgatgcagtaccagaacctggcggcagcgcaaaagatg

SEQ ID NO: 216900 - DNA, 103 bp, Artificial Sequence
  Synthetic Polynucleotide
taatacgactcactatagggggcagcaacgtaaggtgaactgctggtactaacagaggagaagtaccatgagttcacctaacctggcggcagcgcaaaagatg

SEQ ID NO: 216901 - DNA, 103 bp, Artificial Sequence
  Synthetic Polynucleotide
taatacgactcactataggggagtgtgtgaggcagcaacgtaaggtgaacaacagaggagagttcacatgacgttgctgaacctggcggcagcgcaaaagatg

SEQ ID NO: 216902 - DNA, 103 bp, Artificial Sequence
  Synthetic Polynucleotide
taatacgactcactatagggttgatgggaggagtgtgtgaggcagcaacgaacagaggagacgttgcatgctcacacacaacctggcggcagcgcaaaagatg

SEQ ID NO: 216903 - DNA, 103 bp, Artificial Sequence
  Synthetic Polynucleotide
taatacgactcactataggggtctgatccattgatgggaggagtgtgtgaaacagaggagatcacacatgcctcccatcaacctggcggcagcgcaaaagatg

SEQ ID NO: 216904 - DNA, 103 bp, Artificial Sequence
  Synthetic Polynucleotide
taatacgactcactatagggctagaatgctgtctgatccattgatgggagaacagaggagactcccaatgatggatcagaacctggcggcagcgcaaaagatg

SEQ ID NO: 216905 - DNA, 103 bp, Artificial Sequence
  Synthetic Polynucleotide
taatacgactcactatagggcctctggttcctagaatgctgtctgatccaaacagaggagatggatcatgcagcattctaacctggcggcagcgcaaaagatg

SEQ ID NO: 216906 - DNA, 103 bp, Artificial Sequence
  Synthetic Polynucleotide
taatacgactcactatagggagcagcattccctctggttcctagaatgctaacagaggagaagcattatgggaaccagaaacctggcggcagcgcaaaagatg

SEQ ID NO: 216907 - DNA, 103 bp, Artificial Sequence
  Synthetic Polynucleotide
taatacgactcactataggggtgagcttccagcagcattccctctggttcaacagaggagagaaccaatgggaatgctgaacctggcggcagcgcaaaagatg

SEQ ID NO: 216908 - DNA, 103 bp, Artificial Sequence
  Synthetic Polynucleotide
taatacgactcactatagggtcacctgtctgtgagcttccagcagcattcaacagaggagagaatgcatgtggaagctcaacctggcggcagcgcaaaagatg

SEQ ID NO: 216909 - DNA, 103 bp, Artificial Sequence
  Synthetic Polynucleotide
taatacgactcactataggggccgacgggccgcagcagcgcgaacgccataacagaggagaatggcgatggcgctgctgaacctggcggcagcgcaaaagatg

SEQ ID NO: 216910 - DNA, 103 bp, Artificial Sequence
  Synthetic Polynucleotide
taatacgactcactataggggcagccgaacgactggtccgacgcgtcgctaacagaggagaagcgacatgtcggaccagaacctggcggcagcgcaaaagatg

SEQ ID NO: 216911 - DNA, 103 bp, Artificial Sequence
  Synthetic Polynucleotide
taatacgactcactatagggggccctcgcagcagccgaacgactggtccgaacagaggagacggaccatgcgttcggctaacctggcggcagcgcaaaagatg

SEQ ID NO: 216912 - DNA, 103 bp, Artificial Sequence
  Synthetic Polynucleotide
taatacgactcactataggggccgcctccgggccctcgcagcagccgaacaacagaggagagttcggatgctgcgagggaacctggcggcagcgcaaaagatg

SEQ ID NO: 216913 - DNA, 103 bp, Artificial Sequence
  Synthetic Polynucleotide
taatacgactcactataggggccgcgccgcgccgcctccgggccctcgcaaacagaggagatgcgagatgccggaggcgaacctggcggcagcgcaaaagatg

SEQ ID NO: 216914 - DNA, 103 bp, Artificial Sequence
  Synthetic Polynucleotide
taatacgactcactatagggcggggcccgggccgcgccgcgccgcctccgaacagaggagacggaggatgcgcggcgcgaacctggcggcagcgcaaaagatg

SEQ ID NO: 216915 - DNA, 103 bp, Artificial Sequence
  Synthetic Polynucleotide
taatacgactcactatagggcgcccgcccccggggcccgggccgcgccgcaacagaggagagcggcgatgcccgggcccaacctggcggcagcgcaaaagatg

SEQ ID NO: 216916 - DNA, 103 bp, Artificial Sequence
  Synthetic Polynucleotide
taatacgactcactataggggcccgcccgccgcccgcccccggggcccggaacagaggagaccgggcatggggggcgggaacctggcggcagcgcaaaagatg

SEQ ID NO: 216917 - DNA, 103 bp, Artificial Sequence
  Synthetic Polynucleotide
taatacgactcactatagggcgccgccgccgcccgcccgccgcccgccccaacagaggagaggggcgatgggcgggcggaacctggcggcagcgcaaaagatg

SEQ ID NO: 216918 - DNA, 103 bp, Artificial Sequence
  Synthetic Polynucleotide
taatacgactcactataggggggcccgcgccgccgccgccgcccgcccgcaacagaggagagcgggcatgcggcggcggaacctggcggcagcgcaaaagatg

SEQ ID NO: 216919 - DNA, 103 bp, Artificial Sequence
  Synthetic Polynucleotide
taatacgactcactatagggcaccaccacggggcccgcgccgccgccgccaacagaggagaggcggcatgggcgcgggcaacctggcggcagcgcaaaagatg

SEQ ID NO: 216920 - DNA, 103 bp, Artificial Sequence
  Synthetic Polynucleotide
taatacgactcactataggggcacgtgcgcgccgacgggccgcagcagcgaacagaggagacgctgcatgggcccgtcgaacctggcggcagcgcaaaagatg

SEQ ID NO: 216921 - DNA, 103 bp, Artificial Sequence
  Synthetic Polynucleotide
taatacgactcactataggggctgtcgcaccaccaccacggggcccgcgcaacagaggagagcgcggatgccgtggtggaacctggcggcagcgcaaaagatg

SEQ ID NO: 216922 - DNA, 103 bp, Artificial Sequence
  Synthetic Polynucleotide
taatacgactcactataggggccgcctgccgctgtcgcaccaccaccacgaacagaggagacgtggtatgggtgcgacaaacctggcggcagcgcaaaagatg

SEQ ID NO: 216923 - DNA, 103 bp, Artificial Sequence
  Synthetic Polynucleotide
taatacgactcactatagggccgcgcgttggccgcctgccgctgtcgcacaacagaggagagtgcgaatgcggcaggcgaacctggcggcagcgcaaaagatg

SEQ ID NO: 216924 - DNA, 103 bp, Artificial Sequence
  Synthetic Polynucleotide
taatacgactcactatagggggtcccgctcccgcgcgttggccgcctgccaacagaggagaggcaggatgccaacgcgcaacctggcggcagcgcaaaagatg

SEQ ID NO: 216925 - DNA, 103 bp, Artificial Sequence
  Synthetic Polynucleotide
taatacgactcactatagggctctgagtgcggtcccgctcccgcgcgttgaacagaggagacaacgcatgggagcgggaaacctggcggcagcgcaaaagatg

SEQ ID NO: 216926 - DNA, 103 bp, Artificial Sequence
  Synthetic Polynucleotide
taatacgactcactatagggcgtgttcacgctctgagtgcggtcccgctcaacagaggagagagcggatgcgcactcagaacctggcggcagcgcaaaagatg

SEQ ID NO: 216927 - DNA, 103 bp, Artificial Sequence
  Synthetic Polynucleotide
taatacgactcactatagggccgtgaaggccgtgttcacgctctgagtgcaacagaggagagcactcatggcgtgaacaaacctggcggcagcgcaaaagatg

SEQ ID NO: 216928 - DNA, 103 bp, Artificial Sequence
  Synthetic Polynucleotide
taatacgactcactataggggtgcgcagcgccgtgaaggccgtgttcacgaacagaggagacgtgaaatgggccttcacaacctggcggcagcgcaaaagatg

SEQ ID NO: 216929 - DNA, 103 bp, Artificial Sequence
  Synthetic Polynucleotide
taatacgactcactatagggggggatgagcgtgcgcagcgccgtgaaggcaacagaggagagccttcatggcgctgcgcaacctggcggcagcgcaaaagatg

SEQ ID NO: 216930 - DNA, 103 bp, Artificial Sequence
  Synthetic Polynucleotide
taatacgactcactatagggccggctcggtggggatgagcgtgcgcagcgaacagaggagacgctgcatgcgctcatccaacctggcggcagcgcaaaagatg

SEQ ID NO: 216931 - DNA, 103 bp, Artificial Sequence
  Synthetic Polynucleotide
taatacgactcactatagggtccgggtacagcacgtgcgcgccgacgggcaacagaggagagcccgtatgcgcgcacgtaacctggcggcagcgcaaaagatg

SEQ ID NO: 216932 - DNA, 103 bp, Artificial Sequence
  Synthetic Polynucleotide
taatacgactcactatagggttgcggtccaccggctcggtggggatgagcaacagaggagagctcatatgcaccgagccaacctggcggcagcgcaaaagatg

SEQ ID NO: 216933 - DNA, 103 bp, Artificial Sequence
  Synthetic Polynucleotide
taatacgactcactatagggcttggacagcttgcggtccaccggctcggtaacagaggagaaccgagatggtggaccgcaacctggcggcagcgcaaaagatg

SEQ ID NO: 216934 - DNA, 103 bp, Artificial Sequence
  Synthetic Polynucleotide
taatacgactcactatagggcggtctcgatcttggacagcttgcggtccaaacagaggagatggaccatgagctgtccaaacctggcggcagcgcaaaagatg

SEQ ID NO: 216935 - DNA, 103 bp, Artificial Sequence
  Synthetic Polynucleotide
taatacgactcactataggggccaggcgcacggtctcgatcttggacagcaacagaggagagctgtcatggatcgagacaacctggcggcagcgcaaaagatg

SEQ ID NO: 216936 - DNA, 103 bp, Artificial Sequence
  Synthetic Polynucleotide
taatacgactcactataggggtagctggacgccaggcgcacggtctcgataacagaggagaatcgagatggtgcgcctgaacctggcggcagcgcaaaagatg

SEQ ID NO: 216937 - DNA, 103 bp, Artificial Sequence
  Synthetic Polynucleotide
taatacgactcactatagggggtgcgcgatgtagctggacgccaggcgcaaacagaggagatgcgccatgcgtccagctaacctggcggcagcgcaaaagatg

SEQ ID NO: 216938 - DNA, 103 bp, Artificial Sequence
  Synthetic Polynucleotide
taatacgactcactatagggacgttggccaggtgcgcgatgtagctggacaacagaggagagtccagatgcatcgcgcaaacctggcggcagcgcaaaagatg

SEQ ID NO: 216939 - DNA, 103 bp, Artificial Sequence
  Synthetic Polynucleotide
taatacgactcactatagggcagcagcagcacgttggccaggtgcgcgataacagaggagaatcgcgatgctggccaacaacctggcggcagcgcaaaagatg

SEQ ID NO: 216940 - DNA, 103 bp, Artificial Sequence
  Synthetic Polynucleotide
taatacgactcactatagggccgagtcgcccagcagcagcacgttggccaaacagaggagatggccaatgtgctgctgcaacctggcggcagcgcaaaagatg

SEQ ID NO: 216941 - DNA, 103 bp, Artificial Sequence
  Synthetic Polynucleotide
taatacgactcactatagggccgtcgtcggccgagtcgcccagcagcagcaacagaggagagctgctatggggcgactcaacctggcggcagcgcaaaagatg

SEQ ID NO: 216942 - DNA, 103 bp, Artificial Sequence
  Synthetic Polynucleotide
taatacgactcactatagggcagccgcacgtccgggtacagcacgtgcgcaacagaggagagcgcacatgctgtacccgaacctggcggcagcgcaaaagatg

SEQ ID NO: 216943 - DNA, 103 bp, Artificial Sequence
  Synthetic Polynucleotide
taatacgactcactataggggcacggctgcccgtcgtcggccgagtcgccaacagaggagaggcgacatggccgacgacaacctggcggcagcgcaaaagatg

SEQ ID NO: 216944 - DNA, 103 bp, Artificial Sequence
  Synthetic Polynucleotide
taatacgactcactatagggcggcacggaagcacggctgcccgtcgtcggaacagaggagaccgacgatgggcagccgtaacctggcggcagcgcaaaagatg

SEQ ID NO: 216945 - DNA, 103 bp, Artificial Sequence
  Synthetic Polynucleotide
taatacgactcactataggggcactgcccgcggcacggaagcacggctgcaacagaggagagcagccatgcttccgtgcaacctggcggcagcgcaaaagatg

SEQ ID NO: 216946 - DNA, 103 bp, Artificial Sequence
  Synthetic Polynucleotide
taatacgactcactatagggggcgcccttggcactgcccgcggcacggaaaacagaggagattccgtatggcgggcagtaacctggcggcagcgcaaaagatg

SEQ ID NO: 216947 - DNA, 103 bp, Artificial Sequence
  Synthetic Polynucleotide
taatacgactcactatagggcggcggggacggcgcccttggcactgcccgaacagaggagacgggcaatgccaagggcgaacctggcggcagcgcaaaagatg

SEQ ID NO: 216948 - DNA, 103 bp, Artificial Sequence
  Synthetic Polynucleotide
taatacgactcactatagggccgtcggcggcggcggggacggcgcccttgaacagaggagacaagggatgcgtccccgcaacctggcggcagcgcaaaagatg

SEQ ID NO: 216949 - DNA, 103 bp, Artificial Sequence
  Synthetic Polynucleotide
taatacgactcactatagggctggcggccgccgtcggcggcggcggggacaacagaggagagtccccatggccgccgacaacctggcggcagcgcaaaagatg

SEQ ID NO: 216950 - DNA, 103 bp, Artificial Sequence
  Synthetic Polynucleotide
taatacgactcactatagggtggagcgcggctggcggccgccgtcggcggaacagaggagaccgccgatggcggccgccaacctggcggcagcgcaaaagatg

SEQ ID NO: 216951 - DNA, 103 bp, Artificial Sequence
  Synthetic Polynucleotide
taatacgactcactatagggaaggtgcagatggagcgcggctggcggccgaacagaggagacggccgatggccgcgctcaacctggcggcagcgcaaaagatg

SEQ ID NO: 216952 - DNA, 103 bp, Artificial Sequence
  Synthetic Polynucleotide
taatacgactcactataggggctgaggcagaaggtgcagatggagcgcggaacagaggagaccgcgcatgatctgcaccaacctggcggcagcgcaaaagatg

SEQ ID NO: 216953 - DNA, 103 bp, Artificial Sequence
  Synthetic Polynucleotide
taatacgactcactatagggcctcgctcagcagccgcacgtccgggtacaaacagaggagatgtaccatgacgtgcggcaacctggcggcagcgcaaaagatg

SEQ ID NO: 216954 - DNA, 103 bp, Artificial Sequence
  Synthetic Polynucleotide
taatacgactcactatagggtgcgctggttgctgaggcagaaggtgcagaaacagaggagatctgcaatgtctgcctcaaacctggcggcagcgcaaaagatg

SEQ ID NO: 216955 - DNA, 103 bp, Artificial Sequence
  Synthetic Polynucleotide
taatacgactcactatagggccaccccccttgcgctggttgctgaggcagaacagaggagactgcctatgcaaccagcgaacctggcggcagcgcaaaagatg

SEQ ID NO: 216956 - DNA, 103 bp, Artificial Sequence
  Synthetic Polynucleotide
taatacgactcactataggggtcacgacggccaccccccttgcgctggttaacagaggagaaaccagatgaaggggggtaacctggcggcagcgcaaaagatg

SEQ ID NO: 216957 - DNA, 103 bp, Artificial Sequence
  Synthetic Polynucleotide
taatacgactcactatagggtgccccccaggtcacgacggccacccccctaacagaggagaagggggatggccgtcgtgaacctggcggcagcgcaaaagatg

SEQ ID NO: 216958 - DNA, 103 bp, Artificial Sequence
  Synthetic Polynucleotide
taatacgactcactatagggttcaagcagctgccccccaggtcacgacggaacagaggagaccgtcgatgcctggggggaacctggcggcagcgcaaaagatg

SEQ ID NO: 216959 - DNA, 103 bp, Artificial Sequence
  Synthetic Polynucleotide
taatacgactcactatagggccccctcaccttcaagcagctgccccccagaacagaggagactggggatgagctgcttgaacctggcggcagcgcaaaagatg

SEQ ID NO: 216960 - DNA, 103 bp, Artificial Sequence
  Synthetic Polynucleotide
taatacgactcactatagggggggggccacccccctcaccttcaagcagcaacagaggagagctgctatgaggtgagggaacctggcggcagcgcaaaagatg

SEQ ID NO: 216961 - DNA, 103 bp, Artificial Sequence
  Synthetic Polynucleotide
taatacgactcactatagggggccctcgaaggggggccacccccctcaccaacagaggagaggtgagatgggtggccccaacctggcggcagcgcaaaagatg

SEQ ID NO: 216962 - DNA, 103 bp, Artificial Sequence
  Synthetic Polynucleotide
taatacgactcactatagggtcatctccgtggccctcgaaggggggccacaacagaggagagtggccatgcttcgagggaacctggcggcagcgcaaaagatg

SEQ ID NO: 216963 - DNA, 103 bp, Artificial Sequence
  Synthetic Polynucleotide
taatacgactcactatagggttctcctcgtcctcgctcagcagccgcacgaacagaggagacgtgcgatggctgagcgaaacctggcggcagcgcaaaagatg

SEQ ID NO: 216964 - DNA, 103 bp, Artificial Sequence
  Synthetic Polynucleotide
taatacgactcactatagggctcgctgcggttctcctcgtcctcgctcagaacagaggagactgagcatggacgaggagaacctggcggcagcgcaaaagatg

SEQ ID NO: 216965 - DNA, 103 bp, Artificial Sequence
  Synthetic Polynucleotide
taatacgactcactatagggacgcgtcgctctcgctgcggttctcctcgtaacagaggagaacgaggatgaccgcagcgaacctggcggcagcgcaaaagatg

SEQ ID NO: 216966 - DNA, 103 bp, Artificial Sequence
  Synthetic Polynucleotide
taatacgactcactataggggactggtccgacgcgtcgctctcgctgcggaacagaggagaccgcagatggagcgacgcaacctggcggcagcgcaaaagatg

SEQ ID NO: 216967 - DNA, 103 bp, Artificial Sequence
  Synthetic Polynucleotide
taatacgactcactataggggtaactgctttgctcccgaaaggactgcataacagaggagaatgcagatgtttcgggagaacctggcggcagcgcaaaagatg

SEQ ID NO: 216968 - DNA, 103 bp, Artificial Sequence
  Synthetic Polynucleotide
taatacgactcactatagggattctggaacatctgggcctgacgagggctaacagaggagaagccctatgcaggcccagaacctggcggcagcgcaaaagatg

SEQ ID NO: 216969 - DNA, 103 bp, Artificial Sequence
  Synthetic Polynucleotide
taatacgactcactatagggcaggggcagcttggtggcagcgttagtataaacagaggagatatactatggctgccaccaacctggcggcagcgcaaaagatg

SEQ ID NO: 216970 - DNA, 103 bp, Artificial Sequence
  Synthetic Polynucleotide
taatacgactcactatagggcttggctttgcaggggcagcttggtggcagaacagaggagactgccaatgagctgccccaacctggcggcagcgcaaaagatg

SEQ ID NO: 216971 - DNA, 103 bp, Artificial Sequence
  Synthetic Polynucleotide
taatacgactcactatagggtactgccccacttggctttgcaggggcagcaacagaggagagctgccatggcaaagccaaacctggcggcagcgcaaaagatg

SEQ ID NO: 216972 - DNA, 103 bp, Artificial Sequence
  Synthetic Polynucleotide
taatacgactcactatagggaggctggttgtactgccccacttggctttgaacagaggagacaaagcatggtggggcagaacctggcggcagcgcaaaagatg

SEQ ID NO: 216973 - DNA, 103 bp, Artificial Sequence
  Synthetic Polynucleotide
taatacgactcactatagggcaggaacctcaggctggttgtactgccccaaacagaggagatggggcatgacaaccagcaacctggcggcagcgcaaaagatg

SEQ ID NO: 216974 - DNA, 103 bp, Artificial Sequence
  Synthetic Polynucleotide
taatacgactcactatagggggggacctcacaggaacctcaggctggttgaacagaggagacaaccaatgtgaggttccaacctggcggcagcgcaaaagatg

SEQ ID NO: 216975 - DNA, 103 bp, Artificial Sequence
  Synthetic Polynucleotide
taatacgactcactatagggaaactgcatgggggacctcacaggaacctcaacagaggagagaggttatggtgaggtccaacctggcggcagcgcaaaagatg

SEQ ID NO: 216976 - DNA, 103 bp, Artificial Sequence
  Synthetic Polynucleotide
taatacgactcactatagggagttctggtgaaactgcatgggggacctcaaacagaggagatgaggtatgccatgcagtaacctggcggcagcgcaaaagatg

SEQ ID NO: 216977 - DNA, 103 bp, Artificial Sequence
  Synthetic Polynucleotide
taatacgactcactatagggatggggctgaagttctggtgaaactgcatgaacagaggagacatgcaatgtcaccagaaaacctggcggcagcgcaaaagatg

SEQ ID NO: 216978 - DNA, 103 bp, Artificial Sequence
  Synthetic Polynucleotide
taatacgactcactatagggagggttagaaatggggctgaagttctggtgaacagaggagacaccagatgttcagccccaacctggcggcagcgcaaaagatg

SEQ ID NO: 216979 - DNA, 103 bp, Artificial Sequence
  Synthetic Polynucleotide
taatacgactcactatagggtacctccaaaattctggaacatctgggcctaacagaggagaaggcccatgtgttccagaaacctggcggcagcgcaaaagatg

SEQ ID NO: 216980 - DNA, 103 bp, Artificial Sequence
  Synthetic Polynucleotide
taatacgactcactatagggcagctggagaagggttagaaatggggctgaaacagaggagatcagccatgtttctaaccaacctggcggcagcgcaaaagatg

SEQ ID NO: 216981 - DNA, 103 bp, Artificial Sequence
  Synthetic Polynucleotide
taatacgactcactatagggaccacagaggcagctggagaagggttagaaaacagaggagattctaaatgttctccagcaacctggcggcagcgcaaaagatg

SEQ ID NO: 216982 - DNA, 103 bp, Artificial Sequence
  Synthetic Polynucleotide
taatacgactcactatagggtggagactgaaccacagaggcagctggagaaacagaggagatctccaatggcctctgtgaacctggcggcagcgcaaaagatg

SEQ ID NO: 216983 - DNA, 103 bp, Artificial Sequence
  Synthetic Polynucleotide
taatacgactcactatagggaactacagcttggagactgaaccacagaggaacagaggagacctctgatgttcagtctcaacctggcggcagcgcaaaagatg

SEQ ID NO: 216984 - DNA, 103 bp, Artificial Sequence
  Synthetic Polynucleotide
taatacgactcactataggggatggggtagaactacagcttggagactgaaacagaggagatcagtcatgaagctgtagaacctggcggcagcgcaaaagatg

SEQ ID NO: 216985 - DNA, 103 bp, Artificial Sequence
  Synthetic Polynucleotide
taatacgactcactatagggcatgagaggagatggggtagaactacagctaacagaggagaagctgtatgtctaccccaaacctggcggcagcgcaaaagatg

SEQ ID NO: 216986 - DNA, 103 bp, Artificial Sequence
  Synthetic Polynucleotide
taatacgactcactatagggccccagtctgcatgagaggagatggggtagaacagaggagactacccatgctcctctcaaacctggcggcagcgcaaaagatg

SEQ ID NO: 216987 - DNA, 103 bp, Artificial Sequence
  Synthetic Polynucleotide
taatacgactcactatagggtggagattctccccagtctgcatgagaggaaacagaggagatcctctatggcagactggaacctggcggcagcgcaaaagatg

SEQ ID NO: 216988 - DNA, 103 bp, Artificial Sequence
  Synthetic Polynucleotide
taatacgactcactatagggttgcccacactggagattctccccagtctgaacagaggagacagactatggagaatctcaacctggcggcagcgcaaaagatg

SEQ ID NO: 216989 - DNA, 103 bp, Artificial Sequence
  Synthetic Polynucleotide
taatacgactcactataggggcacactgccttgcccacactggagattctaacagaggagaagaatcatgagtgtgggcaacctggcggcagcgcaaaagatg

SEQ ID NO: 216990 - DNA, 103 bp, Artificial Sequence
  Synthetic Polynucleotide
taatacgactcactatagggctgccacctgtacctccaaaattctggaacaacagaggagagttccaatgttttggaggaacctggcggcagcgcaaaagatg

SEQ ID NO: 216991 - DNA, 103 bp, Artificial Sequence
  Synthetic Polynucleotide
taatacgactcactataggggaacccataggcacactgccttgcccacacaacagaggagagtgtggatgaggcagtgtaacctggcggcagcgcaaaagatg

SEQ ID NO: 216992 - DNA, 103 bp, Artificial Sequence
  Synthetic Polynucleotide
taatacgactcactatagggtctgtttctggaacccataggcacactgccaacagaggagaggcagtatgcctatgggtaacctggcggcagcgcaaaagatg

SEQ ID NO: 216993 - DNA, 103 bp, Artificial Sequence
  Synthetic Polynucleotide
taatacgactcactatagggactgtaaaattctgtttctggaacccatagaacagaggagactatggatgccagaaacaaacctggcggcagcgcaaaagatg

SEQ ID NO: 216994 - DNA, 103 bp, Artificial Sequence
  Synthetic Polynucleotide
taatacgactcactatagggtgaggcattaactgtaaaattctgtttctgaacagaggagacagaaaatgaattttacaaacctggcggcagcgcaaaagatg

SEQ ID NO: 216995 - DNA, 103 bp, Artificial Sequence
  Synthetic Polynucleotide
taatacgactcactatagggtggactgagttgaggcattaactgtaaaataacagaggagaattttaatgttaatgcctaacctggcggcagcgcaaaagatg

SEQ ID NO: 216996 - DNA, 103 bp, Artificial Sequence
  Synthetic Polynucleotide
taatacgactcactatagggttgatggggttggactgagttgaggcattaaacagaggagataatgcatgaactcagtcaacctggcggcagcgcaaaagatg

SEQ ID NO: 216997 - DNA, 103 bp, Artificial Sequence
  Synthetic Polynucleotide
taatacgactcactatagggctgggcatcattgatggggttggactgagtaacagaggagaactcagatgaaccccatcaacctggcggcagcgcaaaagatg

SEQ ID NO: 216998 - DNA, 103 bp, Artificial Sequence
  Synthetic Polynucleotide
taatacgactcactatagggagaattaggactgggcatcattgatggggtaacagaggagaaccccaatgatgatgcccaacctggcggcagcgcaaaagatg

SEQ ID NO: 216999 - DNA, 103 bp, Artificial Sequence
  Synthetic Polynucleotide
taatacgactcactatagggctgcagcatgagaattaggactgggcatcaaacagaggagatgatgcatggtcctaattaacctggcggcagcgcaaaagatg

SEQ ID NO: 217000 - DNA, 103 bp, Artificial Sequence
  Synthetic Polynucleotide
taatacgactcactatagggcctttgaagcctgcagcatgagaattaggaaacagaggagatcctaaatgtcatgctgcaacctggcggcagcgcaaaagatg

SEQ ID NO: 217001 - DNA, 103 bp, Artificial Sequence
  Synthetic Polynucleotide
taatacgactcactataggggctgccactactgccacctgtacctccaaaaacagaggagatttggaatgacaggtggcaacctggcggcagcgcaaaagatg

SEQ ID NO: 217002 - DNA, 103 bp, Artificial Sequence
  Synthetic Polynucleotide
taatacgactcactatagggtagtccaaaccctttgaagcctgcagcatgaacagaggagacatgctatgggcttcaaaaacctggcggcagcgcaaaagatg

SEQ ID NO: 217003 - DNA, 103 bp, Artificial Sequence
  Synthetic Polynucleotide
taatacgactcactataggggtaccccttctagtccaaaccctttgaagcaacagaggagagcttcaatgggtttggacaacctggcggcagcgcaaaagatg

SEQ ID NO: 217004 - DNA, 103 bp, Artificial Sequence
  Synthetic Polynucleotide
taatacgactcactatagggcgcttttctggtaccccttctagtccaaacaacagaggagagtttggatgagaaggggtaacctggcggcagcgcaaaagatg

SEQ ID NO: 217005 - DNA, 103 bp, Artificial Sequence
  Synthetic Polynucleotide
taatacgactcactatagggatctgtcagtcgcttttctggtaccccttcaacagaggagagaagggatgccagaaaagaacctggcggcagcgcaaaagatg

SEQ ID NO: 217006 - DNA, 103 bp, Artificial Sequence
  Synthetic Polynucleotide
taatacgactcactatagggtcaacccaggatctgtcagtcgcttttctgaacagaggagacagaaaatggactgacagaacctggcggcagcgcaaaagatg

SEQ ID NO: 217007 - DNA, 103 bp, Artificial Sequence
  Synthetic Polynucleotide
taatacgactcactatagggctcaaactactcaacccaggatctgtcagtaacagaggagaactgacatgtcctgggttaacctggcggcagcgcaaaagatg

SEQ ID NO: 217008 - DNA, 103 bp, Artificial Sequence
  Synthetic Polynucleotide
taatacgactcactatagggactcagagcactcaaactactcaacccaggaacagaggagacctgggatgagtagtttgaacctggcggcagcgcaaaagatg

SEQ ID NO: 217009 - DNA, 103 bp, Artificial Sequence
  Synthetic Polynucleotide
taatacgactcactatagggccacttgagtactcagagcactcaaactacaacagaggagagtagttatggtgctctgaaacctggcggcagcgcaaaagatg

SEQ ID NO: 217010 - DNA, 103 bp, Artificial Sequence
  Synthetic Polynucleotide
taatacgactcactatagggggaagattggccacttgagtactcagagcaaacagaggagatgctctatgtactcaagtaacctggcggcagcgcaaaagatg

SEQ ID NO: 217011 - DNA, 103 bp, Artificial Sequence
  Synthetic Polynucleotide
taatacgactcactataggggacagtgttaggaagattggccacttgagtaacagaggagaactcaaatggccaatcttaacctggcggcagcgcaaaagatg

SEQ ID NO: 217012 - DNA, 103 bp, Artificial Sequence
  Synthetic Polynucleotide
taatacgactcactatagggcactgccactgctgccactactgccacctgaacagaggagacaggtgatggtagtggcaaacctggcggcagcgcaaaagatg

SEQ ID NO: 217013 - DNA, 103 bp, Artificial Sequence
  Synthetic Polynucleotide
taatacgactcactatagggacatgtgctggacagtgttaggaagattggaacagaggagaccaatcatgctaacactgaacctggcggcagcgcaaaagatg

SEQ ID NO: 217014 - DNA, 103 bp, Artificial Sequence
  Synthetic Polynucleotide
taatacgactcactatagggtcagaaagtaacatgtgctggacagtgttaaacagaggagataacacatgccagcacataacctggcggcagcgcaaaagatg

SEQ ID NO: 217015 - DNA, 103 bp, Artificial Sequence
  Synthetic Polynucleotide
taatacgactcactatagggagtcagggcatcagaaagtaacatgtgctgaacagaggagacagcacatgttactttctaacctggcggcagcgcaaaagatg

SEQ ID NO: 217016 - DNA, 103 bp, Artificial Sequence
  Synthetic Polynucleotide
taatacgactcactatagggtcttctgaggagtcagggcatcagaaagtaaacagaggagatactttatgatgccctgaaacctggcggcagcgcaaaagatg

SEQ ID NO: 217017 - DNA, 103 bp, Artificial Sequence
  Synthetic Polynucleotide
taatacgactcactatagggttggaggtcttcttctgaggagtcagggcaaacagaggagatgccctatgtcctcagaaaacctggcggcagcgcaaaagatg

SEQ ID NO: 217018 - DNA, 103 bp, Artificial Sequence
  Synthetic Polynucleotide
taatacgactcactatagggtgagggcctcttggaggtcttcttctgaggaacagaggagacctcagatgaagacctccaacctggcggcagcgcaaaagatg

SEQ ID NO: 217019 - DNA, 103 bp, Artificial Sequence
  Synthetic Polynucleotide
taatacgactcactatagggtcttggaagatgagggcctcttggaggtctaacagaggagaagacctatgagaggccctaacctggcggcagcgcaaaagatg

SEQ ID NO: 217020 - DNA, 103 bp, Artificial Sequence
  Synthetic Polynucleotide
taatacgactcactatagggctatctgctttcttggaagatgagggcctcaacagaggagagaggccatgatcttccaaaacctggcggcagcgcaaaagatg

SEQ ID NO: 217021 - DNA, 103 bp, Artificial Sequence
  Synthetic Polynucleotide
taatacgactcactatagggatttgtgcagctatctgctttcttggaagaaacagaggagatcttccatgaaagcagataacctggcggcagcgcaaaagatg

SEQ ID NO: 217022 - DNA, 103 bp, Artificial Sequence
  Synthetic Polynucleotide
taatacgactcactatagggagccttcagaatttgtgcagctatctgcttaacagaggagaaagcagatggctgcacaaaacctggcggcagcgcaaaagatg

SEQ ID NO: 217023 - DNA, 103 bp, Artificial Sequence
  Synthetic Polynucleotide
taatacgactcactatagggccaccactgccactgccactgctgccactaaacagaggagatagtggatgcagtggcagaacctggcggcagcgcaaaagatg

SEQ ID NO: 217024 - DNA, 103 bp, Artificial Sequence
  Synthetic Polynucleotide
taatacgactcactatagggggttgtgaggagccttcagaatttgtgcagaacagaggagactgcacatgttctgaaggaacctggcggcagcgcaaaagatg

SEQ ID NO: 217025 - DNA, 103 bp, Artificial Sequence
  Synthetic Polynucleotide
taatacgactcactatagggctgttcttcaggttgtgaggagccttcagaaacagaggagatctgaaatgtcctcacaaaacctggcggcagcgcaaaagatg

SEQ ID NO: 217026 - DNA, 103 bp, Artificial Sequence
  Synthetic Polynucleotide
taatacgactcactataggggggacttcagctgttcttcaggttgtgaggaacagaggagacctcacatgctgaagaacaacctggcggcagcgcaaaagatg

SEQ ID NO: 217027 - DNA, 103 bp, Artificial Sequence
  Synthetic Polynucleotide
taatacgactcactatagggtctgccataggggacttcagctgttcttcaaacagaggagatgaagaatggctgaagtcaacctggcggcagcgcaaaagatg

SEQ ID NO: 217028 - DNA, 103 bp, Artificial Sequence
  Synthetic Polynucleotide
taatacgactcactatagggatctaatgactctgccataggggacttcagaacagaggagactgaagatgcctatggcaaacctggcggcagcgcaaaagatg

SEQ ID NO: 217029 - DNA, 103 bp, Artificial Sequence
  Synthetic Polynucleotide
taatacgactcactatagggagcagcctccatctaatgactctgccatagaacagaggagactatggatgagtcattagaacctggcggcagcgcaaaagatg

SEQ ID NO: 217030 - DNA, 103 bp, Artificial Sequence
  Synthetic Polynucleotide
taatacgactcactataggggaactgctggagcagcctccatctaatgacaacagaggagagtcattatgtggaggctgaacctggcggcagcgcaaaagatg

SEQ ID NO: 217031 - DNA, 103 bp, Artificial Sequence
  Synthetic Polynucleotide
taatacgactcactatagggttgatcctctgaactgctggagcagcctccaacagaggagaggaggcatgtccagcagtaacctggcggcagcgcaaaagatg

SEQ ID NO: 217032 - DNA, 103 bp, Artificial Sequence
  Synthetic Polynucleotide
taatacgactcactatagggctctctcgccttgatcctctgaactgctggaacagaggagaccagcaatgcagaggatcaacctggcggcagcgcaaaagatg

SEQ ID NO: 217033 - DNA, 103 bp, Artificial Sequence
  Synthetic Polynucleotide
taatacgactcactatagggagttgccgcactctctcgccttgatcctctaacagaggagaagaggaatgaggcgagagaacctggcggcagcgcaaaagatg

SEQ ID NO: 217034 - DNA, 103 bp, Artificial Sequence
  Synthetic Polynucleotide
taatacgactcactatagggtcgtcgtccaccaccactgccactgccactaacagaggagaagtggcatgggcagtggtaacctggcggcagcgcaaaagatg

SEQ ID NO: 217035 - DNA, 103 bp, Artificial Sequence
  Synthetic Polynucleotide
taatacgactcactatagggctggccacttagttgccgcactctctcgccaacagaggagaggcgagatggtgcggcaaaacctggcggcagcgcaaaagatg

SEQ ID NO: 217036 - DNA, 103 bp, Artificial Sequence
  Synthetic Polynucleotide
taatacgactcactatagggagctggtgctctggccacttagttgccgcaaacagaggagatgcggcatgtaagtggccaacctggcggcagcgcaaaagatg

SEQ ID NO: 217037 - DNA, 103 bp, Artificial Sequence
  Synthetic Polynucleotide
taatacgactcactataggggtggtgtcagagctggtgctctggccacttaacagaggagaaagtggatggagcaccagaacctggcggcagcgcaaaagatg

SEQ ID NO: 217038 - DNA, 103 bp, Artificial Sequence
  Synthetic Polynucleotide
taatacgactcactatagggacccttgtaggtggtgtcagagctggtgctaacagaggagaagcaccatgtctgacaccaacctggcggcagcgcaaaagatg

SEQ ID NO: 217039 - DNA, 103 bp, Artificial Sequence
  Synthetic Polynucleotide
taatacgactcactatagggcagaggctccacccttgtaggtggtgtcagaacagaggagactgacaatgcctacaaggaacctggcggcagcgcaaaagatg

SEQ ID NO: 217040 - DNA, 103 bp, Artificial Sequence
  Synthetic Polynucleotide
taatacgactcactatagggccagctttctcagaggctccacccttgtagaacagaggagactacaaatgtggagcctcaacctggcggcagcgcaaaagatg

SEQ ID NO: 217041 - DNA, 103 bp, Artificial Sequence
  Synthetic Polynucleotide
taatacgactcactatagggcggtgaggagccagctttctcagaggctccaacagaggagaggagccatggagaaagctaacctggcggcagcgcaaaagatg

SEQ ID NO: 217042 - DNA, 103 bp, Artificial Sequence
  Synthetic Polynucleotide
taatacgactcactatagggcaccttgtgccggtgaggagccagctttctaacagaggagaagaaagatggctcctcacaacctggcggcagcgcaaaagatg

SEQ ID NO: 217043 - DNA, 103 bp, Artificial Sequence
  Synthetic Polynucleotide
taatacgactcactatagggtcattctgagcaccttgtgccggtgaggagaacagaggagactcctcatgggcacaaggaacctggcggcagcgcaaaagatg

SEQ ID NO: 217044 - DNA, 103 bp, Artificial Sequence
  Synthetic Polynucleotide
taatacgactcactatagggtctggggggttcattctgagcaccttgtgcaacagaggagagcacaaatggctcagaataacctggcggcagcgcaaaagatg

SEQ ID NO: 217045 - DNA, 103 bp, Artificial Sequence
  Synthetic Polynucleotide
taatacgactcactatagggctgctgctcctcgtcgtccaccaccactgcaacagaggagagcagtgatggtggacgacaacctggcggcagcgcaaaagatg

SEQ ID NO: 217046 - DNA, 103 bp, Artificial Sequence
  Synthetic Polynucleotide
taatacgactcactatagggtagcattgagtctggggggttcattctgagaacagaggagactcagaatgaaccccccaaacctggcggcagcgcaaaagatg

SEQ ID NO: 217047 - DNA, 103 bp, Artificial Sequence
  Synthetic Polynucleotide
taatacgactcactataggggcggcaggactagcattgagtctggggggtaacagaggagaacccccatgactcaatgcaacctggcggcagcgcaaaagatg

SEQ ID NO: 217048 - DNA, 103 bp, Artificial Sequence
  Synthetic Polynucleotide
taatacgactcactatagggctcttctcttgcggcaggactagcattgagaacagaggagactcaatatgagtcctgccaacctggcggcagcgcaaaagatg

SEQ ID NO: 217049 - DNA, 103 bp, Artificial Sequence
  Synthetic Polynucleotide
taatacgactcactataggggtgaggtggcctcttctcttgcggcaggacaacagaggagagtcctgatgcaagagaagaacctggcggcagcgcaaaagatg

SEQ ID NO: 217050 - DNA, 103 bp, Artificial Sequence
  Synthetic Polynucleotide
taatacgactcactatagggttagcgcctggtgaggtggcctcttctcttaacagaggagaaagagaatgggccacctcaacctggcggcagcgcaaaagatg

SEQ ID NO: 217051 - DNA, 103 bp, Artificial Sequence
  Synthetic Polynucleotide
taatacgactcactatagggtggcatgtccttagcgcctggtgaggtggcaacagaggagagccaccatgccaggcgctaacctggcggcagcgcaaaagatg

SEQ ID NO: 217052 - DNA, 103 bp, Artificial Sequence
  Synthetic Polynucleotide
taatacgactcactatagggcggatgacaatggcatgtccttagcgcctgaacagaggagacaggcgatgaggacatgcaacctggcggcagcgcaaaagatg

SEQ ID NO: 217053 - DNA, 103 bp, Artificial Sequence
  Synthetic Polynucleotide
taatacgactcactataggggggttcccgtcggatgacaatggcatgtccaacagaggagaggacatatgattgtcatcaacctggcggcagcgcaaaagatg

SEQ ID NO: 217054 - DNA, 103 bp, Artificial Sequence
  Synthetic Polynucleotide
taatacgactcactatagggattaacctttgggttcccgtcggatgacaaaacagaggagattgtcaatggacgggaacaacctggcggcagcgcaaaagatg

SEQ ID NO: 217055 - DNA, 103 bp, Artificial Sequence
  Synthetic Polynucleotide
taatacgactcactatagggcagtcttctcattaacctttgggttcccgtaacagaggagaacgggaatgcaaaggttaaacctggcggcagcgcaaaagatg

SEQ ID NO: 217056 - DNA, 103 bp, Artificial Sequence
  Synthetic Polynucleotide
taatacgactcactataggggccgcagcagctgctgctcctcgtcgtccaaacagaggagatggacgatgaggagcagcaacctggcggcagcgcaaaagatg

SEQ ID NO: 217057 - DNA, 103 bp, Artificial Sequence
  Synthetic Polynucleotide
taatacgactcactatagggatcaccccaacagtcttctcattaacctttaacagaggagaaaaggtatgtgagaagacaacctggcggcagcgcaaaagatg

SEQ ID NO: 217058 - DNA, 103 bp, Artificial Sequence
  Synthetic Polynucleotide
taatacgactcactatagggccgggagacaatcaccccaacagtcttctcaacagaggagagagaagatggttggggtgaacctggcggcagcgcaaaagatg

SEQ ID NO: 217059 - DNA, 103 bp, Artificial Sequence
  Synthetic Polynucleotide
taatacgactcactatagggtcatggcttcccgggagacaatcaccccaaaacagaggagattggggatgttgtctcccaacctggcggcagcgcaaaagatg

SEQ ID NO: 217060 - DNA, 103 bp, Artificial Sequence
  Synthetic Polynucleotide
taatacgactcactatagggacccgacctgtcatggcttcccgggagacaaacagaggagatgtctcatgggaagccataacctggcggcagcgcaaaagatg

SEQ ID NO: 217061 - DNA, 103 bp, Artificial Sequence
  Synthetic Polynucleotide
taatacgactcactatagggaggcttttctacccgacctgtcatggcttcaacagaggagagaagccatgacaggtcggaacctggcggcagcgcaaaagatg

SEQ ID NO: 217062 - DNA, 103 bp, Artificial Sequence
  Synthetic Polynucleotide
taatacgactcactatagggcttgtccaccaggcttttctacccgacctgaacagaggagacaggtcatgtagaaaagcaacctggcggcagcgcaaaagatg

SEQ ID NO: 217063 - DNA, 103 bp, Artificial Sequence
  Synthetic Polynucleotide
taatacgactcactataggggagcctttatcttgtccaccaggcttttctaacagaggagaagaaaaatgtggtggacaaacctggcggcagcgcaaaagatg

SEQ ID NO: 217064 - DNA, 103 bp, Artificial Sequence
  Synthetic Polynucleotide
taatacgactcactatagggatcctcttgggagcctttatcttgtccaccaacagaggagaggtggaatggataaaggcaacctggcggcagcgcaaaagatg

SEQ ID NO: 217065 - DNA, 103 bp, Artificial Sequence
  Synthetic Polynucleotide
taatacgactcactatagggctgcaggatcatcctcttgggagcctttataacagaggagaataaagatgcccaagaggaacctggcggcagcgcaaaagatg

SEQ ID NO: 217066 - DNA, 103 bp, Artificial Sequence
  Synthetic Polynucleotide
taatacgactcactatagggctttgagtggctgcaggatcatcctcttggaacagaggagaccaagaatgtgatcctgcaacctggcggcagcgcaaaagatg

SEQ ID NO: 217067 - DNA, 103 bp, Artificial Sequence
  Synthetic Polynucleotide
taatacgactcactatagggagccatcgctgccgcagcagctgctgctccaacagaggagaggagcaatggctgctgcgaacctggcggcagcgcaaaagatg

SEQ ID NO: 217068 - DNA, 103 bp, Artificial Sequence
  Synthetic Polynucleotide
taatacgactcactataggggctaggtggcctttgagtggctgcaggatcaacagaggagagatcctatggccactcaaaacctggcggcagcgcaaaagatg

SEQ ID NO: 217069 - DNA, 103 bp, Artificial Sequence
  Synthetic Polynucleotide
taatacgactcactatagggccccaccattgctaggtggcctttgagtggaacagaggagaccactcatgggccacctaaacctggcggcagcgcaaaagatg

SEQ ID NO: 217070 - DNA, 103 bp, Artificial Sequence
  Synthetic Polynucleotide
taatacgactcactataggggtttcctttgccccaccattgctaggtggcaacagaggagagccaccatgcaatggtggaacctggcggcagcgcaaaagatg

SEQ ID NO: 217071 - DNA, 103 bp, Artificial Sequence
  Synthetic Polynucleotide
taatacgactcactatagggtgcatgactggtttcctttgccccaccattaacagaggagaaatggtatggcaaaggaaaacctggcggcagcgcaaaagatg

SEQ ID NO: 217072 - DNA, 103 bp, Artificial Sequence
  Synthetic Polynucleotide
taatacgactcactatagggggggaagtgatgcatgactggtttcctttgaacagaggagacaaaggatgccagtcatgaacctggcggcagcgcaaaagatg

SEQ ID NO: 217073 - DNA, 103 bp, Artificial Sequence
  Synthetic Polynucleotide
taatacgactcactatagggggctctggctggggaagtgatgcatgactgaacagaggagacagtcaatgatcacttccaacctggcggcagcgcaaaagatg

SEQ ID NO: 217074 - DNA, 103 bp, Artificial Sequence
  Synthetic Polynucleotide
taatacgactcactatagggtcctcctggaggctctggctggggaagtgaaacagaggagatcacttatgcagccagagaacctggcggcagcgcaaaagatg

SEQ ID NO: 217075 - DNA, 103 bp, Artificial Sequence
  Synthetic Polynucleotide
taatacgactcactatagggtgctccctcctcctcctggaggctctggctaacagaggagaagccagatgctccaggagaacctggcggcagcgcaaaagatg

SEQ ID NO: 217076 - DNA, 103 bp, Artificial Sequence
  Synthetic Polynucleotide
taatacgactcactatagggttgtttcctttgctccctcctcctcctggaaacagaggagatccaggatgaggagggagaacctggcggcagcgcaaaagatg

SEQ ID NO: 217077 - DNA, 103 bp, Artificial Sequence
  Synthetic Polynucleotide
taatacgactcactatagggatcgccattcttgtttcctttgctccctccaacagaggagaggagggatgaaaggaaacaacctggcggcagcgcaaaagatg

SEQ ID NO: 217078 - DNA, 103 bp, Artificial Sequence
  Synthetic Polynucleotide
taatacgactcactatagggggtttccgtggtaactgctttgctcccgaaaacagaggagattcgggatgaaagcagttaacctggcggcagcgcaaaagatg

SEQ ID NO: 217079 - DNA, 103 bp, Artificial Sequence
  Synthetic Polynucleotide
taatacgactcactatagggaggtctcgctagccatcgctgccgcagcagaacagaggagactgctgatgcagcgatggaacctggcggcagcgcaaaagatg

SEQ ID NO: 217080 - DNA, 103 bp, Artificial Sequence
  Synthetic Polynucleotide
taatacgactcactatagggtggagttgttatcgccattcttgtttccttaacagaggagaaaggaaatgagaatggcgaacctggcggcagcgcaaaagatg

SEQ ID NO: 217081 - DNA, 103 bp, Artificial Sequence
  Synthetic Polynucleotide
taatacgactcactatagggccattatggttggagttgttatcgccattcaacagaggagagaatggatgtaacaactcaacctggcggcagcgcaaaagatg

SEQ ID NO: 217082 - DNA, 103 bp, Artificial Sequence
  Synthetic Polynucleotide
taatacgactcactatagggatttccttctccattatggttggagttgttaacagaggagaaacaacatgaaccataataacctggcggcagcgcaaaagatg

SEQ ID NO: 217083 - DNA, 103 bp, Artificial Sequence
  Synthetic Polynucleotide
taatacgactcactatagggcactctggccatttccttctccattatggtaacagaggagaaccataatggagaaggaaaacctggcggcagcgcaaaagatg

SEQ ID NO: 217084 - DNA, 103 bp, Artificial Sequence
  Synthetic Polynucleotide
taatacgactcactataggggcagagtggccactctggccatttccttctaacagaggagaagaaggatgtggccagagaacctggcggcagcgcaaaagatg

SEQ ID NO: 217085 - DNA, 103 bp, Artificial Sequence
  Synthetic Polynucleotide
taatacgactcactatagggagggcccgctgcagagtggccactctggccaacagaggagaggccagatgggccactctaacctggcggcagcgcaaaagatg

SEQ ID NO: 217086 - DNA, 103 bp, Artificial Sequence
  Synthetic Polynucleotide
taatacgactcactatagggtcgtaaaaccagggcccgctgcagagtggcaacagaggagagccactatgcagcgggccaacctggcggcagcgcaaaagatg

SEQ ID NO: 217087 - DNA, 103 bp, Artificial Sequence
  Synthetic Polynucleotide
taatacgactcactatagggtcagttctgctcgtaaaaccagggcccgctaacagaggagaagcgggatgtggttttacaacctggcggcagcgcaaaagatg

SEQ ID NO: 217088 - DNA, 103 bp, Artificial Sequence
  Synthetic Polynucleotide
taatacgactcactatagggtttgctaggctcagttctgctcgtaaaaccaacagaggagaggttttatgagcagaactaacctggcggcagcgcaaaagatg

SEQ ID NO: 217089 - DNA, 103 bp, Artificial Sequence
  Synthetic Polynucleotide
taatacgactcactatagggttccaggagatttgctaggctcagttctgcaacagaggagagcagaaatgagcctagcaaacctggcggcagcgcaaaagatg

SEQ ID NO: 217090 - DNA, 103 bp, Artificial Sequence
  Synthetic Polynucleotide
taatacgactcactatagggtgatggccagaggtctcgctagccatcgctaacagaggagaagcgatatgtagcgagacaacctggcggcagcgcaaaagatg

SEQ ID NO: 217091 - DNA, 103 bp, Artificial Sequence
  Synthetic Polynucleotide
taatacgactcactatagggtagcgcagacttccaggagatttgctaggcaacagaggagagcctagatgatctcctggaacctggcggcagcgcaaaagatg

SEQ ID NO: 217092 - DNA, 103 bp, Artificial Sequence
  Synthetic Polynucleotide
taatacgactcactatagggtttgtaactatagcgcagacttccaggagaaacagaggagatctcctatgagtctgcgcaacctggcggcagcgcaaaagatg

SEQ ID NO: 217093 - DNA, 103 bp, Artificial Sequence
  Synthetic Polynucleotide
taatacgactcactatagggcgaaactatctttgtaactatagcgcagacaacagaggagagtctgcatgatagttacaaacctggcggcagcgcaaaagatg

SEQ ID NO: 217094 - DNA, 103 bp, Artificial Sequence
  Synthetic Polynucleotide
taatacgactcactatagggacggctgacccgaaactatctttgtaactaaacagaggagatagttaatgagatagtttaacctggcggcagcgcaaaagatg

SEQ ID NO: 217095 - DNA, 103 bp, Artificial Sequence
  Synthetic Polynucleotide
taatacgactcactatagggatttcgtggcacggctgacccgaaactatcaacagaggagagatagtatggggtcagccaacctggcggcagcgcaaaagatg

SEQ ID NO: 217096 - DNA, 103 bp, Artificial Sequence
  Synthetic Polynucleotide
taatacgactcactatagggagccactgacatttcgtggcacggctgaccaacagaggagaggtcagatgtgccacgaaaacctggcggcagcgcaaaagatg

SEQ ID NO: 217097 - DNA, 103 bp, Artificial Sequence
  Synthetic Polynucleotide
taatacgactcactatagggtactgaggaaagccactgacatttcgtggcaacagaggagagccacgatgtgtcagtggaacctggcggcagcgcaaaagatg

SEQ ID NO: 217098 - DNA, 103 bp, Artificial Sequence
  Synthetic Polynucleotide
taatacgactcactatagggccctgtaggatactgaggaaagccactgacaacagaggagagtcagtatgtttcctcagaacctggcggcagcgcaaaagatg

SEQ ID NO: 217099 - DNA, 103 bp, Artificial Sequence
  Synthetic Polynucleotide
taatacgactcactatagggccttttcttgccctgtaggatactgaggaaaacagaggagattcctcatgatcctacagaacctggcggcagcgcaaaagatg

SEQ ID NO: 217100 - DNA, 103 bp, Artificial Sequence
  Synthetic Polynucleotide
taatacgactcactataggggtgaaatctcccttttcttgccctgtaggaaacagaggagatcctacatggcaagaaaaaacctggcggcagcgcaaaagatg

SEQ ID NO: 217101 - DNA, 103 bp, Artificial Sequence
  Synthetic Polynucleotide
taatacgactcactatagggctggtaaccttgatggccagaggtctcgctaacagaggagaagcgagatgtctggccataacctggcggcagcgcaaaagatg

SEQ ID NO: 217102 - DNA, 103 bp, Artificial Sequence
  Synthetic Polynucleotide
taatacgactcactatagggcccatggccagtgaaatctcccttttcttgaacagaggagacaagaaatgggagatttcaacctggcggcagcgcaaaagatg

SEQ ID NO: 217103 - DNA, 103 bp, Artificial Sequence
  Synthetic Polynucleotide
taatacgactcactatagggcctttcgttccccatggccagtgaaatctcaacagaggagagagattatgctggccatgaacctggcggcagcgcaaaagatg

SEQ ID NO: 217104 - DNA, 103 bp, Artificial Sequence
  Synthetic Polynucleotide
taatacgactcactatagggtcatttctaccctttcgttccccatggccaaacagaggagatggccaatgggaacgaaaaacctggcggcagcgcaaaagatg

SEQ ID NO: 217105 - DNA, 103 bp, Artificial Sequence
  Synthetic Polynucleotide
taatacgactcactatagggtgggaatttttcatttctaccctttcgttcaacagaggagagaacgaatgggtagaaataacctggcggcagcgcaaaagatg

SEQ ID NO: 217106 - DNA, 103 bp, Artificial Sequence
  Synthetic Polynucleotide
taatacgactcactataggggcaggaggcttgggaatttttcatttctacaacagaggagagtagaaatgaaaaattccaacctggcggcagcgcaaaagatg

SEQ ID NO: 217107 - DNA, 103 bp, Artificial Sequence
  Synthetic Polynucleotide
taatacgactcactatagggagcacttcctgcaggaggcttgggaattttaacagaggagaaaaattatgaagcctcctaacctggcggcagcgcaaaagatg

SEQ ID NO: 217108 - DNA, 103 bp, Artificial Sequence
  Synthetic Polynucleotide
taatacgactcactataggggtaaccctgaagcacttcctgcaggaggctaacagaggagaagcctcatgcaggaagtgaacctggcggcagcgcaaaagatg

SEQ ID NO: 217109 - DNA, 103 bp, Artificial Sequence
  Synthetic Polynucleotide
taatacgactcactatagggggtggtggtggtaaccctgaagcacttcctaacagaggagaaggaagatgttcagggttaacctggcggcagcgcaaaagatg

SEQ ID NO: 217110 - DNA, 103 bp, Artificial Sequence
  Synthetic Polynucleotide
taatacgactcactatagggctcctgtcagggtggtggtggtaaccctgaaacagaggagatcagggatgccaccaccaaacctggcggcagcgcaaaagatg

SEQ ID NO: 217111 - DNA, 103 bp, Artificial Sequence
  Synthetic Polynucleotide
taatacgactcactatagggcctagaatatctcctgtcagggtggtggtgaacagaggagacaccacatgcctgacaggaacctggcggcagcgcaaaagatg

SEQ ID NO: 217112 - DNA, 103 bp, Artificial Sequence
  Synthetic Polynucleotide
taatacgactcactatagggtcctgaaaccctggtaaccttgatggccagaacagaggagactggccatgaaggttaccaacctggcggcagcgcaaaagatg

SEQ ID NO: 217113 - DNA, 103 bp, Artificial Sequence
  Synthetic Polynucleotide
taatacgactcactatagggcttgagtactcctagaatatctcctgtcagaacagaggagactgacaatggatattctaaacctggcggcagcgcaaaagatg

SEQ ID NO: 217114 - DNA, 103 bp, Artificial Sequence
  Synthetic Polynucleotide
taatacgactcactatagggccctgatgctcttgagtactcctagaatataacagaggagaatattcatggagtactcaaacctggcggcagcgcaaaagatg

SEQ ID NO: 217115 - DNA, 103 bp, Artificial Sequence
  Synthetic Polynucleotide
taatacgactcactatagggaccagccatcccctgatgctcttgagtactaacagaggagaagtactatggagcatcagaacctggcggcagcgcaaaagatg

SEQ ID NO: 217116 - DNA, 103 bp, Artificial Sequence
  Synthetic Polynucleotide
taatacgactcactatagggcttctaggctaccagccatcccctgatgctaacagaggagaagcatcatgggatggctgaacctggcggcagcgcaaaagatg

SEQ ID NO: 217117 - DNA, 103 bp, Artificial Sequence
  Synthetic Polynucleotide
taatacgactcactatagggcttgtggttccttctaggctaccagccatcaacagaggagagatggcatgtagcctagaaacctggcggcagcgcaaaagatg

SEQ ID NO: 217118 - DNA, 103 bp, Artificial Sequence
  Synthetic Polynucleotide
taatacgactcactataggggacattgggccttgtggttccttctaggctaacagaggagaagcctaatgggaaccacaaacctggcggcagcgcaaaagatg

SEQ ID NO: 217119 - DNA, 103 bp, Artificial Sequence
  Synthetic Polynucleotide
taatacgactcactataggggactaaccaagacattgggccttgtggttcaacagaggagagaaccaatgggcccaatgaacctggcggcagcgcaaaagatg

SEQ ID NO: 217120 - DNA, 103 bp, Artificial Sequence
  Synthetic Polynucleotide
taatacgactcactatagggtcattggtttgactaaccaagacattgggcaacagaggagagcccaaatgcttggttagaacctggcggcagcgcaaaagatg

SEQ ID NO: 217121 - DNA, 103 bp, Artificial Sequence
  Synthetic Polynucleotide
taatacgactcactataggggctagctaattcattggtttgactaaccaaaacagaggagattggttatgcaaaccaataacctggcggcagcgcaaaagatg

SEQ ID NO: 217122 - DNA, 103 bp, Artificial Sequence
  Synthetic Polynucleotide
taatacgactcactataggggaaggcccctgctagctaattcattggtttaacagaggagaaaaccaatgaattagctaaacctggcggcagcgcaaaagatg

SEQ ID NO: 217123 - DNA, 103 bp, Artificial Sequence
  Synthetic Polynucleotide
taatacgactcactatagggccagcctctttcctgaaaccctggtaacctaacagaggagaaggttaatggggtttcagaacctggcggcagcgcaaaagatg

SEQ ID NO: 217124 - DNA, 103 bp, Artificial Sequence
  Synthetic Polynucleotide
taatacgactcactatagggcttttgttcagaaggcccctgctagctaataacagaggagaattagcatgcaggggcctaacctggcggcagcgcaaaagatg

SEQ ID NO: 217125 - DNA, 103 bp, Artificial Sequence
  Synthetic Polynucleotide
taatacgactcactatagggagacccaatgcttttgttcagaaggcccctaacagaggagaaggggcatgctgaacaaaaacctggcggcagcgcaaaagatg

SEQ ID NO: 217126 - DNA, 103 bp, Artificial Sequence
  Synthetic Polynucleotide
taatacgactcactatagggtttctaatagagacccaatgcttttgttcaaacagaggagatgaacaatggcattgggtaacctggcggcagcgcaaaagatg

SEQ ID NO: 217127 - DNA, 103 bp, Artificial Sequence
  Synthetic Polynucleotide
taatacgactcactatagggcagtggggattttctaatagagacccaatgaacagaggagacattggatgtctattagaaacctggcggcagcgcaaaagatg

SEQ ID NO: 217128 - DNA, 103 bp, Artificial Sequence
  Synthetic Polynucleotide
taatacgactcactatagggccaggggccccagtggggattttctaatagaacagaggagactattaatgaatccccacaacctggcggcagcgcaaaagatg

SEQ ID NO: 217129 - DNA, 103 bp, Artificial Sequence
  Synthetic Polynucleotide
taatacgactcactatagggatttcctttcccaggggccccagtggggataacagaggagaatccccatgggggcccctaacctggcggcagcgcaaaagatg

SEQ ID NO: 217130 - DNA, 103 bp, Artificial Sequence
  Synthetic Polynucleotide
taatacgactcactataggggtgctgcttgatttcctttcccaggggcccaacagaggagagggcccatgggaaaggaaaacctggcggcagcgcaaaagatg

SEQ ID NO: 217131 - DNA, 103 bp, Artificial Sequence
  Synthetic Polynucleotide
taatacgactcactatagggttcaggagctgtgctgcttgatttcctttcaacagaggagagaaaggatgtcaagcagcaacctggcggcagcgcaaaagatg

SEQ ID NO: 217132 - DNA, 103 bp, Artificial Sequence
  Synthetic Polynucleotide
taatacgactcactatagggtctgtttcatttcaggagctgtgctgcttgaacagaggagacaagcaatgcagctcctgaacctggcggcagcgcaaaagatg

SEQ ID NO: 217133 - DNA, 103 bp, Artificial Sequence
  Synthetic Polynucleotide
taatacgactcactataggggtcaaattgatctgtttcatttcaggagctaacagaggagaagctccatgaatgaaacaaacctggcggcagcgcaaaagatg

SEQ ID NO: 217134 - DNA, 103 bp, Artificial Sequence
  Synthetic Polynucleotide
taatacgactcactataggggtaaaaatctccagcctctttcctgaaaccaacagaggagaggtttcatgaaagaggctaacctggcggcagcgcaaaagatg

SEQ ID NO: 217135 - DNA, 103 bp, Artificial Sequence
  Synthetic Polynucleotide
taatacgactcactatagggtggatagtcagtcaaattgatctgtttcataacagaggagaatgaaaatgatcaatttgaacctggcggcagcgcaaaagatg

SEQ ID NO: 217136 - DNA, 103 bp, Artificial Sequence
  Synthetic Polynucleotide
taatacgactcactatagggttctgggaattggatagtcagtcaaattgaaacagaggagatcaattatgctgactatcaacctggcggcagcgcaaaagatg

SEQ ID NO: 217137 - DNA, 103 bp, Artificial Sequence
  Synthetic Polynucleotide
taatacgactcactatagggatttcaaactttctgggaattggatagtcaaacagaggagatgactaatgaattcccagaacctggcggcagcgcaaaagatg

SEQ ID NO: 217138 - DNA, 103 bp, Artificial Sequence
  Synthetic Polynucleotide
taatacgactcactatagggctgaggctctatttcaaactttctgggaataacagaggagaattcccatgaagtttgaaaacctggcggcagcgcaaaagatg

SEQ ID NO: 217139 - DNA, 103 bp, Artificial Sequence
  Synthetic Polynucleotide
taatacgactcactataggggtgctgatgactgaggctctatttcaaactaacagaggagaagtttgatgtagagcctcaacctggcggcagcgcaaaagatg

SEQ ID NO: 217140 - DNA, 103 bp, Artificial Sequence
  Synthetic Polynucleotide
taatacgactcactatagggccaggctcatgtgctgatgactgaggctctaacagaggagaagagccatggtcatcagcaacctggcggcagcgcaaaagatg

SEQ ID NO: 217141 - DNA, 103 bp, Artificial Sequence
  Synthetic Polynucleotide
taatacgactcactataggggagggaacccccaggctcatgtgctgatgaaacagaggagatcatcaatgcatgagcctaacctggcggcagcgcaaaagatg

SEQ ID NO: 217142 - DNA, 103 bp, Artificial Sequence
  Synthetic Polynucleotide
taatacgactcactatagggttctttcagagagggaacccccaggctcataacagaggagaatgagcatgggggttcccaacctggcggcagcgcaaaagatg

SEQ ID NO: 217143 - DNA, 103 bp, Artificial Sequence
  Synthetic Polynucleotide
taatacgactcactatagggatcactgatcttctttcagagagggaacccaacagaggagagggttcatgctctgaaagaacctggcggcagcgcaaaagatg

SEQ ID NO: 217144 - DNA, 103 bp, Artificial Sequence
  Synthetic Polynucleotide
taatacgactcactatagggaatatcacagatcactgatcttctttcagaaacagaggagatctgaaatgagatcagtgaacctggcggcagcgcaaaagatg

SEQ ID NO: 217145 - DNA, 103 bp, Artificial Sequence
  Synthetic Polynucleotide
taatacgactcactatagggctgccatgtagtaaaaatctccagcctcttaacagaggagaaagaggatggagatttttaacctggcggcagcgcaaaagatg

SEQ ID NO: 217146 - DNA, 103 bp, Artificial Sequence
  Synthetic Polynucleotide
taatacgactcactatagggttagtggagaaatatcacagatcactgatcaacagaggagagatcagatgtctgtgataaacctggcggcagcgcaaaagatg

SEQ ID NO: 217147 - DNA, 103 bp, Artificial Sequence
  Synthetic Polynucleotide
taatacgactcactatagggacaatctgtcttagtggagaaatatcacagaacagaggagactgtgaatgttctccactaacctggcggcagcgcaaaagatg

SEQ ID NO: 217148 - DNA, 103 bp, Artificial Sequence
  Synthetic Polynucleotide
taatacgactcactatagggtgggtccctgacaatctgtcttagtggagaaacagaggagatctccaatgagacagattaacctggcggcagcgcaaaagatg

SEQ ID NO: 217149 - DNA, 103 bp, Artificial Sequence
  Synthetic Polynucleotide
taatacgactcactatagggagtgagcccctgggtccctgacaatctgtcaacagaggagagacagaatgtcagggaccaacctggcggcagcgcaaaagatg

SEQ ID NO: 217150 - DNA, 103 bp, Artificial Sequence
  Synthetic Polynucleotide
taatacgactcactatagggtgtcccagtgagtgagcccctgggtccctgaacagaggagacagggaatgaggggctcaaacctggcggcagcgcaaaagatg

SEQ ID NO: 217151 - DNA, 103 bp, Artificial Sequence
  Synthetic Polynucleotide
taatacgactcactatagggggcactcatgtgtcccagtgagtgagccccaacagaggagaggggctatgtcactgggaaacctggcggcagcgcaaaagatg

SEQ ID NO: 217152 - DNA, 103 bp, Artificial Sequence
  Synthetic Polynucleotide
taatacgactcactatagggttctggtgtcggcactcatgtgtcccagtgaacagaggagacactggatgacatgagtgaacctggcggcagcgcaaaagatg

SEQ ID NO: 217153 - DNA, 103 bp, Artificial Sequence
  Synthetic Polynucleotide
taatacgactcactatagggttcctcccaattctggtgtcggcactcatgaacagaggagacatgagatgcgacaccagaacctggcggcagcgcaaaagatg

SEQ ID NO: 217154 - DNA, 103 bp, Artificial Sequence
  Synthetic Polynucleotide
taatacgactcactataggggagacggtcattcctcccaattctggtgtcaacagaggagagacaccatgattgggaggaacctggcggcagcgcaaaagatg

SEQ ID NO: 217155 - DNA, 103 bp, Artificial Sequence
  Synthetic Polynucleotide
taatacgactcactatagggaagttggattgagacggtcattcctcccaaaacagaggagattgggaatgatgaccgtcaacctggcggcagcgcaaaagatg

SEQ ID NO: 217156 - DNA, 103 bp, Artificial Sequence
  Synthetic Polynucleotide
taatacgactcactatagggtctttgttgcctgccatgtagtaaaaatctaacagaggagaagatttatgctacatggcaacctggcggcagcgcaaaagatg

SEQ ID NO: 217157 - DNA, 103 bp, Artificial Sequence
  Synthetic Polynucleotide
taatacgactcactataggggactgacttaaagttggattgagacggtcaaacagaggagatgaccgatgcaatccaacaacctggcggcagcgcaaaagatg

SEQ ID NO: 217158 - DNA, 103 bp, Artificial Sequence
  Synthetic Polynucleotide
taatacgactcactatagggaagaatgaccgactgacttaaagttggattaacagaggagaaatccaatgttaagtcagaacctggcggcagcgcaaaagatg

SEQ ID NO: 217159 - DNA, 103 bp, Artificial Sequence
  Synthetic Polynucleotide
taatacgactcactatagggaaccaccaggaagaatgaccgactgacttaaacagaggagataagtcatgcggtcattcaacctggcggcagcgcaaaagatg

SEQ ID NO: 217160 - DNA, 103 bp, Artificial Sequence
  Synthetic Polynucleotide
taatacgactcactatagggatggacaccaaaccaccaggaagaatgaccaacagaggagaggtcatatgtcctggtggaacctggcggcagcgcaaaagatg

SEQ ID NO: 217161 - DNA, 103 bp, Artificial Sequence
  Synthetic Polynucleotide
taatacgactcactatagggcttggtttccatggacaccaaaccaccaggaacagaggagacctggtatgttggtgtccaacctggcggcagcgcaaaagatg

SEQ ID NO: 217162 - DNA, 103 bp, Artificial Sequence
  Synthetic Polynucleotide
taatacgactcactataggggggatttcagcttggtttccatggacaccaaacagaggagatggtgtatgtggaaaccaaacctggcggcagcgcaaaagatg

SEQ ID NO: 217163 - DNA, 103 bp, Artificial Sequence
  Synthetic Polynucleotide
taatacgactcactatagggtgcccgctctgggatttcagcttggtttccaacagaggagaggaaacatggctgaaatcaacctggcggcagcgcaaaagatg

SEQ ID NO: 217164 - DNA, 103 bp, Artificial Sequence
  Synthetic Polynucleotide
taatacgactcactatagggctcttttatctgcccgctctgggatttcagaacagaggagactgaaaatgcagagcgggaacctggcggcagcgcaaaagatg

SEQ ID NO: 217165 - DNA, 103 bp, Artificial Sequence
  Synthetic Polynucleotide
taatacgactcactatagggcaaagtcttcctcttttatctgcccgctctaacagaggagaagagcgatgagataaaagaacctggcggcagcgcaaaagatg

SEQ ID NO: 217166 - DNA, 103 bp, Artificial Sequence
  Synthetic Polynucleotide
taatacgactcactatagggttagactgttcaaagtcttcctcttttatcaacagaggagagataaaatgggaagacttaacctggcggcagcgcaaaagatg

SEQ ID NO: 217167 - DNA, 103 bp, Artificial Sequence
  Synthetic Polynucleotide
taatacgactcactatagggagtcacggggtctttgttgcctgccatgtaaacagaggagatacatgatgggcaacaaaaacctggcggcagcgcaaaagatg

SEQ ID NO: 217168 - DNA, 103 bp, Artificial Sequence
  Synthetic Polynucleotide
taatacgactcactatagggagcttgagatttagactgttcaaagtcttcaacagaggagagaagacatggaacagtctaacctggcggcagcgcaaaagatg

SEQ ID NO: 217169 - DNA, 103 bp, Artificial Sequence
  Synthetic Polynucleotide
taatacgactcactatagggtgttgaaactagcttgagatttagactgttaacagaggagaaacagtatgaatctcaagaacctggcggcagcgcaaaagatg

SEQ ID NO: 217170 - DNA, 103 bp, Artificial Sequence
  Synthetic Polynucleotide
taatacgactcactataggggatttcttgttgttgaaactagcttgagataacagaggagaatctcaatgtagtttcaaaacctggcggcagcgcaaaagatg

SEQ ID NO: 217171 - DNA, 103 bp, Artificial Sequence
  Synthetic Polynucleotide
taatacgactcactataggggtggtctccagatttcttgttgttgaaactaacagaggagaagtttcatgaacaagaaaaacctggcggcagcgcaaaagatg

SEQ ID NO: 217172 - DNA, 103 bp, Artificial Sequence
  Synthetic Polynucleotide
taatacgactcactataggggaggatggcagtggtctccagatttcttgtaacagaggagaacaagaatgctggagaccaacctggcggcagcgcaaaagatg

SEQ ID NO: 217173 - DNA, 103 bp, Artificial Sequence
  Synthetic Polynucleotide
taatacgactcactatagggttgatgctaggaggatggcagtggtctccaaacagaggagatggagaatgctgccatccaacctggcggcagcgcaaaagatg

SEQ ID NO: 217174 - DNA, 103 bp, Artificial Sequence
  Synthetic Polynucleotide
taatacgactcactatagggagactcatgcttgatgctaggaggatggcaaacagaggagatgccatatgcctagcatcaacctggcggcagcgcaaaagatg

SEQ ID NO: 217175 - DNA, 103 bp, Artificial Sequence
  Synthetic Polynucleotide
taatacgactcactatagggtgccgcggtaagactcatgcttgatgctagaacagaggagactagcaatgagcatgagtaacctggcggcagcgcaaaagatg

SEQ ID NO: 217176 - DNA, 103 bp, Artificial Sequence
  Synthetic Polynucleotide
taatacgactcactataggggggctggcattgccgcggtaagactcatgcaacagaggagagcatgaatgttaccgcggaacctggcggcagcgcaaaagatg

SEQ ID NO: 217177 - DNA, 103 bp, Artificial Sequence
  Synthetic Polynucleotide
taatacgactcactatagggtgctgctccagggctggcattgccgcggtaaacagaggagataccgcatgaatgccagcaacctggcggcagcgcaaaagatg

SEQ ID NO: 217178 - DNA, 103 bp, Artificial Sequence
  Synthetic Polynucleotide
taatacgactcactataggggggttcctgtagtcacggggtctttgttgcaacagaggagagcaacaatgaccccgtgaaacctggcggcagcgcaaaagatg

SEQ ID NO: 217179 - DNA, 103 bp, Artificial Sequence
  Synthetic Polynucleotide
taatacgactcactatagggaatcatgggttgctgctccagggctggcataacagaggagaatgccaatgctggagcagaacctggcggcagcgcaaaagatg

SEQ ID NO: 217180 - DNA, 103 bp, Artificial Sequence
  Synthetic Polynucleotide
taatacgactcactatagggtctgaaagggaatcatgggttgctgctccaaacagaggagatggagcatgaacccatgaaacctggcggcagcgcaaaagatg

SEQ ID NO: 217181 - DNA, 103 bp, Artificial Sequence
  Synthetic Polynucleotide
taatacgactcactatagggcgggccatagtctgaaagggaatcatgggtaacagaggagaacccatatgtccctttcaaacctggcggcagcgcaaaagatg

SEQ ID NO: 217182 - DNA, 103 bp, Artificial Sequence
  Synthetic Polynucleotide
taatacgactcactatagggtgctgtcttgcgggccatagtctgaaagggaacagaggagaccctttatgactatggccaacctggcggcagcgcaaaagatg

SEQ ID NO: 217183 - DNA, 103 bp, Artificial Sequence
  Synthetic Polynucleotide
taatacgactcactatagggggcgtgggtctgctgtcttgcgggccatagaacagaggagactatggatggcaagacagaacctggcggcagcgcaaaagatg

SEQ ID NO: 217184 - DNA, 103 bp, Artificial Sequence
  Synthetic Polynucleotide
taatacgactcactatagggccgccgcattggcgtgggtctgctgtcttgaacagaggagacaagacatgagacccacgaacctggcggcagcgcaaaagatg

SEQ ID NO: 217185 - DNA, 103 bp, Artificial Sequence
  Synthetic Polynucleotide
taatacgactcactatagggtgccagggacccgccgcattggcgtgggtcaacagaggagagacccaatgcaatgcggcaacctggcggcagcgcaaaagatg

SEQ ID NO: 217186 - DNA, 103 bp, Artificial Sequence
  Synthetic Polynucleotide
taatacgactcactatagggccaccaactctgccagggacccgccgcattaacagaggagaaatgcgatgggtccctggaacctggcggcagcgcaaaagatg

SEQ ID NO: 217187 - DNA, 103 bp, Artificial Sequence
  Synthetic Polynucleotide
taatacgactcactataggggccctcccgaccaccaactctgccagggacaacagaggagagtccctatgagagttggtaacctggcggcagcgcaaaagatg

SEQ ID NO: 217188 - DNA, 103 bp, Artificial Sequence
  Synthetic Polynucleotide
taatacgactcactataggggacccctcatgccctcccgaccaccaactcaacagaggagagagttgatggtcgggaggaacctggcggcagcgcaaaagatg

SEQ ID NO: 217189 - DNA, 103 bp, Artificial Sequence
  Synthetic Polynucleotide
taatacgactcactatagggtagctttgctggtttccgtggtaactgcttaacagaggagaaagcagatgccacggaaaaacctggcggcagcgcaaaagatg

SEQ ID NO: 217190 - DNA, 103 bp, Artificial Sequence
  Synthetic Polynucleotide
taatacgactcactatagggggaggctgtggggttcctgtagtcacggggaacagaggagaccccgtatgtacaggaacaacctggcggcagcgcaaaagatg

SEQ ID NO: 217191 - DNA, 103 bp, Artificial Sequence
  Synthetic Polynucleotide
taatacgactcactataggggaaggggaccgacccctcatgccctcccgaaacagaggagatcgggaatgcatgaggggaacctggcggcagcgcaaaagatg

SEQ ID NO: 217192 - DNA, 103 bp, Artificial Sequence
  Synthetic Polynucleotide
taatacgactcactatagggatgatattgagaaggggaccgacccctcataacagaggagaatgaggatgcggtcccctaacctggcggcagcgcaaaagatg

SEQ ID NO: 217193 - DNA, 103 bp, Artificial Sequence
  Synthetic Polynucleotide
taatacgactcactatagggctgcaaagtcatgatattgagaaggggaccaacagaggagaggtcccatgctcaatatcaacctggcggcagcgcaaaagatg

SEQ ID NO: 217194 - DNA, 103 bp, Artificial Sequence
  Synthetic Polynucleotide
taatacgactcactatagggttcaatttttctgcaaagtcatgatattgaaacagaggagatcaataatgtgactttgcaacctggcggcagcgcaaaagatg

SEQ ID NO: 217195 - DNA, 103 bp, Artificial Sequence
  Synthetic Polynucleotide
taatacgactcactatagggaggagacattttcaatttttctgcaaagtcaacagaggagagactttatggaaaaattgaacctggcggcagcgcaaaagatg

SEQ ID NO: 217196 - DNA, 103 bp, Artificial Sequence
  Synthetic Polynucleotide
taatacgactcactatagggtgctccgcccaggagacattttcaatttttaacagaggagaaaaaatatgaaatgtctcaacctggcggcagcgcaaaagatg

SEQ ID NO: 217197 - DNA, 103 bp, Artificial Sequence
  Synthetic Polynucleotide
taatacgactcactatagggcctgggcctctgctccgcccaggagacattaacagaggagaaatgtcatgtgggcggagaacctggcggcagcgcaaaagatg

SEQ ID NO: 217198 - DNA, 103 bp, Artificial Sequence
  Synthetic Polynucleotide
taatacgactcactatagggagggtctccccctgggcctctgctccgcccaacagaggagagggcggatgagaggcccaaacctggcggcagcgcaaaagatg

SEQ ID NO: 217199 - DNA, 103 bp, Artificial Sequence
  Synthetic Polynucleotide
taatacgactcactatagggtcatgtgatgagggtctccccctgggcctcaacagaggagagaggccatgggggagaccaacctggcggcagcgcaaaagatg

SEQ ID NO: 217200 - DNA, 103 bp, Artificial Sequence
  Synthetic Polynucleotide
taatacgactcactatagggatgtgtggattcatgtgatgagggtctcccaacagaggagagggagaatgtcatcacataacctggcggcagcgcaaaagatg

SEQ ID NO: 217201 - DNA, 103 bp, Artificial Sequence
  Synthetic Polynucleotide
taatacgactcactatagggccttcgctgaggaggctgtggggttcctgtaacagaggagaacaggaatgccacagcctaacctggcggcagcgcaaaagatg

SEQ ID NO: 217202 - DNA, 103 bp, Artificial Sequence
  Synthetic Polynucleotide
taatacgactcactatagggtgaaaaggtcatgtgtggattcatgtgatgaacagaggagacatcacatgaatccacacaacctggcggcagcgcaaaagatg

SEQ ID NO: 217203 - DNA, 103 bp, Artificial Sequence
  Synthetic Polynucleotide
taatacgactcactatagggtagccctctctgaaaaggtcatgtgtggataacagaggagaatccacatgtgaccttttaacctggcggcagcgcaaaagatg

SEQ ID NO: 217204 - DNA, 103 bp, Artificial Sequence
  Synthetic Polynucleotide
taatacgactcactataggggaactccggttagccctctctgaaaaggtcaacagaggagagaccttatgagagagggcaacctggcggcagcgcaaaagatg

SEQ ID NO: 217205 - DNA, 103 bp, Artificial Sequence
  Synthetic Polynucleotide
taatacgactcactatagggagtgtgtaaagaactccggttagccctctcaacagaggagagagaggatgaaccggagtaacctggcggcagcgcaaaagatg

SEQ ID NO: 217206 - DNA, 103 bp, Artificial Sequence
  Synthetic Polynucleotide
taatacgactcactataggggagaaaagggagtgtgtaaagaactccggtaacagaggagaaccggaatgctttacacaaacctggcggcagcgcaaaagatg

SEQ ID NO: 217207 - DNA, 103 bp, Artificial Sequence
  Synthetic Polynucleotide
taatacgactcactatagggtctgagttgggagaaaagggagtgtgtaaaaacagaggagatttacaatgtcccttttcaacctggcggcagcgcaaaagatg

SEQ ID NO: 217208 - DNA, 103 bp, Artificial Sequence
  Synthetic Polynucleotide
taatacgactcactatagggggccagggtttctgagttgggagaaaagggaacagaggagaccctttatgcccaactcaaacctggcggcagcgcaaaagatg

SEQ ID NO: 217209 - DNA, 103 bp, Artificial Sequence
  Synthetic Polynucleotide
taatacgactcactataggggataagcagaggccagggtttctgagttggaacagaggagaccaactatgaaaccctggaacctggcggcagcgcaaaagatg

SEQ ID NO: 217210 - DNA, 103 bp, Artificial Sequence
  Synthetic Polynucleotide
taatacgactcactataggggtatttgcatgataagcagaggccagggttaacagaggagaaaccctatgctctgcttaaacctggcggcagcgcaaaagatg

SEQ ID NO: 217211 - DNA, 103 bp, Artificial Sequence
  Synthetic Polynucleotide
taatacgactcactatagggatgagcccgagtatttgcatgataagcagaaacagaggagatctgctatgcatgcaaataacctggcggcagcgcaaaagatg

SEQ ID NO: 217212 - DNA, 103 bp, Artificial Sequence
  Synthetic Polynucleotide
taatacgactcactataggggcccagaaggccttcgctgaggaggctgtgaacagaggagacacagcatgctcagcgaaaacctggcggcagcgcaaaagatg

SEQ ID NO: 217213 - DNA, 103 bp, Artificial Sequence
  Synthetic Polynucleotide
taatacgactcactatagggccccataagcatgagcccgagtatttgcataacagaggagaatgcaaatgctcgggctcaacctggcggcagcgcaaaagatg

SEQ ID NO: 217214 - DNA, 103 bp, Artificial Sequence
  Synthetic Polynucleotide
taatacgactcactataggggcgttagggtccccataagcatgagcccgaaacagaggagatcgggcatgtgcttatggaacctggcggcagcgcaaaagatg

SEQ ID NO: 217215 - DNA, 103 bp, Artificial Sequence
  Synthetic Polynucleotide
taatacgactcactatagggattcaaacctgcgttagggtccccataagcaacagaggagagcttatatggaccctaacaacctggcggcagcgcaaaagatg

SEQ ID NO: 217216 - DNA, 103 bp, Artificial Sequence
  Synthetic Polynucleotide
taatacgactcactataggggcagctgagaattcaaacctgcgttagggtaacagaggagaaccctaatgcaggtttgaaacctggcggcagcgcaaaagatg

SEQ ID NO: 217217 - DNA, 103 bp, Artificial Sequence
  Synthetic Polynucleotide
taatacgactcactatagggctcttataatgcagctgagaattcaaacctaacagaggagaaggtttatgttctcagctaacctggcggcagcgcaaaagatg

SEQ ID NO: 217218 - DNA, 103 bp, Artificial Sequence
  Synthetic Polynucleotide
taatacgactcactataggggtacatctgtctcttataatgcagctgagaaacagaggagatctcagatgcattataagaacctggcggcagcgcaaaagatg

SEQ ID NO: 217219 - DNA, 103 bp, Artificial Sequence
  Synthetic Polynucleotide
taatacgactcactataggggttgctgttggtacatctgtctcttataataacagaggagaattataatggacagatgtaacctggcggcagcgcaaaagatg

SEQ ID NO: 217220 - DNA, 103 bp, Artificial Sequence
  Synthetic Polynucleotide
taatacgactcactatagggtactcctctggttgctgttggtacatctgtaacagaggagaacagatatgccaacagcaaacctggcggcagcgcaaaagatg

SEQ ID NO: 217221 - DNA, 103 bp, Artificial Sequence
  Synthetic Polynucleotide
taatacgactcactatagggccagtctttatactcctctggttgctgttgaacagaggagacaacagatgccagaggagaacctggcggcagcgcaaaagatg

SEQ ID NO: 217222 - DNA, 103 bp, Artificial Sequence
  Synthetic Polynucleotide
taatacgactcactatagggaaccgctgctccagtctttatactcctctgaacagaggagacagaggatgataaagactaacctggcggcagcgcaaaagatg

SEQ ID NO: 217223 - DNA, 103 bp, Artificial Sequence
  Synthetic Polynucleotide
taatacgactcactatagggctctgcacaggcccagaaggccttcgctgaaacagaggagatcagcgatggccttctggaacctggcggcagcgcaaaagatg

SEQ ID NO: 217224 - DNA, 103 bp, Artificial Sequence
  Synthetic Polynucleotide
taatacgactcactatagggccctgagcagaaccgctgctccagtctttaaacagaggagataaagaatggagcagcggaacctggcggcagcgcaaaagatg

SEQ ID NO: 217225 - DNA, 103 bp, Artificial Sequence
  Synthetic Polynucleotide
taatacgactcactatagggagcaattactccctgagcagaaccgctgctaacagaggagaagcagcatgtctgctcagaacctggcggcagcgcaaaagatg

SEQ ID NO: 217226 - DNA, 103 bp, Artificial Sequence
  Synthetic Polynucleotide
taatacgactcactataggggctgtgctgcagcaattactccctgagcagaacagaggagactgctcatggagtaattgaacctggcggcagcgcaaaagatg

SEQ ID NO: 217227 - DNA, 103 bp, Artificial Sequence
  Synthetic Polynucleotide
taatacgactcactatagggtcctgcctgtgctgtgctgcagcaattactaacagaggagaagtaatatgtgcagcacaaacctggcggcagcgcaaaagatg

SEQ ID NO: 217228 - DNA, 103 bp, Artificial Sequence
  Synthetic Polynucleotide
taatacgactcactatagggccgtggcccctcctgcctgtgctgtgctgcaacagaggagagcagcaatgcacaggcagaacctggcggcagcgcaaaagatg

SEQ ID NO: 217229 - DNA, 103 bp, Artificial Sequence
  Synthetic Polynucleotide
taatacgactcactatagggttggactcttccgtggcccctcctgcctgtaacagaggagaacaggcatgaggggccacaacctggcggcagcgcaaaagatg

SEQ ID NO: 217230 - DNA, 103 bp, Artificial Sequence
  Synthetic Polynucleotide
taatacgactcactatagggtgctgctgccttggactcttccgtggccccaacagaggagaggggccatggaagagtccaacctggcggcagcgcaaaagatg

SEQ ID NO: 217231 - DNA, 103 bp, Artificial Sequence
  Synthetic Polynucleotide
taatacgactcactataggggtcaagaaactgctgctgccttggactcttaacagaggagaaagagtatgaggcagcagaacctggcggcagcgcaaaagatg

SEQ ID NO: 217232 - DNA, 103 bp, Artificial Sequence
  Synthetic Polynucleotide
taatacgactcactatagggtccgtactctgtcaagaaactgctgctgccaacagaggagaggcagcatgagtttcttgaacctggcggcagcgcaaaagatg

SEQ ID NO: 217233 - DNA, 103 bp, Artificial Sequence
  Synthetic Polynucleotide
taatacgactcactatagggttcagagggctccgtactctgtcaagaaacaacagaggagagtttctatgcagagtacgaacctggcggcagcgcaaaagatg

SEQ ID NO: 217234 - DNA, 103 bp, Artificial Sequence
  Synthetic Polynucleotide
taatacgactcactataggggggtccatagctctgcacaggcccagaaggaacagaggagaccttctatgcctgtgcagaacctggcggcagcgcaaaagatg

SEQ ID NO: 217235 - DNA, 103 bp, Artificial Sequence
  Synthetic Polynucleotide
taatacgactcactatagggtttgtcatttttcagagggctccgtactctaacagaggagaagagtaatgagccctctgaacctggcggcagcgcaaaagatg

SEQ ID NO: 217236 - DNA, 103 bp, Artificial Sequence
  Synthetic Polynucleotide
taatacgactcactatagggtcataccatctttgtcatttttcagagggcaacagaggagagccctcatgaaaatgacaaacctggcggcagcgcaaaagatg

SEQ ID NO: 217237 - DNA, 103 bp, Artificial Sequence
  Synthetic Polynucleotide
taatacgactcactataggggggccatacatcataccatctttgtcatttaacagaggagaaaatgaatgagatggtataacctggcggcagcgcaaaagatg

SEQ ID NO: 217238 - DNA, 103 bp, Artificial Sequence
  Synthetic Polynucleotide
taatacgactcactatagggccccactggtgggccatacatcataccatcaacagaggagagatggtatgatgtatggcaacctggcggcagcgcaaaagatg

SEQ ID NO: 217239 - DNA, 103 bp, Artificial Sequence
  Synthetic Polynucleotide
taatacgactcactatagggcatggtaagtccccactggtgggccatacaaacagaggagatgtatgatgcaccagtggaacctggcggcagcgcaaaagatg

SEQ ID NO: 217240 - DNA, 103 bp, Artificial Sequence
  Synthetic Polynucleotide
taatacgactcactataggggcactggggtcatggtaagtccccactggtaacagaggagaaccagtatggacttaccaaacctggcggcagcgcaaaagatg

SEQ ID NO: 217241 - DNA, 103 bp, Artificial Sequence
  Synthetic Polynucleotide
taatacgactcactatagggagcctcctgggcactggggtcatggtaagtaacagaggagaacttacatggaccccagtaacctggcggcagcgcaaaagatg

SEQ ID NO: 217242 - DNA, 103 bp, Artificial Sequence
  Synthetic Polynucleotide
taatacgactcactatagggggcagcgcccagcctcctgggcactggggtaacagaggagaaccccaatgcccaggaggaacctggcggcagcgcaaaagatg

SEQ ID NO: 217243 - DNA, 103 bp, Artificial Sequence
  Synthetic Polynucleotide
taatacgactcactatagggctagacattaggcagcgcccagcctcctggaacagaggagaccaggaatgtgggcgctgaacctggcggcagcgcaaaagatg

SEQ ID NO: 217244 - DNA, 103 bp, Artificial Sequence
  Synthetic Polynucleotide
taatacgactcactatagggcagaccatcactagacattaggcagcgcccaacagaggagagggcgcatgctaatgtctaacctggcggcagcgcaaaagatg

SEQ ID NO: 217245 - DNA, 103 bp, Artificial Sequence
  Synthetic Polynucleotide
taatacgactcactatagggtcccctgggggggtccatagctctgcacagaacagaggagactgtgcatggctatggacaacctggcggcagcgcaaaagatg

SEQ ID NO: 217246 - DNA, 103 bp, Artificial Sequence
  Synthetic Polynucleotide
taatacgactcactatagggccttgttaggcagaccatcactagacattaaacagaggagataatgtatggtgatggtcaacctggcggcagcgcaaaagatg

SEQ ID NO: 217247 - DNA, 103 bp, Artificial Sequence
  Synthetic Polynucleotide
taatacgactcactatagggaattccatgcccttgttaggcagaccatcaaacagaggagatgatggatggcctaacaaaacctggcggcagcgcaaaagatg

SEQ ID NO: 217248 - DNA, 103 bp, Artificial Sequence
  Synthetic Polynucleotide
taatacgactcactataggggccatgctttaattccatgcccttgttaggaacagaggagacctaacatgggcatggaaaacctggcggcagcgcaaaagatg

SEQ ID NO: 217249 - DNA, 103 bp, Artificial Sequence
  Synthetic Polynucleotide
taatacgactcactatagggacttctgggagccatgctttaattccatgcaacagaggagagcatggatgtaaagcatgaacctggcggcagcgcaaaagatg

SEQ ID NO: 217250 - DNA, 103 bp, Artificial Sequence
  Synthetic Polynucleotide
taatacgactcactataggggattcttgtaacttctgggagccatgctttaacagaggagaaaagcaatgctcccagaaaacctggcggcagcgcaaaagatg

SEQ ID NO: 217251 - DNA, 103 bp, Artificial Sequence
  Synthetic Polynucleotide
taatacgactcactatagggatcccaacaggattcttgtaacttctgggaaacagaggagatcccagatgttacaagaaaacctggcggcagcgcaaaagatg

SEQ ID NO: 217252 - DNA, 103 bp, Artificial Sequence
  Synthetic Polynucleotide
taatacgactcactataggggccgagaaagatcccaacaggattcttgtaaacagaggagatacaagatgcctgttgggaacctggcggcagcgcaaaagatg

SEQ ID NO: 217253 - DNA, 103 bp, Artificial Sequence
  Synthetic Polynucleotide
taatacgactcactatagggggagaagtttgccgagaaagatcccaacagaacagaggagactgttgatgtctttctcgaacctggcggcagcgcaaaagatg

SEQ ID NO: 217254 - DNA, 103 bp, Artificial Sequence
  Synthetic Polynucleotide
taatacgactcactataggggcttttggctggagaagtttgccgagaaagaacagaggagactttctatgcaaacttctaacctggcggcagcgcaaaagatg

SEQ ID NO: 217255 - DNA, 103 bp, Artificial Sequence
  Synthetic Polynucleotide
taatacgactcactataggggaggaccgctgcttttggctggagaagtttaacagaggagaaaacttatgcagccaaaaaacctggcggcagcgcaaaagatg

SEQ ID NO: 217256 - DNA, 103 bp, Artificial Sequence
  Synthetic Polynucleotide
taatacgactcactatagggccaaagctgctcccctgggggggtccatagaacagaggagactatggatgcccccagggaacctggcggcagcgcaaaagatg

SEQ ID NO: 217257 - DNA, 103 bp, Artificial Sequence
  Synthetic Polynucleotide
taatacgactcactataggggacattcctggaggaccgctgcttttggctaacagaggagaagccaaatgcagcggtccaacctggcggcagcgcaaaagatg

SEQ ID NO: 217258 - DNA, 103 bp, Artificial Sequence
  Synthetic Polynucleotide
taatacgactcactatagggtttttgactggacattcctggaggaccgctaacagaggagaagcggtatgccaggaatgaacctggcggcagcgcaaaagatg

SEQ ID NO: 217259 - DNA, 103 bp, Artificial Sequence
  Synthetic Polynucleotide
taatacgactcactataggggcccataccttttttgactggacattcctgaacagaggagacaggaaatgccagtcaaaaacctggcggcagcgcaaaagatg

SEQ ID NO: 217260 - DNA, 103 bp, Artificial Sequence
  Synthetic Polynucleotide
taatacgactcactatagggtcatggggcggcccataccttttttgactgaacagaggagacagtcaatgaaggtatggaacctggcggcagcgcaaaagatg

SEQ ID NO: 217261 - DNA, 103 bp, Artificial Sequence
  Synthetic Polynucleotide
taatacgactcactatagggtccatcagtctcatggggcggcccatacctaacagaggagaaggtatatgccgccccataacctggcggcagcgcaaaagatg

SEQ ID NO: 217262 - DNA, 103 bp, Artificial Sequence
  Synthetic Polynucleotide
taatacgactcactatagggctagtccatgtccatcagtctcatggggcgaacagaggagacgccccatgagactgatgaacctggcggcagcgcaaaagatg

SEQ ID NO: 217263 - DNA, 103 bp, Artificial Sequence
  Synthetic Polynucleotide
taatacgactcactataggggtagcctcagctagtccatgtccatcagtcaacagaggagagactgaatgacatggactaacctggcggcagcgcaaaagatg

SEQ ID NO: 217264 - DNA, 103 bp, Artificial Sequence
  Synthetic Polynucleotide
taatacgactcactatagggggatgactgtgtagcctcagctagtccatgaacagaggagacatggaatggctgaggctaacctggcggcagcgcaaaagatg

SEQ ID NO: 217265 - DNA, 103 bp, Artificial Sequence
  Synthetic Polynucleotide
taatacgactcactatagggtaccaggtttggatgactgtgtagcctcagaacagaggagactgaggatgcacagtcataacctggcggcagcgcaaaagatg

SEQ ID NO: 217266 - DNA, 103 bp, Artificial Sequence
  Synthetic Polynucleotide
taatacgactcactatagggagcataacactaccaggtttggatgactgtaacagaggagaacagtcatgcaaacctggaacctggcggcagcgcaaaagatg

SEQ ID NO: 217267 - DNA, 103 bp, Artificial Sequence
  Synthetic Polynucleotide
taatacgactcactatagggatactgattgccaaagctgctcccctggggaacagaggagaccccagatgagcagctttaacctggcggcagcgcaaaagatg

SEQ ID NO: 217268 - DNA, 103 bp, Artificial Sequence
  Synthetic Polynucleotide
taatacgactcactatagggtggaagtctcagcataacactaccaggtttaacagaggagaaaacctatgagtgttatgaacctggcggcagcgcaaaagatg

SEQ ID NO: 217269 - DNA, 103 bp, Artificial Sequence
  Synthetic Polynucleotide
taatacgactcactatagggcctcctggcctggaagtctcagcataacacaacagaggagagtgttaatgtgagacttcaacctggcggcagcgcaaaagatg

SEQ ID NO: 217270 - DNA, 103 bp, Artificial Sequence
  Synthetic Polynucleotide
taatacgactcactataggggaagaatgatcctcctggcctggaagtctcaacagaggagagagactatgaggccaggaaacctggcggcagcgcaaaagatg

SEQ ID NO: 217271 - DNA, 103 bp, Artificial Sequence
  Synthetic Polynucleotide
taatacgactcactatagggggggttttgagaagaatgatcctcctggccaacagaggagaggccagatggatcattctaacctggcggcagcgcaaaagatg

SEQ ID NO: 217272 - DNA, 103 bp, Artificial Sequence
  Synthetic Polynucleotide
taatacgactcactatagggtcatgattaaggggttttgagaagaatgataacagaggagaatcattatgctcaaaaccaacctggcggcagcgcaaaagatg

SEQ ID NO: 217273 - DNA, 103 bp, Artificial Sequence
  Synthetic Polynucleotide
taatacgactcactatagggacacgcctcctcatgattaaggggttttgaaacagaggagatcaaaaatgcttaatcataacctggcggcagcgcaaaagatg

SEQ ID NO: 217274 - DNA, 103 bp, Artificial Sequence
  Synthetic Polynucleotide
taatacgactcactatagggaaaagaacgaacacgcctcctcatgattaaaacagaggagattaatcatgaggaggcgtaacctggcggcagcgcaaaagatg

SEQ ID NO: 217275 - DNA, 103 bp, Artificial Sequence
  Synthetic Polynucleotide
taatacgactcactatagggtgggagagataaaagaacgaacacgcctccaacagaggagaggaggcatgttcgttcttaacctggcggcagcgcaaaagatg

SEQ ID NO: 217276 - DNA, 103 bp, Artificial Sequence
  Synthetic Polynucleotide
taatacgactcactatagggttactgggaatgggagagataaaagaacgaaacagaggagatcgttcatgtatctctccaacctggcggcagcgcaaaagatg

SEQ ID NO: 217277 - DNA, 103 bp, Artificial Sequence
  Synthetic Polynucleotide
taatacgactcactatagggtgactgtctcttactgggaatgggagagataacagaggagaatctctatgattcccagtaacctggcggcagcgcaaaagatg

SEQ ID NO: 217278 - DNA, 103 bp, Artificial Sequence
  Synthetic Polynucleotide
taatacgactcactatagggcctcactcccatactgattgccaaagctgcaacagaggagagcagctatggcaatcagtaacctggcggcagcgcaaaagatg

SEQ ID NO: 217279 - DNA, 103 bp, Artificial Sequence
  Synthetic Polynucleotide
taatacgactcactatagggttacatcttgtgactgtctcttactgggaaaacagaggagattcccaatgagagacagtaacctggcggcagcgcaaaagatg

SEQ ID NO: 217280 - DNA, 103 bp, Artificial Sequence
  Synthetic Polynucleotide
taatacgactcactatagggctactgttctttacatcttgtgactgtctcaacagaggagagagacaatgacaagatgtaacctggcggcagcgcaaaagatg

SEQ ID NO: 217281 - DNA, 103 bp, Artificial Sequence
  Synthetic Polynucleotide
taatacgactcactatagggatcttcagtgctactgttctttacatcttgaacagaggagacaagatatgaagaacagtaacctggcggcagcgcaaaagatg

SEQ ID NO: 217282 - DNA, 103 bp, Artificial Sequence
  Synthetic Polynucleotide
taatacgactcactatagggggcgacctttatcttcagtgctactgttctaacagaggagaagaacaatggcactgaagaacctggcggcagcgcaaaagatg

SEQ ID NO: 217283 - DNA, 103 bp, Artificial Sequence
  Synthetic Polynucleotide
taatacgactcactataggggagtgaaggaggcgacctttatcttcagtgaacagaggagacactgaatgtaaaggtcgaacctggcggcagcgcaaaagatg

SEQ ID NO: 217284 - DNA, 103 bp, Artificial Sequence
  Synthetic Polynucleotide
taatacgactcactatagggttcttttgatgagtgaaggaggcgacctttaacagaggagaaaaggtatgctccttcacaacctggcggcagcgcaaaagatg

SEQ ID NO: 217285 - DNA, 103 bp, Artificial Sequence
  Synthetic Polynucleotide
taatacgactcactatagggtatcagcgccttcttttgatgagtgaaggaaacagaggagatccttcatgcatcaaaagaacctggcggcagcgcaaaagatg

SEQ ID NO: 217286 - DNA, 103 bp, Artificial Sequence
  Synthetic Polynucleotide
taatacgactcactatagggttgaatgctttatcagcgccttcttttgataacagaggagaatcaaaatgaggcgctgaaacctggcggcagcgcaaaagatg

SEQ ID NO: 217287 - DNA, 103 bp, Artificial Sequence
  Synthetic Polynucleotide
taatacgactcactatagggggcataggaattgaatgctttatcagcgccaacagaggagaggcgctatgaaagcattcaacctggcggcagcgcaaaagatg

SEQ ID NO: 217288 - DNA, 103 bp, Artificial Sequence
  Synthetic Polynucleotide
taatacgactcactataggggagaaagatgggcataggaattgaatgcttaacagaggagaaagcatatgattcctatgaacctggcggcagcgcaaaagatg

SEQ ID NO: 217289 - DNA, 103 bp, Artificial Sequence
  Synthetic Polynucleotide
taatacgactcactatagggcccacatgaccctcactcccatactgattgaacagaggagacaatcaatgtgggagtgaaacctggcggcagcgcaaaagatg

SEQ ID NO: 217290 - DNA, 103 bp, Artificial Sequence
  Synthetic Polynucleotide
taatacgactcactatagggtcctgactgtgagaaagatgggcataggaaaacagaggagattcctaatgccatctttcaacctggcggcagcgcaaaagatg

SEQ ID NO: 217291 - DNA, 103 bp, Artificial Sequence
  Synthetic Polynucleotide
taatacgactcactatagggagacttgatatcctgactgtgagaaagatgaacagaggagacatcttatgcacagtcagaacctggcggcagcgcaaaagatg

SEQ ID NO: 217292 - DNA, 103 bp, Artificial Sequence
  Synthetic Polynucleotide
taatacgactcactatagggtcttagggatagacttgatatcctgactgtaacagaggagaacagtcatgatatcaagtaacctggcggcagcgcaaaagatg

SEQ ID NO: 217293 - DNA, 103 bp, Artificial Sequence
  Synthetic Polynucleotide
taatacgactcactataggggaggaatctctcttagggatagacttgataaacagaggagatatcaaatgtatccctaaaacctggcggcagcgcaaaagatg

SEQ ID NO: 217294 - DNA, 103 bp, Artificial Sequence
  Synthetic Polynucleotide
taatacgactcactatagggaaggtccttggaggaatctctcttagggataacagaggagaatccctatgagagattccaacctggcggcagcgcaaaagatg

SEQ ID NO: 217295 - DNA, 103 bp, Artificial Sequence
  Synthetic Polynucleotide
taatacgactcactatagggctggacttggaaggtccttggaggaatctcaacagaggagagagattatgccaaggaccaacctggcggcagcgcaaaagatg

SEQ ID NO: 217296 - DNA, 103 bp, Artificial Sequence
  Synthetic Polynucleotide
taatacgactcactatagggtttctactatctggacttggaaggtccttgaacagaggagacaaggaatgtccaagtccaacctggcggcagcgcaaaagatg

SEQ ID NO: 217297 - DNA, 103 bp, Artificial Sequence
  Synthetic Polynucleotide
taatacgactcactatagggagcagggcagtttctactatctggacttggaacagaggagaccaagtatggatagtagaaacctggcggcagcgcaaaagatg

SEQ ID NO: 217298 - DNA, 103 bp, Artificial Sequence
  Synthetic Polynucleotide
taatacgactcactatagggtgagggtaacagcagggcagtttctactataacagaggagaatagtaatgactgccctgaacctggcggcagcgcaaaagatg

SEQ ID NO: 217299 - DNA, 103 bp, Artificial Sequence
  Synthetic Polynucleotide
taatacgactcactataggggcagggcttgtgagggtaacagcagggcagaacagaggagactgcccatgtgttaccctaacctggcggcagcgcaaaagatg

SEQ ID NO: 217300 - DNA, 103 bp, Artificial Sequence
  Synthetic Polynucleotide
taatacgactcactatagggctcctgtgggtagctttgctggtttccgtgaacagaggagacacggaatgcagcaaagcaacctggcggcagcgcaaaagatg

SEQ ID NO: 217301 - DNA, 103 bp, Artificial Sequence
  Synthetic Polynucleotide
taatacgactcactatagggttgaaactggcccacatgaccctcactcccaacagaggagagggagtatgggtcatgtgaacctggcggcagcgcaaaagatg

SEQ ID NO: 217302 - DNA, 103 bp, Artificial Sequence
  Synthetic Polynucleotide
taatacgactcactatagggtttggtcttagcagggcttgtgagggtaacaacagaggagagttaccatgacaagccctaacctggcggcagcgcaaaagatg

SEQ ID NO: 217303 - DNA, 103 bp, Artificial Sequence
  Synthetic Polynucleotide
taatacgactcactatagggggggcagtattttggtcttagcagggcttgaacagaggagacaagccatgctaagaccaaacctggcggcagcgcaaaagatg

SEQ ID NO: 217304 - DNA, 103 bp, Artificial Sequence
  Synthetic Polynucleotide
taatacgactcactatagggcctttccgtgggggcagtattttggtcttaaacagaggagataagacatgaatactgccaacctggcggcagcgcaaaagatg

SEQ ID NO: 217305 - DNA, 103 bp, Artificial Sequence
  Synthetic Polynucleotide
taatacgactcactatagggcaatccccgtcctttccgtgggggcagtataacagaggagaatactgatgccacggaaaaacctggcggcagcgcaaaagatg

SEQ ID NO: 217306 - DNA, 103 bp, Artificial Sequence
  Synthetic Polynucleotide
taatacgactcactatagggcttccaatttcaatccccgtcctttccgtgaacagaggagacacggaatggacggggataacctggcggcagcgcaaaagatg

SEQ ID NO: 217307 - DNA, 103 bp, Artificial Sequence
  Synthetic Polynucleotide
taatacgactcactatagggtgaactatagcttccaatttcaatccccgtaacagaggagaacggggatggaaattggaaacctggcggcagcgcaaaagatg

SEQ ID NO: 217308 - DNA, 103 bp, Artificial Sequence
  Synthetic Polynucleotide
taatacgactcactatagggtgtaatcttctgaactatagcttccaatttaacagaggagaaaattgatggctatagttaacctggcggcagcgcaaaagatg

SEQ ID NO: 217309 - DNA, 103 bp, Artificial Sequence
  Synthetic Polynucleotide
taatacgactcactatagggtatttggggatgtaatcttctgaactatagaacagaggagactatagatgagaagattaaacctggcggcagcgcaaaagatg

SEQ ID NO: 217310 - DNA, 103 bp, Artificial Sequence
  Synthetic Polynucleotide
taatacgactcactatagggctcctcctaatatttggggatgtaatcttcaacagaggagagaagatatgatccccaaaaacctggcggcagcgcaaaagatg

SEQ ID NO: 217311 - DNA, 103 bp, Artificial Sequence
  Synthetic Polynucleotide
taatacgactcactatagggcgaagatgcgctcctcctaatatttggggaaacagaggagatccccaatgattaggaggaacctggcggcagcgcaaaagatg

SEQ ID NO: 217312 - DNA, 103 bp, Artificial Sequence
  Synthetic Polynucleotide
taatacgactcactatagggagtgctgtgcttgaaactggcccacatgacaacagaggagagtcatgatggccagtttcaacctggcggcagcgcaaaagatg

SEQ ID NO: 217313 - DNA, 103 bp, Artificial Sequence
  Synthetic Polynucleotide
taatacgactcactatagggccgcactgttcgaagatgcgctcctcctaaaacagaggagattaggaatggcgcatcttaacctggcggcagcgcaaaagatg

SEQ ID NO: 217314 - DNA, 103 bp, Artificial Sequence
  Synthetic Polynucleotide
taatacgactcactatagggcccccagcctccgcactgttcgaagatgcgaacagaggagacgcatcatggaacagtgcaacctggcggcagcgcaaaagatg

SEQ ID NO: 217315 - DNA, 103 bp, Artificial Sequence
  Synthetic Polynucleotide
taatacgactcactatagggaaccgtgtctcccccagcctccgcactgttaacagaggagaaacagtatggaggctgggaacctggcggcagcgcaaaagatg

SEQ ID NO: 217316 - DNA, 103 bp, Artificial Sequence
  Synthetic Polynucleotide
taatacgactcactatagggcatcaagcgtaaccgtgtctcccccagcctaacagaggagaaggctgatggagacacggaacctggcggcagcgcaaaagatg

SEQ ID NO: 217317 - DNA, 103 bp, Artificial Sequence
  Synthetic Polynucleotide
taatacgactcactataggggacagtatatcatcaagcgtaaccgtgtctaacagaggagaagacacatgtacgcttgaaacctggcggcagcgcaaaagatg

SEQ ID NO: 217318 - DNA, 103 bp, Artificial Sequence
  Synthetic Polynucleotide
taatacgactcactatagggactcttcaaagacagtatatcatcaagcgtaacagaggagaacgcttatggatatactgaacctggcggcagcgcaaaagatg

SEQ ID NO: 217319 - DNA, 103 bp, Artificial Sequence
  Synthetic Polynucleotide
taatacgactcactatagggcaggaggaccactcttcaaagacagtatataacagaggagaatatacatgctttgaagaaacctggcggcagcgcaaaagatg

SEQ ID NO: 217320 - DNA, 103 bp, Artificial Sequence
  Synthetic Polynucleotide
taatacgactcactatagggctcccaccttcaggaggaccactcttcaaaaacagaggagatttgaaatgtggtcctccaacctggcggcagcgcaaaagatg

SEQ ID NO: 217321 - DNA, 103 bp, Artificial Sequence
  Synthetic Polynucleotide
taatacgactcactatagggaacagcaacactcccaccttcaggaggaccaacagaggagaggtcctatggaaggtgggaacctggcggcagcgcaaaagatg

SEQ ID NO: 217322 - DNA, 103 bp, Artificial Sequence
  Synthetic Polynucleotide
taatacgactcactatagggcagcatcctgaacagcaacactcccaccttaacagaggagaaaggtgatggtgttgctgaacctggcggcagcgcaaaagatg

SEQ ID NO: 217323 - DNA, 103 bp, Artificial Sequence
  Synthetic Polynucleotide
taatacgactcactatagggccaaggccagagtgctgtgcttgaaactggaacagaggagaccagttatgagcacagcaaacctggcggcagcgcaaaagatg

SEQ ID NO: 217324 - DNA, 103 bp, Artificial Sequence
  Synthetic Polynucleotide
taatacgactcactatagggttctctatgtcagcatcctgaacagcaacaaacagaggagatgttgcatgtcaggatgcaacctggcggcagcgcaaaagatg

SEQ ID NO: 217325 - DNA, 103 bp, Artificial Sequence
  Synthetic Polynucleotide
taatacgactcactatagggaccttttctcttctctatgtcagcatcctgaacagaggagacaggatatggacatagagaacctggcggcagcgcaaaagatg

SEQ ID NO: 217326 - DNA, 103 bp, Artificial Sequence
  Synthetic Polynucleotide
taatacgactcactatagggaagccacctcaccttttctcttctctatgtaacagaggagaacatagatgagagaaaagaacctggcggcagcgcaaaagatg

SEQ ID NO: 217327 - DNA, 103 bp, Artificial Sequence
  Synthetic Polynucleotide
taatacgactcactatagggactaggtccgaagccacctcaccttttctcaacagaggagagagaaaatgtgaggtggcaacctggcggcagcgcaaaagatg

SEQ ID NO: 217328 - DNA, 103 bp, Artificial Sequence
  Synthetic Polynucleotide
taatacgactcactatagggtgctggactgactaggtccgaagccacctcaacagaggagagaggtgatgtcggacctaaacctggcggcagcgcaaaagatg

SEQ ID NO: 217329 - DNA, 103 bp, Artificial Sequence
  Synthetic Polynucleotide
taatacgactcactatagggactcctggtttgctggactgactaggtccgaacagaggagacggaccatgtcagtccagaacctggcggcagcgcaaaagatg

SEQ ID NO: 217330 - DNA, 103 bp, Artificial Sequence
  Synthetic Polynucleotide
taatacgactcactatagggtctacgtgcaactcctggtttgctggactgaacagaggagacagtccatgaaaccaggaaacctggcggcagcgcaaaagatg

SEQ ID NO: 217331 - DNA, 103 bp, Artificial Sequence
  Synthetic Polynucleotide
taatacgactcactatagggaagaggtttctctacgtgcaactcctggttaacagaggagaaaccagatgttgcacgtaaacctggcggcagcgcaaaagatg

SEQ ID NO: 217332 - DNA, 103 bp, Artificial Sequence
  Synthetic Polynucleotide
taatacgactcactatagggaagaccttggaagaggtttctctacgtgcaaacagaggagatgcacgatgagaaacctcaacctggcggcagcgcaaaagatg

SEQ ID NO: 217333 - DNA, 103 bp, Artificial Sequence
  Synthetic Polynucleotide
taatacgactcactatagggcactcttctgaagaccttggaagaggtttcaacagaggagagaaaccatgtccaaggtcaacctggcggcagcgcaaaagatg

SEQ ID NO: 217334 - DNA, 103 bp, Artificial Sequence
  Synthetic Polynucleotide
taatacgactcactatagggtgacacaccgccaaggccagagtgctgtgcaacagaggagagcacagatgtctggccttaacctggcggcagcgcaaaagatg

SEQ ID NO: 217335 - DNA, 103 bp, Artificial Sequence
  Synthetic Polynucleotide
taatacgactcactataggggctgccacgccactcttctgaagaccttggaacagaggagaccaaggatgtcagaagagaacctggcggcagcgcaaaagatg

SEQ ID NO: 217336 - DNA, 103 bp, Artificial Sequence
  Synthetic Polynucleotide
taatacgactcactatagggtgtcatccacgctgccacgccactcttctgaacagaggagacagaagatgggcgtggcaaacctggcggcagcgcaaaagatg

SEQ ID NO: 217337 - DNA, 103 bp, Artificial Sequence
  Synthetic Polynucleotide
taatacgactcactataggggtcttcactttgtcatccacgctgccacgcaacagaggagagcgtggatgcgtggatgaaacctggcggcagcgcaaaagatg

SEQ ID NO: 217338 - DNA, 103 bp, Artificial Sequence
  Synthetic Polynucleotide
taatacgactcactatagggatgtgtctctgtcttcactttgtcatccacaacagaggagagtggatatgaaagtgaagaacctggcggcagcgcaaaagatg

SEQ ID NO: 217339 - DNA, 103 bp, Artificial Sequence
  Synthetic Polynucleotide
taatacgactcactatagggctgtttctgcatgtgtctctgtcttcacttaacagaggagaaagtgaatgcagagacacaacctggcggcagcgcaaaagatg

SEQ ID NO: 217340 - DNA, 103 bp, Artificial Sequence
  Synthetic Polynucleotide
taatacgactcactatagggccggcagtaactgtttctgcatgtgtctctaacagaggagaagagacatgtgcagaaacaacctggcggcagcgcaaaagatg

SEQ ID NO: 217341 - DNA, 103 bp, Artificial Sequence
  Synthetic Polynucleotide
taatacgactcactataggggggttcctttccggcagtaactgtttctgcaacagaggagagcagaaatggttactgccaacctggcggcagcgcaaaagatg

SEQ ID NO: 217342 - DNA, 103 bp, Artificial Sequence
  Synthetic Polynucleotide
taatacgactcactatagggtggcaccagggggttcctttccggcagtaaaacagaggagattactgatggaaaggaacaacctggcggcagcgcaaaagatg

SEQ ID NO: 217343 - DNA, 103 bp, Artificial Sequence
  Synthetic Polynucleotide
taatacgactcactataggggtggatgtcatggcaccagggggttcctttaacagaggagaaaaggaatgccctggtgcaacctggcggcagcgcaaaagatg

SEQ ID NO: 217344 - DNA, 103 bp, Artificial Sequence
  Synthetic Polynucleotide
taatacgactcactatagggctgtgaggttgtggatgtcatggcaccaggaacagaggagacctggtatgatgacatccaacctggcggcagcgcaaaagatg

SEQ ID NO: 217345 - DNA, 103 bp, Artificial Sequence
  Synthetic Polynucleotide
taatacgactcactataggggctgataatgtgacacaccgccaaggccagaacagaggagactggccatggcggtgtgtaacctggcggcagcgcaaaagatg

SEQ ID NO: 217346 - DNA, 103 bp, Artificial Sequence
  Synthetic Polynucleotide
taatacgactcactatagggtaccaggcttctgtgaggttgtggatgtcaaacagaggagatgacatatgcaacctcacaacctggcggcagcgcaaaagatg

SEQ ID NO: 217347 - DNA, 103 bp, Artificial Sequence
  Synthetic Polynucleotide
taatacgactcactatagggccttggttactaccaggcttctgtgaggttaacagaggagaaacctcatggaagcctggaacctggcggcagcgcaaaagatg

SEQ ID NO: 217348 - DNA, 103 bp, Artificial Sequence
  Synthetic Polynucleotide
taatacgactcactatagggatctggtctcccttggttactaccaggcttaacagaggagaaagcctatgagtaaccaaaacctggcggcagcgcaaaagatg

SEQ ID NO: 217349 - DNA, 103 bp, Artificial Sequence
  Synthetic Polynucleotide
taatacgactcactatagggccagggaaccatctggtctcccttggttacaacagaggagagtaaccatgggagaccagaacctggcggcagcgcaaaagatg

SEQ ID NO: 217350 - DNA, 103 bp, Artificial Sequence
  Synthetic Polynucleotide
taatacgactcactataggggctgttccacccagggaaccatctggtctcaacagaggagagagaccatgtggttccctaacctggcggcagcgcaaaagatg

SEQ ID NO: 217351 - DNA, 103 bp, Artificial Sequence
  Synthetic Polynucleotide
taatacgactcactataggggattaaaggtgctgttccacccagggaaccaacagaggagaggttccatgggtggaacaaacctggcggcagcgcaaaagatg

SEQ ID NO: 217352 - DNA, 103 bp, Artificial Sequence
  Synthetic Polynucleotide
taatacgactcactatagggagtctggaaagattaaaggtgctgttccacaacagaggagagtggaaatgcacctttaaaacctggcggcagcgcaaaagatg

SEQ ID NO: 217353 - DNA, 103 bp, Artificial Sequence
  Synthetic Polynucleotide
taatacgactcactatagggacattctttgagtctggaaagattaaaggtaacagaggagaacctttatgctttccagaaacctggcggcagcgcaaaagatg

SEQ ID NO: 217354 - DNA, 103 bp, Artificial Sequence
  Synthetic Polynucleotide
taatacgactcactatagggcactggaggtacattctttgagtctggaaaaacagaggagatttccaatgtcaaagaataacctggcggcagcgcaaaagatg

SEQ ID NO: 217355 - DNA, 103 bp, Artificial Sequence
  Synthetic Polynucleotide
taatacgactcactatagggccaatatgcccactggaggtacattctttgaacagaggagacaaagaatgtacctccagaacctggcggcagcgcaaaagatg

SEQ ID NO: 217356 - DNA, 103 bp, Artificial Sequence
  Synthetic Polynucleotide
taatacgactcactataggggtgtaatcctgctgataatgtgacacaccgaacagaggagacggtgtatgacattatcaaacctggcggcagcgcaaaagatg

SEQ ID NO: 217357 - DNA, 103 bp, Artificial Sequence
  Synthetic Polynucleotide
taatacgactcactataggggcctcaggggccaatatgcccactggaggtaacagaggagaacctccatggggcatattaacctggcggcagcgcaaaagatg

SEQ ID NO: 217358 - DNA, 103 bp, Artificial Sequence
  Synthetic Polynucleotide
taatacgactcactatagggcttggggtttgcctcaggggccaatatgccaacagaggagaggcataatggcccctgagaacctggcggcagcgcaaaagatg

SEQ ID NO: 217359 - DNA, 103 bp, Artificial Sequence
  Synthetic Polynucleotide
taatacgactcactatagggtctcttcagccttggggtttgcctcaggggaacagaggagacccctgatgcaaaccccaaacctggcggcagcgcaaaagatg

SEQ ID NO: 217360 - DNA, 103 bp, Artificial Sequence
  Synthetic Polynucleotide
taatacgactcactatagggtcgttctccttctcttcagccttggggtttaacagaggagaaaacccatgggctgaagaaacctggcggcagcgcaaaagatg

SEQ ID NO: 217361 - DNA, 103 bp, Artificial Sequence
  Synthetic Polynucleotide
taatacgactcactatagggcgtcactgtatcgttctccttctcttcagcaacagaggagagctgaaatgaaggagaacaacctggcggcagcgcaaaagatg

SEQ ID NO: 217362 - DNA, 103 bp, Artificial Sequence
  Synthetic Polynucleotide
taatacgactcactatagggtcggtgaaatcgtcactgtatcgttctcctaacagaggagaaggagaatgatacagtgaaacctggcggcagcgcaaaagatg

SEQ ID NO: 217363 - DNA, 103 bp, Artificial Sequence
  Synthetic Polynucleotide
taatacgactcactatagggccctcttgcttcggtgaaatcgtcactgtaaacagaggagatacagtatggatttcaccaacctggcggcagcgcaaaagatg

SEQ ID NO: 217364 - DNA, 103 bp, Artificial Sequence
  Synthetic Polynucleotide
taatacgactcactatagggtggagggaaaccctcttgcttcggtgaaataacagaggagaatttcaatgaagcaagagaacctggcggcagcgcaaaagatg

SEQ ID NO: 217365 - DNA, 103 bp, Artificial Sequence
  Synthetic Polynucleotide
taatacgactcactatagggaatatccctttggagggaaaccctcttgctaacagaggagaagcaagatggtttccctcaacctggcggcagcgcaaaagatg

SEQ ID NO: 217366 - DNA, 103 bp, Artificial Sequence
  Synthetic Polynucleotide
taatacgactcactatagggcctgatgggaaatatccctttggagggaaaaacagaggagatttcccatgaaagggataaacctggcggcagcgcaaaagatg

SEQ ID NO: 217367 - DNA, 103 bp, Artificial Sequence
  Synthetic Polynucleotide
taatacgactcactataggggaaaggcccagtgtaatcctgctgataatgaacagaggagacattatatgcaggattacaacctggcggcagcgcaaaagatg

SEQ ID NO: 217368 - DNA, 103 bp, Artificial Sequence
  Synthetic Polynucleotide
taatacgactcactatagggcttcttctttcctgatgggaaatatcccttaacagaggagaaagggaatgttcccatcaaacctggcggcagcgcaaaagatg

SEQ ID NO: 217369 - DNA, 103 bp, Artificial Sequence
  Synthetic Polynucleotide
taatacgactcactatagggtgggtctccccttcttctttcctgatgggaaacagaggagatcccatatggaaagaagaaacctggcggcagcgcaaaagatg

SEQ ID NO: 217370 - DNA, 103 bp, Artificial Sequence
  Synthetic Polynucleotide
taatacgactcactatagggacactaccaatgggtctccccttcttctttaacagaggagaaaagaaatgggggagaccaacctggcggcagcgcaaaagatg

SEQ ID NO: 217371 - DNA, 103 bp, Artificial Sequence
  Synthetic Polynucleotide
taatacgactcactatagggttgcttattcacactaccaatgggtctcccaacagaggagagggagaatgattggtagtaacctggcggcagcgcaaaagatg

SEQ ID NO: 217372 - DNA, 103 bp, Artificial Sequence
  Synthetic Polynucleotide
taatacgactcactataggggctgtttcttttgcttattcacactaccaaaacagaggagattggtaatgtgaataagcaacctggcggcagcgcaaaagatg

SEQ ID NO: 217373 - DNA, 103 bp, Artificial Sequence
  Synthetic Polynucleotide
taatacgactcactatagggggtggctgctgctgtttcttttgcttattcaacagaggagagaataaatgaaagaaacaaacctggcggcagcgcaaaagatg

SEQ ID NO: 217374 - DNA, 103 bp, Artificial Sequence
  Synthetic Polynucleotide
taatacgactcactataggggggtggaggcggtggctgctgctgtttcttaacagaggagaaagaaaatgcagcagccaaacctggcggcagcgcaaaagatg

SEQ ID NO: 217375 - DNA, 103 bp, Artificial Sequence
  Synthetic Polynucleotide
taatacgactcactatagggggggctgagggggtggaggcggtggctgctaacagaggagaagcagcatgcgcctccacaacctggcggcagcgcaaaagatg

SEQ ID NO: 217376 - DNA, 103 bp, Artificial Sequence
  Synthetic Polynucleotide
taatacgactcactatagggggtatctgtgggggctgagggggtggaggcaacagaggagagcctccatgccctcagccaacctggcggcagcgcaaaagatg

SEQ ID NO: 217377 - DNA, 103 bp, Artificial Sequence
  Synthetic Polynucleotide
taatacgactcactatagggagaaccttctggtatctgtgggggctgaggaacagaggagacctcagatgccacagataaacctggcggcagcgcaaaagatg

SEQ ID NO: 217378 - DNA, 103 bp, Artificial Sequence
  Synthetic Polynucleotide
taatacgactcactatagggtccctggagagaaaggcccagtgtaatcctaacagaggagaaggattatgctgggccttaacctggcggcagcgcaaaagatg

SEQ ID NO: 217379 - DNA, 103 bp, Artificial Sequence
  Synthetic Polynucleotide
taatacgactcactatagggctccatctgcagaaccttctggtatctgtgaacagaggagacacagaatgcagaaggttaacctggcggcagcgcaaaagatg

SEQ ID NO: 217380 - DNA, 103 bp, Artificial Sequence
  Synthetic Polynucleotide
taatacgactcactatagggggctttggctctccatctgcagaaccttctaacagaggagaagaaggatgtgcagatggaacctggcggcagcgcaaaagatg

SEQ ID NO: 217381 - DNA, 103 bp, Artificial Sequence
  Synthetic Polynucleotide
taatacgactcactatagggctgtttttttggctttggctctccatctgcaacagaggagagcagatatggagccaaagaacctggcggcagcgcaaaagatg

SEQ ID NO: 217382 - DNA, 103 bp, Artificial Sequence
  Synthetic Polynucleotide
taatacgactcactatagggtcctttgcctctgtttttttggctttggctaacagaggagaagccaaatgcaaaaaaacaacctggcggcagcgcaaaagatg

SEQ ID NO: 217383 - DNA, 103 bp, Artificial Sequence
  Synthetic Polynucleotide
taatacgactcactatagggcttctctccctcctttgcctctgtttttttaacagaggagaaaaaaaatggaggcaaagaacctggcggcagcgcaaaagatg

SEQ ID NO: 217384 - DNA, 103 bp, Artificial Sequence
  Synthetic Polynucleotide
taatacgactcactatagggcccaggcttccttctctccctcctttgcctaacagaggagaaggcaaatgagggagagaaacctggcggcagcgcaaaagatg

SEQ ID NO: 217385 - DNA, 103 bp, Artificial Sequence
  Synthetic Polynucleotide
taatacgactcactatagggtcggctgggccccaggcttccttctctcccaacagaggagagggagaatgggaagcctgaacctggcggcagcgcaaaagatg

SEQ ID NO: 217386 - DNA, 103 bp, Artificial Sequence
  Synthetic Polynucleotide
taatacgactcactatagggtttcgcttcctcggctgggccccaggcttcaacagaggagagaagccatgggcccagccaacctggcggcagcgcaaaagatg

SEQ ID NO: 217387 - DNA, 103 bp, Artificial Sequence
  Synthetic Polynucleotide
taatacgactcactatagggttgtttggtttttcgcttcctcggctgggcaacagaggagagcccagatgaggaagcgaaacctggcggcagcgcaaaagatg

SEQ ID NO: 217388 - DNA, 103 bp, Artificial Sequence
  Synthetic Polynucleotide
taatacgactcactatagggtgggaactgcttgtttggtttttcgcttccaacagaggagaggaagcatgaaaccaaacaacctggcggcagcgcaaaagatg

SEQ ID NO: 217389 - DNA, 103 bp, Artificial Sequence
  Synthetic Polynucleotide
taatacgactcactatagggtactgagcactccctggagagaaaggcccaaacagaggagatgggccatgctctccaggaacctggcggcagcgcaaaagatg

SEQ ID NO: 217390 - DNA, 103 bp, Artificial Sequence
  Synthetic Polynucleotide
taatacgactcactatagggggttccacaatgggaactgcttgtttggttaacagaggagaaaccaaatgagcagttccaacctggcggcagcgcaaaagatg

SEQ ID NO: 217391 - DNA, 103 bp, Artificial Sequence
  Synthetic Polynucleotide
taatacgactcactatagggaggttcttggggttccacaatgggaactgcaacagaggagagcagttatgattgtggaaaacctggcggcagcgcaaaagatg

SEQ ID NO: 217392 - DNA, 103 bp, Artificial Sequence
  Synthetic Polynucleotide
taatacgactcactataggggtttgatctcaggttcttggggttccacaaaacagaggagattgtggatgcccaagaacaacctggcggcagcgcaaaagatg

SEQ ID NO: 217393 - DNA, 103 bp, Artificial Sequence
  Synthetic Polynucleotide
taatacgactcactataggggcatattttagtttgatctcaggttcttggaacagaggagaccaagaatgtgagatcaaaacctggcggcagcgcaaaagatg

SEQ ID NO: 217394 - DNA, 103 bp, Artificial Sequence
  Synthetic Polynucleotide
taatacgactcactatagggtggctgggtggcatattttagtttgatctcaacagaggagagagatcatgctaaaatataacctggcggcagcgcaaaagatg

SEQ ID NO: 217395 - DNA, 103 bp, Artificial Sequence
  Synthetic Polynucleotide
taatacgactcactatagggttttatccagtggctgggtggcatattttaaacagaggagataaaatatgccacccagcaacctggcggcagcgcaaaagatg

SEQ ID NO: 217396 - DNA, 103 bp, Artificial Sequence
  Synthetic Polynucleotide
taatacgactcactatagggttggcatcagttttatccagtggctgggtgaacagaggagacacccaatgactggataaaacctggcggcagcgcaaaagatg

SEQ ID NO: 217397 - DNA, 103 bp, Artificial Sequence
  Synthetic Polynucleotide
taatacgactcactatagggagacttgttcttggcatcagttttatccagaacagaggagactggatatgactgatgccaacctggcggcagcgcaaaagatg

SEQ ID NO: 217398 - DNA, 103 bp, Artificial Sequence
  Synthetic Polynucleotide
taatacgactcactatagggaagggtaaaaagacttgttcttggcatcagaacagaggagactgatgatgagaacaagtaacctggcggcagcgcaaaagatg

SEQ ID NO: 217399 - DNA, 103 bp, Artificial Sequence
  Synthetic Polynucleotide
taatacgactcactatagggacatggatgtaagggtaaaaagacttgttcaacagaggagagaacaaatgtttttacccaacctggcggcagcgcaaaagatg

SEQ ID NO: 217400 - DNA, 103 bp, Artificial Sequence
  Synthetic Polynucleotide
taatacgactcactatagggctgctgttggtactgagcactccctggagaaacagaggagatctccaatgagtgctcagaacctggcggcagcgcaaaagatg

SEQ ID NO: 217401 - DNA, 103 bp, Artificial Sequence
  Synthetic Polynucleotide
taatacgactcactatagggcttatttactacatggatgtaagggtaaaaaacagaggagattttacatgtacatccataacctggcggcagcgcaaaagatg

SEQ ID NO: 217402 - DNA, 103 bp, Artificial Sequence
  Synthetic Polynucleotide
taatacgactcactatagggcaagttcacacttatttactacatggatgtaacagaggagaacatccatgtagtaaataaacctggcggcagcgcaaaagatg

SEQ ID NO: 217403 - DNA, 103 bp, Artificial Sequence
  Synthetic Polynucleotide
taatacgactcactatagggcaaacggctccaagttcacacttatttactaacagaggagaagtaaaatggtgtgaactaacctggcggcagcgcaaaagatg

SEQ ID NO: 217404 - DNA, 103 bp, Artificial Sequence
  Synthetic Polynucleotide
taatacgactcactataggggatgattgtacaaacggctccaagttcacaaacagaggagatgtgaaatgggagccgttaacctggcggcagcgcaaaagatg

SEQ ID NO: 217405 - DNA, 103 bp, Artificial Sequence
  Synthetic Polynucleotide
taatacgactcactatagggcctcagcattgatgattgtacaaacggctcaacagaggagagagccgatggtacaatcaaacctggcggcagcgcaaaagatg

SEQ ID NO: 217406 - DNA, 103 bp, Artificial Sequence
  Synthetic Polynucleotide
taatacgactcactatagggtgttcttcttcctcagcattgatgattgtaaacagaggagatacaatatgcaatgctgaaacctggcggcagcgcaaaagatg

SEQ ID NO: 217407 - DNA, 103 bp, Artificial Sequence
  Synthetic Polynucleotide
taatacgactcactatagggtaatttggtctgttcttcttcctcagcattaacagaggagaaatgctatggaagaagaaaacctggcggcagcgcaaaagatg

SEQ ID NO: 217408 - DNA, 103 bp, Artificial Sequence
  Synthetic Polynucleotide
taatacgactcactatagggtgcccctcactaatttggtctgttcttcttaacagaggagaaagaagatgagaccaaataacctggcggcagcgcaaaagatg

SEQ ID NO: 217409 - DNA, 103 bp, Artificial Sequence
  Synthetic Polynucleotide
taatacgactcactatagggtgacccttcctgcccctcactaatttggtcaacagaggagagaccaaatgagtgaggggaacctggcggcagcgcaaaagatg

SEQ ID NO: 217410 - DNA, 103 bp, Artificial Sequence
  Synthetic Polynucleotide
taatacgactcactatagggcagtgacctctgacccttcctgcccctcacaacagaggagagtgaggatgaggaagggtaacctggcggcagcgcaaaagatg

SEQ ID NO: 217411 - DNA, 103 bp, Artificial Sequence
  Synthetic Polynucleotide
taatacgactcactatagggagccgtgtacctcctgtgggtagctttgctaacagaggagaagcaaaatgacccacaggaacctggcggcagcgcaaaagatg

SEQ ID NO: 217412 - DNA, 103 bp, Artificial Sequence
  Synthetic Polynucleotide
taatacgactcactatagggggctggaagcctgctgttggtactgagcacaacagaggagagtgctcatgaccaacagcaacctggcggcagcgcaaaagatg

SEQ ID NO: 217413 - DNA, 103 bp, Artificial Sequence
  Synthetic Polynucleotide
taatacgactcactataggggtggaggggtcagtgacctctgacccttccaacagaggagaggaaggatgagaggtcacaacctggcggcagcgcaaaagatg

SEQ ID NO: 217414 - DNA, 103 bp, Artificial Sequence
  Synthetic Polynucleotide
taatacgactcactataggggtgctgctaggtggaggggtcagtgacctcaacagaggagagaggtcatggacccctccaacctggcggcagcgcaaaagatg

SEQ ID NO: 217415 - DNA, 103 bp, Artificial Sequence
  Synthetic Polynucleotide
taatacgactcactatagggcttgctttcagtgctgctaggtggaggggtaacagaggagaacccctatgcctagcagcaacctggcggcagcgcaaaagatg

SEQ ID NO: 217416 - DNA, 103 bp, Artificial Sequence
  Synthetic Polynucleotide
taatacgactcactatagggccgggagcgccttgctttcagtgctgctagaacagaggagactagcaatgctgaaagcaaacctggcggcagcgcaaaagatg

SEQ ID NO: 217417 - DNA, 103 bp, Artificial Sequence
  Synthetic Polynucleotide
taatacgactcactatagggaaggacgaggccgggagcgccttgctttcaaacagaggagatgaaagatgggcgctcccaacctggcggcagcgcaaaagatg

SEQ ID NO: 217418 - DNA, 103 bp, Artificial Sequence
  Synthetic Polynucleotide
taatacgactcactatagggctgcagcataaaggacgaggccgggagcgcaacagaggagagcgctcatggcctcgtccaacctggcggcagcgcaaaagatg

SEQ ID NO: 217419 - DNA, 103 bp, Artificial Sequence
  Synthetic Polynucleotide
taatacgactcactatagggcaacaggtccctgcagcataaaggacgaggaacagaggagacctcgtatgttatgctgcaacctggcggcagcgcaaaagatg

SEQ ID NO: 217420 - DNA, 103 bp, Artificial Sequence
  Synthetic Polynucleotide
taatacgactcactataggggactctgtcacaacaggtccctgcagcataaacagaggagatatgctatggggacctgtaacctggcggcagcgcaaaagatg

SEQ ID NO: 217421 - DNA, 103 bp, Artificial Sequence
  Synthetic Polynucleotide
taatacgactcactatagggcataaccgaagactctgtcacaacaggtccaacagaggagaggacctatggtgacagagaacctggcggcagcgcaaaagatg

SEQ ID NO: 217422 - DNA, 103 bp, Artificial Sequence
  Synthetic Polynucleotide
taatacgactcactatagggccaggtgccccataaccgaagactctgtcaaacagaggagatgacagatgcttcggttaaacctggcggcagcgcaaaagatg

SEQ ID NO: 217423 - DNA, 103 bp, Artificial Sequence
  Synthetic Polynucleotide
taatacgactcactatagggtgctgctgctggctggaagcctgctgttggaacagaggagaccaacaatgggcttccagaacctggcggcagcgcaaaagatg

SEQ ID NO: 217424 - DNA, 103 bp, Artificial Sequence
  Synthetic Polynucleotide
taatacgactcactatagggagacagcaaaccaggtgccccataaccgaaaacagaggagattcggtatgggggcacctaacctggcggcagcgcaaaagatg

SEQ ID NO: 217425 - DNA, 103 bp, Artificial Sequence
  Synthetic Polynucleotide
taatacgactcactatagggcttgccacacagacagcaaaccaggtgcccaacagaggagagggcacatggtttgctgtaacctggcggcagcgcaaaagatg

SEQ ID NO: 217426 - DNA, 103 bp, Artificial Sequence
  Synthetic Polynucleotide
taatacgactcactatagggaactggcccacttgccacacagacagcaaaaacagaggagatttgctatgtgtgtggcaaacctggcggcagcgcaaaagatg

SEQ ID NO: 217427 - DNA, 103 bp, Artificial Sequence
  Synthetic Polynucleotide
taatacgactcactatagggatgttccggtaactggcccacttgccacacaacagaggagagtgtggatggtgggccagaacctggcggcagcgcaaaagatg

SEQ ID NO: 217428 - DNA, 103 bp, Artificial Sequence
  Synthetic Polynucleotide
taatacgactcactataggggaggtcacccatgttccggtaactggcccaaacagaggagatgggccatgtaccggaacaacctggcggcagcgcaaaagatg

SEQ ID NO: 217429 - DNA, 103 bp, Artificial Sequence
  Synthetic Polynucleotide
taatacgactcactatagggaaggtccaaagaggtcacccatgttccggtaacagaggagaaccggaatgtgggtgaccaacctggcggcagcgcaaaagatg

SEQ ID NO: 217430 - DNA, 103 bp, Artificial Sequence
  Synthetic Polynucleotide
taatacgactcactatagggtggggataaaaaggtccaaagaggtcacccaacagaggagagggtgaatgctttggaccaacctggcggcagcgcaaaagatg

SEQ ID NO: 217431 - DNA, 103 bp, Artificial Sequence
  Synthetic Polynucleotide
taatacgactcactatagggtgcataatcttggggataaaaaggtccaaaaacagaggagatttggaatgttttatcccaacctggcggcagcgcaaaagatg

SEQ ID NO: 217432 - DNA, 103 bp, Artificial Sequence
  Synthetic Polynucleotide
taatacgactcactatagggggagagtggctgcataatcttggggataaaaacagaggagatttatcatgaagattatgaacctggcggcagcgcaaaagatg

SEQ ID NO: 217433 - DNA, 103 bp, Artificial Sequence
  Synthetic Polynucleotide
taatacgactcactatagggggattcttcgggagagtggctgcataatctaacagaggagaagattaatgagccactctaacctggcggcagcgcaaaagatg

SEQ ID NO: 217434 - DNA, 103 bp, Artificial Sequence
  Synthetic Polynucleotide
taatacgactcactataggggacttgctgctgctgctgctggctggaagcaacagaggagagcttccatgcagcagcagaacctggcggcagcgcaaaagatg

SEQ ID NO: 217435 - DNA, 103 bp, Artificial Sequence
  Synthetic Polynucleotide
taatacgactcactatagggcttaggaggtggattcttcgggagagtggcaacagaggagagccactatgccgaagaataacctggcggcagcgcaaaagatg

SEQ ID NO: 217436 - DNA, 103 bp, Artificial Sequence
  Synthetic Polynucleotide
taatacgactcactatagggctgtggccctcttaggaggtggattcttcgaacagaggagacgaagaatgcacctcctaaacctggcggcagcgcaaaagatg

SEQ ID NO: 217437 - DNA, 103 bp, Artificial Sequence
  Synthetic Polynucleotide
taatacgactcactatagggctctgcatttctgtggccctcttaggaggtaacagaggagaacctccatggagggccacaacctggcggcagcgcaaaagatg

SEQ ID NO: 217438 - DNA, 103 bp, Artificial Sequence
  Synthetic Polynucleotide
taatacgactcactatagggcttaactttgctctgcatttctgtggccctaacagaggagaagggccatggaaatgcagaacctggcggcagcgcaaaagatg

SEQ ID NO: 217439 - DNA, 103 bp, Artificial Sequence
  Synthetic Polynucleotide
taatacgactcactatagggtgtgccgtaccttaactttgctctgcatttaacagaggagaaaatgcatggcaaagttaaacctggcggcagcgcaaaagatg

SEQ ID NO: 217440 - DNA, 103 bp, Artificial Sequence
  Synthetic Polynucleotide
taatacgactcactataggggaagcacttttgtgccgtaccttaactttgaacagaggagacaaagtatgggtacggcaaacctggcggcagcgcaaaagatg

SEQ ID NO: 217441 - DNA, 103 bp, Artificial Sequence
  Synthetic Polynucleotide
taatacgactcactatagggggagccattagaagcacttttgtgccgtacaacagaggagagtacggatgaaaagtgctaacctggcggcagcgcaaaagatg

SEQ ID NO: 217442 - DNA, 103 bp, Artificial Sequence
  Synthetic Polynucleotide
taatacgactcactatagggtgtccgtcttggagccattagaagcactttaacagaggagaaaagtgatgctaatggctaacctggcggcagcgcaaaagatg

SEQ ID NO: 217443 - DNA, 103 bp, Artificial Sequence
  Synthetic Polynucleotide
taatacgactcactatagggtcctcctcagtgtccgtcttggagccattaaacagaggagataatggatgcaagacggaaacctggcggcagcgcaaaagatg

SEQ ID NO: 217444 - DNA, 103 bp, Artificial Sequence
  Synthetic Polynucleotide
taatacgactcactatagggctgctcttcctcctcctcagtgtccgtcttaacagaggagaaagacgatgactgaggagaacctggcggcagcgcaaaagatg

SEQ ID NO: 217445 - DNA, 103 bp, Artificial Sequence
  Synthetic Polynucleotide
taatacgactcactatagggtcaactgctggacttgctgctgctgctgctaacagaggagaagcagcatgagcagcaagaacctggcggcagcgcaaaagatg

SEQ ID NO: 217446 - DNA, 103 bp, Artificial Sequence
  Synthetic Polynucleotide
taatacgactcactataggggctgctgctgctgctcttcctcctcctcagaacagaggagactgaggatgaggaagagcaacctggcggcagcgcaaaagatg

SEQ ID NO: 217447 - DNA, 103 bp, Artificial Sequence
  Synthetic Polynucleotide
taatacgactcactatagggtgctccttctgctgctgctgctgctcttccaacagaggagaggaagaatggcagcagcaaacctggcggcagcgcaaaagatg

SEQ ID NO: 217448 - DNA, 103 bp, Artificial Sequence
  Synthetic Polynucleotide
taatacgactcactatagggcaggcttctctgctccttctgctgctgctgaacagaggagacagcagatgcagaaggagaacctggcggcagcgcaaaagatg

SEQ ID NO: 217449 - DNA, 103 bp, Artificial Sequence
  Synthetic Polynucleotide
taatacgactcactatagggggtgtgcggccaggcttctctgctccttctaacagaggagaagaaggatgagagaagccaacctggcggcagcgcaaaagatg

SEQ ID NO: 217450 - DNA, 103 bp, Artificial Sequence
  Synthetic Polynucleotide
taatacgactcactatagggttaaacctggggtgtgcggccaggcttctcaacagaggagagagaagatgggccgcacaaacctggcggcagcgcaaaagatg

SEQ ID NO: 217451 - DNA, 103 bp, Artificial Sequence
  Synthetic Polynucleotide
taatacgactcactataggggtggcgccgcttaaacctggggtgtgcggcaacagaggagagccgcaatgcccaggtttaacctggcggcagcgcaaaagatg

SEQ ID NO: 217452 - DNA, 103 bp, Artificial Sequence
  Synthetic Polynucleotide
taatacgactcactatagggcttccgagcggtggcgccgcttaaacctggaacagaggagaccaggtatgagcggcgccaacctggcggcagcgcaaaagatg

SEQ ID NO: 217453 - DNA, 103 bp, Artificial Sequence
  Synthetic Polynucleotide
taatacgactcactatagggccaccacagtcttccgagcggtggcgccgcaacagaggagagcggcgatgccgctcggaaacctggcggcagcgcaaaagatg

SEQ ID NO: 217454 - DNA, 103 bp, Artificial Sequence
  Synthetic Polynucleotide
taatacgactcactatagggccgagggcctccaccacagtcttccgagcgaacagaggagacgctcgatggactgtggtaacctggcggcagcgcaaaagatg

SEQ ID NO: 217455 - DNA, 103 bp, Artificial Sequence
  Synthetic Polynucleotide
taatacgactcactatagggtggacagggaccgagggcctccaccacagtaacagaggagaactgtgatggaggccctcaacctggcggcagcgcaaaagatg

SEQ ID NO: 217456 - DNA, 103 bp, Artificial Sequence
  Synthetic Polynucleotide
taatacgactcactatagggagctgttgtctcaactgctggacttgctgcaacagaggagagcagcaatgccagcagttaacctggcggcagcgcaaaagatg

SEQ ID NO: 217457 - DNA, 103 bp, Artificial Sequence
  Synthetic Polynucleotide
taatacgactcactataggggggagccccctggacagggaccgagggcctaacagaggagaaggcccatggtccctgtcaacctggcggcagcgcaaaagatg

SEQ ID NO: 217458 - DNA, 103 bp, Artificial Sequence
  Synthetic Polynucleotide
taatacgactcactatagggttttttacaagggagccccctggacagggaaacagaggagatccctgatgagggggctcaacctggcggcagcgcaaaagatg

SEQ ID NO: 217459 - DNA, 103 bp, Artificial Sequence
  Synthetic Polynucleotide
taatacgactcactatagggcagtggctgcttttttacaagggagcccccaacagaggagagggggcatgcttgtaaaaaacctggcggcagcgcaaaagatg

SEQ ID NO: 217460 - DNA, 103 bp, Artificial Sequence
  Synthetic Polynucleotide
taatacgactcactatagggctgctgccctcagtggctgcttttttacaaaacagaggagattgtaaatgagcagccacaacctggcggcagcgcaaaagatg

SEQ ID NO: 217461 - DNA, 103 bp, Artificial Sequence
  Synthetic Polynucleotide
taatacgactcactatagggagtcttttcactgctgccctcagtggctgcaacagaggagagcagccatggagggcagcaacctggcggcagcgcaaaagatg

SEQ ID NO: 217462 - DNA, 103 bp, Artificial Sequence
  Synthetic Polynucleotide
taatacgactcactatagggagtccaaaacagtcttttcactgctgccctaacagaggagaagggcaatggtgaaaagaaacctggcggcagcgcaaaagatg

SEQ ID NO: 217463 - DNA, 103 bp, Artificial Sequence
  Synthetic Polynucleotide
taatacgactcactataggggagggcttcgagtccaaaacagtcttttcaaacagaggagatgaaaaatgtgttttggaaacctggcggcagcgcaaaagatg

SEQ ID NO: 217464 - DNA, 103 bp, Artificial Sequence
  Synthetic Polynucleotide
taatacgactcactatagggggtgggcacggagggcttcgagtccaaaacaacagaggagagttttgatgtcgaagcccaacctggcggcagcgcaaaagatg

SEQ ID NO: 217465 - DNA, 103 bp, Artificial Sequence
  Synthetic Polynucleotide
taatacgactcactatagggcttctgaagtggtgggcacggagggcttcgaacagaggagacgaagcatgccgtgcccaaacctggcggcagcgcaaaagatg

SEQ ID NO: 217466 - DNA, 103 bp, Artificial Sequence
  Synthetic Polynucleotide
taatacgactcactatagggtcagggccaccttctgaagtggtgggcacgaacagaggagacgtgccatgcacttcagaaacctggcggcagcgcaaaagatg

SEQ ID NO: 217467 - DNA, 103 bp, Artificial Sequence
  Synthetic Polynucleotide
taatacgactcactatagggggactggtaaagctgttgtctcaactgctgaacagaggagacagcagatgagacaacagaacctggcggcagcgcaaaagatg

SEQ ID NO: 217468 - DNA, 103 bp, Artificial Sequence
  Synthetic Polynucleotide
taatacgactcactatagggtaactccagctcagggccaccttctgaagtaacagaggagaacttcaatgggtggccctaacctggcggcagcgcaaaagatg

SEQ ID NO: 217469 - DNA, 103 bp, Artificial Sequence
  Synthetic Polynucleotide
taatacgactcactatagggcagggatttgtaactccagctcagggccacaacagaggagagtggccatgagctggagtaacctggcggcagcgcaaaagatg

SEQ ID NO: 217470 - DNA, 103 bp, Artificial Sequence
  Synthetic Polynucleotide
taatacgactcactatagggagaggtagttcagggatttgtaactccagcaacagaggagagctggaatgacaaatcccaacctggcggcagcgcaaaagatg

SEQ ID NO: 217471 - DNA, 103 bp, Artificial Sequence
  Synthetic Polynucleotide
taatacgactcactatagggattgctgtcaagaggtagttcagggatttgaacagaggagacaaatcatggaactacctaacctggcggcagcgcaaaagatg

SEQ ID NO: 217472 - DNA, 103 bp, Artificial Sequence
  Synthetic Polynucleotide
taatacgactcactatagggcccaaaattcattgctgtcaagaggtagttaacagaggagaaactacatgttgacagcaaacctggcggcagcgcaaaagatg

SEQ ID NO: 217473 - DNA, 103 bp, Artificial Sequence
  Synthetic Polynucleotide
taatacgactcactatagggccctcatggacccaaaattcattgctgtcaaacagaggagatgacagatgtgaattttgaacctggcggcagcgcaaaagatg

SEQ ID NO: 217474 - DNA, 103 bp, Artificial Sequence
  Synthetic Polynucleotide
taatacgactcactataggggagaatacaaccctcatggacccaaaattcaacagaggagagaatttatggtccatgagaacctggcggcagcgcaaaagatg

SEQ ID NO: 217475 - DNA, 103 bp, Artificial Sequence
  Synthetic Polynucleotide
taatacgactcactatagggcattggcccagagaatacaaccctcatggaaacagaggagatccatgatggttgtattcaacctggcggcagcgcaaaagatg

SEQ ID NO: 217476 - DNA, 103 bp, Artificial Sequence
  Synthetic Polynucleotide
taatacgactcactatagggaggtagattccattggcccagagaatacaaaacagaggagattgtatatgctgggccaaaacctggcggcagcgcaaaagatg

SEQ ID NO: 217477 - DNA, 103 bp, Artificial Sequence
  Synthetic Polynucleotide
taatacgactcactataggggccacaaaccaggtagattccattggcccaaacagaggagatgggccatgggaatctacaacctggcggcagcgcaaaagatg

SEQ ID NO: 217478 - DNA, 103 bp, Artificial Sequence
  Synthetic Polynucleotide
taatacgactcactatagggggggctgatgggactggtaaagctgttgtcaacagaggagagacaacatgtttaccagtaacctggcggcagcgcaaaagatg

SEQ ID NO: 217479 - DNA, 103 bp, Artificial Sequence
  Synthetic Polynucleotide
taatacgactcactatagggcatagagcctgccacaaaccaggtagattcaacagaggagagaatctatgtggtttgtgaacctggcggcagcgcaaaagatg

SEQ ID NO: 217480 - DNA, 103 bp, Artificial Sequence
  Synthetic Polynucleotide
taatacgactcactatagggtcctgcaggccatagagcctgccacaaaccaacagaggagaggtttgatgcaggctctaaacctggcggcagcgcaaaagatg

SEQ ID NO: 217481 - DNA, 103 bp, Artificial Sequence
  Synthetic Polynucleotide
taatacgactcactatagggttccagcgcttcctgcaggccatagagcctaacagaggagaaggctcatgggcctgcagaacctggcggcagcgcaaaagatg

SEQ ID NO: 217482 - DNA, 103 bp, Artificial Sequence
  Synthetic Polynucleotide
taatacgactcactatagggctctggctatttccagcgcttcctgcaggcaacagaggagagcctgcatgaagcgctggaacctggcggcagcgcaaaagatg

SEQ ID NO: 217483 - DNA, 103 bp, Artificial Sequence
  Synthetic Polynucleotide
taatacgactcactatagggcatttcatctctctggctatttccagcgctaacagaggagaagcgctatgaatagccagaacctggcggcagcgcaaaagatg

SEQ ID NO: 217484 - DNA, 103 bp, Artificial Sequence
  Synthetic Polynucleotide
taatacgactcactataggggcagtgggaacatttcatctctctggctataacagaggagaatagccatggagatgaaaaacctggcggcagcgcaaaagatg

SEQ ID NO: 217485 - DNA, 103 bp, Artificial Sequence
  Synthetic Polynucleotide
taatacgactcactatagggctgcctcctggcagtgggaacatttcatctaacagaggagaagatgaatggttcccactaacctggcggcagcgcaaaagatg

SEQ ID NO: 217486 - DNA, 103 bp, Artificial Sequence
  Synthetic Polynucleotide
taatacgactcactatagggaaggtggcgcctgcctcctggcagtgggaaaacagaggagattcccaatgccaggaggcaacctggcggcagcgcaaaagatg

SEQ ID NO: 217487 - DNA, 103 bp, Artificial Sequence
  Synthetic Polynucleotide
taatacgactcactataggggtagcagcccaaggtggcgcctgcctcctgaacagaggagacaggagatgggcgccaccaacctggcggcagcgcaaaagatg

SEQ ID NO: 217488 - DNA, 103 bp, Artificial Sequence
  Synthetic Polynucleotide
taatacgactcactatagggagcctttgttgtagcagcccaaggtggcgcaacagaggagagcgccaatgtgggctgctaacctggcggcagcgcaaaagatg

SEQ ID NO: 217489 - DNA, 103 bp, Artificial Sequence
  Synthetic Polynucleotide
taatacgactcactataggggcctgtggcaggggctgatgggactggtaaaacagaggagattaccaatgccatcagccaacctggcggcagcgcaaaagatg

SEQ ID NO: 217490 - DNA, 103 bp, Artificial Sequence
  Synthetic Polynucleotide
taatacgactcactatagggcggaaggagcagcctttgttgtagcagcccaacagaggagagggctgatgcaacaaaggaacctggcggcagcgcaaaagatg

SEQ ID NO: 217491 - DNA, 103 bp, Artificial Sequence
  Synthetic Polynucleotide
taatacgactcactataggggtaatggtatcggaaggagcagcctttgttaacagaggagaaacaaaatgtgctccttcaacctggcggcagcgcaaaagatg

SEQ ID NO: 217492 - DNA, 103 bp, Artificial Sequence
  Synthetic Polynucleotide
taatacgactcactatagggtggcacacgggtaatggtatcggaaggagcaacagaggagagctcctatggataccattaacctggcggcagcgcaaaagatg

SEQ ID NO: 217493 - DNA, 103 bp, Artificial Sequence
  Synthetic Polynucleotide
taatacgactcactatagggtctgcatcaatggcacacgggtaatggtataacagaggagaataccaatgcccgtgtgcaacctggcggcagcgcaaaagatg

SEQ ID NO: 217494 - DNA, 103 bp, Artificial Sequence
  Synthetic Polynucleotide
taatacgactcactatagggtagcaaacaatctgcatcaatggcacacggaacagaggagaccgtgtatgattgatgcaaacctggcggcagcgcaaaagatg

SEQ ID NO: 217495 - DNA, 103 bp, Artificial Sequence
  Synthetic Polynucleotide
taatacgactcactatagggtctcctcatgtagcaaacaatctgcatcaaaacagaggagattgatgatgattgtttgcaacctggcggcagcgcaaaagatg

SEQ ID NO: 217496 - DNA, 103 bp, Artificial Sequence
  Synthetic Polynucleotide
taatacgactcactatagggaccgagaagttctcctcatgtagcaaacaaaacagaggagattgtttatgacatgaggaaacctggcggcagcgcaaaagatg

SEQ ID NO: 217497 - DNA, 103 bp, Artificial Sequence
  Synthetic Polynucleotide
taatacgactcactatagggagggcacctcaccgagaagttctcctcatgaacagaggagacatgagatgaacttctcgaacctggcggcagcgcaaaagatg

SEQ ID NO: 217498 - DNA, 103 bp, Artificial Sequence
  Synthetic Polynucleotide
taatacgactcactatagggccttgtgcttagggcacctcaccgagaagtaacagaggagaacttctatgtgaggtgccaacctggcggcagcgcaaaagatg

SEQ ID NO: 217499 - DNA, 103 bp, Artificial Sequence
  Synthetic Polynucleotide
taatacgactcactatagggcacagtctcaccttgtgcttagggcacctcaacagaggagagaggtgatgtaagcacaaaacctggcggcagcgcaaaagatg

SEQ ID NO: 217500 - DNA, 103 bp, Artificial Sequence
  Synthetic Polynucleotide
taatacgactcactatagggttggccagtggcctgtggcaggggctgatgaacagaggagacatcagatgctgccacagaacctggcggcagcgcaaaagatg

SEQ ID NO: 217501 - DNA, 103 bp, Artificial Sequence
  Synthetic Polynucleotide
taatacgactcactatagggtggatgctggttggccagtggcctgtggcaaacagaggagatgccacatgccactggccaacctggcggcagcgcaaaagatg

SEQ ID NO: 217502 - DNA, 103 bp, Artificial Sequence
  Synthetic Polynucleotide
taatacgactcactatagggagccgggatgagccgtgtacctcctgtgggaacagaggagacccacaatgggtacacggaacctggcggcagcgcaaaagatg

SEQ ID NO: 217503 - DNA, 103 bp, Artificial Sequence
  Synthetic Polynucleotide
taatacgactcactatagggtgggatgagctggatgctggttggccagtgaacagaggagacactggatgaccagcatcaacctggcggcagcgcaaaagatg

SEQ ID NO: 217504 - DNA, 103 bp, Artificial Sequence
  Synthetic Polynucleotide
taatacgactcactatagggtggctgtagatgggatgagctggatgctggaacagaggagaccagcaatgagctcatccaacctggcggcagcgcaaaagatg

SEQ ID NO: 217505 - DNA, 103 bp, Artificial Sequence
  Synthetic Polynucleotide
taatacgactcactataggggccgctgcattggctgtagatgggatgagcaacagaggagagctcatatgatctacagcaacctggcggcagcgcaaaagatg

SEQ ID NO: 217506 - DNA, 103 bp, Artificial Sequence
  Synthetic Polynucleotide
taatacgactcactatagggagagttgagggccgctgcattggctgtagaaacagaggagatctacaatgaatgcagcgaacctggcggcagcgcaaaagatg

SEQ ID NO: 217507 - DNA, 103 bp, Artificial Sequence
  Synthetic Polynucleotide
taatacgactcactatagggagaggatggcagagttgagggccgctgcataacagaggagaatgcagatgccctcaactaacctggcggcagcgcaaaagatg

SEQ ID NO: 217508 - DNA, 103 bp, Artificial Sequence
  Synthetic Polynucleotide
taatacgactcactatagggaaccagcagcagaggatggcagagttgaggaacagaggagacctcaaatgtgccatcctaacctggcggcagcgcaaaagatg

SEQ ID NO: 217509 - DNA, 103 bp, Artificial Sequence
  Synthetic Polynucleotide
taatacgactcactatagggcttaactggtaaccagcagcagaggatggcaacagaggagagccatcatgtgctgctggaacctggcggcagcgcaaaagatg

SEQ ID NO: 217510 - DNA, 103 bp, Artificial Sequence
  Synthetic Polynucleotide
taatacgactcactatagggctgacccactcttaactggtaaccagcagcaacagaggagagctgctatgtaccagttaaacctggcggcagcgcaaaagatg

SEQ ID NO: 217511 - DNA, 103 bp, Artificial Sequence
  Synthetic Polynucleotide
taatacgactcactataggggttggccaaactgacccactcttaactggtaacagaggagaaccagtatggagtgggtcaacctggcggcagcgcaaaagatg

SEQ ID NO: 217512 - DNA, 103 bp, Artificial Sequence
  Synthetic Polynucleotide
taatacgactcactataggggactgatagtgttggccaaactgacccactaacagaggagaagtgggatggtttggccaaacctggcggcagcgcaaaagatg

SEQ ID NO: 217513 - DNA, 103 bp, Artificial Sequence
  Synthetic Polynucleotide
taatacgactcactataggggaactcttctagccgggatgagccgtgtacaacagaggagagtacacatgtcatcccggaacctggcggcagcgcaaaagatg

SEQ ID NO: 217514 - DNA, 103 bp, Artificial Sequence
  Synthetic Polynucleotide
taatacgactcactatagggggaagcagaagactgatagtgttggccaaaaacagaggagatttggcatgcactatcagaacctggcggcagcgcaaaagatg

SEQ ID NO: 217515 - DNA, 103 bp, Artificial Sequence
  Synthetic Polynucleotide
taatacgactcactatagggaggaggaggaggaagcagaagactgatagtaacagaggagaactatcatgcttctgcttaacctggcggcagcgcaaaagatg

SEQ ID NO: 217516 - DNA, 103 bp, Artificial Sequence
  Synthetic Polynucleotide
taatacgactcactatagggaaggaggaggaggaggaggaggaagcagaaaacagaggagattctgcatgctcctcctcaacctggcggcagcgcaaaagatg

SEQ ID NO: 217517 - DNA, 103 bp, Artificial Sequence
  Synthetic Polynucleotide
taatacgactcactatagggtggtgaagggaaggaggaggaggaggaggaaacagaggagatcctccatgtcctcctccaacctggcggcagcgcaaaagatg

SEQ ID NO: 217518 - DNA, 103 bp, Artificial Sequence
  Synthetic Polynucleotide
taatacgactcactatagggtaaaacgctgtggtgaagggaaggaggaggaacagaggagacctcctatgtcccttcacaacctggcggcagcgcaaaagatg

SEQ ID NO: 217519 - DNA, 103 bp, Artificial Sequence
  Synthetic Polynucleotide
taatacgactcactatagggccagactggctaaaacgctgtggtgaagggaacagaggagacccttcatgacagcgtttaacctggcggcagcgcaaaagatg

SEQ ID NO: 217520 - DNA, 103 bp, Artificial Sequence
  Synthetic Polynucleotide
taatacgactcactatagggatagctctgtccagactggctaaaacgctgaacagaggagacagcgtatgagccagtctaacctggcggcagcgcaaaagatg

SEQ ID NO: 217521 - DNA, 103 bp, Artificial Sequence
  Synthetic Polynucleotide
taatacgactcactatagggaactgccatcatagctctgtccagactggcaacagaggagagccagtatggacagagctaacctggcggcagcgcaaaagatg

SEQ ID NO: 217522 - DNA, 103 bp, Artificial Sequence
  Synthetic Polynucleotide
taatacgactcactatagggttcacattgtaactgccatcatagctctgtaacagaggagaacagagatgtgatggcagaacctggcggcagcgcaaaagatg

SEQ ID NO: 217523 - DNA, 103 bp, Artificial Sequence
  Synthetic Polynucleotide
taatacgactcactatagggagatccagcattcacattgtaactgccatcaacagaggagagatggcatgtacaatgtgaacctggcggcagcgcaaaagatg

SEQ ID NO: 217524 - DNA, 103 bp, Artificial Sequence
  Synthetic Polynucleotide
taatacgactcactataggggacgagggctgaactcttctagccgggatgaacagaggagacatcccatgtagaagagtaacctggcggcagcgcaaaagatg

SEQ ID NO: 217525 - DNA, 103 bp, Artificial Sequence
  Synthetic Polynucleotide
taatacgactcactatagggcttcatactgagatccagcattcacattgtaacagaggagaacaatgatgatgctggataacctggcggcagcgcaaaagatg

SEQ ID NO: 217526 - DNA, 103 bp, Artificial Sequence
  Synthetic Polynucleotide
taatacgactcactatagggacattgtgtccttcatactgagatccagcaaacagaggagatgctggatgtcagtatgaaacctggcggcagcgcaaaagatg

SEQ ID NO: 217527 - DNA, 103 bp, Artificial Sequence
  Synthetic Polynucleotide
taatacgactcactatagggattagaacccacattgtgtccttcatactgaacagaggagacagtatatgggacacaataacctggcggcagcgcaaaagatg

SEQ ID NO: 217528 - DNA, 103 bp, Artificial Sequence
  Synthetic Polynucleotide
taatacgactcactatagggaagcctgtgcattagaacccacattgtgtcaacagaggagagacacaatgtgggttctaaacctggcggcagcgcaaaagatg

SEQ ID NO: 217529 - DNA, 103 bp, Artificial Sequence
  Synthetic Polynucleotide
taatacgactcactatagggtgtgttccataagcctgtgcattagaacccaacagaggagagggttcatgtgcacaggcaacctggcggcagcgcaaaagatg

SEQ ID NO: 217530 - DNA, 103 bp, Artificial Sequence
  Synthetic Polynucleotide
taatacgactcactataggggtaattggattgtgttccataagcctgtgcaacagaggagagcacagatgtatggaacaaacctggcggcagcgcaaaagatg

SEQ ID NO: 217531 - DNA, 103 bp, Artificial Sequence
  Synthetic Polynucleotide
taatacgactcactataggggctgatagctgtaattggattgtgttccataacagaggagaatggaaatgaatccaattaacctggcggcagcgcaaaagatg

SEQ ID NO: 217532 - DNA, 103 bp, Artificial Sequence
  Synthetic Polynucleotide
taatacgactcactatagggatagattgaggctgatagctgtaattggataacagaggagaatccaaatgcagctatcaaacctggcggcagcgcaaaagatg

SEQ ID NO: 217533 - DNA, 103 bp, Artificial Sequence
  Synthetic Polynucleotide
taatacgactcactatagggaaaattcttcatagattgaggctgatagctaacagaggagaagctatatgcctcaatctaacctggcggcagcgcaaaagatg

SEQ ID NO: 217534 - DNA, 103 bp, Artificial Sequence
  Synthetic Polynucleotide
taatacgactcactatagggttgcctgttcaaaattcttcatagattgagaacagaggagactcaatatgtgaagaattaacctggcggcagcgcaaaagatg

SEQ ID NO: 217535 - DNA, 103 bp, Artificial Sequence
  Synthetic Polynucleotide
taatacgactcactatagggatctgggcctgacgagggctgaactcttctaacagaggagaagaagaatgcagccctcgaacctggcggcagcgcaaaagatg

SEQ ID NO: 217536 - DNA, 103 bp, Artificial Sequence
  Synthetic Polynucleotide
taatacgactcactatagggtgtggaatctttgcctgttcaaaattcttcaacagaggagagaagaaatgtgaacaggcaacctggcggcagcgcaaaagatg

SEQ ID NO: 217537 - DNA, 103 bp, Artificial Sequence
  Synthetic Polynucleotide
taatacgactcactatagggttgggtcccttgtggaatctttgcctgttcaacagaggagagaacagatgaagattccaaacctggcggcagcgcaaaagatg

SEQ ID NO: 217538 - DNA, 103 bp, Artificial Sequence
  Synthetic Polynucleotide
taatacgactcactataggggctgcccctgttgggtcccttgtggaatctaacagaggagaagattcatgaagggacccaacctggcggcagcgcaaaagatg

SEQ ID NO: 217539 - DNA, 103 bp, Artificial Sequence
  Synthetic Polynucleotide
taatacgactcactatagggtgctgctgctgctgcccctgttgggtccctaacagaggagaagggacatgacaggggcaaacctggcggcagcgcaaaagatg

SEQ ID NO: 217540 - DNA, 103 bp, Artificial Sequence
  Synthetic Polynucleotide
taatacgactcactatagggttgctgcggttgctgctgctgctgcccctgaacagaggagacaggggatgcagcagcagaacctggcggcagcgcaaaagatg

SEQ ID NO: 217541 - DNA, 103 bp, Artificial Sequence
  Synthetic Polynucleotide
taatacgactcactatagggggtgttgttgttgctgcggttgctgctgctaacagaggagaagcagcatgaaccgcagcaacctggcggcagcgcaaaagatg

SEQ ID NO: 217542 - DNA, 103 bp, Artificial Sequence
  Synthetic Polynucleotide
taatacgactcactatagggtgctgagaagggtgttgttgttgctgcggtaacagaggagaaccgcaatgacaacaacaaacctggcggcagcgcaaaagatg

SEQ ID NO: 217543 - DNA, 103 bp, Artificial Sequence
  Synthetic Polynucleotide
taatacgactcactatagggctgcatcacatgctgagaagggtgttgttgaacagaggagacaacaaatgccttctcagaacctggcggcagcgcaaaagatg

SEQ ID NO: 217544 - DNA, 103 bp, Artificial Sequence
  Synthetic Polynucleotide
taatacgactcactatagggcgttagtatactgcatcacatgctgagaagaacagaggagacttctcatgatgtgatgcaacctggcggcagcgcaaaagatg

SEQ ID NO: 217545 - DNA, 103 bp, Artificial Sequence
  Synthetic Polynucleotide
taatacgactcactatagggttggtggcagcgttagtatactgcatcacaaacagaggagatgtgatatggtatactaaaacctggcggcagcgcaaaagatg

SEQ ID NO: 217546 - DNA, 103 bp, Artificial Sequence
  Synthetic Polynucleotide
taatacgactcactatagggctccacatcgctgagggagccggtggacataacagaggagaatgtccatgggctccctcaacctggcggcagcgcaaaagatg

SEQ ID NO: 217547 - DNA, 103 bp, Artificial Sequence
  Synthetic Polynucleotide
taatacgactcactatagggctcctcggtgctctcgttggaagtcacaaaaacagaggagatttgtgatgtccaacgagaacctggcggcagcgcaaaagatg

SEQ ID NO: 217548 - DNA, 103 bp, Artificial Sequence
  Synthetic Polynucleotide
taatacgactcactatagggagttggagctctcctcggtgctctcgttggaacagaggagaccaacgatggcaccgaggaacctggcggcagcgcaaaagatg

SEQ ID NO: 217549 - DNA, 103 bp, Artificial Sequence
  Synthetic Polynucleotide
taatacgactcactatagggccattctcgcagttggagctctcctcggtgaacagaggagacaccgaatggagctccaaaacctggcggcagcgcaaaagatg

SEQ ID NO: 217550 - DNA, 103 bp, Artificial Sequence
  Synthetic Polynucleotide
taatacgactcactatagggctggggagacccattctcgcagttggagctaacagaggagaagctccatgtgcgagaataacctggcggcagcgcaaaagatg

SEQ ID NO: 217551 - DNA, 103 bp, Artificial Sequence
  Synthetic Polynucleotide
taatacgactcactatagggcgcggcccttctggggagacccattctcgcaacagaggagagcgagaatgggtctccccaacctggcggcagcgcaaaagatg

SEQ ID NO: 217552 - DNA, 103 bp, Artificial Sequence
  Synthetic Polynucleotide
taatacgactcactatagggcccaggccgccgcggcccttctggggagacaacagaggagagtctccatggaagggccgaacctggcggcagcgcaaaagatg

SEQ ID NO: 217553 - DNA, 103 bp, Artificial Sequence
  Synthetic Polynucleotide
taatacgactcactatagggcctcctcttgcccaggccgccgcggcccttaacagaggagaaagggcatgggcggcctgaacctggcggcagcgcaaaagatg

SEQ ID NO: 217554 - DNA, 103 bp, Artificial Sequence
  Synthetic Polynucleotide
taatacgactcactatagggtgggcgccttcctcctcttgcccaggccgcaacagaggagagcggccatggcaagaggaaacctggcggcagcgcaaaagatg

SEQ ID NO: 217555 - DNA, 103 bp, Artificial Sequence
  Synthetic Polynucleotide
taatacgactcactatagggctcttcttggtgggcgccttcctcctcttgaacagaggagacaagagatggaaggcgccaacctggcggcagcgcaaaagatg

SEQ ID NO: 217556 - DNA, 103 bp, Artificial Sequence
  Synthetic Polynucleotide
taatacgactcactataggggctcagggggctcttcttggtgggcgccttaacagaggagaaaggcgatgaccaagaagaacctggcggcagcgcaaaagatg

SEQ ID NO: 217557 - DNA, 103 bp, Artificial Sequence
  Synthetic Polynucleotide
taatacgactcactatagggcttgaaggtcctccacatcgctgagggagcaacagaggagagctcccatggcgatgtggaacctggcggcagcgcaaaagatg

SEQ ID NO: 217558 - DNA, 103 bp, Artificial Sequence
  Synthetic Polynucleotide
taatacgactcactatagggggctgaccccgctcagggggctcttcttggaacagaggagaccaagaatggccccctgaaacctggcggcagcgcaaaagatg

SEQ ID NO: 217559 - DNA, 103 bp, Artificial Sequence
  Synthetic Polynucleotide
taatacgactcactatagggttcccctcctggctgaccccgctcagggggaacagaggagaccccctatgcggggtcagaacctggcggcagcgcaaaagatg

SEQ ID NO: 217560 - DNA, 103 bp, Artificial Sequence
  Synthetic Polynucleotide
taatacgactcactatagggctggacctgcttcccctcctggctgaccccaacagaggagaggggtcatgcaggaggggaacctggcggcagcgcaaaagatg

SEQ ID NO: 217561 - DNA, 103 bp, Artificial Sequence
  Synthetic Polynucleotide
taatacgactcactatagggcggcgttgcgctggacctgcttcccctcctaacagaggagaaggaggatgagcaggtccaacctggcggcagcgcaaaagatg

SEQ ID NO: 217562 - DNA, 103 bp, Artificial Sequence
  Synthetic Polynucleotide
taatacgactcactatagggcgcgcgttggcggcgttgcgctggacctgcaacagaggagagcaggtatggcgcaacgcaacctggcggcagcgcaaaagatg

SEQ ID NO: 217563 - DNA, 103 bp, Artificial Sequence
  Synthetic Polynucleotide
taatacgactcactatagggggcccgctctcgcgcgttggcggcgttgcgaacagaggagacgcaacatggccaacgcgaacctggcggcagcgcaaaagatg

SEQ ID NO: 217564 - DNA, 103 bp, Artificial Sequence
  Synthetic Polynucleotide
taatacgactcactatagggctcgcatgcgggcccgctctcgcgcgttggaacagaggagaccaacgatggagagcgggaacctggcggcagcgcaaaagatg

SEQ ID NO: 217565 - DNA, 103 bp, Artificial Sequence
  Synthetic Polynucleotide
taatacgactcactatagggttgctcagcactcgcatgcgggcccgctctaacagaggagaagagcgatgccgcatgcgaacctggcggcagcgcaaaagatg

SEQ ID NO: 217566 - DNA, 103 bp, Artificial Sequence
  Synthetic Polynucleotide
taatacgactcactatagggggagaaggccttgctcagcactcgcatgcgaacagaggagacgcatgatggtgctgagcaacctggcggcagcgcaaaagatg

SEQ ID NO: 217567 - DNA, 103 bp, Artificial Sequence
  Synthetic Polynucleotide
taatacgactcactatagggtcttgagtctggagaaggccttgctcagcaaacagaggagatgctgaatgaggccttctaacctggcggcagcgcaaaagatg

SEQ ID NO: 217568 - DNA, 103 bp, Artificial Sequence
  Synthetic Polynucleotide
taatacgactcactatagggatctccacctcttgaaggtcctccacatcgaacagaggagacgatgtatgggaccttcaaacctggcggcagcgcaaaagatg

SEQ ID NO: 217569 - DNA, 103 bp, Artificial Sequence
  Synthetic Polynucleotide
taatacgactcactatagggggcagggtggtcttgagtctggagaaggccaacagaggagaggccttatgcagactcaaaacctggcggcagcgcaaaagatg

SEQ ID NO: 217570 - DNA, 103 bp, Artificial Sequence
  Synthetic Polynucleotide
taatacgactcactataggggggcacccagggcagggtggtcttgagtctaacagaggagaagactcatgaccaccctgaacctggcggcagcgcaaaagatg

SEQ ID NO: 217571 - DNA, 103 bp, Artificial Sequence
  Synthetic Polynucleotide
taatacgactcactatagggtggtgtcggggggcacccagggcagggtggaacagaggagaccacccatgcctgggtgcaacctggcggcagcgcaaaagatg

SEQ ID NO: 217572 - DNA, 103 bp, Artificial Sequence
  Synthetic Polynucleotide
taatacgactcactatagggttggagagcttggtgtcggggggcacccagaacagaggagactgggtatgccccgacacaacctggcggcagcgcaaaagatg

SEQ ID NO: 217573 - DNA, 103 bp, Artificial Sequence
  Synthetic Polynucleotide
taatacgactcactatagggcgtgtccagcttggagagcttggtgtcgggaacagaggagacccgacatgaagctctccaacctggcggcagcgcaaaagatg

SEQ ID NO: 217574 - DNA, 103 bp, Artificial Sequence
  Synthetic Polynucleotide
taatacgactcactatagggccagcctgagcgtgtccagcttggagagctaacagaggagaagctctatgagctggacaaacctggcggcagcgcaaaagatg

SEQ ID NO: 217575 - DNA, 103 bp, Artificial Sequence
  Synthetic Polynucleotide
taatacgactcactatagggtagctggacgccagcctgagcgtgtccagcaacagaggagagctggaatggctcaggctaacctggcggcagcgcaaaagatg

SEQ ID NO: 217576 - DNA, 103 bp, Artificial Sequence
  Synthetic Polynucleotide
taatacgactcactataggggtgggcgatgtagctggacgccagcctgagaacagaggagactcaggatggcgtccagcaacctggcggcagcgcaaaagatg

SEQ ID NO: 217577 - DNA, 103 bp, Artificial Sequence
  Synthetic Polynucleotide
taatacgactcactatagggtctgcctcaagtgggcgatgtagctggacgaacagaggagacgtccaatgacatcgcccaacctggcggcagcgcaaaagatg

SEQ ID NO: 217578 - DNA, 103 bp, Artificial Sequence
  Synthetic Polynucleotide
taatacgactcactatagggttagccaggatctgcctcaagtgggcgatgaacagaggagacatcgcatgcttgaggcaaacctggcggcagcgcaaaagatg

SEQ ID NO: 217579 - DNA, 103 bp, Artificial Sequence
  Synthetic Polynucleotide
taatacgactcactatagggacattccaacatctccacctcttgaaggtcaacagaggagagaccttatggaggtggagaacctggcggcagcgcaaaagatg

SEQ ID NO: 217580 - DNA, 103 bp, Artificial Sequence
  Synthetic Polynucleotide
taatacgactcactataggggtatttgtcgttagccaggatctgcctcaaaacagaggagattgaggatgatcctggctaacctggcggcagcgcaaaagatg

SEQ ID NO: 217581 - DNA, 103 bp, Artificial Sequence
  Synthetic Polynucleotide
taatacgactcactatagggacccgttctcgtatttgtcgttagccaggaaacagaggagatcctggatgacgacaaataacctggcggcagcgcaaaagatg

SEQ ID NO: 217582 - DNA, 103 bp, Artificial Sequence
  Synthetic Polynucleotide
taatacgactcactataggggggtgaatgtacccgttctcgtatttgtcgaacagaggagacgacaaatgcgagaacggaacctggcggcagcgcaaaagatg

SEQ ID NO: 217583 - DNA, 103 bp, Artificial Sequence
  Synthetic Polynucleotide
taatacgactcactatagggcaggttgaccgggtgaatgtacccgttctcaacagaggagagagaacatgtacattcacaacctggcggcagcgcaaaagatg

SEQ ID NO: 217584 - DNA, 103 bp, Artificial Sequence
  Synthetic Polynucleotide
taatacgactcactatagggagggccacgtcaggttgaccgggtgaatgtaacagaggagaacattcatgcggtcaaccaacctggcggcagcgcaaaagatg

SEQ ID NO: 217585 - DNA, 103 bp, Artificial Sequence
  Synthetic Polynucleotide
taatacgactcactataggggccaccataaagggccacgtcaggttgaccaacagaggagaggtcaaatggacgtggccaacctggcggcagcgcaaaagatg

SEQ ID NO: 217586 - DNA, 103 bp, Artificial Sequence
  Synthetic Polynucleotide
taatacgactcactataggggggtttcccggccaccataaagggccacgtaacagaggagaacgtggatgtttatggtgaacctggcggcagcgcaaaagatg

SEQ ID NO: 217587 - DNA, 103 bp, Artificial Sequence
  Synthetic Polynucleotide
taatacgactcactatagggggtcactctcgggtttcccggccaccataaaacagaggagattatggatgccgggaaacaacctggcggcagcgcaaaagatg

SEQ ID NO: 217588 - DNA, 103 bp, Artificial Sequence
  Synthetic Polynucleotide
taatacgactcactatagggacttctttcaggtcactctcgggtttcccgaacagaggagacgggaaatgcgagagtgaaacctggcggcagcgcaaaagatg

SEQ ID NO: 217589 - DNA, 103 bp, Artificial Sequence
  Synthetic Polynucleotide
taatacgactcactatagggcgcggtcaccacttctttcaggtcactctcaacagaggagagagagtatgctgaaagaaaacctggcggcagcgcaaaagatg

SEQ ID NO: 217590 - DNA, 103 bp, Artificial Sequence
  Synthetic Polynucleotide
taatacgactcactatagggtcaacccgtcacattccaacatctccacctaacagaggagaaggtggatgtgttggaataacctggcggcagcgcaaaagatg

SEQ ID NO: 217591 - DNA, 103 bp, Artificial Sequence
  Synthetic Polynucleotide
taatacgactcactatagggataagcggctcgcggtcaccacttctttcaaacagaggagatgaaagatgtggtgaccgaacctggcggcagcgcaaaagatg

SEQ ID NO: 217592 - DNA, 103 bp, Artificial Sequence
  Synthetic Polynucleotide
taatacgactcactataggggtggttccacataagcggctcgcggtcaccaacagaggagaggtgacatggagccgcttaacctggcggcagcgcaaaagatg

SEQ ID NO: 217593 - DNA, 103 bp, Artificial Sequence
  Synthetic Polynucleotide
taatacgactcactatagggtcaggacgcggtggttccacataagcggctaacagaggagaagccgcatgtgtggaaccaacctggcggcagcgcaaaagatg

SEQ ID NO: 217594 - DNA, 103 bp, Artificial Sequence
  Synthetic Polynucleotide
taatacgactcactataggggaatccattttcaacccgtcacattccaacaacagaggagagttggaatgtgacgggttaacctggcggcagcgcaaaagatg

SEQ ID NO: 217595 - DNA, 103 bp, Artificial Sequence
  Synthetic Polynucleotide
taatacgactcactatagggttccttgttcgaatccattttcaacccgtcaacagaggagagacgggatgaaaatggataacctggcggcagcgcaaaagatg

SEQ ID NO: 217596 - DNA, 103 bp, Artificial Sequence
  Synthetic Polynucleotide
taatacgactcactatagggaagtcacaaattccttgttcgaatccatttaacagaggagaaaatggatgcgaacaaggaacctggcggcagcgcaaaagatg

SEQ ID NO: 217597 - DNA, 103 bp, Artificial Sequence
  Synthetic Polynucleotide
taatacgactcactatagggctctcgttggaagtcacaaattccttgttcaacagaggagagaacaaatgatttgtgacaacctggcggcagcgcaaaagatg

SEQ ID NO: 217598 - DNA, 103 bp, Artificial Sequence
  Synthetic Polynucleotide
taatacgactcactatagggcacaggcgccatcctctgcggctggttcataacagaggagaatgaacatgccgcagaggaacctggcggcagcgcaaaagatg

SEQ ID NO: 217599 - DNA, 103 bp, Artificial Sequence
  Synthetic Polynucleotide
taatacgactcactatagggcagggaggcgggccggcccttcccgttggtaacagaggagaaccaacatgaagggccggaacctggcggcagcgcaaaagatg

SEQ ID NO: 217600 - DNA, 103 bp, Artificial Sequence
  Synthetic Polynucleotide
taatacgactcactataggggtagatcgaggccagtgctttgccgagggcaacagaggagagccctcatgaaagcactgaacctggcggcagcgcaaaagatg

SEQ ID NO: 217601 - DNA, 103 bp, Artificial Sequence
  Synthetic Polynucleotide
taatacgactcactataggggatccggggagtagatcgaggccagtgcttaacagaggagaaagcacatgcctcgatctaacctggcggcagcgcaaaagatg

SEQ ID NO: 217602 - DNA, 103 bp, Artificial Sequence
  Synthetic Polynucleotide
taatacgactcactatagggttgcttgagtgatccggggagtagatcgagaacagaggagactcgatatgctccccggaaacctggcggcagcgcaaaagatg

SEQ ID NO: 217603 - DNA, 103 bp, Artificial Sequence
  Synthetic Polynucleotide
taatacgactcactatagggcgagaagttattgcttgagtgatccggggaaacagaggagatccccgatgcactcaagcaacctggcggcagcgcaaaagatg

SEQ ID NO: 217604 - DNA, 103 bp, Artificial Sequence
  Synthetic Polynucleotide
taatacgactcactatagggaagggctggacgagaagttattgcttgagtaacagaggagaactcaaatgataacttctaacctggcggcagcgcaaaagatg

SEQ ID NO: 217605 - DNA, 103 bp, Artificial Sequence
  Synthetic Polynucleotide
taatacgactcactatagggacgggggtagaagggctggacgagaagttaaacagaggagataacttatggtccagcccaacctggcggcagcgcaaaagatg

SEQ ID NO: 217606 - DNA, 103 bp, Artificial Sequence
  Synthetic Polynucleotide
taatacgactcactataggggggggagcccacgggggtagaagggctggaaacagaggagatccagcatgtctacccccaacctggcggcagcgcaaaagatg

SEQ ID NO: 217607 - DNA, 103 bp, Artificial Sequence
  Synthetic Polynucleotide
taatacgactcactatagggccaggccctggggggagcccacgggggtagaacagaggagactacccatgtgggctcccaacctggcggcagcgcaaaagatg

SEQ ID NO: 217608 - DNA, 103 bp, Artificial Sequence
  Synthetic Polynucleotide
taatacgactcactataggggacgttcctgccaggccctggggggagcccaacagaggagagggctcatgccagggcctaacctggcggcagcgcaaaagatg

SEQ ID NO: 217609 - DNA, 103 bp, Artificial Sequence
  Synthetic Polynucleotide
taatacgactcactatagggaggccactgtgacgttcctgccaggccctgaacagaggagacagggcatggcaggaacgaacctggcggcagcgcaaaagatg

SEQ ID NO: 217610 - DNA, 103 bp, Artificial Sequence
  Synthetic Polynucleotide
taatacgactcactataggggcgccccggccagggaggcgggccggccctaacagaggagaagggccatgccgcctcccaacctggcggcagcgcaaaagatg

SEQ ID NO: 217611 - DNA, 103 bp, Artificial Sequence
  Synthetic Polynucleotide
taatacgactcactatagggctcctgctcgaggccactgtgacgttcctgaacagaggagacaggaaatgcacagtggcaacctggcggcagcgcaaaagatg

SEQ ID NO: 217612 - DNA, 103 bp, Artificial Sequence
  Synthetic Polynucleotide
taatacgactcactataggggcaccgggggctcctgctcgaggccactgtaacagaggagaacagtgatgtcgagcaggaacctggcggcagcgcaaaagatg

SEQ ID NO: 217613 - DNA, 103 bp, Artificial Sequence
  Synthetic Polynucleotide
taatacgactcactataggggggcgataaggcaccgggggctcctgctcgaacagaggagacgagcaatggcccccggtaacctggcggcagcgcaaaagatg

SEQ ID NO: 217614 - DNA, 103 bp, Artificial Sequence
  Synthetic Polynucleotide
taatacgactcactatagggcgtcgtagctgggcgataaggcaccgggggaacagaggagacccccgatgccttatcgcaacctggcggcagcgcaaaagatg

SEQ ID NO: 217615 - DNA, 103 bp, Artificial Sequence
  Synthetic Polynucleotide
taatacgactcactatagggtggagacccccgtcgtagctgggcgataagaacagaggagacttatcatgcagctacgaaacctggcggcagcgcaaaagatg

SEQ ID NO: 217616 - DNA, 103 bp, Artificial Sequence
  Synthetic Polynucleotide
taatacgactcactatagggctgcaggccgtggagacccccgtcgtagctaacagaggagaagctacatggggggtctcaacctggcggcagcgcaaaagatg

SEQ ID NO: 217617 - DNA, 103 bp, Artificial Sequence
  Synthetic Polynucleotide
taatacgactcactatagggctatcttactctgcaggccgtggagaccccaacagaggagaggggtcatgacggcctgcaacctggcggcagcgcaaaagatg

SEQ ID NO: 217618 - DNA, 103 bp, Artificial Sequence
  Synthetic Polynucleotide
taatacgactcactatagggaggtggtcttctatcttactctgcaggccgaacagaggagacggcctatggagtaagataacctggcggcagcgcaaaagatg

SEQ ID NO: 217619 - DNA, 103 bp, Artificial Sequence
  Synthetic Polynucleotide
taatacgactcactatagggggcctcgtccaggtggtcttctatcttactaacagaggagaagtaagatggaagaccacaacctggcggcagcgcaaaagatg

SEQ ID NO: 217620 - DNA, 103 bp, Artificial Sequence
  Synthetic Polynucleotide
taatacgactcactataggggcacgtggatggcctcgtccaggtggtcttaacagaggagaaagaccatgtggacgaggaacctggcggcagcgcaaaagatg

SEQ ID NO: 217621 - DNA, 103 bp, Artificial Sequence
  Synthetic Polynucleotide
taatacgactcactatagggcctccgaactgcgccccggccagggaggcgaacagaggagacgcctcatgggccggggcaacctggcggcagcgcaaaagatg

SEQ ID NO: 217622 - DNA, 103 bp, Artificial Sequence
  Synthetic Polynucleotide
taatacgactcactatagggtggctgcggagcacgtggatggcctcgtccaacagaggagaggacgaatgcatccacgtaacctggcggcagcgcaaaagatg

SEQ ID NO: 217623 - DNA, 103 bp, Artificial Sequence
  Synthetic Polynucleotide
taatacgactcactataggggcccacggcgtggctgcggagcacgtggataacagaggagaatccacatgctccgcagcaacctggcggcagcgcaaaagatg

SEQ ID NO: 217624 - DNA, 103 bp, Artificial Sequence
  Synthetic Polynucleotide
taatacgactcactatagggcgccggctgtgcccacggcgtggctgcggaaacagaggagatccgcaatgacgccgtggaacctggcggcagcgcaaaagatg

SEQ ID NO: 217625 - DNA, 103 bp, Artificial Sequence
  Synthetic Polynucleotide
taatacgactcactataggggtgtgcatgtcgccggctgtgcccacggcgaacagaggagacgccgtatgcacagccggaacctggcggcagcgcaaaagatg

SEQ ID NO: 217626 - DNA, 103 bp, Artificial Sequence
  Synthetic Polynucleotide
taatacgactcactatagggaggcagcagcgtgtgcatgtcgccggctgtaacagaggagaacagccatggacatgcacaacctggcggcagcgcaaaagatg

SEQ ID NO: 217627 - DNA, 103 bp, Artificial Sequence
  Synthetic Polynucleotide
taatacgactcactatagggccccgtggccaggcagcagcgtgtgcatgtaacagaggagaacatgcatgcgctgctgcaacctggcggcagcgcaaaagatg

SEQ ID NO: 217628 - DNA, 103 bp, Artificial Sequence
  Synthetic Polynucleotide
taatacgactcactataggggaggccagcgccccgtggccaggcagcagcaacagaggagagctgctatgtggccacggaacctggcggcagcgcaaaagatg

SEQ ID NO: 217629 - DNA, 103 bp, Artificial Sequence
  Synthetic Polynucleotide
taatacgactcactatagggggtgaaacctgaggccagcgccccgtggccaacagaggagaggccacatggcgctggccaacctggcggcagcgcaaaagatg

SEQ ID NO: 217630 - DNA, 103 bp, Artificial Sequence
  Synthetic Polynucleotide
taatacgactcactatagggacatggggccggtgaaacctgaggccagcgaacagaggagacgctggatgcaggtttcaaacctggcggcagcgcaaaagatg

SEQ ID NO: 217631 - DNA, 103 bp, Artificial Sequence
  Synthetic Polynucleotide
taatacgactcactatagggccgcccagtgacatggggccggtgaaacctaacagaggagaaggtttatgcggccccataacctggcggcagcgcaaaagatg

SEQ ID NO: 217632 - DNA, 103 bp, Artificial Sequence
  Synthetic Polynucleotide
taatacgactcactatagggaagacctgaacctccgaactgcgccccggcaacagaggagagccgggatgcagttcggaaacctggcggcagcgcaaaagatg

SEQ ID NO: 217633 - DNA, 103 bp, Artificial Sequence
  Synthetic Polynucleotide
taatacgactcactatagggtgcgtgccgcccgcccagtgacatggggccaacagaggagaggccccatgtcactgggcaacctggcggcagcgcaaaagatg

SEQ ID NO: 217634 - DNA, 103 bp, Artificial Sequence
  Synthetic Polynucleotide
taatacgactcactatagggcaaccaggcctgcgtgccgcccgcccagtgaacagaggagacactggatgggcggcacgaacctggcggcagcgcaaaagatg

SEQ ID NO: 217635 - DNA, 103 bp, Artificial Sequence
  Synthetic Polynucleotide
taatacgactcactatagggtggctgcctccaaccaggcctgcgtgccgcaacagaggagagcggcaatgaggcctggtaacctggcggcagcgcaaaagatg

SEQ ID NO: 217636 - DNA, 103 bp, Artificial Sequence
  Synthetic Polynucleotide
taatacgactcactataggggtcctcggggtggctgcctccaaccaggccaacagaggagaggcctgatgggaggcagcaacctggcggcagcgcaaaagatg

SEQ ID NO: 217637 - DNA, 103 bp, Artificial Sequence
  Synthetic Polynucleotide
taatacgactcactatagggctgcgaggccgtcctcggggtggctgcctcaacagaggagagaggcaatgaccccgaggaacctggcggcagcgcaaaagatg

SEQ ID NO: 217638 - DNA, 103 bp, Artificial Sequence
  Synthetic Polynucleotide
taatacgactcactatagggctggtgctgcctgcgaggccgtcctcggggaacagaggagaccccgaatgcggcctcgcaacctggcggcagcgcaaaagatg

SEQ ID NO: 217639 - DNA, 103 bp, Artificial Sequence
  Synthetic Polynucleotide
taatacgactcactataggggtgcatgaggctggtgctgcctgcgaggccaacagaggagaggcctcatgggcagcaccaacctggcggcagcgcaaaagatg

SEQ ID NO: 217640 - DNA, 103 bp, Artificial Sequence
  Synthetic Polynucleotide
taatacgactcactatagggccgcgtggttgtgcatgaggctggtgctgcaacagaggagagcagcaatggcctcatgcaacctggcggcagcgcaaaagatg

SEQ ID NO: 217641 - DNA, 103 bp, Artificial Sequence
  Synthetic Polynucleotide
taatacgactcactatagggctggggagggccgcgtggttgtgcatgaggaacagaggagacctcatatgcaaccacgcaacctggcggcagcgcaaaagatg

SEQ ID NO: 217642 - DNA, 103 bp, Artificial Sequence
  Synthetic Polynucleotide
taatacgactcactataggggcctggctggctggggagggccgcgtggttaacagaggagaaaccacatggccctccccaacctggcggcagcgcaaaagatg

SEQ ID NO: 217643 - DNA, 103 bp, Artificial Sequence
  Synthetic Polynucleotide
taatacgactcactataggggccggtcctcaagacctgaacctccgaactaacagaggagaagttcgatggttcaggtcaacctggcggcagcgcaaaagatg

SEQ ID NO: 217644 - DNA, 103 bp, Artificial Sequence
  Synthetic Polynucleotide
taatacgactcactatagggcagggagggtgcctggctggctggggagggaacagaggagaccctccatggccagccagaacctggcggcagcgcaaaagatg

SEQ ID NO: 217645 - DNA, 103 bp, Artificial Sequence
  Synthetic Polynucleotide
taatacgactcactatagggcgagacaggtcagggagggtgcctggctggaacagaggagaccagccatgcaccctcccaacctggcggcagcgcaaaagatg

SEQ ID NO: 217646 - DNA, 103 bp, Artificial Sequence
  Synthetic Polynucleotide
taatacgactcactataggggtcgggaggccgagacaggtcagggagggtaacagaggagaaccctcatggacctgtctaacctggcggcagcgcaaaagatg

SEQ ID NO: 217647 - DNA, 103 bp, Artificial Sequence
  Synthetic Polynucleotide
taatacgactcactatagggcactgtaggagtcgggaggccgagacaggtaacagaggagaacctgtatgggcctcccgaacctggcggcagcgcaaaagatg

SEQ ID NO: 217648 - DNA, 103 bp, Artificial Sequence
  Synthetic Polynucleotide
taatacgactcactatagggcgccctagcccactgtaggagtcgggaggcaacagaggagagcctccatgctcctacagaacctggcggcagcgcaaaagatg

SEQ ID NO: 217649 - DNA, 103 bp, Artificial Sequence
  Synthetic Polynucleotide
taatacgactcactatagggggcacctgctcgccctagcccactgtaggaaacagaggagatcctacatggggctagggaacctggcggcagcgcaaaagatg

SEQ ID NO: 217650 - DNA, 103 bp, Artificial Sequence
  Synthetic Polynucleotide
taatacgactcactatagggcggccgccgtggcacctgctcgccctagccaacagaggagaggctagatggagcaggtgaacctggcggcagcgcaaaagatg

SEQ ID NO: 217651 - DNA, 103 bp, Artificial Sequence
  Synthetic Polynucleotide
taatacgactcactatagggatctcgctggcggccgccgtggcacctgctaacagaggagaagcaggatgcacggcggcaacctggcggcagcgcaaaagatg

SEQ ID NO: 217652 - DNA, 103 bp, Artificial Sequence
  Synthetic Polynucleotide
taatacgactcactatagggctcccgcttgatctcgctggcggccgccgtaacagaggagaacggcgatggccagcgagaacctggcggcagcgcaaaagatg

SEQ ID NO: 217653 - DNA, 103 bp, Artificial Sequence
  Synthetic Polynucleotide
taatacgactcactatagggcctccttctcctcccgcttgatctcgctggaacagaggagaccagcgatgtcaagcgggaacctggcggcagcgcaaaagatg

SEQ ID NO: 217654 - DNA, 103 bp, Artificial Sequence
  Synthetic Polynucleotide
taatacgactcactatagggcctgagctgggccggtcctcaagacctgaaaacagaggagattcaggatgtgaggaccgaacctggcggcagcgcaaaagatg

SEQ ID NO: 217655 - DNA, 103 bp, Artificial Sequence
  Synthetic Polynucleotide
taatacgactcactatagggttctcctcgtcctccttctcctcccgcttgaacagaggagacaagcgatgggagaaggaaacctggcggcagcgcaaaagatg

SEQ ID NO: 217656 - DNA, 103 bp, Artificial Sequence
  Synthetic Polynucleotide
taatacgactcactatagggcgctgacgtgttctcctcgtcctccttctcaacagaggagagagaagatggacgaggagaacctggcggcagcgcaaaagatg

SEQ ID NO: 217657 - DNA, 103 bp, Artificial Sequence
  Synthetic Polynucleotide
taatacgactcactatagggagtggtcagccgctgacgtgttctcctcgtaacagaggagaacgaggatgacacgtcagaacctggcggcagcgcaaaagatg

SEQ ID NO: 217658 - DNA, 103 bp, Artificial Sequence
  Synthetic Polynucleotide
taatacgactcactatagggtcctcctccgagtggtcagccgctgacgtgaacagaggagacacgtcatgggctgaccaaacctggcggcagcgcaaaagatg

SEQ ID NO: 217659 - DNA, 103 bp, Artificial Sequence
  Synthetic Polynucleotide
taatacgactcactatagggctccttcttctcctcctccgagtggtcagcaacagaggagagctgacatgtcggaggagaacctggcggcagcgcaaaagatg

SEQ ID NO: 217660 - DNA, 103 bp, Artificial Sequence
  Synthetic Polynucleotide
taatacgactcactataggggggccttcagctccttcttctcctcctccgaacagaggagacggaggatgagaagaaggaacctggcggcagcgcaaaagatg

SEQ ID NO: 217661 - DNA, 103 bp, Artificial Sequence
  Synthetic Polynucleotide
taatacgactcactatagggcgggcccggggggccttcagctccttcttcaacagaggagagaagaaatggctgaaggcaacctggcggcagcgcaaaagatg

SEQ ID NO: 217662 - DNA, 103 bp, Artificial Sequence
  Synthetic Polynucleotide
taatacgactcactatagggtgggctggtccgggcccggggggccttcagaacagaggagactgaagatgccccgggccaacctggcggcagcgcaaaagatg

SEQ ID NO: 217663 - DNA, 103 bp, Artificial Sequence
  Synthetic Polynucleotide
taatacgactcactatagggcgtcctcgtctgggctggtccgggcccgggaacagaggagacccgggatgggaccagccaacctggcggcagcgcaaaagatg

SEQ ID NO: 217664 - DNA, 103 bp, Artificial Sequence
  Synthetic Polynucleotide
taatacgactcactatagggaggtcgtcctcgtcctcgtctgggctggtcaacagaggagagaccagatgagacgaggaaacctggcggcagcgcaaaagatg

SEQ ID NO: 217665 - DNA, 103 bp, Artificial Sequence
  Synthetic Polynucleotide
taatacgactcactataggggccccaggagcctgagctgggccggtcctcaacagaggagagaggacatgcccagctcaaacctggcggcagcgcaaaagatg

SEQ ID NO: 217666 - DNA, 103 bp, Artificial Sequence
  Synthetic Polynucleotide
taatacgactcactatagggtggggggagaaggtcgtcctcgtcctcgtcaacagaggagagacgagatggaggacgacaacctggcggcagcgcaaaagatg

SEQ ID NO: 217667 - DNA, 103 bp, Artificial Sequence
  Synthetic Polynucleotide
taatacgactcactatagggccttctgctctggggggagaaggtcgtcctaacagaggagaaggacgatgttctcccccaacctggcggcagcgcaaaagatg

SEQ ID NO: 217668 - DNA, 103 bp, Artificial Sequence
  Synthetic Polynucleotide
taatacgactcactatagggtcccgctcggccttctgctctggggggagaaacagaggagatctcccatgagagcagaaaacctggcggcagcgcaaaagatg

SEQ ID NO: 217669 - DNA, 103 bp, Artificial Sequence
  Synthetic Polynucleotide
taatacgactcactataggggcgctccttctcccgctcggccttctgctcaacagaggagagagcagatggccgagcggaacctggcggcagcgcaaaagatg

SEQ ID NO: 217670 - DNA, 103 bp, Artificial Sequence
  Synthetic Polynucleotide
taatacgactcactatagggtggccacccggcgctccttctcccgctcggaacagaggagaccgagcatgagaaggagcaacctggcggcagcgcaaaagatg

SEQ ID NO: 217671 - DNA, 103 bp, Artificial Sequence
  Synthetic Polynucleotide
taatacgactcactatagggcgggcgttattggccacccggcgctccttcaacagaggagagaaggaatgccgggtggcaacctggcggcagcgcaaaagatg

SEQ ID NO: 217672 - DNA, 103 bp, Artificial Sequence
  Synthetic Polynucleotide
taatacgactcactatagggcagccgctcccgggcgttattggccacccgaacagaggagacgggtgatgaataacgccaacctggcggcagcgcaaaagatg

SEQ ID NO: 217673 - DNA, 103 bp, Artificial Sequence
  Synthetic Polynucleotide
taatacgactcactatagggcacggacccgcagccgctcccgggcgttataacagaggagaataacgatggggagcggcaacctggcggcagcgcaaaagatg

SEQ ID NO: 217674 - DNA, 103 bp, Artificial Sequence
  Synthetic Polynucleotide
taatacgactcactatagggtcgttgatgtcacggacccgcagccgctccaacagaggagaggagcgatggcgggtccgaacctggcggcagcgcaaaagatg

SEQ ID NO: 217675 - DNA, 103 bp, Artificial Sequence
  Synthetic Polynucleotide
taatacgactcactatagggcttaaaggcctcgttgatgtcacggacccgaacagaggagacgggtcatggacatcaacaacctggcggcagcgcaaaagatg

SEQ ID NO: 217676 - DNA, 103 bp, Artificial Sequence
  Synthetic Polynucleotide
taatacgactcactatagggggtcgccgctgccccaggagcctgagctggaacagaggagaccagctatggctcctgggaacctggcggcagcgcaaaagatg

SEQ ID NO: 217677 - DNA, 103 bp, Artificial Sequence
  Synthetic Polynucleotide
taatacgactcactataggggccccagctccttaaaggcctcgttgatgtaacagaggagaacatcaatgaggcctttaaacctggcggcagcgcaaaagatg

SEQ ID NO: 217678 - DNA, 103 bp, Artificial Sequence
  Synthetic Polynucleotide
taatacgactcactatagggtggcacatgcgccccagctccttaaaggccaacagaggagaggccttatgggagctgggaacctggcggcagcgcaaaagatg

SEQ ID NO: 217679 - DNA, 103 bp, Artificial Sequence
  Synthetic Polynucleotide
taatacgactcactataggggaggtgcagttggcacatgcgccccagctcaacagaggagagagctgatgcgcatgtgcaacctggcggcagcgcaaaagatg

SEQ ID NO: 217680 - DNA, 103 bp, Artificial Sequence
  Synthetic Polynucleotide
taatacgactcactatagggtctcgctgttgaggtgcagttggcacatgcaacagaggagagcatgtatgaactgcaccaacctggcggcagcgcaaaagatg

SEQ ID NO: 217681 - DNA, 103 bp, Artificial Sequence
  Synthetic Polynucleotide
taatacgactcactataggggtctggggcttctcgctgttgaggtgcagtaacagaggagaactgcaatgcaacagcgaaacctggcggcagcgcaaaagatg

SEQ ID NO: 217682 - DNA, 103 bp, Artificial Sequence
  Synthetic Polynucleotide
taatacgactcactataggggagcagtttggtctggggcttctcgctgttaacagaggagaaacagcatgaagccccagaacctggcggcagcgcaaaagatg

SEQ ID NO: 217683 - DNA, 103 bp, Artificial Sequence
  Synthetic Polynucleotide
taatacgactcactatagggggtgcaggatgagcagtttggtctggggctaacagaggagaagccccatgccaaactgcaacctggcggcagcgcaaaagatg

SEQ ID NO: 217684 - DNA, 103 bp, Artificial Sequence
  Synthetic Polynucleotide
taatacgactcactataggggagacagcctggtgcaggatgagcagtttgaacagaggagacaaactatgcatcctgcaaacctggcggcagcgcaaaagatg

SEQ ID NO: 217685 - DNA, 103 bp, Artificial Sequence
  Synthetic Polynucleotide
taatacgactcactatagggcaggatgaccgagacagcctggtgcaggataacagaggagaatcctgatgcaggctgtcaacctggcggcagcgcaaaagatg

SEQ ID NO: 217686 - DNA, 103 bp, Artificial Sequence
  Synthetic Polynucleotide
taatacgactcactataggggctccaagttcaggatgaccgagacagcctaacagaggagaaggctgatgcggtcatccaacctggcggcagcgcaaaagatg

SEQ ID NO: 217687 - DNA, 103 bp, Artificial Sequence
  Synthetic Polynucleotide
taatacgactcactataggggagctgctctggtcgccgctgccccaggagaacagaggagactcctgatgcagcggcgaaacctggcggcagcgcaaaagatg

SEQ ID NO: 217688 - DNA, 103 bp, Artificial Sequence
  Synthetic Polynucleotide
taatacgactcactatagggcgcacttgctgctccaagttcaggatgaccaacagaggagaggtcatatggaacttggaaacctggcggcagcgcaaaagatg

SEQ ID NO: 217689 - DNA, 103 bp, Artificial Sequence
  Synthetic Polynucleotide
taatacgactcactataggggttccgctctcgcacttgctgctccaagttaacagaggagaaacttgatgcagcaagtgaacctggcggcagcgcaaaagatg

SEQ ID NO: 217690 - DNA, 103 bp, Artificial Sequence
  Synthetic Polynucleotide
taatacgactcactatagggtgggattcaggttccgctctcgcacttgctaacagaggagaagcaagatggagagcggaaacctggcggcagcgcaaaagatg

SEQ ID NO: 217691 - DNA, 103 bp, Artificial Sequence
  Synthetic Polynucleotide
taatacgactcactatagggcaggctgctttgggattcaggttccgctctaacagaggagaagagcgatgcctgaatccaacctggcggcagcgcaaaagatg

SEQ ID NO: 217692 - DNA, 103 bp, Artificial Sequence
  Synthetic Polynucleotide
taatacgactcactatagggccgtttcaaacaggctgctttgggattcagaacagaggagactgaatatgaaagcagccaacctggcggcagcgcaaaagatg

SEQ ID NO: 217693 - DNA, 103 bp, Artificial Sequence
  Synthetic Polynucleotide
taatacgactcactatagggcctcttctcgccgtttcaaacaggctgcttaacagaggagaaagcagatggtttgaaacaacctggcggcagcgcaaaagatg

SEQ ID NO: 217694 - DNA, 103 bp, Artificial Sequence
  Synthetic Polynucleotide
taatacgactcactataggggacaccttttcctcttctcgccgtttcaaaaacagaggagatttgaaatggcgagaagaaacctggcggcagcgcaaaagatg

SEQ ID NO: 217695 - DNA, 103 bp, Artificial Sequence
  Synthetic Polynucleotide
taatacgactcactatagggaaccacacctgacaccttttcctcttctcgaacagaggagacgagaaatggaaaaggtgaacctggcggcagcgcaaaagatg

SEQ ID NO: 217696 - DNA, 103 bp, Artificial Sequence
  Synthetic Polynucleotide
taatacgactcactataggggggggtctccaaccacacctgacaccttttaacagaggagaaaaaggatgcaggtgtggaacctggcggcagcgcaaaagatg

SEQ ID NO: 217697 - DNA, 103 bp, Artificial Sequence
  Synthetic Polynucleotide
taatacgactcactatagggagcaccatctgggggtctccaaccacacctaacagaggagaaggtgtatgtggagacccaacctggcggcagcgcaaaagatg

SEQ ID NO: 217698 - DNA, 103 bp, Artificial Sequence
  Synthetic Polynucleotide
taatacgactcactataggggtcaaaggaggagctgctctggtcgccgctaacagaggagaagcggcatgcagagcagcaacctggcggcagcgcaaaagatg

SEQ ID NO: 217699 - DNA, 103 bp, Artificial Sequence
  Synthetic Polynucleotide
taatacgactcactataggggggagctgaaagcaccatctgggggtctccaacagaggagaggagacatgcagatggtgaacctggcggcagcgcaaaagatg

SEQ ID NO: 217700 - DNA, 103 bp, Artificial Sequence
  Synthetic Polynucleotide
taatacgactcactatagggggcctgggtggggagctgaaagcaccatctaacagaggagaagatggatgtttcagctcaacctggcggcagcgcaaaagatg

SEQ ID NO: 217701 - DNA, 103 bp, Artificial Sequence
  Synthetic Polynucleotide
taatacgactcactataggggcttcgctcaggcctgggtggggagctgaaaacagaggagattcagcatgccacccaggaacctggcggcagcgcaaaagatg

SEQ ID NO: 217702 - DNA, 103 bp, Artificial Sequence
  Synthetic Polynucleotide
taatacgactcactatagggggggttgtgggcttcgctcaggcctgggtgaacagaggagacacccaatgctgagcgaaaacctggcggcagcgcaaaagatg

SEQ ID NO: 217703 - DNA, 103 bp, Artificial Sequence
  Synthetic Polynucleotide
taatacgactcactatagggtgtgcccggcggggttgtgggcttcgctcaaacagaggagatgagcgatgcccacaaccaacctggcggcagcgcaaaagatg

SEQ ID NO: 217704 - DNA, 103 bp, Artificial Sequence
  Synthetic Polynucleotide
taatacgactcactatagggtgtctgtgcccacaggcgccatcctctgcgaacagaggagacgcagaatgtggcgcctgaacctggcggcagcgcaaaagatg

SEQ ID NO: 217705 - DNA, 103 bp, Artificial Sequence
  Synthetic Polynucleotide
taatacgactcactatagggtccggctggggtcaaaggaggagctgctctaacagaggagaagagcaatgcctcctttgaacctggcggcagcgcaaaagatg

SEQ ID NO: 217706 - DNA, 103 bp, Artificial Sequence
  Synthetic Polynucleotide
taatacgactcactatagggtcgctgaaggtccggctggggtcaaaggagaacagaggagactccttatgccccagccgaacctggcggcagcgcaaaagatg

SEQ ID NO: 217707 - DNA, 103 bp, Artificial Sequence
  Synthetic Polynucleotide
taatacgactcactataggggtgggtgccctcgctgaaggtccggctgggaacagaggagacccagcatgaccttcagcaacctggcggcagcgcaaaagatg

SEQ ID NO: 217708 - DNA, 103 bp, Artificial Sequence
  Synthetic Polynucleotide
taatacgactcactatagggactcagtgaagtgggtgccctcgctgaaggaacagaggagaccttcaatgagggcacccaacctggcggcagcgcaaaagatg

SEQ ID NO: 217709 - DNA, 103 bp, Artificial Sequence
  Synthetic Polynucleotide
taatacgactcactatagggctgctgtgcgactcagtgaagtgggtgcccaacagaggagagggcacatgcttcactgaaacctggcggcagcgcaaaagatg

SEQ ID NO: 217710 - DNA, 103 bp, Artificial Sequence
  Synthetic Polynucleotide
taatacgactcactatagggtgaagagaggctgctgtgcgactcagtgaaaacagaggagattcactatgtcgcacagcaacctggcggcagcgcaaaagatg

SEQ ID NO: 217711 - DNA, 103 bp, Artificial Sequence
  Synthetic Polynucleotide
taatacgactcactatagggggaatgtggatgaagagaggctgctgtgcgaacagaggagacgcacaatggcctctcttaacctggcggcagcgcaaaagatg

SEQ ID NO: 217712 - DNA, 103 bp, Artificial Sequence
  Synthetic Polynucleotide
taatacgactcactatagggcccggtcccaggaatgtggatgaagagaggaacagaggagacctctcatgatccacattaacctggcggcagcgcaaaagatg

SEQ ID NO: 217713 - DNA, 103 bp, Artificial Sequence
  Synthetic Polynucleotide
taatacgactcactataggggcctccgagtcccggtcccaggaatgtggaaacagaggagatccacaatgctgggaccgaacctggcggcagcgcaaaagatg

SEQ ID NO: 217714 - DNA, 103 bp, Artificial Sequence
  Synthetic Polynucleotide
taatacgactcactatagggcaccgctcttgcctccgagtcccggtcccaaacagaggagatgggacatggactcggagaacctggcggcagcgcaaaagatg

SEQ ID NO: 217715 - DNA, 103 bp, Artificial Sequence
  Synthetic Polynucleotide
taatacgactcactatagggctgagctccttgtctgtgcccacaggcgccaacagaggagaggcgccatggggcacagaaacctggcggcagcgcaaaagatg

SEQ ID NO: 217716 - DNA, 103 bp, Artificial Sequence
  Synthetic Polynucleotide
taatacgactcactataggggcgccccgctcaccgctcttgcctccgagtaacagaggagaactcggatgcaagagcggaacctggcggcagcgcaaaagatg

SEQ ID NO: 217717 - DNA, 103 bp, Artificial Sequence
  Synthetic Polynucleotide
taatacgactcactatagggggaggcataggcgccccgctcaccgctcttaacagaggagaaagagcatggagcggggcaacctggcggcagcgcaaaagatg

SEQ ID NO: 217718 - DNA, 103 bp, Artificial Sequence
  Synthetic Polynucleotide
taatacgactcactatagggctctcccgaaggaggcataggcgccccgctaacagaggagaagcgggatgcctatgcctaacctggcggcagcgcaaaagatg

SEQ ID NO: 217719 - DNA, 103 bp, Artificial Sequence
  Synthetic Polynucleotide
taatacgactcactatagggacgcctgcgtctctcccgaaggaggcatagaacagaggagactatgcatgcttcgggagaacctggcggcagcgcaaaagatg

SEQ ID NO: 217720 - DNA, 103 bp, Artificial Sequence
  Synthetic Polynucleotide
taatacgactcactatagggcaggccgcccacgcctgcgtctctcccgaaaacagaggagattcgggatggacgcaggcaacctggcggcagcgcaaaagatg

SEQ ID NO: 217721 - DNA, 103 bp, Artificial Sequence
  Synthetic Polynucleotide
taatacgactcactatagggcagcctgagtcaggccgcccacgcctgcgtaacagaggagaacgcagatgtgggcggccaacctggcggcagcgcaaaagatg

SEQ ID NO: 217722 - DNA, 103 bp, Artificial Sequence
  Synthetic Polynucleotide
taatacgactcactataggggacaggaagccagcctgagtcaggccgcccaacagaggagagggcggatggactcaggcaacctggcggcagcgcaaaagatg

SEQ ID NO: 217723 - DNA, 103 bp, Artificial Sequence
  Synthetic Polynucleotide
taatacgactcactatagggcagctcgcctgacaggaagccagcctgagtaacagaggagaactcagatgggcttcctgaacctggcggcagcgcaaaagatg

SEQ ID NO: 217724 - DNA, 103 bp, Artificial Sequence
  Synthetic Polynucleotide
taatacgactcactatagggtgttgagggccagctcgcctgacaggaagcaacagaggagagcttccatgcaggcgagcaacctggcggcagcgcaaaagatg

SEQ ID NO: 217725 - DNA, 103 bp, Artificial Sequence
  Synthetic Polynucleotide
taatacgactcactatagggggcccggggctgttgagggccagctcgcctaacagaggagaaggcgaatgggccctcaaaacctggcggcagcgcaaaagatg

SEQ ID NO: 217726 - DNA, 103 bp, Artificial Sequence
  Synthetic Polynucleotide
taatacgactcactatagggcaggaggtcactgagctccttgtctgtgccaacagaggagaggcacaatgaaggagctcaacctggcggcagcgcaaaagatg

SEQ ID NO: 217727 - DNA, 103 bp, Artificial Sequence
  Synthetic Polynucleotide
taatacgactcactatagggaggggacaggggcccggggctgttgagggcaacagaggagagccctcatgagccccgggaacctggcggcagcgcaaaagatg

SEQ ID NO: 217728 - DNA, 103 bp, Artificial Sequence
  Synthetic Polynucleotide
taatacgactcactatagggtcatgcccgaaggggacaggggcccggggcaacagaggagagccccgatgccctgtcccaacctggcggcagcgcaaaagatg

SEQ ID NO: 217729 - DNA, 103 bp, Artificial Sequence
  Synthetic Polynucleotide
taatacgactcactataggggaggtccccttcatgcccgaaggggacaggaacagaggagacctgtcatgttcgggcataacctggcggcagcgcaaaagatg

SEQ ID NO: 217730 - DNA, 103 bp, Artificial Sequence
  Synthetic Polynucleotide
taatacgactcactataggggtagtactgggaggtccccttcatgcccgaaacagaggagatcgggcatgaaggggaccaacctggcggcagcgcaaaagatg

SEQ ID NO: 217731 - DNA, 103 bp, Artificial Sequence
  Synthetic Polynucleotide
taatacgactcactatagggagtaggaggggtagtactgggaggtcccctaacagaggagaaggggaatgcccagtactaacctggcggcagcgcaaaagatg

SEQ ID NO: 217732 - DNA, 103 bp, Artificial Sequence
  Synthetic Polynucleotide
taatacgactcactataggggagctgccggagtaggaggggtagtactggaacagaggagaccagtaatgcccctcctaaacctggcggcagcgcaaaagatg

SEQ ID NO: 217733 - DNA, 103 bp, Artificial Sequence
  Synthetic Polynucleotide
taatacgactcactatagggtctccgccgggagctgccggagtaggagggaacagaggagaccctccatgtccggcagcaacctggcggcagcgcaaaagatg

SEQ ID NO: 217734 - DNA, 103 bp, Artificial Sequence
  Synthetic Polynucleotide
taatacgactcactatagggcgtctgccgctctccgccgggagctgccggaacagaggagaccggcaatgcccggcggaaacctggcggcagcgcaaaagatg

SEQ ID NO: 217735 - DNA, 103 bp, Artificial Sequence
  Synthetic Polynucleotide
taatacgactcactatagggtctaggctgccgtctgccgctctccgccggaacagaggagaccggcgatgagcggcagaaacctggcggcagcgcaaaagatg

SEQ ID NO: 217736 - DNA, 103 bp, Artificial Sequence
  Synthetic Polynucleotide
taatacgactcactataggggggctgcgtgtctaggctgccgtctgccgcaacagaggagagcggcaatgggcagcctaaacctggcggcagcgcaaaagatg

SEQ ID NO: 217737 - DNA, 103 bp, Artificial Sequence
  Synthetic Polynucleotide
taatacgactcactatagggtgctgaagtccaggaggtcactgagctcctaacagaggagaaggagcatggtgacctccaacctggcggcagcgcaaaagatg

SEQ ID NO: 217738 - DNA, 103 bp, Artificial Sequence
  Synthetic Polynucleotide
taatacgactcactatagggggaccttcttgggctgcgtgtctaggctgcaacagaggagagcagccatgacacgcagcaacctggcggcagcgcaaaagatg

SEQ ID NO: 217739 - DNA, 103 bp, Artificial Sequence
  Synthetic Polynucleotide
taatacgactcactataggggggaccttccggaccttcttgggctgcgtgaacagaggagacacgcaatgcaagaaggtaacctggcggcagcgcaaaagatg

SEQ ID NO: 217740 - DNA, 103 bp, Artificial Sequence
  Synthetic Polynucleotide
taatacgactcactatagggaagacccggcgggaccttccggaccttcttaacagaggagaaagaagatgcggaaggtcaacctggcggcagcgcaaaagatg

SEQ ID NO: 217741 - DNA, 103 bp, Artificial Sequence
  Synthetic Polynucleotide
taatacgactcactatagggccgaggatggaagacccggcgggaccttccaacagaggagaggaaggatgcgccgggtcaacctggcggcagcgcaaaagatg

SEQ ID NO: 217742 - DNA, 103 bp, Artificial Sequence
  Synthetic Polynucleotide
taatacgactcactatagggggtgggtacaccgaggatggaagacccggcaacagaggagagccgggatgtccatcctcaacctggcggcagcgcaaaagatg

SEQ ID NO: 217743 - DNA, 103 bp, Artificial Sequence
  Synthetic Polynucleotide
taatacgactcactatagggacctgagctgggtgggtacaccgaggatggaacagaggagaccatccatggtgtacccaaacctggcggcagcgcaaaagatg

SEQ ID NO: 217744 - DNA, 103 bp, Artificial Sequence
  Synthetic Polynucleotide
taatacgactcactatagggcgtagtcctcacctgagctgggtgggtacaaacagaggagatgtaccatgccagctcagaacctggcggcagcgcaaaagatg

SEQ ID NO: 217745 - DNA, 103 bp, Artificial Sequence
  Synthetic Polynucleotide
taatacgactcactataggggcatccctgccgtagtcctcacctgagctgaacagaggagacagctcatgtgaggactaaacctggcggcagcgcaaaagatg

SEQ ID NO: 217746 - DNA, 103 bp, Artificial Sequence
  Synthetic Polynucleotide
taatacgactcactataggggtaggcggtggcatccctgccgtagtcctcaacagaggagagaggacatgggcagggataacctggcggcagcgcaaaagatg

SEQ ID NO: 217747 - DNA, 103 bp, Artificial Sequence
  Synthetic Polynucleotide
taatacgactcactatagggtggcggacgggtaggcggtggcatccctgcaacagaggagagcagggatgccaccgcctaacctggcggcagcgcaaaagatg

SEQ ID NO: 217748 - DNA, 103 bp, Artificial Sequence
  Synthetic Polynucleotide
taatacgactcactataggggggaacatcatgctgaagtccaggaggtcaaacagaggagatgacctatgggacttcagaacctggcggcagcgcaaaagatg

SEQ ID NO: 217749 - DNA, 103 bp, Artificial Sequence
  Synthetic Polynucleotide
taatacgactcactatagggctgggggtcttggcggacgggtaggcggtgaacagaggagacaccgcatgcccgtccgcaacctggcggcagcgcaaaagatg

SEQ ID NO: 217750 - DNA, 103 bp, Artificial Sequence
  Synthetic Polynucleotide
taatacgactcactatagggataggtgctgctgggggtcttggcggacggaacagaggagaccgtccatgaagacccccaacctggcggcagcgcaaaagatg

SEQ ID NO: 217751 - DNA, 103 bp, Artificial Sequence
  Synthetic Polynucleotide
taatacgactcactatagggagggggcgggataggtgctgctgggggtctaacagaggagaagacccatggcagcacctaacctggcggcagcgcaaaagatg

SEQ ID NO: 217752 - DNA, 103 bp, Artificial Sequence
  Synthetic Polynucleotide
taatacgactcactataggggccacgtagaagggggcgggataggtgctgaacagaggagacagcacatgtcccgccccaacctggcggcagcgcaaaagatg

SEQ ID NO: 217753 - DNA, 103 bp, Artificial Sequence
  Synthetic Polynucleotide
taatacgactcactataggggctgccatctgccacgtagaagggggcgggaacagaggagacccgccatgttctacgtgaacctggcggcagcgcaaaagatg

SEQ ID NO: 217754 - DNA, 103 bp, Artificial Sequence
  Synthetic Polynucleotide
taatacgactcactatagggaggggtgcaggctgccatctgccacgtagaaacagaggagatctacgatgcagatggcaaacctggcggcagcgcaaaagatg

SEQ ID NO: 217755 - DNA, 103 bp, Artificial Sequence
  Synthetic Polynucleotide
taatacgactcactatagggagctcggctgaggggtgcaggctgccatctaacagaggagaagatggatgcctgcacccaacctggcggcagcgcaaaagatg

SEQ ID NO: 217756 - DNA, 103 bp, Artificial Sequence
  Synthetic Polynucleotide
taatacgactcactataggggggactccagagctcggctgaggggtgcagaacagaggagactgcacatgtcagccgagaacctggcggcagcgcaaaagatg

SEQ ID NO: 217757 - DNA, 103 bp, Artificial Sequence
  Synthetic Polynucleotide
taatacgactcactatagggcctggcccgggggactccagagctcggctgaacagaggagacagccgatgtctggagtcaacctggcggcagcgcaaaagatg

SEQ ID NO: 217758 - DNA, 103 bp, Artificial Sequence
  Synthetic Polynucleotide
taatacgactcactatagggccgaagcccgcctggcccgggggactccagaacagaggagactggagatgcccgggccaaacctggcggcagcgcaaaagatg

SEQ ID NO: 217759 - DNA, 103 bp, Artificial Sequence
  Synthetic Polynucleotide
taatacgactcactataggggacaggcagcgggaacatcatgctgaagtcaacagaggagagacttcatgatgatgttcaacctggcggcagcgcaaaagatg

SEQ ID NO: 217760 - DNA, 103 bp, Artificial Sequence
  Synthetic Polynucleotide
taatacgactcactatagggcagcatgggcccgaagcccgcctggcccggaacagaggagaccgggcatggcgggcttcaacctggcggcagcgcaaaagatg

SEQ ID NO: 217761 - DNA, 103 bp, Artificial Sequence
  Synthetic Polynucleotide
taatacgactcactatagggagcccccacccagcatgggcccgaagcccgaacagaggagacgggctatgggcccatgcaacctggcggcagcgcaaaagatg

SEQ ID NO: 217762 - DNA, 103 bp, Artificial Sequence
  Synthetic Polynucleotide
taatacgactcactatagggagcggggatgagcccccacccagcatgggcaacagaggagagcccatatggggtgggggaacctggcggcagcgcaaaagatg

SEQ ID NO: 217763 - DNA, 103 bp, Artificial Sequence
  Synthetic Polynucleotide
taatacgactcactatagggcgggaggggcagcggggatgagcccccaccaacagaggagaggtgggatgtcatccccgaacctggcggcagcgcaaaagatg

SEQ ID NO: 217764 - DNA, 103 bp, Artificial Sequence
  Synthetic Polynucleotide
taatacgactcactatagggcgctaccgggcgggaggggcagcggggatgaacagaggagacatcccatgtgcccctccaacctggcggcagcgcaaaagatg

SEQ ID NO: 217765 - DNA, 103 bp, Artificial Sequence
  Synthetic Polynucleotide
taatacgactcactatagggcccaccgggccgctaccgggcgggaggggcaacagaggagagcccctatggcccggtagaacctggcggcagcgcaaaagatg

SEQ ID NO: 217766 - DNA, 103 bp, Artificial Sequence
  Synthetic Polynucleotide
taatacgactcactatagggtccactgctgcccaccgggccgctaccgggaacagaggagacccggtatgggcccggtgaacctggcggcagcgcaaaagatg

SEQ ID NO: 217767 - DNA, 103 bp, Artificial Sequence
  Synthetic Polynucleotide
taatacgactcactatagggtgctgctgcttccactgctgcccaccgggcaacagaggagagcccggatggcagcagtgaacctggcggcagcgcaaaagatg

SEQ ID NO: 217768 - DNA, 103 bp, Artificial Sequence
  Synthetic Polynucleotide
taatacgactcactatagggccaccaaacgtgctgctgcttccactgctgaacagaggagacagcagatgaagcagcagaacctggcggcagcgcaaaagatg

SEQ ID NO: 217769 - DNA, 103 bp, Artificial Sequence
  Synthetic Polynucleotide
taatacgactcactatagggctggtgcaggccaccaaacgtgctgctgctaacagaggagaagcagcatgacgtttggtaacctggcggcagcgcaaaagatg

SEQ ID NO: 217770 - DNA, 103 bp, Artificial Sequence
  Synthetic Polynucleotide
taatacgactcactatagggtcccgttggtgacaggcagcgggaacatcaaacagaggagatgatgtatgcgctgcctgaacctggcggcagcgcaaaagatg

SEQ ID NO: 217771 - DNA, 103 bp, Artificial Sequence
  Synthetic Polynucleotide
taatacgactcactatagggtacgctcgtgctggtgcaggccaccaaacgaacagaggagacgtttgatggcctgcaccaacctggcggcagcgcaaaagatg

SEQ ID NO: 217772 - DNA, 103 bp, Artificial Sequence
  Synthetic Polynucleotide
taatacgactcactatagggtggtagcccatacgctcgtgctggtgcaggaacagaggagacctgcaatggcacgagcgaacctggcggcagcgcaaaagatg

SEQ ID NO: 217773 - DNA, 103 bp, Artificial Sequence
  Synthetic Polynucleotide
taatacgactcactatagggtccatgcagctggtagcccatacgctcgtgaacagaggagacacgagatgatgggctacaacctggcggcagcgcaaaagatg

SEQ ID NO: 217774 - DNA, 103 bp, Artificial Sequence
  Synthetic Polynucleotide
taatacgactcactatagggtcacctctgctccatgcagctggtagcccaaacagaggagatgggctatgagctgcatgaacctggcggcagcgcaaaagatg

SEQ ID NO: 217775 - DNA, 103 bp, Artificial Sequence
  Synthetic Polynucleotide
taatacgactcactatagggagcccaccgttcacctctgctccatgcagcaacagaggagagctgcaatgagcagaggtaacctggcggcagcgcaaaagatg

SEQ ID NO: 217776 - DNA, 103 bp, Artificial Sequence
  Synthetic Polynucleotide
taatacgactcactatagggtgcagatgggagcccaccgttcacctctgcaacagaggagagcagagatgaacggtgggaacctggcggcagcgcaaaagatg

SEQ ID NO: 217777 - DNA, 103 bp, Artificial Sequence
  Synthetic Polynucleotide
taatacgactcactatagggagaaggaggatgcagatgggagcccaccgtaacagaggagaacggtgatgtcccatctgaacctggcggcagcgcaaaagatg

SEQ ID NO: 217778 - DNA, 103 bp, Artificial Sequence
  Synthetic Polynucleotide
taatacgactcactatagggggggctgaggagaaggaggatgcagatgggaacagaggagacccatcatgatcctccttaacctggcggcagcgcaaaagatg

SEQ ID NO: 217779 - DNA, 103 bp, Artificial Sequence
  Synthetic Polynucleotide
taatacgactcactatagggcgtggctccgggggctgaggagaaggaggaaacagaggagatcctccatgtcctcagccaacctggcggcagcgcaaaagatg

SEQ ID NO: 217780 - DNA, 103 bp, Artificial Sequence
  Synthetic Polynucleotide
taatacgactcactatagggcgccgccgtacgtggctccgggggctgaggaacagaggagacctcagatgccggagccaaacctggcggcagcgcaaaagatg

SEQ ID NO: 217781 - DNA, 103 bp, Artificial Sequence
  Synthetic Polynucleotide
taatacgactcactatagggggccggcccttcccgttggtgacaggcagcaacagaggagagctgccatgcaccaacggaacctggcggcagcgcaaaagatg

SEQ ID NO: 217782 - DNA, 103 bp, Artificial Sequence
  Synthetic Polynucleotide
taatacgactcactatagggtggctggagacgccgccgtacgtggctccgaacagaggagacggagcatggtacggcggaacctggcggcagcgcaaaagatg

SEQ ID NO: 217783 - DNA, 103 bp, Artificial Sequence
  Synthetic Polynucleotide
taatacgactcactatagggaggcggcgtgtggctggagacgccgccgtaaacagaggagatacggcatggtctccagcaacctggcggcagcgcaaaagatg

SEQ ID NO: 217784 - DNA, 103 bp, Artificial Sequence
  Synthetic Polynucleotide
taatacgactcactatagggccccgctgacaggcggcgtgtggctggagaaacagaggagatctccaatgacacgccgcaacctggcggcagcgcaaaagatg

SEQ ID NO: 217785 - DNA, 103 bp, Artificial Sequence
  Synthetic Polynucleotide
taatacgactcactatagggaggctgtcggccccgctgacaggcggcgtgaacagaggagacacgccatgtgtcagcggaacctggcggcagcgcaaaagatg

SEQ ID NO: 217786 - DNA, 103 bp, Artificial Sequence
  Synthetic Polynucleotide
taatacgactcactatagggggagcccaggaggctgtcggccccgctgacaacagaggagagtcagcatggccgacagcaacctggcggcagcgcaaaagatg

SEQ ID NO: 217787 - DNA, 103 bp, Artificial Sequence
  Synthetic Polynucleotide
taatacgactcactatagggtggtccctcgggagcccaggaggctgtcggaacagaggagaccgacaatgtcctgggctaacctggcggcagcgcaaaagatg

SEQ ID NO: 217788 - DNA, 103 bp, Artificial Sequence
  Synthetic Polynucleotide
taatacgactcactatagggctgccagctgtggtccctcgggagcccaggaacagaggagacctgggatgccgagggacaacctggcggcagcgcaaaagatg

SEQ ID NO: 217789 - DNA, 103 bp, Artificial Sequence
  Synthetic Polynucleotide
taatacgactcactatagggatccccggagctgccagctgtggtccctcgaacagaggagacgagggatgacagctggcaacctggcggcagcgcaaaagatg

SEQ ID NO: 217790 - DNA, 103 bp, Artificial Sequence
  Synthetic Polynucleotide
taatacgactcactatagggtgccgagggcatccccggagctgccagctgaacagaggagacagctgatggctccggggaacctggcggcagcgcaaaagatg

SEQ ID NO: 217791 - DNA, 103 bp, Artificial Sequence
  Synthetic Polynucleotide
taatacgactcactataggggccagtgctttgccgagggcatccccggagaacagaggagactccggatgtgccctcggaacctggcggcagcgcaaaagatg

SEQ ID NO: 217792 - DNA, 103 bp, Artificial Sequence
  Synthetic Polynucleotide
taatacgactcactatagggtaaggcagccattcgctgttggtgatgcataacagaggagaatgcatatgcaacagcgaaacctggcggcagcgcaaaagatg

SEQ ID NO: 217793 - DNA, 103 bp, Artificial Sequence
  Synthetic Polynucleotide
taatacgactcactatagggcaaagaagttggtccatttttcccactgctaacagaggagaagcagtatgaaaaatggaaacctggcggcagcgcaaaagatg

SEQ ID NO: 217794 - DNA, 103 bp, Artificial Sequence
  Synthetic Polynucleotide
taatacgactcactataggggctgttgttagtgtgatctggagaatagataacagaggagaatctatatgccagatcacaacctggcggcagcgcaaaagatg

SEQ ID NO: 217795 - DNA, 103 bp, Artificial Sequence
  Synthetic Polynucleotide
taatacgactcactatagggttgatgaaaagctgttgttagtgtgatctgaacagaggagacagatcatgctaacaacaaacctggcggcagcgcaaaagatg

SEQ ID NO: 217796 - DNA, 103 bp, Artificial Sequence
  Synthetic Polynucleotide
taatacgactcactataggggttgaagggtttgatgaaaagctgttgttaaacagaggagataacaaatgcttttcatcaacctggcggcagcgcaaaagatg

SEQ ID NO: 217797 - DNA, 103 bp, Artificial Sequence
  Synthetic Polynucleotide
taatacgactcactataggggccaacaggagttgaagggtttgatgaaaaaacagaggagattttcaatgaacccttcaaacctggcggcagcgcaaaagatg

SEQ ID NO: 217798 - DNA, 103 bp, Artificial Sequence
  Synthetic Polynucleotide
taatacgactcactatagggatggaggagagccaacaggagttgaagggtaacagaggagaacccttatgctcctgttgaacctggcggcagcgcaaaagatg

SEQ ID NO: 217799 - DNA, 103 bp, Artificial Sequence
  Synthetic Polynucleotide
taatacgactcactataggggctgagagagatggaggagagccaacaggaaacagaggagatcctgtatgctctcctccaacctggcggcagcgcaaaagatg

SEQ ID NO: 217800 - DNA, 103 bp, Artificial Sequence
  Synthetic Polynucleotide
taatacgactcactatagggagctgtgcctgctgagagagatggaggagaaacagaggagatctcctatgtctctctcaaacctggcggcagcgcaaaagatg

SEQ ID NO: 217801 - DNA, 103 bp, Artificial Sequence
  Synthetic Polynucleotide
taatacgactcactatagggtagaccaaacagctgtgcctgctgagagagaacagaggagactctctatgcaggcacagaacctggcggcagcgcaaaagatg

SEQ ID NO: 217802 - DNA, 103 bp, Artificial Sequence
  Synthetic Polynucleotide
taatacgactcactatagggcctccatttctagaccaaacagctgtgcctaacagaggagaaggcacatgtgtttggtcaacctggcggcagcgcaaaagatg

SEQ ID NO: 217803 - DNA, 103 bp, Artificial Sequence
  Synthetic Polynucleotide
taatacgactcactatagggtgaggcctgtcctccatttctagaccaaacaacagaggagagtttggatgagaaatggaaacctggcggcagcgcaaaagatg

SEQ ID NO: 217804 - DNA, 103 bp, Artificial Sequence
  Synthetic Polynucleotide
taatacgactcactataggggtccacttgccaaagaagttggtccattttaacagaggagaaaaatgatgcaacttcttaacctggcggcagcgcaaaagatg

SEQ ID NO: 217805 - DNA, 103 bp, Artificial Sequence
  Synthetic Polynucleotide
taatacgactcactatagggtaggagacgatgaggcctgtcctccatttcaacagaggagagaaatgatggacaggcctaacctggcggcagcgcaaaagatg

SEQ ID NO: 217806 - DNA, 103 bp, Artificial Sequence
  Synthetic Polynucleotide
taatacgactcactatagggccttcataattaggagacgatgaggcctgtaacagaggagaacaggcatgatcgtctccaacctggcggcagcgcaaaagatg

SEQ ID NO: 217807 - DNA, 103 bp, Artificial Sequence
  Synthetic Polynucleotide
taatacgactcactataggggtgtaagggtccttcataattaggagacgaaacagaggagatcgtctatgaattatgaaaacctggcggcagcgcaaaagatg

SEQ ID NO: 217808 - DNA, 103 bp, Artificial Sequence
  Synthetic Polynucleotide
taatacgactcactatagggtttgcaaagagtgtaagggtccttcataataacagaggagaattatgatggacccttacaacctggcggcagcgcaaaagatg

SEQ ID NO: 217809 - DNA, 103 bp, Artificial Sequence
  Synthetic Polynucleotide
taatacgactcactatagggtcaattcggctttgcaaagagtgtaagggtaacagaggagaacccttatgctctttgcaaacctggcggcagcgcaaaagatg

SEQ ID NO: 217810 - DNA, 103 bp, Artificial Sequence
  Synthetic Polynucleotide
taatacgactcactatagggtaaacgatcttcaattcggctttgcaaagaaacagaggagatctttgatgagccgaattaacctggcggcagcgcaaaagatg

SEQ ID NO: 217811 - DNA, 103 bp, Artificial Sequence
  Synthetic Polynucleotide
taatacgactcactatagggccagtctttctaaacgatcttcaattcggcaacagaggagagccgaaatgaagatcgttaacctggcggcagcgcaaaagatg

SEQ ID NO: 217812 - DNA, 103 bp, Artificial Sequence
  Synthetic Polynucleotide
taatacgactcactatagggatagcatcatccagtctttctaaacgatctaacagaggagaagatcgatgagaaagactaacctggcggcagcgcaaaagatg

SEQ ID NO: 217813 - DNA, 103 bp, Artificial Sequence
  Synthetic Polynucleotide
taatacgactcactataggggagaacatgaatagcatcatccagtctttcaacagaggagagaaagaatggatgatgctaacctggcggcagcgcaaaagatg

SEQ ID NO: 217814 - DNA, 103 bp, Artificial Sequence
  Synthetic Polynucleotide
taatacgactcactatagggcatggttccggagaacatgaatagcatcataacagaggagaatgatgatgttcatgttcaacctggcggcagcgcaaaagatg

SEQ ID NO: 217815 - DNA, 103 bp, Artificial Sequence
  Synthetic Polynucleotide
taatacgactcactatagggccagtaaaatgtccacttgccaaagaagttaacagaggagaaacttcatgggcaagtggaacctggcggcagcgcaaaagatg

SEQ ID NO: 217816 - DNA, 103 bp, Artificial Sequence
  Synthetic Polynucleotide
taatacgactcactataggggggcccactgcatggttccggagaacatgaaacagaggagatcatgtatgccggaaccaaacctggcggcagcgcaaaagatg

SEQ ID NO: 217817 - DNA, 103 bp, Artificial Sequence
  Synthetic Polynucleotide
taatacgactcactatagggagctgtggatgggcccactgcatggttccgaacagaggagacggaacatggcagtgggcaacctggcggcagcgcaaaagatg

SEQ ID NO: 217818 - DNA, 103 bp, Artificial Sequence
  Synthetic Polynucleotide
taatacgactcactatagggcaccaggcatagctgtggatgggcccactgaacagaggagacagtggatgcatccacagaacctggcggcagcgcaaaagatg

SEQ ID NO: 217819 - DNA, 103 bp, Artificial Sequence
  Synthetic Polynucleotide
taatacgactcactatagggtccccatgaccaccaggcatagctgtggataacagaggagaatccacatgtatgcctggaacctggcggcagcgcaaaagatg

SEQ ID NO: 217820 - DNA, 103 bp, Artificial Sequence
  Synthetic Polynucleotide
taatacgactcactatagggtccatgcatgtccccatgaccaccaggcataacagaggagaatgcctatgggtcatgggaacctggcggcagcgcaaaagatg

SEQ ID NO: 217821 - DNA, 103 bp, Artificial Sequence
  Synthetic Polynucleotide
taatacgactcactataggggtccaatgattccatgcatgtccccatgacaacagaggagagtcatgatgacatgcatgaacctggcggcagcgcaaaagatg

SEQ ID NO: 217822 - DNA, 103 bp, Artificial Sequence
  Synthetic Polynucleotide
taatacgactcactatagggttatgagaaggtccaatgattccatgcatgaacagaggagacatgcaatgaatcattggaacctggcggcagcgcaaaagatg

SEQ ID NO: 217823 - DNA, 103 bp, Artificial Sequence
  Synthetic Polynucleotide
taatacgactcactatagggcatggctccattatgagaaggtccaatgataacagaggagaatcattatgccttctcataacctggcggcagcgcaaaagatg

SEQ ID NO: 217824 - DNA, 103 bp, Artificial Sequence
  Synthetic Polynucleotide
taatacgactcactatagggccagaccacccatggctccattatgagaagaacagaggagacttctcatgatggagccaaacctggcggcagcgcaaaagatg

SEQ ID NO: 217825 - DNA, 103 bp, Artificial Sequence
  Synthetic Polynucleotide
taatacgactcactatagggtaccctgagcccagaccacccatggctccaaacagaggagatggagcatggggtggtctaacctggcggcagcgcaaaagatg

SEQ ID NO: 217826 - DNA, 103 bp, Artificial Sequence
  Synthetic Polynucleotide
taatacgactcactatagggtacatttgagccagtaaaatgtccacttgcaacagaggagagcaagtatgcattttactaacctggcggcagcgcaaaagatg

SEQ ID NO: 217827 - DNA, 103 bp, Artificial Sequence
  Synthetic Polynucleotide
taatacgactcactataggggccggttccataccctgagcccagaccaccaacagaggagaggtggtatgggctcagggaacctggcggcagcgcaaaagatg

SEQ ID NO: 217828 - DNA, 103 bp, Artificial Sequence
  Synthetic Polynucleotide
taatacgactcactatagggctgaaagaaggccggttccataccctgagcaacagaggagagctcagatgatggaaccgaacctggcggcagcgcaaaagatg

SEQ ID NO: 217829 - DNA, 103 bp, Artificial Sequence
  Synthetic Polynucleotide
taatacgactcactatagggtgtctgttggctgaaagaaggccggttccaaacagaggagatggaacatgccttctttcaacctggcggcagcgcaaaagatg

SEQ ID NO: 217830 - DNA, 103 bp, Artificial Sequence
  Synthetic Polynucleotide
taatacgactcactatagggcatgagtgaatgtctgttggctgaaagaagaacagaggagacttcttatggccaacagaaacctggcggcagcgcaaaagatg

SEQ ID NO: 217831 - DNA, 103 bp, Artificial Sequence
  Synthetic Polynucleotide
taatacgactcactataggggggtccccaccatgagtgaatgtctgttggaacagaggagaccaacaatgattcactcaaacctggcggcagcgcaaaagatg

SEQ ID NO: 217832 - DNA, 103 bp, Artificial Sequence
  Synthetic Polynucleotide
taatacgactcactatagggtcttcacgatgggtccccaccatgagtgaaaacagaggagattcactatgggtggggacaacctggcggcagcgcaaaagatg

SEQ ID NO: 217833 - DNA, 103 bp, Artificial Sequence
  Synthetic Polynucleotide
taatacgactcactatagggggccacgccatcttcacgatgggtccccacaacagaggagagtggggatgcatcgtgaaaacctggcggcagcgcaaaagatg

SEQ ID NO: 217834 - DNA, 103 bp, Artificial Sequence
  Synthetic Polynucleotide
taatacgactcactatagggtgcctctcagggccacgccatcttcacgataacagaggagaatcgtgatgatggcgtggaacctggcggcagcgcaaaagatg

SEQ ID NO: 217835 - DNA, 103 bp, Artificial Sequence
  Synthetic Polynucleotide
taatacgactcactatagggagagaatggctgcctctcagggccacgccaaacagaggagatggcgtatgcctgagaggaacctggcggcagcgcaaaagatg

SEQ ID NO: 217836 - DNA, 103 bp, Artificial Sequence
  Synthetic Polynucleotide
taatacgactcactataggggtttggcagaagagaatggctgcctctcagaacagaggagactgagaatgagccattctaacctggcggcagcgcaaaagatg

SEQ ID NO: 217837 - DNA, 103 bp, Artificial Sequence
  Synthetic Polynucleotide
taatacgactcactatagggttctgtcttctacatttgagccagtaaaataacagaggagaattttaatggctcaaatgaacctggcggcagcgcaaaagatg

SEQ ID NO: 217838 - DNA, 103 bp, Artificial Sequence
  Synthetic Polynucleotide
taatacgactcactatagggccggaacctggtttggcagaagagaatggcaacagaggagagccattatgttctgccaaaacctggcggcagcgcaaaagatg

SEQ ID NO: 217839 - DNA, 103 bp, Artificial Sequence
  Synthetic Polynucleotide
taatacgactcactatagggagctgtggaaccggaacctggtttggcagaaacagaggagatctgccatgccaggttccaacctggcggcagcgcaaaagatg

SEQ ID NO: 217840 - DNA, 103 bp, Artificial Sequence
  Synthetic Polynucleotide
taatacgactcactatagggctggacaggaagctgtggaaccggaacctgaacagaggagacaggttatggttccacagaacctggcggcagcgcaaaagatg

SEQ ID NO: 217841 - DNA, 103 bp, Artificial Sequence
  Synthetic Polynucleotide
taatacgactcactatagggaagtcgcagactggacaggaagctgtggaaaacagaggagattccacatgttcctgtccaacctggcggcagcgcaaaagatg

SEQ ID NO: 217842 - DNA, 103 bp, Artificial Sequence
  Synthetic Polynucleotide
taatacgactcactatagggaggtcaggggaagtcgcagactggacaggaaacagaggagatcctgtatggtctgcgacaacctggcggcagcgcaaaagatg

SEQ ID NO: 217843 - DNA, 103 bp, Artificial Sequence
  Synthetic Polynucleotide
taatacgactcactataggggggtgggttcaggtcaggggaagtcgcagaaacagaggagatctgcgatgtcccctgacaacctggcggcagcgcaaaagatg

SEQ ID NO: 217844 - DNA, 103 bp, Artificial Sequence
  Synthetic Polynucleotide
taatacgactcactatagggaagggtcctggggtgggttcaggtcaggggaacagaggagacccctgatgtgaacccacaacctggcggcagcgcaaaagatg

SEQ ID NO: 217845 - DNA, 103 bp, Artificial Sequence
  Synthetic Polynucleotide
taatacgactcactatagggatgcctctgtaagggtcctggggtgggttcaacagaggagagaacccatgccaggacccaacctggcggcagcgcaaaagatg

SEQ ID NO: 217846 - DNA, 103 bp, Artificial Sequence
  Synthetic Polynucleotide
taatacgactcactatagggtcctggtggcatgcctctgtaagggtcctgaacagaggagacaggacatgtacagaggcaacctggcggcagcgcaaaagatg

SEQ ID NO: 217847 - DNA, 103 bp, Artificial Sequence
  Synthetic Polynucleotide
taatacgactcactataggggcccctgtagtcctggtggcatgcctctgtaacagaggagaacagagatgtgccaccagaacctggcggcagcgcaaaagatg

SEQ ID NO: 217848 - DNA, 103 bp, Artificial Sequence
  Synthetic Polynucleotide
taatacgactcactatagggcctgagctacttctgtcttctacatttgagaacagaggagactcaaaatgagaagacagaacctggcggcagcgcaaaagatg

SEQ ID NO: 217849 - DNA, 103 bp, Artificial Sequence
  Synthetic Polynucleotide
taatacgactcactataggggagacactctgcccctgtagtcctggtggcaacagaggagagccaccatgactacagggaacctggcggcagcgcaaaagatg

SEQ ID NO: 217850 - DNA, 103 bp, Artificial Sequence
  Synthetic Polynucleotide
taatacgactcactataggggctgccagaggagacactctgcccctgtagaacagaggagactacagatgcagagtgtcaacctggcggcagcgcaaaagatg

SEQ ID NO: 217851 - DNA, 103 bp, Artificial Sequence
  Synthetic Polynucleotide
taatacgactcactatagggtgatctcagagctgccagaggagacactctaacagaggagaagagtgatgcctctggcaaacctggcggcagcgcaaaagatg

SEQ ID NO: 217852 - DNA, 103 bp, Artificial Sequence
  Synthetic Polynucleotide
taatacgactcactatagggtcatcggatttgatctcagagctgccagagaacagaggagactctggatgctctgagataacctggcggcagcgcaaaagatg

SEQ ID NO: 217853 - DNA, 103 bp, Artificial Sequence
  Synthetic Polynucleotide
taatacgactcactatagggatcaccctcgtcatcggatttgatctcagaaacagaggagatctgagatgaaatccgataacctggcggcagcgcaaaagatg

SEQ ID NO: 217854 - DNA, 103 bp, Artificial Sequence
  Synthetic Polynucleotide
taatacgactcactataggggcaggttctcatcaccctcgtcatcggattaacagaggagaaatccgatgacgagggtgaacctggcggcagcgcaaaagatg

SEQ ID NO: 217855 - DNA, 103 bp, Artificial Sequence
  Synthetic Polynucleotide
taatacgactcactatagggttcgtgtcttgcaggttctcatcaccctcgaacagaggagacgagggatgtgagaacctaacctggcggcagcgcaaaagatg

SEQ ID NO: 217856 - DNA, 103 bp, Artificial Sequence
  Synthetic Polynucleotide
taatacgactcactatagggctccgaagatttcgtgtcttgcaggttctcaacagaggagagagaacatgcaagacacgaacctggcggcagcgcaaaagatg

SEQ ID NO: 217857 - DNA, 103 bp, Artificial Sequence
  Synthetic Polynucleotide
taatacgactcactatagggatttcttgtcctccgaagatttcgtgtcttaacagaggagaaagacaatgaatcttcggaacctggcggcagcgcaaaagatg

SEQ ID NO: 217858 - DNA, 103 bp, Artificial Sequence
  Synthetic Polynucleotide
taatacgactcactatagggtcgtcatctaatttcttgtcctccgaagataacagaggagaatcttcatgggacaagaaaacctggcggcagcgcaaaagatg

SEQ ID NO: 217859 - DNA, 103 bp, Artificial Sequence
  Synthetic Polynucleotide
taatacgactcactatagggcccccaggaccctgagctacttctgtcttcaacagaggagagaagacatgagtagctcaaacctggcggcagcgcaaaagatg

SEQ ID NO: 217860 - DNA, 103 bp, Artificial Sequence
  Synthetic Polynucleotide
taatacgactcactatagggatccttcttgtcgtcatctaatttcttgtcaacagaggagagacaagatgttagatgacaacctggcggcagcgcaaaagatg

SEQ ID NO: 217861 - DNA, 103 bp, Artificial Sequence
  Synthetic Polynucleotide
taatacgactcactatagggttgatttgatatccttcttgtcgtcatctaaacagaggagatagatgatgacaagaaggaacctggcggcagcgcaaaagatg

SEQ ID NO: 217862 - DNA, 103 bp, Artificial Sequence
  Synthetic Polynucleotide
taatacgactcactataggggacctagtaattgatttgatatccttcttgaacagaggagacaagaaatgtatcaaatcaacctggcggcagcgcaaaagatg

SEQ ID NO: 217863 - DNA, 103 bp, Artificial Sequence
  Synthetic Polynucleotide
taatacgactcactataggggctagatcttgacctagtaattgatttgataacagaggagaatcaaaatgattactaggaacctggcggcagcgcaaaagatg

SEQ ID NO: 217864 - DNA, 103 bp, Artificial Sequence
  Synthetic Polynucleotide
taatacgactcactatagggcgtcattattgctagatcttgacctagtaaaacagaggagattactaatgcaagatctaaacctggcggcagcgcaaaagatg

SEQ ID NO: 217865 - DNA, 103 bp, Artificial Sequence
  Synthetic Polynucleotide
taatacgactcactatagggaggtcctcatcgtcattattgctagatcttaacagaggagaaagatcatgcaataatgaaacctggcggcagcgcaaaagatg

SEQ ID NO: 217866 - DNA, 103 bp, Artificial Sequence
  Synthetic Polynucleotide
taatacgactcactatagggctctggtgtcaggtcctcatcgtcattattaacagaggagaaataatatggatgaggacaacctggcggcagcgcaaaagatg

SEQ ID NO: 217867 - DNA, 103 bp, Artificial Sequence
  Synthetic Polynucleotide
taatacgactcactatagggctgccttctgctctggtgtcaggtcctcataacagaggagaatgaggatgtgacaccagaacctggcggcagcgcaaaagatg

SEQ ID NO: 217868 - DNA, 103 bp, Artificial Sequence
  Synthetic Polynucleotide
taatacgactcactatagggttctcacgctctgccttctgctctggtgtcaacagaggagagacaccatggcagaaggcaacctggcggcagcgcaaaagatg

SEQ ID NO: 217869 - DNA, 103 bp, Artificial Sequence
  Synthetic Polynucleotide
taatacgactcactatagggcctccgctccttctcacgctctgccttctgaacagaggagacagaagatggagcgtgagaacctggcggcagcgcaaaagatg

SEQ ID NO: 217870 - DNA, 103 bp, Artificial Sequence
  Synthetic Polynucleotide
taatacgactcactataggggtcctccattcccccaggaccctgagctacaacagaggagagtagctatgggtcctgggaacctggcggcagcgcaaaagatg

SEQ ID NO: 217871 - DNA, 103 bp, Artificial Sequence
  Synthetic Polynucleotide
taatacgactcactatagggtgttggccatcctccgctccttctcacgctaacagaggagaagcgtgatgaggagcggaaacctggcggcagcgcaaaagatg

SEQ ID NO: 217872 - DNA, 103 bp, Artificial Sequence
  Synthetic Polynucleotide
taatacgactcactatagggtctcgggcattgttggccatcctccgctccaacagaggagaggagcgatggatggccaaaacctggcggcagcgcaaaagatg

SEQ ID NO: 217873 - DNA, 103 bp, Artificial Sequence
  Synthetic Polynucleotide
taatacgactcactatagggccgcagacgctctcgggcattgttggccataacagaggagaatggccatgaatgcccgaaacctggcggcagcgcaaaagatg

SEQ ID NO: 217874 - DNA, 103 bp, Artificial Sequence
  Synthetic Polynucleotide
taatacgactcactatagggtgtcacggacccgcagacgctctcgggcataacagaggagaatgcccatgagcgtctgcaacctggcggcagcgcaaaagatg

SEQ ID NO: 217875 - DNA, 103 bp, Artificial Sequence
  Synthetic Polynucleotide
taatacgactcactataggggcctcgttgatgtcacggacccgcagacgcaacagaggagagcgtctatgggtccgtgaaacctggcggcagcgcaaaagatg

SEQ ID NO: 217876 - DNA, 103 bp, Artificial Sequence
  Synthetic Polynucleotide
taatacgactcactatagggctctttgaaagcctcgttgatgtcacggacaacagaggagagtccgtatgatcaacgagaacctggcggcagcgcaaaagatg

SEQ ID NO: 217877 - DNA, 103 bp, Artificial Sequence
  Synthetic Polynucleotide
taatacgactcactatagggtgcggccgagctctttgaaagcctcgttgaaacagaggagatcaacgatgctttcaaagaacctggcggcagcgcaaaagatg

SEQ ID NO: 217878 - DNA, 103 bp, Artificial Sequence
  Synthetic Polynucleotide
taatacgactcactatagggagctgcaccatgcggccgagctctttgaaaaacagaggagatttcaaatggctcggccgaacctggcggcagcgcaaaagatg

SEQ ID NO: 217879 - DNA, 103 bp, Artificial Sequence
  Synthetic Polynucleotide
taatacgactcactatagggcttgaggtggagctgcaccatgcggccgagaacagaggagactcggcatgatggtgcagaacctggcggcagcgcaaaagatg

SEQ ID NO: 217880 - DNA, 103 bp, Artificial Sequence
  Synthetic Polynucleotide
taatacgactcactataggggcttgtcactcttgaggtggagctgcaccaaacagaggagatggtgcatgtccacctcaaacctggcggcagcgcaaaagatg

SEQ ID NO: 217881 - DNA, 103 bp, Artificial Sequence
  Synthetic Polynucleotide
taatacgactcactataggggggcttggatgtcctccattcccccaggacaacagaggagagtcctgatggaatggaggaacctggcggcagcgcaaaagatg

SEQ ID NO: 217882 - DNA, 103 bp, Artificial Sequence
  Synthetic Polynucleotide
taatacgactcactatagggttggtctggggcttgtcactcttgaggtggaacagaggagaccacctatggagtgacaaaacctggcggcagcgcaaaagatg

SEQ ID NO: 217883 - DNA, 103 bp, Artificial Sequence
  Synthetic Polynucleotide
taatacgactcactataggggatcaggagcttggtctggggcttgtcactaacagaggagaagtgacatgccccagaccaacctggcggcagcgcaaaagatg

SEQ ID NO: 217884 - DNA, 103 bp, Artificial Sequence
  Synthetic Polynucleotide
taatacgactcactatagggcctggtggaggatcaggagcttggtctgggaacagaggagacccagaatgagctcctgaaacctggcggcagcgcaaaagatg

SEQ ID NO: 217885 - DNA, 103 bp, Artificial Sequence
  Synthetic Polynucleotide
taatacgactcactatagggacggccaccgcctggtggaggatcaggagcaacagaggagagctcctatgcctccaccaaacctggcggcagcgcaaaagatg

SEQ ID NO: 217886 - DNA, 103 bp, Artificial Sequence
  Synthetic Polynucleotide
taatacgactcactatagggactgaggatgacggccaccgcctggtggagaacagaggagactccacatggcggtggccaacctggcggcagcgcaaaagatg

SEQ ID NO: 217887 - DNA, 103 bp, Artificial Sequence
  Synthetic Polynucleotide
taatacgactcactataggggctgctccagactgaggatgacggccaccgaacagaggagacggtggatgtcatcctcaaacctggcggcagcgcaaaagatg

SEQ ID NO: 217888 - DNA, 103 bp, Artificial Sequence
  Synthetic Polynucleotide
taatacgactcactatagggtctcggacttgctgctccagactgaggatgaacagaggagacatcctatgtctggagcaaacctggcggcagcgcaaaagatg

SEQ ID NO: 217889 - DNA, 103 bp, Artificial Sequence
  Synthetic Polynucleotide
taatacgactcactatagggcagattcctttctcggacttgctgctccagaacagaggagactggagatgcaagtccgaaacctggcggcagcgcaaaagatg

SEQ ID NO: 217890 - DNA, 103 bp, Artificial Sequence
  Synthetic Polynucleotide
taatacgactcactatagggctttcggattcagattcctttctcggacttaacagaggagaaagtccatgaaaggaatcaacctggcggcagcgcaaaagatg

SEQ ID NO: 217891 - DNA, 103 bp, Artificial Sequence
  Synthetic Polynucleotide
taatacgactcactatagggagacacgcagctttcggattcagattccttaacagaggagaaaggaaatggaatccgaaaacctggcggcagcgcaaaagatg

SEQ ID NO: 217892 - DNA, 103 bp, Artificial Sequence
  Synthetic Polynucleotide
taatacgactcactataggggttcctggacgggcttggatgtcctccattaacagaggagaaatggaatgcatccaagcaacctggcggcagcgcaaaagatg

SEQ ID NO: 217893 - DNA, 103 bp, Artificial Sequence
  Synthetic Polynucleotide
taatacgactcactatagggccttcttttcagacacgcagctttcggattaacagaggagaaatccgatggctgcgtgtaacctggcggcagcgcaaaagatg

SEQ ID NO: 217894 - DNA, 103 bp, Artificial Sequence
  Synthetic Polynucleotide
taatacgactcactatagggtctcttcctcccttcttttcagacacgcagaacagaggagactgcgtatgtgaaaagaaaacctggcggcagcgcaaaagatg

SEQ ID NO: 217895 - DNA, 103 bp, Artificial Sequence
  Synthetic Polynucleotide
taatacgactcactataggggaggacaccttctcttcctcccttcttttcaacagaggagagaaaagatgggaggaagaaacctggcggcagcgcaaaagatg

SEQ ID NO: 217896 - DNA, 103 bp, Artificial Sequence
  Synthetic Polynucleotide
taatacgactcactataggggggaggctctgaggacaccttctcttcctcaacagaggagagaggaaatgaaggtgtccaacctggcggcagcgcaaaagatg

SEQ ID NO: 217897 - DNA, 103 bp, Artificial Sequence
  Synthetic Polynucleotide
taatacgactcactatagggaggagagagggggaggctctgaggacacctaacagaggagaaggtgtatgcagagcctcaacctggcggcagcgcaaaagatg

SEQ ID NO: 217898 - DNA, 103 bp, Artificial Sequence
  Synthetic Polynucleotide
taatacgactcactataggggggccggccaaggagagagggggaggctctaacagaggagaagagccatgccctctctcaacctggcggcagcgcaaaagatg

SEQ ID NO: 217899 - DNA, 103 bp, Artificial Sequence
  Synthetic Polynucleotide
taatacgactcactatagggtccagggtgtgggccggccaaggagagaggaacagaggagacctctcatgttggccggcaacctggcggcagcgcaaaagatg

SEQ ID NO: 217900 - DNA, 103 bp, Artificial Sequence
  Synthetic Polynucleotide
taatacgactcactatagggcgtctcccattccagggtgtgggccggccaaacagaggagatggccgatgcacaccctgaacctggcggcagcgcaaaagatg

SEQ ID NO: 217901 - DNA, 103 bp, Artificial Sequence
  Synthetic Polynucleotide
taatacgactcactatagggtgattcgatgcgtctcccattccagggtgtaacagaggagaacacccatgaatgggagaaacctggcggcagcgcaaaagatg

SEQ ID NO: 217902 - DNA, 103 bp, Artificial Sequence
  Synthetic Polynucleotide
taatacgactcactatagggctgtcccatgtgattcgatgcgtctcccataacagaggagaatgggaatggcatcgaataacctggcggcagcgcaaaagatg

SEQ ID NO: 217903 - DNA, 103 bp, Artificial Sequence
  Synthetic Polynucleotide
taatacgactcactatagggtgtccgtccctaaggcagccattcgctgttaacagaggagaaacagcatgtggctgcctaacctggcggcagcgcaaaagatg

SEQ ID NO: 217904 - DNA, 103 bp, Artificial Sequence
  Synthetic Polynucleotide
taatacgactcactatagggcatctccatagttcctggacgggcttggataacagaggagaatccaaatgcgtccaggaaacctggcggcagcgcaaaagatg

SEQ ID NO: 217905 - DNA, 103 bp, Artificial Sequence
  Synthetic Polynucleotide
taatacgactcactatagggtagggagtcccatctccatagttcctggacaacagaggagagtccagatgctatggagaaacctggcggcagcgcaaaagatg

SEQ ID NO: 217906 - DNA, 103 bp, Artificial Sequence
  Synthetic Polynucleotide
taatacgactcactatagggcatgtggtcatagggagtcccatctccataaacagaggagatatggaatggggactcccaacctggcggcagcgcaaaagatg

SEQ ID NO: 217907 - DNA, 103 bp, Artificial Sequence
  Synthetic Polynucleotide
taatacgactcactatagggccctgctggtcatgtggtcatagggagtccaacagaggagaggactcatgatgaccacaaacctggcggcagcgcaaaagatg

SEQ ID NO: 217908 - DNA, 103 bp, Artificial Sequence
  Synthetic Polynucleotide
taatacgactcactataggggacccaaggtccctgctggtcatgtggtcaaacagaggagatgaccaatggaccagcagaacctggcggcagcgcaaaagatg

SEQ ID NO: 217909 - DNA, 103 bp, Artificial Sequence
  Synthetic Polynucleotide
taatacgactcactatagggattgtcatgtgacccaaggtccctgctggtaacagaggagaaccagcatggaccttgggaacctggcggcagcgcaaaagatg

SEQ ID NO: 217910 - DNA, 103 bp, Artificial Sequence
  Synthetic Polynucleotide
taatacgactcactataggggtggagagagattgtcatgtgacccaaggtaacagaggagaaccttgatgcacatgacaaacctggcggcagcgcaaaagatg

SEQ ID NO: 217911 - DNA, 103 bp, Artificial Sequence
  Synthetic Polynucleotide
taatacgactcactatagggttgacaaaaggtggagagagattgtcatgtaacagaggagaacatgaatgtctctctccaacctggcggcagcgcaaaagatg

SEQ ID NO: 217912 - DNA, 103 bp, Artificial Sequence
  Synthetic Polynucleotide
taatacgactcactatagggtattctggaattgacaaaaggtggagagagaacagaggagactctctatgccttttgtcaacctggcggcagcgcaaaagatg

SEQ ID NO: 217913 - DNA, 103 bp, Artificial Sequence
  Synthetic Polynucleotide
taatacgactcactatagggttttactttgtattctggaattgacaaaagaacagaggagacttttgatgattccagaaaacctggcggcagcgcaaaagatg

SEQ ID NO: 217914 - DNA, 103 bp, Artificial Sequence
  Synthetic Polynucleotide
taatacgactcactatagggctcagctctttgtccgtccctaaggcagccaacagaggagaggctgcatgagggacggaaacctggcggcagcgcaaaagatg

SEQ ID NO: 217915 - DNA, 103 bp, Artificial Sequence
  Synthetic Polynucleotide
taatacgactcactatagggcccctttctgttttactttgtattctggaaaacagaggagattccagatgacaaagtaaaacctggcggcagcgcaaaagatg

SEQ ID NO: 217916 - DNA, 103 bp, Artificial Sequence
  Synthetic Polynucleotide
taatacgactcactatagggtgagtatgagcccctttctgttttactttgaacagaggagacaaagtatgacagaaaggaacctggcggcagcgcaaaagatg

SEQ ID NO: 217917 - DNA, 103 bp, Artificial Sequence
  Synthetic Polynucleotide
taatacgactcactatagggtcccataagatgagtatgagcccctttctgaacagaggagacagaaaatggctcatactaacctggcggcagcgcaaaagatg

SEQ ID NO: 217918 - DNA, 103 bp, Artificial Sequence
  Synthetic Polynucleotide
taatacgactcactatagggtttgattctctcccataagatgagtatgagaacagaggagactcataatgatcttatggaacctggcggcagcgcaaaagatg

SEQ ID NO: 217919 - DNA, 103 bp, Artificial Sequence
  Synthetic Polynucleotide
taatacgactcactatagggaccctgtaagtttgattctctcccataagaaacagaggagatcttatatgagagaatcaaacctggcggcagcgcaaaagatg

SEQ ID NO: 217920 - DNA, 103 bp, Artificial Sequence
  Synthetic Polynucleotide
taatacgactcactataggggctggtggcaaccctgtaagtttgattctcaacagaggagagagaatatgacttacaggaacctggcggcagcgcaaaagatg

SEQ ID NO: 217921 - DNA, 103 bp, Artificial Sequence
  Synthetic Polynucleotide
taatacgactcactatagggaggagactctgctggtggcaaccctgtaagaacagaggagacttacaatgttgccaccaaacctggcggcagcgcaaaagatg

SEQ ID NO: 217922 - DNA, 103 bp, Artificial Sequence
  Synthetic Polynucleotide
taatacgactcactataggggtcacctccaaggagactctgctggtggcaaacagaggagatgccacatgcagagtctcaacctggcggcagcgcaaaagatg

SEQ ID NO: 217923 - DNA, 103 bp, Artificial Sequence
  Synthetic Polynucleotide
taatacgactcactatagggccatatccatgtcacctccaaggagactctaacagaggagaagagtcatgttggaggtgaacctggcggcagcgcaaaagatg

SEQ ID NO: 217924 - DNA, 103 bp, Artificial Sequence
  Synthetic Polynucleotide
taatacgactcactatagggcctgggttgcccatatccatgtcacctccaaacagaggagatggaggatgcatggatataacctggcggcagcgcaaaagatg

SEQ ID NO: 217925 - DNA, 103 bp, Artificial Sequence
  Synthetic Polynucleotide
taatacgactcactatagggcagtaaatcactcagctctttgtccgtcccaacagaggagagggacgatgaaagagctgaacctggcggcagcgcaaaagatg

SEQ ID NO: 217926 - DNA, 103 bp, Artificial Sequence
  Synthetic Polynucleotide
taatacgactcactatagggcgaaagggttcctgggttgcccatatccataacagaggagaatggatatgggcaacccaaacctggcggcagcgcaaaagatg

SEQ ID NO: 217927 - DNA, 103 bp, Artificial Sequence
  Synthetic Polynucleotide
taatacgactcactataggggtttggtgggcgaaagggttcctgggttgcaacagaggagagcaaccatggaaccctttaacctggcggcagcgcaaaagatg

SEQ ID NO: 217928 - DNA, 103 bp, Artificial Sequence
  Synthetic Polynucleotide
taatacgactcactatagggtgggaaccaggtttggtgggcgaaagggttaacagaggagaaaccctatggcccaccaaaacctggcggcagcgcaaaagatg

SEQ ID NO: 217929 - DNA, 103 bp, Artificial Sequence
  Synthetic Polynucleotide
taatacgactcactatagggctgatagtactgggaaccaggtttggtgggaacagaggagacccaccatgcctggttccaacctggcggcagcgcaaaagatg

SEQ ID NO: 217930 - DNA, 103 bp, Artificial Sequence
  Synthetic Polynucleotide
taatacgactcactatagggtgctagaatactgatagtactgggaaccagaacagaggagactggttatgagtactatcaacctggcggcagcgcaaaagatg

SEQ ID NO: 217931 - DNA, 103 bp, Artificial Sequence
  Synthetic Polynucleotide
taatacgactcactatagggcggggattattgctagaatactgatagtacaacagaggagagtactaatggtattctagaacctggcggcagcgcaaaagatg

SEQ ID NO: 217932 - DNA, 103 bp, Artificial Sequence
  Synthetic Polynucleotide
taatacgactcactatagggaggcctccttcggggattattgctagaataaacagaggagatattctatgaataatcccaacctggcggcagcgcaaaagatg

SEQ ID NO: 217933 - DNA, 103 bp, Artificial Sequence
  Synthetic Polynucleotide
taatacgactcactatagggtactgtgaagaggcctccttcggggattataacagaggagaataatcatggaaggaggcaacctggcggcagcgcaaaagatg

SEQ ID NO: 217934 - DNA, 103 bp, Artificial Sequence
  Synthetic Polynucleotide
taatacgactcactatagggtccatggcactactgtgaagaggcctccttaacagaggagaaaggagatgtcttcacagaacctggcggcagcgcaaaagatg

SEQ ID NO: 217935 - DNA, 103 bp, Artificial Sequence
  Synthetic Polynucleotide
taatacgactcactatagggtgtctgtacctccatggcactactgtgaagaacagaggagacttcacatgagtgccatgaacctggcggcagcgcaaaagatg

SEQ ID NO: 217936 - DNA, 103 bp, Artificial Sequence
  Synthetic Polynucleotide
taatacgactcactatagggcactgaaatccagtaaatcactcagctcttaacagaggagaaagagcatggtgatttacaacctggcggcagcgcaaaagatg

SEQ ID NO: 217937 - DNA, 103 bp, Artificial Sequence
  Synthetic Polynucleotide
taatacgactcactataggggaactttctttgtctgtacctccatggcacaacagaggagagtgccaatgaggtacagaaacctggcggcagcgcaaaagatg

SEQ ID NO: 217938 - DNA, 103 bp, Artificial Sequence
  Synthetic Polynucleotide
taatacgactcactatagggggaacttttcgaactttctttgtctgtaccaacagaggagaggtacaatgaaagaaagtaacctggcggcagcgcaaaagatg

SEQ ID NO: 217939 - DNA, 103 bp, Artificial Sequence
  Synthetic Polynucleotide
taatacgactcactatagggcaaacctggaggaacttttcgaactttcttaacagaggagaaagaaaatgcgaaaagttaacctggcggcagcgcaaaagatg

SEQ ID NO: 217940 - DNA, 103 bp, Artificial Sequence
  Synthetic Polynucleotide
taatacgactcactatagggctgaagatggcaaacctggaggaacttttcaacagaggagagaaaagatgctccaggttaacctggcggcagcgcaaaagatg

SEQ ID NO: 217941 - DNA, 103 bp, Artificial Sequence
  Synthetic Polynucleotide
taatacgactcactatagggggagcatagactgaagatggcaaacctggaaacagaggagatccaggatggccatcttcaacctggcggcagcgcaaaagatg

SEQ ID NO: 217942 - DNA, 103 bp, Artificial Sequence
  Synthetic Polynucleotide
taatacgactcactataggggcttgctgatggagcatagactgaagatggaacagaggagaccatctatggtctatgctaacctggcggcagcgcaaaagatg

SEQ ID NO: 217943 - DNA, 103 bp, Artificial Sequence
  Synthetic Polynucleotide
taatacgactcactatagggagtcggcagtgcttgctgatggagcatagaaacagaggagatctatgatgcatcagcaaaacctggcggcagcgcaaaagatg

SEQ ID NO: 217944 - DNA, 103 bp, Artificial Sequence
  Synthetic Polynucleotide
taatacgactcactatagggtccctattgtagtcggcagtgcttgctgataacagaggagaatcagcatgcactgccgaaacctggcggcagcgcaaaagatg

SEQ ID NO: 217945 - DNA, 103 bp, Artificial Sequence
  Synthetic Polynucleotide
taatacgactcactataggggcctggcgagtccctattgtagtcggcagtaacagaggagaactgccatgtacaataggaacctggcggcagcgcaaaagatg

SEQ ID NO: 217946 - DNA, 103 bp, Artificial Sequence
  Synthetic Polynucleotide
taatacgactcactatagggaggaaggatagcctggcgagtccctattgtaacagaggagaacaataatgactcgccagaacctggcggcagcgcaaaagatg

SEQ ID NO: 217947 - DNA, 103 bp, Artificial Sequence
  Synthetic Polynucleotide
taatacgactcactataggggaaaacatcgcactgaaatccagtaaatcaaacagaggagatgatttatgggatttcagaacctggcggcagcgcaaaagatg

SEQ ID NO: 217948 - DNA, 103 bp, Artificial Sequence
  Synthetic Polynucleotide
taatacgactcactataggggctggtttggaggaaggatagcctggcgagaacagaggagactcgccatgctatccttcaacctggcggcagcgcaaaagatg

SEQ ID NO: 217949 - DNA, 103 bp, Artificial Sequence
  Synthetic Polynucleotide
taatacgactcactatagggagtgctggttgctggtttggaggaaggataaacagaggagatatcctatgtccaaaccaaacctggcggcagcgcaaaagatg

SEQ ID NO: 217950 - DNA, 103 bp, Artificial Sequence
  Synthetic Polynucleotide
taatacgactcactatagggagctagggaaagtgctggttgctggtttggaacagaggagaccaaacatgcaaccagcaaacctggcggcagcgcaaaagatg

SEQ ID NO: 217951 - DNA, 103 bp, Artificial Sequence
  Synthetic Polynucleotide
taatacgactcactatagggatgaagaaggagctagggaaagtgctggttaacagaggagaaaccagatgtttccctagaacctggcggcagcgcaaaagatg

SEQ ID NO: 217952 - DNA, 103 bp, Artificial Sequence
  Synthetic Polynucleotide
taatacgactcactataggggccatcttgcatgaagaaggagctagggaaaacagaggagattccctatgtccttcttcaacctggcggcagcgcaaaagatg

SEQ ID NO: 217953 - DNA, 103 bp, Artificial Sequence
  Synthetic Polynucleotide
taatacgactcactatagggtgctgtgatggccatcttgcatgaagaaggaacagaggagaccttctatgtgcaagatgaacctggcggcagcgcaaaagatg

SEQ ID NO: 217954 - DNA, 103 bp, Artificial Sequence
  Synthetic Polynucleotide
taatacgactcactatagggcaagggtcactgctgtgatggccatcttgcaacagaggagagcaagaatgccatcacagaacctggcggcagcgcaaaagatg

SEQ ID NO: 217955 - DNA, 103 bp, Artificial Sequence
  Synthetic Polynucleotide
taatacgactcactatagggggaggagctccaagggtcactgctgtgatgaacagaggagacatcacatgagtgaccctaacctggcggcagcgcaaaagatg

SEQ ID NO: 217956 - DNA, 103 bp, Artificial Sequence
  Synthetic Polynucleotide
taatacgactcactatagggtcatcccactggaggagctccaagggtcacaacagaggagagtgaccatgggagctcctaacctggcggcagcgcaaaagatg

SEQ ID NO: 217957 - DNA, 103 bp, Artificial Sequence
  Synthetic Polynucleotide
taatacgactcactatagggccaggctgattcatcccactggaggagctcaacagaggagagagctcatgcagtgggataacctggcggcagcgcaaaagatg

SEQ ID NO: 217958 - DNA, 103 bp, Artificial Sequence
  Synthetic Polynucleotide
taatacgactcactatagggcacaggaggtgaaaacatcgcactgaaatcaacagaggagagatttcatggcgatgtttaacctggcggcagcgcaaaagatg

SEQ ID NO: 217959 - DNA, 103 bp, Artificial Sequence
  Synthetic Polynucleotide
taatacgactcactatagggtcctgcatagccaggctgattcatcccactaacagaggagaagtgggatgaatcagcctaacctggcggcagcgcaaaagatg

SEQ ID NO: 217960 - DNA, 103 bp, Artificial Sequence
  Synthetic Polynucleotide
taatacgactcactatagggtgcccaacattcctgcatagccaggctgataacagaggagaatcagcatggctatgcagaacctggcggcagcgcaaaagatg

SEQ ID NO: 217961 - DNA, 103 bp, Artificial Sequence
  Synthetic Polynucleotide
taatacgactcactatagggtgagaagagttgcccaacattcctgcatagaacagaggagactatgcatgaatgttgggaacctggcggcagcgcaaaagatg

SEQ ID NO: 217962 - DNA, 103 bp, Artificial Sequence
  Synthetic Polynucleotide
taatacgactcactatagggctgtggaatatgagaagagttgcccaacataacagaggagaatgttgatgaactcttctaacctggcggcagcgcaaaagatg

SEQ ID NO: 217963 - DNA, 103 bp, Artificial Sequence
  Synthetic Polynucleotide
taatacgactcactatagggagctgctggactgtggaatatgagaagagtaacagaggagaactcttatgatattccacaacctggcggcagcgcaaaagatg

SEQ ID NO: 217964 - DNA, 103 bp, Artificial Sequence
  Synthetic Polynucleotide
taatacgactcactatagggaggctacagtagctgctggactgtggaataaacagaggagatattccatggtccagcagaacctggcggcagcgcaaaagatg

SEQ ID NO: 217965 - DNA, 103 bp, Artificial Sequence
  Synthetic Polynucleotide
taatacgactcactatagggatgtggatgcaggctacagtagctgctggaaacagaggagatccagcatgtactgtagcaacctggcggcagcgcaaaagatg

SEQ ID NO: 217966 - DNA, 103 bp, Artificial Sequence
  Synthetic Polynucleotide
taatacgactcactatagggtcaaacgttcatgtggatgcaggctacagtaacagaggagaactgtaatgtgcatccacaacctggcggcagcgcaaaagatg

SEQ ID NO: 217967 - DNA, 103 bp, Artificial Sequence
  Synthetic Polynucleotide
taatacgactcactataggggatggatagctcaaacgttcatgtggatgcaacagaggagagcatccatgtgaacgtttaacctggcggcagcgcaaaagatg

SEQ ID NO: 217968 - DNA, 103 bp, Artificial Sequence
  Synthetic Polynucleotide
taatacgactcactatagggtgaggagtgtgatggatagctcaaacgttcaacagaggagagaacgtatgagctatccaaacctggcggcagcgcaaaagatg

SEQ ID NO: 217969 - DNA, 103 bp, Artificial Sequence
  Synthetic Polynucleotide
taatacgactcactatagggtcccactgctcacaggaggtgaaaacatcgaacagaggagacgatgtatgcacctcctgaacctggcggcagcgcaaaagatg

SEQ ID NO: 217970 - DNA, 103 bp, Artificial Sequence
  Synthetic Polynucleotide
taatacgactcactatagggtgatgtctgctgaggagtgtgatggatagcaacagaggagagctatcatgcacactcctaacctggcggcagcgcaaaagatg

SEQ ID NO: 217971 - DNA, 103 bp, Artificial Sequence
  Synthetic Polynucleotide
taatacgactcactatagggagactggaattgatgtctgctgaggagtgtaacagaggagaacactcatgagcagacataacctggcggcagcgcaaaagatg

SEQ ID NO: 217972 - DNA, 103 bp, Artificial Sequence
  Synthetic Polynucleotide
taatacgactcactatagggcatcggaggaagactggaattgatgtctgcaacagaggagagcagacatgaattccagtaacctggcggcagcgcaaaagatg

SEQ ID NO: 217973 - DNA, 103 bp, Artificial Sequence
  Synthetic Polynucleotide
taatacgactcactatagggggaaagtggacatcggaggaagactggaataacagaggagaattccaatgttcctccgaaacctggcggcagcgcaaaagatg

SEQ ID NO: 217974 - DNA, 103 bp, Artificial Sequence
  Synthetic Polynucleotide
taatacgactcactatagggccactacgatggaaagtggacatcggaggaaacagaggagatcctccatggtccactttaacctggcggcagcgcaaaagatg

SEQ ID NO: 217975 - DNA, 103 bp, Artificial Sequence
  Synthetic Polynucleotide
taatacgactcactatagggatggtttgtaccactacgatggaaagtggaaacagaggagatccactatgcatcgtagtaacctggcggcagcgcaaaagatg

SEQ ID NO: 217976 - DNA, 103 bp, Artificial Sequence
  Synthetic Polynucleotide
taatacgactcactatagggaggtgctgtaatggtttgtaccactacgataacagaggagaatcgtaatggtacaaaccaacctggcggcagcgcaaaagatg

SEQ ID NO: 217977 - DNA, 103 bp, Artificial Sequence
  Synthetic Polynucleotide
taatacgactcactataggggtacaggaagaggtgctgtaatggtttgtaaacagaggagatacaaaatgttacagcacaacctggcggcagcgcaaaagatg

SEQ ID NO: 217978 - DNA, 103 bp, Artificial Sequence
  Synthetic Polynucleotide
taatacgactcactatagggggcaggaggcgtacaggaagaggtgctgtaaacagaggagatacagcatgtcttcctgtaacctggcggcagcgcaaaagatg

SEQ ID NO: 217979 - DNA, 103 bp, Artificial Sequence
  Synthetic Polynucleotide
taatacgactcactatagggctgtcccgttggcaggaggcgtacaggaagaacagaggagacttcctatgcgcctcctgaacctggcggcagcgcaaaagatg

SEQ ID NO: 217980 - DNA, 103 bp, Artificial Sequence
  Synthetic Polynucleotide
taatacgactcactatagggggtccatttttcccactgctcacaggaggtaacagaggagaacctccatggagcagtggaacctggcggcagcgcaaaagatg

SEQ ID NO: 217981 - DNA, 103 bp, Artificial Sequence
  Synthetic Polynucleotide
taatacgactcactatagggattatactgtctgtcccgttggcaggaggcaacagaggagagcctccatgcaacgggacaacctggcggcagcgcaaaagatg

SEQ ID NO: 217982 - DNA, 103 bp, Artificial Sequence
  Synthetic Polynucleotide
taatacgactcactatagggtctatttgccattatactgtctgtcccgttaacagaggagaaacgggatggacagtataaacctggcggcagcgcaaaagatg

SEQ ID NO: 217983 - DNA, 103 bp, Artificial Sequence
  Synthetic Polynucleotide
taatacgactcactatagggccccgcttcctctatttgccattatactgtaacagaggagaacagtaatgtggcaaataaacctggcggcagcgcaaaagatg

SEQ ID NO: 217984 - DNA, 103 bp, Artificial Sequence
  Synthetic Polynucleotide
taatacgactcactatagggctgccggctgccccgcttcctctatttgccaacagaggagaggcaaaatgaggaagcggaacctggcggcagcgcaaaagatg

SEQ ID NO: 217985 - DNA, 103 bp, Artificial Sequence
  Synthetic Polynucleotide
taatacgactcactatagggagtctgggagctgccggctgccccgcttccaacagaggagaggaagcatggcagccggcaacctggcggcagcgcaaaagatg

SEQ ID NO: 217986 - DNA, 103 bp, Artificial Sequence
  Synthetic Polynucleotide
taatacgactcactataggggagcatctccagtctgggagctgccggctgaacagaggagacagccgatggctcccagaaacctggcggcagcgcaaaagatg

SEQ ID NO: 217987 - DNA, 103 bp, Artificial Sequence
  Synthetic Polynucleotide
taatacgactcactataggggctttccccagagcatctccagtctgggagaacagaggagactcccaatgtggagatgcaacctggcggcagcgcaaaagatg

SEQ ID NO: 217988 - DNA, 103 bp, Artificial Sequence
  Synthetic Polynucleotide
taatacgactcactatagggcgaagcaagtgctttccccagagcatctccaacagaggagaggagatatgctggggaaaaacctggcggcagcgcaaaagatg

SEQ ID NO: 217989 - DNA, 103 bp, Artificial Sequence
  Synthetic Polynucleotide
taatacgactcactataggggagaatagatcgaagcaagtgctttccccaaacagaggagatggggaatgcacttgcttaacctggcggcagcgcaaaagatg

SEQ ID NO: 217990 - DNA, 103 bp, Artificial Sequence
  Synthetic Polynucleotide
taatacgactcactataggggtgtgatctggagaatagatcgaagcaagtaacagaggagaacttgcatggatctattcaacctggcggcagcgcaaaagatg

SEQ ID NO: 217991 - DNA, 103 bp, Artificial Sequence
  Synthetic Polynucleotide
taatacgactcactataggggccgcccccgccggagtccagctgcggcataacagaggagaatgccgatgctggactccaacctggcggcagcgcaaaagatg

SEQ ID NO: 217992 - DNA, 103 bp, Artificial Sequence
  Synthetic Polynucleotide
taatacgactcactataggggctgtcgcggctcttgtcgtcctgctcctcaacagaggagagaggagatggacgacaagaacctggcggcagcgcaaaagatg

SEQ ID NO: 217993 - DNA, 103 bp, Artificial Sequence
  Synthetic Polynucleotide
taatacgactcactataggggtcccgcgctgaccagcctgggtatagctgaacagaggagacagctaatgccaggctggaacctggcggcagcgcaaaagatg

SEQ ID NO: 217994 - DNA, 103 bp, Artificial Sequence
  Synthetic Polynucleotide
taatacgactcactatagggtcccgtagttgtcccgcgctgaccagcctgaacagaggagacaggctatgcagcgcgggaacctggcggcagcgcaaaagatg

SEQ ID NO: 217995 - DNA, 103 bp, Artificial Sequence
  Synthetic Polynucleotide
taatacgactcactatagggctcttcttcttcccgtagttgtcccgcgctaacagaggagaagcgcgatgcaactacggaacctggcggcagcgcaaaagatg

SEQ ID NO: 217996 - DNA, 103 bp, Artificial Sequence
  Synthetic Polynucleotide
taatacgactcactatagggcctcgaccgcctcttcttcttcccgtagttaacagaggagaaactacatgaagaagaagaacctggcggcagcgcaaaagatg

SEQ ID NO: 217997 - DNA, 103 bp, Artificial Sequence
  Synthetic Polynucleotide
taatacgactcactatagggggtgcttttccctcgaccgcctcttcttctaacagaggagaagaagaatgggcggtcgaaacctggcggcagcgcaaaagatg

SEQ ID NO: 217998 - DNA, 103 bp, Artificial Sequence
  Synthetic Polynucleotide
taatacgactcactataggggtggattcttggtgcttttccctcgaccgcaacagaggagagcggtcatgggaaaagcaaacctggcggcagcgcaaaagatg

SEQ ID NO: 217999 - DNA, 103 bp, Artificial Sequence
  Synthetic Polynucleotide
taatacgactcactatagggtcctcctgtggtggattcttggtgcttttcaacagaggagagaaaagatgcaagaatccaacctggcggcagcgcaaaagatg

SEQ ID NO: 218000 - DNA, 103 bp, Artificial Sequence
  Synthetic Polynucleotide
taatacgactcactatagggcatttctttttcctcctgtggtggattcttaacagaggagaaagaatatgccacaggagaacctggcggcagcgcaaaagatg

SEQ ID NO: 218001 - DNA, 103 bp, Artificial Sequence
  Synthetic Polynucleotide
taatacgactcactataggggtaccgaatgcatttctttttcctcctgtgaacagaggagacacaggatgaaaaagaaaaacctggcggcagcgcaaaagatg

SEQ ID NO: 218002 - DNA, 103 bp, Artificial Sequence
  Synthetic Polynucleotide
taatacgactcactatagggctccgggtaagtaccgaatgcatttcttttaacagaggagaaaaagaatggcattcggtaacctggcggcagcgcaaaagatg

SEQ ID NO: 218003 - DNA, 103 bp, Artificial Sequence
  Synthetic Polynucleotide
taatacgactcactataggggaccggcggcgctgtcgcggctcttgtcgtaacagaggagaacgacaatggccgcgacaaacctggcggcagcgcaaaagatg

SEQ ID NO: 218004 - DNA, 103 bp, Artificial Sequence
  Synthetic Polynucleotide
taatacgactcactatagggcagcggccttctccgggtaagtaccgaatgaacagaggagacattcgatgcttacccggaacctggcggcagcgcaaaagatg

SEQ ID NO: 218005 - DNA, 103 bp, Artificial Sequence
  Synthetic Polynucleotide
taatacgactcactatagggggggctggggcagcggccttctccgggtaaaacagaggagattacccatggaaggccgcaacctggcggcagcgcaaaagatg

SEQ ID NO: 218006 - DNA, 103 bp, Artificial Sequence
  Synthetic Polynucleotide
taatacgactcactatagggcggaaggaacggggctggggcagcggccttaacagaggagaaaggccatggccccagccaacctggcggcagcgcaaaagatg

SEQ ID NO: 218007 - DNA, 103 bp, Artificial Sequence
  Synthetic Polynucleotide
taatacgactcactataggggcactgtcatcggaaggaacggggctggggaacagaggagaccccagatgcgttccttcaacctggcggcagcgcaaaagatg

SEQ ID NO: 218008 - DNA, 103 bp, Artificial Sequence
  Synthetic Polynucleotide
taatacgactcactatagggtcgcgctcgggaccggcggcgctgtcgcggaacagaggagaccgcgaatgcgccgccggaacctggcggcagcgcaaaagatg

SEQ ID NO: 218009 - DNA, 103 bp, Artificial Sequence
  Synthetic Polynucleotide
taatacgactcactatagggctcggccaggtcgcgctcgggaccggcggcaacagaggagagccgccatgcccgagcgcaacctggcggcagcgcaaaagatg

SEQ ID NO: 218010 - DNA, 103 bp, Artificial Sequence
  Synthetic Polynucleotide
taatacgactcactatagggacgacttgagctcggccaggtcgcgctcggaacagaggagaccgagcatgacctggccgaacctggcggcagcgcaaaagatg

SEQ ID NO: 218011 - DNA, 103 bp, Artificial Sequence
  Synthetic Polynucleotide
taatacgactcactatagggttcacgagcgacgacttgagctcggccaggaacagaggagacctggcatggctcaagtcaacctggcggcagcgcaaaagatg

SEQ ID NO: 218012 - DNA, 103 bp, Artificial Sequence
  Synthetic Polynucleotide
taatacgactcactatagggctcggactcgttcacgagcgacgacttgagaacagaggagactcaagatgtcgctcgtgaacctggcggcagcgcaaaagatg

SEQ ID NO: 218013 - DNA, 103 bp, Artificial Sequence
  Synthetic Polynucleotide
taatacgactcactatagggcggccgcgccctcggactcgttcacgagcgaacagaggagacgctcgatgacgagtccgaacctggcggcagcgcaaaagatg

SEQ ID NO: 218014 - DNA, 103 bp, Artificial Sequence
  Synthetic Polynucleotide
taatacgactcactatagggcctgcgccgccggccgcgccctcggactcgaacagaggagacgagtcatggggcgcggcaacctggcggcagcgcaaaagatg

SEQ ID NO: 218015 - DNA, 103 bp, Artificial Sequence
  Synthetic Polynucleotide
taatacgactcactatagggccccgggatccctgcgccgccggccgcgccaacagaggagaggcgcgatgggcggcgcaaacctggcggcagcgcaaaagatg

SEQ ID NO: 218016 - DNA, 103 bp, Artificial Sequence
  Synthetic Polynucleotide
taatacgactcactatagggcgccgcccgcgccgcccccgccggagtccaaacagaggagatggactatggcgggggcgaacctggcggcagcgcaaaagatg

SEQ ID NO: 218017 - DNA, 103 bp, Artificial Sequence
  Synthetic Polynucleotide
taatacgactcactatagggcccccgggacccccgggatccctgcgccgcaacagaggagagcggcgatgggatcccggaacctggcggcagcgcaaaagatg

SEQ ID NO: 218018 - DNA, 103 bp, Artificial Sequence
  Synthetic Polynucleotide
taatacgactcactatagggccggcgccggcccccgggacccccgggatcaacagaggagagatcccatgggtcccgggaacctggcggcagcgcaaaagatg

SEQ ID NO: 218019 - DNA, 103 bp, Artificial Sequence
  Synthetic Polynucleotide
taatacgactcactataggggccgcgggccccggcgccggcccccgggacaacagaggagagtcccgatggccggcgccaacctggcggcagcgcaaaagatg

SEQ ID NO: 218020 - DNA, 103 bp, Artificial Sequence
  Synthetic Polynucleotide
taatacgactcactatagggcctcggcctcgccgcgggccccggcgccggaacagaggagaccggcgatggggcccgcgaacctggcggcagcgcaaaagatg

SEQ ID NO: 218021 - DNA, 103 bp, Artificial Sequence
  Synthetic Polynucleotide
taatacgactcactatagggcgcccgagagcctcggcctcgccgcgggccaacagaggagaggcccgatgcgaggccgaaacctggcggcagcgcaaaagatg

SEQ ID NO: 218022 - DNA, 103 bp, Artificial Sequence
  Synthetic Polynucleotide
taatacgactcactatagggagcgtgttcccgcccgagagcctcggcctcaacagaggagagaggccatggctctcgggaacctggcggcagcgcaaaagatg

SEQ ID NO: 218023 - DNA, 103 bp, Artificial Sequence
  Synthetic Polynucleotide
taatacgactcactataggggtctctgcgcagcgtgttcccgcccgagagaacagaggagactctcgatggggaacacgaacctggcggcagcgcaaaagatg

SEQ ID NO: 218024 - DNA, 103 bp, Artificial Sequence
  Synthetic Polynucleotide
taatacgactcactatagggtccgggaagagtctctgcgcagcgtgttccaacagaggagaggaacaatgtgcgcagagaacctggcggcagcgcaaaagatg

SEQ ID NO: 218025 - DNA, 103 bp, Artificial Sequence
  Synthetic Polynucleotide
taatacgactcactatagggtggaagtttgtccgggaagagtctctgcgcaacagaggagagcgcagatgctcttcccgaacctggcggcagcgcaaaagatg

SEQ ID NO: 218026 - DNA, 103 bp, Artificial Sequence
  Synthetic Polynucleotide
taatacgactcactatagggccaggggctctggaagtttgtccgggaagaaacagaggagatcttccatgacaaacttcaacctggcggcagcgcaaaagatg

SEQ ID NO: 218027 - DNA, 103 bp, Artificial Sequence
  Synthetic Polynucleotide
taatacgactcactatagggaggtcgtcgccgccgcccgcgccgcccccgaacagaggagacgggggatgcgcgggcggaacctggcggcagcgcaaaagatg

SEQ ID NO: 218028 - DNA, 103 bp, Artificial Sequence
  Synthetic Polynucleotide
taatacgactcactatagggaggccgtcctccaggggctctggaagtttgaacagaggagacaaactatgagagcccctaacctggcggcagcgcaaaagatg

SEQ ID NO: 218029 - DNA, 103 bp, Artificial Sequence
  Synthetic Polynucleotide
taatacgactcactatagggcggggccttcaggccgtcctccaggggctcaacagaggagagagcccatggaggacggcaacctggcggcagcgcaaaagatg

SEQ ID NO: 218030 - DNA, 103 bp, Artificial Sequence
  Synthetic Polynucleotide
taatacgactcactatagggtggtgcactccggggccttcaggccgtcctaacagaggagaaggacgatgtgaaggcccaacctggcggcagcgcaaaagatg

SEQ ID NO: 218031 - DNA, 103 bp, Artificial Sequence
  Synthetic Polynucleotide
taatacgactcactatagggtacatgccgctggtgcactccggggccttcaacagaggagagaaggcatgggagtgcacaacctggcggcagcgcaaaagatg

SEQ ID NO: 218032 - DNA, 103 bp, Artificial Sequence
  Synthetic Polynucleotide
taatacgactcactatagggggtctctttgtacatgccgctggtgcactcaacagaggagagagtgcatgagcggcatgaacctggcggcagcgcaaaagatg

SEQ ID NO: 218033 - DNA, 103 bp, Artificial Sequence
  Synthetic Polynucleotide
taatacgactcactatagggcggagtagacggtctctttgtacatgccgcaacagaggagagcggcaatgacaaagagaaacctggcggcagcgcaaaagatg

SEQ ID NO: 218034 - DNA, 103 bp, Artificial Sequence
  Synthetic Polynucleotide
taatacgactcactatagggagattgaaggcggagtagacggtctctttgaacagaggagacaaagaatgcgtctactcaacctggcggcagcgcaaaagatg

SEQ ID NO: 218035 - DNA, 103 bp, Artificial Sequence
  Synthetic Polynucleotide
taatacgactcactatagggatgcatgagcagattgaaggcggagtagacaacagaggagagtctacatggccttcaataacctggcggcagcgcaaaagatg

SEQ ID NO: 218036 - DNA, 103 bp, Artificial Sequence
  Synthetic Polynucleotide
taatacgactcactatagggggggtgggtaatgcatgagcagattgaaggaacagaggagaccttcaatgtgctcatgcaacctggcggcagcgcaaaagatg

SEQ ID NO: 218037 - DNA, 103 bp, Artificial Sequence
  Synthetic Polynucleotide
taatacgactcactataggggctcccgaggggggtgggtaatgcatgagcaacagaggagagctcatatgttacccaccaacctggcggcagcgcaaaagatg

SEQ ID NO: 218038 - DNA, 103 bp, Artificial Sequence
  Synthetic Polynucleotide
taatacgactcactatagggcggcgcgccgaggtcgtcgccgccgcccgcaacagaggagagcgggcatgggcgacgacaacctggcggcagcgcaaaagatg

SEQ ID NO: 218039 - DNA, 103 bp, Artificial Sequence
  Synthetic Polynucleotide
taatacgactcactataggggtgctgccctgctcccgaggggggtgggtaaacagaggagatacccaatgccctcgggaaacctggcggcagcgcaaaagatg

SEQ ID NO: 218040 - DNA, 103 bp, Artificial Sequence
  Synthetic Polynucleotide
taatacgactcactataggggcggctgggggtgctgccctgctcccgaggaacagaggagacctcggatgcagggcagcaacctggcggcagcgcaaaagatg

SEQ ID NO: 218041 - DNA, 103 bp, Artificial Sequence
  Synthetic Polynucleotide
taatacgactcactatagggagcgggggctgcggctgggggtgctgccctaacagaggagaagggcaatgcccccagccaacctggcggcagcgcaaaagatg

SEQ ID NO: 218042 - DNA, 103 bp, Artificial Sequence
  Synthetic Polynucleotide
taatacgactcactatagggggccttgtgcagcgggggctgcggctggggaacagaggagaccccagatgcagcccccgaacctggcggcagcgcaaaagatg

SEQ ID NO: 218043 - DNA, 103 bp, Artificial Sequence
  Synthetic Polynucleotide
taatacgactcactatagggggggctgattggccttgtgcagcgggggctaacagaggagaagccccatgtgcacaaggaacctggcggcagcgcaaaagatg

SEQ ID NO: 218044 - DNA, 103 bp, Artificial Sequence
  Synthetic Polynucleotide
taatacgactcactatagggacaccgtgggggggctgattggccttgtgcaacagaggagagcacaaatgcaatcagccaacctggcggcagcgcaaaagatg

SEQ ID NO: 218045 - DNA, 103 bp, Artificial Sequence
  Synthetic Polynucleotide
taatacgactcactataggggagttgggggacaccgtgggggggctgattaacagaggagaaatcagatgccccacggtaacctggcggcagcgcaaaagatg

SEQ ID NO: 218046 - DNA, 103 bp, Artificial Sequence
  Synthetic Polynucleotide
taatacgactcactatagggcgtagagagagagttgggggacaccgtgggaacagaggagacccacgatgtcccccaacaacctggcggcagcgcaaaagatg

SEQ ID NO: 218047 - DNA, 103 bp, Artificial Sequence
  Synthetic Polynucleotide
taatacgactcactatagggttgaaatgttcgtagagagagagttgggggaacagaggagacccccaatgctctctctaaacctggcggcagcgcaaaagatg

SEQ ID NO: 218048 - DNA, 103 bp, Artificial Sequence
  Synthetic Polynucleotide
taatacgactcactatagggatgtgggctgttgaaatgttcgtagagagaaacagaggagatctctcatggaacatttcaacctggcggcagcgcaaaagatg

SEQ ID NO: 218049 - DNA, 103 bp, Artificial Sequence
  Synthetic Polynucleotide
taatacgactcactataggggcagctcgtccggcgcgccgaggtcgtcgcaacagaggagagcgacgatgtcggcgcgcaacctggcggcagcgcaaaagatg

SEQ ID NO: 218050 - DNA, 103 bp, Artificial Sequence
  Synthetic Polynucleotide
taatacgactcactatagggcaggggtgggatgtgggctgttgaaatgttaacagaggagaaacattatgacagcccacaacctggcggcagcgcaaaagatg

SEQ ID NO: 218051 - DNA, 103 bp, Artificial Sequence
  Synthetic Polynucleotide
taatacgactcactatagggtccgcaggtgcaggggtgggatgtgggctgaacagaggagacagcccatgtcccaccccaacctggcggcagcgcaaaagatg

SEQ ID NO: 218052 - DNA, 103 bp, Artificial Sequence
  Synthetic Polynucleotide
taatacgactcactatagggctggctgatgtccgcaggtgcaggggtgggaacagaggagacccaccatggcacctgcgaacctggcggcagcgcaaaagatg

SEQ ID NO: 218053 - DNA, 103 bp, Artificial Sequence
  Synthetic Polynucleotide
taatacgactcactataggggaacttgcttctggctgatgtccgcaggtgaacagaggagacacctgatgacatcagccaacctggcggcagcgcaaaagatg

SEQ ID NO: 218054 - DNA, 103 bp, Artificial Sequence
  Synthetic Polynucleotide
taatacgactcactatagggagaggcctgtgaacttgcttctggctgatgaacagaggagacatcagatggaagcaagtaacctggcggcagcgcaaaagatg

SEQ ID NO: 218055 - DNA, 103 bp, Artificial Sequence
  Synthetic Polynucleotide
taatacgactcactatagggaggggtctgcagaggcctgtgaacttgcttaacagaggagaaagcaaatgcacaggcctaacctggcggcagcgcaaaagatg

SEQ ID NO: 218056 - DNA, 103 bp, Artificial Sequence
  Synthetic Polynucleotide
taatacgactcactatagggcagagaggtcaggggtctgcagaggcctgtaacagaggagaacaggcatgtgcagacccaacctggcggcagcgcaaaagatg

SEQ ID NO: 218057 - DNA, 103 bp, Artificial Sequence
  Synthetic Polynucleotide
taatacgactcactataggggagtagaagccagagaggtcaggggtctgcaacagaggagagcagacatgtgacctctcaacctggcggcagcgcaaaagatg

SEQ ID NO: 218058 - DNA, 103 bp, Artificial Sequence
  Synthetic Polynucleotide
taatacgactcactatagggtgaggtcagggagtagaagccagagaggtcaacagaggagagacctcatgggcttctacaacctggcggcagcgcaaaagatg

SEQ ID NO: 218059 - DNA, 103 bp, Artificial Sequence
  Synthetic Polynucleotide
taatacgactcactatagggccatgctgcctgaggtcagggagtagaagcaacagaggagagcttctatgccctgacctaacctggcggcagcgcaaaagatg

SEQ ID NO: 218060 - DNA, 103 bp, Artificial Sequence
  Synthetic Polynucleotide
taatacgactcactatagggtggaaggccagcagctcgtccggcgcgccgaacagaggagacggcgcatgggacgagctaacctggcggcagcgcaaaagatg

SEQ ID NO: 218061 - DNA, 103 bp, Artificial Sequence
  Synthetic Polynucleotide
taatacgactcactataggggggagctgccccatgctgcctgaggtcaggaacagaggagacctgacatgaggcagcataacctggcggcagcgcaaaagatg

SEQ ID NO: 218062 - DNA, 103 bp, Artificial Sequence
  Synthetic Polynucleotide
taatacgactcactatagggcacagtgtgggggagctgccccatgctgccaacagaggagaggcagcatggggcagctcaacctggcggcagcgcaaaagatg

SEQ ID NO: 218063 - DNA, 103 bp, Artificial Sequence
  Synthetic Polynucleotide
taatacgactcactatagggtgaaccagctcacagtgtgggggagctgccaacagaggagaggcagcatgcccacactgaacctggcggcagcgcaaaagatg

SEQ ID NO: 218064 - DNA, 103 bp, Artificial Sequence
  Synthetic Polynucleotide
taatacgactcactataggggatgggtgggtgaaccagctcacagtgtggaacagaggagaccacacatggagctggttaacctggcggcagcgcaaaagatg

SEQ ID NO: 218065 - DNA, 103 bp, Artificial Sequence
  Synthetic Polynucleotide
taatacgactcactatagggtagcatcaaggatgggtgggtgaaccagctaacagaggagaagctggatgacccacccaaacctggcggcagcgcaaaagatg

SEQ ID NO: 218066 - DNA, 103 bp, Artificial Sequence
  Synthetic Polynucleotide
taatacgactcactatagggcaccagaacctagcatcaaggatgggtgggaacagaggagacccaccatgccttgatgcaacctggcggcagcgcaaaagatg

SEQ ID NO: 218067 - DNA, 103 bp, Artificial Sequence
  Synthetic Polynucleotide
taatacgactcactatagggtgaccaggtacaccagaacctagcatcaagaacagaggagacttgatatgaggttctggaacctggcggcagcgcaaaagatg

SEQ ID NO: 218068 - DNA, 103 bp, Artificial Sequence
  Synthetic Polynucleotide
taatacgactcactatagggggctgctgggtgaccaggtacaccagaaccaacagaggagaggttctatggtacctggtaacctggcggcagcgcaaaagatg

SEQ ID NO: 218069 - DNA, 103 bp, Artificial Sequence
  Synthetic Polynucleotide
taatacgactcactatagggggtgggggatggctgctgggtgaccaggtaaacagaggagatacctgatgacccagcagaacctggcggcagcgcaaaagatg

SEQ ID NO: 218070 - DNA, 103 bp, Artificial Sequence
  Synthetic Polynucleotide
taatacgactcactatagggacaatggccgggtgggggatggctgctgggaacagaggagacccagcatgcatcccccaaacctggcggcagcgcaaaagatg

SEQ ID NO: 218071 - DNA, 103 bp, Artificial Sequence
  Synthetic Polynucleotide
taatacgactcactataggggccttcatcctggaaggccagcagctcgtcaacagaggagagacgagatgctggccttcaacctggcggcagcgcaaaagatg

SEQ ID NO: 218072 - DNA, 103 bp, Artificial Sequence
  Synthetic Polynucleotide
taatacgactcactatagggtgaggggggcacaatggccgggtgggggataacagaggagaatccccatgccggccattaacctggcggcagcgcaaaagatg

SEQ ID NO: 218073 - DNA, 103 bp, Artificial Sequence
  Synthetic Polynucleotide
taatacgactcactatagggcctgcttccctgaggggggcacaatggccgaacagaggagacggccaatgtgcccccctaacctggcggcagcgcaaaagatg

SEQ ID NO: 218074 - DNA, 103 bp, Artificial Sequence
  Synthetic Polynucleotide
taatacgactcactatagggggctgcagctcctgcttccctgaggggggcaacagaggagagcccccatgagggaagcaaacctggcggcagcgcaaaagatg

SEQ ID NO: 218075 - DNA, 103 bp, Artificial Sequence
  Synthetic Polynucleotide
taatacgactcactataggggcggtcgaagggctgcagctcctgcttcccaacagaggagagggaagatggagctgcagaacctggcggcagcgcaaaagatg

SEQ ID NO: 218076 - DNA, 103 bp, Artificial Sequence
  Synthetic Polynucleotide
taatacgactcactatagggtcttcaggttgcggtcgaagggctgcagctaacagaggagaagctgcatgccttcgaccaacctggcggcagcgcaaaagatg

SEQ ID NO: 218077 - DNA, 103 bp, Artificial Sequence
  Synthetic Polynucleotide
taatacgactcactatagggtctgcttgtgtcttcaggttgcggtcgaagaacagaggagacttcgaatgcaacctgaaaacctggcggcagcgcaaaagatg

SEQ ID NO: 218078 - DNA, 103 bp, Artificial Sequence
  Synthetic Polynucleotide
taatacgactcactatagggtgccttggactctgcttgtgtcttcaggttaacagaggagaaacctgatgacacaagcaaacctggcggcagcgcaaaagatg

SEQ ID NO: 218079 - DNA, 103 bp, Artificial Sequence
  Synthetic Polynucleotide
taatacgactcactatagggcctccttctctgccttggactctgcttgtgaacagaggagacacaagatgagtccaaggaacctggcggcagcgcaaaagatg

SEQ ID NO: 218080 - DNA, 103 bp, Artificial Sequence
  Synthetic Polynucleotide
taatacgactcactatagggggcttcttggcctccttctctgccttggacaacagaggagagtccaaatgagagaaggaaacctggcggcagcgcaaaagatg

SEQ ID NO: 218081 - DNA, 103 bp, Artificial Sequence
  Synthetic Polynucleotide
taatacgactcactatagggcttgatggttggcttcttggcctccttctcaacagaggagagagaagatggccaagaagaacctggcggcagcgcaaaagatg

SEQ ID NO: 218082 - DNA, 103 bp, Artificial Sequence
  Synthetic Polynucleotide
taatacgactcactatagggcctgctcctcgccttcatcctggaaggccaaacagaggagatggcctatgaggatgaagaacctggcggcagcgcaaaagatg

SEQ ID NO: 218083 - DNA, 103 bp, Artificial Sequence
  Synthetic Polynucleotide
taatacgactcactatagggtgaggggcttcttgatggttggcttcttggaacagaggagaccaagaatgcaaccatcaaacctggcggcagcgcaaaagatg

SEQ ID NO: 218084 - DNA, 103 bp, Artificial Sequence
  Synthetic Polynucleotide
taatacgactcactatagggatgaaggcattgaggggcttcttgatggttaacagaggagaaaccatatggaagcccctaacctggcggcagcgcaaaagatg

SEQ ID NO: 218085 - DNA, 103 bp, Artificial Sequence
  Synthetic Polynucleotide
taatacgactcactatagggcatgtacagcatgaaggcattgaggggcttaacagaggagaaagcccatgaatgccttcaacctggcggcagcgcaaaagatg

SEQ ID NO: 218086 - DNA, 103 bp, Artificial Sequence
  Synthetic Polynucleotide
taatacgactcactatagggtcatctccttcatgtacagcatgaaggcataacagaggagaatgcctatgtgctgtacaaacctggcggcagcgcaaaagatg

SEQ ID NO: 218087 - DNA, 103 bp, Artificial Sequence
  Synthetic Polynucleotide
taatacgactcactatagggaccttggctctcatctccttcatgtacagcaacagaggagagctgtaatggaaggagataacctggcggcagcgcaaaagatg

SEQ ID NO: 218088 - DNA, 103 bp, Artificial Sequence
  Synthetic Polynucleotide
taatacgactcactatagggctctgcaatgaccttggctctcatctccttaacagaggagaaaggagatgagagccaagaacctggcggcagcgcaaaagatg

SEQ ID NO: 218089 - DNA, 103 bp, Artificial Sequence
  Synthetic Polynucleotide
taatacgactcactatagggtaagtgtgcactctgcaatgaccttggctcaacagaggagagagccaatgtcattgcagaacctggcggcagcgcaaaagatg

SEQ ID NO: 218090 - DNA, 103 bp, Artificial Sequence
  Synthetic Polynucleotide
taatacgactcactataggggcgctctccttaagtgtgcactctgcaatgaacagaggagacattgcatggtgcacactaacctggcggcagcgcaaaagatg

SEQ ID NO: 218091 - DNA, 103 bp, Artificial Sequence
  Synthetic Polynucleotide
taatacgactcactataggggttgatggcagcgctctccttaagtgtgcaaacagaggagatgcacaatgaaggagagcaacctggcggcagcgcaaaagatg

SEQ ID NO: 218092 - DNA, 103 bp, Artificial Sequence
  Synthetic Polynucleotide
taatacgactcactatagggccaggatctggttgatggcagcgctctcctaacagaggagaaggagaatgctgccatcaaacctggcggcagcgcaaaagatg

SEQ ID NO: 218093 - DNA, 103 bp, Artificial Sequence
  Synthetic Polynucleotide
taatacgactcactatagggctcttgtcgtcctgctcctcgccttcatccaacagaggagaggatgaatgcgaggagcaaacctggcggcagcgcaaaagatg

SEQ ID NO: 218094 - DNA, 103 bp, Artificial Sequence
  Synthetic Polynucleotide
taatacgactcactatagggcacctgcggcccaggatctggttgatggcaaacagaggagatgccatatgccagatcctaacctggcggcagcgcaaaagatg

SEQ ID NO: 218095 - DNA, 103 bp, Artificial Sequence
  Synthetic Polynucleotide
taatacgactcactatagggcagcgcgtgccacctgcggcccaggatctgaacagaggagacagatcatgggccgcaggaacctggcggcagcgcaaaagatg

SEQ ID NO: 218096 - DNA, 103 bp, Artificial Sequence
  Synthetic Polynucleotide
taatacgactcactatagggcttctcgcgacagcgcgtgccacctgcggcaacagaggagagccgcaatgggcacgcgcaacctggcggcagcgcaaaagatg

SEQ ID NO: 218097 - DNA, 103 bp, Artificial Sequence
  Synthetic Polynucleotide
taatacgactcactatagggttggcctgctcttctcgcgacagcgcgtgcaacagaggagagcacgcatggtcgcgagaaacctggcggcagcgcaaaagatg

SEQ ID NO: 218098 - DNA, 103 bp, Artificial Sequence
  Synthetic Polynucleotide
taatacgactcactatagggctcatagtacttggcctgctcttctcgcgaaacagaggagatcgcgaatggagcaggccaacctggcggcagcgcaaaagatg

SEQ ID NO: 218099 - DNA, 103 bp, Artificial Sequence
  Synthetic Polynucleotide
taatacgactcactatagggtgcgggccagctcatagtacttggcctgctaacagaggagaagcaggatgagtactatgaacctggcggcagcgcaaaagatg

SEQ ID NO: 218100 - DNA, 103 bp, Artificial Sequence
  Synthetic Polynucleotide
taatacgactcactatagggtgcctctccttgcgggccagctcatagtacaacagaggagagtactaatggctggcccgaacctggcggcagcgcaaaagatg

SEQ ID NO: 218101 - DNA, 103 bp, Artificial Sequence
  Synthetic Polynucleotide
taatacgactcactatagggcatgtgcagctgcctctccttgcgggccagaacagaggagactggccatgaaggagaggaacctggcggcagcgcaaaagatg

SEQ ID NO: 218102 - DNA, 103 bp, Artificial Sequence
  Synthetic Polynucleotide
taatacgactcactatagggggtatagctgcatgtgcagctgcctctcctaacagaggagaaggagaatgagctgcacaaacctggcggcagcgcaaaagatg

SEQ ID NO: 218103 - DNA, 103 bp, Artificial Sequence
  Synthetic Polynucleotide
taatacgactcactataggggaccagcctgggtatagctgcatgtgcagcaacagaggagagctgcaatggcagctataaacctggcggcagcgcaaaagatg

SEQ ID NO: 218104 - DNA, 103 bp, Artificial Sequence
  Synthetic Polynucleotide
taatacgactcactataggggccgccgcccccgccgccgagctggggcataacagaggagaatgcccatgctcggcggcaacctggcggcagcgcaaaagatg

SEQ ID NO: 218105 - DNA, 103 bp, Artificial Sequence
  Synthetic Polynucleotide
taatacgactcactatagggggggatcagctcgtcgttcgccccgaggtcaacagaggagagacctcatggcgaacgacaacctggcggcagcgcaaaagatg

SEQ ID NO: 218106 - DNA, 103 bp, Artificial Sequence
  Synthetic Polynucleotide
taatacgactcactatagggctcctcctttttcacggtgactggtgatttaacagaggagaaaatcaatggtcaccgtgaacctggcggcagcgcaaaagatg

SEQ ID NO: 218107 - DNA, 103 bp, Artificial Sequence
  Synthetic Polynucleotide
taatacgactcactataggggcttcttttcctcctcctttttcacggtgaaacagaggagatcaccgatgaaaaggaggaacctggcggcagcgcaaaagatg

SEQ ID NO: 218108 - DNA, 103 bp, Artificial Sequence
  Synthetic Polynucleotide
taatacgactcactatagggttcacgtggggcttcttttcctcctcctttaacagaggagaaaaggaatgggaaaagaaaacctggcggcagcgcaaaagatg

SEQ ID NO: 218109 - DNA, 103 bp, Artificial Sequence
  Synthetic Polynucleotide
taatacgactcactatagggcagaggcttcttcacgtggggcttcttttcaacagaggagagaaaagatgccccacgtgaacctggcggcagcgcaaaagatg

SEQ ID NO: 218110 - DNA, 103 bp, Artificial Sequence
  Synthetic Polynucleotide
taatacgactcactatagggtgaaggcattcagaggcttcttcacgtgggaacagaggagacccacgatgagaagcctcaacctggcggcagcgcaaaagatg

SEQ ID NO: 218111 - DNA, 103 bp, Artificial Sequence
  Synthetic Polynucleotide
taatacgactcactatagggatatacaacatgaaggcattcagaggcttcaacagaggagagaagccatggaatgccttaacctggcggcagcgcaaaagatg

SEQ ID NO: 218112 - DNA, 103 bp, Artificial Sequence
  Synthetic Polynucleotide
taatacgactcactatagggcatctccttcatatacaacatgaaggcattaacagaggagaaatgccatgatgttgtataacctggcggcagcgcaaaagatg

SEQ ID NO: 218113 - DNA, 103 bp, Artificial Sequence
  Synthetic Polynucleotide
taatacgactcactatagggccttggccctcatctccttcatatacaacaaacagaggagatgttgtatgtgaaggagaaacctggcggcagcgcaaaagatg

SEQ ID NO: 218114 - DNA, 103 bp, Artificial Sequence
  Synthetic Polynucleotide
taatacgactcactatagggtcagccaccaccttggccctcatctccttcaacagaggagagaaggaatggagggccaaaacctggcggcagcgcaaaagatg

SEQ ID NO: 218115 - DNA, 103 bp, Artificial Sequence
  Synthetic Polynucleotide
taatacgactcactatagggcagggtgcactcagccaccaccttggccctaacagaggagaagggccatggtggtggctaacctggcggcagcgcaaaagatg

SEQ ID NO: 218116 - DNA, 103 bp, Artificial Sequence
  Synthetic Polynucleotide
taatacgactcactatagggcgtcctggaaggggatcagctcgtcgttcgaacagaggagacgaacgatgagctgatccaacctggcggcagcgcaaaagatg

SEQ ID NO: 218117 - DNA, 103 bp, Artificial Sequence
  Synthetic Polynucleotide
taatacgactcactatagggcactttccttcagggtgcactcagccaccaaacagaggagatggtggatgagtgcacccaacctggcggcagcgcaaaagatg

SEQ ID NO: 218118 - DNA, 103 bp, Artificial Sequence
  Synthetic Polynucleotide
taatacgactcactatagggttaatggctgcactttccttcagggtgcacaacagaggagagtgcacatggaaggaaagaacctggcggcagcgcaaaagatg

SEQ ID NO: 218119 - DNA, 103 bp, Artificial Sequence
  Synthetic Polynucleotide
taatacgactcactatagggaaggatctggttaatggctgcactttccttaacagaggagaaaggaaatggcagccattaacctggcggcagcgcaaaagatg

SEQ ID NO: 218120 - DNA, 103 bp, Artificial Sequence
  Synthetic Polynucleotide
taatacgactcactatagggactttcttccaaggatctggttaatggctgaacagaggagacagccaatgaccagatccaacctggcggcagcgcaaaagatg

SEQ ID NO: 218121 - DNA, 103 bp, Artificial Sequence
  Synthetic Polynucleotide
taatacgactcactatagggaggttgtgccactttcttccaaggatctggaacagaggagaccagatatgtggaagaaaaacctggcggcagcgcaaaagatg

SEQ ID NO: 218122 - DNA, 103 bp, Artificial Sequence
  Synthetic Polynucleotide
taatacgactcactatagggttctcgagacaggttgtgccactttcttccaacagaggagaggaagaatgtggcacaacaacctggcggcagcgcaaaagatg

SEQ ID NO: 218123 - DNA, 103 bp, Artificial Sequence
  Synthetic Polynucleotide
taatacgactcactatagggtggcctgttcttctcgagacaggttgtgccaacagaggagaggcacaatgtgtctcgagaacctggcggcagcgcaaaagatg

SEQ ID NO: 218124 - DNA, 103 bp, Artificial Sequence
  Synthetic Polynucleotide
taatacgactcactatagggtcgtagtacttggcctgttcttctcgagacaacagaggagagtctcgatgagaacaggcaacctggcggcagcgcaaaagatg

SEQ ID NO: 218125 - DNA, 103 bp, Artificial Sequence
  Synthetic Polynucleotide
taatacgactcactatagggccgggccagctcgtagtacttggcctgttcaacagaggagagaacagatgaagtactacaacctggcggcagcgcaaaagatg

SEQ ID NO: 218126 - DNA, 103 bp, Artificial Sequence
  Synthetic Polynucleotide
taatacgactcactataggggccgctccttccgggccagctcgtagtactaacagaggagaagtactatgagctggcccaacctggcggcagcgcaaaagatg

SEQ ID NO: 218127 - DNA, 103 bp, Artificial Sequence
  Synthetic Polynucleotide
taatacgactcactatagggtcgcccccctcgtcctggaaggggatcagcaacagaggagagctgatatgcttccaggaaacctggcggcagcgcaaaagatg

SEQ ID NO: 218128 - DNA, 103 bp, Artificial Sequence
  Synthetic Polynucleotide
taatacgactcactataggggagtgaagctgccgctccttccgggccagcaacagaggagagctggcatggaaggagcgaacctggcggcagcgcaaaagatg

SEQ ID NO: 218129 - DNA, 103 bp, Artificial Sequence
  Synthetic Polynucleotide
taatacgactcactataggggtagagctgcgagtgaagctgccgctccttaacagaggagaaaggagatgcagcttcacaacctggcggcagcgcaaaagatg

SEQ ID NO: 218130 - DNA, 103 bp, Artificial Sequence
  Synthetic Polynucleotide
taatacgactcactatagggaccaggttgggtagagctgcgagtgaagctaacagaggagaagcttcatgcgcagctctaacctggcggcagcgcaaaagatg

SEQ ID NO: 218131 - DNA, 103 bp, Artificial Sequence
  Synthetic Polynucleotide
taatacgactcactatagggtcccgggctgaccaggttgggtagagctgcaacagaggagagcagctatgcccaacctgaacctggcggcagcgcaaaagatg

SEQ ID NO: 218132 - DNA, 103 bp, Artificial Sequence
  Synthetic Polynucleotide
taatacgactcactatagggaccatagttgtcccgggctgaccaggttggaacagaggagaccaaccatgtcagcccggaacctggcggcagcgcaaaagatg

SEQ ID NO: 218133 - DNA, 103 bp, Artificial Sequence
  Synthetic Polynucleotide
taatacgactcactatagggtctttttcttaccatagttgtcccgggctgaacagaggagacagcccatgacaactatgaacctggcggcagcgcaaaagatg

SEQ ID NO: 218134 - DNA, 103 bp, Artificial Sequence
  Synthetic Polynucleotide
taatacgactcactatagggctcttcctcttctttttcttaccatagttgaacagaggagacaactaatgtaagaaaaaaacctggcggcagcgcaaaagatg

SEQ ID NO: 218135 - DNA, 103 bp, Artificial Sequence
  Synthetic Polynucleotide
taatacgactcactatagggctgcttttctctcttcctcttctttttcttaacagaggagaaagaaaatgaagaggaagaacctggcggcagcgcaaaagatg

SEQ ID NO: 218136 - DNA, 103 bp, Artificial Sequence
  Synthetic Polynucleotide
taatacgactcactatagggtctgggacagctgcttttctctcttcctctaacagaggagaagaggaatggagaaaagcaacctggcggcagcgcaaaagatg

SEQ ID NO: 218137 - DNA, 103 bp, Artificial Sequence
  Synthetic Polynucleotide
taatacgactcactatagggtgtgactgtgtctgggacagctgcttttctaacagaggagaagaaaaatggctgtcccaaacctggcggcagcgcaaaagatg

SEQ ID NO: 218138 - DNA, 103 bp, Artificial Sequence
  Synthetic Polynucleotide
taatacgactcactatagggctcctgctcctcgcccccctcgtcctggaaaacagaggagattccagatggaggggggcaacctggcggcagcgcaaaagatg

SEQ ID NO: 218139 - DNA, 103 bp, Artificial Sequence
  Synthetic Polynucleotide
taatacgactcactataggggacttgctgctgtgactgtgtctgggacagaacagaggagactgtccatgacacagtcaaacctggcggcagcgcaaaagatg

SEQ ID NO: 218140 - DNA, 103 bp, Artificial Sequence
  Synthetic Polynucleotide
taatacgactcactatagggctgcctcctggacttgctgctgtgactgtgaacagaggagacacagtatgagcagcaagaacctggcggcagcgcaaaagatg

SEQ ID NO: 218141 - DNA, 103 bp, Artificial Sequence
  Synthetic Polynucleotide
taatacgactcactatagggagggcaccctctgcctcctggacttgctgcaacagaggagagcagcaatgccaggaggcaacctggcggcagcgcaaaagatg

SEQ ID NO: 218142 - DNA, 103 bp, Artificial Sequence
  Synthetic Polynucleotide
taatacgactcactatagggcttggaggccagggcaccctctgcctcctgaacagaggagacaggagatggagggtgccaacctggcggcagcgcaaaagatg

SEQ ID NO: 218143 - DNA, 103 bp, Artificial Sequence
  Synthetic Polynucleotide
taatacgactcactataggggcttcttgctcttggaggccagggcaccctaacagaggagaagggtgatgtggcctccaaacctggcggcagcgcaaaagatg

SEQ ID NO: 218144 - DNA, 103 bp, Artificial Sequence
  Synthetic Polynucleotide
taatacgactcactatagggtgaacacatggcttcttgctcttggaggccaacagaggagaggcctcatggagcaagaaaacctggcggcagcgcaaaagatg

SEQ ID NO: 218145 - DNA, 103 bp, Artificial Sequence
  Synthetic Polynucleotide
taatacgactcactataggggggcaggtactgaacacatggcttcttgctaacagaggagaagcaagatgccatgtgttaacctggcggcagcgcaaaagatg

SEQ ID NO: 218146 - DNA, 103 bp, Artificial Sequence
  Synthetic Polynucleotide
taatacgactcactataggggcttctcggggggcaggtactgaacacatgaacagaggagacatgtgatgagtacctgcaacctggcggcagcgcaaaagatg

SEQ ID NO: 218147 - DNA, 103 bp, Artificial Sequence
  Synthetic Polynucleotide
taatacgactcactatagggctgtcacagggcttctcggggggcaggtacaacagaggagagtacctatgccccgagaaaacctggcggcagcgcaaaagatg

SEQ ID NO: 218148 - DNA, 103 bp, Artificial Sequence
  Synthetic Polynucleotide
taatacgactcactatagggggaggcagggctgtcacagggcttctcgggaacagaggagacccgagatgccctgtgacaacctggcggcagcgcaaaagatg

SEQ ID NO: 218149 - DNA, 103 bp, Artificial Sequence
  Synthetic Polynucleotide
taatacgactcactatagggcgctgctcggctcctgctcctcgcccccctaacagaggagaagggggatgaggagcaggaacctggcggcagcgcaaaagatg

SEQ ID NO: 218150 - DNA, 103 bp, Artificial Sequence
  Synthetic Polynucleotide
taatacgactcactatagggtcccgtgggaggaggcagggctgtcacaggaacagaggagacctgtgatggccctgcctaacctggcggcagcgcaaaagatg

SEQ ID NO: 218151 - DNA, 103 bp, Artificial Sequence
  Synthetic Polynucleotide
taatacgactcactatagggtccagcatgctcccgtgggaggaggcagggaacagaggagaccctgcatgctcccacggaacctggcggcagcgcaaaagatg

SEQ ID NO: 218152 - DNA, 103 bp, Artificial Sequence
  Synthetic Polynucleotide
taatacgactcactatagggggccggggagtccagcatgctcccgtgggaaacagaggagatcccacatgagcatgctgaacctggcggcagcgcaaaagatg

SEQ ID NO: 218153 - DNA, 103 bp, Artificial Sequence
  Synthetic Polynucleotide
taatacgactcactatagggcagagggagtggccggggagtccagcatgcaacagaggagagcatgcatgactccccggaacctggcggcagcgcaaaagatg

SEQ ID NO: 218154 - DNA, 103 bp, Artificial Sequence
  Synthetic Polynucleotide
taatacgactcactataggggccaaagctgcagagggagtggccggggagaacagaggagactccccatgcactccctcaacctggcggcagcgcaaaagatg

SEQ ID NO: 218155 - DNA, 103 bp, Artificial Sequence
  Synthetic Polynucleotide
taatacgactcactatagggagctggtgaggccaaagctgcagagggagtaacagaggagaactcccatggcagctttgaacctggcggcagcgcaaaagatg

SEQ ID NO: 218156 - DNA, 103 bp, Artificial Sequence
  Synthetic Polynucleotide
taatacgactcactatagggcagcaggggcagctggtgaggccaaagctgaacagaggagacagcttatgcctcaccagaacctggcggcagcgcaaaagatg

SEQ ID NO: 218157 - DNA, 103 bp, Artificial Sequence
  Synthetic Polynucleotide
taatacgactcactataggggaatgggtggcagcaggggcagctggtgagaacagaggagactcaccatgtgcccctgcaacctggcggcagcgcaaaagatg

SEQ ID NO: 218158 - DNA, 103 bp, Artificial Sequence
  Synthetic Polynucleotide
taatacgactcactatagggggcttgctccgaatgggtggcagcaggggcaacagaggagagcccctatggccacccataacctggcggcagcgcaaaagatg

SEQ ID NO: 218159 - DNA, 103 bp, Artificial Sequence
  Synthetic Polynucleotide
taatacgactcactatagggagaggggctgggcttgctccgaatgggtggaacagaggagaccacccatgcggagcaagaacctggcggcagcgcaaaagatg

SEQ ID NO: 218160 - DNA, 103 bp, Artificial Sequence
  Synthetic Polynucleotide
taatacgactcactataggggaggcgctatcgctgctcggctcctgctccaacagaggagaggagcaatggccgagcagaacctggcggcagcgcaaaagatg

SEQ ID NO: 218161 - DNA, 103 bp, Artificial Sequence
  Synthetic Polynucleotide
taatacgactcactataggggtggtgagggagaggggctgggcttgctccaacagaggagaggagcaatgccagcccctaacctggcggcagcgcaaaagatg

SEQ ID NO: 218162 - DNA, 103 bp, Artificial Sequence
  Synthetic Polynucleotide
taatacgactcactatagggttctggtttggtggtgagggagaggggctgaacagaggagacagcccatgtccctcaccaacctggcggcagcgcaaaagatg

SEQ ID NO: 218163 - DNA, 103 bp, Artificial Sequence
  Synthetic Polynucleotide
taatacgactcactataggggggcccgggtttctggtttggtggtgagggaacagaggagaccctcaatgccaaaccagaacctggcggcagcgcaaaagatg

SEQ ID NO: 218164 - DNA, 103 bp, Artificial Sequence
  Synthetic Polynucleotide
taatacgactcactatagggagagccagctgggcccgggtttctggtttgaacagaggagacaaaccatgaacccgggcaacctggcggcagcgcaaaagatg

SEQ ID NO: 218165 - DNA, 103 bp, Artificial Sequence
  Synthetic Polynucleotide
taatacgactcactatagggggcagagtggagagccagctgggcccgggtaacagaggagaacccggatgcagctggctaacctggcggcagcgcaaaagatg

SEQ ID NO: 218166 - DNA, 103 bp, Artificial Sequence
  Synthetic Polynucleotide
taatacgactcactatagggacaggaaggcggcagagtggagagccagctaacagaggagaagctggatgtccactctgaacctggcggcagcgcaaaagatg

SEQ ID NO: 218167 - DNA, 103 bp, Artificial Sequence
  Synthetic Polynucleotide
taatacgactcactataggggccttagccgacaggaaggcggcagagtggaacagaggagaccactcatgcgccttcctaacctggcggcagcgcaaaagatg

SEQ ID NO: 218168 - DNA, 103 bp, Artificial Sequence
  Synthetic Polynucleotide
taatacgactcactatagggggaggctgcagccttagccgacaggaaggcaacagaggagagccttcatgtcggctaagaacctggcggcagcgcaaaagatg

SEQ ID NO: 218169 - DNA, 103 bp, Artificial Sequence
  Synthetic Polynucleotide
taatacgactcactataggggcccagaggaggaggctgcagccttagccgaacagaggagacggctaatgctgcagcctaacctggcggcagcgcaaaagatg

SEQ ID NO: 218170 - DNA, 103 bp, Artificial Sequence
  Synthetic Polynucleotide
taatacgactcactatagggctgcccatctgcccagaggaggaggctgcaaacagaggagatgcagcatgctcctctggaacctggcggcagcgcaaaagatg

SEQ ID NO: 218171 - DNA, 103 bp, Artificial Sequence
  Synthetic Polynucleotide
taatacgactcactatagggccgctgcgccgaggcgctatcgctgctcggaacagaggagaccgagcatggatagcgccaacctggcggcagcgcaaaagatg

SEQ ID NO: 218172 - DNA, 103 bp, Artificial Sequence
  Synthetic Polynucleotide
taatacgactcactataggggggaggctggctgcccatctgcccagaggaaacagaggagatcctctatgcagatgggcaacctggcggcagcgcaaaagatg

SEQ ID NO: 218173 - DNA, 103 bp, Artificial Sequence
  Synthetic Polynucleotide
taatacgactcactataggggggacaggaggggaggctggctgcccatctaacagaggagaagatggatggccagcctcaacctggcggcagcgcaaaagatg

SEQ ID NO: 218174 - DNA, 103 bp, Artificial Sequence
  Synthetic Polynucleotide
taatacgactcactataggggggaggggccgggacaggaggggaggctggaacagaggagaccagccatgcctcctgtcaacctggcggcagcgcaaaagatg

SEQ ID NO: 218175 - DNA, 103 bp, Artificial Sequence
  Synthetic Polynucleotide
taatacgactcactatagggggacccaagggggaggggccgggacaggagaacagaggagactcctgatgcggcccctcaacctggcggcagcgcaaaagatg

SEQ ID NO: 218176 - DNA, 103 bp, Artificial Sequence
  Synthetic Polynucleotide
taatacgactcactatagggctgtgggcatggacccaagggggaggggccaacagaggagaggccccatgcccttgggtaacctggcggcagcgcaaaagatg

SEQ ID NO: 218177 - DNA, 103 bp, Artificial Sequence
  Synthetic Polynucleotide
taatacgactcactataggggccagcagagctgtgggcatggacccaaggaacagaggagaccttggatgcatgcccacaacctggcggcagcgcaaaagatg

SEQ ID NO: 218178 - DNA, 103 bp, Artificial Sequence
  Synthetic Polynucleotide
taatacgactcactatagggcgggggagaggccagcagagctgtgggcataacagaggagaatgcccatggctctgctgaacctggcggcagcgcaaaagatg

SEQ ID NO: 218179 - DNA, 103 bp, Artificial Sequence
  Synthetic Polynucleotide
taatacgactcactatagggcggggaaggacgggggagaggccagcagagaacagaggagactctgcatgcctctccccaacctggcggcagcgcaaaagatg

SEQ ID NO: 218180 - DNA, 103 bp, Artificial Sequence
  Synthetic Polynucleotide
taatacgactcactatagggtggagcgtggcggggaaggacgggggagagaacagaggagactctccatggtccttcccaacctggcggcagcgcaaaagatg

SEQ ID NO: 218181 - DNA, 103 bp, Artificial Sequence
  Synthetic Polynucleotide
taatacgactcactatagggctggtgggcatggagcgtggcggggaaggaaacagaggagatccttcatggccacgctcaacctggcggcagcgcaaaagatg

SEQ ID NO: 218182 - DNA, 103 bp, Artificial Sequence
  Synthetic Polynucleotide
taatacgactcactatagggcgtctaggtcccgctgcgccgaggcgctataacagaggagaatagcgatgcggcgcagcaacctggcggcagcgcaaaagatg

SEQ ID NO: 218183 - DNA, 103 bp, Artificial Sequence
  Synthetic Polynucleotide
taatacgactcactatagggccgggagggcctggtgggcatggagcgtggaacagaggagaccacgcatgatgcccaccaacctggcggcagcgcaaaagatg

SEQ ID NO: 218184 - DNA, 103 bp, Artificial Sequence
  Synthetic Polynucleotide
taatacgactcactataggggcctgtagcaccgggagggcctggtgggcaaacagaggagatgcccaatgggccctcccaacctggcggcagcgcaaaagatg

SEQ ID NO: 218185 - DNA, 103 bp, Artificial Sequence
  Synthetic Polynucleotide
taatacgactcactatagggaagaggctgggcctgtagcaccgggagggcaacagaggagagccctcatggtgctacagaacctggcggcagcgcaaaagatg

SEQ ID NO: 218186 - DNA, 103 bp, Artificial Sequence
  Synthetic Polynucleotide
taatacgactcactatagggtgaccagggaaagaggctgggcctgtagcaaacagaggagatgctacatgcccagcctcaacctggcggcagcgcaaaagatg

SEQ ID NO: 218187 - DNA, 103 bp, Artificial Sequence
  Synthetic Polynucleotide
taatacgactcactataggggcagacttggtgaccagggaaagaggctggaacagaggagaccagccatgttccctggtaacctggcggcagcgcaaaagatg

SEQ ID NO: 218188 - DNA, 103 bp, Artificial Sequence
  Synthetic Polynucleotide
taatacgactcactataggggacttgacctcgtctaggtcccgctgcgccaacagaggagaggcgcaatgggacctagaaacctggcggcagcgcaaaagatg

SEQ ID NO: 218189 - DNA, 103 bp, Artificial Sequence
  Synthetic Polynucleotide
taatacgactcactataggggaccagggacgacttgacctcgtctaggtcaacagaggagagacctaatggaggtcaagaacctggcggcagcgcaaaagatg

SEQ ID NO: 218190 - DNA, 103 bp, Artificial Sequence
  Synthetic Polynucleotide
taatacgactcactatagggcgccgccgccgccgccgcccccgccgccgaaacagaggagatcggcgatgggggcggcgaacctggcggcagcgcaaaagatg

SEQ ID NO: 218191 - DNA, 103 bp, Artificial Sequence
  Synthetic Polynucleotide
taatacgactcactatagggccgactcgttgaccagggacgacttgacctaacagaggagaaggtcaatgcgtccctggaacctggcggcagcgcaaaagatg

SEQ ID NO: 218192 - DNA, 103 bp, Artificial Sequence
  Synthetic Polynucleotide
taatacgactcactatagggctctggttctccgactcgttgaccagggacaacagaggagagtccctatgcaacgagtcaacctggcggcagcgcaaaagatg

SEQ ID NO: 218193 - DNA, 103 bp, Artificial Sequence
  Synthetic Polynucleotide
taatacgactcactatagggcgagctgctgctctggttctccgactcgttaacagaggagaaacgagatggagaaccagaacctggcggcagcgcaaaagatg

SEQ ID NO: 218194 - DNA, 103 bp, Artificial Sequence
  Synthetic Polynucleotide
taatacgactcactatagggcctccgagtccgagctgctgctctggttctaacagaggagaagaaccatggcagcagctaacctggcggcagcgcaaaagatg

SEQ ID NO: 218195 - DNA, 103 bp, Artificial Sequence
  Synthetic Polynucleotide
taatacgactcactatagggcgcctctccgcctccgagtccgagctgctgaacagaggagacagcagatgggactcggaaacctggcggcagcgcaaaagatg

SEQ ID NO: 218196 - DNA, 103 bp, Artificial Sequence
  Synthetic Polynucleotide
taatacgactcactataggggggctgcgggcgcctctccgcctccgagtcaacagaggagagactcgatggcggagaggaacctggcggcagcgcaaaagatg

SEQ ID NO: 218197 - DNA, 103 bp, Artificial Sequence
  Synthetic Polynucleotide
taatacgactcactatagggtgtcccggacgggctgcgggcgcctctccgaacagaggagacggagaatggcccgcagcaacctggcggcagcgcaaaagatg

SEQ ID NO: 218198 - DNA, 103 bp, Artificial Sequence
  Synthetic Polynucleotide
taatacgactcactatagggttctggaaagtgtcccggacgggctgcgggaacagaggagacccgcaatgcgtccgggaaacctggcggcagcgcaaaagatg

SEQ ID NO: 218199 - DNA, 103 bp, Artificial Sequence
  Synthetic Polynucleotide
taatacgactcactataggggtcccgcggcttctggaaagtgtcccggacaacagaggagagtccggatgactttccagaacctggcggcagcgcaaaagatg

SEQ ID NO: 218200 - DNA, 103 bp, Artificial Sequence
  Synthetic Polynucleotide
taatacgactcactatagggcggcgaaatagtcccgcggcttctggaaagaacagaggagactttccatgagccgcgggaacctggcggcagcgcaaaagatg

SEQ ID NO: 218201 - DNA, 103 bp, Artificial Sequence
  Synthetic Polynucleotide
taatacgactcactatagggcccccgctgccgccgccgccgccgccgcccaacagaggagagggcggatgcggcggcggaacctggcggcagcgcaaaagatg

SEQ ID NO: 218202 - DNA, 103 bp, Artificial Sequence
  Synthetic Polynucleotide
taatacgactcactatagggcttctcacttcggcgaaatagtcccgcggcaacagaggagagccgcgatgctatttcgcaacctggcggcagcgcaaaagatg

SEQ ID NO: 218203 - DNA, 103 bp, Artificial Sequence
  Synthetic Polynucleotide
taatacgactcactataggggtcctgaggccttctcacttcggcgaaataaacagaggagatatttcatggaagtgagaaacctggcggcagcgcaaaagatg

SEQ ID NO: 218204 - DNA, 103 bp, Artificial Sequence
  Synthetic Polynucleotide
taatacgactcactatagggagaacgcgctgtcctgaggccttctcacttaacagaggagaaagtgaatgggcctcaggaacctggcggcagcgcaaaagatg

SEQ ID NO: 218205 - DNA, 103 bp, Artificial Sequence
  Synthetic Polynucleotide
taatacgactcactatagggggtcctttaaagaacgcgctgtcctgaggcaacagaggagagcctcaatgcagcgcgttaacctggcggcagcgcaaaagatg

SEQ ID NO: 218206 - DNA, 103 bp, Artificial Sequence
  Synthetic Polynucleotide
taatacgactcactatagggagggtacgggggtcctttaaagaacgcgctaacagaggagaagcgcgatgtttaaaggaaacctggcggcagcgcaaaagatg

SEQ ID NO: 218207 - DNA, 103 bp, Artificial Sequence
  Synthetic Polynucleotide
taatacgactcactatagggaggggtacccagggtacgggggtcctttaaaacagaggagattaaagatgccccgtaccaacctggcggcagcgcaaaagatg

SEQ ID NO: 218208 - DNA, 103 bp, Artificial Sequence
  Synthetic Polynucleotide
taatacgactcactatagggatcatcaggaaggggtacccagggtacgggaacagaggagacccgtaatgtgggtacccaacctggcggcagcgcaaaagatg

SEQ ID NO: 218209 - DNA, 103 bp, Artificial Sequence
  Synthetic Polynucleotide
taatacgactcactatagggcaggtccgggatcatcaggaaggggtacccaacagaggagagggtacatgttcctgatgaacctggcggcagcgcaaaagatg

SEQ ID NO: 218210 - DNA, 103 bp, Artificial Sequence
  Synthetic Polynucleotide
taatacgactcactatagggacgggctgctcaggtccgggatcatcaggaaacagaggagatcctgaatgtcccggaccaacctggcggcagcgcaaaagatg

SEQ ID NO: 218211 - DNA, 103 bp, Artificial Sequence
  Synthetic Polynucleotide
taatacgactcactatagggttggagaggtacgggctgctcaggtccgggaacagaggagacccggaatggagcagcccaacctggcggcagcgcaaaagatg

SEQ ID NO: 218212 - DNA, 103 bp, Artificial Sequence
  Synthetic Polynucleotide
taatacgactcactataggggccgccgcctcccccgctgccgccgccgccaacagaggagaggcggcatgggcagcgggaacctggcggcagcgcaaaagatg

SEQ ID NO: 218213 - DNA, 103 bp, Artificial Sequence
  Synthetic Polynucleotide
taatacgactcactatagggcaggggtccgttggagaggtacgggctgctaacagaggagaagcagcatgtacctctccaacctggcggcagcgcaaaagatg

SEQ ID NO: 218214 - DNA, 103 bp, Artificial Sequence
  Synthetic Polynucleotide
taatacgactcactatagggctccgggagacaggggtccgttggagaggtaacagaggagaacctctatgacggaccccaacctggcggcagcgcaaaagatg

SEQ ID NO: 218215 - DNA, 103 bp, Artificial Sequence
  Synthetic Polynucleotide
taatacgactcactataggggtgcgcgctcctccgggagacaggggtccgaacagaggagacggaccatggtctcccggaacctggcggcagcgcaaaagatg

SEQ ID NO: 218216 - DNA, 103 bp, Artificial Sequence
  Synthetic Polynucleotide
taatacgactcactatagggctgcaggtaggtgcgcgctcctccgggagaaacagaggagatctcccatgggagcgcgcaacctggcggcagcgcaaaagatg

SEQ ID NO: 218217 - DNA, 103 bp, Artificial Sequence
  Synthetic Polynucleotide
taatacgactcactataggggccatttcatctgcaggtaggtgcgcgctcaacagaggagagagcgcatgcctacctgcaacctggcggcagcgcaaaagatg

SEQ ID NO: 218218 - DNA, 103 bp, Artificial Sequence
  Synthetic Polynucleotide
taatacgactcactatagggtcgaggaggggccatttcatctgcaggtagaacagaggagactacctatggatgaaatgaacctggcggcagcgcaaaagatg

SEQ ID NO: 218219 - DNA, 103 bp, Artificial Sequence
  Synthetic Polynucleotide
taatacgactcactatagggggaggggacatcgaggaggggccatttcataacagaggagaatgaaaatgcccctcctcaacctggcggcagcgcaaaagatg

SEQ ID NO: 218220 - DNA, 103 bp, Artificial Sequence
  Synthetic Polynucleotide
taatacgactcactatagggctgtggcgctggaggggacatcgaggagggaacagaggagaccctccatgatgtcccctaacctggcggcagcgcaaaagatg

SEQ ID NO: 218221 - DNA, 103 bp, Artificial Sequence
  Synthetic Polynucleotide
taatacgactcactataggggtgtccttgactgtggcgctggaggggacaaacagaggagatgtcccatgcagcgccacaacctggcggcagcgcaaaagatg

SEQ ID NO: 218222 - DNA, 103 bp, Artificial Sequence
  Synthetic Polynucleotide
taatacgactcactatagggtggtgacctcgtgtccttgactgtggcgctaacagaggagaagcgccatggtcaaggacaacctggcggcagcgcaaaagatg

SEQ ID NO: 218223 - DNA, 103 bp, Artificial Sequence
  Synthetic Polynucleotide
taatacgactcactatagggcggcgctggagccgccgcctcccccgctgcaacagaggagagcagcgatggaggcggcgaacctggcggcagcgcaaaagatg

SEQ ID NO: 218224 - DNA, 103 bp, Artificial Sequence
  Synthetic Polynucleotide
taatacgactcactataggggtgctggagatggtgacctcgtgtccttgaaacagaggagatcaaggatgcgaggtcacaacctggcggcagcgcaaaagatg

SEQ ID NO: 218225 - DNA, 103 bp, Artificial Sequence
  Synthetic Polynucleotide
taatacgactcactatagggttagacaagtgtgctggagatggtgacctcaacagaggagagaggtcatgatctccagcaacctggcggcagcgcaaaagatg

SEQ ID NO: 218226 - DNA, 103 bp, Artificial Sequence
  Synthetic Polynucleotide
taatacgactcactatagggaggaactttattagacaagtgtgctggagaaacagaggagatctccaatgcacttgtctaacctggcggcagcgcaaaagatg

SEQ ID NO: 218227 - DNA, 103 bp, Artificial Sequence
  Synthetic Polynucleotide
taatacgactcactataggggctgaacgacaggaactttattagacaagtaacagaggagaacttgtatgataaagttcaacctggcggcagcgcaaaagatg

SEQ ID NO: 218228 - DNA, 103 bp, Artificial Sequence
  Synthetic Polynucleotide
taatacgactcactatagggtgatgcgggtgctgaacgacaggaactttaaacagaggagataaagtatgtgtcgttcaaacctggcggcagcgcaaaagatg

SEQ ID NO: 218229 - DNA, 103 bp, Artificial Sequence
  Synthetic Polynucleotide
taatacgactcactatagggcggatgcatgtgatgcgggtgctgaacgacaacagaggagagtcgttatgcacccgcataacctggcggcagcgcaaaagatg

SEQ ID NO: 218230 - DNA, 103 bp, Artificial Sequence
  Synthetic Polynucleotide
taatacgactcactatagggggggagtcagcggatgcatgtgatgcgggtaacagaggagaacccgcatgacatgcatcaacctggcggcagcgcaaaagatg

SEQ ID NO: 218231 - DNA, 103 bp, Artificial Sequence
  Synthetic Polynucleotide
taatacgactcactatagggtaggtgatgaggggagtcagcggatgcatgaacagaggagacatgcaatggctgactccaacctggcggcagcgcaaaagatg

SEQ ID NO: 218232 - DNA, 103 bp, Artificial Sequence
  Synthetic Polynucleotide
taatacgactcactataggggtcattgctgtaggtgatgaggggagtcagaacagaggagactgactatgctcatcaccaacctggcggcagcgcaaaagatg

SEQ ID NO: 218233 - DNA, 103 bp, Artificial Sequence
  Synthetic Polynucleotide
taatacgactcactataggggggagaagtggtcattgctgtaggtgatgaaacagaggagatcatcaatgacagcaatgaacctggcggcagcgcaaaagatg

SEQ ID NO: 218234 - DNA, 103 bp, Artificial Sequence
  Synthetic Polynucleotide
taatacgactcactatagggccggccgccccggcgctggagccgccgcctaacagaggagaaggcggatgctccagcgcaacctggcggcagcgcaaaagatg

SEQ ID NO: 218235 - DNA, 103 bp, Artificial Sequence
  Synthetic Polynucleotide
taatacgactcactatagggggggagccgggggagaagtggtcattgctgaacagaggagacagcaaatgccacttctcaacctggcggcagcgcaaaagatg

SEQ ID NO: 218236 - DNA, 103 bp, Artificial Sequence
  Synthetic Polynucleotide
taatacgactcactataggggtgggtgggaggggagccgggggagaagtgaacagaggagacacttcatgcccggctccaacctggcggcagcgcaaaagatg

SEQ ID NO: 218237 - DNA, 103 bp, Artificial Sequence
  Synthetic Polynucleotide
taatacgactcactatagggctggggagaggtgggtgggaggggagccggaacagaggagaccggctatgctcccacccaacctggcggcagcgcaaaagatg

SEQ ID NO: 218238 - DNA, 103 bp, Artificial Sequence
  Synthetic Polynucleotide
taatacgactcactatagggggatcgatctctggggagaggtgggtgggaaacagaggagatcccacatgcctctccccaacctggcggcagcgcaaaagatg

SEQ ID NO: 218239 - DNA, 103 bp, Artificial Sequence
  Synthetic Polynucleotide
taatacgactcactatagggtcctgtctttggatcgatctctggggagagaacagaggagactctccatggagatcgataacctggcggcagcgcaaaagatg

SEQ ID NO: 218240 - DNA, 103 bp, Artificial Sequence
  Synthetic Polynucleotide
taatacgactcactataggggccgggggattcctgtctttggatcgatctaacagaggagaagatcgatgcaaagacagaacctggcggcagcgcaaaagatg

SEQ ID NO: 218241 - DNA, 103 bp, Artificial Sequence
  Synthetic Polynucleotide
taatacgactcactataggggggtgagggggccgggggattcctgtctttaacagaggagaaaagacatgaatcccccgaacctggcggcagcgcaaaagatg

SEQ ID NO: 218242 - DNA, 103 bp, Artificial Sequence
  Synthetic Polynucleotide
taatacgactcactatagggcagctcggatgggtgagggggccgggggataacagaggagaatccccatgccccctcacaacctggcggcagcgcaaaagatg

SEQ ID NO: 218243 - DNA, 103 bp, Artificial Sequence
  Synthetic Polynucleotide
taatacgactcactatagggaatacggtgacagctcggatgggtgaggggaacagaggagacccctcatgcatccgagcaacctggcggcagcgcaaaagatg

SEQ ID NO: 218244 - DNA, 103 bp, Artificial Sequence
  Synthetic Polynucleotide
taatacgactcactataggggagagtgggtaatacggtgacagctcggataacagaggagaatccgaatggtcaccgtaaacctggcggcagcgcaaaagatg

SEQ ID NO: 218245 - DNA, 103 bp, Artificial Sequence
  Synthetic Polynucleotide
taatacgactcactataggggtcccctccgccggccgccccggcgctggaaacagaggagatccagcatgggggcggccaacctggcggcagcgcaaaagatg

SEQ ID NO: 218246 - DNA, 103 bp, Artificial Sequence
  Synthetic Polynucleotide
taatacgactcactatagggagctccgggagagagtgggtaatacggtgaaacagaggagatcaccgatgtacccactcaacctggcggcagcgcaaaagatg

SEQ ID NO: 218247 - DNA, 103 bp, Artificial Sequence
  Synthetic Polynucleotide
taatacgactcactatagggtttgtccgacagctccgggagagagtgggtaacagaggagaacccacatgctcccggagaacctggcggcagcgcaaaagatg

SEQ ID NO: 218248 - DNA, 103 bp, Artificial Sequence
  Synthetic Polynucleotide
taatacgactcactataggggggtgggggatttgtccgacagctccgggaaacagaggagatcccggatgtgtcggacaaacctggcggcagcgcaaaagatg

SEQ ID NO: 218249 - DNA, 103 bp, Artificial Sequence
  Synthetic Polynucleotide
taatacgactcactatagggccagccgagggggtgggggatttgtccgacaacagaggagagtcggaatgatcccccacaacctggcggcagcgcaaaagatg

SEQ ID NO: 218250 - DNA, 103 bp, Artificial Sequence
  Synthetic Polynucleotide
taatacgactcactataggggtgggacgagccagccgagggggtgggggaaacagaggagatcccccatgccctcggctaacctggcggcagcgcaaaagatg

SEQ ID NO: 218251 - DNA, 103 bp, Artificial Sequence
  Synthetic Polynucleotide
taatacgactcactatagggtggccttgctgtgggacgagccagccgaggaacagaggagacctcggatggctcgtcccaacctggcggcagcgcaaaagatg

SEQ ID NO: 218252 - DNA, 103 bp, Artificial Sequence
  Synthetic Polynucleotide
taatacgactcactataggggtacatgggctggccttgctgtgggacgagaacagaggagactcgtcatgcagcaaggcaacctggcggcagcgcaaaagatg

SEQ ID NO: 218253 - DNA, 103 bp, Artificial Sequence
  Synthetic Polynucleotide
taatacgactcactataggggaggaagggagtacatgggctggccttgctaacagaggagaagcaagatgagcccatgtaacctggcggcagcgcaaaagatg

SEQ ID NO: 218254 - DNA, 103 bp, Artificial Sequence
  Synthetic Polynucleotide
taatacgactcactatagggaagccaccgggaggaagggagtacatgggcaacagaggagagcccatatgctcccttccaacctggcggcagcgcaaaagatg

SEQ ID NO: 218255 - DNA, 103 bp, Artificial Sequence
  Synthetic Polynucleotide
taatacgactcactatagggagggtgccggaagccaccgggaggaagggaaacagaggagatcccttatgcccggtggcaacctggcggcagcgcaaaagatg

SEQ ID NO: 218256 - DNA, 103 bp, Artificial Sequence
  Synthetic Polynucleotide
taatacgactcactatagggccccgaggtcgtcccctccgccggccgcccaacagaggagagggcggatggcggaggggaacctggcggcagcgcaaaagatg

SEQ ID NO: 218257 - DNA, 103 bp, Artificial Sequence
  Synthetic Polynucleotide
taatacgactcactataggggggcggggtaagggtgccggaagccaccggaacagaggagaccggtgatgtccggcaccaacctggcggcagcgcaaaagatg

SEQ ID NO: 218258 - DNA, 103 bp, Artificial Sequence
  Synthetic Polynucleotide
taatacgactcactatagggttcatggcgagggcggggtaagggtgccggaacagaggagaccggcaatgttaccccgcaacctggcggcagcgcaaaagatg

SEQ ID NO: 218259 - DNA, 103 bp, Artificial Sequence
  Synthetic Polynucleotide
taatacgactcactatagggcatcgaggcgttcatggcgagggcggggtaaacagaggagataccccatgctcgccatgaacctggcggcagcgcaaaagatg

SEQ ID NO: 218260 - DNA, 103 bp, Artificial Sequence
  Synthetic Polynucleotide
taatacgactcactatagggccaggctggacatcgaggcgttcatggcgaaacagaggagatcgccaatgacgcctcgaaacctggcggcagcgcaaaagatg

SEQ ID NO: 218261 - DNA, 103 bp, Artificial Sequence
  Synthetic Polynucleotide
taatacgactcactatagggcgactggagaccaggctggacatcgaggcgaacagaggagacgcctcatggtccagcctaacctggcggcagcgcaaaagatg

SEQ ID NO: 218262 - DNA, 103 bp, Artificial Sequence
  Synthetic Polynucleotide
taatacgactcactatagggaggagagaaccgactggagaccaggctggaaacagaggagatccagcatggtctccagtaacctggcggcagcgcaaaagatg

SEQ ID NO: 218263 - DNA, 103 bp, Artificial Sequence
  Synthetic Polynucleotide
taatacgactcactatagggccaccatgtgaggagagaaccgactggagaaacagaggagatctccaatgggttctctcaacctggcggcagcgcaaaagatg

SEQ ID NO: 218264 - DNA, 103 bp, Artificial Sequence
  Synthetic Polynucleotide
taatacgactcactatagggtgggcaggagccaccatgtgaggagagaacaacagaggagagttctcatgtcacatggtaacctggcggcagcgcaaaagatg

SEQ ID NO: 218265 - DNA, 103 bp, Artificial Sequence
  Synthetic Polynucleotide
taatacgactcactatagggcaggccagggtgggcaggagccaccatgtgaacagaggagacacatgatggctcctgccaacctggcggcagcgcaaaagatg

SEQ ID NO: 218266 - DNA, 103 bp, Artificial Sequence
  Synthetic Polynucleotide
taatacgactcactatagggctgaggtgggcaggccagggtgggcaggagaacagaggagactcctgatgaccctggccaacctggcggcagcgcaaaagatg

SEQ ID NO: 218267 - DNA, 103 bp, Artificial Sequence
  Synthetic Polynucleotide
taatacgactcactatagggtcgtcgttcgccccgaggtcgtcccctccgaacagaggagacggaggatgcgacctcggaacctggcggcagcgcaaaagatg

SEQ ID NO: 218268 - DNA, 103 bp, Artificial Sequence
  Synthetic Polynucleotide
taatacgactcactatagggtgggggatccctgaggtgggcaggccagggaacagaggagaccctggatggcccacctcaacctggcggcagcgcaaaagatg

SEQ ID NO: 218269 - DNA, 103 bp, Artificial Sequence
  Synthetic Polynucleotide
taatacgactcactataggggatggcagggtgggggatccctgaggtgggaacagaggagacccaccatggggatccccaacctggcggcagcgcaaaagatg

SEQ ID NO: 218270 - DNA, 103 bp, Artificial Sequence
  Synthetic Polynucleotide
taatacgactcactatagggtgggggagacgatggcagggtgggggatccaacagaggagaggatccatgaccctgccaaacctggcggcagcgcaaaagatg

SEQ ID NO: 218271 - DNA, 103 bp, Artificial Sequence
  Synthetic Polynucleotide
taatacgactcactatagggtgcttgacgatgggggagacgatggcagggaacagaggagaccctgcatgcgtctccccaacctggcggcagcgcaaaagatg

SEQ ID NO: 218272 - DNA, 103 bp, Artificial Sequence
  Synthetic Polynucleotide
taatacgactcactatagggtgccggttcctgcttgacgatgggggagacaacagaggagagtctccatgatcgtcaagaacctggcggcagcgcaaaagatg

SEQ ID NO: 218273 - DNA, 103 bp, Artificial Sequence
  Synthetic Polynucleotide
taatacgactcactatagggggctggggggtgccggttcctgcttgacgaaacagaggagatcgtcaatgaggaaccggaacctggcggcagcgcaaaagatg

SEQ ID NO: 218274 - DNA, 103 bp, Artificial Sequence
  Synthetic Polynucleotide
taatacgactcactataggggcagggctcaggctggggggtgccggttccaacagaggagaggaaccatgaccccccagaacctggcggcagcgcaaaagatg

SEQ ID NO: 218275 - DNA, 103 bp, Artificial Sequence
  Synthetic Polynucleotide
taatacgactcactatagggcacgctcactgcagggctcaggctggggggaacagaggagaccccccatgctgagccctaacctggcggcagcgcaaaagatg

SEQ ID NO: 218276 - DNA, 103 bp, Artificial Sequence
  Synthetic Polynucleotide
taatacgactcactatagggctggtgatttcacgctcactgcagggctcaaacagaggagatgagccatgcagtgagcgaacctggcggcagcgcaaaagatg

SEQ ID NO: 218277 - DNA, 103 bp, Artificial Sequence
  Synthetic Polynucleotide
taatacgactcactatagggttcacggtgactggtgatttcacgctcactaacagaggagaagtgagatggaaatcaccaacctggcggcagcgcaaaagatg

SEQ ID NO: 218278 - DNA, 103 bp, Artificial Sequence
  Synthetic Polynucleotide
taatacgactcactatagggatcccctccaccgccgttcagctgcggcataacagaggagaatgccgatgctgaacggcaacctggcggcagcgcaaaagatg

SEQ ID NO: 218279 - DNA, 103 bp, Artificial Sequence
  Synthetic Polynucleotide
taatacgactcactatagggatccctctctgccgaggagttttcggagctaacagaggagaagctccatgaactcctcgaacctggcggcagcgcaaaagatg

SEQ ID NO: 218280 - DNA, 103 bp, Artificial Sequence
  Synthetic Polynucleotide
taatacgactcactatagggttccttcatatacaacatgaatgcattaagaacagaggagacttaatatgttcatgttgaacctggcggcagcgcaaaagatg

SEQ ID NO: 218281 - DNA, 103 bp, Artificial Sequence
  Synthetic Polynucleotide
taatacgactcactatagggttgctctcatttccttcatatacaacatgaaacagaggagatcatgtatgatatgaaggaacctggcggcagcgcaaaagatg

SEQ ID NO: 218282 - DNA, 103 bp, Artificial Sequence
  Synthetic Polynucleotide
taatacgactcactataggggctacgacctttgctctcatttccttcataaacagaggagatatgaaatgaatgagagcaacctggcggcagcgcaaaagatg

SEQ ID NO: 218283 - DNA, 103 bp, Artificial Sequence
  Synthetic Polynucleotide
taatacgactcactatagggcgtgcactcagctacgacctttgctctcataacagaggagaatgagaatgaaggtcgtaaacctggcggcagcgcaaaagatg

SEQ ID NO: 218284 - DNA, 103 bp, Artificial Sequence
  Synthetic Polynucleotide
taatacgactcactatagggtttctttcaacgtgcactcagctacgacctaacagaggagaaggtcgatgctgagtgcaaacctggcggcagcgcaaaagatg

SEQ ID NO: 218285 - DNA, 103 bp, Artificial Sequence
  Synthetic Polynucleotide
taatacgactcactatagggatggccgcgctttctttcaacgtgcactcaaacagaggagatgagtgatggttgaaagaaacctggcggcagcgcaaaagatg

SEQ ID NO: 218286 - DNA, 103 bp, Artificial Sequence
  Synthetic Polynucleotide
taatacgactcactataggggatctggttgatggccgcgctttctttcaaaacagaggagattgaaaatgagcgcggccaacctggcggcagcgcaaaagatg

SEQ ID NO: 218287 - DNA, 103 bp, Artificial Sequence
  Synthetic Polynucleotide
taatacgactcactatagggtccgcccaaggatctggttgatggccgcgcaacagaggagagcgcggatgtcaaccagaaacctggcggcagcgcaaaagatg

SEQ ID NO: 218288 - DNA, 103 bp, Artificial Sequence
  Synthetic Polynucleotide
taatacgactcactataggggcatgccacctccgcccaaggatctggttgaacagaggagacaaccaatgccttgggcgaacctggcggcagcgcaaaagatg

SEQ ID NO: 218289 - DNA, 103 bp, Artificial Sequence
  Synthetic Polynucleotide
taatacgactcactatagggtctggacagtgcatgccacctccgcccaagaacagaggagacttgggatgaggtggcataacctggcggcagcgcaaaagatg

SEQ ID NO: 218290 - DNA, 103 bp, Artificial Sequence
  Synthetic Polynucleotide
taatacgactcactatagggcatcagctaaatccctctctgccgaggagtaacagaggagaactcctatgcagagagggaacctggcggcagcgcaaaagatg

SEQ ID NO: 218291 - DNA, 103 bp, Artificial Sequence
  Synthetic Polynucleotide
taatacgactcactatagggcttgctcttctctggacagtgcatgccaccaacagaggagaggtggcatgcactgtccaaacctggcggcagcgcaaaagatg

SEQ ID NO: 218292 - DNA, 103 bp, Artificial Sequence
  Synthetic Polynucleotide
taatacgactcactatagggtagtatttcgcttgctcttctctggacagtaacagaggagaactgtcatgagaagagcaaacctggcggcagcgcaaaagatg

SEQ ID NO: 218293 - DNA, 103 bp, Artificial Sequence
  Synthetic Polynucleotide
taatacgactcactatagggggccagctcgtagtatttcgcttgctcttcaacagaggagagaagagatggcgaaatacaacctggcggcagcgcaaaagatg

SEQ ID NO: 218294 - DNA, 103 bp, Artificial Sequence
  Synthetic Polynucleotide
taatacgactcactataggggctccttccgggccagctcgtagtatttcgaacagaggagacgaaatatgacgagctggaacctggcggcagcgcaaaagatg

SEQ ID NO: 218295 - DNA, 103 bp, Artificial Sequence
  Synthetic Polynucleotide
taatacgactcactatagggtgaagctgtcgctccttccgggccagctcgaacagaggagacgagctatgccggaaggaaacctggcggcagcgcaaaagatg

SEQ ID NO: 218296 - DNA, 103 bp, Artificial Sequence
  Synthetic Polynucleotide
taatacgactcactatagggcagttgcatatgaagctgtcgctccttccgaacagaggagacggaagatgcgacagcttaacctggcggcagcgcaaaagatg

SEQ ID NO: 218297 - DNA, 103 bp, Artificial Sequence
  Synthetic Polynucleotide
taatacgactcactatagggagccggggtacagttgcatatgaagctgtcaacagaggagagacagcatgatatgcaacaacctggcggcagcgcaaaagatg

SEQ ID NO: 218298 - DNA, 103 bp, Artificial Sequence
  Synthetic Polynucleotide
taatacgactcactatagggcgcgcggaccagccggggtacagttgcataaacagaggagatatgcaatggtaccccggaacctggcggcagcgcaaaagatg

SEQ ID NO: 218299 - DNA, 103 bp, Artificial Sequence
  Synthetic Polynucleotide
taatacgactcactatagggatagttatcccgcgcggaccagccggggtaaacagaggagataccccatgtggtccgcgaacctggcggcagcgcaaaagatg

SEQ ID NO: 218300 - DNA, 103 bp, Artificial Sequence
  Synthetic Polynucleotide
taatacgactcactatagggtcttctttccatagttatcccgcgcggaccaacagaggagaggtccgatggggataactaacctggcggcagcgcaaaagatg

SEQ ID NO: 218301 - DNA, 103 bp, Artificial Sequence
  Synthetic Polynucleotide
taatacgactcactataggggacgatttgacatcagctaaatccctctctaacagaggagaagagagatgtttagctgaaacctggcggcagcgcaaaagatg

SEQ ID NO: 218302 - DNA, 103 bp, Artificial Sequence
  Synthetic Polynucleotide
taatacgactcactatagggttcctcttcttcttctttccatagttatccaacagaggagaggataaatgtggaaagaaaacctggcggcagcgcaaaagatg

SEQ ID NO: 218303 - DNA, 103 bp, Artificial Sequence
  Synthetic Polynucleotide
taatacgactcactatagggcttgtcccttttcctcttcttcttctttccaacagaggagaggaaagatgaagaagaggaacctggcggcagcgcaaaagatg

SEQ ID NO: 218304 - DNA, 103 bp, Artificial Sequence
  Synthetic Polynucleotide
taatacgactcactatagggctcccggctgcttgtcccttttcctcttctaacagaggagaagaagaatgaaagggacaaacctggcggcagcgcaaaagatg

SEQ ID NO: 218305 - DNA, 103 bp, Artificial Sequence
  Synthetic Polynucleotide
taatacgactcactatagggtcattggtctctcccggctgcttgtcccttaacagaggagaaagggaatggcagccgggaacctggcggcagcgcaaaagatg

SEQ ID NO: 218306 - DNA, 103 bp, Artificial Sequence
  Synthetic Polynucleotide
taatacgactcactatagggttcgctgtgttcattggtctctcccggctgaacagaggagacagccgatggagaccaataacctggcggcagcgcaaaagatg

SEQ ID NO: 218307 - DNA, 103 bp, Artificial Sequence
  Synthetic Polynucleotide
taatacgactcactatagggttaggaaacattcgctgtgttcattggtctaacagaggagaagaccaatgaacacagcgaacctggcggcagcgcaaaagatg

SEQ ID NO: 218308 - DNA, 103 bp, Artificial Sequence
  Synthetic Polynucleotide
taatacgactcactatagggaggcaaggatttaggaaacattcgctgtgtaacagaggagaacacagatgatgtttcctaacctggcggcagcgcaaaagatg

SEQ ID NO: 218309 - DNA, 103 bp, Artificial Sequence
  Synthetic Polynucleotide
taatacgactcactatagggaggaagtgaaaggcaaggatttaggaaacaaacagaggagatgtttcatgaatccttgcaacctggcggcagcgcaaaagatg

SEQ ID NO: 218310 - DNA, 103 bp, Artificial Sequence
  Synthetic Polynucleotide
taatacgactcactatagggctgtaatcggaggaagtgaaaggcaaggataacagaggagaatccttatgtttcacttcaacctggcggcagcgcaaaagatg

SEQ ID NO: 218311 - DNA, 103 bp, Artificial Sequence
  Synthetic Polynucleotide
taatacgactcactataggggcgctcaggtctgtaatcggaggaagtgaaaacagaggagattcactatgtccgattacaacctggcggcagcgcaaaagatg

SEQ ID NO: 218312 - DNA, 103 bp, Artificial Sequence
  Synthetic Polynucleotide
taatacgactcactatagggattgactagagacgatttgacatcagctaaaacagaggagattagctatggtcaaatcgaacctggcggcagcgcaaaagatg

SEQ ID NO: 218313 - DNA, 103 bp, Artificial Sequence
  Synthetic Polynucleotide
taatacgactcactatagggtttcttaggagcgctcaggtctgtaatcggaacagaggagaccgattatggacctgagcaacctggcggcagcgcaaaagatg

SEQ ID NO: 218314 - DNA, 103 bp, Artificial Sequence
  Synthetic Polynucleotide
taatacgactcactataggggcgctcggcatttcttaggagcgctcaggtaacagaggagaacctgaatgctcctaagaaacctggcggcagcgcaaaagatg

SEQ ID NO: 218315 - DNA, 103 bp, Artificial Sequence
  Synthetic Polynucleotide
taatacgactcactatagggaggccaaagcgcgctcggcatttcttaggaaacagaggagatcctaaatgatgccgagcaacctggcggcagcgcaaaagatg

SEQ ID NO: 218316 - DNA, 103 bp, Artificial Sequence
  Synthetic Polynucleotide
taatacgactcactatagggctgttgatcaaggccaaagcgcgctcggcaaacagaggagatgccgaatgcgctttggcaacctggcggcagcgcaaaagatg

SEQ ID NO: 218317 - DNA, 103 bp, Artificial Sequence
  Synthetic Polynucleotide
taatacgactcactatagggaccagttattctgttgatcaaggccaaagcaacagaggagagctttgatgttgatcaacaacctggcggcagcgcaaaagatg

SEQ ID NO: 218318 - DNA, 103 bp, Artificial Sequence
  Synthetic Polynucleotide
taatacgactcactatagggcaagggccgcaccagttattctgttgatcaaacagaggagatgatcaatggaataactgaacctggcggcagcgcaaaagatg

SEQ ID NO: 218319 - DNA, 103 bp, Artificial Sequence
  Synthetic Polynucleotide
taatacgactcactatagggtcaaagactgcaagggccgcaccagttattaacagaggagaaataacatgtgcggccctaacctggcggcagcgcaaaagatg

SEQ ID NO: 218320 - DNA, 103 bp, Artificial Sequence
  Synthetic Polynucleotide
taatacgactcactatagggtttctgattcattgactagagacgatttgaaacagaggagatcaaatatgctctagtcaaacctggcggcagcgcaaaagatg

SEQ ID NO: 218321 - DNA, 103 bp, Artificial Sequence
  Synthetic Polynucleotide
taatacgactcactatagggttttgattcgtttctgattcattgactagaaacagaggagatctagtatgtgaatcagaaacctggcggcagcgcaaaagatg

SEQ ID NO: 218322 - DNA, 103 bp, Artificial Sequence
  Synthetic Polynucleotide
taatacgactcactatagggggaggagctgttttgattcgtttctgattcaacagaggagagaatcaatgacgaatcaaaacctggcggcagcgcaaaagatg

SEQ ID NO: 218323 - DNA, 103 bp, Artificial Sequence
  Synthetic Polynucleotide
taatacgactcactatagggcctcggaatcggaggagctgttttgattcgaacagaggagacgaatcatgacagctcctaacctggcggcagcgcaaaagatg

SEQ ID NO: 218324 - DNA, 103 bp, Artificial Sequence
  Synthetic Polynucleotide
taatacgactcactatagggcgtctttccgcctcggaatcggaggagctgaacagaggagacagctcatgcgattccgaaacctggcggcagcgcaaaagatg

SEQ ID NO: 218325 - DNA, 103 bp, Artificial Sequence
  Synthetic Polynucleotide
taatacgactcactatagggaggcggaggccgtctttccgcctcggaatcaacagaggagagattccatggcggaaagaaacctggcggcagcgcaaaagatg

SEQ ID NO: 218326 - DNA, 103 bp, Artificial Sequence
  Synthetic Polynucleotide
taatacgactcactatagggcgcctaggtcatcccctccaccgccgttcaaacagaggagatgaacgatggtggaggggaacctggcggcagcgcaaaagatg

SEQ ID NO: 218327 - DNA, 103 bp, Artificial Sequence
  Synthetic Polynucleotide
taatacgactcactatagggtttcggagcgaggcggaggccgtctttccgaacagaggagacggaaaatgggcctccgcaacctggcggcagcgcaaaagatg

SEQ ID NO: 218328 - DNA, 103 bp, Artificial Sequence
  Synthetic Polynucleotide
taatacgactcactatagggtctcggaaactttcggagcgaggcggaggcaacagaggagagcctccatgtcgctccgaaacctggcggcagcgcaaaagatg

SEQ ID NO: 218329 - DNA, 103 bp, Artificial Sequence
  Synthetic Polynucleotide
taatacgactcactatagggccgggatttgtctcggaaactttcggagcgaacagaggagacgctccatgagtttccgaaacctggcggcagcgcaaaagatg

SEQ ID NO: 218330 - DNA, 103 bp, Artificial Sequence
  Synthetic Polynucleotide
taatacgactcactatagggccaaactttcccgggatttgtctcggaaacaacagaggagagtttccatgacaaatcccaacctggcggcagcgcaaaagatg

SEQ ID NO: 218331 - DNA, 103 bp, Artificial Sequence
  Synthetic Polynucleotide
taatacgactcactataggggccgcttcttccaaactttcccgggatttgaacagaggagacaaatcatgggaaagtttaacctggcggcagcgcaaaagatg

SEQ ID NO: 218332 - DNA, 103 bp, Artificial Sequence
  Synthetic Polynucleotide
taatacgactcactatagggttgcctcttggccgcttcttccaaactttcaacagaggagagaaagtatggaagaagcgaacctggcggcagcgcaaaagatg

SEQ ID NO: 218333 - DNA, 103 bp, Artificial Sequence
  Synthetic Polynucleotide
taatacgactcactataggggccctccatcttgcctcttggccgcttcttaacagaggagaaagaagatgccaagaggcaacctggcggcagcgcaaaagatg

SEQ ID NO: 218334 - DNA, 103 bp, Artificial Sequence
  Synthetic Polynucleotide
taatacgactcactatagggcccttaaagagccctccatcttgcctcttgaacagaggagacaagagatgagatggaggaacctggcggcagcgcaaaagatg

SEQ ID NO: 218335 - DNA, 103 bp, Artificial Sequence
  Synthetic Polynucleotide
taatacgactcactatagggatacggtggccccttaaagagccctccatcaacagaggagagatggaatgctctttaagaacctggcggcagcgcaaaagatg

SEQ ID NO: 218336 - DNA, 103 bp, Artificial Sequence
  Synthetic Polynucleotide
taatacgactcactatagggggtagccgggatacggtggccccttaaagaaacagaggagatctttaatgggccaccgtaacctggcggcagcgcaaaagatg

SEQ ID NO: 218337 - DNA, 103 bp, Artificial Sequence
  Synthetic Polynucleotide
taatacgactcactatagggtcgtcgttggcgcctaggtcatcccctccaaacagaggagatggaggatgtgacctaggaacctggcggcagcgcaaaagatg

SEQ ID NO: 218338 - DNA, 103 bp, Artificial Sequence
  Synthetic Polynucleotide
taatacgactcactatagggatgatgaaggggtagccgggatacggtggcaacagaggagagccaccatgtcccggctaaacctggcggcagcgcaaaagatg

SEQ ID NO: 218339 - DNA, 103 bp, Artificial Sequence
  Synthetic Polynucleotide
taatacgactcactataggggtcggggatcatgatgaaggggtagccgggaacagaggagacccggcatgcccttcatcaacctggcggcagcgcaaaagatg

SEQ ID NO: 218340 - DNA, 103 bp, Artificial Sequence
  Synthetic Polynucleotide
taatacgactcactatagggggctcgtcaggtcggggatcatgatgaaggaacagaggagaccttcaatgtgatccccgaacctggcggcagcgcaaaagatg

SEQ ID NO: 218341 - DNA, 103 bp, Artificial Sequence
  Synthetic Polynucleotide
taatacgactcactataggggggaggtaggggctcgtcaggtcggggatcaacagaggagagatcccatgcctgacgagaacctggcggcagcgcaaaagatg

SEQ ID NO: 218342 - DNA, 103 bp, Artificial Sequence
  Synthetic Polynucleotide
taatacgactcactatagggcgatccgttggggaggtaggggctcgtcagaacagaggagactgacgatgccctacctcaacctggcggcagcgcaaaagatg

SEQ ID NO: 218343 - DNA, 103 bp, Artificial Sequence
  Synthetic Polynucleotide
taatacgactcactatagggtgggcgagagcgatccgttggggaggtaggaacagaggagacctaccatgccaacggataacctggcggcagcgcaaaagatg

SEQ ID NO: 218344 - DNA, 103 bp, Artificial Sequence
  Synthetic Polynucleotide
taatacgactcactataggggttcgggcggtgggcgagagcgatccgttgaacagaggagacaacggatggctctcgccaacctggcggcagcgcaaaagatg

SEQ ID NO: 218345 - DNA, 103 bp, Artificial Sequence
  Synthetic Polynucleotide
taatacgactcactatagggctggagataggttcgggcggtgggcgagagaacagaggagactctcgatgaccgcccgaaacctggcggcagcgcaaaagatg

SEQ ID NO: 218346 - DNA, 103 bp, Artificial Sequence
  Synthetic Polynucleotide
taatacgactcactataggggccatttcatctggagataggttcgggcggaacagaggagaccgcccatgcctatctccaacctggcggcagcgcaaaagatg

SEQ ID NO: 218347 - DNA, 103 bp, Artificial Sequence
  Synthetic Polynucleotide
taatacgactcactatagggtcaagcagtggccatttcatctggagatagaacagaggagactatctatggatgaaatgaacctggcggcagcgcaaaagatg

SEQ ID NO: 218348 - DNA, 103 bp, Artificial Sequence
  Synthetic Polynucleotide
taatacgactcactatagggggaaatcagttcgtcgttggcgcctaggtcaacagaggagagacctaatggccaacgacaacctggcggcagcgcaaaagatg

SEQ ID NO: 218349 - DNA, 103 bp, Artificial Sequence
  Synthetic Polynucleotide
taatacgactcactatagggtgcctggacatcaagcagtggccatttcataacagaggagaatgaaaatgccactgcttaacctggcggcagcgcaaaagatg

SEQ ID NO: 218350 - DNA, 103 bp, Artificial Sequence
  Synthetic Polynucleotide
taatacgactcactatagggggaggctccctgcctggacatcaagcagtgaacagaggagacactgcatgatgtccaggaacctggcggcagcgcaaaagatg

SEQ ID NO: 218351 - DNA, 103 bp, Artificial Sequence
  Synthetic Polynucleotide
taatacgactcactatagggtgtctactctggaggctccctgcctggacaaacagaggagatgtccaatgagggagcctaacctggcggcagcgcaaaagatg

SEQ ID NO: 218352 - DNA, 103 bp, Artificial Sequence
  Synthetic Polynucleotide
taatacgactcactatagggcttgagggcttgtctactctggaggctcccaacagaggagagggagcatgcagagtagaaacctggcggcagcgcaaaagatg

SEQ ID NO: 218353 - DNA, 103 bp, Artificial Sequence
  Synthetic Polynucleotide
taatacgactcactatagggaccgggcatccttgagggcttgtctactctaacagaggagaagagtaatgaagccctcaaacctggcggcagcgcaaaagatg

SEQ ID NO: 218354 - DNA, 103 bp, Artificial Sequence
  Synthetic Polynucleotide
taatacgactcactatagggggtgatggggaccgggcatccttgagggctaacagaggagaagccctatgggatgcccgaacctggcggcagcgcaaaagatg

SEQ ID NO: 218355 - DNA, 103 bp, Artificial Sequence
  Synthetic Polynucleotide
taatacgactcactatagggaatgtgtgccggtgatggggaccgggcatcaacagaggagagatgccatgtccccatcaaacctggcggcagcgcaaaagatg

SEQ ID NO: 218356 - DNA, 103 bp, Artificial Sequence
  Synthetic Polynucleotide
taatacgactcactatagggtgttagagacaatgtgtgccggtgatggggaacagaggagaccccatatgcggcacacaaacctggcggcagcgcaaaagatg

SEQ ID NO: 218357 - DNA, 103 bp, Artificial Sequence
  Synthetic Polynucleotide
taatacgactcactatagggactggcactttgttagagacaatgtgtgccaacagaggagaggcacaatgtgtctctaaaacctggcggcagcgcaaaagatg

SEQ ID NO: 218358 - DNA, 103 bp, Artificial Sequence
  Synthetic Polynucleotide
taatacgactcactataggggtgctgcaccactggcactttgttagagacaacagaggagagtctctatgaaagtgccaaacctggcggcagcgcaaaagatg

SEQ ID NO: 218359 - DNA, 103 bp, Artificial Sequence
  Synthetic Polynucleotide
taatacgactcactatagggcgtctttgaaggaaatcagttcgtcgttggaacagaggagaccaacgatgaactgatttaacctggcggcagcgcaaaagatg

SEQ ID NO: 218360 - DNA, 103 bp, Artificial Sequence
  Synthetic Polynucleotide
taatacgactcactatagggcatggtgagggtgctgcaccactggcacttaacagaggagaaagtgcatgtggtgcagcaacctggcggcagcgcaaaagatg

SEQ ID NO: 218361 - DNA, 103 bp, Artificial Sequence
  Synthetic Polynucleotide
taatacgactcactatagggagggggtggacatggtgagggtgctgcaccaacagaggagaggtgcaatgccctcaccaaacctggcggcagcgcaaaagatg

SEQ ID NO: 218362 - DNA, 103 bp, Artificial Sequence
  Synthetic Polynucleotide
taatacgactcactatagggaagaggcgtgagggggtggacatggtgaggaacagaggagacctcacatggtccaccccaacctggcggcagcgcaaaagatg

SEQ ID NO: 218363 - DNA, 103 bp, Artificial Sequence
  Synthetic Polynucleotide
taatacgactcactatagggtgtacgtgataagaggcgtgagggggtggaaacagaggagatccaccatgtcacgcctcaacctggcggcagcgcaaaagatg

SEQ ID NO: 218364 - DNA, 103 bp, Artificial Sequence
  Synthetic Polynucleotide
taatacgactcactatagggtgttcattgctgtacgtgataagaggcgtgaacagaggagacacgccatgtatcacgtaaacctggcggcagcgcaaaagatg

SEQ ID NO: 218365 - DNA, 103 bp, Artificial Sequence
  Synthetic Polynucleotide
taatacgactcactatagggcggcgtgaagtgttcattgctgtacgtgataacagaggagaatcacgatgagcaatgaaaacctggcggcagcgcaaaagatg

SEQ ID NO: 218366 - DNA, 103 bp, Artificial Sequence
  Synthetic Polynucleotide
taatacgactcactataggggtgggtttcccggcgtgaagtgttcattgcaacagaggagagcaatgatgacttcacgcaacctggcggcagcgcaaaagatg

SEQ ID NO: 218367 - DNA, 103 bp, Artificial Sequence
  Synthetic Polynucleotide
taatacgactcactatagggaagtgtggaggtgggtttcccggcgtgaagaacagaggagacttcacatggggaaacccaacctggcggcagcgcaaaagatg

SEQ ID NO: 218368 - DNA, 103 bp, Artificial Sequence
  Synthetic Polynucleotide
taatacgactcactataggggtcggctggtaagtgtggaggtgggtttccaacagaggagaggaaacatgcctccacacaacctggcggcagcgcaaaagatg

SEQ ID NO: 218369 - DNA, 103 bp, Artificial Sequence
  Synthetic Polynucleotide
taatacgactcactatagggtggggtctacgtcggctggtaagtgtggagaacagaggagactccacatgtaccagccgaacctggcggcagcgcaaaagatg

SEQ ID NO: 218370 - DNA, 103 bp, Artificial Sequence
  Synthetic Polynucleotide
taatacgactcactatagggtgttcgccctcgtctttgaaggaaatcagtaacagaggagaactgatatgcttcaaagaaacctggcggcagcgcaaaagatg

SEQ ID NO: 218371 - DNA, 103 bp, Artificial Sequence
  Synthetic Polynucleotide
taatacgactcactatagggattcctgttttggggtctacgtcggctggtaacagaggagaaccagcatgcgtagacccaacctggcggcagcgcaaaagatg

SEQ ID NO: 218372 - DNA, 103 bp, Artificial Sequence
  Synthetic Polynucleotide
taatacgactcactatagggaggccgtgggattcctgttttggggtctacaacagaggagagtagacatgaaaacaggaaacctggcggcagcgcaaaagatg

SEQ ID NO: 218373 - DNA, 103 bp, Artificial Sequence
  Synthetic Polynucleotide
taatacgactcactataggggagggtgcggaggccgtgggattcctgtttaacagaggagaaaacagatgtcccacggcaacctggcggcagcgcaaaagatg

SEQ ID NO: 218374 - DNA, 103 bp, Artificial Sequence
  Synthetic Polynucleotide
taatacgactcactataggggatatatctggagggtgcggaggccgtgggaacagaggagacccacgatgtccgcacccaacctggcggcagcgcaaaagatg

SEQ ID NO: 218375 - DNA, 103 bp, Artificial Sequence
  Synthetic Polynucleotide
taatacgactcactataggggtaatacggggatatatctggagggtgcggaacagaggagaccgcacatgccagatataaacctggcggcagcgcaaaagatg

SEQ ID NO: 218376 - DNA, 103 bp, Artificial Sequence
  Synthetic Polynucleotide
taatacgactcactataggggcgatagtgggtaatacggggatatatctgaacagaggagacagataatgccccgtattaacctggcggcagcgcaaaagatg

SEQ ID NO: 218377 - DNA, 103 bp, Artificial Sequence
  Synthetic Polynucleotide
taatacgactcactatagggacggtgccaggcgatagtgggtaatacgggaacagaggagacccgtaatgcccactatcaacctggcggcagcgcaaaagatg

SEQ ID NO: 218378 - DNA, 103 bp, Artificial Sequence
  Synthetic Polynucleotide
taatacgactcactataggggatttgtcctacggtgccaggcgatagtggaacagaggagaccactaatgcctggcaccaacctggcggcagcgcaaaagatg

SEQ ID NO: 218379 - DNA, 103 bp, Artificial Sequence
  Synthetic Polynucleotide
taatacgactcactataggggcggatgggggatttgtcctacggtgccagaacagaggagactggcaatgtaggacaaaaacctggcggcagcgcaaaagatg

SEQ ID NO: 218380 - DNA, 103 bp, Artificial Sequence
  Synthetic Polynucleotide
taatacgactcactatagggaaccatcctagcggatgggggatttgtcctaacagaggagaaggacaatgcccccatccaacctggcggcagcgcaaaagatg

SEQ ID NO: 218381 - DNA, 103 bp, Artificial Sequence
  Synthetic Polynucleotide
taatacgactcactatagggcttctcctcctgttcgccctcgtctttgaaaacagaggagattcaaaatggagggcgaaaacctggcggcagcgcaaaagatg

SEQ ID NO: 218382 - DNA, 103 bp, Artificial Sequence
  Synthetic Polynucleotide
taatacgactcactatagggctgtggtactaaccatcctagcggatggggaacagaggagaccccatatgctaggatggaacctggcggcagcgcaaaagatg

SEQ ID NO: 218383 - DNA, 103 bp, Artificial Sequence
  Synthetic Polynucleotide
taatacgactcactataggggttgaccttgctgtggtactaaccatcctaaacagaggagataggatatgtagtaccacaacctggcggcagcgcaaaagatg

SEQ ID NO: 218384 - DNA, 103 bp, Artificial Sequence
  Synthetic Polynucleotide
taatacgactcactataggggggtacactggttgaccttgctgtggtactaacagaggagaagtaccatggcaaggtcaaacctggcggcagcgcaaaagatg

SEQ ID NO: 218385 - DNA, 103 bp, Artificial Sequence
  Synthetic Polynucleotide
taatacgactcactatagggtgtcgtgattgggtacactggttgaccttgaacagaggagacaaggtatgccagtgtacaacctggcggcagcgcaaaagatg

SEQ ID NO: 218386 - DNA, 103 bp, Artificial Sequence
  Synthetic Polynucleotide
taatacgactcactatagggtgaatcctcctgtcgtgattgggtacactgaacagaggagacagtgtatgcaatcacgaaacctggcggcagcgcaaaagatg

SEQ ID NO: 218387 - DNA, 103 bp, Artificial Sequence
  Synthetic Polynucleotide
taatacgactcactatagggtaggggtgtctgaatcctcctgtcgtgattaacagaggagaaatcacatgaggaggattaacctggcggcagcgcaaaagatg

SEQ ID NO: 218388 - DNA, 103 bp, Artificial Sequence
  Synthetic Polynucleotide
taatacgactcactatagggagctgtggggtaggggtgtctgaatcctccaacagaggagaggaggaatgagacaccccaacctggcggcagcgcaaaagatg

SEQ ID NO: 218389 - DNA, 103 bp, Artificial Sequence
  Synthetic Polynucleotide
taatacgactcactatagggtgacggtcagagctgtggggtaggggtgtcaacagaggagagacaccatgaccccacagaacctggcggcagcgcaaaagatg

SEQ ID NO: 218390 - DNA, 103 bp, Artificial Sequence
  Synthetic Polynucleotide
taatacgactcactatagggatggaagcattgacggtcagagctgtggggaacagaggagaccccacatgtctgaccgtaacctggcggcagcgcaaaagatg

SEQ ID NO: 218391 - DNA, 103 bp, Artificial Sequence
  Synthetic Polynucleotide
taatacgactcactataggggaacctggacatggaagcattgacggtcagaacagaggagactgaccatgaatgcttccaacctggcggcagcgcaaaagatg

SEQ ID NO: 218392 - DNA, 103 bp, Artificial Sequence
  Synthetic Polynucleotide
taatacgactcactatagggtttcggagctcttctcctcctgttcgccctaacagaggagaagggcgatgaggaggagaaacctggcggcagcgcaaaagatg

SEQ ID NO: 218393 - DNA, 103 bp, Artificial Sequence
  Synthetic Polynucleotide
taatacgactcactatagggtatggggagggaacctggacatggaagcataacagaggagaatgcttatgtgtccaggtaacctggcggcagcgcaaaagatg

SEQ ID NO: 218394 - DNA, 103 bp, Artificial Sequence
  Synthetic Polynucleotide
taatacgactcactatagggggtgggaccatatggggagggaacctggacaacagaggagagtccagatgccctccccaaacctggcggcagcgcaaaagatg

SEQ ID NO: 218395 - DNA, 103 bp, Artificial Sequence
  Synthetic Polynucleotide
taatacgactcactatagggcgtatgatgtggtgggaccatatggggaggaacagaggagacctcccatgatggtcccaaacctggcggcagcgcaaaagatg

SEQ ID NO: 218396 - DNA, 103 bp, Artificial Sequence
  Synthetic Polynucleotide
taatacgactcactatagggtcgtgtgtagcgtatgatgtggtgggaccaaacagaggagatggtccatgcacatcataaacctggcggcagcgcaaaagatg

SEQ ID NO: 218397 - DNA, 103 bp, Artificial Sequence
  Synthetic Polynucleotide
taatacgactcactatagggggaatgcccgtcgtgtgtagcgtatgatgtaacagaggagaacatcaatggctacacacaacctggcggcagcgcaaaagatg

SEQ ID NO: 218398 - DNA, 103 bp, Artificial Sequence
  Synthetic Polynucleotide
taatacgactcactatagggggccggatgcggaatgcccgtcgtgtgtagaacagaggagactacacatgacgggcattaacctggcggcagcgcaaaagatg

SEQ ID NO: 218399 - DNA, 103 bp, Artificial Sequence
  Synthetic Polynucleotide
taatacgactcactataggggtgtgactatggccggatgcggaatgcccgaacagaggagacgggcaatgcgcatccggaacctggcggcagcgcaaaagatg

SEQ ID NO: 218400 - DNA, 103 bp, Artificial Sequence
  Synthetic Polynucleotide
taatacgactcactatagggttgactgttggtgtgactatggccggatgcaacagaggagagcatccatgcatagtcacaacctggcggcagcgcaaaagatg

SEQ ID NO: 218401 - DNA, 103 bp, Artificial Sequence
  Synthetic Polynucleotide
taatacgactcactatagggcgattcctgtttgactgttggtgtgactataacagaggagaatagtcatgccaacagtcaacctggcggcagcgcaaaagatg

SEQ ID NO: 218402 - DNA, 103 bp, Artificial Sequence
  Synthetic Polynucleotide
taatacgactcactatagggcactctgggacgattcctgtttgactgttgaacagaggagacaacagatgaacaggaataacctggcggcagcgcaaaagatg

SEQ ID NO: 218403 - DNA, 103 bp, Artificial Sequence
  Synthetic Polynucleotide
taatacgactcactataggggccgaggagttttcggagctcttctcctccaacagaggagaggaggaatggagctccgaaacctggcggcagcgcaaaagatg

SEQ ID NO: 218404 - DNA, 103 bp, Artificial Sequence
  Synthetic Polynucleotide
taatacgactcactataggggagccgacatcactctgggacgattcctgtaacagaggagaacaggaatggtcccagagaacctggcggcagcgcaaaagatg

SEQ ID NO: 218405 - DNA, 103 bp, Artificial Sequence
  Synthetic Polynucleotide
taatacgactcactatagggactatggagtgagccgacatcactctgggaaacagaggagatcccagatggatgtcggcaacctggcggcagcgcaaaagatg

SEQ ID NO: 218406 - DNA, 103 bp, Artificial Sequence
  Synthetic Polynucleotide
taatacgactcactataggggatgctttgaactatggagtgagccgacataacagaggagaatgtcgatgcactccataaacctggcggcagcgcaaaagatg

SEQ ID NO: 218407 - DNA, 103 bp, Artificial Sequence
  Synthetic Polynucleotide
taatacgactcactatagggttggagtcctgatgctttgaactatggagtaacagaggagaactccaatgttcaaagcaaacctggcggcagcgcaaaagatg

SEQ ID NO: 218408 - DNA, 103 bp, Artificial Sequence
  Synthetic Polynucleotide
taatacgactcactatagggttcttcctttttggagtcctgatgctttgaaacagaggagatcaaagatgcaggactccaacctggcggcagcgcaaaagatg

SEQ ID NO: 218409 - DNA, 103 bp, Artificial Sequence
  Synthetic Polynucleotide
taatacgactcactatagggtcttcttttcttcttcctttttggagtcctaacagaggagaaggactatgaaaaggaagaacctggcggcagcgcaaaagatg

SEQ ID NO: 218410 - DNA, 103 bp, Artificial Sequence
  Synthetic Polynucleotide
taatacgactcactatagggatgtggggcttcttcttttcttcttcctttaacagaggagaaaaggaatgagaaaagaaaacctggcggcagcgcaaaagatg

SEQ ID NO: 218411 - DNA, 103 bp, Artificial Sequence
  Synthetic Polynucleotide
taatacgactcactatagggaggtttctttatgtggggcttcttcttttcaacagaggagagaaaagatgaagccccacaacctggcggcagcgcaaaagatg

SEQ ID NO: 218412 - DNA, 103 bp, Artificial Sequence
  Synthetic Polynucleotide
taatacgactcactatagggatgcattaagaggtttctttatgtggggctaacagaggagaagccccatgtaaagaaacaacctggcggcagcgcaaaagatg

SEQ ID NO: 218413 - DNA, 103 bp, Artificial Sequence
  Synthetic Polynucleotide
taatacgactcactatagggtacaacatgaatgcattaagaggtttctttaacagaggagaaaagaaatgtcttaatgcaacctggcggcagcgcaaaagatg

SEQ ID NO: 218414 - DNA, 103 bp, Artificial Sequence
  Synthetic Polynucleotide
taatacgactcactatagggcggcggctcccgcggtccggggcccgacataacagaggagaatgtcgatgcccggaccgaacctggcggcagcgcaaaagatg

SEQ ID NO: 218415 - DNA, 103 bp, Artificial Sequence
  Synthetic Polynucleotide
taatacgactcactatagggcgtgaagctcagccccggctcgcccagcgcaacagaggagagcgctgatggagccggggaacctggcggcagcgcaaaagatg

SEQ ID NO: 218416 - DNA, 103 bp, Artificial Sequence
  Synthetic Polynucleotide
taatacgactcactatagggcagtgcttgtttgcatagcgctgcttctccaacagaggagaggagaaatggcgctatgcaacctggcggcagcgcaaaagatg

SEQ ID NO: 218417 - DNA, 103 bp, Artificial Sequence
  Synthetic Polynucleotide
taatacgactcactataggggattcctcttcagtgcttgtttgcatagcgaacagaggagacgctatatgaacaagcacaacctggcggcagcgcaaaagatg

SEQ ID NO: 218418 - DNA, 103 bp, Artificial Sequence
  Synthetic Polynucleotide
taatacgactcactatagggattctactccgattcctcttcagtgcttgtaacagaggagaacaagcatggaagaggaaaacctggcggcagcgcaaaagatg

SEQ ID NO: 218419 - DNA, 103 bp, Artificial Sequence
  Synthetic Polynucleotide
taatacgactcactatagggcaactgacgcattctactccgattcctcttaacagaggagaaagaggatgcggagtagaaacctggcggcagcgcaaaagatg

SEQ ID NO: 218420 - DNA, 103 bp, Artificial Sequence
  Synthetic Polynucleotide
taatacgactcactatagggcatttgtgtccaactgacgcattctactccaacagaggagaggagtaatgtgcgtcagtaacctggcggcagcgcaaaagatg

SEQ ID NO: 218421 - DNA, 103 bp, Artificial Sequence
  Synthetic Polynucleotide
taatacgactcactatagggcttcgctctacatttgtgtccaactgacgcaacagaggagagcgtcaatgggacacaaaaacctggcggcagcgcaaaagatg

SEQ ID NO: 218422 - DNA, 103 bp, Artificial Sequence
  Synthetic Polynucleotide
taatacgactcactatagggtccaagggctcttcgctctacatttgtgtcaacagaggagagacacaatggtagagcgaaacctggcggcagcgcaaaagatg

SEQ ID NO: 218423 - DNA, 103 bp, Artificial Sequence
  Synthetic Polynucleotide
taatacgactcactatagggtctgaatctctccaagggctcttcgctctaaacagaggagatagagcatggagcccttgaacctggcggcagcgcaaaagatg

SEQ ID NO: 218424 - DNA, 103 bp, Artificial Sequence
  Synthetic Polynucleotide
taatacgactcactatagggtcgcccacattctgaatctctccaagggctaacagaggagaagccctatgagagattcaaacctggcggcagcgcaaaagatg

SEQ ID NO: 218425 - DNA, 103 bp, Artificial Sequence
  Synthetic Polynucleotide
taatacgactcactatagggggtggcaccttcgcccacattctgaatctcaacagaggagagagattatgaatgtgggcaacctggcggcagcgcaaaagatg

SEQ ID NO: 218426 - DNA, 103 bp, Artificial Sequence
  Synthetic Polynucleotide
taatacgactcactatagggggtcggtggtcgtgaagctcagccccggctaacagaggagaagccggatgtgagcttcaaacctggcggcagcgcaaaagatg

SEQ ID NO: 218427 - DNA, 103 bp, Artificial Sequence
  Synthetic Polynucleotide
taatacgactcactatagggcttgtgtggcggtggcaccttcgcccacataacagaggagaatgtggatgaaggtgccaaacctggcggcagcgcaaaagatg

SEQ ID NO: 218428 - DNA, 103 bp, Artificial Sequence
  Synthetic Polynucleotide
taatacgactcactatagggtgccaagcgccttgtgtggcggtggcacctaacagaggagaaggtgcatgcgccacacaaacctggcggcagcgcaaaagatg

SEQ ID NO: 218429 - DNA, 103 bp, Artificial Sequence
  Synthetic Polynucleotide
taatacgactcactatagggctccgaggactgccaagcgccttgtgtggcaacagaggagagccacaatgggcgcttggaacctggcggcagcgcaaaagatg

SEQ ID NO: 218430 - DNA, 103 bp, Artificial Sequence
  Synthetic Polynucleotide
taatacgactcactatagggcctgtgaggactccgaggactgccaagcgcaacagaggagagcgcttatgagtcctcggaacctggcggcagcgcaaaagatg

SEQ ID NO: 218431 - DNA, 103 bp, Artificial Sequence
  Synthetic Polynucleotide
taatacgactcactatagggcccaggtttgcctgtgaggactccgaggacaacagaggagagtcctcatggtcctcacaaacctggcggcagcgcaaaagatg

SEQ ID NO: 218432 - DNA, 103 bp, Artificial Sequence
  Synthetic Polynucleotide
taatacgactcactatagggggcctgctcccccaggtttgcctgtgaggaaacagaggagatcctcaatggcaaacctgaacctggcggcagcgcaaaagatg

SEQ ID NO: 218433 - DNA, 103 bp, Artificial Sequence
  Synthetic Polynucleotide
taatacgactcactataggggcccactctgggcctgctcccccaggtttgaacagaggagacaaaccatggggagcaggaacctggcggcagcgcaaaagatg

SEQ ID NO: 218434 - DNA, 103 bp, Artificial Sequence
  Synthetic Polynucleotide
taatacgactcactatagggcctccctggggcccactctgggcctgctccaacagaggagaggagcaatgccagagtggaacctggcggcagcgcaaaagatg

SEQ ID NO: 218435 - DNA, 103 bp, Artificial Sequence
  Synthetic Polynucleotide
taatacgactcactatagggttgagaccttcctccctggggcccactctgaacagaggagacagagtatgccccagggaaacctggcggcagcgcaaaagatg

SEQ ID NO: 218436 - DNA, 103 bp, Artificial Sequence
  Synthetic Polynucleotide
taatacgactcactatagggtctccctacgttgagaccttcctccctgggaacagaggagacccaggatggaaggtctcaacctggcggcagcgcaaaagatg

SEQ ID NO: 218437 - DNA, 103 bp, Artificial Sequence
  Synthetic Polynucleotide
taatacgactcactatagggaccaggctcaggtcggtggtcgtgaagctcaacagaggagagagcttatggaccaccgaaacctggcggcagcgcaaaagatg

SEQ ID NO: 218438 - DNA, 103 bp, Artificial Sequence
  Synthetic Polynucleotide
taatacgactcactatagggcggttatgcctctccctacgttgagaccttaacagaggagaaaggtcatgacgtagggaaacctggcggcagcgcaaaagatg

SEQ ID NO: 218439 - DNA, 103 bp, Artificial Sequence
  Synthetic Polynucleotide
taatacgactcactatagggtctttccattcggttatgcctctccctacgaacagaggagacgtaggatgaggcataacaacctggcggcagcgcaaaagatg

SEQ ID NO: 218440 - DNA, 103 bp, Artificial Sequence
  Synthetic Polynucleotide
taatacgactcactataggggccttctatctctttccattcggttatgccaacagaggagaggcataatggaatggaaaaacctggcggcagcgcaaaagatg

SEQ ID NO: 218441 - DNA, 103 bp, Artificial Sequence
  Synthetic Polynucleotide
taatacgactcactatagggcggattctgcgccttctatctctttccattaacagaggagaaatggaatgagatagaagaacctggcggcagcgcaaaagatg

SEQ ID NO: 218442 - DNA, 103 bp, Artificial Sequence
  Synthetic Polynucleotide
taatacgactcactatagggacagcaaatgcggattctgcgccttctatcaacagaggagagatagaatgcgcagaatcaacctggcggcagcgcaaaagatg

SEQ ID NO: 218443 - DNA, 103 bp, Artificial Sequence
  Synthetic Polynucleotide
taatacgactcactatagggtcaactcatcacagcaaatgcggattctgcaacagaggagagcagaaatggcatttgctaacctggcggcagcgcaaaagatg

SEQ ID NO: 218444 - DNA, 103 bp, Artificial Sequence
  Synthetic Polynucleotide
taatacgactcactatagggactaagagattcaactcatcacagcaaatgaacagaggagacatttgatgtgatgagttaacctggcggcagcgcaaaagatg

SEQ ID NO: 218445 - DNA, 103 bp, Artificial Sequence
  Synthetic Polynucleotide
taatacgactcactataggggcagaacggcactaagagattcaactcatcaacagaggagagatgagatgaatctcttaaacctggcggcagcgcaaaagatg

SEQ ID NO: 218446 - DNA, 103 bp, Artificial Sequence
  Synthetic Polynucleotide
taatacgactcactatagggtctcggcattgcagaacggcactaagagataacagaggagaatctctatgtgccgttctaacctggcggcagcgcaaaagatg

SEQ ID NO: 218447 - DNA, 103 bp, Artificial Sequence
  Synthetic Polynucleotide
taatacgactcactataggggccttgtcagtctcggcattgcagaacggcaacagaggagagccgttatgcaatgccgaaacctggcggcagcgcaaaagatg

SEQ ID NO: 218448 - DNA, 103 bp, Artificial Sequence
  Synthetic Polynucleotide
taatacgactcactatagggcgtcatctccaccaggctcaggtcggtggtaacagaggagaaccaccatgctgagcctgaacctggcggcagcgcaaaagatg

SEQ ID NO: 218449 - DNA, 103 bp, Artificial Sequence
  Synthetic Polynucleotide
taatacgactcactatagggcagagttgtggccttgtcagtctcggcattaacagaggagaaatgccatgactgacaagaacctggcggcagcgcaaaagatg

SEQ ID NO: 218450 - DNA, 103 bp, Artificial Sequence
  Synthetic Polynucleotide
taatacgactcactatagggtggtccactgcagagttgtggccttgtcagaacagaggagactgacaatgccacaactcaacctggcggcagcgcaaaagatg

SEQ ID NO: 218451 - DNA, 103 bp, Artificial Sequence
  Synthetic Polynucleotide
taatacgactcactatagggaggaatgctgtggtccactgcagagttgtgaacagaggagacacaacatggcagtggacaacctggcggcagcgcaaaagatg

SEQ ID NO: 218452 - DNA, 103 bp, Artificial Sequence
  Synthetic Polynucleotide
taatacgactcactataggggatgtatttcaggaatgctgtggtccactgaacagaggagacagtggatgacagcattcaacctggcggcagcgcaaaagatg

SEQ ID NO: 218453 - DNA, 103 bp, Artificial Sequence
  Synthetic Polynucleotide
taatacgactcactataggggtctttcctggatgtatttcaggaatgctgaacagaggagacagcatatgtgaaatacaaacctggcggcagcgcaaaagatg

SEQ ID NO: 218454 - DNA, 103 bp, Artificial Sequence
  Synthetic Polynucleotide
taatacgactcactataggggaatctccatgtctttcctggatgtatttcaacagaggagagaaataatgccaggaaagaacctggcggcagcgcaaaagatg

SEQ ID NO: 218455 - DNA, 103 bp, Artificial Sequence
  Synthetic Polynucleotide
taatacgactcactatagggctttttaagagaatctccatgtctttcctgaacagaggagacaggaaatgcatggagataacctggcggcagcgcaaaagatg

SEQ ID NO: 218456 - DNA, 103 bp, Artificial Sequence
  Synthetic Polynucleotide
taatacgactcactatagggtctcaaattcctttttaagagaatctccataacagaggagaatggagatgctcttaaaaaacctggcggcagcgcaaaagatg

SEQ ID NO: 218457 - DNA, 103 bp, Artificial Sequence
  Synthetic Polynucleotide
taatacgactcactatagggcaaaatacgctctcaaattcctttttaagaaacagaggagatcttaaatgggaatttgaaacctggcggcagcgcaaaagatg

SEQ ID NO: 218458 - DNA, 103 bp, Artificial Sequence
  Synthetic Polynucleotide
taatacgactcactatagggagttttaccgcaaaatacgctctcaaattcaacagaggagagaatttatgagcgtatttaacctggcggcagcgcaaaagatg

SEQ ID NO: 218459 - DNA, 103 bp, Artificial Sequence
  Synthetic Polynucleotide
taatacgactcactatagggactccacctccgtcatctccaccaggctcaaacagaggagatgagccatgtggagatgaaacctggcggcagcgcaaaagatg

SEQ ID NO: 218460 - DNA, 103 bp, Artificial Sequence
  Synthetic Polynucleotide
taatacgactcactataggggccttcggccagttttaccgcaaaatacgcaacagaggagagcgtatatggcggtaaaaaacctggcggcagcgcaaaagatg

SEQ ID NO: 218461 - DNA, 103 bp, Artificial Sequence
  Synthetic Polynucleotide
taatacgactcactataggggtcagctttagccttcggccagttttaccgaacagaggagacggtaaatgtggccgaagaacctggcggcagcgcaaaagatg

SEQ ID NO: 218462 - DNA, 103 bp, Artificial Sequence
  Synthetic Polynucleotide
taatacgactcactataggggtccggtctggtcagctttagccttcggccaacagaggagaggccgaatgctaaagctgaacctggcggcagcgcaaaagatg

SEQ ID NO: 218463 - DNA, 103 bp, Artificial Sequence
  Synthetic Polynucleotide
taatacgactcactatagggtcaccaaggagtccggtctggtcagctttaaacagaggagataaagcatgccagaccggaacctggcggcagcgcaaaagatg

SEQ ID NO: 218464 - DNA, 103 bp, Artificial Sequence
  Synthetic Polynucleotide
taatacgactcactataggggcaggacaggtcaccaaggagtccggtctgaacagaggagacagaccatgctccttggtaacctggcggcagcgcaaaagatg

SEQ ID NO: 218465 - DNA, 103 bp, Artificial Sequence
  Synthetic Polynucleotide
taatacgactcactatagggactcccctgtgcaggacaggtcaccaaggaaacagaggagatccttgatgacctgtcctaacctggcggcagcgcaaaagatg

SEQ ID NO: 218466 - DNA, 103 bp, Artificial Sequence
  Synthetic Polynucleotide
taatacgactcactatagggtgctctgtaaactcccctgtgcaggacaggaacagaggagacctgtcatgcacaggggaaacctggcggcagcgcaaaagatg

SEQ ID NO: 218467 - DNA, 103 bp, Artificial Sequence
  Synthetic Polynucleotide
taatacgactcactatagggatcgaggggctgctctgtaaactcccctgtaacagaggagaacagggatgtttacagagaacctggcggcagcgcaaaagatg

SEQ ID NO: 218468 - DNA, 103 bp, Artificial Sequence
  Synthetic Polynucleotide
taatacgactcactatagggcttgatctccatcgaggggctgctctgtaaaacagaggagattacagatgagcccctcgaacctggcggcagcgcaaaagatg

SEQ ID NO: 218469 - DNA, 103 bp, Artificial Sequence
  Synthetic Polynucleotide
taatacgactcactatagggagctgcgtgtactccacctccgtcatctccaacagaggagaggagatatgggaggtggaaacctggcggcagcgcaaaagatg

SEQ ID NO: 218470 - DNA, 103 bp, Artificial Sequence
  Synthetic Polynucleotide
taatacgactcactataggggatgtgctgcagctgcgtgtactccacctcaacagaggagagaggtgatgtacacgcagaacctggcggcagcgcaaaagatg

SEQ ID NO: 218471 - DNA, 103 bp, Artificial Sequence
  Synthetic Polynucleotide
taatacgactcactataggggcgagcagaggatgtgctgcagctgcgtgtaacagaggagaacacgcatgtgcagcacaaacctggcggcagcgcaaaagatg

SEQ ID NO: 218472 - DNA, 103 bp, Artificial Sequence
  Synthetic Polynucleotide
taatacgactcactataggggcctccatgtgcgagcagaggatgtgctgcaacagaggagagcagcaatgcctctgctcaacctggcggcagcgcaaaagatg

SEQ ID NO: 218473 - DNA, 103 bp, Artificial Sequence
  Synthetic Polynucleotide
taatacgactcactataggggtcagccgccgcctccatgtgcgagcagagaacagaggagactctgcatgcacatggagaacctggcggcagcgcaaaagatg

SEQ ID NO: 218474 - DNA, 103 bp, Artificial Sequence
  Synthetic Polynucleotide
taatacgactcactatagggctgcctccggcggcggctcccgcggtccggaacagaggagaccggacatggggagccgcaacctggcggcagcgcaaaagatg

SEQ ID NO: 218475 - DNA, 103 bp, Artificial Sequence
  Synthetic Polynucleotide
taatacgactcactatagggcgagctcgccgtcagccgccgcctccatgtaacagaggagaacatggatgcggcggctgaacctggcggcagcgcaaaagatg

SEQ ID NO: 218476 - DNA, 103 bp, Artificial Sequence
  Synthetic Polynucleotide
taatacgactcactatagggaggcgcgtctcgagctcgccgtcagccgccaacagaggagaggcggcatgcggcgagctaacctggcggcagcgcaaaagatg

SEQ ID NO: 218477 - DNA, 103 bp, Artificial Sequence
  Synthetic Polynucleotide
taatacgactcactatagggcgccgagttgaggcgcgtctcgagctcgccaacagaggagaggcgagatggagacgcgcaacctggcggcagcgcaaaagatg

SEQ ID NO: 218478 - DNA, 103 bp, Artificial Sequence
  Synthetic Polynucleotide
taatacgactcactatagggccgccagcagcgccgagttgaggcgcgtctaacagaggagaagacgcatgtcaactcggaacctggcggcagcgcaaaagatg

SEQ ID NO: 218479 - DNA, 103 bp, Artificial Sequence
  Synthetic Polynucleotide
taatacgactcactataggggggcccgccgccgccagcagcgccgagttgaacagaggagacaactcatggctgctggcaacctggcggcagcgcaaaagatg

SEQ ID NO: 218480 - DNA, 103 bp, Artificial Sequence
  Synthetic Polynucleotide
taatacgactcactataggggcctgcgcccgggcccgccgccgccagcagaacagaggagactgctgatggcggcgggcaacctggcggcagcgcaaaagatg

SEQ ID NO: 218481 - DNA, 103 bp, Artificial Sequence
  Synthetic Polynucleotide
taatacgactcactatagggagccgcccgcgcctgcgcccgggcccgccgaacagaggagacggcggatgcgggcgcagaacctggcggcagcgcaaaagatg

SEQ ID NO: 218482 - DNA, 103 bp, Artificial Sequence
  Synthetic Polynucleotide
taatacgactcactatagggcccgccgcgaagccgcccgcgcctgcgcccaacagaggagagggcgcatgcgcgggcggaacctggcggcagcgcaaaagatg

SEQ ID NO: 218483 - DNA, 103 bp, Artificial Sequence
  Synthetic Polynucleotide
taatacgactcactatagggcccctgaccgcccgccgcgaagccgcccgcaacagaggagagcgggcatgttcgcggcgaacctggcggcagcgcaaaagatg

SEQ ID NO: 218484 - DNA, 103 bp, Artificial Sequence
  Synthetic Polynucleotide
taatacgactcactataggggcgccgcgcccccctgaccgcccgccgcgaaacagaggagatcgcggatggcggtcaggaacctggcggcagcgcaaaagatg

SEQ ID NO: 218485 - DNA, 103 bp, Artificial Sequence
  Synthetic Polynucleotide
taatacgactcactatagggcctgccgcgcctgcctccggcggcggctccaacagaggagaggagccatggccggaggcaacctggcggcagcgcaaaagatg

SEQ ID NO: 218486 - DNA, 103 bp, Artificial Sequence
  Synthetic Polynucleotide
taatacgactcactataggggggtacacgggcgccgcgcccccctgaccgaacagaggagacggtcaatggggcgcggcaacctggcggcagcgcaaaagatg

SEQ ID NO: 218487 - DNA, 103 bp, Artificial Sequence
  Synthetic Polynucleotide
taatacgactcactataggggcacagcacggggtacacgggcgccgcgccaacagaggagaggcgcgatgcccgtgtacaacctggcggcagcgcaaaagatg

SEQ ID NO: 218488 - DNA, 103 bp, Artificial Sequence
  Synthetic Polynucleotide
taatacgactcactataggggcgcggacgggcacagcacggggtacacggaacagaggagaccgtgtatgccgtgctgtaacctggcggcagcgcaaaagatg

SEQ ID NO: 218489 - DNA, 103 bp, Artificial Sequence
  Synthetic Polynucleotide
taatacgactcactatagggtcggccgccagcgcggacgggcacagcacgaacagaggagacgtgctatgcccgtccgcaacctggcggcagcgcaaaagatg

SEQ ID NO: 218490 - DNA, 103 bp, Artificial Sequence
  Synthetic Polynucleotide
taatacgactcactataggggcagggcgcgtcggccgccagcgcggacggaacagaggagaccgtccatgctggcggccaacctggcggcagcgcaaaagatg

SEQ ID NO: 218491 - DNA, 103 bp, Artificial Sequence
  Synthetic Polynucleotide
taatacgactcactatagggtgtggcccaggcagggcgcgtcggccgccaaacagaggagatggcggatgacgcgccctaacctggcggcagcgcaaaagatg

SEQ ID NO: 218492 - DNA, 103 bp, Artificial Sequence
  Synthetic Polynucleotide
taatacgactcactatagggtggaagtcgatgtggcccaggcagggcgcgaacagaggagacgcgccatgcctgggccaaacctggcggcagcgcaaaagatg

SEQ ID NO: 218493 - DNA, 103 bp, Artificial Sequence
  Synthetic Polynucleotide
taatacgactcactataggggcgcagctcctggaagtcgatgtggcccagaacagaggagactgggcatgatcgacttcaacctggcggcagcgcaaaagatg

SEQ ID NO: 218494 - DNA, 103 bp, Artificial Sequence
  Synthetic Polynucleotide
taatacgactcactataggggcagcatcatgcgcagctcctggaagtcgaaacagaggagatcgactatgaggagctgcaacctggcggcagcgcaaaagatg

SEQ ID NO: 218495 - DNA, 103 bp, Artificial Sequence
  Synthetic Polynucleotide
taatacgactcactataggggcctcgcttagcagcatcatgcgcagctccaacagaggagaggagctatgcatgatgctaacctggcggcagcgcaaaagatg

SEQ ID NO: 218496 - DNA, 103 bp, Artificial Sequence
  Synthetic Polynucleotide
taatacgactcactatagggcgcctcgccgcctgccgcgcctgcctccggaacagaggagaccggagatgggcgcggcaaacctggcggcagcgcaaaagatg

SEQ ID NO: 218497 - DNA, 103 bp, Artificial Sequence
  Synthetic Polynucleotide
taatacgactcactatagggcgccgcgcccgcctcgcttagcagcatcataacagaggagaatgatgatgctaagcgagaacctggcggcagcgcaaaagatg

SEQ ID NO: 218498 - DNA, 103 bp, Artificial Sequence
  Synthetic Polynucleotide
taatacgactcactatagggacgtcttctccgccgcgcccgcctcgcttaaacagaggagataagcgatgcgggcgcggaacctggcggcagcgcaaaagatg

SEQ ID NO: 218499 - DNA, 103 bp, Artificial Sequence
  Synthetic Polynucleotide
taatacgactcactatagggccgccgcccgacgtcttctccgccgcgcccaacagaggagagggcgcatgggagaagacaacctggcggcagcgcaaaagatg

SEQ ID NO: 218500 - DNA, 103 bp, Artificial Sequence
  Synthetic Polynucleotide
taatacgactcactatagggcgctccgtccccgccgcccgacgtcttctcaacagaggagagagaagatgtcgggcggcaacctggcggcagcgcaaaagatg

SEQ ID NO: 218501 - DNA, 103 bp, Artificial Sequence
  Synthetic Polynucleotide
taatacgactcactatagggcccgggccctcgctccgtccccgccgcccgaacagaggagacgggcgatggggacggagaacctggcggcagcgcaaaagatg

SEQ ID NO: 218502 - DNA, 103 bp, Artificial Sequence
  Synthetic Polynucleotide
taatacgactcactataggggcgccgtcggcccgggccctcgctccgtccaacagaggagaggacggatggagggcccgaacctggcggcagcgcaaaagatg

SEQ ID NO: 218503 - DNA, 103 bp, Artificial Sequence
  Synthetic Polynucleotide
taatacgactcactatagggctccttggcggcgccgtcggcccgggccctaacagaggagaagggccatggccgacggcaacctggcggcagcgcaaaagatg

SEQ ID NO: 218504 - DNA, 103 bp, Artificial Sequence
  Synthetic Polynucleotide
taatacgactcactatagggcgcccgcgccctccttggcggcgccgtcggaacagaggagaccgacgatgccgccaaggaacctggcggcagcgcaaaagatg

SEQ ID NO: 218505 - DNA, 103 bp, Artificial Sequence
  Synthetic Polynucleotide
taatacgactcactataggggccgcagccgcgcccgcgccctccttggcgaacagaggagacgccaaatggggcgcgggaacctggcggcagcgcaaaagatg

SEQ ID NO: 218506 - DNA, 103 bp, Artificial Sequence
  Synthetic Polynucleotide
taatacgactcactatagggtccagccgcagccgcagccgcgcccgcgccaacagaggagaggcgcgatggcggctgcgaacctggcggcagcgcaaaagatg

SEQ ID NO: 218507 - DNA, 103 bp, Artificial Sequence
  Synthetic Polynucleotide
taatacgactcactatagggcctcgacggccgcctcgccgcctgccgcgcaacagaggagagcgcggatggcggcgaggaacctggcggcagcgcaaaagatg

SEQ ID NO: 218508 - DNA, 103 bp, Artificial Sequence
  Synthetic Polynucleotide
taatacgactcactatagggcgccgtcgggtccagccgcagccgcagccgaacagaggagacggctgatgctgcggctgaacctggcggcagcgcaaaagatg

SEQ ID NO: 218509 - DNA, 103 bp, Artificial Sequence
  Synthetic Polynucleotide
taatacgactcactataggggcctcgggcgcgccgtcgggtccagccgcaaacagaggagatgcggcatgacccgacggaacctggcggcagcgcaaaagatg

SEQ ID NO: 218510 - DNA, 103 bp, Artificial Sequence
  Synthetic Polynucleotide
taatacgactcactatagggcttggcccgggcctcgggcgcgccgtcgggaacagaggagacccgacatggcgcccgagaacctggcggcagcgcaaaagatg

SEQ ID NO: 218511 - DNA, 103 bp, Artificial Sequence
  Synthetic Polynucleotide
taatacgactcactataggggcacggccggcttggcccgggcctcgggcgaacagaggagacgcccgatgcccgggccaaacctggcggcagcgcaaaagatg

SEQ ID NO: 218512 - DNA, 103 bp, Artificial Sequence
  Synthetic Polynucleotide
taatacgactcactatagggaggcggacgcgcacggccggcttggcccggaacagaggagaccgggcatggccggccgtaacctggcggcagcgcaaaagatg

SEQ ID NO: 218513 - DNA, 103 bp, Artificial Sequence
  Synthetic Polynucleotide
taatacgactcactataggggcggtcctccaggcggacgcgcacggccggaacagaggagaccggccatgcgcgtccgcaacctggcggcagcgcaaaagatg

SEQ ID NO: 218514 - DNA, 103 bp, Artificial Sequence
  Synthetic Polynucleotide
taatacgactcactatagggtgctgttgaagcggtcctccaggcggacgcaacagaggagagcgtccatgtggaggaccaacctggcggcagcgcaaaagatg

SEQ ID NO: 218515 - DNA, 103 bp, Artificial Sequence
  Synthetic Polynucleotide
taatacgactcactatagggtcggcggggatgctgttgaagcggtcctccaacagaggagaggaggaatgcttcaacagaacctggcggcagcgcaaaagatg

SEQ ID NO: 218516 - DNA, 103 bp, Artificial Sequence
  Synthetic Polynucleotide
taatacgactcactataggggggcggcggctcggcggggatgctgttgaaaacagaggagattcaacatgatccccgccaacctggcggcagcgcaaaagatg

SEQ ID NO: 218517 - DNA, 103 bp, Artificial Sequence
  Synthetic Polynucleotide
taatacgactcactatagggcgcgcggcgcgggcggcggctcggcggggaaacagaggagatccccgatgagccgccgcaacctggcggcagcgcaaaagatg

SEQ ID NO: 218518 - DNA, 103 bp, Artificial Sequence
  Synthetic Polynucleotide
taatacgactcactatagggccgcccgcgccctcgacggccgcctcgccgaacagaggagacggcgaatgggccgtcgaaacctggcggcagcgcaaaagatg

SEQ ID NO: 218519 - DNA, 103 bp, Artificial Sequence
  Synthetic Polynucleotide
taatacgactcactatagggggctcggggccgcgcggcgcgggcggcggcaacagaggagagccgccatgcgcgccgcgaacctggcggcagcgcaaaagatg

SEQ ID NO: 218520 - DNA, 103 bp, Artificial Sequence
  Synthetic Polynucleotide
taatacgactcactatagggcggctcggggggctcggggccgcgcggcgcaacagaggagagcgccgatgggccccgagaacctggcggcagcgcaaaagatg

SEQ ID NO: 218521 - DNA, 103 bp, Artificial Sequence
  Synthetic Polynucleotide
taatacgactcactataggggcgccccgcccggctcggggggctcggggcaacagaggagagccccgatgcccccgagcaacctggcggcagcgcaaaagatg

SEQ ID NO: 218522 - DNA, 103 bp, Artificial Sequence
  Synthetic Polynucleotide
taatacgactcactatagggaaattgttgagcgccccgcccggctcggggaacagaggagaccccgaatggggcggggcaacctggcggcagcgcaaaagatg

SEQ ID NO: 218523 - DNA, 103 bp, Artificial Sequence
  Synthetic Polynucleotide
taatacgactcactataggggagagttaccaaattgttgagcgccccgccaacagaggagaggcgggatgctcaacaataacctggcggcagcgcaaaagatg

SEQ ID NO: 218524 - DNA, 103 bp, Artificial Sequence
  Synthetic Polynucleotide
taatacgactcactataggggatgtcgaatgagagttaccaaattgttgaaacagaggagatcaacaatgtggtaactcaacctggcggcagcgcaaaagatg

SEQ ID NO: 218525 - DNA, 103 bp, Artificial Sequence
  Synthetic Polynucleotide
taatacgactcactatagggagttcagatggatgtcgaatgagagttaccaacagaggagaggtaacatgcattcgacaaacctggcggcagcgcaaaagatg

SEQ ID NO: 218526 - DNA, 103 bp, Artificial Sequence
  Synthetic Polynucleotide
taatacgactcactatagggaacattcattagttcagatggatgtcgaataacagaggagaattcgaatgccatctgaaaacctggcggcagcgcaaaagatg

SEQ ID NO: 218527 - DNA, 103 bp, Artificial Sequence
  Synthetic Polynucleotide
taatacgactcactataggggctgaagaggaacattcattagttcagatgaacagaggagacatctgatgtaatgaatgaacctggcggcagcgcaaaagatg

SEQ ID NO: 218528 - DNA, 103 bp, Artificial Sequence
  Synthetic Polynucleotide
taatacgactcactatagggttgttttgttgctgaagaggaacattcattaacagaggagaaatgaaatgtcctcttcaaacctggcggcagcgcaaaagatg

SEQ ID NO: 218529 - DNA, 103 bp, Artificial Sequence
  Synthetic Polynucleotide
taatacgactcactatagggcgcgtccccgccgcccgcgccctcgacggcaacagaggagagccgtcatgggcgcgggcaacctggcggcagcgcaaaagatg

SEQ ID NO: 218530 - DNA, 103 bp, Artificial Sequence
  Synthetic Polynucleotide
taatacgactcactatagggtgctgtacatttgttttgttgctgaagaggaacagaggagacctcttatgcaacaaaacaacctggcggcagcgcaaaagatg

SEQ ID NO: 218531 - DNA, 103 bp, Artificial Sequence
  Synthetic Polynucleotide
taatacgactcactatagggttttcactaatgctgtacatttgttttgttaacagaggagaaacaaaatgaatgtacagaacctggcggcagcgcaaaagatg

SEQ ID NO: 218532 - DNA, 103 bp, Artificial Sequence
  Synthetic Polynucleotide
taatacgactcactataggggcagttttatttttcactaatgctgtacataacagaggagaatgtacatgattagtgaaaacctggcggcagcgcaaaagatg

SEQ ID NO: 218533 - DNA, 103 bp, Artificial Sequence
  Synthetic Polynucleotide
taatacgactcactatagggagttgtagccgcagttttatttttcactaaaacagaggagattagtgatgaataaaactaacctggcggcagcgcaaaagatg

SEQ ID NO: 218534 - DNA, 103 bp, Artificial Sequence
  Synthetic Polynucleotide
taatacgactcactataggggcaaagcagtagttgtagccgcagttttataacagaggagaataaaaatgcggctacaaaacctggcggcagcgcaaaagatg

SEQ ID NO: 218535 - DNA, 103 bp, Artificial Sequence
  Synthetic Polynucleotide
taatacgactcactatagggtatgtaaattgcaaagcagtagttgtagccaacagaggagaggctacatgtactgctttaacctggcggcagcgcaaaagatg

SEQ ID NO: 218536 - DNA, 103 bp, Artificial Sequence
  Synthetic Polynucleotide
taatacgactcactatagggaaacagtgggtatgtaaattgcaaagcagtaacagaggagaactgctatgcaatttacaaacctggcggcagcgcaaaagatg

SEQ ID NO: 218537 - DNA, 103 bp, Artificial Sequence
  Synthetic Polynucleotide
taatacgactcactatagggcatttgtagtaaacagtgggtatgtaaattaacagaggagaaatttaatgacccactgtaacctggcggcagcgcaaaagatg

SEQ ID NO: 218538 - DNA, 103 bp, Artificial Sequence
  Synthetic Polynucleotide
taatacgactcactataggggtagagcaagcatttgtagtaaacagtgggaacagaggagacccactatgtactacaaaaacctggcggcagcgcaaaagatg

SEQ ID NO: 218539 - DNA, 103 bp, Artificial Sequence
  Synthetic Polynucleotide
taatacgactcactatagggatttccactagtagagcaagcatttgtagtaacagaggagaactacaatggcttgctctaacctggcggcagcgcaaaagatg

SEQ ID NO: 218540 - DNA, 103 bp, Artificial Sequence
  Synthetic Polynucleotide
taatacgactcactatagggcgcccagcgccgcgtccccgccgcccgcgcaacagaggagagcgcggatggcggggacgaacctggcggcagcgcaaaagatg

SEQ ID NO: 218541 - DNA, 103 bp, Artificial Sequence
  Synthetic Polynucleotide
taatacgactcactatagggaaagattagaatttccactagtagagcaagaacagaggagacttgctatgctagtggaaaacctggcggcagcgcaaaagatg

SEQ ID NO: 218542 - DNA, 103 bp, Artificial Sequence
  Synthetic Polynucleotide
taatacgactcactatagggtgtgtctgtgaaagattagaatttccactaaacagaggagatagtggatgttctaatctaacctggcggcagcgcaaaagatg

SEQ ID NO: 218543 - DNA, 103 bp, Artificial Sequence
  Synthetic Polynucleotide
taatacgactcactatagggactagaactctgtgtctgtgaaagattagaaacagaggagatctaatatgtcacagacaaacctggcggcagcgcaaaagatg

SEQ ID NO: 218544 - DNA, 103 bp, Artificial Sequence
  Synthetic Polynucleotide
taatacgactcactatagggaacatgagttactagaactctgtgtctgtgaacagaggagacacagaatgagagttctaaacctggcggcagcgcaaaagatg

SEQ ID NO: 218545 - DNA, 103 bp, Artificial Sequence
  Synthetic Polynucleotide
taatacgactcactatagggtcaagtacagaacatgagttactagaactcaacagaggagagagttcatgtaactcatgaacctggcggcagcgcaaaagatg

SEQ ID NO: 218546 - DNA, 103 bp, Artificial Sequence
  Synthetic Polynucleotide
taatacgactcactatagggcttggcagcttcaagtacagaacatgagttaacagaggagaaactcaatgtctgtacttaacctggcggcagcgcaaaagatg

SEQ ID NO: 218547 - DNA, 103 bp, Artificial Sequence
  Synthetic Polynucleotide
taatacgactcactatagggtatcctggtgcttggcagcttcaagtacagaacagaggagactgtacatgaagctgccaaacctggcggcagcgcaaaagatg

SEQ ID NO: 218548 - DNA, 103 bp, Artificial Sequence
  Synthetic Polynucleotide
taatacgactcactatagggggcaatccaatatcctggtgcttggcagctaacagaggagaagctgcatggcaccaggaaacctggcggcagcgcaaaagatg

SEQ ID NO: 218549 - DNA, 103 bp, Artificial Sequence
  Synthetic Polynucleotide
taatacgactcactatagggaaatgctctaggcaatccaatatcctggtgaacagaggagacaccagatgattggattgaacctggcggcagcgcaaaagatg

SEQ ID NO: 218550 - DNA, 103 bp, Artificial Sequence
  Synthetic Polynucleotide
taatacgactcactatagggaacagaaagaaaatgctctaggcaatccaaaacagaggagattggatatgctagagcataacctggcggcagcgcaaaagatg

SEQ ID NO: 218551 - DNA, 103 bp, Artificial Sequence
  Synthetic Polynucleotide
taatacgactcactatagggagccccggctcgcccagcgccgcgtccccgaacagaggagacggggaatgggcgctgggaacctggcggcagcgcaaaagatg

SEQ ID NO: 218552 - DNA, 103 bp, Artificial Sequence
  Synthetic Polynucleotide
taatacgactcactatagggtcttgctgataacagaaagaaaatgctctaaacagaggagatagagcatgttctttctgaacctggcggcagcgcaaaagatg

SEQ ID NO: 218553 - DNA, 103 bp, Artificial Sequence
  Synthetic Polynucleotide
taatacgactcactatagggggattcaatttcttgctgataacagaaagaaacagaggagatctttcatgtatcagcaaaacctggcggcagcgcaaaagatg

SEQ ID NO: 218554 - DNA, 103 bp, Artificial Sequence
  Synthetic Polynucleotide
taatacgactcactatagggtctgtttagtggattcaatttcttgctgataacagaggagaatcagcatgaaattgaataacctggcggcagcgcaaaagatg

SEQ ID NO: 218555 - DNA, 103 bp, Artificial Sequence
  Synthetic Polynucleotide
taatacgactcactatagggctacctaacgtctgtttagtggattcaattaacagaggagaaattgaatgcactaaacaaacctggcggcagcgcaaaagatg

SEQ ID NO: 218556 - DNA, 103 bp, Artificial Sequence
  Synthetic Polynucleotide
taatacgactcactatagggtttgtttctactacctaacgtctgtttagtaacagaggagaactaaaatgacgttaggtaacctggcggcagcgcaaaagatg

SEQ ID NO: 218557 - DNA, 103 bp, Artificial Sequence
  Synthetic Polynucleotide
taatacgactcactatagggcaggcaaaactttgtttctactacctaacgaacagaggagacgttagatggtagaaacaaacctggcggcagcgcaaaagatg

SEQ ID NO: 218558 - DNA, 103 bp, Artificial Sequence
  Synthetic Polynucleotide
taatacgactcactatagggcaaacttgctcaggcaaaactttgtttctaaacagaggagatagaaaatgagttttgccaacctggcggcagcgcaaaagatg

SEQ ID NO: 218559 - DNA, 103 bp, Artificial Sequence
  Synthetic Polynucleotide
taatacgactcactatagggcactttaatccaaacttgctcaggcaaaacaacagaggagagttttgatggagcaagttaacctggcggcagcgcaaaagatg

SEQ ID NO: 218560 - DNA, 103 bp, Artificial Sequence
  Synthetic Polynucleotide
taatacgactcactatagggctgcttctcccactttaatccaaacttgctaacagaggagaagcaagatgggattaaagaacctggcggcagcgcaaaagatg

SEQ ID NO: 218561 - DNA, 103 bp, Artificial Sequence
  Synthetic Polynucleotide
taatacgactcactatagggttgcatagcgctgcttctcccactttaatcaacagaggagagattaaatggggagaagcaacctggcggcagcgcaaaagatg

SEQ ID NO: 218562 - DNA, 103 bp, Artificial Sequence
  Synthetic Polynucleotide
taatacgactcactatagggcttatctgcagagtcactcatcctttccataacagaggagaatggaaatgatgagtgacaacctggcggcagcgcaaaagatg

SEQ ID NO: 218563 - DNA, 103 bp, Artificial Sequence
  Synthetic Polynucleotide
taatacgactcactatagggcctcccacatggtggatagatagccagggcaacagaggagagccctgatgatctatccaaacctggcggcagcgcaaaagatg

SEQ ID NO: 218564 - DNA, 103 bp, Artificial Sequence
  Synthetic Polynucleotide
taatacgactcactatagggaacttcaaacacacaggccatgcagagtagaacagaggagactactcatgatggcctgtaacctggcggcagcgcaaaagatg

SEQ ID NO: 218565 - DNA, 103 bp, Artificial Sequence
  Synthetic Polynucleotide
taatacgactcactatagggcactatttgaaacttcaaacacacaggccaaacagaggagatggcctatgtgtttgaagaacctggcggcagcgcaaaagatg

SEQ ID NO: 218566 - DNA, 103 bp, Artificial Sequence
  Synthetic Polynucleotide
taatacgactcactataggggctccgtgttcactatttgaaacttcaaacaacagaggagagtttgaatgttcaaatagaacctggcggcagcgcaaaagatg

SEQ ID NO: 218567 - DNA, 103 bp, Artificial Sequence
  Synthetic Polynucleotide
taatacgactcactatagggatgatgttgtgctccgtgttcactatttgaaacagaggagatcaaatatggaacacggaaacctggcggcagcgcaaaagatg

SEQ ID NO: 218568 - DNA, 103 bp, Artificial Sequence
  Synthetic Polynucleotide
taatacgactcactataggggcctgtaaatatgatgttgtgctccgtgttaacagaggagaaacacgatgcacaacatcaacctggcggcagcgcaaaagatg

SEQ ID NO: 218569 - DNA, 103 bp, Artificial Sequence
  Synthetic Polynucleotide
taatacgactcactatagggtcctttacaagcctgtaaatatgatgttgtaacagaggagaacaacaatgtatttacagaacctggcggcagcgcaaaagatg

SEQ ID NO: 218570 - DNA, 103 bp, Artificial Sequence
  Synthetic Polynucleotide
taatacgactcactatagggtgattttcctcctcccacatggtggatagaaacagaggagatctatcatgcatgtgggaaacctggcggcagcgcaaaagatg

SEQ ID NO: 218571 - DNA, 103 bp, Artificial Sequence
  Synthetic Polynucleotide
taatacgactcactatagggtctgataagatgattttcctcctcccacataacagaggagaatgtggatggaggaaaataacctggcggcagcgcaaaagatg

SEQ ID NO: 218572 - DNA, 103 bp, Artificial Sequence
  Synthetic Polynucleotide
taatacgactcactatagggtttgccttcgtctgataagatgattttcctaacagaggagaaggaaaatgatcttatcaaacctggcggcagcgcaaaagatg

SEQ ID NO: 218573 - DNA, 103 bp, Artificial Sequence
  Synthetic Polynucleotide
taatacgactcactatagggtaccatacattttgccttcgtctgataagaaacagaggagatcttatatgacgaaggcaaacctggcggcagcgcaaaagatg

SEQ ID NO: 218574 - DNA, 103 bp, Artificial Sequence
  Synthetic Polynucleotide
taatacgactcactatagggaattcattcctaccatacattttgccttcgaacagaggagacgaaggatgaatgtatggaacctggcggcagcgcaaaagatg

SEQ ID NO: 218575 - DNA, 103 bp, Artificial Sequence
  Synthetic Polynucleotide
taatacgactcactatagggtctggctatcaattcattcctaccatacataacagaggagaatgtatatgaggaatgaaaacctggcggcagcgcaaaagatg

SEQ ID NO: 218576 - DNA, 103 bp, Artificial Sequence
  Synthetic Polynucleotide
taatacgactcactataggggtttgatgtatctggctatcaattcattccaacagaggagaggaatgatgtgatagccaaacctggcggcagcgcaaaagatg

SEQ ID NO: 218577 - DNA, 103 bp, Artificial Sequence
  Synthetic Polynucleotide
taatacgactcactatagggcctgtcctgagtttgatgtatctggctatcaacagaggagagatagcatgatacatcaaaacctggcggcagcgcaaaagatg

SEQ ID NO: 218578 - DNA, 103 bp, Artificial Sequence
  Synthetic Polynucleotide
taatacgactcactatagggcctcgtcttgcctgtcctgagtttgatgtaaacagaggagatacatcatgctcaggacaaacctggcggcagcgcaaaagatg

SEQ ID NO: 218579 - DNA, 103 bp, Artificial Sequence
  Synthetic Polynucleotide
taatacgactcactatagggtgtcaattggcttatctgcagagtcactcaaacagaggagatgagtgatgctgcagataaacctggcggcagcgcaaaagatg

SEQ ID NO: 218580 - DNA, 103 bp, Artificial Sequence
  Synthetic Polynucleotide
taatacgactcactataggggttttctggtcctcgtcttgcctgtcctgaaacagaggagatcaggaatggcaagacgaaacctggcggcagcgcaaaagatg

SEQ ID NO: 218581 - DNA, 103 bp, Artificial Sequence
  Synthetic Polynucleotide
taatacgactcactatagggctagacacctgttttctggtcctcgtcttgaacagaggagacaagacatggaccagaaaaacctggcggcagcgcaaaagatg

SEQ ID NO: 218582 - DNA, 103 bp, Artificial Sequence
  Synthetic Polynucleotide
taatacgactcactatagggctgaatgtgactagacacctgttttctggtaacagaggagaaccagaatgcaggtgtctaacctggcggcagcgcaaaagatg

SEQ ID NO: 218583 - DNA, 103 bp, Artificial Sequence
  Synthetic Polynucleotide
taatacgactcactatagggtggcaagaacctgaatgtgactagacacctaacagaggagaaggtgtatggtcacattcaacctggcggcagcgcaaaagatg

SEQ ID NO: 218584 - DNA, 103 bp, Artificial Sequence
  Synthetic Polynucleotide
taatacgactcactataggggatttccttctggcaagaacctgaatgtgaaacagaggagatcacatatgggttcttgcaacctggcggcagcgcaaaagatg

SEQ ID NO: 218585 - DNA, 103 bp, Artificial Sequence
  Synthetic Polynucleotide
taatacgactcactatagggaaaatcacgagatttccttctggcaagaacaacagaggagagttcttatgagaaggaaaaacctggcggcagcgcaaaagatg

SEQ ID NO: 218586 - DNA, 103 bp, Artificial Sequence
  Synthetic Polynucleotide
taatacgactcactataggggcttggaatgaaaatcacgagatttccttcaacagaggagagaaggaatgctcgtgattaacctggcggcagcgcaaaagatg

SEQ ID NO: 218587 - DNA, 103 bp, Artificial Sequence
  Synthetic Polynucleotide
taatacgactcactataggggttacctttagcttggaatgaaaatcacgaaacagaggagatcgtgaatgtcattccaaaacctggcggcagcgcaaaagatg

SEQ ID NO: 218588 - DNA, 103 bp, Artificial Sequence
  Synthetic Polynucleotide
taatacgactcactatagggatccatgcttgttacctttagcttggaatgaacagaggagacattccatgctaaaggtaaacctggcggcagcgcaaaagatg

SEQ ID NO: 218589 - DNA, 103 bp, Artificial Sequence
  Synthetic Polynucleotide
taatacgactcactatagggttgcagtctgatccatgcttgttacctttaaacagaggagataaaggatgcaagcatggaacctggcggcagcgcaaaagatg

SEQ ID NO: 218590 - DNA, 103 bp, Artificial Sequence
  Synthetic Polynucleotide
taatacgactcactatagggtctgcatcattgtcaattggcttatctgcaaacagaggagatgcagaatggccaattgaaacctggcggcagcgcaaaagatg

SEQ ID NO: 218591 - DNA, 103 bp, Artificial Sequence
  Synthetic Polynucleotide
taatacgactcactataggggccttatcctttgcagtctgatccatgcttaacagaggagaaagcatatgtcagactgcaacctggcggcagcgcaaaagatg

SEQ ID NO: 218592 - DNA, 103 bp, Artificial Sequence
  Synthetic Polynucleotide
taatacgactcactataggggtgctgcagggccttatcctttgcagtctgaacagaggagacagactatgaaggataagaacctggcggcagcgcaaaagatg

SEQ ID NO: 218593 - DNA, 103 bp, Artificial Sequence
  Synthetic Polynucleotide
taatacgactcactatagggtggccgccatgtgctgcagggccttatcctaacagaggagaaggataatgccctgcagcaacctggcggcagcgcaaaagatg

SEQ ID NO: 218594 - DNA, 103 bp, Artificial Sequence
  Synthetic Polynucleotide
taatacgactcactataggggctgaggacatggccgccatgtgctgcaggaacagaggagacctgcaatgcatggcggcaacctggcggcagcgcaaaagatg

SEQ ID NO: 218595 - DNA, 103 bp, Artificial Sequence
  Synthetic Polynucleotide
taatacgactcactataggggacgatctgggctgaggacatggccgccataacagaggagaatggcgatgatgtcctcaaacctggcggcagcgcaaaagatg

SEQ ID NO: 218596 - DNA, 103 bp, Artificial Sequence
  Synthetic Polynucleotide
taatacgactcactatagggcagtggccgagacgatctgggctgaggacaaacagaggagatgtcctatgcccagatcgaacctggcggcagcgcaaaagatg

SEQ ID NO: 218597 - DNA, 103 bp, Artificial Sequence
  Synthetic Polynucleotide
taatacgactcactatagggttatgaatggcagtggccgagacgatctggaacagaggagaccagatatgctcggccacaacctggcggcagcgcaaaagatg

SEQ ID NO: 218598 - DNA, 103 bp, Artificial Sequence
  Synthetic Polynucleotide
taatacgactcactatagggccccagcttgttatgaatggcagtggccgaaacagaggagatcggccatggccattcataacctggcggcagcgcaaaagatg

SEQ ID NO: 218599 - DNA, 103 bp, Artificial Sequence
  Synthetic Polynucleotide
taatacgactcactatagggtcccaggcagccccagcttgttatgaatggaacagaggagaccattcatgacaagctggaacctggcggcagcgcaaaagatg

SEQ ID NO: 218600 - DNA, 103 bp, Artificial Sequence
  Synthetic Polynucleotide
taatacgactcactataggggggcgtggaatcccaggcagccccagcttgaacagaggagacaagctatggctgcctggaacctggcggcagcgcaaaagatg

SEQ ID NO: 218601 - DNA, 103 bp, Artificial Sequence
  Synthetic Polynucleotide
taatacgactcactatagggccagaccccttctgcatcattgtcaattggaacagaggagaccaattatgaatgatgcaaacctggcggcagcgcaaaagatg

SEQ ID NO: 218602 - DNA, 103 bp, Artificial Sequence
  Synthetic Polynucleotide
taatacgactcactatagggtgggaaggtcgggcgtggaatcccaggcagaacagaggagactgcctatgattccacgcaacctggcggcagcgcaaaagatg

SEQ ID NO: 218603 - DNA, 103 bp, Artificial Sequence
  Synthetic Polynucleotide
taatacgactcactatagggccggcgcccctgggaaggtcgggcgtggaaaacagaggagattccacatgcgaccttccaacctggcggcagcgcaaaagatg

SEQ ID NO: 218604 - DNA, 103 bp, Artificial Sequence
  Synthetic Polynucleotide
taatacgactcactatagggggccagaaccccggcgcccctgggaaggtcaacagaggagagaccttatgaggggcgccaacctggcggcagcgcaaaagatg

SEQ ID NO: 218605 - DNA, 103 bp, Artificial Sequence
  Synthetic Polynucleotide
taatacgactcactatagggaatcattcccggccagaaccccggcgccccaacagaggagaggggcgatggggttctggaacctggcggcagcgcaaaagatg

SEQ ID NO: 218606 - DNA, 103 bp, Artificial Sequence
  Synthetic Polynucleotide
taatacgactcactataggggccctgtttgaatcattcccggccagaaccaacagaggagaggttctatgcgggaatgaaacctggcggcagcgcaaaagatg

SEQ ID NO: 218607 - DNA, 103 bp, Artificial Sequence
  Synthetic Polynucleotide
taatacgactcactataggggatcctggctgccctgtttgaatcattcccaacagaggagagggaatatgtcaaacaggaacctggcggcagcgcaaaagatg

SEQ ID NO: 218608 - DNA, 103 bp, Artificial Sequence
  Synthetic Polynucleotide
taatacgactcactataggggtcttgtgaggatcctggctgccctgtttgaacagaggagacaaacaatgcagccaggaaacctggcggcagcgcaaaagatg

SEQ ID NO: 218609 - DNA, 103 bp, Artificial Sequence
  Synthetic Polynucleotide
taatacgactcactatagggaaggcttgacgtcttgtgaggatcctggctaacagaggagaagccagatgcctcacaagaacctggcggcagcgcaaaagatg

SEQ ID NO: 218610 - DNA, 103 bp, Artificial Sequence
  Synthetic Polynucleotide
taatacgactcactatagggtgctgcacaaaaggcttgacgtcttgtgagaacagaggagactcacaatgcgtcaagccaacctggcggcagcgcaaaagatg

SEQ ID NO: 218611 - DNA, 103 bp, Artificial Sequence
  Synthetic Polynucleotide
taatacgactcactatagggggggtaggcctgctgcacaaaaggcttgacaacagaggagagtcaagatgtttgtgcagaacctggcggcagcgcaaaagatg

SEQ ID NO: 218612 - DNA, 103 bp, Artificial Sequence
  Synthetic Polynucleotide
taatacgactcactatagggtgtcggggctccagaccccttctgcatcataacagaggagaatgatgatgaaggggtctaacctggcggcagcgcaaaagatg

SEQ ID NO: 218613 - DNA, 103 bp, Artificial Sequence
  Synthetic Polynucleotide
taatacgactcactatagggctggctggatggggtaggcctgctgcacaaaacagaggagattgtgcatgaggcctaccaacctggcggcagcgcaaaagatg

SEQ ID NO: 218614 - DNA, 103 bp, Artificial Sequence
  Synthetic Polynucleotide
taatacgactcactataggggctgtgaccgctggctggatggggtaggccaacagaggagaggcctaatgcatccagccaacctggcggcagcgcaaaagatg

SEQ ID NO: 218615 - DNA, 103 bp, Artificial Sequence
  Synthetic Polynucleotide
taatacgactcactatagggtggaatgggggctgtgaccgctggctggataacagaggagaatccagatggcggtcacaaacctggcggcagcgcaaaagatg

SEQ ID NO: 218616 - DNA, 103 bp, Artificial Sequence
  Synthetic Polynucleotide
taatacgactcactataggggctcaaaccctggaatgggggctgtgaccgaacagaggagacggtcaatgcccccattcaacctggcggcagcgcaaaagatg

SEQ ID NO: 218617 - DNA, 103 bp, Artificial Sequence
  Synthetic Polynucleotide
taatacgactcactataggggccgatgcaggctcaaaccctggaatggggaacagaggagaccccatatgagggtttgaaacctggcggcagcgcaaaagatg

SEQ ID NO: 218618 - DNA, 103 bp, Artificial Sequence
  Synthetic Polynucleotide
taatacgactcactataggggggagctggggccgatgcaggctcaaacccaacagaggagagggtttatgcctgcatcgaacctggcggcagcgcaaaagatg

SEQ ID NO: 218619 - DNA, 103 bp, Artificial Sequence
  Synthetic Polynucleotide
taatacgactcactatagggcagggactgagggagctggggccgatgcagaacagaggagactgcatatgccccagctcaacctggcggcagcgcaaaagatg

SEQ ID NO: 218620 - DNA, 103 bp, Artificial Sequence
  Synthetic Polynucleotide
taatacgactcactatagggccttgccaggcagggactgagggagctgggaacagaggagacccagcatgctcagtcccaacctggcggcagcgcaaaagatg

SEQ ID NO: 218621 - DNA, 103 bp, Artificial Sequence
  Synthetic Polynucleotide
taatacgactcactatagggaatggagcgaccttgccaggcagggactgaaacagaggagatcagtcatggcctggcaaaacctggcggcagcgcaaaagatg

SEQ ID NO: 218622 - DNA, 103 bp, Artificial Sequence
  Synthetic Polynucleotide
taatacgactcactatagggtggttgtgccaatggagcgaccttgccaggaacagaggagacctggcatggtcgctccaaacctggcggcagcgcaaaagatg

SEQ ID NO: 218623 - DNA, 103 bp, Artificial Sequence
  Synthetic Polynucleotide
taatacgactcactatagggctttgctcgatgtcggggctccagacccctaacagaggagaaggggtatggagccccgaaacctggcggcagcgcaaaagatg

SEQ ID NO: 218624 - DNA, 103 bp, Artificial Sequence
  Synthetic Polynucleotide
taatacgactcactatagggaggcgaagcttggttgtgccaatggagcgaaacagaggagatcgctcatgtggcacaacaacctggcggcagcgcaaaagatg

SEQ ID NO: 218625 - DNA, 103 bp, Artificial Sequence
  Synthetic Polynucleotide
taatacgactcactatagggaaattccaccaggcgaagcttggttgtgccaacagaggagaggcacaatgaagcttcgcaacctggcggcagcgcaaaagatg

SEQ ID NO: 218626 - DNA, 103 bp, Artificial Sequence
  Synthetic Polynucleotide
taatacgactcactataggggaaaagctgaaaattccaccaggcgaagctaacagaggagaagcttcatgtggtggaataacctggcggcagcgcaaaagatg

SEQ ID NO: 218627 - DNA, 103 bp, Artificial Sequence
  Synthetic Polynucleotide
taatacgactcactatagggtgctgctcgagaaaagctgaaaattccaccaacagaggagaggtggaatgttcagctttaacctggcggcagcgcaaaagatg

SEQ ID NO: 218628 - DNA, 103 bp, Artificial Sequence
  Synthetic Polynucleotide
taatacgactcactatagggtgggtctcgctgctgctcgagaaaagctgaaacagaggagatcagctatgctcgagcagaacctggcggcagcgcaaaagatg

SEQ ID NO: 218629 - DNA, 103 bp, Artificial Sequence
  Synthetic Polynucleotide
taatacgactcactatagggcagccgagtctgggtctcgctgctgctcgaaacagaggagatcgagcatgagcgagaccaacctggcggcagcgcaaaagatg

SEQ ID NO: 218630 - DNA, 103 bp, Artificial Sequence
  Synthetic Polynucleotide
taatacgactcactatagggcagtttaaatcagccgagtctgggtctcgcaacagaggagagcgagaatgagactcggcaacctggcggcagcgcaaaagatg

SEQ ID NO: 218631 - DNA, 103 bp, Artificial Sequence
  Synthetic Polynucleotide
taatacgactcactatagggttgaatattgcagtttaaatcagccgagtcaacagaggagagactcgatggatttaaacaacctggcggcagcgcaaaagatg

SEQ ID NO: 218632 - DNA, 103 bp, Artificial Sequence
  Synthetic Polynucleotide
taatacgactcactatagggcagcatcatcttgaatattgcagtttaaataacagaggagaatttaaatggcaatattcaacctggcggcagcgcaaaagatg

SEQ ID NO: 218633 - DNA, 103 bp, Artificial Sequence
  Synthetic Polynucleotide
taatacgactcactatagggtaaaaagccccagcatcatcttgaatattgaacagaggagacaatatatgagatgatgcaacctggcggcagcgcaaaagatg

SEQ ID NO: 218634 - DNA, 103 bp, Artificial Sequence
  Synthetic Polynucleotide
taatacgactcactatagggctcctgaaagctttgctcgatgtcggggctaacagaggagaagccccatgatcgagcaaaacctggcggcagcgcaaaagatg

SEQ ID NO: 218635 - DNA, 103 bp, Artificial Sequence
  Synthetic Polynucleotide
taatacgactcactatagggggttacaccataaaaagccccagcatcatcaacagaggagagatgatatgggggcttttaacctggcggcagcgcaaaagatg

SEQ ID NO: 218636 - DNA, 103 bp, Artificial Sequence
  Synthetic Polynucleotide
taatacgactcactatagggcgtactgactggttacaccataaaaagcccaacagaggagagggcttatgatggtgtaaaacctggcggcagcgcaaaagatg

SEQ ID NO: 218637 - DNA, 103 bp, Artificial Sequence
  Synthetic Polynucleotide
taatacgactcactatagggtcagaactctcgtactgactggttacaccaaacagaggagatggtgtatgcagtcagtaaacctggcggcagcgcaaaagatg

SEQ ID NO: 218638 - DNA, 103 bp, Artificial Sequence
  Synthetic Polynucleotide
taatacgactcactatagggtgtcatattttcagaactctcgtactgactaacagaggagaagtcagatggagagttctaacctggcggcagcgcaaaagatg

SEQ ID NO: 218639 - DNA, 103 bp, Artificial Sequence
  Synthetic Polynucleotide
taatacgactcactatagggaacaggtgactgtcatattttcagaactctaacagaggagaagagttatgaaaatatgaaacctggcggcagcgcaaaagatg

SEQ ID NO: 218640 - DNA, 103 bp, Artificial Sequence
  Synthetic Polynucleotide
taatacgactcactatagggactttggtggaacaggtgactgtcatatttaacagaggagaaaatatatgagtcacctgaacctggcggcagcgcaaaagatg

SEQ ID NO: 218641 - DNA, 103 bp, Artificial Sequence
  Synthetic Polynucleotide
taatacgactcactatagggaaaggagcaaactttggtggaacaggtgacaacagaggagagtcaccatgtccaccaaaaacctggcggcagcgcaaaagatg

SEQ ID NO: 218642 - DNA, 103 bp, Artificial Sequence
  Synthetic Polynucleotide
taatacgactcactatagggcttgcttcccaaaggagcaaactttggtggaacagaggagaccaccaatgtttgctcctaacctggcggcagcgcaaaagatg

SEQ ID NO: 218643 - DNA, 103 bp, Artificial Sequence
  Synthetic Polynucleotide
taatacgactcactatagggttttctactacttgcttcccaaaggagcaaaacagaggagattgctcatgtgggaagcaaacctggcggcagcgcaaaagatg

SEQ ID NO: 218644 - DNA, 103 bp, Artificial Sequence
  Synthetic Polynucleotide
taatacgactcactatagggcgtctctactttttctactacttgcttcccaacagaggagagggaagatggtagtagaaaacctggcggcagcgcaaaagatg

SEQ ID NO: 218645 - DNA, 103 bp, Artificial Sequence
  Synthetic Polynucleotide
taatacgactcactatagggtagccagggcctcctgaaagctttgctcgaaacagaggagatcgagcatggctttcaggaacctggcggcagcgcaaaagatg

SEQ ID NO: 218646 - DNA, 103 bp, Artificial Sequence
  Synthetic Polynucleotide
taatacgactcactatagggttgcatactccgtctctactttttctactaaacagaggagatagtagatgaagtagagaaacctggcggcagcgcaaaagatg

SEQ ID NO: 218647 - DNA, 103 bp, Artificial Sequence
  Synthetic Polynucleotide
taatacgactcactatagggttctcaaaccttgcatactccgtctctactaacagaggagaagtagaatgggagtatgcaacctggcggcagcgcaaaagatg

SEQ ID NO: 218648 - DNA, 103 bp, Artificial Sequence
  Synthetic Polynucleotide
taatacgactcactatagggaaatcggccattctcaaaccttgcatactcaacagaggagagagtatatgaggtttgagaacctggcggcagcgcaaaagatg

SEQ ID NO: 218649 - DNA, 103 bp, Artificial Sequence
  Synthetic Polynucleotide
taatacgactcactatagggttcggtatacaaatcggccattctcaaaccaacagaggagaggtttgatgatggccgataacctggcggcagcgcaaaagatg

SEQ ID NO: 218650 - DNA, 103 bp, Artificial Sequence
  Synthetic Polynucleotide
taatacgactcactataggggagcggtttattcggtatacaaatcggccaaacagaggagatggccgatgtgtataccgaacctggcggcagcgcaaaagatg

SEQ ID NO: 218651 - DNA, 103 bp, Artificial Sequence
  Synthetic Polynucleotide
taatacgactcactatagggacacattggggagcggtttattcggtatacaacagaggagagtatacatgataaaccgcaacctggcggcagcgcaaaagatg

SEQ ID NO: 218652 - DNA, 103 bp, Artificial Sequence
  Synthetic Polynucleotide
taatacgactcactatagggtcatatattcacacattggggagcggtttaaacagaggagataaaccatgccccaatgtaacctggcggcagcgcaaaagatg

SEQ ID NO: 218653 - DNA, 103 bp, Artificial Sequence
  Synthetic Polynucleotide
taatacgactcactatagggatgaagttgatcatatattcacacattgggaacagaggagacccaatatgtgaatatataacctggcggcagcgcaaaagatg

SEQ ID NO: 218654 - DNA, 103 bp, Artificial Sequence
  Synthetic Polynucleotide
taatacgactcactataggggagcttgtggatgaagttgatcatatattcaacagaggagagaatatatgatcaacttcaacctggcggcagcgcaaaagatg

SEQ ID NO: 218655 - DNA, 103 bp, Artificial Sequence
  Synthetic Polynucleotide
taatacgactcactataggggtaagtgtttgagcttgtggatgaagttgaaacagaggagatcaactatgtccacaagcaacctggcggcagcgcaaaagatg

SEQ ID NO: 218656 - DNA, 103 bp, Artificial Sequence
  Synthetic Polynucleotide
taatacgactcactatagggggtggatagatagccagggcctcctgaaagaacagaggagactttcaatgggccctggcaacctggcggcagcgcaaaagatg

SEQ ID NO: 218657 - DNA, 103 bp, Artificial Sequence
  Synthetic Polynucleotide
taatacgactcactatagggtatttctctggtaagtgtttgagcttgtggaacagaggagaccacaaatgcaaacacttaacctggcggcagcgcaaaagatg

SEQ ID NO: 218658 - DNA, 103 bp, Artificial Sequence
  Synthetic Polynucleotide
taatacgactcactataggggttcatcatatatttctctggtaagtgtttaacagaggagaaaacacatgccagagaaaaacctggcggcagcgcaaaagatg

SEQ ID NO: 218659 - DNA, 103 bp, Artificial Sequence
  Synthetic Polynucleotide
taatacgactcactatagggccaaaacactgttcatcatatatttctctgaacagaggagacagagaatgatatgatgaaacctggcggcagcgcaaaagatg

SEQ ID NO: 218660 - DNA, 103 bp, Artificial Sequence
  Synthetic Polynucleotide
taatacgactcactataggggtgaagttttccaaaacactgttcatcataaacagaggagatatgatatgcagtgttttaacctggcggcagcgcaaaagatg

SEQ ID NO: 218661 - DNA, 103 bp, Artificial Sequence
  Synthetic Polynucleotide
taatacgactcactatagggcaataaaattgtgaagttttccaaaacactaacagaggagaagtgttatggaaaacttcaacctggcggcagcgcaaaagatg

SEQ ID NO: 218662 - DNA, 103 bp, Artificial Sequence
  Synthetic Polynucleotide
taatacgactcactatagggttgttaccaccaataaaattgtgaagttttaacagaggagaaaaactatgcaattttataacctggcggcagcgcaaaagatg

SEQ ID NO: 218663 - DNA, 103 bp, Artificial Sequence
  Synthetic Polynucleotide
taatacgactcactataggggtatccctgtttgttaccaccaataaaattaacagaggagaaattttatgggtggtaacaacctggcggcagcgcaaaagatg

SEQ ID NO: 218664 - DNA, 103 bp, Artificial Sequence
  Synthetic Polynucleotide
taatacgactcactatagggagtttcttgtgtatccctgtttgttaccacaacagaggagagtggtaatgaacagggataacctggcggcagcgcaaaagatg

SEQ ID NO: 218665 - DNA, 103 bp, Artificial Sequence
  Synthetic Polynucleotide
taatacgactcactatagggtgcagagtagagtttcttgtgtatccctgtaacagaggagaacagggatgcacaagaaaaacctggcggcagcgcaaaagatg

SEQ ID NO: 218666 - DNA, 103 bp, Artificial Sequence
  Synthetic Polynucleotide
taatacgactcactatagggacacaggccatgcagagtagagtttcttgtaacagaggagaacaagaatgtctactctgaacctggcggcagcgcaaaagatg

SEQ ID NO: 218667 - DNA, 103 bp, Artificial Sequence
  Synthetic Polynucleotide
taatacgactcactatagggcagggcggccccagcccggggttcccccataacagaggagaatggggatgccccgggctaacctggcggcagcgcaaaagatg

SEQ ID NO: 218668 - DNA, 103 bp, Artificial Sequence
  Synthetic Polynucleotide
taatacgactcactatagggatccgggcccccgtcacccccagccccctcaacagaggagagaggggatggggggtgacaacctggcggcagcgcaaaagatg

SEQ ID NO: 218669 - DNA, 103 bp, Artificial Sequence
  Synthetic Polynucleotide
taatacgactcactatagggggtcatgtgttccaggctctcatactggctaacagaggagaagccagatggagagcctgaacctggcggcagcgcaaaagatg

SEQ ID NO: 218670 - DNA, 103 bp, Artificial Sequence
  Synthetic Polynucleotide
taatacgactcactatagggaacaggtgagggtcatgtgttccaggctctaacagaggagaagagccatgaacacatgaaacctggcggcagcgcaaaagatg

SEQ ID NO: 218671 - DNA, 103 bp, Artificial Sequence
  Synthetic Polynucleotide
taatacgactcactatagggaccttggaggaacaggtgagggtcatgtgtaacagaggagaacacatatgcctcacctgaacctggcggcagcgcaaaagatg

SEQ ID NO: 218672 - DNA, 103 bp, Artificial Sequence
  Synthetic Polynucleotide
taatacgactcactatagggaaaagagcagaccttggaggaacaggtgagaacagaggagactcaccatgtcctccaagaacctggcggcagcgcaaaagatg

SEQ ID NO: 218673 - DNA, 103 bp, Artificial Sequence
  Synthetic Polynucleotide
taatacgactcactatagggcctgcttgccaaaagagcagaccttggaggaacagaggagacctccaatgtctgctcttaacctggcggcagcgcaaaagatg

SEQ ID NO: 218674 - DNA, 103 bp, Artificial Sequence
  Synthetic Polynucleotide
taatacgactcactatagggttctccaccacctgcttgccaaaagagcagaacagaggagactgctcatgtggcaagcaaacctggcggcagcgcaaaagatg

SEQ ID NO: 218675 - DNA, 103 bp, Artificial Sequence
  Synthetic Polynucleotide
taatacgactcactatagggcgtctccaccttctccaccacctgcttgccaacagaggagaggcaagatggtggtggagaacctggcggcagcgcaaaagatg

SEQ ID NO: 218676 - DNA, 103 bp, Artificial Sequence
  Synthetic Polynucleotide
taatacgactcactataggggggcccgttccgtctccaccttctccaccaaacagaggagatggtggatgaggtggagaaacctggcggcagcgcaaaagatg

SEQ ID NO: 218677 - DNA, 103 bp, Artificial Sequence
  Synthetic Polynucleotide
taatacgactcactatagggtcctccagctgggcccgttccgtctccaccaacagaggagaggtggaatgggaacgggcaacctggcggcagcgcaaaagatg

SEQ ID NO: 218678 - DNA, 103 bp, Artificial Sequence
  Synthetic Polynucleotide
taatacgactcactatagggaaatctgccgtcctccagctgggcccgttcaacagaggagagaacggatgcagctggagaacctggcggcagcgcaaaagatg

SEQ ID NO: 218679 - DNA, 103 bp, Artificial Sequence
  Synthetic Polynucleotide
taatacgactcactatagggccccctctgcatccgggcccccgtcaccccaacagaggagaggggtgatgggggcccggaacctggcggcagcgcaaaagatg

SEQ ID NO: 218680 - DNA, 103 bp, Artificial Sequence
  Synthetic Polynucleotide
taatacgactcactatagggggcggtacacaaatctgccgtcctccagctaacagaggagaagctggatgacggcagataacctggcggcagcgcaaaagatg

SEQ ID NO: 218681 - DNA, 103 bp, Artificial Sequence
  Synthetic Polynucleotide
taatacgactcactataggggagcgcagcaggcggtacacaaatctgccgaacagaggagacggcagatgtgtgtaccgaacctggcggcagcgcaaaagatg

SEQ ID NO: 218682 - DNA, 103 bp, Artificial Sequence
  Synthetic Polynucleotide
taatacgactcactataggggcacatgggcgagcgcagcaggcggtacacaacagaggagagtgtacatgctgctgcgcaacctggcggcagcgcaaaagatg

SEQ ID NO: 218683 - DNA, 103 bp, Artificial Sequence
  Synthetic Polynucleotide
taatacgactcactatagggccaggtactcgcacatgggcgagcgcagcaaacagaggagatgctgcatgcgcccatgtaacctggcggcagcgcaaaagatg

SEQ ID NO: 218684 - DNA, 103 bp, Artificial Sequence
  Synthetic Polynucleotide
taatacgactcactatagggaagaaattcaccaggtactcgcacatgggcaacagaggagagcccatatgcgagtacctaacctggcggcagcgcaaaagatg

SEQ ID NO: 218685 - DNA, 103 bp, Artificial Sequence
  Synthetic Polynucleotide
taatacgactcactatagggcaacttgtgcaagaaattcaccaggtactcaacagaggagagagtacatggtgaatttcaacctggcggcagcgcaaaagatg

SEQ ID NO: 218686 - DNA, 103 bp, Artificial Sequence
  Synthetic Polynucleotide
taatacgactcactataggggcagctgccgcaacttgtgcaagaaattcaaacagaggagatgaattatgtgcacaagtaacctggcggcagcgcaaaagatg

SEQ ID NO: 218687 - DNA, 103 bp, Artificial Sequence
  Synthetic Polynucleotide
taatacgactcactatagggtatcgctcaggcagctgccgcaacttgtgcaacagaggagagcacaaatggcggcagctaacctggcggcagcgcaaaagatg

SEQ ID NO: 218688 - DNA, 103 bp, Artificial Sequence
  Synthetic Polynucleotide
taatacgactcactataggggttcatcatgtatcgctcaggcagctgccgaacagaggagacggcagatgcctgagcgaaacctggcggcagcgcaaaagatg

SEQ ID NO: 218689 - DNA, 103 bp, Artificial Sequence
  Synthetic Polynucleotide
taatacgactcactatagggccaggacgctgttcatcatgtatcgctcagaacagaggagactgagcatgacatgatgaaacctggcggcagcgcaaaagatg

SEQ ID NO: 218690 - DNA, 103 bp, Artificial Sequence
  Synthetic Polynucleotide
taatacgactcactataggggggctccacaccccctctgcatccgggcccaacagaggagagggcccatgtgcagagggaacctggcggcagcgcaaaagatg

SEQ ID NO: 218691 - DNA, 103 bp, Artificial Sequence
  Synthetic Polynucleotide
taatacgactcactataggggtgaagttttccaggacgctgttcatcatgaacagaggagacatgatatgcagcgtcctaacctggcggcagcgcaaaagatg

SEQ ID NO: 218692 - DNA, 103 bp, Artificial Sequence
  Synthetic Polynucleotide
taatacgactcactatagggctggaggatggtgaagttttccaggacgctaacagaggagaagcgtcatggaaaacttcaacctggcggcagcgcaaaagatg

SEQ ID NO: 218693 - DNA, 103 bp, Artificial Sequence
  Synthetic Polynucleotide
taatacgactcactatagggttgtcaccacctggaggatggtgaagttttaacagaggagaaaaactatgccatcctccaacctggcggcagcgcaaaagatg

SEQ ID NO: 218694 - DNA, 103 bp, Artificial Sequence
  Synthetic Polynucleotide
taatacgactcactataggggtgtctctgtttgtcaccacctggaggatgaacagaggagacatcctatgggtggtgacaacctggcggcagcgcaaaagatg

SEQ ID NO: 218695 - DNA, 103 bp, Artificial Sequence
  Synthetic Polynucleotide
taatacgactcactatagggcagttcctgggtgtctctgtttgtcaccacaacagaggagagtggtgatgaacagagacaacctggcggcagcgcaaaagatg

SEQ ID NO: 218696 - DNA, 103 bp, Artificial Sequence
  Synthetic Polynucleotide
taatacgactcactatagggtgcagagcagcagttcctgggtgtctctgtaacagaggagaacagagatgcccaggaacaacctggcggcagcgcaaaagatg

SEQ ID NO: 218697 - DNA, 103 bp, Artificial Sequence
  Synthetic Polynucleotide
taatacgactcactatagggacataggcggtgcagagcagcagttcctggaacagaggagaccaggaatggctgctctgaacctggcggcagcgcaaaagatg

SEQ ID NO: 218698 - DNA, 103 bp, Artificial Sequence
  Synthetic Polynucleotide
taatacgactcactataggggacctcgaagacataggcggtgcagagcagaacagaggagactgctcatgaccgcctataacctggcggcagcgcaaaagatg

SEQ ID NO: 218699 - DNA, 103 bp, Artificial Sequence
  Synthetic Polynucleotide
taatacgactcactatagggcgctggtggagacctcgaagacataggcggaacagaggagaccgcctatgtcttcgaggaacctggcggcagcgcaaaagatg

SEQ ID NO: 218700 - DNA, 103 bp, Artificial Sequence
  Synthetic Polynucleotide
taatacgactcactataggggccccacgctcgctggtggagacctcgaagaacagaggagacttcgaatgctccaccagaacctggcggcagcgcaaaagatg

SEQ ID NO: 218701 - DNA, 103 bp, Artificial Sequence
  Synthetic Polynucleotide
taatacgactcactatagggctcaatgtctgggctccacaccccctctgcaacagaggagagcagagatggtgtggagcaacctggcggcagcgcaaaagatg

SEQ ID NO: 218702 - DNA, 103 bp, Artificial Sequence
  Synthetic Polynucleotide
taatacgactcactataggggtgatgctgggccccacgctcgctggtggaaacagaggagatccaccatggagcgtgggaacctggcggcagcgcaaaagatg

SEQ ID NO: 218703 - DNA, 103 bp, Artificial Sequence
  Synthetic Polynucleotide
taatacgactcactatagggggcggtaaatgtgatgctgggccccacgctaacagaggagaagcgtgatgcccagcatcaacctggcggcagcgcaaaagatg

SEQ ID NO: 218704 - DNA, 103 bp, Artificial Sequence
  Synthetic Polynucleotide
taatacgactcactatagggtccctgaccaggcggtaaatgtgatgctggaacagaggagaccagcaatgcatttaccgaacctggcggcagcgcaaaagatg

SEQ ID NO: 218705 - DNA, 103 bp, Artificial Sequence
  Synthetic Polynucleotide
taatacgactcactatagggggaagctctgctcaatgtctgggctccacaaacagaggagatgtggaatgcagacattgaacctggcggcagcgcaaaagatg

SEQ ID NO: 218706 - DNA, 103 bp, Artificial Sequence
  Synthetic Polynucleotide
taatacgactcactatagggagggcctcctggaagctctgctcaatgtctaacagaggagaagacatatggcagagcttaacctggcggcagcgcaaaagatg

SEQ ID NO: 218707 - DNA, 103 bp, Artificial Sequence
  Synthetic Polynucleotide
taatacgactcactatagggatagatggccagggcctcctggaagctctgaacagaggagacagagcatgcaggaggccaacctggcggcagcgcaaaagatg

SEQ ID NO: 218708 - DNA, 103 bp, Artificial Sequence
  Synthetic Polynucleotide
taatacgactcactatagggcgcagggtggatagatggccagggcctcctaacagaggagaaggaggatgtggccatctaacctggcggcagcgcaaaagatg

SEQ ID NO: 218709 - DNA, 103 bp, Artificial Sequence
  Synthetic Polynucleotide
taatacgactcactatagggttccggcggccgcagggtggatagatggccaacagaggagaggccatatgtccaccctgaacctggcggcagcgcaaaagatg

SEQ ID NO: 218710 - DNA, 103 bp, Artificial Sequence
  Synthetic Polynucleotide
taatacgactcactatagggcaaaattattttccggcggccgcagggtggaacagaggagaccacccatgggccgccggaacctggcggcagcgcaaaagatg

SEQ ID NO: 218711 - DNA, 103 bp, Artificial Sequence
  Synthetic Polynucleotide
taatacgactcactatagggtgccatcgtccagggcggccccagcccgggaacagaggagacccgggatggggccgcccaacctggcggcagcgcaaaagatg

SEQ ID NO: 218712 - DNA, 103 bp, Artificial Sequence
  Synthetic Polynucleotide
taatacgactcactatagggcttcatcagacaaaattattttccggcggcaacagaggagagccgccatgaaataatttaacctggcggcagcgcaaaagatg

SEQ ID NO: 218713 - DNA, 103 bp, Artificial Sequence
  Synthetic Polynucleotide
taatacgactcactatagggtacatcttgccttcatcagacaaaattattaacagaggagaaataatatggtctgatgaaacctggcggcagcgcaaaagatg

SEQ ID NO: 218714 - DNA, 103 bp, Artificial Sequence
  Synthetic Polynucleotide
taatacgactcactatagggattccgaccatacatcttgccttcatcagaaacagaggagatctgatatgggcaagatgaacctggcggcagcgcaaaagatg

SEQ ID NO: 218715 - DNA, 103 bp, Artificial Sequence
  Synthetic Polynucleotide
taatacgactcactatagggcgatcagttcattccgaccatacatcttgcaacagaggagagcaagaatgatggtcggaaacctggcggcagcgcaaaagatg

SEQ ID NO: 218716 - DNA, 103 bp, Artificial Sequence
  Synthetic Polynucleotide
taatacgactcactatagggatgtagcgggcgatcagttcattccgaccaaacagaggagatggtcgatgtgaactgataacctggcggcagcgcaaaagatg

SEQ ID NO: 218717 - DNA, 103 bp, Artificial Sequence
  Synthetic Polynucleotide
taatacgactcactatagggtctcagcttgatgtagcgggcgatcagttcaacagaggagagaactgatggcccgctacaacctggcggcagcgcaaaagatg

SEQ ID NO: 218718 - DNA, 103 bp, Artificial Sequence
  Synthetic Polynucleotide
taatacgactcactatagggtcttccccgttctcagcttgatgtagcgggaacagaggagacccgctatgtcaagctgaaacctggcggcagcgcaaaagatg

SEQ ID NO: 218719 - DNA, 103 bp, Artificial Sequence
  Synthetic Polynucleotide
taatacgactcactatagggcgagttcgggtcttccccgttctcagcttgaacagaggagacaagctatgaacggggaaaacctggcggcagcgcaaaagatg

SEQ ID NO: 218720 - DNA, 103 bp, Artificial Sequence
  Synthetic Polynucleotide
taatacgactcactatagggaacctgttttcgagttcgggtcttccccgtaacagaggagaacggggatgacccgaactaacctggcggcagcgcaaaagatg

SEQ ID NO: 218721 - DNA, 103 bp, Artificial Sequence
  Synthetic Polynucleotide
taatacgactcactatagggtgtgactagaaacctgttttcgagttcgggaacagaggagacccgaaatggaaaacaggaacctggcggcagcgcaaaagatg

SEQ ID NO: 218722 - DNA, 103 bp, Artificial Sequence
  Synthetic Polynucleotide
taatacgactcactataggggtccagccgctgccatcgtccagggcggccaacagaggagaggccgcatgggacgatggaacctggcggcagcgcaaaagatg

SEQ ID NO: 218723 - DNA, 103 bp, Artificial Sequence
  Synthetic Polynucleotide
taatacgactcactatagggaaaacctggatgtgactagaaacctgttttaacagaggagaaaaacaatgttctagtcaaacctggcggcagcgcaaaagatg

SEQ ID NO: 218724 - DNA, 103 bp, Artificial Sequence
  Synthetic Polynucleotide
taatacgactcactatagggccttcgggccaaaacctggatgtgactagaaacagaggagatctagtatgatccaggttaacctggcggcagcgcaaaagatg

SEQ ID NO: 218725 - DNA, 103 bp, Artificial Sequence
  Synthetic Polynucleotide
taatacgactcactatagggcccttgatttccttcgggccaaaacctggaaacagaggagatccaggatgtggcccgaaaacctggcggcagcgcaaaagatg

SEQ ID NO: 218726 - DNA, 103 bp, Artificial Sequence
  Synthetic Polynucleotide
taatacgactcactataggggactggatttcccttgatttccttcgggccaacagaggagaggcccgatggaaatcaagaacctggcggcagcgcaaaagatg

SEQ ID NO: 218727 - DNA, 103 bp, Artificial Sequence
  Synthetic Polynucleotide
taatacgactcactatagggcttcaacttggactggatttcccttgatttaacagaggagaaaatcaatggaaatccagaacctggcggcagcgcaaaagatg

SEQ ID NO: 218728 - DNA, 103 bp, Artificial Sequence
  Synthetic Polynucleotide
taatacgactcactatagggaaacctggtccttcaacttggactggatttaacagaggagaaaatccatgccaagttgaaacctggcggcagcgcaaaagatg

SEQ ID NO: 218729 - DNA, 103 bp, Artificial Sequence
  Synthetic Polynucleotide
taatacgactcactatagggttgtccttggaaacctggtccttcaacttgaacagaggagacaagttatgggaccaggtaacctggcggcagcgcaaaagatg

SEQ ID NO: 218730 - DNA, 103 bp, Artificial Sequence
  Synthetic Polynucleotide
taatacgactcactatagggctggaaagccttgtccttggaaacctggtcaacagaggagagaccagatgtccaaggacaacctggcggcagcgcaaaagatg

SEQ ID NO: 218731 - DNA, 103 bp, Artificial Sequence
  Synthetic Polynucleotide
taatacgactcactatagggttgccattgtctggaaagccttgtccttggaacagaggagaccaaggatgaggctttccaacctggcggcagcgcaaaagatg

SEQ ID NO: 218732 - DNA, 103 bp, Artificial Sequence
  Synthetic Polynucleotide
taatacgactcactataggggaggacatggttgccattgtctggaaagccaacagaggagaggctttatggacaatggcaacctggcggcagcgcaaaagatg

SEQ ID NO: 218733 - DNA, 103 bp, Artificial Sequence
  Synthetic Polynucleotide
taatacgactcactatagggctcactgcccgtccagccgctgccatcgtcaacagaggagagacgatatgagcggctggaacctggcggcagcgcaaaagatg

SEQ ID NO: 218734 - DNA, 103 bp, Artificial Sequence
  Synthetic Polynucleotide
taatacgactcactataggggagctgggcagaggacatggttgccattgtaacagaggagaacaatgatgaccatgtccaacctggcggcagcgcaaaagatg

SEQ ID NO: 218735 - DNA, 103 bp, Artificial Sequence
  Synthetic Polynucleotide
taatacgactcactataggggcgcggagatgagctgggcagaggacatggaacagaggagaccatgtatgctgcccagcaacctggcggcagcgcaaaagatg

SEQ ID NO: 218736 - DNA, 103 bp, Artificial Sequence
  Synthetic Polynucleotide
taatacgactcactatagggtgcagagaaggcgcggagatgagctgggcaaacagaggagatgcccaatgcatctccgcaacctggcggcagcgcaaaagatg

SEQ ID NO: 218737 - DNA, 103 bp, Artificial Sequence
  Synthetic Polynucleotide
taatacgactcactatagggcagtttggcctgcagagaaggcgcggagataacagaggagaatctccatgccttctctgaacctggcggcagcgcaaaagatg

SEQ ID NO: 218738 - DNA, 103 bp, Artificial Sequence
  Synthetic Polynucleotide
taatacgactcactatagggcagtgggacccagtttggcctgcagagaagaacagaggagacttctcatgaggccaaacaacctggcggcagcgcaaaagatg

SEQ ID NO: 218739 - DNA, 103 bp, Artificial Sequence
  Synthetic Polynucleotide
taatacgactcactataggggcctgaggaccagtgggacccagtttggccaacagaggagaggccaaatggggtcccacaacctggcggcagcgcaaaagatg

SEQ ID NO: 218740 - DNA, 103 bp, Artificial Sequence
  Synthetic Polynucleotide
taatacgactcactatagggaagctcagaggcctgaggaccagtgggaccaacagaggagaggtcccatgggtcctcagaacctggcggcagcgcaaaagatg

SEQ ID NO: 218741 - DNA, 103 bp, Artificial Sequence
  Synthetic Polynucleotide
taatacgactcactatagggaaaactggaaaagctcagaggcctgaggacaacagaggagagtcctcatgcctctgagcaacctggcggcagcgcaaaagatg

SEQ ID NO: 218742 - DNA, 103 bp, Artificial Sequence
  Synthetic Polynucleotide
taatacgactcactatagggcctccagaccaaaactggaaaagctcagagaacagaggagactctgaatgtttccagttaacctggcggcagcgcaaaagatg

SEQ ID NO: 218743 - DNA, 103 bp, Artificial Sequence
  Synthetic Polynucleotide
taatacgactcactataggggggcccagatcctccagaccaaaactggaaaacagaggagattccagatgtggtctggaaacctggcggcagcgcaaaagatg

SEQ ID NO: 218744 - DNA, 103 bp, Artificial Sequence
  Synthetic Polynucleotide
taatacgactcactatagggcactgccttcctcactgcccgtccagccgcaacagaggagagcggctatgcgggcagtgaacctggcggcagcgcaaaagatg

SEQ ID NO: 218745 - DNA, 103 bp, Artificial Sequence
  Synthetic Polynucleotide
taatacgactcactatagggcattccaggggggcccagatcctccagaccaacagaggagaggtctgatggatctgggcaacctggcggcagcgcaaaagatg

SEQ ID NO: 218746 - DNA, 103 bp, Artificial Sequence
  Synthetic Polynucleotide
taatacgactcactatagggacatctggaacattccaggggggcccagataacagaggagaatctggatgcccctggaaaacctggcggcagcgcaaaagatg

SEQ ID NO: 218747 - DNA, 103 bp, Artificial Sequence
  Synthetic Polynucleotide
taatacgactcactataggggaatggcttcacatctggaacattccagggaacagaggagaccctggatggttccagataacctggcggcagcgcaaaagatg

SEQ ID NO: 218748 - DNA, 103 bp, Artificial Sequence
  Synthetic Polynucleotide
taatacgactcactataggggtgtctgtgagaatggcttcacatctggaaaacagaggagattccagatgtgaagccataacctggcggcagcgcaaaagatg

SEQ ID NO: 218749 - DNA, 103 bp, Artificial Sequence
  Synthetic Polynucleotide
taatacgactcactatagggaaggtgaacggtgtctgtgagaatggcttcaacagaggagagaagccatgctcacagacaacctggcggcagcgcaaaagatg

SEQ ID NO: 218750 - DNA, 103 bp, Artificial Sequence
  Synthetic Polynucleotide
taatacgactcactatagggagtcagtgacaaggtgaacggtgtctgtgaaacagaggagatcacagatgccgttcaccaacctggcggcagcgcaaaagatg

SEQ ID NO: 218751 - DNA, 103 bp, Artificial Sequence
  Synthetic Polynucleotide
taatacgactcactatagggtagatgggggagtcagtgacaaggtgaacgaacagaggagacgttcaatgtgtcactgaaacctggcggcagcgcaaaagatg

SEQ ID NO: 218752 - DNA, 103 bp, Artificial Sequence
  Synthetic Polynucleotide
taatacgactcactataggggggaggtcagtagatgggggagtcagtgacaacagaggagagtcactatgtcccccatcaacctggcggcagcgcaaaagatg

SEQ ID NO: 218753 - DNA, 103 bp, Artificial Sequence
  Synthetic Polynucleotide
taatacgactcactatagggctcgtaccctgggaggtcagtagatgggggaacagaggagacccccaatgactgacctcaacctggcggcagcgcaaaagatg

SEQ ID NO: 218754 - DNA, 103 bp, Artificial Sequence
  Synthetic Polynucleotide
taatacgactcactatagggcttgggggggctcgtaccctgggaggtcagaacagaggagactgaccatgcagggtacgaacctggcggcagcgcaaaagatg

SEQ ID NO: 218755 - DNA, 103 bp, Artificial Sequence
  Synthetic Polynucleotide
taatacgactcactataggggtaccctcctcactgccttcctcactgcccaacagaggagagggcagatgggaaggcagaacctggcggcagcgcaaaagatg

SEQ ID NO: 218756 - DNA, 103 bp, Artificial Sequence
  Synthetic Polynucleotide
taatacgactcactatagggggtgagagggcttgggggggctcgtaccctaacagaggagaagggtaatggcccccccaaacctggcggcagcgcaaaagatg

SEQ ID NO: 218757 - DNA, 103 bp, Artificial Sequence
  Synthetic Polynucleotide
taatacgactcactatagggtgggggcaggggtgagagggcttgggggggaacagaggagaccccccatggccctctcaaacctggcggcagcgcaaaagatg

SEQ ID NO: 218758 - DNA, 103 bp, Artificial Sequence
  Synthetic Polynucleotide
taatacgactcactatagggatggggtaggtgggggcaggggtgagagggaacagaggagaccctctatgccctgccccaacctggcggcagcgcaaaagatg

SEQ ID NO: 218759 - DNA, 103 bp, Artificial Sequence
  Synthetic Polynucleotide
taatacgactcactataggggctgggggcgatggggtaggtgggggcaggaacagaggagacctgccatgacctaccccaacctggcggcagcgcaaaagatg

SEQ ID NO: 218760 - DNA, 103 bp, Artificial Sequence
  Synthetic Polynucleotide
taatacgactcactatagggagcctgccaggctgggggcgatggggtaggaacagaggagacctaccatgtcgcccccaaacctggcggcagcgcaaaagatg

SEQ ID NO: 218761 - DNA, 103 bp, Artificial Sequence
  Synthetic Polynucleotide
taatacgactcactatagggccaggccccgagcctgccaggctgggggcgaacagaggagacgccccatgcctggcaggaacctggcggcagcgcaaaagatg

SEQ ID NO: 218762 - DNA, 103 bp, Artificial Sequence
  Synthetic Polynucleotide
taatacgactcactatagggcgggcggtgcccaggccccgagcctgccagaacagaggagactggcaatgtcggggcctaacctggcggcagcgcaaaagatg

SEQ ID NO: 218763 - DNA, 103 bp, Artificial Sequence
  Synthetic Polynucleotide
taatacgactcactatagggcagctgcaaccgggcggtgcccaggccccgaacagaggagacggggcatgggcaccgccaacctggcggcagcgcaaaagatg

SEQ ID NO: 218764 - DNA, 103 bp, Artificial Sequence
  Synthetic Polynucleotide
taatacgactcactatagggagaactctaccagctgcaaccgggcggtgcaacagaggagagcaccgatgggttgcagcaacctggcggcagcgcaaaagatg

SEQ ID NO: 218765 - DNA, 103 bp, Artificial Sequence
  Synthetic Polynucleotide
taatacgactcactatagggacgaaggctgagaactctaccagctgcaacaacagaggagagttgcaatgggtagagttaacctggcggcagcgcaaaagatg

SEQ ID NO: 218766 - DNA, 103 bp, Artificial Sequence
  Synthetic Polynucleotide
taatacgactcactatagggactgccgccggtaccctcctcactgccttcaacagaggagagaaggcatggaggagggtaacctggcggcagcgcaaaagatg

SEQ ID NO: 218767 - DNA, 103 bp, Artificial Sequence
  Synthetic Polynucleotide
taatacgactcactatagggtggcggttccacgaaggctgagaactctacaacagaggagagtagagatgtcagccttcaacctggcggcagcgcaaaagatg

SEQ ID NO: 218768 - DNA, 103 bp, Artificial Sequence
  Synthetic Polynucleotide
taatacgactcactatagggcaactgcatctggcggttccacgaaggctgaacagaggagacagcctatgtggaaccgcaacctggcggcagcgcaaaagatg

SEQ ID NO: 218769 - DNA, 103 bp, Artificial Sequence
  Synthetic Polynucleotide
taatacgactcactatagggtggtaagaatcaactgcatctggcggttccaacagaggagaggaaccatgagatgcagtaacctggcggcagcgcaaaagatg

SEQ ID NO: 218770 - DNA, 103 bp, Artificial Sequence
  Synthetic Polynucleotide
taatacgactcactatagggcaggtgcctctggtaagaatcaactgcatcaacagaggagagatgcaatggattcttacaacctggcggcagcgcaaaagatg

SEQ ID NO: 218771 - DNA, 103 bp, Artificial Sequence
  Synthetic Polynucleotide
taatacgactcactatagggtgtgcacgaacaggtgcctctggtaagaataacagaggagaattcttatgagaggcaccaacctggcggcagcgcaaaagatg

SEQ ID NO: 218772 - DNA, 103 bp, Artificial Sequence
  Synthetic Polynucleotide
taatacgactcactatagggtgctggctgatgtgcacgaacaggtgcctcaacagaggagagaggcaatggttcgtgcaaacctggcggcagcgcaaaagatg

SEQ ID NO: 218773 - DNA, 103 bp, Artificial Sequence
  Synthetic Polynucleotide
taatacgactcactataggggctggggcagtgctggctgatgtgcacgaaaacagaggagattcgtgatgatcagccagaacctggcggcagcgcaaaagatg

SEQ ID NO: 218774 - DNA, 103 bp, Artificial Sequence
  Synthetic Polynucleotide
taatacgactcactataggggcgctccggggctggggcagtgctggctgaaacagaggagatcagccatgactgccccaaacctggcggcagcgcaaaagatg

SEQ ID NO: 218775 - DNA, 103 bp, Artificial Sequence
  Synthetic Polynucleotide
taatacgactcactatagggtcgagcggcggcgctccggggctggggcagaacagaggagactgcccatgccccggagcaacctggcggcagcgcaaaagatg

SEQ ID NO: 218776 - DNA, 103 bp, Artificial Sequence
  Synthetic Polynucleotide
taatacgactcactataggggtccacactctcgagcggcggcgctccgggaacagaggagacccggaatgccgccgctcaacctggcggcagcgcaaaagatg

SEQ ID NO: 218777 - DNA, 103 bp, Artificial Sequence
  Synthetic Polynucleotide
taatacgactcactatagggcagccccctcactgccgccggtaccctcctaacagaggagaaggaggatgccggcggcaaacctggcggcagcgcaaaagatg

SEQ ID NO: 218778 - DNA, 103 bp, Artificial Sequence
  Synthetic Polynucleotide
taatacgactcactatagggtctgccggacgtccacactctcgagcggcgaacagaggagacgccgcatgagagtgtggaacctggcggcagcgcaaaagatg

SEQ ID NO: 218779 - DNA, 103 bp, Artificial Sequence
  Synthetic Polynucleotide
taatacgactcactatagggttgtcgtagatctgccggacgtccacactcaacagaggagagagtgtatgcgtccggcaaacctggcggcagcgcaaaagatg

SEQ ID NO: 218780 - DNA, 103 bp, Artificial Sequence
  Synthetic Polynucleotide
taatacgactcactatagggctcagggaatttgtcgtagatctgccggacaacagaggagagtccggatgatctacgacaacctggcggcagcgcaaaagatg

SEQ ID NO: 218781 - DNA, 103 bp, Artificial Sequence
  Synthetic Polynucleotide
taatacgactcactatagggcaccctttttctcagggaatttgtcgtagaaacagaggagatctacgatgaattccctgaacctggcggcagcgcaaaagatg

SEQ ID NO: 218782 - DNA, 103 bp, Artificial Sequence
  Synthetic Polynucleotide
taatacgactcactatagggtctcggaggccaccctttttctcagggaataacagaggagaattcccatggaaaaagggaacctggcggcagcgcaaaagatg

SEQ ID NO: 218783 - DNA, 103 bp, Artificial Sequence
  Synthetic Polynucleotide
taatacgactcactatagggatcatatagctctcggaggccaccctttttaacagaggagaaaaaagatgggcctccgaaacctggcggcagcgcaaaagatg

SEQ ID NO: 218784 - DNA, 103 bp, Artificial Sequence
  Synthetic Polynucleotide
taatacgactcactataggggggggccacgatcatatagctctcggaggcaacagaggagagcctccatgagctatatgaacctggcggcagcgcaaaagatg

SEQ ID NO: 218785 - DNA, 103 bp, Artificial Sequence
  Synthetic Polynucleotide
taatacgactcactatagggaaggcatggggggggccacgatcatatagcaacagaggagagctataatgtcgtggcccaacctggcggcagcgcaaaagatg

SEQ ID NO: 218786 - DNA, 103 bp, Artificial Sequence
  Synthetic Polynucleotide
taatacgactcactataggggaccaggaagaaggcatggggggggccacgaacagaggagacgtggcatgccccatgccaacctggcggcagcgcaaaagatg

SEQ ID NO: 218787 - DNA, 103 bp, Artificial Sequence
  Synthetic Polynucleotide
taatacgactcactatagggcccagaacttgaccaggaagaaggcatgggaacagaggagacccatgatgtcttcctggaacctggcggcagcgcaaaagatg

SEQ ID NO: 218788 - DNA, 103 bp, Artificial Sequence
  Synthetic Polynucleotide
taatacgactcactatagggccgtcacccccagccccctcactgccgccgaacagaggagacggcggatgtgagggggcaacctggcggcagcgcaaaagatg

SEQ ID NO: 218789 - DNA, 103 bp, Artificial Sequence
  Synthetic Polynucleotide
taatacgactcactatagggttcaggtccgcccagaacttgaccaggaagaacagaggagacttcctatgcaagttctgaacctggcggcagcgcaaaagatg

SEQ ID NO: 218790 - DNA, 103 bp, Artificial Sequence
  Synthetic Polynucleotide
taatacgactcactatagggtgggccccagttcaggtccgcccagaacttaacagaggagaaagttcatggcggacctgaacctggcggcagcgcaaaagatg

SEQ ID NO: 218791 - DNA, 103 bp, Artificial Sequence
  Synthetic Polynucleotide
taatacgactcactatagggcctcaccacttgggccccagttcaggtccgaacagaggagacggaccatgactggggccaacctggcggcagcgcaaaagatg

SEQ ID NO: 218792 - DNA, 103 bp, Artificial Sequence
  Synthetic Polynucleotide
taatacgactcactataggggcccctgcctcctcaccacttgggccccagaacagaggagactggggatgaagtggtgaaacctggcggcagcgcaaaagatg

SEQ ID NO: 218793 - DNA, 103 bp, Artificial Sequence
  Synthetic Polynucleotide
taatacgactcactataggggctgccaccggcccctgcctcctcaccactaacagaggagaagtggtatggaggcagggaacctggcggcagcgcaaaagatg

SEQ ID NO: 218794 - DNA, 103 bp, Artificial Sequence
  Synthetic Polynucleotide
taatacgactcactatagggcactgctgatgctgccaccggcccctgcctaacagaggagaaggcagatgccggtggcaaacctggcggcagcgcaaaagatg

SEQ ID NO: 218795 - DNA, 103 bp, Artificial Sequence
  Synthetic Polynucleotide
taatacgactcactatagggtagaagccaccactgctgatgctgccaccgaacagaggagacggtggatgcatcagcagaacctggcggcagcgcaaaagatg

SEQ ID NO: 218796 - DNA, 103 bp, Artificial Sequence
  Synthetic Polynucleotide
taatacgactcactataggggctcactccgtagaagccaccactgctgataacagaggagaatcagcatgggtggcttcaacctggcggcagcgcaaaagatg

SEQ ID NO: 218797 - DNA, 103 bp, Artificial Sequence
  Synthetic Polynucleotide
taatacgactcactatagggcatactggctgctcactccgtagaagccacaacagaggagagtggctatgacggagtgaaacctggcggcagcgcaaaagatg

SEQ ID NO: 218798 - DNA, 103 bp, Artificial Sequence
  Synthetic Polynucleotide
taatacgactcactatagggtccaggctctcatactggctgctcactccgaacagaggagacggagtatgcagccagtaaacctggcggcagcgcaaaagatg

SEQ ID NO: 218799 - DNA, 103 bp, Artificial Sequence
  Synthetic Polynucleotide
taatacgactcactataggggctgctggcgttccagctgttggacgctataacagaggagaatagcgatgaacagctggaacctggcggcagcgcaaaagatg

SEQ ID NO: 218800 - DNA, 103 bp, Artificial Sequence
  Synthetic Polynucleotide
taatacgactcactatagggctcgatgtccgggctccacacgccctccgcaacagaggagagcggagatggtgtggagcaacctggcggcagcgcaaaagatg

SEQ ID NO: 218801 - DNA, 103 bp, Artificial Sequence
  Synthetic Polynucleotide
taatacgactcactatagggtttgccaaaggagcacaccttggtggagacaacagaggagagtctccatgaaggtgtgcaacctggcggcagcgcaaaagatg

SEQ ID NO: 218802 - DNA, 103 bp, Artificial Sequence
  Synthetic Polynucleotide
taatacgactcactatagggctaccacctgtttgccaaaggagcacacctaacagaggagaaggtgtatgcctttggcaaacctggcggcagcgcaaaagatg

SEQ ID NO: 218803 - DNA, 103 bp, Artificial Sequence
  Synthetic Polynucleotide
taatacgactcactatagggtccaccttctctaccacctgtttgccaaagaacagaggagactttggatgacaggtggtaacctggcggcagcgcaaaagatg

SEQ ID NO: 218804 - DNA, 103 bp, Artificial Sequence
  Synthetic Polynucleotide
taatacgactcactatagggatactcagtctccaccttctctaccacctgaacagaggagacaggtgatggagaaggtgaacctggcggcagcgcaaaagatg

SEQ ID NO: 218805 - DNA, 103 bp, Artificial Sequence
  Synthetic Polynucleotide
taatacgactcactatagggccagcctggcatactcagtctccaccttctaacagaggagaagaaggatgagactgagtaacctggcggcagcgcaaaagatg

SEQ ID NO: 218806 - DNA, 103 bp, Artificial Sequence
  Synthetic Polynucleotide
taatacgactcactatagggcgcccgttctccagcctggcatactcagtcaacagaggagagactgaatgtgccaggctaacctggcggcagcgcaaaagatg

SEQ ID NO: 218807 - DNA, 103 bp, Artificial Sequence
  Synthetic Polynucleotide
taatacgactcactataggggtacacaaagcgcccgttctccagcctggcaacagaggagagccaggatggagaacgggaacctggcggcagcgcaaaagatg

SEQ ID NO: 218808 - DNA, 103 bp, Artificial Sequence
  Synthetic Polynucleotide
taatacgactcactatagggggtggatacggtacacaaagcgcccgttctaacagaggagaagaacgatggctttgtgtaacctggcggcagcgcaaaagatg

SEQ ID NO: 218809 - DNA, 103 bp, Artificial Sequence
  Synthetic Polynucleotide
taatacgactcactatagggatgggcgagcggtggatacggtacacaaagaacagaggagactttgtatgccgtatccaaacctggcggcagcgcaaaagatg

SEQ ID NO: 218810 - DNA, 103 bp, Artificial Sequence
  Synthetic Polynucleotide
taatacgactcactataggggtactcgcacatgggcgagcggtggatacgaacagaggagacgtatcatgcgctcgcccaacctggcggcagcgcaaaagatg

SEQ ID NO: 218811 - DNA, 103 bp, Artificial Sequence
  Synthetic Polynucleotide
taatacgactcactatagggggaagctctgctcgatgtccgggctccacaaacagaggagatgtggaatgcggacatcgaacctggcggcagcgcaaaagatg

SEQ ID NO: 218812 - DNA, 103 bp, Artificial Sequence
  Synthetic Polynucleotide
taatacgactcactatagggagttgatcatgtactcgcacatgggcgagcaacagaggagagctcgcatgtgtgcgagtaacctggcggcagcgcaaaagatg

SEQ ID NO: 218813 - DNA, 103 bp, Artificial Sequence
  Synthetic Polynucleotide
taatacgactcactatagggttgtggatgaagttgatcatgtactcgcacaacagaggagagtgcgaatgcatgatcaaaacctggcggcagcgcaaaagatg

SEQ ID NO: 218814 - DNA, 103 bp, Artificial Sequence
  Synthetic Polynucleotide
taatacgactcactataggggtgcttcagcttgtggatgaagttgatcataacagaggagaatgatcatgttcatccacaacctggcggcagcgcaaaagatg

SEQ ID NO: 218815 - DNA, 103 bp, Artificial Sequence
  Synthetic Polynucleotide
taatacgactcactatagggtctcgggcaggtgcttcagcttgtggatgaaacagaggagatcatccatgagctgaagcaacctggcggcagcgcaaaagatg

SEQ ID NO: 218816 - DNA, 103 bp, Artificial Sequence
  Synthetic Polynucleotide
taatacgactcactatagggatcatgtacttctcgggcaggtgcttcagcaacagaggagagctgaaatgcctgcccgaaacctggcggcagcgcaaaagatg

SEQ ID NO: 218817 - DNA, 103 bp, Artificial Sequence
  Synthetic Polynucleotide
taatacgactcactatagggcacgctgttcatcatgtacttctcgggcagaacagaggagactgcccatgaagtacatgaacctggcggcagcgcaaaagatg

SEQ ID NO: 218818 - DNA, 103 bp, Artificial Sequence
  Synthetic Polynucleotide
taatacgactcactatagggagttctccagcacgctgttcatcatgtactaacagaggagaagtacaatgtgaacagcgaacctggcggcagcgcaaaagatg

SEQ ID NO: 218819 - DNA, 103 bp, Artificial Sequence
  Synthetic Polynucleotide
taatacgactcactatagggaggatggtgaagttctccagcacgctgttcaacagaggagagaacagatggctggagaaaacctggcggcagcgcaaaagatg

SEQ ID NO: 218820 - DNA, 103 bp, Artificial Sequence
  Synthetic Polynucleotide
taatacgactcactataggggaccacctgcaggatggtgaagttctccagaacagaggagactggagatgttcaccatcaacctggcggcagcgcaaaagatg

SEQ ID NO: 218821 - DNA, 103 bp, Artificial Sequence
  Synthetic Polynucleotide
taatacgactcactatagggcccggctcgtgaccacctgcaggatggtgaaacagaggagatcaccaatgtgcaggtggaacctggcggcagcgcaaaagatg

SEQ ID NO: 218822 - DNA, 103 bp, Artificial Sequence
  Synthetic Polynucleotide
taatacgactcactatagggagggcctcctggaagctctgctcgatgtccaacagaggagaggacatatggcagagcttaacctggcggcagcgcaaaagatg

SEQ ID NO: 218823 - DNA, 103 bp, Artificial Sequence
  Synthetic Polynucleotide
taatacgactcactatagggtcctgggagtcccggctcgtgaccacctgcaacagaggagagcaggtatgcacgagccgaacctggcggcagcgcaaaagatg

SEQ ID NO: 218824 - DNA, 103 bp, Artificial Sequence
  Synthetic Polynucleotide
taatacgactcactatagggaagcagggtctcctgggagtcccggctcgtaacagaggagaacgagcatggactcccagaacctggcggcagcgcaaaagatg

SEQ ID NO: 218825 - DNA, 103 bp, Artificial Sequence
  Synthetic Polynucleotide
taatacgactcactatagggaagcaatgacaagcagggtctcctgggagtaacagaggagaactcccatgagaccctgcaacctggcggcagcgcaaaagatg

SEQ ID NO: 218826 - DNA, 103 bp, Artificial Sequence
  Synthetic Polynucleotide
taatacgactcactatagggtcgaagacaaaagcaatgacaagcagggtcaacagaggagagaccctatgtgtcattgcaacctggcggcagcgcaaaagatg

SEQ ID NO: 218827 - DNA, 103 bp, Artificial Sequence
  Synthetic Polynucleotide
taatacgactcactatagggggtggagacttcgaagacaaaagcaatgacaacagaggagagtcattatgtttgtcttcaacctggcggcagcgcaaaagatg

SEQ ID NO: 218828 - DNA, 103 bp, Artificial Sequence
  Synthetic Polynucleotide
taatacgactcactatagggcgtgctcactggtggagacttcgaagacaaaacagaggagattgtctatgaagtctccaaacctggcggcagcgcaaaagatg

SEQ ID NO: 218829 - DNA, 103 bp, Artificial Sequence
  Synthetic Polynucleotide
taatacgactcactatagggtgctgggccccgtgctcactggtggagactaacagaggagaagtctcatgcagtgagcaaacctggcggcagcgcaaaagatg

SEQ ID NO: 218830 - DNA, 103 bp, Artificial Sequence
  Synthetic Polynucleotide
taatacgactcactataggggtagacatggtgctgggccccgtgctcactaacagaggagaagtgagatgggggcccagaacctggcggcagcgcaaaagatg

SEQ ID NO: 218831 - DNA, 103 bp, Artificial Sequence
  Synthetic Polynucleotide
taatacgactcactatagggtgacgagcttgtagacatggtgctgggcccaacagaggagagggcccatgaccatgtctaacctggcggcagcgcaaaagatg

SEQ ID NO: 218832 - DNA, 103 bp, Artificial Sequence
  Synthetic Polynucleotide
taatacgactcactataggggtagatggccagggcctcctggaagctctgaacagaggagacagagcatgcaggaggccaacctggcggcagcgcaaaagatg

SEQ ID NO: 218833 - DNA, 103 bp, Artificial Sequence
  Synthetic Polynucleotide
taatacgactcactatagggcgcagggcgggtagatggccagggcctcctaacagaggagaaggaggatgtggccatctaacctggcggcagcgcaaaagatg

SEQ ID NO: 218834 - DNA, 103 bp, Artificial Sequence
  Synthetic Polynucleotide
taatacgactcactatagggttccgccggccgcagggcgggtagatggccaacagaggagaggccatatgcccgccctgaacctggcggcagcgcaaaagatg

SEQ ID NO: 218835 - DNA, 103 bp, Artificial Sequence
  Synthetic Polynucleotide
taatacgactcactatagggcaggatgatcttccgccggccgcagggcggaacagaggagaccgcccatgggccggcggaacctggcggcagcgcaaaagatg

SEQ ID NO: 218836 - DNA, 103 bp, Artificial Sequence
  Synthetic Polynucleotide
taatacgactcactatagggcctcgtctgacaggatgatcttccgccggcaacagaggagagccggcatgagatcatccaacctggcggcagcgcaaaagatg

SEQ ID NO: 218837 - DNA, 103 bp, Artificial Sequence
  Synthetic Polynucleotide
taatacgactcactatagggtacatcttgccctcgtctgacaggatgatcaacagaggagagatcatatggtcagacgaaacctggcggcagcgcaaaagatg

SEQ ID NO: 218838 - DNA, 103 bp, Artificial Sequence
  Synthetic Polynucleotide
taatacgactcactatagggatttcggccgtacatcttgccctcgtctgaaacagaggagatcagacatgggcaagatgaacctggcggcagcgcaaaagatg

SEQ ID NO: 218839 - DNA, 103 bp, Artificial Sequence
  Synthetic Polynucleotide
taatacgactcactatagggccccggggctgctgctggcgttccagctgtaacagaggagaacagctatgacgccagcaaacctggcggcagcgcaaaagatg

SEQ ID NO: 218840 - DNA, 103 bp, Artificial Sequence
  Synthetic Polynucleotide
taatacgactcactatagggcaatcaactcatttcggccgtacatcttgcaacagaggagagcaagaatgacggccgaaaacctggcggcagcgcaaaagatg

SEQ ID NO: 218841 - DNA, 103 bp, Artificial Sequence
  Synthetic Polynucleotide
taatacgactcactatagggatatagcgtgcaatcaactcatttcggccgaacagaggagacggccgatgtgagttgataacctggcggcagcgcaaaagatg

SEQ ID NO: 218842 - DNA, 103 bp, Artificial Sequence
  Synthetic Polynucleotide
taatacgactcactatagggcctcagtttaatatagcgtgcaatcaactcaacagaggagagagttgatggcacgctataacctggcggcagcgcaaaagatg

SEQ ID NO: 218843 - DNA, 103 bp, Artificial Sequence
  Synthetic Polynucleotide
taatacgactcactatagggtcttccccgtcctcagtttaatatagcgtgaacagaggagacacgctatgttaaactgaaacctggcggcagcgcaaaagatg

SEQ ID NO: 218844 - DNA, 103 bp, Artificial Sequence
  Synthetic Polynucleotide
taatacgactcactatagggctcgtccgagtcttccccgtcctcagtttaaacagaggagataaactatggacggggaaaacctggcggcagcgcaaaagatg

SEQ ID NO: 218845 - DNA, 103 bp, Artificial Sequence
  Synthetic Polynucleotide
taatacgactcactataggggacctgttttctcgtccgagtcttccccgtaacagaggagaacggggatgactcggacgaacctggcggcagcgcaaaagatg

SEQ ID NO: 218846 - DNA, 103 bp, Artificial Sequence
  Synthetic Polynucleotide
taatacgactcactatagggagtggctagagacctgttttctcgtccgagaacagaggagactcggaatggaaaacaggaacctggcggcagcgcaaaagatg

SEQ ID NO: 218847 - DNA, 103 bp, Artificial Sequence
  Synthetic Polynucleotide
taatacgactcactatagggagaacttgcaagtggctagagacctgttttaacagaggagaaaaacaatgctctagccaaacctggcggcagcgcaaaagatg

SEQ ID NO: 218848 - DNA, 103 bp, Artificial Sequence
  Synthetic Polynucleotide
taatacgactcactatagggccgcctggctagaacttgcaagtggctagaaacagaggagatctagcatgttgcaagttaacctggcggcagcgcaaaagatg

SEQ ID NO: 218849 - DNA, 103 bp, Artificial Sequence
  Synthetic Polynucleotide
taatacgactcactatagggcccgagatttccgcctggctagaacttgcaaacagaggagatgcaagatgtagccaggcaacctggcggcagcgcaaaagatg

SEQ ID NO: 218850 - DNA, 103 bp, Artificial Sequence
  Synthetic Polynucleotide
taatacgactcactatagggtcccgggcctccccggggctgctgctggcgaacagaggagacgccagatgcagccccggaacctggcggcagcgcaaaagatg

SEQ ID NO: 218851 - DNA, 103 bp, Artificial Sequence
  Synthetic Polynucleotide
taatacgactcactataggggactgaatctcccgagatttccgcctggctaacagaggagaagccagatggaaatctcgaacctggcggcagcgcaaaagatg

SEQ ID NO: 218852 - DNA, 103 bp, Artificial Sequence
  Synthetic Polynucleotide
taatacgactcactatagggcttcagcttagactgaatctcccgagatttaacagaggagaaaatctatggagattcagaacctggcggcagcgcaaaagatg

SEQ ID NO: 218853 - DNA, 103 bp, Artificial Sequence
  Synthetic Polynucleotide
taatacgactcactatagggggttcatggccttcagcttagactgaatctaacagaggagaagattcatgctaagctgaaacctggcggcagcgcaaaagatg

SEQ ID NO: 218854 - DNA, 103 bp, Artificial Sequence
  Synthetic Polynucleotide
taatacgactcactatagggacctggtccaggttcatggccttcagcttaaacagaggagataagctatgggccatgaaaacctggcggcagcgcaaaagatg

SEQ ID NO: 218855 - DNA, 103 bp, Artificial Sequence
  Synthetic Polynucleotide
taatacgactcactataggggtccttggagacctggtccaggttcatggcaacagaggagagccatgatgctggaccagaacctggcggcagcgcaaaagatg

SEQ ID NO: 218856 - DNA, 103 bp, Artificial Sequence
  Synthetic Polynucleotide
taatacgactcactataggggaagggctttgtccttggagacctggtccaaacagaggagatggaccatgtctccaaggaacctggcggcagcgcaaaagatg

SEQ ID NO: 218857 - DNA, 103 bp, Artificial Sequence
  Synthetic Polynucleotide
taatacgactcactataggggccatgctctgaagggctttgtccttggagaacagaggagactccaaatgcaaagccctaacctggcggcagcgcaaaagatg

SEQ ID NO: 218858 - DNA, 103 bp, Artificial Sequence
  Synthetic Polynucleotide
taatacgactcactatagggggacatggacgccatgctctgaagggctttaacagaggagaaaagccatgcagagcatgaacctggcggcagcgcaaaagatg

SEQ ID NO: 218859 - DNA, 103 bp, Artificial Sequence
  Synthetic Polynucleotide
taatacgactcactatagggtctgggcagaggacatggacgccatgctctaacagaggagaagagcaatgcgtccatgtaacctggcggcagcgcaaaagatg

SEQ ID NO: 218860 - DNA, 103 bp, Artificial Sequence
  Synthetic Polynucleotide
taatacgactcactataggggcagagacgatctgggcagaggacatggacaacagaggagagtccatatgctctgcccaaacctggcggcagcgcaaaagatg

SEQ ID NO: 218861 - DNA, 103 bp, Artificial Sequence
  Synthetic Polynucleotide
taatacgactcactataggggggcccatcctcccgggcctccccggggctaacagaggagaagccccatggaggcccggaacctggcggcagcgcaaaagatg

SEQ ID NO: 218862 - DNA, 103 bp, Artificial Sequence
  Synthetic Polynucleotide
taatacgactcactatagggcaggacactggcagagacgatctgggcagaaacagaggagatctgccatgatcgtctctaacctggcggcagcgcaaaagatg

SEQ ID NO: 218863 - DNA, 103 bp, Artificial Sequence
  Synthetic Polynucleotide
taatacgactcactatagggacttgttctgcaggacactggcagagacgaaacagaggagatcgtctatgccagtgtccaacctggcggcagcgcaaaagatg

SEQ ID NO: 218864 - DNA, 103 bp, Artificial Sequence
  Synthetic Polynucleotide
taatacgactcactatagggggtgggctgaacttgttctgcaggacactgaacagaggagacagtgtatggcagaacaaaacctggcggcagcgcaaaagatg

SEQ ID NO: 218865 - DNA, 103 bp, Artificial Sequence
  Synthetic Polynucleotide
taatacgactcactatagggcagaggggaaggtgggctgaacttgttctgaacagaggagacagaacatgttcagcccaaacctggcggcagcgcaaaagatg

SEQ ID NO: 218866 - DNA, 103 bp, Artificial Sequence
  Synthetic Polynucleotide
taatacgactcactatagggcggcctggggcagaggggaaggtgggctgaaacagaggagatcagccatgcttcccctcaacctggcggcagcgcaaaagatg

SEQ ID NO: 218867 - DNA, 103 bp, Artificial Sequence
  Synthetic Polynucleotide
taatacgactcactataggggtggagaagacggcctggggcagaggggaaaacagaggagattccccatggccccaggcaacctggcggcagcgcaaaagatg

SEQ ID NO: 218868 - DNA, 103 bp, Artificial Sequence
  Synthetic Polynucleotide
taatacgactcactatagggccgcgaggaagtggagaagacggcctggggaacagaggagaccccagatggtcttctccaacctggcggcagcgcaaaagatg

SEQ ID NO: 218869 - DNA, 103 bp, Artificial Sequence
  Synthetic Polynucleotide
taatacgactcactatagggtgctccagaaccgcgaggaagtggagaagaaacagaggagatcttctatgcttcctcgcaacctggcggcagcgcaaaagatg

SEQ ID NO: 218870 - DNA, 103 bp, Artificial Sequence
  Synthetic Polynucleotide
taatacgactcactatagggagaggggggctgctccagaaccgcgaggaaaacagaggagattcctcatggttctggagaacctggcggcagcgcaaaagatg

SEQ ID NO: 218871 - DNA, 103 bp, Artificial Sequence
  Synthetic Polynucleotide
taatacgactcactatagggctgtcccaggagaggggggctgctccagaaaacagaggagattctggatgagcccccctaacctggcggcagcgcaaaagatg

SEQ ID NO: 218872 - DNA, 103 bp, Artificial Sequence
  Synthetic Polynucleotide
taatacgactcactatagggccaggccctcgggcccatcctcccgggcctaacagaggagaaggcccatgaggatgggcaacctggcggcagcgcaaaagatg

SEQ ID NO: 218873 - DNA, 103 bp, Artificial Sequence
  Synthetic Polynucleotide
taatacgactcactataggggtccaggctgctgtcccaggagaggggggcaacagaggagagcccccatgtcctgggacaacctggcggcagcgcaaaagatg

SEQ ID NO: 218874 - DNA, 103 bp, Artificial Sequence
  Synthetic Polynucleotide
taatacgactcactatagggtcctgagagggtccaggctgctgtcccaggaacagaggagacctgggatggcagcctggaacctggcggcagcgcaaaagatg

SEQ ID NO: 218875 - DNA, 103 bp, Artificial Sequence
  Synthetic Polynucleotide
taatacgactcactataggggggcttgatgtcctgagagggtccaggctgaacagaggagacagcctatgccctctcagaacctggcggcagcgcaaaagatg

SEQ ID NO: 218876 - DNA, 103 bp, Artificial Sequence
  Synthetic Polynucleotide
taatacgactcactataggggctgtgcaaagggcttgatgtcctgagaggaacagaggagacctctcatgacatcaagcaacctggcggcagcgcaaaagatg

SEQ ID NO: 218877 - DNA, 103 bp, Artificial Sequence
  Synthetic Polynucleotide
taatacgactcactataggggggtaggctggctgtgcaaagggcttgatgaacagaggagacatcaaatgctttgcacaaacctggcggcagcgcaaaagatg

SEQ ID NO: 218878 - DNA, 103 bp, Artificial Sequence
  Synthetic Polynucleotide
taatacgactcactatagggcggctggatggggtaggctggctgtgcaaaaacagaggagatttgcaatgccagcctacaacctggcggcagcgcaaaagatg

SEQ ID NO: 218879 - DNA, 103 bp, Artificial Sequence
  Synthetic Polynucleotide
taatacgactcactataggggcggcaggggcggctggatggggtaggctgaacagaggagacagcctatgccatccagcaacctggcggcagcgcaaaagatg

SEQ ID NO: 218880 - DNA, 103 bp, Artificial Sequence
  Synthetic Polynucleotide
taatacgactcactatagggctgagcgtcggcggcaggggcggctggatgaacagaggagacatccaatggcccctgccaacctggcggcagcgcaaaagatg

SEQ ID NO: 218881 - DNA, 103 bp, Artificial Sequence
  Synthetic Polynucleotide
taatacgactcactatagggctcataactgctgagcgtcggcggcaggggaacagaggagacccctgatgccgacgctcaacctggcggcagcgcaaaagatg

SEQ ID NO: 218882 - DNA, 103 bp, Artificial Sequence
  Synthetic Polynucleotide
taatacgactcactataggggggccaggggctcataactgctgagcgtcgaacagaggagacgacgcatggcagttatgaacctggcggcagcgcaaaagatg

SEQ ID NO: 218883 - DNA, 103 bp, Artificial Sequence
  Synthetic Polynucleotide
taatacgactcactatagggagccccttgtccaggccctcgggcccatccaacagaggagaggatggatgcgagggcctaacctggcggcagcgcaaaagatg

SEQ ID NO: 218884 - DNA, 103 bp, Artificial Sequence
  Synthetic Polynucleotide
taatacgactcactataggggaggggagcggggccaggggctcataactgaacagaggagacagttaatggcccctggcaacctggcggcagcgcaaaagatg

SEQ ID NO: 218885 - DNA, 103 bp, Artificial Sequence
  Synthetic Polynucleotide
taatacgactcactatagggggcagcagctgaggggagcggggccaggggaacagaggagacccctgatgccgctccccaacctggcggcagcgcaaaagatg

SEQ ID NO: 218886 - DNA, 103 bp, Artificial Sequence
  Synthetic Polynucleotide
taatacgactcactatagggcaggcacagaggcagcagctgaggggagcgaacagaggagacgctccatgcagctgctgaacctggcggcagcgcaaaagatg

SEQ ID NO: 218887 - DNA, 103 bp, Artificial Sequence
  Synthetic Polynucleotide
taatacgactcactatagggtcctgccacacaggcacagaggcagcagctaacagaggagaagctgcatgctctgtgccaacctggcggcagcgcaaaagatg

SEQ ID NO: 218888 - DNA, 103 bp, Artificial Sequence
  Synthetic Polynucleotide
taatacgactcactatagggaatggtacggtcctgccacacaggcacagaaacagaggagatctgtgatggtgtggcagaacctggcggcagcgcaaaagatg

SEQ ID NO: 218889 - DNA, 103 bp, Artificial Sequence
  Synthetic Polynucleotide
taatacgactcactataggggggaggaggcaatggtacggtcctgccacaaacagaggagatgtggcatgaccgtaccaaacctggcggcagcgcaaaagatg

SEQ ID NO: 218890 - DNA, 103 bp, Artificial Sequence
  Synthetic Polynucleotide
taatacgactcactatagggagccgcagccgggaggaggcaatggtacggaacagaggagaccgtacatgtgcctcctcaacctggcggcagcgcaaaagatg

SEQ ID NO: 218891 - DNA, 103 bp, Artificial Sequence
  Synthetic Polynucleotide
taatacgactcactatagggatactccaggagccgcagccgggaggaggcaacagaggagagcctccatgcggctgcggaacctggcggcagcgcaaaagatg

SEQ ID NO: 218892 - DNA, 103 bp, Artificial Sequence
  Synthetic Polynucleotide
taatacgactcactatagggtgaaggctgaatactccaggagccgcagccaacagaggagaggctgcatgtcctggagtaacctggcggcagcgcaaaagatg

SEQ ID NO: 218893 - DNA, 103 bp, Artificial Sequence
  Synthetic Polynucleotide
taatacgactcactatagggtgcacctccatgaaggctgaatactccaggaacagaggagacctggaatgttcagccttaacctggcggcagcgcaaaagatg

SEQ ID NO: 218894 - DNA, 103 bp, Artificial Sequence
  Synthetic Polynucleotide
taatacgactcactatagggatcgttgtccagccccttgtccaggccctcaacagaggagagagggcatggacaaggggaacctggcggcagcgcaaaagatg

SEQ ID NO: 218895 - DNA, 103 bp, Artificial Sequence
  Synthetic Polynucleotide
taatacgactcactatagggagggtctcgctgcacctccatgaaggctgaaacagaggagatcagccatgatggaggtgaacctggcggcagcgcaaaagatg

SEQ ID NO: 218896 - DNA, 103 bp, Artificial Sequence
  Synthetic Polynucleotide
taatacgactcactatagggtgtacgtgtcagggtctcgctgcacctccaaacagaggagatggaggatgagcgagaccaacctggcggcagcgcaaaagatg

SEQ ID NO: 218897 - DNA, 103 bp, Artificial Sequence
  Synthetic Polynucleotide
taatacgactcactatagggaggtgtttgctgtacgtgtcagggtctcgcaacagaggagagcgagaatgtgacacgtaaacctggcggcagcgcaaaagatg

SEQ ID NO: 218898 - DNA, 103 bp, Artificial Sequence
  Synthetic Polynucleotide
taatacgactcactataggggtgcacaaacaggtgtttgctgtacgtgtcaacagaggagagacacgatgagcaaacacaacctggcggcagcgcaaaagatg

SEQ ID NO: 218899 - DNA, 103 bp, Artificial Sequence
  Synthetic Polynucleotide
taatacgactcactatagggtctggccgatgtgcacaaacaggtgtttgcaacagaggagagcaaacatgtgtttgtgcaacctggcggcagcgcaaaagatg

SEQ ID NO: 218900 - DNA, 103 bp, Artificial Sequence
  Synthetic Polynucleotide
taatacgactcactataggggcggggttcgtctggccgatgtgcacaaacaacagaggagagtttgtatgcatcggccaaacctggcggcagcgcaaaagatg

SEQ ID NO: 218901 - DNA, 103 bp, Artificial Sequence
  Synthetic Polynucleotide
taatacgactcactataggggtctgagaaggcggggttcgtctggccgataacagaggagaatcggcatgacgaaccccaacctggcggcagcgcaaaagatg

SEQ ID NO: 218902 - DNA, 103 bp, Artificial Sequence
  Synthetic Polynucleotide
taatacgactcactatagggccaggggtgggtctgagaaggcggggttcgaacagaggagacgaaccatgccttctcagaacctggcggcagcgcaaaagatg

SEQ ID NO: 218903 - DNA, 103 bp, Artificial Sequence
  Synthetic Polynucleotide
taatacgactcactatagggtctactgcctccaggggtgggtctgagaagaacagaggagacttctcatgcccacccctaacctggcggcagcgcaaaagatg

SEQ ID NO: 218904 - DNA, 103 bp, Artificial Sequence
  Synthetic Polynucleotide
taatacgactcactatagggctggcgcacatctactgcctccaggggtggaacagaggagaccacccatggaggcagtaaacctggcggcagcgcaaaagatg

SEQ ID NO: 218905 - DNA, 103 bp, Artificial Sequence
  Synthetic Polynucleotide
taatacgactcactatagggcgccctccgcatcgttgtccagccccttgtaacagaggagaacaaggatgtggacaacgaacctggcggcagcgcaaaagatg

SEQ ID NO: 218906 - DNA, 103 bp, Artificial Sequence
  Synthetic Polynucleotide
taatacgactcactatagggtgtcatagatctggcgcacatctactgcctaacagaggagaaggcagatgatgtgcgccaacctggcggcagcgcaaaagatg

SEQ ID NO: 218907 - DNA, 103 bp, Artificial Sequence
  Synthetic Polynucleotide
taatacgactcactatagggtcggggaatttgtcatagatctggcgcacaaacagaggagatgtgcgatggatctatgaaacctggcggcagcgcaaaagatg

SEQ ID NO: 218908 - DNA, 103 bp, Artificial Sequence
  Synthetic Polynucleotide
taatacgactcactatagggtccctttttctcggggaatttgtcatagataacagaggagaatctatatgaaattccccaacctggcggcagcgcaaaagatg

SEQ ID NO: 218909 - DNA, 103 bp, Artificial Sequence
  Synthetic Polynucleotide
taatacgactcactatagggccttcaatcctccctttttctcggggaattaacagaggagaaattccatgagaaaaaggaacctggcggcagcgcaaaagatg

SEQ ID NO: 218910 - DNA, 103 bp, Artificial Sequence
  Synthetic Polynucleotide
taatacgactcactatagggtcatagagctccttcaatcctccctttttcaacagaggagagaaaaaatgaggattgaaaacctggcggcagcgcaaaagatg

SEQ ID NO: 218911 - DNA, 103 bp, Artificial Sequence
  Synthetic Polynucleotide
taatacgactcactataggggggccccttctcatagagctccttcaatccaacagaggagaggattgatggagctctataacctggcggcagcgcaaaagatg

SEQ ID NO: 218912 - DNA, 103 bp, Artificial Sequence
  Synthetic Polynucleotide
taatacgactcactatagggaggcattagggggccccttctcatagagctaacagaggagaagctctatgagaaggggcaacctggcggcagcgcaaaagatg

SEQ ID NO: 218913 - DNA, 103 bp, Artificial Sequence
  Synthetic Polynucleotide
taatacgactcactatagggacaaggaagaaggcattagggggccccttcaacagaggagagaagggatgccctaatgcaacctggcggcagcgcaaaagatg

SEQ ID NO: 218914 - DNA, 103 bp, Artificial Sequence
  Synthetic Polynucleotide
taatacgactcactatagggccagaacttgacaaggaagaaggcattaggaacagaggagacctaatatgttcttccttaacctggcggcagcgcaaaagatg

SEQ ID NO: 218915 - DNA, 103 bp, Artificial Sequence
  Synthetic Polynucleotide
taatacgactcactatagggtgaggtcggcccagaacttgacaaggaagaaacagaggagatcttccatgtcaagttctaacctggcggcagcgcaaaagatg

SEQ ID NO: 218916 - DNA, 103 bp, Artificial Sequence
  Synthetic Polynucleotide
taatacgactcactataggggggctccacacgccctccgcatcgttgtccaacagaggagaggacaaatgtgcggagggaacctggcggcagcgcaaaagatg

SEQ ID NO: 218917 - DNA, 103 bp, Artificial Sequence
  Synthetic Polynucleotide
taatacgactcactatagggatggtgctgttgaggtcggcccagaacttgaacagaggagacaagttatgggccgacctaacctggcggcagcgcaaaagatg

SEQ ID NO: 218918 - DNA, 103 bp, Artificial Sequence
  Synthetic Polynucleotide
taatacgactcactataggggccctcctggatggtgctgttgaggtcggcaacagaggagagccgacatgaacagcaccaacctggcggcagcgcaaaagatg

SEQ ID NO: 218919 - DNA, 103 bp, Artificial Sequence
  Synthetic Polynucleotide
taatacgactcactatagggaggctcccgggccctcctggatggtgctgtaacagaggagaacagcaatgtccaggaggaacctggcggcagcgcaaaagatg

SEQ ID NO: 218920 - DNA, 103 bp, Artificial Sequence
  Synthetic Polynucleotide
taatacgactcactatagggaccccatagaaggctcccgggccctcctggaacagaggagaccaggaatgcccgggagcaacctggcggcagcgcaaaagatg

SEQ ID NO: 218921 - DNA, 103 bp, Artificial Sequence
  Synthetic Polynucleotide
taatacgactcactatagggctgagagctgaccccatagaaggctcccggaacagaggagaccgggaatgttctatgggaacctggcggcagcgcaaaagatg

SEQ ID NO: 218922 - DNA, 103 bp, Artificial Sequence
  Synthetic Polynucleotide
taatacgactcactatagggcagagctgtactgagagctgaccccatagaaacagaggagatctatgatgtcagctctcaacctggcggcagcgcaaaagatg

SEQ ID NO: 218923 - DNA, 103 bp, Artificial Sequence
  Synthetic Polynucleotide
taatacgactcactatagggatgctatcagcagagctgtactgagagctgaacagaggagacagctcatggtacagctcaacctggcggcagcgcaaaagatg

SEQ ID NO: 218924 - DNA, 103 bp, Artificial Sequence
  Synthetic Polynucleotide
taatacgactcactataggggctgatggtcatgctatcagcagagctgtaaacagaggagatacagcatggctgatagcaacctggcggcagcgcaaaagatg

SEQ ID NO: 218925 - DNA, 103 bp, Artificial Sequence
  Synthetic Polynucleotide
taatacgactcactatagggtggtggagacgctgatggtcatgctatcagaacagaggagactgataatgtgaccatcaaacctggcggcagcgcaaaagatg

SEQ ID NO: 218926 - DNA, 103 bp, Artificial Sequence
  Synthetic Polynucleotide
taatacgactcactataggggagcacaccttggtggagacgctgatggtcaacagaggagagaccatatgcgtctccacaacctggcggcagcgcaaaagatg

SEQ ID NO: 218927 - DNA, 103 bp, Artificial Sequence
  Synthetic Polynucleotide
taatacgactcactataggggatgatctgtgcagacgacatggcagccataacagaggagaatggctatgatgtcgtctaacctggcggcagcgcaaaagatg

SEQ ID NO: 218928 - DNA, 103 bp, Artificial Sequence
  Synthetic Polynucleotide
taatacgactcactataggggcctggcaaagctccttgccaaaaccctgaaacagaggagatcagggatgtggcaaggaaacctggcggcagcgcaaaagatg

SEQ ID NO: 218929 - DNA, 103 bp, Artificial Sequence
  Synthetic Polynucleotide
taatacgactcactatagggttccggcttggcctggcaaagctccttgccaacagaggagaggcaagatgctttgccagaacctggcggcagcgcaaaagatg

SEQ ID NO: 218930 - DNA, 103 bp, Artificial Sequence
  Synthetic Polynucleotide
taatacgactcactatagggtcatgggacgttccggcttggcctggcaaaaacagaggagatttgccatgccaagccggaacctggcggcagcgcaaaagatg

SEQ ID NO: 218931 - DNA, 103 bp, Artificial Sequence
  Synthetic Polynucleotide
taatacgactcactatagggaggcttcacatcatgggacgttccggcttgaacagaggagacaagccatgacgtcccataacctggcggcagcgcaaaagatg

SEQ ID NO: 218932 - DNA, 103 bp, Artificial Sequence
  Synthetic Polynucleotide
taatacgactcactataggggctgagagaaaggcttcacatcatgggacgaacagaggagacgtcccatgatgtgaagcaacctggcggcagcgcaaaagatg

SEQ ID NO: 218933 - DNA, 103 bp, Artificial Sequence
  Synthetic Polynucleotide
taatacgactcactataggggcataggtttgctgagagaaaggcttcacaaacagaggagatgtgaaatgtttctctcaaacctggcggcagcgcaaaagatg

SEQ ID NO: 218934 - DNA, 103 bp, Artificial Sequence
  Synthetic Polynucleotide
taatacgactcactatagggaggctggacagcataggtttgctgagagaaaacagaggagattctctatgcaaacctataacctggcggcagcgcaaaagatg

SEQ ID NO: 218935 - DNA, 103 bp, Artificial Sequence
  Synthetic Polynucleotide
taatacgactcactataggggaggcagcggaggctggacagcataggtttaacagaggagaaaacctatgctgtccagcaacctggcggcagcgcaaaagatg

SEQ ID NO: 218936 - DNA, 103 bp, Artificial Sequence
  Synthetic Polynucleotide
taatacgactcactatagggaaccctggcagaggcagcggaggctggacaaacagaggagatgtccaatgtccgctgccaacctggcggcagcgcaaaagatg

SEQ ID NO: 218937 - DNA, 103 bp, Artificial Sequence
  Synthetic Polynucleotide
taatacgactcactatagggaggagactcaaaccctggcagaggcagcggaacagaggagaccgctgatgctgccagggaacctggcggcagcgcaaaagatg

SEQ ID NO: 218938 - DNA, 103 bp, Artificial Sequence
  Synthetic Polynucleotide
taatacgactcactatagggccgtggcggagatgatctgtgcagacgacaaacagaggagatgtcgtatgcacagatcaaacctggcggcagcgcaaaagatg

SEQ ID NO: 218939 - DNA, 103 bp, Artificial Sequence
  Synthetic Polynucleotide
taatacgactcactatagggcgggccctgcaggagactcaaaccctggcaaacagaggagatgccagatgttgagtctcaacctggcggcagcgcaaaagatg

SEQ ID NO: 218940 - DNA, 103 bp, Artificial Sequence
  Synthetic Polynucleotide
taatacgactcactatagggggcgatggggcgggccctgcaggagactcaaacagaggagatgagtcatgtgcagggccaacctggcggcagcgcaaaagatg

SEQ ID NO: 218941 - DNA, 103 bp, Artificial Sequence
  Synthetic Polynucleotide
taatacgactcactataggggggcgcagagggcgatggggcgggccctgcaacagaggagagcagggatggccccatcgaacctggcggcagcgcaaaagatg

SEQ ID NO: 218942 - DNA, 103 bp, Artificial Sequence
  Synthetic Polynucleotide
taatacgactcactatagggggggtgccgggggcgcagagggcgatggggaacagaggagaccccatatgcctctgcgcaacctggcggcagcgcaaaagatg

SEQ ID NO: 218943 - DNA, 103 bp, Artificial Sequence
  Synthetic Polynucleotide
taatacgactcactatagggccctgccatgggggtgccgggggcgcagagaacagaggagactctgcatgcccggcaccaacctggcggcagcgcaaaagatg

SEQ ID NO: 218944 - DNA, 103 bp, Artificial Sequence
  Synthetic Polynucleotide
taatacgactcactatagggcacgctgcggccctgccatgggggtgccggaacagaggagaccggcaatgccatggcagaacctggcggcagcgcaaaagatg

SEQ ID NO: 218945 - DNA, 103 bp, Artificial Sequence
  Synthetic Polynucleotide
taatacgactcactatagggtggagctggccacgctgcggccctgccatgaacagaggagacatggcatggccgcagcgaacctggcggcagcgcaaaagatg

SEQ ID NO: 218946 - DNA, 103 bp, Artificial Sequence
  Synthetic Polynucleotide
taatacgactcactatagggatccagagcttggagctggccacgctgcggaacagaggagaccgcagatgggccagctcaacctggcggcagcgcaaaagatg

SEQ ID NO: 218947 - DNA, 103 bp, Artificial Sequence
  Synthetic Polynucleotide
taatacgactcactataggggaactccaacatccagagcttggagctggcaacagaggagagccagcatgaagctctggaacctggcggcagcgcaaaagatg

SEQ ID NO: 218948 - DNA, 103 bp, Artificial Sequence
  Synthetic Polynucleotide
taatacgactcactatagggggaaggcagagaactccaacatccagagctaacagaggagaagctctatgtgttggagtaacctggcggcagcgcaaaagatg

SEQ ID NO: 218949 - DNA, 103 bp, Artificial Sequence
  Synthetic Polynucleotide
taatacgactcactatagggctgtggaaggccgtggcggagatgatctgtaacagaggagaacagatatgctccgccacaacctggcggcagcgcaaaagatg

SEQ ID NO: 218950 - DNA, 103 bp, Artificial Sequence
  Synthetic Polynucleotide
taatacgactcactatagggtgctgctccaggaaggcagagaactccaacaacagaggagagttggaatgctctgccttaacctggcggcagcgcaaaagatg

SEQ ID NO: 218951 - DNA, 103 bp, Artificial Sequence
  Synthetic Polynucleotide
taatacgactcactatagggcgggtcctgctgctgctccaggaaggcagaaacagaggagatctgccatgctggagcagaacctggcggcagcgcaaaagatg

SEQ ID NO: 218952 - DNA, 103 bp, Artificial Sequence
  Synthetic Polynucleotide
taatacgactcactatagggtgtacgtgtccgggtcctgctgctgctccaaacagaggagatggagcatgagcaggaccaacctggcggcagcgcaaaagatg

SEQ ID NO: 218953 - DNA, 103 bp, Artificial Sequence
  Synthetic Polynucleotide
taatacgactcactatagggaggtgcttgttgtacgtgtccgggtcctgcaacagaggagagcaggaatgggacacgtaaacctggcggcagcgcaaaagatg

SEQ ID NO: 218954 - DNA, 103 bp, Artificial Sequence
  Synthetic Polynucleotide
taatacgactcactataggggtgcacgaacaggtgcttgttgtacgtgtcaacagaggagagacacgatgaacaagcacaacctggcggcagcgcaaaagatg

SEQ ID NO: 218955 - DNA, 103 bp, Artificial Sequence
  Synthetic Polynucleotide
taatacgactcactatagggactggccaatgtgcacgaacaggtgcttgtaacagaggagaacaagcatgtgttcgtgcaacctggcggcagcgcaaaagatg

SEQ ID NO: 218956 - DNA, 103 bp, Artificial Sequence
  Synthetic Polynucleotide
taatacgactcactatagggcttgggctggactggccaatgtgcacgaacaacagaggagagttcgtatgcattggccaaacctggcggcagcgcaaaagatg

SEQ ID NO: 218957 - DNA, 103 bp, Artificial Sequence
  Synthetic Polynucleotide
taatacgactcactataggggtcgctgtagcttgggctggactggccaataacagaggagaattggcatgtccagcccaaacctggcggcagcgcaaaagatg

SEQ ID NO: 218958 - DNA, 103 bp, Artificial Sequence
  Synthetic Polynucleotide
taatacgactcactatagggcgaggtaggggtcgctgtagcttgggctggaacagaggagaccagccatggctacagcgaacctggcggcagcgcaaaagatg

SEQ ID NO: 218959 - DNA, 103 bp, Artificial Sequence
  Synthetic Polynucleotide
taatacgactcactatagggtccacggcttcgaggtaggggtcgctgtagaacagaggagactacagatgcccctacctaacctggcggcagcgcaaaagatg

SEQ ID NO: 218960 - DNA, 103 bp, Artificial Sequence
  Synthetic Polynucleotide
taatacgactcactatagggggccatgctactgtggaaggccgtggcggaaacagaggagatccgccatggccttccacaacctggcggcagcgcaaaagatg

SEQ ID NO: 218961 - DNA, 103 bp, Artificial Sequence
  Synthetic Polynucleotide
taatacgactcactatagggttggcggatgtccacggcttcgaggtagggaacagaggagaccctacatggaagccgtgaacctggcggcagcgcaaaagatg

SEQ ID NO: 218962 - DNA, 103 bp, Artificial Sequence
  Synthetic Polynucleotide
taatacgactcactatagggtgtcatagatttggcggatgtccacggcttaacagaggagaaagccgatgacatccgccaacctggcggcagcgcaaaagatg

SEQ ID NO: 218963 - DNA, 103 bp, Artificial Sequence
  Synthetic Polynucleotide
taatacgactcactatagggtccgggaatttgtcatagatttggcggatgaacagaggagacatccgatgaatctatgaaacctggcggcagcgcaaaagatg

SEQ ID NO: 218964 - DNA, 103 bp, Artificial Sequence
  Synthetic Polynucleotide
taatacgactcactatagggaccctttttctccgggaatttgtcatagataacagaggagaatctatatgaaattcccgaacctggcggcagcgcaaaagatg

SEQ ID NO: 218965 - DNA, 103 bp, Artificial Sequence
  Synthetic Polynucleotide
taatacgactcactatagggccttgagtccaccctttttctccgggaattaacagaggagaaattccatgagaaaaaggaacctggcggcagcgcaaaagatg

SEQ ID NO: 218966 - DNA, 103 bp, Artificial Sequence
  Synthetic Polynucleotide
taatacgactcactatagggtcgaagagatccttgagtccaccctttttcaacagaggagagaaaaaatgtggactcaaaacctggcggcagcgcaaaagatg

SEQ ID NO: 218967 - DNA, 103 bp, Artificial Sequence
  Synthetic Polynucleotide
taatacgactcactataggggggtccccgttcgaagagatccttgagtccaacagaggagaggactcatggatctcttcaacctggcggcagcgcaaaagatg

SEQ ID NO: 218968 - DNA, 103 bp, Artificial Sequence
  Synthetic Polynucleotide
taatacgactcactatagggaggcattggagggtccccgttcgaagagataacagaggagaatctctatgaacggggacaacctggcggcagcgcaaaagatg

SEQ ID NO: 218969 - DNA, 103 bp, Artificial Sequence
  Synthetic Polynucleotide
taatacgactcactatagggacaagaaaaaaggcattggagggtccccgtaacagaggagaacggggatgctccaatgcaacctggcggcagcgcaaaagatg

SEQ ID NO: 218970 - DNA, 103 bp, Artificial Sequence
  Synthetic Polynucleotide
taatacgactcactatagggccagaacttcacaagaaaaaaggcattggaaacagaggagatccaatatgttttttcttaacctggcggcagcgcaaaagatg

SEQ ID NO: 218971 - DNA, 103 bp, Artificial Sequence
  Synthetic Polynucleotide
taatacgactcactatagggcccgggcgagggccatgctactgtggaaggaacagaggagaccttccatggtagcatggaacctggcggcagcgcaaaagatg

SEQ ID NO: 218972 - DNA, 103 bp, Artificial Sequence
  Synthetic Polynucleotide
taatacgactcactatagggtgaggtctgcccagaacttcacaagaaaaaaacagaggagatttttcatgtgaagttctaacctggcggcagcgcaaaagatg

SEQ ID NO: 218973 - DNA, 103 bp, Artificial Sequence
  Synthetic Polynucleotide
taatacgactcactatagggatgttggtgttgaggtctgcccagaacttcaacagaggagagaagttatgggcagacctaacctggcggcagcgcaaaagatg

SEQ ID NO: 218974 - DNA, 103 bp, Artificial Sequence
  Synthetic Polynucleotide
taatacgactcactatagggttcatcctcgatgttggtgttgaggtctgcaacagaggagagcagacatgaacaccaacaacctggcggcagcgcaaaagatg

SEQ ID NO: 218975 - DNA, 103 bp, Artificial Sequence
  Synthetic Polynucleotide
taatacgactcactatagggaggagctgccttcatcctcgatgttggtgtaacagaggagaacaccaatgtcgaggatgaacctggcggcagcgcaaaagatg

SEQ ID NO: 218976 - DNA, 103 bp, Artificial Sequence
  Synthetic Polynucleotide
taatacgactcactatagggaccccatagaaggagctgccttcatcctcgaacagaggagacgaggaatgaggcagctcaacctggcggcagcgcaaaagatg

SEQ ID NO: 218977 - DNA, 103 bp, Artificial Sequence
  Synthetic Polynucleotide
taatacgactcactatagggctggctggagaccccatagaaggagctgccaacagaggagaggcagcatgttctatgggaacctggcggcagcgcaaaagatg

SEQ ID NO: 218978 - DNA, 103 bp, Artificial Sequence
  Synthetic Polynucleotide
taatacgactcactatagggggctctcatactggctggagaccccatagaaacagaggagatctatgatgtctccagccaacctggcggcagcgcaaaagatg

SEQ ID NO: 218979 - DNA, 103 bp, Artificial Sequence
  Synthetic Polynucleotide
taatacgactcactatagggatgttctcggggctctcatactggctggagaacagaggagactccagatggtatgagagaacctggcggcagcgcaaaagatg

SEQ ID NO: 218980 - DNA, 103 bp, Artificial Sequence
  Synthetic Polynucleotide
taatacgactcactatagggggtgatgatcatgttctcggggctctcataaacagaggagatatgagatgcccgagaacaacctggcggcagcgcaaaagatg

SEQ ID NO: 218981 - DNA, 103 bp, Artificial Sequence
  Synthetic Polynucleotide
taatacgactcactatagggtcgtggagcaggtgatgatcatgttctcggaacagaggagaccgagaatgtgatcatcaaacctggcggcagcgcaaaagatg

SEQ ID NO: 218982 - DNA, 103 bp, Artificial Sequence
  Synthetic Polynucleotide
taatacgactcactatagggcggccggggccccgggcgagggccatgctaaacagaggagatagcatatgcctcgcccgaacctggcggcagcgcaaaagatg

SEQ ID NO: 218983 - DNA, 103 bp, Artificial Sequence
  Synthetic Polynucleotide
taatacgactcactataggggagcagaccttcgtggagcaggtgatgatcaacagaggagagatcatatgctgctccacaacctggcggcagcgcaaaagatg

SEQ ID NO: 218984 - DNA, 103 bp, Artificial Sequence
  Synthetic Polynucleotide
taatacgactcactatagggcttgccgaaagagcagaccttcgtggagcaaacagaggagatgctccatgaaggtctgcaacctggcggcagcgcaaaagatg

SEQ ID NO: 218985 - DNA, 103 bp, Artificial Sequence
  Synthetic Polynucleotide
taatacgactcactatagggccaccacctgcttgccgaaagagcagacctaacagaggagaaggtctatgctttcggcaaacctggcggcagcgcaaaagatg

SEQ ID NO: 218986 - DNA, 103 bp, Artificial Sequence
  Synthetic Polynucleotide
taatacgactcactatagggtcaactttctccaccacctgcttgccgaaaaacagaggagatttcggatggcaggtggtaacctggcggcagcgcaaaagatg

SEQ ID NO: 218987 - DNA, 103 bp, Artificial Sequence
  Synthetic Polynucleotide
taatacgactcactatagggatactctgtctcaactttctccaccacctgaacagaggagacaggtgatggagaaagttaacctggcggcagcgcaaaagatg

SEQ ID NO: 218988 - DNA, 103 bp, Artificial Sequence
  Synthetic Polynucleotide
taatacgactcactatagggcatagcgagcatactctgtctcaactttctaacagaggagaagaaagatgagacagagtaacctggcggcagcgcaaaagatg

SEQ ID NO: 218989 - DNA, 103 bp, Artificial Sequence
  Synthetic Polynucleotide
taatacgactcactatagggtgtccattctcatagcgagcatactctgtcaacagaggagagacagaatgtgctcgctaaacctggcggcagcgcaaaagatg

SEQ ID NO: 218990 - DNA, 103 bp, Artificial Sequence
  Synthetic Polynucleotide
taatacgactcactataggggtaagagtagtgtccattctcatagcgagcaacagaggagagctcgcatggagaatggaaacctggcggcagcgcaaaagatg

SEQ ID NO: 218991 - DNA, 103 bp, Artificial Sequence
  Synthetic Polynucleotide
taatacgactcactatagggggtggatgcggtaagagtagtgtccattctaacagaggagaagaatgatgactactcttaacctggcggcagcgcaaaagatg

SEQ ID NO: 218992 - DNA, 103 bp, Artificial Sequence
  Synthetic Polynucleotide
taatacgactcactatagggagcggggaccggtggatgcggtaagagtagaacagaggagactactcatgccgcatccaaacctggcggcagcgcaaaagatg

SEQ ID NO: 218993 - DNA, 103 bp, Artificial Sequence
  Synthetic Polynucleotide
taatacgactcactataggggactgctgggcggccggggccccgggcgagaacagaggagactcgccatgggccccggcaacctggcggcagcgcaaaagatg

SEQ ID NO: 218994 - DNA, 103 bp, Artificial Sequence
  Synthetic Polynucleotide
taatacgactcactataggggtactcacagagcggggaccggtggatgcgaacagaggagacgcatcatgcggtccccgaacctggcggcagcgcaaaagatg

SEQ ID NO: 218995 - DNA, 103 bp, Artificial Sequence
  Synthetic Polynucleotide
taatacgactcactatagggagttgatcatgtactcacagagcggggaccaacagaggagaggtcccatgtctgtgagtaacctggcggcagcgcaaaagatg

SEQ ID NO: 218996 - DNA, 103 bp, Artificial Sequence
  Synthetic Polynucleotide
taatacgactcactatagggttgtggatgaagttgatcatgtactcacagaacagaggagactgtgaatgcatgatcaaaacctggcggcagcgcaaaagatg

SEQ ID NO: 218997 - DNA, 103 bp, Artificial Sequence
  Synthetic Polynucleotide
taatacgactcactataggggtgcttgagcttgtggatgaagttgatcataacagaggagaatgatcatgttcatccacaacctggcggcagcgcaaaagatg

SEQ ID NO: 218998 - DNA, 103 bp, Artificial Sequence
  Synthetic Polynucleotide
taatacgactcactatagggtctcagggaggtgcttgagcttgtggatgaaacagaggagatcatccatgagctcaagcaacctggcggcagcgcaaaagatg

SEQ ID NO: 218999 - DNA, 103 bp, Artificial Sequence
  Synthetic Polynucleotide
taatacgactcactatagggatcatgtacttctcagggaggtgcttgagcaacagaggagagctcaaatgcctccctgaaacctggcggcagcgcaaaagatg

SEQ ID NO: 219000 - DNA, 103 bp, Artificial Sequence
  Synthetic Polynucleotide
taatacgactcactatagggcacgctgttcatcatgtacttctcagggagaacagaggagactccctatgaagtacatgaacctggcggcagcgcaaaagatg

SEQ ID NO: 219001 - DNA, 103 bp, Artificial Sequence; identical to SEQ ID NO: 218818
  Synthetic Polynucleotide

SEQ ID NO: 219002 - DNA, 103 bp, Artificial Sequence; identical to SEQ ID NO: 218819
  Synthetic Polynucleotide

SEQ ID NO: 219003 - DNA, 103 bp, Artificial Sequence; identical to SEQ ID NO: 218820
  Synthetic Polynucleotide

SEQ ID NO: 219004 - DNA, 103 bp, Artificial Sequence
  Synthetic Polynucleotide
taatacgactcactatagggaaaaccctgagactgctgggcggccggggcaacagaggagagccccgatggcccagcagaacctggcggcagcgcaaaagatg

SEQ ID NO: 219005 - DNA, 103 bp, Artificial Sequence
  Synthetic Polynucleotide
taatacgactcactatagggctctgttggtgaccacctgcaggatggtgaaacagaggagatcaccaatgtgcaggtggaacctggcggcagcgcaaaagatg

SEQ ID NO: 219006 - DNA, 103 bp, Artificial Sequence
  Synthetic Polynucleotide
taatacgactcactatagggtcctgtgtgtctctgttggtgaccacctgcaacagaggagagcaggtatgcaccaacagaacctggcggcagcgcaaaagatg

SEQ ID NO: 219007 - DNA, 103 bp, Artificial Sequence
  Synthetic Polynucleotide
taatacgactcactatagggcagcaaggtctcctgtgtgtctctgttggtaacagaggagaaccaacatggacacacagaacctggcggcagcgcaaaagatg

SEQ ID NO: 219008 - DNA, 103 bp, Artificial Sequence
  Synthetic Polynucleotide
taatacgactcactatagggaggcaatgcacagcaaggtctcctgtgtgtaacagaggagaacacacatgagaccttgcaacctggcggcagcgcaaaagatg

SEQ ID NO: 219009 - DNA, 103 bp, Artificial Sequence
  Synthetic Polynucleotide
taatacgactcactatagggtcaaagacataggcaatgcacagcaaggtcaacagaggagagaccttatggtgcattgcaacctggcggcagcgcaaaagatg

SEQ ID NO: 219010 - DNA, 103 bp, Artificial Sequence
  Synthetic Polynucleotide
taatacgactcactatagggggctgacacctcaaagacataggcaatgcaaacagaggagatgcattatgtatgtctttaacctggcggcagcgcaaaagatg

SEQ ID NO: 219011 - DNA, 103 bp, Artificial Sequence
  Synthetic Polynucleotide
taatacgactcactatagggcgtgctcactggctgacacctcaaagacataacagaggagaatgtctatgaggtgtcagaacctggcggcagcgcaaaagatg

SEQ ID NO: 219012 - DNA, 103 bp, Artificial Sequence
  Synthetic Polynucleotide
taatacgactcactatagggtgctgagccccgtgctcactggctgacaccaacagaggagaggtgtcatgcagtgagcaaacctggcggcagcgcaaaagatg

SEQ ID NO: 219013 - DNA, 103 bp, Artificial Sequence
  Synthetic Polynucleotide
taatacgactcactataggggtagatgtggtgctgagccccgtgctcactaacagaggagaagtgagatgggggctcagaacctggcggcagcgcaaaagatg

SEQ ID NO: 219014 - DNA, 103 bp, Artificial Sequence
  Synthetic Polynucleotide
taatacgactcactatagggtcaccagcctgtagatgtggtgctgagcccaacagaggagagggctcatgaccacatctaacctggcggcagcgcaaaagatg

SEQ ID NO: 219015 - DNA, 103 bp, Artificial Sequence
  Synthetic Polynucleotide
taatacgactcactataggggctccttgccaaaaccctgagactgctgggaacagaggagacccagcatgctcagggttaacctggcggcagcgcaaaagatg

SEQ ID NO: 219016 - DNA, 103 bp, Artificial Sequence
  Synthetic Polynucleotide
taatacgactcactatagggcggcttctttccgccgcccgcgtcggacataacagaggagaatgtccatggcgggcggcaacctggcggcagcgcaaaagatg

SEQ ID NO: 219017 - DNA, 103 bp, Artificial Sequence
  Synthetic Polynucleotide
taatacgactcactatagggcttcaggaccagggggaaggaccccgacagaacagaggagactgtcgatgtccttccccaacctggcggcagcgcaaaagatg

SEQ ID NO: 219018 - DNA, 103 bp, Artificial Sequence
  Synthetic Polynucleotide
taatacgactcactatagggccatcagcttcttcaggaccagggggaaggaacagaggagaccttccatgtggtcctgaaacctggcggcagcgcaaaagatg

SEQ ID NO: 219019 - DNA, 103 bp, Artificial Sequence
  Synthetic Polynucleotide
taatacgactcactatagggggggggttctccatcagcttcttcaggaccaacagaggagaggtcctatggaagctgataacctggcggcagcgcaaaagatg

SEQ ID NO: 219020 - DNA, 103 bp, Artificial Sequence
  Synthetic Polynucleotide
taatacgactcactatagggcgcctcgcgcggggggttctccatcagcttaacagaggagaaagctgatggagaaccccaacctggcggcagcgcaaaagatg

SEQ ID NO: 219021 - DNA, 103 bp, Artificial Sequence
  Synthetic Polynucleotide
taatacgactcactatagggtatcgaggcgcgcctcgcgcggggggttctaacagaggagaagaaccatgcgcgcgaggaacctggcggcagcgcaaaagatg

SEQ ID NO: 219022 - DNA, 103 bp, Artificial Sequence
  Synthetic Polynucleotide
taatacgactcactatagggcccttttccttatcgaggcgcgcctcgcgcaacagaggagagcgcgaatggcgcctcgaaacctggcggcagcgcaaaagatg

SEQ ID NO: 219023 - DNA, 103 bp, Artificial Sequence
  Synthetic Polynucleotide
taatacgactcactatagggcttttccttccccttttccttatcgaggcgaacagaggagacgcctcatgaaggaaaagaacctggcggcagcgcaaaagatg

SEQ ID NO: 219024 - DNA, 103 bp, Artificial Sequence
  Synthetic Polynucleotide
taatacgactcactatagggcctcctccagcttttccttccccttttcctaacagaggagaaggaaaatgggaaggaaaaacctggcggcagcgcaaaagatg

SEQ ID NO: 219025 - DNA, 103 bp, Artificial Sequence
  Synthetic Polynucleotide
taatacgactcactataggggcggcctcgtcctcctccagcttttccttcaacagaggagagaaggaatggctggaggaaacctggcggcagcgcaaaagatg

SEQ ID NO: 219026 - DNA, 103 bp, Artificial Sequence
  Synthetic Polynucleotide
taatacgactcactataggggctggcggctgcggcctcgtcctcctccagaacagaggagactggagatggacgaggccaacctggcggcagcgcaaaagatg

SEQ ID NO: 219027 - DNA, 103 bp, Artificial Sequence
  Synthetic Polynucleotide
taatacgactcactatagggggtccacaggcggcttctttccgccgcccgaacagaggagacgggcgatggaaagaagcaacctggcggcagcgcaaaagatg

SEQ ID NO: 219028 - DNA, 103 bp, Artificial Sequence
  Synthetic Polynucleotide
taatacgactcactatagggcagccatggtgctggcggctgcggcctcgtaacagaggagaacgaggatgcagccgccaaacctggcggcagcgcaaaagatg

SEQ ID NO: 219029 - DNA, 103 bp, Artificial Sequence
  Synthetic Polynucleotide
taatacgactcactataggggaggctgagacagccatggtgctggcggctaacagaggagaagccgcatgcaccatggcaacctggcggcagcgcaaaagatg

SEQ ID NO: 219030 - DNA, 103 bp, Artificial Sequence
  Synthetic Polynucleotide
taatacgactcactatagggtggcatgagggaggctgagacagccatggtaacagaggagaaccatgatggtctcagccaacctggcggcagcgcaaaagatg

SEQ ID NO: 219031 - DNA, 103 bp, Artificial Sequence
  Synthetic Polynucleotide
taatacgactcactatagggcccagatgggtggcatgagggaggctgagaaacagaggagatctcagatgccctcatgcaacctggcggcagcgcaaaagatg

SEQ ID NO: 219032 - DNA, 103 bp, Artificial Sequence
  Synthetic Polynucleotide
taatacgactcactatagggatggtcttgtcccagatgggtggcatgaggaacagaggagacctcatatgacccatctgaacctggcggcagcgcaaaagatg

SEQ ID NO: 219033 - DNA, 103 bp, Artificial Sequence
  Synthetic Polynucleotide
taatacgactcactatagggatcatatgggatggtcttgtcccagatgggaacagaggagacccatcatggacaagaccaacctggcggcagcgcaaaagatg

SEQ ID NO: 219034 - DNA, 103 bp, Artificial Sequence
  Synthetic Polynucleotide
taatacgactcactatagggaagattcgccatcatatgggatggtcttgtaacagaggagaacaagaatgtcccatatgaacctggcggcagcgcaaaagatg

SEQ ID NO: 219035 - DNA, 103 bp, Artificial Sequence
  Synthetic Polynucleotide
taatacgactcactatagggtccaggtggaaagattcgccatcatatgggaacagaggagacccataatgtggcgaatcaacctggcggcagcgcaaaagatg

SEQ ID NO: 219036 - DNA, 103 bp, Artificial Sequence
  Synthetic Polynucleotide
taatacgactcactataggggtccatgtactccaggtggaaagattcgccaacagaggagaggcgaaatgttccacctgaacctggcggcagcgcaaaagatg

SEQ ID NO: 219037 - DNA, 103 bp, Artificial Sequence
  Synthetic Polynucleotide
taatacgactcactatagggactcatccaggtccatgtactccaggtggaaacagaggagatccaccatgagtacatggaacctggcggcagcgcaaaagatg

SEQ ID NO: 219038 - DNA, 103 bp, Artificial Sequence
  Synthetic Polynucleotide
taatacgactcactatagggcctgcctgcgggtccacaggcggcttctttaacagaggagaaaagaaatggcctgtggaaacctggcggcagcgcaaaagatg

SEQ ID NO: 219039 - DNA, 103 bp, Artificial Sequence
  Synthetic Polynucleotide
taatacgactcactatagggtccagcaggaactcatccaggtccatgtacaacagaggagagtacatatgcctggatgaaacctggcggcagcgcaaaagatg

SEQ ID NO: 219040 - DNA, 103 bp, Artificial Sequence
  Synthetic Polynucleotide
taatacgactcactataggggatgccattctccagcaggaactcatccagaacagaggagactggatatgttcctgctgaacctggcggcagcgcaaaagatg

SEQ ID NO: 219041 - DNA, 103 bp, Artificial Sequence
  Synthetic Polynucleotide
taatacgactcactatagggggctggcggggatgccattctccagcaggaaacagaggagatcctgcatgagaatggcaaacctggcggcagcgcaaaagatg

SEQ ID NO: 219042 - DNA, 103 bp, Artificial Sequence
  Synthetic Polynucleotide
taatacgactcactatagggaggtgggtggggctggcggggatgccattcaacagaggagagaatggatgccccgccagaacctggcggcagcgcaaaagatg

SEQ ID NO: 219043 - DNA, 103 bp, Artificial Sequence
  Synthetic Polynucleotide
taatacgactcactataggggttgtgggccaggtgggtggggctggcgggaacagaggagacccgccatgcccacccacaacctggcggcagcgcaaaagatg

SEQ ID NO: 219044 - DNA, 103 bp, Artificial Sequence
  Synthetic Polynucleotide
taatacgactcactataggggcagcagcaggttgtgggccaggtgggtggaacagaggagaccacccatgtggcccacaaacctggcggcagcgcaaaagatg

SEQ ID NO: 219045 - DNA, 103 bp, Artificial Sequence
  Synthetic Polynucleotide
taatacgactcactatagggtctgctacaggcagcagcaggttgtgggccaacagaggagaggcccaatgcctgctgctaacctggcggcagcgcaaaagatg

SEQ ID NO: 219046 - DNA, 103 bp, Artificial Sequence
  Synthetic Polynucleotide
taatacgactcactatagggcccttctagctctgctacaggcagcagcagaacagaggagactgctgatgcctgtagcaaacctggcggcagcgcaaaagatg

SEQ ID NO: 219047 - DNA, 103 bp, Artificial Sequence
  Synthetic Polynucleotide
taatacgactcactatagggcagactccttcccttctagctctgctacagaacagaggagactgtagatgagctagaagaacctggcggcagcgcaaaagatg

SEQ ID NO: 219048 - DNA, 103 bp, Artificial Sequence
  Synthetic Polynucleotide
taatacgactcactataggggaagagctggcagactccttcccttctagcaacagaggagagctagaatggaaggagtcaacctggcggcagcgcaaaagatg

SEQ ID NO: 219049 - DNA, 103 bp, Artificial Sequence
  Synthetic Polynucleotide
taatacgactcactatagggcggaccgggtcctgcctgcgggtccacaggaacagaggagacctgtgatgccgcaggcaaacctggcggcagcgcaaaagatg

SEQ ID NO: 219050 - DNA, 103 bp, Artificial Sequence
  Synthetic Polynucleotide
taatacgactcactatagggggatgctgtggaagagctggcagactccttaacagaggagaaaggagatggccagctctaacctggcggcagcgcaaaagatg

SEQ ID NO: 219051 - DNA, 103 bp, Artificial Sequence
  Synthetic Polynucleotide
taatacgactcactatagggaggatggtggggatgctgtggaagagctggaacagaggagaccagctatgccacagcataacctggcggcagcgcaaaagatg

SEQ ID NO: 219052 - DNA, 103 bp, Artificial Sequence
  Synthetic Polynucleotide
taatacgactcactataggggcagtggaggaggatggtggggatgctgtgaacagaggagacacagcatgcccaccatcaacctggcggcagcgcaaaagatg

SEQ ID NO: 219053 - DNA, 103 bp, Artificial Sequence
  Synthetic Polynucleotide
taatacgactcactatagggctgaaagatggcagtggaggaggatggtggaacagaggagaccaccaatgtcctccactaacctggcggcagcgcaaaagatg

SEQ ID NO: 219054 - DNA, 103 bp, Artificial Sequence
  Synthetic Polynucleotide
taatacgactcactatagggtttcagagggctgaaagatggcagtggaggaacagaggagacctccaatgccatctttcaacctggcggcagcgcaaaagatg

SEQ ID NO: 219055 - DNA, 103 bp, Artificial Sequence
  Synthetic Polynucleotide
taatacgactcactatagggctggacacggtttcagagggctgaaagatgaacagaggagacatcttatggccctctgaaacctggcggcagcgcaaaagatg

SEQ ID NO: 219056 - DNA, 103 bp, Artificial Sequence
  Synthetic Polynucleotide
taatacgactcactatagggagattctgtgctggacacggtttcagagggaacagaggagaccctctatgaccgtgtccaacctggcggcagcgcaaaagatg

SEQ ID NO: 219057 - DNA, 103 bp, Artificial Sequence
  Synthetic Polynucleotide
taatacgactcactatagggtctccagggaagattctgtgctggacacggaacagaggagaccgtgtatggcacagaataacctggcggcagcgcaaaagatg

SEQ ID NO: 219058 - DNA, 103 bp, Artificial Sequence
  Synthetic Polynucleotide
taatacgactcactatagggtccctctccttctccagggaagattctgtgaacagaggagacacagaatgttccctggaaacctggcggcagcgcaaaagatg

SEQ ID NO: 219059 - DNA, 103 bp, Artificial Sequence
  Synthetic Polynucleotide
taatacgactcactatagggactgggagtctccctctccttctccagggaaacagaggagatccctgatgaaggagaggaacctggcggcagcgcaaaagatg

SEQ ID NO: 219060 - DNA, 103 bp, Artificial Sequence
  Synthetic Polynucleotide
taatacgactcactataggggccccggccccggaccgggtcctgcctgcgaacagaggagacgcaggatggacccggtcaacctggcggcagcgcaaaagatg

SEQ ID NO: 219061 - DNA, 103 bp, Artificial Sequence
  Synthetic Polynucleotide
taatacgactcactatagggggtcgatgggactgggagtctccctctcctaacagaggagaaggagaatgagactcccaaacctggcggcagcgcaaaagatg

SEQ ID NO: 219062 - DNA, 103 bp, Artificial Sequence
  Synthetic Polynucleotide
taatacgactcactatagggacacaattggggtcgatgggactgggagtcaacagaggagagactccatgtcccatcgaaacctggcggcagcgcaaaagatg

SEQ ID NO: 219063 - DNA, 103 bp, Artificial Sequence
  Synthetic Polynucleotide
taatacgactcactatagggatccacttccacacaattggggtcgatgggaacagaggagacccatcatgcccaattgtaacctggcggcagcgcaaaagatg

SEQ ID NO: 219064 - DNA, 103 bp, Artificial Sequence
  Synthetic Polynucleotide
taatacgactcactatagggtgaagttcacatccacttccacacaattggaacagaggagaccaattatgtggaagtggaacctggcggcagcgcaaaagatg

SEQ ID NO: 219065 - DNA, 103 bp, Artificial Sequence
  Synthetic Polynucleotide
taatacgactcactataggggggtccggattgaagttcacatccacttccaacagaggagaggaagtatgtgtgaacttaacctggcggcagcgcaaaagatg

SEQ ID NO: 219066 - DNA, 103 bp, Artificial Sequence
  Synthetic Polynucleotide
taatacgactcactatagggcaggtcggcggggtccggattgaagttcacaacagaggagagtgaacatgaatccggacaacctggcggcagcgcaaaagatg

SEQ ID NO: 219067 - DNA, 103 bp, Artificial Sequence
  Synthetic Polynucleotide
taatacgactcactatagggtggagagcaccaggtcggcggggtccggataacagaggagaatccggatgccgccgaccaacctggcggcagcgcaaaagatg

SEQ ID NO: 219068 - DNA, 103 bp, Artificial Sequence
  Synthetic Polynucleotide
taatacgactcactatagggcctggcacactggagagcaccaggtcggcgaacagaggagacgccgaatgggtgctctcaacctggcggcagcgcaaaagatg

SEQ ID NO: 219069 - DNA, 103 bp, Artificial Sequence
  Synthetic Polynucleotide
taatacgactcactataggggagctccccgcctggcacactggagagcacaacagaggagagtgctcatgagtgtgccaaacctggcggcagcgcaaaagatg

SEQ ID NO: 219070 - DNA, 103 bp, Artificial Sequence
  Synthetic Polynucleotide
taatacgactcactataggggagggttgaagagctccccgcctggcacacaacagaggagagtgtgcatggcggggagcaacctggcggcagcgcaaaagatg

SEQ ID NO: 219071 - DNA, 103 bp, Artificial Sequence
  Synthetic Polynucleotide
taatacgactcactatagggccagctgcgcgccccggccccggaccgggtaacagaggagaacccggatgggggccgggaacctggcggcagcgcaaaagatg

SEQ ID NO: 219072 - DNA, 103 bp, Artificial Sequence
  Synthetic Polynucleotide
taatacgactcactatagggttgtgcttccgagggttgaagagctccccgaacagaggagacggggaatgcttcaacccaacctggcggcagcgcaaaagatg

SEQ ID NO: 219073 - DNA, 103 bp, Artificial Sequence
  Synthetic Polynucleotide
taatacgactcactatagggctcagcaaacttgtgcttccgagggttgaaaacagaggagattcaacatgcggaagcacaacctggcggcagcgcaaaagatg

SEQ ID NO: 219074 - DNA, 103 bp, Artificial Sequence
  Synthetic Polynucleotide
taatacgactcactatagggtcaggtcctcctcagcaaacttgtgcttccaacagaggagaggaagcatgagtttgctgaacctggcggcagcgcaaaagatg

SEQ ID NO: 219075 - DNA, 103 bp, Artificial Sequence
  Synthetic Polynucleotide
taatacgactcactatagggggctggggcttcaggtcctcctcagcaaacaacagaggagagtttgcatgggaggacctaacctggcggcagcgcaaaagatg

SEQ ID NO: 219076 - DNA, 103 bp, Artificial Sequence
  Synthetic Polynucleotide
taatacgactcactatagggtttgatcataggctggggcttcaggtcctcaacagaggagagaggacatgaagccccagaacctggcggcagcgcaaaagatg

SEQ ID NO: 219077 - DNA, 103 bp, Artificial Sequence
  Synthetic Polynucleotide
taatacgactcactatagggtcttggcctttttgatcataggctggggctaacagaggagaagccccatgctatgatcaaacctggcggcagcgcaaaagatg

SEQ ID NO: 219078 - DNA, 103 bp, Artificial Sequence
  Synthetic Polynucleotide
taatacgactcactatagggacaaagaccttcttggcctttttgatcataaacagaggagatatgatatgaaaggccaaaacctggcggcagcgcaaaagatg

SEQ ID NO: 219079 - DNA, 103 bp, Artificial Sequence
  Synthetic Polynucleotide
taatacgactcactatagggctcgtcggggacaaagaccttcttggccttaacagaggagaaaggccatgaaggtctttaacctggcggcagcgcaaaagatg

SEQ ID NO: 219080 - DNA, 103 bp, Artificial Sequence
  Synthetic Polynucleotide
taatacgactcactatagggcatccttctgctcgtcggggacaaagacctaacagaggagaaggtctatgtccccgacgaacctggcggcagcgcaaaagatg

SEQ ID NO: 219081 - DNA, 103 bp, Artificial Sequence
  Synthetic Polynucleotide
taatacgactcactatagggcagtacttttcatccttctgctcgtcggggaacagaggagaccccgaatggcagaaggaaacctggcggcagcgcaaaagatg

SEQ ID NO: 219082 - DNA, 103 bp, Artificial Sequence
  Synthetic Polynucleotide
taatacgactcactataggggcccctttccccagctgcgcgccccggcccaacagaggagagggccgatgcgcgcagctaacctggcggcagcgcaaaagatg

SEQ ID NO: 219083 - DNA, 103 bp, Artificial Sequence
  Synthetic Polynucleotide
taatacgactcactataggggcgtcttgtccagtacttttcatccttctgaacagaggagacagaagatggaaaagtacaacctggcggcagcgcaaaagatg

SEQ ID NO: 219084 - DNA, 103 bp, Artificial Sequence
  Synthetic Polynucleotide
taatacgactcactatagggtgttcttcttgcgtcttgtccagtacttttaacagaggagaaaaagtatgggacaagacaacctggcggcagcgcaaaagatg

SEQ ID NO: 219085 - DNA, 103 bp, Artificial Sequence
  Synthetic Polynucleotide
taatacgactcactataggggctgccacgttgttcttcttgcgtcttgtcaacagaggagagacaagatgcaagaagaaaacctggcggcagcgcaaaagatg

SEQ ID NO: 219086 - DNA, 103 bp, Artificial Sequence
  Synthetic Polynucleotide
taatacgactcactatagggtgaccgtttagctgccacgttgttcttcttaacagaggagaaagaagatgaacgtggcaaacctggcggcagcgcaaaagatg

SEQ ID NO: 219087 - DNA, 103 bp, Artificial Sequence
  Synthetic Polynucleotide
taatacgactcactataggggggcatcccgtgaccgtttagctgccacgtaacagaggagaacgtggatgctaaacggtaacctggcggcagcgcaaaagatg

SEQ ID NO: 219088 - DNA, 103 bp, Artificial Sequence
  Synthetic Polynucleotide
taatacgactcactatagggttcaggcgccgggcatcccgtgaccgtttaaacagaggagataaacgatgacgggatgcaacctggcggcagcgcaaaagatg

SEQ ID NO: 219089 - DNA, 103 bp, Artificial Sequence
  Synthetic Polynucleotide
taatacgactcactatagggctgattctctttcaggcgccgggcatcccgaacagaggagacgggatatgcggcgcctgaacctggcggcagcgcaaaagatg

SEQ ID NO: 219090 - DNA, 103 bp, Artificial Sequence
  Synthetic Polynucleotide
taatacgactcactatagggggatggtgatctgattctctttcaggcgccaacagaggagaggcgccatgaagagaatcaacctggcggcagcgcaaaagatg

SEQ ID NO: 219091 - DNA, 103 bp, Artificial Sequence
  Synthetic Polynucleotide
taatacgactcactatagggaaggctgcccggatggtgatctgattctctaacagaggagaagagaaatggatcaccataacctggcggcagcgcaaaagatg

SEQ ID NO: 219092 - DNA, 103 bp, Artificial Sequence
  Synthetic Polynucleotide
taatacgactcactatagggcttctccaggaaggctgcccggatggtgataacagaggagaatcaccatgcgggcagccaacctggcggcagcgcaaaagatg

SEQ ID NO: 219093 - DNA, 103 bp, Artificial Sequence
  Synthetic Polynucleotide
taatacgactcactatagggaccccgacaggcccctttccccagctgcgcaacagaggagagcgcagatggggaaagggaacctggcggcagcgcaaaagatg

SEQ ID NO: 219094 - DNA, 103 bp, Artificial Sequence
  Synthetic Polynucleotide
taatacgactcactatagggctgtgttctccttctccaggaaggctgcccaacagaggagagggcagatgtcctggagaaacctggcggcagcgcaaaagatg

SEQ ID NO: 219095 - DNA, 103 bp, Artificial Sequence
  Synthetic Polynucleotide
taatacgactcactataggggtccgcagggctgtgttctccttctccaggaacagaggagacctggaatgggagaacacaacctggcggcagcgcaaaagatg

SEQ ID NO: 219096 - DNA, 103 bp, Artificial Sequence
  Synthetic Polynucleotide
taatacgactcactatagggggccacctccgtccgcagggctgtgttctcaacagaggagagagaacatggccctgcggaacctggcggcagcgcaaaagatg

SEQ ID NO: 219097 - DNA, 103 bp, Artificial Sequence
  Synthetic Polynucleotide
taatacgactcactatagggtgcgtagctcggccacctccgtccgcagggaacagaggagaccctgcatgcggaggtggaacctggcggcagcgcaaaagatg

SEQ ID NO: 219098 - DNA, 103 bp, Artificial Sequence
  Synthetic Polynucleotide
taatacgactcactatagggcccacctccttgcgtagctcggccacctccaacagaggagaggaggtatgcgagctacgaacctggcggcagcgcaaaagatg

SEQ ID NO: 219099 - DNA, 103 bp, Artificial Sequence
  Synthetic Polynucleotide
taatacgactcactatagggcttgcacttgcccacctccttgcgtagctcaacagaggagagagctaatgaaggaggtgaacctggcggcagcgcaaaagatg

SEQ ID NO: 219100 - DNA, 103 bp, Artificial Sequence
  Synthetic Polynucleotide
taatacgactcactatagggacacgatggtcttgcacttgcccacctcctaacagaggagaaggaggatggcaagtgcaaacctggcggcagcgcaaaagatg

SEQ ID NO: 219101 - DNA, 103 bp, Artificial Sequence
  Synthetic Polynucleotide
taatacgactcactatagggtcatacttggacacgatggtcttgcacttgaacagaggagacaagtgatggaccatcgtaacctggcggcagcgcaaaagatg

SEQ ID NO: 219102 - DNA, 103 bp, Artificial Sequence
  Synthetic Polynucleotide
taatacgactcactataggggtatttggtctcatacttggacacgatggtaacagaggagaaccatcatgtccaagtataacctggcggcagcgcaaaagatg

SEQ ID NO: 219103 - DNA, 103 bp, Artificial Sequence
  Synthetic Polynucleotide
taatacgactcactatagggacaagggcccgtatttggtctcatacttggaacagaggagaccaagtatgagaccaaataacctggcggcagcgcaaaagatg

SEQ ID NO: 219104 - DNA, 103 bp, Artificial Sequence
  Synthetic Polynucleotide
taatacgactcactatagggagggggaaggaccccgacaggcccctttccaacagaggagaggaaagatgcctgtcgggaacctggcggcagcgcaaaagatg

SEQ ID NO: 219105 - DNA, 103 bp, Artificial Sequence
  Synthetic Polynucleotide
taatacgactcactatagggcacgccccacatgcttcggagaaacgccataacagaggagaatggcgatgctccgaagcaacctggcggcagcgcaaaagatg

SEQ ID NO: 219106 - DNA, 103 bp, Artificial Sequence
  Synthetic Polynucleotide
taatacgactcactatagggcctcggtaaatacacaaaactgaagggggaaacagaggagatcccccatgagttttgtgaacctggcggcagcgcaaaagatg

SEQ ID NO: 219107 - DNA, 103 bp, Artificial Sequence
  Synthetic Polynucleotide
taatacgactcactatagggatgaaaaccacctcggtaaatacacaaaacaacagaggagagttttgatgatttaccgaaacctggcggcagcgcaaaagatg

SEQ ID NO: 219108 - DNA, 103 bp, Artificial Sequence
  Synthetic Polynucleotide
taatacgactcactataggggccaagacagatgaaaaccacctcggtaaaaacagaggagatttaccatggtggttttcaacctggcggcagcgcaaaagatg

SEQ ID NO: 219109 - DNA, 103 bp, Artificial Sequence
  Synthetic Polynucleotide
taatacgactcactatagggtggacaacttgccaagacagatgaaaaccaaacagaggagatggtttatgtctgtcttgaacctggcggcagcgcaaaagatg

SEQ ID NO: 219110 - DNA, 103 bp, Artificial Sequence
  Synthetic Polynucleotide
taatacgactcactatagggcaggtttctttggacaacttgccaagacagaacagaggagactgtctatgcaagttgtcaacctggcggcagcgcaaaagatg

SEQ ID NO: 219111 - DNA, 103 bp, Artificial Sequence
  Synthetic Polynucleotide
taatacgactcactatagggtaagaacttacaggtttctttggacaacttaacagaggagaaagttgatgaaagaaaccaacctggcggcagcgcaaaagatg

SEQ ID NO: 219112 - DNA, 103 bp, Artificial Sequence
  Synthetic Polynucleotide
taatacgactcactatagggaaatcgaaggtaagaacttacaggtttcttaacagaggagaaagaaaatggtaagttctaacctggcggcagcgcaaaagatg

SEQ ID NO: 219113 - DNA, 103 bp, Artificial Sequence
  Synthetic Polynucleotide
taatacgactcactataggggttctttagaaaatcgaaggtaagaacttaaacagaggagataagttatgaccttcgataacctggcggcagcgcaaaagatg

SEQ ID NO: 219114 - DNA, 103 bp, Artificial Sequence
  Synthetic Polynucleotide
taatacgactcactatagggatgggtagttgttctttagaaaatcgaaggaacagaggagaccttcgatgttctaaagaaacctggcggcagcgcaaaagatg

SEQ ID NO: 219115 - DNA, 103 bp, Artificial Sequence
  Synthetic Polynucleotide
taatacgactcactatagggagctttaaatatgggtagttgttctttagaaacagaggagatctaaaatgcaactacccaacctggcggcagcgcaaaagatg

SEQ ID NO: 219116 - DNA, 103 bp, Artificial Sequence
  Synthetic Polynucleotide
taatacgactcactataggggggcactcagcacgccccacatgcttcggaaacagaggagatccgaaatgtgtggggcgaacctggcggcagcgcaaaagatg

SEQ ID NO: 219117 - DNA, 103 bp, Artificial Sequence
  Synthetic Polynucleotide
taatacgactcactatagggctgggttctgagctttaaatatgggtagttaacagaggagaaactacatgtatttaaagaacctggcggcagcgcaaaagatg

SEQ ID NO: 219118 - DNA, 103 bp, Artificial Sequence
  Synthetic Polynucleotide
taatacgactcactataggggtttttgcatctgggttctgagctttaaataacagaggagaatttaaatgtcagaacccaacctggcggcagcgcaaaagatg

SEQ ID NO: 219119 - DNA, 103 bp, Artificial Sequence
  Synthetic Polynucleotide
taatacgactcactatagggtagttctgtagtttttgcatctgggttctgaacagaggagacagaacatggatgcaaaaaacctggcggcagcgcaaaagatg

SEQ ID NO: 219120 - DNA, 103 bp, Artificial Sequence
  Synthetic Polynucleotide
taatacgactcactatagggttcttctaattagttctgtagtttttgcataacagaggagaatgcaaatgctacagaacaacctggcggcagcgcaaaagatg

SEQ ID NO: 219121 - DNA, 103 bp, Artificial Sequence
  Synthetic Polynucleotide
taatacgactcactatagggcgctgggcaattcttctaattagttctgtaaacagaggagatacagaatgaattagaagaacctggcggcagcgcaaaagatg

SEQ ID NO: 219122 - DNA, 103 bp, Artificial Sequence
  Synthetic Polynucleotide
taatacgactcactatagggttccctccaacgctgggcaattcttctaataacagaggagaattagaatgattgcccagaacctggcggcagcgcaaaagatg

SEQ ID NO: 219123 - DNA, 103 bp, Artificial Sequence
  Synthetic Polynucleotide
taatacgactcactatagggaatcaggaagttccctccaacgctgggcaaaacagaggagattgcccatggttggagggaacctggcggcagcgcaaaagatg

SEQ ID NO: 219124 - DNA, 103 bp, Artificial Sequence
  Synthetic Polynucleotide
taatacgactcactatagggtttttctttgaatcaggaagttccctccaaaacagaggagattggagatgacttcctgaaacctggcggcagcgcaaaagatg

SEQ ID NO: 219125 - DNA, 103 bp, Artificial Sequence
  Synthetic Polynucleotide
taatacgactcactatagggttgatatatttttttctttgaatcaggaagaacagaggagacttcctatgtcaaagaaaaacctggcggcagcgcaaaagatg

SEQ ID NO: 219126 - DNA, 103 bp, Artificial Sequence
  Synthetic Polynucleotide
taatacgactcactatagggtataagcatcttgatatatttttttctttgaacagaggagacaaagaatgaaatatatcaacctggcggcagcgcaaaagatg

SEQ ID NO: 219127 - DNA, 103 bp, Artificial Sequence
  Synthetic Polynucleotide
taatacgactcactataggggaccttcccagggcactcagcacgccccacaacagaggagagtggggatggctgagtgcaacctggcggcagcgcaaaagatg

SEQ ID NO: 219128 - DNA, 103 bp, Artificial Sequence
  Synthetic Polynucleotide
taatacgactcactatagggcactccgccctataagcatcttgatatattaacagaggagaaatataatgagatgcttaaacctggcggcagcgcaaaagatg

SEQ ID NO: 219129 - DNA, 103 bp, Artificial Sequence
  Synthetic Polynucleotide
taatacgactcactatagggatatacctgccactccgccctataagcatcaacagaggagagatgctatgagggcggagaacctggcggcagcgcaaaagatg

SEQ ID NO: 219130 - DNA, 103 bp, Artificial Sequence
  Synthetic Polynucleotide
taatacgactcactatagggtctcttctttatatacctgccactccgcccaacagaggagagggcggatgggcaggtataacctggcggcagcgcaaaagatg

SEQ ID NO: 219131 - DNA, 103 bp, Artificial Sequence
  Synthetic Polynucleotide
taatacgactcactatagggaatctgcttatctcttctttatatacctgcaacagaggagagcaggtatgtaaagaagaaacctggcggcagcgcaaaagatg

SEQ ID NO: 219132 - DNA, 103 bp, Artificial Sequence
  Synthetic Polynucleotide
taatacgactcactatagggctgttctttaaatctgcttatctcttctttaacagaggagaaaagaaatgataagcagaaacctggcggcagcgcaaaagatg

SEQ ID NO: 219133 - DNA, 103 bp, Artificial Sequence
  Synthetic Polynucleotide
taatacgactcactatagggttggagttagctgttctttaaatctgcttaaacagaggagataagcaatgttaaagaacaacctggcggcagcgcaaaagatg

SEQ ID NO: 219134 - DNA, 103 bp, Artificial Sequence
  Synthetic Polynucleotide
taatacgactcactatagggataatctgacttggagttagctgttctttaaacagaggagataaagaatggctaactccaacctggcggcagcgcaaaagatg

SEQ ID NO: 219135 - DNA, 103 bp, Artificial Sequence
  Synthetic Polynucleotide
taatacgactcactatagggttccaaagacataatctgacttggagttagaacagaggagactaactatgagtcagattaacctggcggcagcgcaaaagatg

SEQ ID NO: 219136 - DNA, 103 bp, Artificial Sequence
  Synthetic Polynucleotide
taatacgactcactatagggtgatttctttttccaaagacataatctgacaacagaggagagtcagaatgtgtctttggaacctggcggcagcgcaaaagatg

SEQ ID NO: 219137 - DNA, 103 bp, Artificial Sequence
  Synthetic Polynucleotide
taatacgactcactatagggtgtttgtccatgatttctttttccaaagacaacagaggagagtctttatgaaaagaaataacctggcggcagcgcaaaagatg

SEQ ID NO: 219138 - DNA, 103 bp, Artificial Sequence
  Synthetic Polynucleotide
taatacgactcactatagggctctgctccagaccttcccagggcactcagaacagaggagactgagtatgctgggaaggaacctggcggcagcgcaaaagatg

SEQ ID NO: 219139 - DNA, 103 bp, Artificial Sequence
  Synthetic Polynucleotide
taatacgactcactatagggcctttttaaatgtttgtccatgatttctttaacagaggagaaaagaaatgatggacaaaaacctggcggcagcgcaaaagatg

SEQ ID NO: 219140 - DNA, 103 bp, Artificial Sequence
  Synthetic Polynucleotide
taatacgactcactatagggtcatagctttcctttttaaatgtttgtccaaacagaggagatggacaatgatttaaaaaaacctggcggcagcgcaaaagatg

SEQ ID NO: 219141 - DNA, 103 bp, Artificial Sequence
  Synthetic Polynucleotide
taatacgactcactatagggtttttttttgtcatagctttcctttttaaaaacagaggagatttaaaatggaaagctataacctggcggcagcgcaaaagatg

SEQ ID NO: 219142 - DNA, 103 bp, Artificial Sequence
  Synthetic Polynucleotide
taatacgactcactatagggcagcttttcttttttttttgtcatagctttaacagaggagaaaagctatgacaaaaaaaaacctggcggcagcgcaaaagatg

SEQ ID NO: 219143 - DNA, 103 bp, Artificial Sequence
  Synthetic Polynucleotide
taatacgactcactatagggttacagtcttcagcttttcttttttttttgaacagaggagacaaaaaatgaagaaaagcaacctggcggcagcgcaaaagatg

SEQ ID NO: 219144 - DNA, 103 bp, Artificial Sequence
  Synthetic Polynucleotide
taatacgactcactatagggcagttttcctttacagtcttcagcttttctaacagaggagaagaaaaatggaagactgtaacctggcggcagcgcaaaagatg

SEQ ID NO: 219145 - DNA, 103 bp, Artificial Sequence
  Synthetic Polynucleotide
taatacgactcactatagggcagatttttccagttttcctttacagtcttaacagaggagaaagactatgaaggaaaacaacctggcggcagcgcaaaagatg

SEQ ID NO: 219146 - DNA, 103 bp, Artificial Sequence
  Synthetic Polynucleotide
taatacgactcactatagggcagagtcagacagatttttccagttttcctaacagaggagaaggaaaatgggaaaaatcaacctggcggcagcgcaaaagatg

SEQ ID NO: 219147 - DNA, 103 bp, Artificial Sequence
  Synthetic Polynucleotide
taatacgactcactatagggaattccttttcagagtcagacagatttttcaacagaggagagaaaaaatggtctgactcaacctggcggcagcgcaaaagatg

SEQ ID NO: 219148 - DNA, 103 bp, Artificial Sequence
  Synthetic Polynucleotide
taatacgactcactatagggctgaatatataattccttttcagagtcagaaacagaggagatctgacatggaaaaggaaaacctggcggcagcgcaaaagatg

SEQ ID NO: 219149 - DNA, 103 bp, Artificial Sequence
  Synthetic Polynucleotide
taatacgactcactatagggcggtgcacagctctgctccagaccttcccaaacagaggagatgggaaatgctggagcagaacctggcggcagcgcaaaagatg

SEQ ID NO: 219150 - DNA, 103 bp, Artificial Sequence
  Synthetic Polynucleotide
taatacgactcactatagggctttagcatgctgaatatataattccttttaacagaggagaaaaaggatgtatatattcaacctggcggcagcgcaaaagatg

SEQ ID NO: 219151 - DNA, 103 bp, Artificial Sequence
  Synthetic Polynucleotide
taatacgactcactataggggtttcgtcctctttagcatgctgaatatataacagaggagaatatatatggcatgctaaaacctggcggcagcgcaaaagatg

SEQ ID NO: 219152 - DNA, 103 bp, Artificial Sequence
  Synthetic Polynucleotide
taatacgactcactatagggatgataacgagtttcgtcctctttagcatgaacagaggagacatgctatggaggacgaaaacctggcggcagcgcaaaagatg

SEQ ID NO: 219153 - DNA, 103 bp, Artificial Sequence
  Synthetic Polynucleotide
taatacgactcactatagggtcatttcattatgataacgagtttcgtcctaacagaggagaaggacgatgctcgttatcaacctggcggcagcgcaaaagatg

SEQ ID NO: 219154 - DNA, 103 bp, Artificial Sequence
  Synthetic Polynucleotide
taatacgactcactatagggtcccaagacttcatttcattatgataacgaaacagaggagatcgttaatgtaatgaaataacctggcggcagcgcaaaagatg

SEQ ID NO: 219155 - DNA, 103 bp, Artificial Sequence
  Synthetic Polynucleotide
taatacgactcactatagggcatttgttcttcccaagacttcatttcattaacagaggagaaatgaaatgaagtcttggaacctggcggcagcgcaaaagatg

SEQ ID NO: 219156 - DNA, 103 bp, Artificial Sequence
  Synthetic Polynucleotide
taatacgactcactatagggcaacttcaatcatttgttcttcccaagactaacagaggagaagtcttatgaagaacaaaaacctggcggcagcgcaaaagatg

SEQ ID NO: 219157 - DNA, 103 bp, Artificial Sequence
  Synthetic Polynucleotide
taatacgactcactatagggtcctttcgtccaacttcaatcatttgttctaacagaggagaagaacaatggattgaagtaacctggcggcagcgcaaaagatg

SEQ ID NO: 219158 - DNA, 103 bp, Artificial Sequence
  Synthetic Polynucleotide
taatacgactcactatagggacgtagaagatcctttcgtccaacttcaataacagaggagaattgaaatgggacgaaagaacctggcggcagcgcaaaagatg

SEQ ID NO: 219159 - DNA, 103 bp, Artificial Sequence
  Synthetic Polynucleotide
taatacgactcactatagggttattgtgcgacgtagaagatcctttcgtcaacagaggagagacgaaatgatcttctacaacctggcggcagcgcaaaagatg

SEQ ID NO: 219160 - DNA, 103 bp, Artificial Sequence
  Synthetic Polynucleotide
taatacgactcactatagggcttccacagccggtgcacagctctgctccaaacagaggagatggagcatggctgtgcacaacctggcggcagcgcaaaagatg

SEQ ID NO: 219161 - DNA, 103 bp, Artificial Sequence
  Synthetic Polynucleotide
taatacgactcactatagggcgttgtttctttattgtgcgacgtagaagaaacagaggagatcttctatgtcgcacaataacctggcggcagcgcaaaagatg

SEQ ID NO: 219162 - DNA, 103 bp, Artificial Sequence
  Synthetic Polynucleotide
taatacgactcactatagggaccatattttcgttgtttctttattgtgcgaacagaggagacgcacaatgaagaaacaaaacctggcggcagcgcaaaagatg

SEQ ID NO: 219163 - DNA, 103 bp, Artificial Sequence
  Synthetic Polynucleotide
taatacgactcactatagggactcctcagcaccatattttcgttgtttctaacagaggagaagaaacatggaaaatatgaacctggcggcagcgcaaaagatg

SEQ ID NO: 219164 - DNA, 103 bp, Artificial Sequence
  Synthetic Polynucleotide
taatacgactcactataggggcgcagtcgacttccacagccggtgcacagaacagaggagactgtgcatgggctgtggaaacctggcggcagcgcaaaagatg

SEQ ID NO: 219165 - DNA, 103 bp, Artificial Sequence
  Synthetic Polynucleotide
taatacgactcactatagggtgaagggggagcgcagtcgacttccacagcaacagaggagagctgtgatggtcgactgcaacctggcggcagcgcaaaagatg

SEQ ID NO: 219166 - DNA, 103 bp, Artificial Sequence
  Synthetic Polynucleotide
taatacgactcactatagggtacacaaaactgaagggggagcgcagtcgaaacagaggagatcgactatgctcccccttaacctggcggcagcgcaaaagatg

SEQ ID NO: 219167 - DNA, 103 bp, Artificial Sequence
  Synthetic Polynucleotide
taatacgactcactatagggccagtcccccattttggcaagtatggacataacagaggagaatgtccatgcttgccaaaaacctggcggcagcgcaaaagatg

SEQ ID NO: 219168 - DNA, 103 bp, Artificial Sequence
  Synthetic Polynucleotide
taatacgactcactatagggcggcggggcgctcgtgtagggagattgaccaacagaggagaggtcaaatgccctacacgaacctggcggcagcgcaaaagatg

SEQ ID NO: 219169 - DNA, 103 bp, Artificial Sequence
  Synthetic Polynucleotide
taatacgactcactatagggtatctgttttgtagccaggagcatgtttttaacagaggagaaaaaacatgctcctggctaacctggcggcagcgcaaaagatg

SEQ ID NO: 219170 - DNA, 103 bp, Artificial Sequence
  Synthetic Polynucleotide
taatacgactcactatagggactctttgcatatctgttttgtagccaggaaacagaggagatcctggatgcaaaacagaaacctggcggcagcgcaaaagatg

SEQ ID NO: 219171 - DNA, 103 bp, Artificial Sequence
  Synthetic Polynucleotide
taatacgactcactatagggaggtcggtgaactctttgcatatctgttttaacagaggagaaaaacaatgatgcaaagaaacctggcggcagcgcaaaagatg

SEQ ID NO: 219172 - DNA, 103 bp, Artificial Sequence
  Synthetic Polynucleotide
taatacgactcactatagggctgagccagcaggtcggtgaactctttgcaaacagaggagatgcaaaatgttcaccgacaacctggcggcagcgcaaaagatg

SEQ ID NO: 219173 - DNA, 103 bp, Artificial Sequence
  Synthetic Polynucleotide
taatacgactcactataggggagatcggtcctgagccagcaggtcggtgaaacagaggagatcaccgatgtgctggctcaacctggcggcagcgcaaaagatg

SEQ ID NO: 219174 - DNA, 103 bp, Artificial Sequence
  Synthetic Polynucleotide
taatacgactcactatagggttccccaggggagatcggtcctgagccagcaacagaggagagctggcatgggaccgatcaacctggcggcagcgcaaaagatg

SEQ ID NO: 219175 - DNA, 103 bp, Artificial Sequence
  Synthetic Polynucleotide
taatacgactcactataggggggccgtgagttccccaggggagatcggtcaacagaggagagaccgaatgcccctggggaacctggcggcagcgcaaaagatg

SEQ ID NO: 219176 - DNA, 103 bp, Artificial Sequence
  Synthetic Polynucleotide
taatacgactcactatagggggatggggttgggccgtgagttccccagggaacagaggagaccctggatgactcacggcaacctggcggcagcgcaaaagatg

SEQ ID NO: 219177 - DNA, 103 bp, Artificial Sequence
  Synthetic Polynucleotide
taatacgactcactatagggccgggctccaggatggggttgggccgtgagaacagaggagactcacgatgcaaccccataacctggcggcagcgcaaaagatg

SEQ ID NO: 219178 - DNA, 103 bp, Artificial Sequence
  Synthetic Polynucleotide
taatacgactcactataggggctctggatgccgggctccaggatggggttaacagaggagaaaccccatgctggagcccaacctggcggcagcgcaaaagatg

SEQ ID NO: 219179 - DNA, 103 bp, Artificial Sequence
  Synthetic Polynucleotide
taatacgactcactatagggtgtgggacagcggcggggcgctcgtgtaggaacagaggagacctacaatggcgccccgcaacctggcggcagcgcaaaagatg

SEQ ID NO: 219180 - DNA, 103 bp, Artificial Sequence
  Synthetic Polynucleotide
taatacgactcactataggggggtcaagcagctctggatgccgggctccaaacagaggagatggagcatggcatccagaaacctggcggcagcgcaaaagatg

SEQ ID NO: 219181 - DNA, 103 bp, Artificial Sequence
  Synthetic Polynucleotide
taatacgactcactatagggaggttgaagtgggtcaagcagctctggatgaacagaggagacatccaatgctgcttgacaacctggcggcagcgcaaaagatg

SEQ ID NO: 219182 - DNA, 103 bp, Artificial Sequence
  Synthetic Polynucleotide
taatacgactcactataggggtgggagatgaggttgaagtgggtcaagcaaacagaggagatgcttgatgcacttcaacaacctggcggcagcgcaaaagatg

SEQ ID NO: 219183 - DNA, 103 bp, Artificial Sequence
  Synthetic Polynucleotide
taatacgactcactatagggtgccgaagccgtgggagatgaggttgaagtaacagaggagaacttcaatgtcatctcccaacctggcggcagcgcaaaagatg

SEQ ID NO: 219184 - DNA, 103 bp, Artificial Sequence
  Synthetic Polynucleotide
taatacgactcactatagggaccgcggggctgccgaagccgtgggagatgaacagaggagacatctcatgcggcttcggaacctggcggcagcgcaaaagatg

SEQ ID NO: 219185 - DNA, 103 bp, Artificial Sequence
  Synthetic Polynucleotide
taatacgactcactatagggcgcggcacacaccgcggggctgccgaagccaacagaggagaggcttcatgagccccgcgaacctggcggcagcgcaaaagatg

SEQ ID NO: 219186 - DNA, 103 bp, Artificial Sequence
  Synthetic Polynucleotide
taatacgactcactataggggggccgtgaccgcggcacacaccgcggggcaacagaggagagccccgatgtgtgtgccgaacctggcggcagcgcaaaagatg

SEQ ID NO: 219187 - DNA, 103 bp, Artificial Sequence
  Synthetic Polynucleotide
taatacgactcactatagggtagttctgcagggccgtgaccgcggcacacaacagaggagagtgtgcatgggtcacggcaacctggcggcagcgcaaaagatg

SEQ ID NO: 219188 - DNA, 103 bp, Artificial Sequence
  Synthetic Polynucleotide
taatacgactcactatagggctcggtgagatagttctgcagggccgtgacaacagaggagagtcacgatgctgcagaacaacctggcggcagcgcaaaagatg

SEQ ID NO: 219189 - DNA, 103 bp, Artificial Sequence
  Synthetic Polynucleotide
taatacgactcactatagggccttgagggcctcggtgagatagttctgcaaacagaggagatgcagaatgatctcaccgaacctggcggcagcgcaaaagatg

SEQ ID NO: 219190 - DNA, 103 bp, Artificial Sequence
  Synthetic Polynucleotide
taatacgactcactataggggcattgggggtgtgggacagcggcggggcgaacagaggagacgccccatggctgtcccaaacctggcggcagcgcaaaagatg

SEQ ID NO: 219191 - DNA, 103 bp, Artificial Sequence
  Synthetic Polynucleotide
taatacgactcactatagggttgtccatggccttgagggcctcggtgagaaacagaggagatctcacatgggccctcaaaacctggcggcagcgcaaaagatg

SEQ ID NO: 219192 - DNA, 103 bp, Artificial Sequence
  Synthetic Polynucleotide
taatacgactcactataggggaggtacattttgtccatggccttgagggcaacagaggagagccctcatggccatggacaacctggcggcagcgcaaaagatg

SEQ ID NO: 219193 - DNA, 103 bp, Artificial Sequence
  Synthetic Polynucleotide
taatacgactcactatagggggttgttgctgaggtacattttgtccatggaacagaggagaccatggatgaaatgtaccaacctggcggcagcgcaaaagatg

SEQ ID NO: 219194 - DNA, 103 bp, Artificial Sequence
  Synthetic Polynucleotide
taatacgactcactatagggtggctgttggggttgttgctgaggtacattaacagaggagaaatgtaatgcagcaacaaaacctggcggcagcgcaaaagatg

SEQ ID NO: 219195 - DNA, 103 bp, Artificial Sequence
  Synthetic Polynucleotide
taatacgactcactataggggttgtccgtgtggctgttggggttgttgctaacagaggagaagcaacatgcccaacagcaacctggcggcagcgcaaaagatg

SEQ ID NO: 219196 - DNA, 103 bp, Artificial Sequence
  Synthetic Polynucleotide
taatacgactcactatagggttttggcgttgttgtccgtgtggctgttggaacagaggagaccaacaatgacacggacaaacctggcggcagcgcaaaagatg

SEQ ID NO: 219197 - DNA, 103 bp, Artificial Sequence
  Synthetic Polynucleotide
taatacgactcactatagggttgtcactgcttttggcgttgttgtccgtgaacagaggagacacggaatgcaacgccaaaacctggcggcagcgcaaaagatg

SEQ ID NO: 219198 - DNA, 103 bp, Artificial Sequence
  Synthetic Polynucleotide
taatacgactcactatagggcttctcctctttgtcactgcttttggcgttaacagaggagaaacgccatgagcagtgacaacctggcggcagcgcaaaagatg

SEQ ID NO: 219199 - DNA, 103 bp, Artificial Sequence
  Synthetic Polynucleotide
taatacgactcactatagggactttctgtgcttctcctctttgtcactgcaacagaggagagcagtgatgaagaggagaaacctggcggcagcgcaaaagatg

SEQ ID NO: 219200 - DNA, 103 bp, Artificial Sequence
  Synthetic Polynucleotide
taatacgactcactatagggctggaagtcggcattgggggtgtgggacagaacagaggagactgtccatgacccccaataacctggcggcagcgcaaaagatg

SEQ ID NO: 219201 - DNA, 103 bp, Artificial Sequence
  Synthetic Polynucleotide
taatacgactcactatagggagtatgggggctggaagtcggcattgggggaacagaggagacccccaatgccgacttccaacctggcggcagcgcaaaagatg

SEQ ID NO: 219202 - DNA, 103 bp, Artificial Sequence
  Synthetic Polynucleotide
taatacgactcactatagggggtggggggaagtatgggggctggaagtcgaacagaggagacgacttatggcccccataaacctggcggcagcgcaaaagatg

SEQ ID NO: 219203 - DNA, 103 bp, Artificial Sequence
  Synthetic Polynucleotide
taatacgactcactatagggaggctggtagggtggggggaagtatgggggaacagaggagacccccaatgttccccccaaacctggcggcagcgcaaaagatg

SEQ ID NO: 219204 - DNA, 103 bp, Artificial Sequence
  Synthetic Polynucleotide
taatacgactcactataggggggggtagataggctggtagggtggggggaaacagaggagatcccccatgcctaccagcaacctggcggcagcgcaaaagatg

SEQ ID NO: 219205 - DNA, 103 bp, Artificial Sequence
  Synthetic Polynucleotide
taatacgactcactatagggtcttgcgactgggggtagataggctggtagaacagaggagactaccaatgtatctacccaacctggcggcagcgcaaaagatg

SEQ ID NO: 219206 - DNA, 103 bp, Artificial Sequence
  Synthetic Polynucleotide
taatacgactcactatagggggagtaaggatcttgcgactgggggtagataacagaggagaatctacatgcagtcgcaaaacctggcggcagcgcaaaagatg

SEQ ID NO: 219207 - DNA, 103 bp, Artificial Sequence
  Synthetic Polynucleotide
taatacgactcactataggggacggtcctgccagtcccccattttggcaaaacagaggagattgccaatgtgggggactaacctggcggcagcgcaaaagatg

SEQ ID NO: 219208 - DNA, 103 bp, Artificial Sequence
  Synthetic Polynucleotide
taatacgactcactatagggcgttgacgtgggagtaaggatcttgcgactaacagaggagaagtcgcatgatccttactaacctggcggcagcgcaaaagatg

SEQ ID NO: 219209 - DNA, 103 bp, Artificial Sequence
  Synthetic Polynucleotide
taatacgactcactatagggctgtaggggtcgttgacgtgggagtaaggaaacagaggagatccttaatgccacgtcaaaacctggcggcagcgcaaaagatg

SEQ ID NO: 219210 - DNA, 103 bp, Artificial Sequence
  Synthetic Polynucleotide
taatacgactcactatagggggggttcaggctgtaggggtcgttgacgtgaacagaggagacacgtcatggacccctacaacctggcggcagcgcaaaagatg

SEQ ID NO: 219211 - DNA, 103 bp, Artificial Sequence
  Synthetic Polynucleotide
taatacgactcactataggggggcgtgcagggggttcaggctgtaggggtaacagaggagaacccctatggcctgaaccaacctggcggcagcgcaaaagatg

SEQ ID NO: 219212 - DNA, 103 bp, Artificial Sequence
  Synthetic Polynucleotide
taatacgactcactatagggggctgcggctgggcgtgcagggggttcaggaacagaggagacctgaaatgcctgcacgcaacctggcggcagcgcaaaagatg

SEQ ID NO: 219213 - DNA, 103 bp, Artificial Sequence
  Synthetic Polynucleotide
taatacgactcactatagggtgggtgctgcggctgcggctgggcgtgcagaacagaggagactgcacatgcagccgcagaacctggcggcagcgcaaaagatg

SEQ ID NO: 219214 - DNA, 103 bp, Artificial Sequence
  Synthetic Polynucleotide
taatacgactcactatagggcgggccagcctgggtgctgcggctgcggctaacagaggagaagccgcatgcgcagcaccaacctggcggcagcgcaaaagatg

SEQ ID NO: 219215 - DNA, 103 bp, Artificial Sequence
  Synthetic Polynucleotide
taatacgactcactatagggtgcctctggccgggccagcctgggtgctgcaacagaggagagcagcaatgaggctggccaacctggcggcagcgcaaaagatg

SEQ ID NO: 219216 - DNA, 103 bp, Artificial Sequence
  Synthetic Polynucleotide
taatacgactcactatagggctcctggctctgcctctggccgggccagccaacagaggagaggctggatgggccagaggaacctggcggcagcgcaaaagatg

SEQ ID NO: 219217 - DNA, 103 bp, Artificial Sequence
  Synthetic Polynucleotide
taatacgactcactatagggggagcccagactcctggctctgcctctggcaacagaggagagccagaatgagagccaggaacctggcggcagcgcaaaagatg

SEQ ID NO: 219218 - DNA, 103 bp, Artificial Sequence
  Synthetic Polynucleotide
taatacgactcactataggggtgccgtcgtgacggtcctgccagtcccccaacagaggagagggggaatggcaggaccgaacctggcggcagcgcaaaagatg

SEQ ID NO: 219219 - DNA, 103 bp, Artificial Sequence
  Synthetic Polynucleotide
taatacgactcactatagggtgcgtgtgcaggagcccagactcctggctcaacagaggagagagccaatggtctgggctaacctggcggcagcgcaaaagatg

SEQ ID NO: 219220 - DNA, 103 bp, Artificial Sequence
  Synthetic Polynucleotide
taatacgactcactatagggcagcccccggtgcgtgtgcaggagcccagaaacagaggagatctgggatgctgcacacgaacctggcggcagcgcaaaagatg

SEQ ID NO: 219221 - DNA, 103 bp, Artificial Sequence
  Synthetic Polynucleotide
taatacgactcactataggggctggtgaggcagcccccggtgcgtgtgcaaacagaggagatgcacaatgaccgggggcaacctggcggcagcgcaaaagatg

SEQ ID NO: 219222 - DNA, 103 bp, Artificial Sequence
  Synthetic Polynucleotide
taatacgactcactatagggaggcccgacagctggtgaggcagcccccggaacagaggagaccggggatggcctcaccaaacctggcggcagcgcaaaagatg

SEQ ID NO: 219223 - DNA, 103 bp, Artificial Sequence
  Synthetic Polynucleotide
taatacgactcactataggggcgaggatccaggcccgacagctggtgaggaacagaggagacctcacatgctgtcgggcaacctggcggcagcgcaaaagatg

SEQ ID NO: 219224 - DNA, 103 bp, Artificial Sequence
  Synthetic Polynucleotide
taatacgactcactatagggtgtagtccctgcgaggatccaggcccgacaaacagaggagatgtcggatgtggatcctcaacctggcggcagcgcaaaagatg

SEQ ID NO: 219225 - DNA, 103 bp, Artificial Sequence
  Synthetic Polynucleotide
taatacgactcactatagggtcgtgccgcctgtagtccctgcgaggatccaacagaggagaggatccatgcagggactaaacctggcggcagcgcaaaagatg

SEQ ID NO: 219226 - DNA, 103 bp, Artificial Sequence
  Synthetic Polynucleotide
taatacgactcactatagggcaggaggtcctcgtgccgcctgtagtccctaacagaggagaagggacatgaggcggcacaacctggcggcagcgcaaaagatg

SEQ ID NO: 219227 - DNA, 103 bp, Artificial Sequence
  Synthetic Polynucleotide
taatacgactcactataggggtgggccgtgcaggaggtcctcgtgccgccaacagaggagaggcggcatgaggacctccaacctggcggcagcgcaaaagatg

SEQ ID NO: 219228 - DNA, 103 bp, Artificial Sequence
  Synthetic Polynucleotide
taatacgactcactatagggctgagcgcgtgtgggccgtgcaggaggtccaacagaggagaggacctatggcacggcccaacctggcggcagcgcaaaagatg

SEQ ID NO: 219229 - DNA, 103 bp, Artificial Sequence
  Synthetic Polynucleotide
taatacgactcactatagggcccgttgctggtgccgtcgtgacggtcctgaacagaggagacaggacatgcacgacggcaacctggcggcagcgcaaaagatg

SEQ ID NO: 219230 - DNA, 103 bp, Artificial Sequence
  Synthetic Polynucleotide
taatacgactcactataggggagtcctgagctgagcgcgtgtgggccgtgaacagaggagacacggcatgcacgcgctcaacctggcggcagcgcaaaagatg

SEQ ID NO: 219231 - DNA, 103 bp, Artificial Sequence
  Synthetic Polynucleotide
taatacgactcactatagggagaggtctccgagtcctgagctgagcgcgtaacagaggagaacgcgcatggctcaggacaacctggcggcagcgcaaaagatg

SEQ ID NO: 219232 - DNA, 103 bp, Artificial Sequence
  Synthetic Polynucleotide
taatacgactcactataggggagtggatcgagaggtctccgagtcctgagaacagaggagactcaggatgcggagacctaacctggcggcagcgcaaaagatg

SEQ ID NO: 219233 - DNA, 103 bp, Artificial Sequence
  Synthetic Polynucleotide
taatacgactcactataggggtgaggtaaggagtggatcgagaggtctccaacagaggagaggagacatgtcgatccacaacctggcggcagcgcaaaagatg

SEQ ID NO: 219234 - DNA, 103 bp, Artificial Sequence
  Synthetic Polynucleotide
taatacgactcactatagggcctcgatggcgtgaggtaaggagtggatcgaacagaggagacgatccatgccttacctcaacctggcggcagcgcaaaagatg

SEQ ID NO: 219235 - DNA, 103 bp, Artificial Sequence
  Synthetic Polynucleotide
taatacgactcactatagggtgcgggacctcctcgatggcgtgaggtaagaacagaggagacttaccatgcgccatcgaaacctggcggcagcgcaaaagatg

SEQ ID NO: 219236 - DNA, 103 bp, Artificial Sequence
  Synthetic Polynucleotide
taatacgactcactataggggtcttctacatgcgggacctcctcgatggcaacagaggagagccatcatggaggtcccgaacctggcggcagcgcaaaagatg

SEQ ID NO: 219237 - DNA, 103 bp, Artificial Sequence
  Synthetic Polynucleotide
taatacgactcactatagggtaatacccgggtcttctacatgcgggacctaacagaggagaaggtccatgatgtagaagaacctggcggcagcgcaaaagatg

SEQ ID NO: 219238 - DNA, 103 bp, Artificial Sequence
  Synthetic Polynucleotide
taatacgactcactatagggtctgggatgttaatacccgggtcttctacaaacagaggagatgtagaatgcccgggtataacctggcggcagcgcaaaagatg

SEQ ID NO: 219239 - DNA, 103 bp, Artificial Sequence
  Synthetic Polynucleotide
taatacgactcactatagggtacagtttgatctgggatgttaatacccggaacagaggagaccgggtatgaacatcccaaacctggcggcagcgcaaaagatg

SEQ ID NO: 219240 - DNA, 103 bp, Artificial Sequence
  Synthetic Polynucleotide
taatacgactcactatagggaccgtgccgtcccgttgctggtgccgtcgtaacagaggagaacgacgatgccagcaacgaacctggcggcagcgcaaaagatg

SEQ ID NO: 219241 - DNA, 103 bp, Artificial Sequence
  Synthetic Polynucleotide
taatacgactcactatagggctttcttaattacagtttgatctgggatgtaacagaggagaacatccatgatcaaactgaacctggcggcagcgcaaaagatg

SEQ ID NO: 219242 - DNA, 103 bp, Artificial Sequence
  Synthetic Polynucleotide
taatacgactcactataggggacacggggcctttcttaattacagtttgaaacagaggagatcaaacatgaattaagaaaacctggcggcagcgcaaaagatg

SEQ ID NO: 219243 - DNA, 103 bp, Artificial Sequence
  Synthetic Polynucleotide
taatacgactcactatagggcttggacagggacacggggcctttcttaataacagaggagaattaagatgggccccgtgaacctggcggcagcgcaaaagatg

SEQ ID NO: 219244 - DNA, 103 bp, Artificial Sequence
  Synthetic Polynucleotide
taatacgactcactatagggtgctgttggacttggacagggacacggggcaacagaggagagccccgatgccctgtccaaacctggcggcagcgcaaaagatg

SEQ ID NO: 219245 - DNA, 103 bp, Artificial Sequence
  Synthetic Polynucleotide
taatacgactcactataggggagacggcattgctgttggacttggacaggaacagaggagacctgtcatggtccaacagaacctggcggcagcgcaaaagatg

SEQ ID NO: 219246 - DNA, 103 bp, Artificial Sequence
  Synthetic Polynucleotide
taatacgactcactatagggagggatggcggagacggcattgctgttggaaacagaggagatccaacatgaatgccgtcaacctggcggcagcgcaaaagatg

SEQ ID NO: 219247 - DNA, 103 bp, Artificial Sequence
  Synthetic Polynucleotide
taatacgactcactatagggccttgttaatagggatggcggagacggcataacagaggagaatgccgatgccgccatccaacctggcggcagcgcaaaagatg

SEQ ID NO: 219248 - DNA, 103 bp, Artificial Sequence
  Synthetic Polynucleotide
taatacgactcactatagggaagaggttgtccttgttaatagggatggcgaacagaggagacgccatatgtattaacaaaacctggcggcagcgcaaaagatg

SEQ ID NO: 219249 - DNA, 103 bp, Artificial Sequence
  Synthetic Polynucleotide
taatacgactcactatagggcacgccgccgaagaggttgtccttgttaataacagaggagaattaacatggacaacctcaacctggcggcagcgcaaaagatg

SEQ ID NO: 219250 - DNA, 103 bp, Artificial Sequence
  Synthetic Polynucleotide
taatacgactcactatagggtggggttcaccacgccgccgaagaggttgtaacagaggagaacaaccatgtcggcggcgaacctggcggcagcgcaaaagatg

SEQ ID NO: 219251 - DNA, 103 bp, Artificial Sequence
  Synthetic Polynucleotide
taatacgactcactatagggagctggggcaaccgtgccgtcccgttgctgaacagaggagacagcaaatggacggcacgaacctggcggcagcgcaaaagatg

SEQ ID NO: 219252 - DNA, 103 bp, Artificial Sequence
  Synthetic Polynucleotide
taatacgactcactatagggaagacttcgttggggttcaccacgccgccgaacagaggagacggcggatgggtgaacccaacctggcggcagcgcaaaagatg

SEQ ID NO: 219253 - DNA, 103 bp, Artificial Sequence
  Synthetic Polynucleotide
taatacgactcactatagggaactgaacagaagacttcgttggggttcacaacagaggagagtgaacatgaacgaagtcaacctggcggcagcgcaaaagatg

SEQ ID NO: 219254 - DNA, 103 bp, Artificial Sequence
  Synthetic Polynucleotide
taatacgactcactatagggggcgacccggaactgaacagaagacttcgtaacagaggagaacgaagatgtctgttcagaacctggcggcagcgcaaaagatg

SEQ ID NO: 219255 - DNA, 103 bp, Artificial Sequence
  Synthetic Polynucleotide
taatacgactcactatagggaggagcgagaggcgacccggaactgaacagaacagaggagactgttcatgtccgggtcgaacctggcggcagcgcaaaagatg

SEQ ID NO: 219256 - DNA, 103 bp, Artificial Sequence
  Synthetic Polynucleotide
taatacgactcactatagggggtggagctgaggagcgagaggcgacccggaacagaggagaccgggtatgctctcgctcaacctggcggcagcgcaaaagatg

SEQ ID NO: 219257 - DNA, 103 bp, Artificial Sequence
  Synthetic Polynucleotide
taatacgactcactatagggtgtacttcgaggtggagctgaggagcgagaaacagaggagatctcgcatgtcagctccaaacctggcggcagcgcaaaagatg

SEQ ID NO: 219258 - DNA, 103 bp, Artificial Sequence
  Synthetic Polynucleotide
taatacgactcactatagggaccgtgaccttgtacttcgaggtggagctgaacagaggagacagctcatgctcgaagtaaacctggcggcagcgcaaaagatg

SEQ ID NO: 219259 - DNA, 103 bp, Artificial Sequence
  Synthetic Polynucleotide
taatacgactcactatagggcacttccgccaccgtgaccttgtacttcgaaacagaggagatcgaagatgaaggtcacgaacctggcggcagcgcaaaagatg

SEQ ID NO: 219260 - DNA, 103 bp, Artificial Sequence
  Synthetic Polynucleotide
taatacgactcactataggggccgccgctgcacttccgccaccgtgacctaacagaggagaaggtcaatgtggcggaagaacctggcggcagcgcaaaagatg

SEQ ID NO: 219261 - DNA, 103 bp, Artificial Sequence
  Synthetic Polynucleotide
taatacgactcactatagggggtggtgagagccgccgctgcacttccgccaacagaggagaggcggaatggcagcggcgaacctggcggcagcgcaaaagatg

SEQ ID NO: 219262 - DNA, 103 bp, Artificial Sequence
  Synthetic Polynucleotide
taatacgactcactatagggtacagtgcccagctggggcaaccgtgccgtaacagaggagaacggcaatgttgccccagaacctggcggcagcgcaaaagatg

SEQ ID NO: 219263 - DNA, 103 bp, Artificial Sequence
  Synthetic Polynucleotide
taatacgactcactataggggagacactcgggtggtgagagccgccgctgaacagaggagacagcggatgctctcaccaaacctggcggcagcgcaaaagatg

SEQ ID NO: 219264 - DNA, 103 bp, Artificial Sequence
  Synthetic Polynucleotide
taatacgactcactataggggcgacgcgttgagacactcgggtggtgagaaacagaggagatctcacatgccgagtgtcaacctggcggcagcgcaaaagatg

SEQ ID NO: 219265 - DNA, 103 bp, Artificial Sequence
  Synthetic Polynucleotide
taatacgactcactatagggccgcccagcagcgacgcgttgagacactcgaacagaggagacgagtgatgcaacgcgtcaacctggcggcagcgcaaaagatg

SEQ ID NO: 219266 - DNA, 103 bp, Artificial Sequence
  Synthetic Polynucleotide
taatacgactcactatagggccggagcactccgcccagcagcgacgcgttaacagaggagaaacgcgatgctgctgggcaacctggcggcagcgcaaaagatg

SEQ ID NO: 219267 - DNA, 103 bp, Artificial Sequence
  Synthetic Polynucleotide
taatacgactcactatagggacttcgccctccggagcactccgcccagcaaacagaggagatgctggatggagtgctccaacctggcggcagcgcaaaagatg

SEQ ID NO: 219268 - DNA, 103 bp, Artificial Sequence
  Synthetic Polynucleotide
taatacgactcactatagggccatttttagacttcgccctccggagcactaacagaggagaagtgctatggagggcgaaaacctggcggcagcgcaaaagatg

SEQ ID NO: 219269 - DNA, 103 bp, Artificial Sequence
  Synthetic Polynucleotide
taatacgactcactatagggagatcttcctccatttttagacttcgccctaacagaggagaagggcgatgtctaaaaataacctggcggcagcgcaaaagatg

SEQ ID NO: 219270 - DNA, 103 bp, Artificial Sequence
  Synthetic Polynucleotide
taatacgactcactatagggtttctcttaaagatcttcctccatttttagaacagaggagactaaaaatggaggaagataacctggcggcagcgcaaaagatg

SEQ ID NO: 219271 - DNA, 103 bp, Artificial Sequence
  Synthetic Polynucleotide
taatacgactcactatagggttgtccagtttttctcttaaagatcttcctaacagaggagaaggaagatgtttaagagaaacctggcggcagcgcaaaagatg

SEQ ID NO: 219272 - DNA, 103 bp, Artificial Sequence
  Synthetic Polynucleotide
taatacgactcactatagggtaatcctattttgtccagtttttctcttaaaacagaggagattaagaatgaaactggacaacctggcggcagcgcaaaagatg

SEQ ID NO: 219273 - DNA, 103 bp, Artificial Sequence
  Synthetic Polynucleotide
taatacgactcactataggggagattgacctacagtgcccagctggggcaaacagaggagatgccccatgtgggcactgaacctggcggcagcgcaaaagatg

SEQ ID NO: 219274 - DNA, 103 bp, Artificial Sequence
  Synthetic Polynucleotide
taatacgactcactatagggcaggcagatttaatcctattttgtccagttaacagaggagaaactggatgaaataggataacctggcggcagcgcaaaagatg

SEQ ID NO: 219275 - DNA, 103 bp, Artificial Sequence
  Synthetic Polynucleotide
taatacgactcactatagggcgtctccctgcaggcagatttaatcctattaacagaggagaaataggatgaaatctgccaacctggcggcagcgcaaaagatg

SEQ ID NO: 219276 - DNA, 103 bp, Artificial Sequence
  Synthetic Polynucleotide
taatacgactcactatagggggcagctttacgtctccctgcaggcagattaacagaggagaaatctgatggcagggagaaacctggcggcagcgcaaaagatg

SEQ ID NO: 219277 - DNA, 103 bp, Artificial Sequence
  Synthetic Polynucleotide
taatacgactcactataggggggtaacgttggcagctttacgtctccctgaacagaggagacagggaatggtaaagctgaacctggcggcagcgcaaaagatg

SEQ ID NO: 219278 - DNA, 103 bp, Artificial Sequence
  Synthetic Polynucleotide
taatacgactcactataggggatgtgagcagggtaacgttggcagctttaaacagaggagataaagcatgcaacgttacaacctggcggcagcgcaaaagatg

SEQ ID NO: 219279 - DNA, 103 bp, Artificial Sequence
  Synthetic Polynucleotide
taatacgactcactatagggctctactagtgatgtgagcagggtaacgttaacagaggagaaacgttatgctgctcacaaacctggcggcagcgcaaaagatg

SEQ ID NO: 219280 - DNA, 103 bp, Artificial Sequence
  Synthetic Polynucleotide
taatacgactcactatagggcagcttctccctctactagtgatgtgagcaaacagaggagatgctcaatgcactagtagaacctggcggcagcgcaaaagatg

SEQ ID NO: 219281 - DNA, 103 bp, Artificial Sequence
  Synthetic Polynucleotide
taatacgactcactataggggctaggtggacagcttctccctctactagtaacagaggagaactagtatggggagaagcaacctggcggcagcgcaaaagatg

SEQ ID NO: 219282 - DNA, 103 bp, Artificial Sequence
  Synthetic Polynucleotide
taatacgactcactatagggaaagtccctggctaggtggacagcttctccaacagaggagaggagaaatggtccacctaaacctggcggcagcgcaaaagatg

SEQ ID NO: 219283 - DNA, 103 bp, Artificial Sequence
  Synthetic Polynucleotide
taatacgactcactatagggacacgtacccaaagtccctggctaggtggaaacagaggagatccaccatgccagggactaacctggcggcagcgcaaaagatg

SEQ ID NO: 219284 - DNA, 103 bp, Artificial Sequence
  Synthetic Polynucleotide
taatacgactcactatagggctcgtgtagggagattgacctacagtgcccaacagaggagagggcacatgaggtcaatcaacctggcggcagcgcaaaagatg

SEQ ID NO: 219285 - DNA, 103 bp, Artificial Sequence
  Synthetic Polynucleotide
taatacgactcactatagggtcggtttcgcacacgtacccaaagtccctgaacagaggagacagggaatgtgggtacgtaacctggcggcagcgcaaaagatg

SEQ ID NO: 219286 - DNA, 103 bp, Artificial Sequence
  Synthetic Polynucleotide
taatacgactcactatagggggcaggaaattcggtttcgcacacgtacccaacagaggagagggtacatgtgcgaaaccaacctggcggcagcgcaaaagatg

SEQ ID NO: 219287 - DNA, 103 bp, Artificial Sequence
  Synthetic Polynucleotide
taatacgactcactatagggctactgctttggcaggaaattcggtttcgcaacagaggagagcgaaaatgaatttcctgaacctggcggcagcgcaaaagatg

SEQ ID NO: 219288 - DNA, 103 bp, Artificial Sequence
  Synthetic Polynucleotide
taatacgactcactatagggagaaattcagctactgctttggcaggaaataacagaggagaatttccatgcaaagcagtaacctggcggcagcgcaaaagatg

SEQ ID NO: 219289 - DNA, 103 bp, Artificial Sequence
  Synthetic Polynucleotide
taatacgactcactatagggttgtcggttgagaaattcagctactgctttaacagaggagaaaagcaatggctgaatttaacctggcggcagcgcaaaagatg

SEQ ID NO: 219290 - DNA, 103 bp, Artificial Sequence
  Synthetic Polynucleotide
taatacgactcactataggggatcggaatgttgtcggttgagaaattcagaacagaggagactgaatatgtcaaccgacaacctggcggcagcgcaaaagatg

SEQ ID NO: 219291 - DNA, 103 bp, Artificial Sequence
  Synthetic Polynucleotide
taatacgactcactatagggtgctcattgggatcggaatgttgtcggttgaacagaggagacaaccgatgacattccgaaacctggcggcagcgcaaaagatg

SEQ ID NO: 219292 - DNA, 103 bp, Artificial Sequence
  Synthetic Polynucleotide
taatacgactcactatagggtcttgtcacttgctcattgggatcggaatgaacagaggagacattccatgcccaatgagaacctggcggcagcgcaaaagatg

SEQ ID NO: 219293 - DNA, 103 bp, Artificial Sequence
  Synthetic Polynucleotide
taatacgactcactataggggcatgttttttcttgtcacttgctcattggaacagaggagaccaatgatgaagtgacaaaacctggcggcagcgcaaaagatg

SEQ ID NO: 219294 - DNA, 103 bp, Artificial Sequence
  Synthetic Polynucleotide
taatacgactcactataggggtagccaggagcatgttttttcttgtcactaacagaggagaagtgacatgaaaaaacataacctggcggcagcgcaaaagatg

SEQ ID NO: 219295 - DNA, 103 bp, Artificial Sequence
  Synthetic Polynucleotide
taatacgactcactatagggggcagcctggtctctaggaggtgagtgcataacagaggagaatgcacatgcctcctagaaacctggcggcagcgcaaaagatg

SEQ ID NO: 219296 - DNA, 103 bp, Artificial Sequence
  Synthetic Polynucleotide
taatacgactcactataggggagccgcgagctgtggctcgggacaccatcaacagaggagagatggtatgccgagccacaacctggcggcagcgcaaaagatg

SEQ ID NO: 219297 - DNA, 103 bp, Artificial Sequence
  Synthetic Polynucleotide
taatacgactcactatagggcaaatactcagagacggctttggcgggaaaaacagaggagatttcccatgaaagccgtcaacctggcggcagcgcaaaagatg

SEQ ID NO: 219298 - DNA, 103 bp, Artificial Sequence
  Synthetic Polynucleotide
taatacgactcactataggggctgccggttcaaatactcagagacggcttaacagaggagaaagccgatgctgagtattaacctggcggcagcgcaaaagatg

SEQ ID NO: 219299 - DNA, 103 bp, Artificial Sequence
  Synthetic Polynucleotide
taatacgactcactataggggggtctgtgtgctgccggttcaaatactcaaacagaggagatgagtaatggaaccggcaaacctggcggcagcgcaaaagatg

SEQ ID NO: 219300 - DNA, 103 bp, Artificial Sequence
  Synthetic Polynucleotide
taatacgactcactatagggcaggtcactcgggtctgtgtgctgccggttaacagaggagaaaccggatgcacacagacaacctggcggcagcgcaaaagatg

SEQ ID NO: 219301 - DNA, 103 bp, Artificial Sequence
  Synthetic Polynucleotide
taatacgactcactatagggttcgggagtgcaggtcactcgggtctgtgtaacagaggagaacacagatgcgagtgaccaacctggcggcagcgcaaaagatg

SEQ ID NO: 219302 - DNA, 103 bp, Artificial Sequence
  Synthetic Polynucleotide
taatacgactcactatagggagcatattctttcgggagtgcaggtcactcaacagaggagagagtgaatggcactcccgaacctggcggcagcgcaaaagatg

SEQ ID NO: 219303 - DNA, 103 bp, Artificial Sequence
  Synthetic Polynucleotide
taatacgactcactatagggggtggccaacagcatattctttcgggagtgaacagaggagacactccatgaagaatatgaacctggcggcagcgcaaaagatg

SEQ ID NO: 219304 - DNA, 103 bp, Artificial Sequence
  Synthetic Polynucleotide
taatacgactcactatagggaaagttgcttggtggccaacagcatattctaacagaggagaagaataatgtgttggccaaacctggcggcagcgcaaaagatg

SEQ ID NO: 219305 - DNA, 103 bp, Artificial Sequence
  Synthetic Polynucleotide
taatacgactcactatagggaattctttacaaagttgcttggtggccaacaacagaggagagttggcatgcaagcaactaacctggcggcagcgcaaaagatg

SEQ ID NO: 219306 - DNA, 103 bp, Artificial Sequence
  Synthetic Polynucleotide
taatacgactcactatagggtagatccgtaaattctttacaaagttgcttaacagaggagaaagcaaatgtgtaaagaaaacctggcggcagcgcaaaagatg

SEQ ID NO: 219307 - DNA, 103 bp, Artificial Sequence
  Synthetic Polynucleotide
taatacgactcactatagggccagctgggagagccgcgagctgtggctcgaacagaggagacgagccatggctcgcggcaacctggcggcagcgcaaaagatg

SEQ ID NO: 219308 - DNA, 103 bp, Artificial Sequence
  Synthetic Polynucleotide
taatacgactcactatagggcctgcgccagtagatccgtaaattctttacaacagaggagagtaaagatgttacggatcaacctggcggcagcgcaaaagatg

SEQ ID NO: 219309 - DNA, 103 bp, Artificial Sequence
  Synthetic Polynucleotide
taatacgactcactatagggggtgtccggtcctgcgccagtagatccgtaaacagaggagatacggaatgactggcgcaaacctggcggcagcgcaaaagatg

SEQ ID NO: 219310 - DNA, 103 bp, Artificial Sequence
  Synthetic Polynucleotide
taatacgactcactataggggttccctatcggtgtccggtcctgcgccagaacagaggagactggcgatggaccggacaaacctggcggcagcgcaaaagatg

SEQ ID NO: 219311 - DNA, 103 bp, Artificial Sequence
  Synthetic Polynucleotide
taatacgactcactatagggtgggtcggctgttccctatcggtgtccggtaacagaggagaaccggaatgcgatagggaaacctggcggcagcgcaaaagatg

SEQ ID NO: 219312 - DNA, 103 bp, Artificial Sequence
  Synthetic Polynucleotide
taatacgactcactatagggaggatggggctgggtcggctgttccctatcaacagaggagagataggatgcagccgaccaacctggcggcagcgcaaaagatg

SEQ ID NO: 219313 - DNA, 103 bp, Artificial Sequence
  Synthetic Polynucleotide
taatacgactcactatagggccccggctccaggatggggctgggtcggctaacagaggagaagccgaatgagccccatcaacctggcggcagcgcaaaagatg

SEQ ID NO: 219314 - DNA, 103 bp, Artificial Sequence
  Synthetic Polynucleotide
taatacgactcactatagggagctctggatccccggctccaggatggggcaacagaggagagccccaatgtggagccggaacctggcggcagcgcaaaagatg

SEQ ID NO: 219315 - DNA, 103 bp, Artificial Sequence
  Synthetic Polynucleotide
taatacgactcactatagggtgcgtgaggcagctctggatccccggctccaacagaggagaggagccatggatccagagaacctggcggcagcgcaaaagatg

SEQ ID NO: 219316 - DNA, 103 bp, Artificial Sequence
  Synthetic Polynucleotide
taatacgactcactataggggaggctgaagtgcgtgaggcagctctggataacagaggagaatccagatgtgcctcacgaacctggcggcagcgcaaaagatg

SEQ ID NO: 219317 - DNA, 103 bp, Artificial Sequence
  Synthetic Polynucleotide
taatacgactcactatagggcgtgcgtgatgaggctgaagtgcgtgaggcaacagaggagagcctcaatgacttcagccaacctggcggcagcgcaaaagatg

SEQ ID NO: 219318 - DNA, 103 bp, Artificial Sequence
  Synthetic Polynucleotide
taatacgactcactataggggacaccgagcccagctgggagagccgcgagaacagaggagactcgcgatgctcccagctaacctggcggcagcgcaaaagatg

SEQ ID NO: 219319 - DNA, 103 bp, Artificial Sequence
  Synthetic Polynucleotide
taatacgactcactataggggcgccgaagccgtgcgtgatgaggctgaagaacagaggagacttcagatgcatcacgcaaacctggcggcagcgcaaaagatg

SEQ ID NO: 219320 - DNA, 103 bp, Artificial Sequence
  Synthetic Polynucleotide
taatacgactcactatagggaatggccggggcgccgaagccgtgcgtgataacagaggagaatcacgatgggcttcggcaacctggcggcagcgcaaaagatg

SEQ ID NO: 219321 - DNA, 103 bp, Artificial Sequence
  Synthetic Polynucleotide
taatacgactcactataggggcgcggcgcaaatggccggggcgccgaagcaacagaggagagcttcgatgccccggccaaacctggcggcagcgcaaaagatg

SEQ ID NO: 219322 - DNA, 103 bp, Artificial Sequence
  Synthetic Polynucleotide
taatacgactcactatagggagggccgtgagcgcggcgcaaatggccgggaacagaggagacccggcatgttgcgccgcaacctggcggcagcgcaaaagatg

SEQ ID NO: 219323 - DNA, 103 bp, Artificial Sequence
  Synthetic Polynucleotide
taatacgactcactatagggatagttctgcagggccgtgagcgcggcgcaaacagaggagatgcgccatgctcacggccaacctggcggcagcgcaaaagatg

SEQ ID NO: 219324 - DNA, 103 bp, Artificial Sequence
  Synthetic Polynucleotide
taatacgactcactatagggcctcggtgagatagttctgcagggccgtgaaacagaggagatcacggatgtgcagaactaacctggcggcagcgcaaaagatg

SEQ ID NO: 219325 - DNA, 103 bp, Artificial Sequence
  Synthetic Polynucleotide
taatacgactcactatagggcctttgagcgcctcggtgagatagttctgcaacagaggagagcagaaatgtctcaccgaaacctggcggcagcgcaaaagatg

SEQ ID NO: 219326 - DNA, 103 bp, Artificial Sequence
  Synthetic Polynucleotide
taatacgactcactatagggcttgtccatgcctttgagcgcctcggtgagaacagaggagactcaccatggcgctcaaaaacctggcggcagcgcaaaagatg

SEQ ID NO: 219327 - DNA, 103 bp, Artificial Sequence
  Synthetic Polynucleotide
taatacgactcactatagggtcaagaacatcttgtccatgcctttgagcgaacagaggagacgctcaatggcatggacaaacctggcggcagcgcaaaagatg

SEQ ID NO: 219328 - DNA, 103 bp, Artificial Sequence
  Synthetic Polynucleotide
taatacgactcactataggggtggtgttgttcaagaacatcttgtccatgaacagaggagacatggaatggatgttcttaacctggcggcagcgcaaaagatg

SEQ ID NO: 219329 - DNA, 103 bp, Artificial Sequence
  Synthetic Polynucleotide
taatacgactcactataggggggtccttgggacaccgagcccagctgggaaacagaggagatcccagatgggctcggtgaacctggcggcagcgcaaaagatg

SEQ ID NO: 219330 - DNA, 103 bp, Artificial Sequence
  Synthetic Polynucleotide
taatacgactcactatagggcctgttagtggtggtgttgttcaagaacataacagaggagaatgttcatgaacaacaccaacctggcggcagcgcaaaagatg

SEQ ID NO: 219331 - DNA, 103 bp, Artificial Sequence
  Synthetic Polynucleotide
taatacgactcactatagggcagacgtgtgcctgttagtggtggtgttgtaacagaggagaacaacaatgccactaacaaacctggcggcagcgcaaaagatg

SEQ ID NO: 219332 - DNA, 103 bp, Artificial Sequence
  Synthetic Polynucleotide
taatacgactcactataggggggccttccccagacgtgtgcctgttagtgaacagaggagacactaaatggcacacgtcaacctggcggcagcgcaaaagatg

SEQ ID NO: 219333 - DNA, 103 bp, Artificial Sequence
  Synthetic Polynucleotide
taatacgactcactatagggtttactacctgggccttccccagacgtgtgaacagaggagacacacgatgggggaaggcaacctggcggcagcgcaaaagatg

SEQ ID NO: 219334 - DNA, 103 bp, Artificial Sequence
  Synthetic Polynucleotide
taatacgactcactatagggtgtcgccagttttactacctgggccttcccaacagaggagagggaagatgcaggtagtaaacctggcggcagcgcaaaagatg

SEQ ID NO: 219335 - DNA, 103 bp, Artificial Sequence
  Synthetic Polynucleotide
taatacgactcactatagggttctcctccttgtcgccagttttactacctaacagaggagaaggtagatgaactggcgaaacctggcggcagcgcaaaagatg

SEQ ID NO: 219336 - DNA, 103 bp, Artificial Sequence
  Synthetic Polynucleotide
taatacgactcactatagggtttcctgtgtttctcctccttgtcgccagtaacagaggagaactggcatgaaggaggagaacctggcggcagcgcaaaagatg

SEQ ID NO: 219337 - DNA, 103 bp, Artificial Sequence
  Synthetic Polynucleotide
taatacgactcactatagggcgctcgagtagggtccttgggacaccgagcaacagaggagagctcggatgcccaaggacaacctggcggcagcgcaaaagatg

SEQ ID NO: 219338 - DNA, 103 bp, Artificial Sequence
  Synthetic Polynucleotide
taatacgactcactatagggagcggcggggcgctcgagtagggtccttggaacagaggagaccaaggatgctactcgagaacctggcggcagcgcaaaagatg

SEQ ID NO: 219339 - DNA, 103 bp, Artificial Sequence
  Synthetic Polynucleotide
taatacgactcactatagggggtgtgggacagcggcggggcgctcgagtaaacagaggagatactcgatggccccgccgaacctggcggcagcgcaaaagatg

SEQ ID NO: 219340 - DNA, 103 bp, Artificial Sequence
  Synthetic Polynucleotide
taatacgactcactatagggccgacgacggggtgtgggacagcggcggggaacagaggagaccccgcatgtgtcccacaaacctggcggcagcgcaaaagatg

SEQ ID NO: 219341 - DNA, 103 bp, Artificial Sequence
  Synthetic Polynucleotide
taatacgactcactatagggggctggaagtccgacgacggggtgtgggacaacagaggagagtcccaatgcccgtcgtcaacctggcggcagcgcaaaagatg

SEQ ID NO: 219342 - DNA, 103 bp, Artificial Sequence
  Synthetic Polynucleotide
taatacgactcactataggggaagtagggcggctggaagtccgacgacggaacagaggagaccgtcgatggacttccagaacctggcggcagcgcaaaagatg

SEQ ID NO: 219343 - DNA, 103 bp, Artificial Sequence
  Synthetic Polynucleotide
taatacgactcactatagggagagcatgatggcagcctggtctctaggagaacagaggagactcctaatgaccaggctgaacctggcggcagcgcaaaagatg

SEQ ID NO: 219344 - DNA, 103 bp, Artificial Sequence
  Synthetic Polynucleotide
taatacgactcactatagggaggggggtgggaagtagggcggctggaagtaacagaggagaacttccatgcgccctactaacctggcggcagcgcaaaagatg

SEQ ID NO: 219345 - DNA, 103 bp, Artificial Sequence
  Synthetic Polynucleotide
taatacgactcactatagggagcggctggtaggggggtgggaagtagggcaacagaggagagccctaatgcccacccccaacctggcggcagcgcaaaagatg

SEQ ID NO: 219346 - DNA, 103 bp, Artificial Sequence
  Synthetic Polynucleotide
taatacgactcactataggggtggtaggggagcggctggtaggggggtggaacagaggagaccacccatgtaccagccgaacctggcggcagcgcaaaagatg

SEQ ID NO: 219347 - DNA, 103 bp, Artificial Sequence
  Synthetic Polynucleotide
taatacgactcactatagggcctggctctggtggtaggggagcggctggtaacagaggagaaccagcatgtcccctaccaacctggcggcagcgcaaaagatg

SEQ ID NO: 219348 - DNA, 103 bp, Artificial Sequence
  Synthetic Polynucleotide
taatacgactcactataggggagtaggggtcctggctctggtggtaggggaacagaggagacccctaatgccagagccaaacctggcggcagcgcaaaagatg

SEQ ID NO: 219349 - DNA, 103 bp, Artificial Sequence
  Synthetic Polynucleotide
taatacgactcactataggggttgacgtgggagtaggggtcctggctctgaacagaggagacagagcatggacccctacaacctggcggcagcgcaaaagatg

SEQ ID NO: 219350 - DNA, 103 bp, Artificial Sequence
  Synthetic Polynucleotide
taatacgactcactatagggagtaggggtcgttgacgtgggagtaggggtaacagaggagaacccctatgcccacgtcaaacctggcggcagcgcaaaagatg

SEQ ID NO: 219351 - DNA, 103 bp, Artificial Sequence
  Synthetic Polynucleotide
taatacgactcactataggggggttcagggagtaggggtcgttgacgtggaacagaggagaccacgtatgcgacccctaaacctggcggcagcgcaaaagatg

SEQ ID NO: 219352 - DNA, 103 bp, Artificial Sequence
  Synthetic Polynucleotide
taatacgactcactatagggctggtgcagtgggttcagggagtaggggtcaacagaggagagaccccatgtccctgaacaacctggcggcagcgcaaaagatg

SEQ ID NO: 219353 - DNA, 103 bp, Artificial Sequence
  Synthetic Polynucleotide
taatacgactcactataggggttgctggggctggtgcagtgggttcagggaacagaggagaccctgaatgcactgcaccaacctggcggcagcgcaaaagatg

SEQ ID NO: 219354 - DNA, 103 bp, Artificial Sequence
  Synthetic Polynucleotide
taatacgactcactatagggacaagcttccagagcatgatggcagcctggaacagaggagaccaggcatgcatcatgctaacctggcggcagcgcaaaagatg

SEQ ID NO: 219355 - DNA, 103 bp, Artificial Sequence
  Synthetic Polynucleotide
taatacgactcactatagggccccagggatgttgctggggctggtgcagtaacagaggagaactgcaatggccccagcaaacctggcggcagcgcaaaagatg

SEQ ID NO: 219356 - DNA, 103 bp, Artificial Sequence
  Synthetic Polynucleotide
taatacgactcactatagggctgccgttgcccccagggatgttgctggggaacagaggagaccccagatgcatccctggaacctggcggcagcgcaaaagatg

SEQ ID NO: 219357 - DNA, 103 bp, Artificial Sequence
  Synthetic Polynucleotide
taatacgactcactatagggcttcttgccgctgccgttgcccccagggataacagaggagaatccctatgggcaacggcaacctggcggcagcgcaaaagatg

SEQ ID NO: 219358 - DNA, 103 bp, Artificial Sequence
  Synthetic Polynucleotide
taatacgactcactatagggtccgaacccacttcttgccgctgccgttgcaacagaggagagcaacgatggcggcaagaaacctggcggcagcgcaaaagatg

SEQ ID NO: 219359 - DNA, 103 bp, Artificial Sequence
  Synthetic Polynucleotide
taatacgactcactatagggagagccggcttccgaacccacttcttgccgaacagaggagacggcaaatggtgggttcgaacctggcggcagcgcaaaagatg

SEQ ID NO: 219360 - DNA, 103 bp, Artificial Sequence
  Synthetic Polynucleotide
taatacgactcactatagggggggcaggagagagccggcttccgaacccaaacagaggagatgggttatgaagccggctaacctggcggcagcgcaaaagatg

SEQ ID NO: 219361 - DNA, 103 bp, Artificial Sequence
  Synthetic Polynucleotide
taatacgactcactataggggcccgaggctggggcaggagagagccggctaacagaggagaagccggatgtctcctgccaacctggcggcagcgcaaaagatg

SEQ ID NO: 219362 - DNA, 103 bp, Artificial Sequence
  Synthetic Polynucleotide
taatacgactcactataggggggcaaggcggcccgaggctggggcaggagaacagaggagactcctgatgcagcctcggaacctggcggcagcgcaaaagatg

SEQ ID NO: 219363 - DNA, 103 bp, Artificial Sequence
  Synthetic Polynucleotide
taatacgactcactatagggccgagagctggggcaaggcggcccgaggctaacagaggagaagcctcatgccgccttgcaacctggcggcagcgcaaaagatg

SEQ ID NO: 219364 - DNA, 103 bp, Artificial Sequence
  Synthetic Polynucleotide
taatacgactcactataggggggtcaaggcccgagagctggggcaaggcgaacagaggagacgccttatgccagctctcaacctggcggcagcgcaaaagatg

SEQ ID NO: 219365 - DNA, 103 bp, Artificial Sequence
  Synthetic Polynucleotide
taatacgactcactataggggacattctccacaagcttccagagcatgataacagaggagaatcatgatgtggaagcttaacctggcggcagcgcaaaagatg

SEQ ID NO: 219366 - DNA, 103 bp, Artificial Sequence
  Synthetic Polynucleotide
taatacgactcactataggggtccctccgggggtcaaggcccgagagctgaacagaggagacagctcatgggccttgacaacctggcggcagcgcaaaagatg

SEQ ID NO: 219367 - DNA, 103 bp, Artificial Sequence
  Synthetic Polynucleotide
taatacgactcactatagggccgagtggtagtccctccgggggtcaaggcaacagaggagagccttgatgcccggagggaacctggcggcagcgcaaaagatg

SEQ ID NO: 219368 - DNA, 103 bp, Artificial Sequence
  Synthetic Polynucleotide
taatacgactcactatagggggccggcggaccgagtggtagtccctccggaacagaggagaccggagatgctaccactcaacctggcggcagcgcaaaagatg

SEQ ID NO: 219369 - DNA, 103 bp, Artificial Sequence
  Synthetic Polynucleotide
taatacgactcactatagggcagcacgtccggccggcggaccgagtggtaaacagaggagataccacatggtccgccggaacctggcggcagcgcaaaagatg

SEQ ID NO: 219370 - DNA, 103 bp, Artificial Sequence
  Synthetic Polynucleotide
taatacgactcactatagggccgaatgcagcagcacgtccggccggcggaaacagaggagatccgccatgcggacgtgcaacctggcggcagcgcaaaagatg

SEQ ID NO: 219371 - DNA, 103 bp, Artificial Sequence
  Synthetic Polynucleotide
taatacgactcactatagggccgtggtgcgccgaatgcagcagcacgtccaacagaggagaggacgtatggctgcattcaacctggcggcagcgcaaaagatg

SEQ ID NO: 219372 - DNA, 103 bp, Artificial Sequence
  Synthetic Polynucleotide
taatacgactcactatagggcgcgtccaggccgtggtgcgccgaatgcagaacagaggagactgcatatggcgcaccacaacctggcggcagcgcaaaagatg

SEQ ID NO: 219373 - DNA, 103 bp, Artificial Sequence
  Synthetic Polynucleotide
taatacgactcactatagggcacccatgcccgcgtccaggccgtggtgcgaacagaggagacgcaccatggcctggacgaacctggcggcagcgcaaaagatg

SEQ ID NO: 219374 - DNA, 103 bp, Artificial Sequence
  Synthetic Polynucleotide
taatacgactcactataggggagaggctgtcacccatgcccgcgtccaggaacagaggagacctggaatggggcatgggaacctggcggcagcgcaaaagatg

SEQ ID NO: 219375 - DNA, 103 bp, Artificial Sequence
  Synthetic Polynucleotide
taatacgactcactataggggccgtgcagcgagaggctgtcacccatgccaacagaggagaggcatgatggacagcctcaacctggcggcagcgcaaaagatg

SEQ ID NO: 219376 - DNA, 103 bp, Artificial Sequence
  Synthetic Polynucleotide
taatacgactcactatagggcttcgtacttgacattctccacaagcttccaacagaggagaggaagcatgtggagaatgaacctggcggcagcgcaaaagatg

SEQ ID NO: 219377 - DNA, 103 bp, Artificial Sequence
  Synthetic Polynucleotide
taatacgactcactataggggatggccgaggccgtgcagcgagaggctgtaacagaggagaacagccatgcgctgcacgaacctggcggcagcgcaaaagatg

SEQ ID NO: 219378 - DNA, 103 bp, Artificial Sequence
  Synthetic Polynucleotide
taatacgactcactatagggtccattccgggatggccgaggccgtgcagcaacagaggagagctgcaatgcctcggccaaacctggcggcagcgcaaaagatg

SEQ ID NO: 219379 - DNA, 103 bp, Artificial Sequence
  Synthetic Polynucleotide
taatacgactcactatagggctggacgtcttccattccgggatggccgagaacagaggagactcggcatgcccggaatgaacctggcggcagcgcaaaagatg

SEQ ID NO: 219380 - DNA, 103 bp, Artificial Sequence
  Synthetic Polynucleotide
taatacgactcactatagggcttcaactgactggacgtcttccattccggaacagaggagaccggaaatgaagacgtccaacctggcggcagcgcaaaagatg

SEQ ID NO: 219381 - DNA, 103 bp, Artificial Sequence
  Synthetic Polynucleotide
taatacgactcactatagggttattggcatcttcaactgactggacgtctaacagaggagaagacgtatggtcagttgaaacctggcggcagcgcaaaagatg

SEQ ID NO: 219382 - DNA, 103 bp, Artificial Sequence
  Synthetic Polynucleotide
taatacgactcactatagggcatgccgctgttattggcatcttcaactgaaacagaggagatcagttatggatgccaataacctggcggcagcgcaaaagatg

SEQ ID NO: 219383 - DNA, 103 bp, Artificial Sequence
  Synthetic Polynucleotide
taatacgactcactatagggccaatagattcatgccgctgttattggcataacagaggagaatgccaatgacagcggcaaacctggcggcagcgcaaaagatg

SEQ ID NO: 219384 - DNA, 103 bp, Artificial Sequence
  Synthetic Polynucleotide
taatacgactcactatagggacagactggtccaatagattcatgccgctgaacagaggagacagcggatggaatctattaacctggcggcagcgcaaaagatg

SEQ ID NO: 219385 - DNA, 103 bp, Artificial Sequence
  Synthetic Polynucleotide
taatacgactcactatagggttttttaatgacagactggtccaatagattaacagaggagaaatctaatggaccagtctaacctggcggcagcgcaaaagatg

SEQ ID NO: 219386 - DNA, 103 bp, Artificial Sequence
  Synthetic Polynucleotide
taatacgactcactataggggaactggaacttttttaatgacagactggtaacagaggagaaccagtatgtcattaaaaaacctggcggcagcgcaaaagatg

SEQ ID NO: 219387 - DNA, 103 bp, Artificial Sequence
  Synthetic Polynucleotide
taatacgactcactatagggtcatagatatcttcgtacttgacattctccaacagaggagaggagaaatgcaagtacgaaacctggcggcagcgcaaaagatg

SEQ ID NO: 219388 - DNA, 103 bp, Artificial Sequence
  Synthetic Polynucleotide
taatacgactcactataggggatttgggaggaactggaacttttttaatgaacagaggagacattaaatgagttccagtaacctggcggcagcgcaaaagatg

SEQ ID NO: 219389 - DNA, 103 bp, Artificial Sequence
  Synthetic Polynucleotide
taatacgactcactatagggagaagtcaccgatttgggaggaactggaacaacagaggagagttccaatgcctcccaaaaacctggcggcagcgcaaaagatg

SEQ ID NO: 219390 - DNA, 103 bp, Artificial Sequence
  Synthetic Polynucleotide
taatacgactcactatagggtcatcattagagaagtcaccgatttgggagaacagaggagactcccaatgcggtgacttaacctggcggcagcgcaaaagatg

SEQ ID NO: 219391 - DNA, 103 bp, Artificial Sequence
  Synthetic Polynucleotide
taatacgactcactatagggccgtctttattcatcattagagaagtcaccaacagaggagaggtgacatgtctaatgataacctggcggcagcgcaaaagatg

SEQ ID NO: 219392 - DNA, 103 bp, Artificial Sequence
  Synthetic Polynucleotide
taatacgactcactatagggtcccaggaagccgtctttattcatcattagaacagaggagactaatgatgaataaagacaacctggcggcagcgcaaaagatg

SEQ ID NO: 219393 - DNA, 103 bp, Artificial Sequence
  Synthetic Polynucleotide
taatacgactcactatagggcagacatgcctcccaggaagccgtctttataacagaggagaataaagatggcttcctggaacctggcggcagcgcaaaagatg

SEQ ID NO: 219394 - DNA, 103 bp, Artificial Sequence
  Synthetic Polynucleotide
taatacgactcactatagggccggtgttgacagacatgcctcccaggaagaacagaggagacttcctatgaggcatgtcaacctggcggcagcgcaaaagatg

SEQ ID NO: 219395 - DNA, 103 bp, Artificial Sequence
  Synthetic Polynucleotide
taatacgactcactatagggaaacacctcgccggtgttgacagacatgccaacagaggagaggcatgatggtcaacaccaacctggcggcagcgcaaaagatg

SEQ ID NO: 219396 - DNA, 103 bp, Artificial Sequence
  Synthetic Polynucleotide
taatacgactcactatagggggacggagcaaaacacctcgccggtgttgaaacagaggagatcaacaatggcgaggtgtaacctggcggcagcgcaaaagatg

SEQ ID NO: 219397 - DNA, 103 bp, Artificial Sequence
  Synthetic Polynucleotide
taatacgactcactatagggaaacggcctgggacggagcaaaacacctcgaacagaggagacgaggtatgttgctccgtaacctggcggcagcgcaaaagatg

SEQ ID NO: 219398 - DNA, 103 bp, Artificial Sequence
  Synthetic Polynucleotide
taatacgactcactataggggtgccggtcctcatagatatcttcgtacttaacagaggagaaagtacatggatatctataacctggcggcagcgcaaaagatg

SEQ ID NO: 219399 - DNA, 103 bp, Artificial Sequence
  Synthetic Polynucleotide
taatacgactcactataggggagcagagacaaacggcctgggacggagcaaacagaggagatgctccatgccaggccgtaacctggcggcagcgcaaaagatg

SEQ ID NO: 219400 - DNA, 103 bp, Artificial Sequence
  Synthetic Polynucleotide
taatacgactcactatagggaagttgaactgagcagagacaaacggcctgaacagaggagacaggccatgtgtctctgcaacctggcggcagcgcaaaagatg

SEQ ID NO: 219401 - DNA, 103 bp, Artificial Sequence
  Synthetic Polynucleotide
taatacgactcactatagggttgtacttcgaagttgaactgagcagagacaacagaggagagtctctatgcagttcaacaacctggcggcagcgcaaaagatg

SEQ ID NO: 219402 - DNA, 103 bp, Artificial Sequence
  Synthetic Polynucleotide
taatacgactcactatagggcacagttactttgtacttcgaagttgaactaacagaggagaagttcaatgtcgaagtacaacctggcggcagcgcaaaagatg

SEQ ID NO: 219403 - DNA, 103 bp, Artificial Sequence
  Synthetic Polynucleotide
taatacgactcactataggggaacttctcccacagttactttgtacttcgaacagaggagacgaagtatgaagtaactgaacctggcggcagcgcaaaagatg

SEQ ID NO: 219404 - DNA, 103 bp, Artificial Sequence
  Synthetic Polynucleotide
taatacgactcactatagggagccgtctctgaacttctcccacagttactaacagaggagaagtaacatggggagaagtaacctggcggcagcgcaaaagatg

SEQ ID NO: 219405 - DNA, 103 bp, Artificial Sequence
  Synthetic Polynucleotide
taatacgactcactatagggagggggcgacagccgtctctgaacttctccaacagaggagaggagaaatgcagagacggaacctggcggcagcgcaaaagatg

SEQ ID NO: 219406 - DNA, 103 bp, Artificial Sequence
  Synthetic Polynucleotide
taatacgactcactatagggtgaggcattcagggggcgacagccgtctctaacagaggagaagagacatgtgtcgccccaacctggcggcagcgcaaaagatg

SEQ ID NO: 219407 - DNA, 103 bp, Artificial Sequence
  Synthetic Polynucleotide
taatacgactcactatagggagagatgcattgaggcattcagggggcgacaacagaggagagtcgccatgtgaatgcctaacctggcggcagcgcaaaagatg

SEQ ID NO: 219408 - DNA, 103 bp, Artificial Sequence
  Synthetic Polynucleotide
taatacgactcactatagggtccgccgaggagagatgcattgaggcattcaacagaggagagaatgcatgaatgcatctaacctggcggcagcgcaaaagatg

SEQ ID NO: 219409 - DNA, 103 bp, Artificial Sequence
  Synthetic Polynucleotide
taatacgactcactatagggggacaccatcgtgccggtcctcatagatataacagaggagaatatctatgaggaccggcaacctggcggcagcgcaaaagatg

SEQ ID NO: 219410 - DNA, 103 bp, Artificial Sequence
  Synthetic Polynucleotide
taatacgactcactatagggttctgaggactccgccgaggagagatgcataacagaggagaatgcatatgtcctcggcgaacctggcggcagcgcaaaagatg

SEQ ID NO: 219411 - DNA, 103 bp, Artificial Sequence
  Synthetic Polynucleotide
taatacgactcactataggggatttggctcttctgaggactccgccgaggaacagaggagacctcggatgagtcctcagaacctggcggcagcgcaaaagatg

SEQ ID NO: 219412 - DNA, 103 bp, Artificial Sequence
  Synthetic Polynucleotide
taatacgactcactatagggcccatttttcgatttggctcttctgaggacaacagaggagagtcctcatgagagccaaaaacctggcggcagcgcaaaagatg

SEQ ID NO: 219413 - DNA, 103 bp, Artificial Sequence
  Synthetic Polynucleotide
taatacgactcactatagggaagatctccccccatttttcgatttggctcaacagaggagagagccaatgcgaaaaatgaacctggcggcagcgcaaaagatg

SEQ ID NO: 219414 - DNA, 103 bp, Artificial Sequence
  Synthetic Polynucleotide
taatacgactcactatagggctttctcgcaaagatctccccccatttttcaacagaggagagaaaaaatgggggagatcaacctggcggcagcgcaaaagatg

SEQ ID NO: 219415 - DNA, 103 bp, Artificial Sequence
  Synthetic Polynucleotide
taatacgactcactatagggtttttctagcctttctcgcaaagatctcccaacagaggagagggagaatgttgcgagaaaacctggcggcagcgcaaaagatg

SEQ ID NO: 219416 - DNA, 103 bp, Artificial Sequence
  Synthetic Polynucleotide
taatacgactcactatagggtcaaaccgattttttctagcctttctcgcaaacagaggagatgcgagatgggctagaaaaacctggcggcagcgcaaaagatg

SEQ ID NO: 219417 - DNA, 103 bp, Artificial Sequence
  Synthetic Polynucleotide
taatacgactcactataggggcgggtaaattcaaaccgattttttctagcaacagaggagagctagaatgaatcggtttaacctggcggcagcgcaaaagatg

SEQ ID NO: 219418 - DNA, 103 bp, Artificial Sequence
  Synthetic Polynucleotide
taatacgactcactataggggcgcctgcccgcgggtaaattcaaaccgataacagaggagaatcggtatgaatttacccaacctggcggcagcgcaaaagatg

SEQ ID NO: 219419 - DNA, 103 bp, Artificial Sequence
  Synthetic Polynucleotide
taatacgactcactatagggttgctgctttgcgcctgcccgcgggtaaataacagaggagaatttacatgcgggcaggcaacctggcggcagcgcaaaagatg

SEQ ID NO: 219420 - DNA, 103 bp, Artificial Sequence
  Synthetic Polynucleotide
taatacgactcactatagggctgtggctcgggacaccatcgtgccggtccaacagaggagaggaccgatgcgatggtgtaacctggcggcagcgcaaaagatg

SEQ ID NO: 219421 - DNA, 103 bp, Artificial Sequence
  Synthetic Polynucleotide
taatacgactcactatagggaacgtgacatttgctgctttgcgcctgcccaacagaggagagggcagatgcaaagcagcaacctggcggcagcgcaaaagatg

SEQ ID NO: 219422 - DNA, 103 bp, Artificial Sequence
  Synthetic Polynucleotide
taatacgactcactatagggggaggtgagtaacgtgacatttgctgctttaacagaggagaaaagcaatgaatgtcacgaacctggcggcagcgcaaaagatg

SEQ ID NO: 219423 - DNA, 103 bp, Artificial Sequence
  Synthetic Polynucleotide
taatacgactcactatagggcttccaccagggaggtgagtaacgtgacataacagaggagaatgtcaatgtactcacctaacctggcggcagcgcaaaagatg

SEQ ID NO: 219424 - DNA, 103 bp, Artificial Sequence
  Synthetic Polynucleotide
taatacgactcactatagggacagcttctccttccaccagggaggtgagtaacagaggagaactcacatgcctggtggaaacctggcggcagcgcaaaagatg

SEQ ID NO: 219425 - DNA, 103 bp, Artificial Sequence
  Synthetic Polynucleotide
taatacgactcactatagggagctaagtgaacagcttctccttccaccagaacagaggagactggtgatgggagaagctaacctggcggcagcgcaaaagatg

SEQ ID NO: 219426 - DNA, 103 bp, Artificial Sequence
  Synthetic Polynucleotide
taatacgactcactatagggcaaaatccctagctaagtgaacagcttctcaacagaggagagagaagatgttcacttagaacctggcggcagcgcaaaagatg

SEQ ID NO: 219427 - DNA, 103 bp, Artificial Sequence
  Synthetic Polynucleotide
taatacgactcactatagggcaaatgtacccaaaatccctagctaagtgaaacagaggagatcacttatgtagggatttaacctggcggcagcgcaaaagatg

SEQ ID NO: 219428 - DNA, 103 bp, Artificial Sequence
  Synthetic Polynucleotide
taatacgactcactatagggctccgtttcgcaaatgtacccaaaatccctaacagaggagaagggatatggggtacattaacctggcggcagcgcaaaagatg

SEQ ID NO: 219429 - DNA, 103 bp, Artificial Sequence
  Synthetic Polynucleotide
taatacgactcactatagggtggcgggaaactccgtttcgcaaatgtaccaacagaggagaggtacaatggcgaaacggaacctggcggcagcgcaaaagatg

SEQ ID NO: 219430 - DNA, 103 bp, Artificial Sequence
  Synthetic Polynucleotide
taatacgactcactataggggagacggctttggcgggaaactccgtttcgaacagaggagacgaaacatggtttcccgcaacctggcggcagcgcaaaagatg

SEQ ID NO: 219431 - DNA, 103 bp, Artificial Sequence
  Synthetic Polynucleotide
taatacgactcactatagggcttgacattatcggttattttccacaacataacagaggagaatgttgatgaaaataaccaacctggcggcagcgcaaaagatg

SEQ ID NO: 219432 - DNA, 103 bp, Artificial Sequence
  Synthetic Polynucleotide
taatacgactcactataggggtagaggtgctgcccggcggaggagaggtgaacagaggagacacctcatgtccgccgggaacctggcggcagcgcaaaagatg

SEQ ID NO: 219433 - DNA, 103 bp, Artificial Sequence
  Synthetic Polynucleotide
taatacgactcactatagggtccaagatgaggtctggttaaatattctgcaacagaggagagcagaaatgttaaccagaaacctggcggcagcgcaaaagatg

SEQ ID NO: 219434 - DNA, 103 bp, Artificial Sequence
  Synthetic Polynucleotide
taatacgactcactatagggcatttcgtcctccaagatgaggtctggttaaacagaggagataaccaatgctcatcttgaacctggcggcagcgcaaaagatg

SEQ ID NO: 219435 - DNA, 103 bp, Artificial Sequence
  Synthetic Polynucleotide
taatacgactcactataggggctgccatctcatttcgtcctccaagatgaaacagaggagatcatctatgaggacgaaaaacctggcggcagcgcaaaagatg

SEQ ID NO: 219436 - DNA, 103 bp, Artificial Sequence
  Synthetic Polynucleotide
taatacgactcactataggggttcttcctagctgccatctcatttcgtccaacagaggagaggacgaatggagatggcaaacctggcggcagcgcaaaagatg

SEQ ID NO: 219437 - DNA, 103 bp, Artificial Sequence
  Synthetic Polynucleotide
taatacgactcactatagggccaatagcatgttcttcctagctgccatctaacagaggagaagatggatgctaggaagaaacctggcggcagcgcaaaagatg

SEQ ID NO: 219438 - DNA, 103 bp, Artificial Sequence
  Synthetic Polynucleotide
taatacgactcactatagggtgctgggccgccaatagcatgttcttcctaaacagaggagataggaaatgcatgctattaacctggcggcagcgcaaaagatg

SEQ ID NO: 219439 - DNA, 103 bp, Artificial Sequence
  Synthetic Polynucleotide
taatacgactcactatagggtttacacagttgctgggccgccaatagcataacagaggagaatgctaatggcggcccagaacctggcggcagcgcaaaagatg

SEQ ID NO: 219440 - DNA, 103 bp, Artificial Sequence
  Synthetic Polynucleotide
taatacgactcactatagggctgtgaattctttacacagttgctgggccgaacagaggagacggcccatgaactgtgtaaacctggcggcagcgcaaaagatg

SEQ ID NO: 219441 - DNA, 103 bp, Artificial Sequence
  Synthetic Polynucleotide
taatacgactcactatagggctgagaagttctgtgaattctttacacagtaacagaggagaactgtgatgagaattcacaacctggcggcagcgcaaaagatg

SEQ ID NO: 219442 - DNA, 103 bp, Artificial Sequence
  Synthetic Polynucleotide
taatacgactcactatagggccggtcttggctgagaagttctgtgaattcaacagaggagagaattcatggaacttctcaacctggcggcagcgcaaaagatg

SEQ ID NO: 219443 - DNA, 103 bp, Artificial Sequence
  Synthetic Polynucleotide
taatacgactcactataggggcgcggggctgtagaggtgctgcccggcggaacagaggagaccgccgatgagcacctctaacctggcggcagcgcaaaagatg

SEQ ID NO: 219444 - DNA, 103 bp, Artificial Sequence
  Synthetic Polynucleotide
taatacgactcactatagggcatggggtgtccggtcttggctgagaagttaacagaggagaaacttcatggccaagaccaacctggcggcagcgcaaaagatg

SEQ ID NO: 219445 - DNA, 103 bp, Artificial Sequence
  Synthetic Polynucleotide
taatacgactcactatagggctgctggtcccatggggtgtccggtcttggaacagaggagaccaagaatggacaccccaaacctggcggcagcgcaaaagatg

SEQ ID NO: 219446 - DNA, 103 bp, Artificial Sequence
  Synthetic Polynucleotide
taatacgactcactatagggtggggcgagcctgctggtcccatggggtgtaacagaggagaacacccatggggaccagcaacctggcggcagcgcaaaagatg

SEQ ID NO: 219447 - DNA, 103 bp, Artificial Sequence
  Synthetic Polynucleotide
taatacgactcactatagggtctccaagactggggcgagcctgctggtccaacagaggagaggaccaatgggctcgcccaacctggcggcagcgcaaaagatg

SEQ ID NO: 219448 - DNA, 103 bp, Artificial Sequence
  Synthetic Polynucleotide
taatacgactcactatagggtgtatgttcgtctccaagactggggcgagcaacagaggagagctcgcatgagtcttggaaacctggcggcagcgcaaaagatg

SEQ ID NO: 219449 - DNA, 103 bp, Artificial Sequence
  Synthetic Polynucleotide
taatacgactcactatagggcaagcagttctgtatgttcgtctccaagacaacagaggagagtcttgatgacgaacataaacctggcggcagcgcaaaagatg

SEQ ID NO: 219450 - DNA, 103 bp, Artificial Sequence
  Synthetic Polynucleotide
taatacgactcactatagggtgaaatgagacaagcagttctgtatgttcgaacagaggagacgaacaatgagaactgctaacctggcggcagcgcaaaagatg

SEQ ID NO: 219451 - DNA, 103 bp, Artificial Sequence
  Synthetic Polynucleotide
taatacgactcactataggggtaatcaggctgaaatgagacaagcagttcaacagaggagagaactgatggtctcatttaacctggcggcagcgcaaaagatg

SEQ ID NO: 219452 - DNA, 103 bp, Artificial Sequence
  Synthetic Polynucleotide
taatacgactcactatagggaaacccgtgggtaatcaggctgaaatgagaaacagaggagatctcatatgagcctgattaacctggcggcagcgcaaaagatg

SEQ ID NO: 219453 - DNA, 103 bp, Artificial Sequence
  Synthetic Polynucleotide
taatacgactcactatagggcctggctgccaaacccgtgggtaatcaggcaacagaggagagcctgaatgcccacgggtaacctggcggcagcgcaaaagatg

SEQ ID NO: 219454 - DNA, 103 bp, Artificial Sequence
  Synthetic Polynucleotide
taatacgactcactataggggagaggggtggcgcggggctgtagaggtgcaacagaggagagcacctatgcagccccgcaacctggcggcagcgcaaaagatg

SEQ ID NO: 219455 - DNA, 103 bp, Artificial Sequence
  Synthetic Polynucleotide
taatacgactcactataggggcacagatggcctggctgccaaacccgtggaacagaggagaccacggatgtggcagccaaacctggcggcagcgcaaaagatg

SEQ ID NO: 219456 - DNA, 103 bp, Artificial Sequence
  Synthetic Polynucleotide
taatacgactcactatagggagacaccgcggcacagatggcctggctgccaacagaggagaggcagcatggccatctgtaacctggcggcagcgcaaaagatg

SEQ ID NO: 219457 - DNA, 103 bp, Artificial Sequence
  Synthetic Polynucleotide
taatacgactcactatagggtctgcagggcagacaccgcggcacagatggaacagaggagaccatctatgccgcggtgtaacctggcggcagcgcaaaagatg

SEQ ID NO: 219458 - DNA, 103 bp, Artificial Sequence
  Synthetic Polynucleotide
taatacgactcactatagggttgatgtagttctgcagggcagacaccgcgaacagaggagacgcggtatgtgccctgcaaacctggcggcagcgcaaaagatg

SEQ ID NO: 219459 - DNA, 103 bp, Artificial Sequence
  Synthetic Polynucleotide
taatacgactcactatagggcagggcttctttgatgtagttctgcagggcaacagaggagagccctgatgaactacatcaacctggcggcagcgcaaaagatg

SEQ ID NO: 219460 - DNA, 103 bp, Artificial Sequence
  Synthetic Polynucleotide
taatacgactcactatagggctatgacaatcagggcttctttgatgtagtaacagaggagaactacaatgaagaagcccaacctggcggcagcgcaaaagatg

SEQ ID NO: 219461 - DNA, 103 bp, Artificial Sequence
  Synthetic Polynucleotide
taatacgactcactatagggtaggatttgtctatgacaatcagggcttctaacagaggagaagaagcatggattgtcataacctggcggcagcgcaaaagatg

SEQ ID NO: 219462 - DNA, 103 bp, Artificial Sequence
  Synthetic Polynucleotide
taatacgactcactatagggagggttcatgtaggatttgtctatgacaataacagaggagaattgtcatggacaaatccaacctggcggcagcgcaaaagatg

SEQ ID NO: 219463 - DNA, 103 bp, Artificial Sequence
  Synthetic Polynucleotide
taatacgactcactatagggtctggtctccagggttcatgtaggatttgtaacagaggagaacaaatatgacatgaaccaacctggcggcagcgcaaaagatg

SEQ ID NO: 219464 - DNA, 103 bp, Artificial Sequence
  Synthetic Polynucleotide
taatacgactcactatagggtcagctggactctggtctccagggttcatgaacagaggagacatgaaatgtggagaccaaacctggcggcagcgcaaaagatg

SEQ ID NO: 219465 - DNA, 103 bp, Artificial Sequence
  Synthetic Polynucleotide
taatacgactcactatagggtccagtgtgggagaggggtggcgcggggctaacagaggagaagccccatgccacccctcaacctggcggcagcgcaaaagatg

SEQ ID NO: 219466 - DNA, 103 bp, Artificial Sequence
  Synthetic Polynucleotide
taatacgactcactatagggtttgttagaatcagctggactctggtctccaacagaggagaggagacatgagtccagctaacctggcggcagcgcaaaagatg

SEQ ID NO: 219467 - DNA, 103 bp, Artificial Sequence
  Synthetic Polynucleotide
taatacgactcactatagggtctccagggttttgttagaatcagctggacaacagaggagagtccagatgattctaacaaacctggcggcagcgcaaaagatg

SEQ ID NO: 219468 - DNA, 103 bp, Artificial Sequence
  Synthetic Polynucleotide
taatacgactcactatagggttctccattttctccagggttttgttagaaaacagaggagattctaaatgaaccctggaaacctggcggcagcgcaaaagatg

SEQ ID NO: 219469 - DNA, 103 bp, Artificial Sequence
  Synthetic Polynucleotide
taatacgactcactatagggtttcctgtgtttctccattttctccagggtaacagaggagaaccctgatgaaaatggagaacctggcggcagcgcaaaagatg

SEQ ID NO: 219470 - DNA, 103 bp, Artificial Sequence
  Synthetic Polynucleotide
taatacgactcactatagggattcggcgactccagtgtgggagaggggtgaacagaggagacaccccatgcccacactgaacctggcggcagcgcaaaagatg

SEQ ID NO: 219471 - DNA, 103 bp, Artificial Sequence
  Synthetic Polynucleotide
taatacgactcactatagggggcggctgatattcggcgactccagtgtggaacagaggagaccacacatgagtcgccgaaacctggcggcagcgcaaaagatg

SEQ ID NO: 219472 - DNA, 103 bp, Artificial Sequence
  Synthetic Polynucleotide
taatacgactcactatagggaaagtagggtggcggctgatattcggcgacaacagaggagagtcgccatgtatcagccgaacctggcggcagcgcaaaagatg

SEQ ID NO: 219473 - DNA, 103 bp, Artificial Sequence
  Synthetic Polynucleotide
taatacgactcactatagggagggagggggaaagtagggtggcggctgataacagaggagaatcagcatgcaccctactaacctggcggcagcgcaaaagatg

SEQ ID NO: 219474 - DNA, 103 bp, Artificial Sequence
  Synthetic Polynucleotide
taatacgactcactatagggagctgctggtagggagggggaaagtagggtaacagaggagaaccctaatgtccccctccaacctggcggcagcgcaaaagatg

SEQ ID NO: 219475 - DNA, 103 bp, Artificial Sequence
  Synthetic Polynucleotide
taatacgactcactatagggggagtaggccagctgctggtagggagggggaacagaggagaccccctatgtaccagcagaacctggcggcagcgcaaaagatg

SEQ ID NO: 219476 - DNA, 103 bp, Artificial Sequence
  Synthetic Polynucleotide
taatacgactcactatagggcctcttcgtacttgacattatcggttatttaacagaggagaaaataaatgataatgtcaaacctggcggcagcgcaaaagatg

SEQ ID NO: 219477 - DNA, 103 bp, Artificial Sequence
  Synthetic Polynucleotide
taatacgactcactatagggcggccgactgggagtaggccagctgctggtaacagaggagaaccagcatgtggcctactaacctggcggcagcgcaaaagatg

SEQ ID NO: 219478 - DNA, 103 bp, Artificial Sequence
  Synthetic Polynucleotide
taatacgactcactataggggagtaggggtcggccgactgggagtaggccaacagaggagaggcctaatgccagtcggcaacctggcggcagcgcaaaagatg

SEQ ID NO: 219479 - DNA, 103 bp, Artificial Sequence
  Synthetic Polynucleotide
taatacgactcactatagggccccagatgcgagtaggggtcggccgactgaacagaggagacagtcgatggacccctacaacctggcggcagcgcaaaagatg

SEQ ID NO: 219480 - DNA, 103 bp, Artificial Sequence
  Synthetic Polynucleotide
taatacgactcactatagggcgtacgcttcccccagatgcgagtaggggtaacagaggagaacccctatgcgcatctggaacctggcggcagcgcaaaagatg

SEQ ID NO: 219481 - DNA, 103 bp, Artificial Sequence
  Synthetic Polynucleotide
taatacgactcactatagggatggcggcggcgtacgcttcccccagatgcaacagaggagagcatctatgggaagcgtaaacctggcggcagcgcaaaagatg

SEQ ID NO: 219482 - DNA, 103 bp, Artificial Sequence
  Synthetic Polynucleotide
taatacgactcactatagggcagggggttgatggcggcggcgtacgcttcaacagaggagagaagcgatggccgccgccaacctggcggcagcgcaaaagatg

SEQ ID NO: 219483 - DNA, 103 bp, Artificial Sequence
  Synthetic Polynucleotide
taatacgactcactatagggccggctggtgcagggggttgatggcggcggaacagaggagaccgccgatgtcaacccccaacctggcggcagcgcaaaagatg

SEQ ID NO: 219484 - DNA, 103 bp, Artificial Sequence
  Synthetic Polynucleotide
taatacgactcactatagggcctgtgggcgccggctggtgcagggggttgaacagaggagacaacccatggcaccagccaacctggcggcagcgcaaaagatg

SEQ ID NO: 219485 - DNA, 103 bp, Artificial Sequence
  Synthetic Polynucleotide
taatacgactcactatagggctgctggctgcctgtgggcgccggctggtgaacagaggagacaccagatggcgcccacaaacctggcggcagcgcaaaagatg

SEQ ID NO: 219486 - DNA, 103 bp, Artificial Sequence
  Synthetic Polynucleotide
taatacgactcactataggggccaggcctgctgctggctgcctgtgggcgaacagaggagacgcccaatggcagccagcaacctggcggcagcgcaaaagatg

SEQ ID NO: 219487 - DNA, 103 bp, Artificial Sequence
  Synthetic Polynucleotide
taatacgactcactatagggtcctcgcagtcctcttcgtacttgacattaaacagaggagataatgtatggtacgaagaaacctggcggcagcgcaaaagatg

SEQ ID NO: 219488 - DNA, 103 bp, Artificial Sequence
  Synthetic Polynucleotide
taatacgactcactatagggtggcggccgggccaggcctgctgctggctgaacagaggagacagccaatggcaggcctgaacctggcggcagcgcaaaagatg

SEQ ID NO: 219489 - DNA, 103 bp, Artificial Sequence
  Synthetic Polynucleotide
taatacgactcactatagggctcctggctctggcggccgggccaggcctgaacagaggagacaggccatgcccggccgcaacctggcggcagcgcaaaagatg

SEQ ID NO: 219490 - DNA, 103 bp, Artificial Sequence
  Synthetic Polynucleotide
taatacgactcactataggggccccgctccctcctggctctggcggccggaacagaggagaccggccatgagagccaggaacctggcggcagcgcaaaagatg

SEQ ID NO: 219491 - DNA, 103 bp, Artificial Sequence
  Synthetic Polynucleotide
taatacgactcactatagggtgcgagggcagccccgctccctcctggctcaacagaggagagagccaatggggagcgggaacctggcggcagcgcaaaagatg

SEQ ID NO: 219492 - DNA, 103 bp, Artificial Sequence
  Synthetic Polynucleotide
taatacgactcactataggggcgcccgtggtgcgagggcagccccgctccaacagaggagaggagcgatgctgccctcgaacctggcggcagcgcaaaagatg

SEQ ID NO: 219493 - DNA, 103 bp, Artificial Sequence
  Synthetic Polynucleotide
taatacgactcactatagggggccggccgggcgcccgtggtgcgagggcaaacagaggagatgccctatgaccacgggcaacctggcggcagcgcaaaagatg

SEQ ID NO: 219494 - DNA, 103 bp, Artificial Sequence
  Synthetic Polynucleotide
taatacgactcactatagggtggggcagtaggccggccgggcgcccgtggaacagaggagaccacggatgcccggccggaacctggcggcagcgcaaaagatg

SEQ ID NO: 219495 - DNA, 103 bp, Artificial Sequence
  Synthetic Polynucleotide
taatacgactcactatagggcccggagaggtggggcagtaggccggccggaacagaggagaccggccatgctactgcccaacctggcggcagcgcaaaagatg

SEQ ID NO: 219496 - DNA, 103 bp, Artificial Sequence
  Synthetic Polynucleotide
taatacgactcactatagggccgcctccagcccggagaggtggggcagtaaacagaggagatactgcatgacctctccgaacctggcggcagcgcaaaagatg

SEQ ID NO: 219497 - DNA, 103 bp, Artificial Sequence
  Synthetic Polynucleotide
taatacgactcactatagggctcaccgcgcccgcctccagcccggagaggaacagaggagacctctcatggctggaggcaacctggcggcagcgcaaaagatg

SEQ ID NO: 219498 - DNA, 103 bp, Artificial Sequence
  Synthetic Polynucleotide
taatacgactcactataggggtcgtggcgatcctcgcagtcctcttcgtaaacagaggagatacgaaatggactgcgagaacctggcggcagcgcaaaagatg

SEQ ID NO: 219499 - DNA, 103 bp, Artificial Sequence
  Synthetic Polynucleotide
taatacgactcactatagggcctgcgggcgctcaccgcgcccgcctccagaacagaggagactggagatgggcgcggtgaacctggcggcagcgcaaaagatg

SEQ ID NO: 219500 - DNA, 103 bp, Artificial Sequence
  Synthetic Polynucleotide
taatacgactcactatagggggtaggcatccctgcgggcgctcaccgcgcaacagaggagagcgcggatggcgcccgcaaacctggcggcagcgcaaaagatg

SEQ ID NO: 219501 - DNA, 103 bp, Artificial Sequence
  Synthetic Polynucleotide
taatacgactcactatagggtcggagcggcggtaggcatccctgcgggcgaacagaggagacgcccgatgggatgcctaaacctggcggcagcgcaaaagatg

SEQ ID NO: 219502 - DNA, 103 bp, Artificial Sequence
  Synthetic Polynucleotide
taatacgactcactatagggcagcagcaggtcggagcggcggtaggcatcaacagaggagagatgccatgcgccgctccaacctggcggcagcgcaaaagatg

SEQ ID NO: 219503 - DNA, 103 bp, Artificial Sequence
  Synthetic Polynucleotide
taatacgactcactataggggtgcgtggggcagcagcaggtcggagcggcaacagaggagagccgctatgacctgctgcaacctggcggcagcgcaaaagatg

SEQ ID NO: 219504 - DNA, 103 bp, Artificial Sequence
  Synthetic Polynucleotide
taatacgactcactatagggtccagggcgtgtgcgtggggcagcagcaggaacagaggagacctgctatggccccacgcaacctggcggcagcgcaaaagatg

SEQ ID NO: 219505 - DNA, 103 bp, Artificial Sequence
  Synthetic Polynucleotide
taatacgactcactataggggcccgcggcatccagggcgtgtgcgtggggaacagaggagaccccacatgcacgccctgaacctggcggcagcgcaaaagatg

SEQ ID NO: 219506 - DNA, 103 bp, Artificial Sequence
  Synthetic Polynucleotide
taatacgactcactatagggtctcggccaggcccgcggcatccagggcgtaacagaggagaacgcccatgatgccgcggaacctggcggcagcgcaaaagatg

SEQ ID NO: 219507 - DNA, 103 bp, Artificial Sequence
  Synthetic Polynucleotide
taatacgactcactatagggagccccaggttctcggccaggcccgcggcaaacagaggagatgccgcatgcctggccgaaacctggcggcagcgcaaaagatg

SEQ ID NO: 219508 - DNA, 103 bp, Artificial Sequence
  Synthetic Polynucleotide
taatacgactcactatagggcatgtcgtggagccccaggttctcggccagaacagaggagactggccatgaacctggggaacctggcggcagcgcaaaagatg

SEQ ID NO: 219509 - DNA, 103 bp, Artificial Sequence
  Synthetic Polynucleotide
taatacgactcactatagggtgctgctcccgtcgtggcgatcctcgcagtaacagaggagaactgcgatgatcgccacgaacctggcggcagcgcaaaagatg

SEQ ID NO: 219510 - DNA, 103 bp, Artificial Sequence
  Synthetic Polynucleotide
taatacgactcactatagggtctggtgaggcatgtcgtggagccccaggtaacagaggagaacctggatgtccacgacaaacctggcggcagcgcaaaagatg

SEQ ID NO: 219511 - DNA, 103 bp, Artificial Sequence
  Synthetic Polynucleotide
taatacgactcactatagggacctcgtccatctggtgaggcatgtcgtggaacagaggagaccacgaatggcctcaccaaacctggcggcagcgcaaaagatg

SEQ ID NO: 219512 - DNA, 103 bp, Artificial Sequence
  Synthetic Polynucleotide
taatacgactcactataggggacattctgcacctcgtccatctggtgaggaacagaggagacctcacatgatggacgagaacctggcggcagcgcaaaagatg

SEQ ID NO: 219513 - DNA, 103 bp, Artificial Sequence
  Synthetic Polynucleotide
taatacgactcactataggggctggtcgtcgacattctgcacctcgtccaaacagaggagatggacgatgtgcagaatgaacctggcggcagcgcaaaagatg

SEQ ID NO: 219514 - DNA, 103 bp, Artificial Sequence
  Synthetic Polynucleotide
taatacgactcactatagggagcaacaggtgctggtcgtcgacattctgcaacagaggagagcagaaatgcgacgaccaaacctggcggcagcgcaaaagatg

SEQ ID NO: 219515 - DNA, 103 bp, Artificial Sequence
  Synthetic Polynucleotide
taatacgactcactatagggctgatcgtgcagcaacaggtgctggtcgtcaacagaggagagacgacatgcacctgttgaacctggcggcagcgcaaaagatg

SEQ ID NO: 219516 - DNA, 103 bp, Artificial Sequence
  Synthetic Polynucleotide
taatacgactcactataggggaatgactgtctgatcgtgcagcaacaggtaacagaggagaacctgtatgtgcacgatcaacctggcggcagcgcaaaagatg

SEQ ID NO: 219517 - DNA, 103 bp, Artificial Sequence
  Synthetic Polynucleotide
taatacgactcactatagggggacctttgcgaatgactgtctgatcgtgcaacagaggagagcacgaatggacagtcataacctggcggcagcgcaaaagatg

SEQ ID NO: 219518 - DNA, 103 bp, Artificial Sequence
  Synthetic Polynucleotide
taatacgactcactatagggcatggaaatgggacctttgcgaatgactgtaacagaggagaacagtcatgcgcaaaggtaacctggcggcagcgcaaaagatg

SEQ ID NO: 219519 - DNA, 103 bp, Artificial Sequence
  Synthetic Polynucleotide
taatacgactcactatagggggttcttggtcatggaaatgggacctttgcaacagaggagagcaaagatgccatttccaaacctggcggcagcgcaaaagatg

SEQ ID NO: 219520 - DNA, 103 bp, Artificial Sequence
  Synthetic Polynucleotide
taatacgactcactatagggggattcccattgctgctcccgtcgtggcgaaacagaggagatcgccaatgcgggagcagaacctggcggcagcgcaaaagatg

SEQ ID NO: 219521 - DNA, 103 bp, Artificial Sequence
  Synthetic Polynucleotide
taatacgactcactatagggaggttcagagggttcttggtcatggaaatgaacagaggagacatttcatggaccaagaaaacctggcggcagcgcaaaagatg

SEQ ID NO: 219522 - DNA, 103 bp, Artificial Sequence
  Synthetic Polynucleotide
taatacgactcactatagggctgacaggggaggttcagagggttcttggtaacagaggagaaccaagatgcctctgaacaacctggcggcagcgcaaaagatg

SEQ ID NO: 219523 - DNA, 103 bp, Artificial Sequence
  Synthetic Polynucleotide
taatacgactcactatagggccagctccttctgacaggggaggttcagagaacagaggagactctgaatgtcccctgtcaacctggcggcagcgcaaaagatg

SEQ ID NO: 219524 - DNA, 103 bp, Artificial Sequence
  Synthetic Polynucleotide
taatacgactcactatagggacggcccccaccagctccttctgacaggggaacagaggagacccctgatggaaggagctaacctggcggcagcgcaaaagatg

SEQ ID NO: 219525 - DNA, 103 bp, Artificial Sequence
  Synthetic Polynucleotide
taatacgactcactatagggggggttcattacggcccccaccagctccttaacagaggagaaaggagatggtgggggccaacctggcggcagcgcaaaagatg

SEQ ID NO: 219526 - DNA, 103 bp, Artificial Sequence
  Synthetic Polynucleotide
taatacgactcactatagggagacctcagtggggttcattacggcccccaaacagaggagatgggggatgtaatgaaccaacctggcggcagcgcaaaagatg

SEQ ID NO: 219527 - DNA, 103 bp, Artificial Sequence
  Synthetic Polynucleotide
taatacgactcactatagggactgagcagaagacctcagtggggttcattaacagaggagaaatgaaatgcactgaggtaacctggcggcagcgcaaaagatg

SEQ ID NO: 219528 - DNA, 103 bp, Artificial Sequence
  Synthetic Polynucleotide
taatacgactcactatagggtcttccagggactgagcagaagacctcagtaacagaggagaactgagatgttctgctcaaacctggcggcagcgcaaaagatg

SEQ ID NO: 219529 - DNA, 103 bp, Artificial Sequence
  Synthetic Polynucleotide
taatacgactcactatagggggagcgacaatcttccagggactgagcagaaacagaggagatctgctatgtccctggaaaacctggcggcagcgcaaaagatg

SEQ ID NO: 219530 - DNA, 103 bp, Artificial Sequence
  Synthetic Polynucleotide
taatacgactcactataggggtagagctgaggagcgacaatcttccagggaacagaggagaccctggatgattgtcgctaacctggcggcagcgcaaaagatg

SEQ ID NO: 219531 - DNA, 103 bp, Artificial Sequence
  Synthetic Polynucleotide
taatacgactcactatagggggggacccgcggattcccattgctgctcccaacagaggagagggagcatgaatgggaataacctggcggcagcgcaaaagatg

SEQ ID NO: 219532 - DNA, 103 bp, Artificial Sequence
  Synthetic Polynucleotide
taatacgactcactataggggtatttagacgtagagctgaggagcgacaaaacagaggagattgtcgatgctcagctctaacctggcggcagcgcaaaagatg

SEQ ID NO: 219533 - DNA, 103 bp, Artificial Sequence
  Synthetic Polynucleotide
taatacgactcactatagggctgtcactttgtatttagacgtagagctgaaacagaggagatcagctatgcgtctaaataacctggcggcagcgcaaaagatg

SEQ ID NO: 219534 - DNA, 103 bp, Artificial Sequence
  Synthetic Polynucleotide
taatacgactcactatagggacttcagccactgtcactttgtatttagacaacagaggagagtctaaatgcaaagtgacaacctggcggcagcgcaaaagatg

SEQ ID NO: 219535 - DNA, 103 bp, Artificial Sequence
  Synthetic Polynucleotide
taatacgactcactatagggtcgcctctgtacttcagccactgtcactttaacagaggagaaaagtgatggtggctgaaaacctggcggcagcgcaaaagatg

SEQ ID NO: 219536 - DNA, 103 bp, Artificial Sequence
  Synthetic Polynucleotide
taatacgactcactataggggtggggacagtcgcctctgtacttcagccaaacagaggagatggctgatgtacagaggcaacctggcggcagcgcaaaagatg

SEQ ID NO: 219537 - DNA, 103 bp, Artificial Sequence
  Synthetic Polynucleotide
taatacgactcactatagggaagcattcaggtggggacagtcgcctctgtaacagaggagaacagagatgactgtccccaacctggcggcagcgcaaaagatg

SEQ ID NO: 219538 - DNA, 103 bp, Artificial Sequence
  Synthetic Polynucleotide
taatacgactcactatagggcgaggcatttaagcattcaggtggggacagaacagaggagactgtccatgcctgaatgcaacctggcggcagcgcaaaagatg

SEQ ID NO: 219539 - DNA, 103 bp, Artificial Sequence
  Synthetic Polynucleotide
taatacgactcactatagggctcccagtaacgaggcatttaagcattcagaacagaggagactgaatatgtaaatgcctaacctggcggcagcgcaaaagatg

SEQ ID NO: 219540 - DNA, 103 bp, Artificial Sequence
  Synthetic Polynucleotide
taatacgactcactatagggctgagaacacctcccagtaacgaggcatttaacagaggagaaaatgcatggttactgggaacctggcggcagcgcaaaagatg

SEQ ID NO: 219541 - DNA, 103 bp, Artificial Sequence
  Synthetic Polynucleotide
taatacgactcactatagggtttggctcttctgagaacacctcccagtaaaacagaggagattactgatgggtgttctcaacctggcggcagcgcaaaagatg

SEQ ID NO: 219542 - DNA, 103 bp, Artificial Sequence
  Synthetic Polynucleotide
taatacgactcactatagggaggagaggtgggggacccgcggattcccataacagaggagaatgggaatgcgcgggtccaacctggcggcagcgcaaaagatg

SEQ ID NO: 219543 - DNA, 103 bp, Artificial Sequence
  Synthetic Polynucleotide
taatacgactcactatagggcatttttcgatttggctcttctgagaacacaacagaggagagtgttcatggaagagccaaacctggcggcagcgcaaaagatg

SEQ ID NO: 219544 - DNA, 103 bp, Artificial Sequence
  Synthetic Polynucleotide
taatacgactcactataggggaccggcctccatttttcgatttggctcttaacagaggagaaagagcatgatcgaaaaaaacctggcggcagcgcaaaagatg

SEQ ID NO: 219545 - DNA, 103 bp, Artificial Sequence
  Synthetic Polynucleotide
taatacgactcactatagggctcccgcaaggaccggcctccatttttcgaaacagaggagatcgaaaatgggaggccggaacctggcggcagcgcaaaagatg

SEQ ID NO: 219546 - DNA, 103 bp, Artificial Sequence
  Synthetic Polynucleotide
taatacgactcactatagggtgtccaacttctcccgcaaggaccggcctcaacagaggagagaggccatgccttgcgggaacctggcggcagcgcaaaagatg

SEQ ID NO: 219547 - DNA, 103 bp, Artificial Sequence
  Synthetic Polynucleotide
taatacgactcactatagggaacccaatcttgtccaacttctcccgcaagaacagaggagacttgcgatggaagttggaaacctggcggcagcgcaaaagatg

SEQ ID NO: 219548 - DNA, 103 bp, Artificial Sequence
  Synthetic Polynucleotide
taatacgactcactatagggcggaagattcaacccaatcttgtccaacttaacagaggagaaagttgatgaagattgggaacctggcggcagcgcaaaagatg

SEQ ID NO: 219549 - DNA, 103 bp, Artificial Sequence
  Synthetic Polynucleotide
taatacgactcactataggggcctcccggccggaagattcaacccaatctaacagaggagaagattgatgtgaatcttcaacctggcggcagcgcaaaagatg

SEQ ID NO: 219550 - DNA, 103 bp, Artificial Sequence
  Synthetic Polynucleotide
taatacgactcactataggggcggctttccgcctcccggccggaagattcaacagaggagagaatctatgggccgggagaacctggcggcagcgcaaaagatg

SEQ ID NO: 219551 - DNA, 103 bp, Artificial Sequence
  Synthetic Polynucleotide
taatacgactcactatagggagtcacatgagcggctttccgcctcccggcaacagaggagagccgggatgcggaaagccaacctggcggcagcgcaaaagatg

SEQ ID NO: 219552 - DNA, 103 bp, Artificial Sequence
  Synthetic Polynucleotide
taatacgactcactatagggatgtcaggagagtcacatgagcggctttccaacagaggagaggaaagatgctcatgtgaaacctggcggcagcgcaaaagatg

SEQ ID NO: 219553 - DNA, 103 bp, Artificial Sequence
  Synthetic Polynucleotide
taatacgactcactatagggtgcccggcggaggagaggtgggggacccgcaacagaggagagcgggtatgccacctctcaacctggcggcagcgcaaaagatg

SEQ ID NO: 219554 - DNA, 103 bp, Artificial Sequence
  Synthetic Polynucleotide
taatacgactcactatagggtctactaaggatgtcaggagagtcacatgaaacagaggagatcatgtatgtctcctgacaacctggcggcagcgcaaaagatg

SEQ ID NO: 219555 - DNA, 103 bp, Artificial Sequence
  Synthetic Polynucleotide
taatacgactcactatagggagcttcaccttctactaaggatgtcaggagaacagaggagactcctgatgtccttagtaaacctggcggcagcgcaaaagatg

SEQ ID NO: 219556 - DNA, 103 bp, Artificial Sequence
  Synthetic Polynucleotide
taatacgactcactatagggccaaatgaacagcttcaccttctactaaggaacagaggagaccttagatgaaggtgaagaacctggcggcagcgcaaaagatg

SEQ ID NO: 219557 - DNA, 103 bp, Artificial Sequence
  Synthetic Polynucleotide
taatacgactcactatagggaagtccctagccaaatgaacagcttcacctaacagaggagaaggtgaatgtgttcatttaacctggcggcagcgcaaaagatg

SEQ ID NO: 219558 - DNA, 103 bp, Artificial Sequence
  Synthetic Polynucleotide
taatacgactcactataggggacataggcaaagtccctagccaaatgaacaacagaggagagttcatatggctagggacaacctggcggcagcgcaaaagatg

SEQ ID NO: 219559 - DNA, 103 bp, Artificial Sequence
  Synthetic Polynucleotide
taatacgactcactatagggcggcttcacagacataggcaaagtccctagaacagaggagactagggatgttgcctatgaacctggcggcagcgcaaaagatg

SEQ ID NO: 219560 - DNA, 103 bp, Artificial Sequence
  Synthetic Polynucleotide
taatacgactcactatagggctaggaaattcggcttcacagacataggcaaacagaggagatgcctaatgctgtgaagcaacctggcggcagcgcaaaagatg

SEQ ID NO: 219561 - DNA, 103 bp, Artificial Sequence
  Synthetic Polynucleotide
taatacgactcactatagggcactggtttactaggaaattcggcttcacaaacagaggagatgtgaaatggaatttcctaacctggcggcagcgcaaaagatg

SEQ ID NO: 219562 - DNA, 103 bp, Artificial Sequence
  Synthetic Polynucleotide
taatacgactcactatagggaatattctgccactggtttactaggaaattaacagaggagaaatttcatggtaaaccagaacctggcggcagcgcaaaagatg

SEQ ID NO: 219563 - DNA, 103 bp, Artificial Sequence
  Synthetic Polynucleotide
taatacgactcactatagggggtctggttaaatattctgccactggtttaaacagaggagataaaccatgggcagaataaacctggcggcagcgcaaaagatg

SEQ ID NO: 219564 - DNA, 103 bp, Artificial Sequence
  Synthetic Polynucleotide
taatacgactcactataggggtggactagtcccggaaaggtagttgacataacagaggagaatgtcaatgacctttccgaacctggcggcagcgcaaaagatg

SEQ ID NO: 219565 - DNA, 103 bp, Artificial Sequence
  Synthetic Polynucleotide
taatacgactcactatagggataggcgacagtggaattggctactgactcaacagaggagagagtcaatggccaattccaacctggcggcagcgcaaaagatg

SEQ ID NO: 219566 - DNA, 103 bp, Artificial Sequence
  Synthetic Polynucleotide
taatacgactcactatagggcgccaggatcatcttttttcttgctgtctgaacagaggagacagacaatgagaaaaaagaacctggcggcagcgcaaaagatg

SEQ ID NO: 219567 - DNA, 103 bp, Artificial Sequence
  Synthetic Polynucleotide
taatacgactcactatagggtttgtttggtcgccaggatcatcttttttcaacagaggagagaaaaaatgtgatcctggaacctggcggcagcgcaaaagatg

SEQ ID NO: 219568 - DNA, 103 bp, Artificial Sequence
  Synthetic Polynucleotide
taatacgactcactatagggtctttacagatttgtttggtcgccaggatcaacagaggagagatcctatggaccaaacaaacctggcggcagcgcaaaagatg

SEQ ID NO: 219569 - DNA, 103 bp, Artificial Sequence
  Synthetic Polynucleotide
taatacgactcactataggggtcttggaattctttacagatttgtttggtaacagaggagaaccaaaatgatctgtaaaaacctggcggcagcgcaaaagatg

SEQ ID NO: 219570 - DNA, 103 bp, Artificial Sequence
  Synthetic Polynucleotide
taatacgactcactatagggggctcaagaggtcttggaattctttacagaaacagaggagatctgtaatgaattccaagaacctggcggcagcgcaaaagatg

SEQ ID NO: 219571 - DNA, 103 bp, Artificial Sequence
  Synthetic Polynucleotide
taatacgactcactataggggatctatcttggctcaagaggtcttggaataacagaggagaattccaatgcctcttgagaacctggcggcagcgcaaaagatg

SEQ ID NO: 219572 - DNA, 103 bp, Artificial Sequence
  Synthetic Polynucleotide
taatacgactcactatagggtcccagtggtgatctatcttggctcaagagaacagaggagactcttgatgcaagatagaaacctggcggcagcgcaaaagatg

SEQ ID NO: 219573 - DNA, 103 bp, Artificial Sequence
  Synthetic Polynucleotide
taatacgactcactataggggtctggaggatcccagtggtgatctatcttaacagaggagaaagataatgcaccactggaacctggcggcagcgcaaaagatg

SEQ ID NO: 219574 - DNA, 103 bp, Artificial Sequence
  Synthetic Polynucleotide
taatacgactcactatagggattggagtgggtctggaggatcccagtggtaacagaggagaaccactatgatcctccagaacctggcggcagcgcaaaagatg

SEQ ID NO: 219575 - DNA, 103 bp, Artificial Sequence
  Synthetic Polynucleotide
taatacgactcactatagggaaggtctagaattggagtgggtctggaggaaacagaggagatcctccatgcccactccaaacctggcggcagcgcaaaagatg

SEQ ID NO: 219576 - DNA, 103 bp, Artificial Sequence
  Synthetic Polynucleotide
taatacgactcactatagggaggaggaggaataggcgacagtggaattggaacagaggagaccaattatgctgtcgcctaacctggcggcagcgcaaaagatg

SEQ ID NO: 219577 - DNA, 103 bp, Artificial Sequence
  Synthetic Polynucleotide
taatacgactcactatagggtctggatgtcaaggtctagaattggagtggaacagaggagaccactcatgttctagaccaacctggcggcagcgcaaaagatg

SEQ ID NO: 219578 - DNA, 103 bp, Artificial Sequence
  Synthetic Polynucleotide
taatacgactcactataggggttaaatgtctctggatgtcaaggtctagaaacagaggagatctagaatgtgacatccaaacctggcggcagcgcaaaagatg

SEQ ID NO: 219579 - DNA, 103 bp, Artificial Sequence
  Synthetic Polynucleotide
taatacgactcactatagggactgaaatgtgttaaatgtctctggatgtcaacagaggagagacatcatgagacatttaaacctggcggcagcgcaaaagatg

SEQ ID NO: 219580 - DNA, 103 bp, Artificial Sequence
  Synthetic Polynucleotide
taatacgactcactataggggagtgatcaaactgaaatgtgttaaatgtcaacagaggagagacattatgcacatttcaaacctggcggcagcgcaaaagatg

SEQ ID NO: 219581 - DNA, 103 bp, Artificial Sequence
  Synthetic Polynucleotide
taatacgactcactatagggccaaagccatgagtgatcaaactgaaatgtaacagaggagaacatttatgtttgatcacaacctggcggcagcgcaaaagatg

SEQ ID NO: 219582 - DNA, 103 bp, Artificial Sequence
  Synthetic Polynucleotide
taatacgactcactatagggtgccggagtcccaaagccatgagtgatcaaaacagaggagattgatcatgcatggctttaacctggcggcagcgcaaaagatg

SEQ ID NO: 219583 - DNA, 103 bp, Artificial Sequence
  Synthetic Polynucleotide
taatacgactcactatagggctgcacatattgccggagtcccaaagccataacagaggagaatggctatgggactccggaacctggcggcagcgcaaaagatg

SEQ ID NO: 219584 - DNA, 103 bp, Artificial Sequence
  Synthetic Polynucleotide
taatacgactcactataggggtgcttagagctgcacatattgccggagtcaacagaggagagactccatgaatatgtgcaacctggcggcagcgcaaaagatg

SEQ ID NO: 219585 - DNA, 103 bp, Artificial Sequence
  Synthetic Polynucleotide
taatacgactcactatagggtgtttggaaagtgcttagagctgcacatataacagaggagaatatgtatggctctaagcaacctggcggcagcgcaaaagatg

SEQ ID NO: 219586 - DNA, 103 bp, Artificial Sequence
  Synthetic Polynucleotide
taatacgactcactatagggcactgagaactgtttggaaagtgcttagagaacagaggagactctaaatgctttccaaaaacctggcggcagcgcaaaagatg

SEQ ID NO: 219587 - DNA, 103 bp, Artificial Sequence
  Synthetic Polynucleotide
taatacgactcactataggggttaaaggagaggaggaggaataggcgacaaacagaggagatgtcgcatgttcctcctcaacctggcggcagcgcaaaagatg

SEQ ID NO: 219588 - DNA, 103 bp, Artificial Sequence
  Synthetic Polynucleotide
taatacgactcactatagggttcagcatttcactgagaactgtttggaaaaacagaggagatttccaatgagttctcagaacctggcggcagcgcaaaagatg

SEQ ID NO: 219589 - DNA, 103 bp, Artificial Sequence
  Synthetic Polynucleotide
taatacgactcactatagggttccaagtagttcagcatttcactgagaacaacagaggagagttctcatggaaatgctgaacctggcggcagcgcaaaagatg

SEQ ID NO: 219590 - DNA, 103 bp, Artificial Sequence
  Synthetic Polynucleotide
taatacgactcactatagggtagtgtgtttttccaagtagttcagcatttaacagaggagaaaatgcatgactacttggaacctggcggcagcgcaaaagatg

SEQ ID NO: 219591 - DNA, 103 bp, Artificial Sequence
  Synthetic Polynucleotide
taatacgactcactatagggttcttgtgagtagtgtgtttttccaagtagaacagaggagactacttatgaaaacacacaacctggcggcagcgcaaaagatg

SEQ ID NO: 219592 - DNA, 103 bp, Artificial Sequence
  Synthetic Polynucleotide
taatacgactcactatagggcgctccgccgttcttgtgagtagtgtgtttaacagaggagaaaacacatgactcacaagaacctggcggcagcgcaaaagatg

SEQ ID NO: 219593 - DNA, 103 bp, Artificial Sequence
  Synthetic Polynucleotide
taatacgactcactatagggcagaatccgccgctccgccgttcttgtgagaacagaggagactcacaatgacggcggagaacctggcggcagcgcaaaagatg

SEQ ID NO: 219594 - DNA, 103 bp, Artificial Sequence
  Synthetic Polynucleotide
taatacgactcactatagggtgtccttggccagaatccgccgctccgccgaacagaggagacggcggatgggcggattcaacctggcggcagcgcaaaagatg

SEQ ID NO: 219595 - DNA, 103 bp, Artificial Sequence
  Synthetic Polynucleotide
taatacgactcactatagggcgagttggcatgtccttggccagaatccgcaacagaggagagcggatatgggccaaggaaacctggcggcagcgcaaaagatg

SEQ ID NO: 219596 - DNA, 103 bp, Artificial Sequence
  Synthetic Polynucleotide
taatacgactcactataggggagctttctccgagttggcatgtccttggcaacagaggagagccaagatgatgccaactaacctggcggcagcgcaaaagatg

SEQ ID NO: 219597 - DNA, 103 bp, Artificial Sequence
  Synthetic Polynucleotide
taatacgactcactatagggttccgcaggggagctttctccgagttggcaaacagaggagatgccaaatgggagaaagcaacctggcggcagcgcaaaagatg

SEQ ID NO: 219598 - DNA, 103 bp, Artificial Sequence
  Synthetic Polynucleotide
taatacgactcactatagggggtggagtaagttaaaggagaggaggaggaaacagaggagatcctccatgtctcctttaaacctggcggcagcgcaaaagatg

SEQ ID NO: 219599 - DNA, 103 bp, Artificial Sequence
  Synthetic Polynucleotide
taatacgactcactatagggctctgaagttttccgcaggggagctttctcaacagaggagagagaaaatgcccctgcggaacctggcggcagcgcaaaagatg

SEQ ID NO: 219600 - DNA, 103 bp, Artificial Sequence
  Synthetic Polynucleotide
taatacgactcactatagggtcacggcagcctctgaagttttccgcagggaacagaggagaccctgcatgaaacttcagaacctggcggcagcgcaaaagatg

SEQ ID NO: 219601 - DNA, 103 bp, Artificial Sequence
  Synthetic Polynucleotide
taatacgactcactatagggttgccctctttcacggcagcctctgaagttaacagaggagaaacttcatgggctgccgtaacctggcggcagcgcaaaagatg

SEQ ID NO: 219602 - DNA, 103 bp, Artificial Sequence
  Synthetic Polynucleotide
taatacgactcactatagggcttttctgttttgccctctttcacggcagcaacagaggagagctgccatgaaagagggcaacctggcggcagcgcaaaagatg

SEQ ID NO: 219603 - DNA, 103 bp, Artificial Sequence
  Synthetic Polynucleotide
taatacgactcactatagggcggtgccggtggtggagtaagttaaaggagaacagaggagactccttatgcttactccaaacctggcggcagcgcaaaagatg

SEQ ID NO: 219604 - DNA, 103 bp, Artificial Sequence
  Synthetic Polynucleotide
taatacgactcactataggggacgcaaactcggtgccggtggtggagtaaaacagaggagattactcatgcaccggcacaacctggcggcagcgcaaaagatg

SEQ ID NO: 219605 - DNA, 103 bp, Artificial Sequence
  Synthetic Polynucleotide
taatacgactcactataggggaagtagggggacgcaaactcggtgccggtaacagaggagaaccggcatggagtttgcgaacctggcggcagcgcaaaagatg

SEQ ID NO: 219606 - DNA, 103 bp, Artificial Sequence
  Synthetic Polynucleotide
taatacgactcactatagggggttagtggagaagtagggggacgcaaactaacagaggagaagtttgatgccccctactaacctggcggcagcgcaaaagatg

SEQ ID NO: 219607 - DNA, 103 bp, Artificial Sequence
  Synthetic Polynucleotide
taatacgactcactataggggtgtactggtggttagtggagaagtaggggaacagaggagacccctaatgctccactaaaacctggcggcagcgcaaaagatg

SEQ ID NO: 219608 - DNA, 103 bp, Artificial Sequence
  Synthetic Polynucleotide
taatacgactcactataggggtggagcggggtgtactggtggttagtggaaacagaggagatccactatgcaccagtacaacctggcggcagcgcaaaagatg

SEQ ID NO: 219609 - DNA, 103 bp, Artificial Sequence
  Synthetic Polynucleotide
taatacgactcactatagggtctcggcatcgtggactagtcccggaaaggaacagaggagacctttcatggactagtccaacctggcggcagcgcaaaagatg

SEQ ID NO: 219610 - DNA, 103 bp, Artificial Sequence
  Synthetic Polynucleotide
taatacgactcactatagggaggactggtggtggagcggggtgtactggtaacagaggagaaccagtatgccccgctccaacctggcggcagcgcaaaagatg

SEQ ID NO: 219611 - DNA, 103 bp, Artificial Sequence
  Synthetic Polynucleotide
taatacgactcactatagggtcgtaatggaaggactggtggtggagcgggaacagaggagacccgctatgccaccagtcaacctggcggcagcgcaaaagatg

SEQ ID NO: 219612 - DNA, 103 bp, Artificial Sequence
  Synthetic Polynucleotide
taatacgactcactataggggtgctgaaactcgtaatggaaggactggtgaacagaggagacaccagatgttccattacaacctggcggcagcgcaaaagatg

SEQ ID NO: 219613 - DNA, 103 bp, Artificial Sequence
  Synthetic Polynucleotide
taatacgactcactatagggccgggtggctgtgctgaaactcgtaatggaaacagaggagatccattatgagtttcagcaacctggcggcagcgcaaaagatg

SEQ ID NO: 219614 - DNA, 103 bp, Artificial Sequence
  Synthetic Polynucleotide
taatacgactcactatagggggggtgacggccgggtggctgtgctgaaacaacagaggagagtttcaatgcagccacccaacctggcggcagcgcaaaagatg

SEQ ID NO: 219615 - DNA, 103 bp, Artificial Sequence
  Synthetic Polynucleotide
taatacgactcactataggggtaggcgtcgggggtgacggccgggtggctaacagaggagaagccacatggccgtcaccaacctggcggcagcgcaaaagatg

SEQ ID NO: 219616 - DNA, 103 bp, Artificial Sequence
  Synthetic Polynucleotide
taatacgactcactatagggagttcagagagtaggcgtcgggggtgacggaacagaggagaccgtcaatgccgacgcctaacctggcggcagcgcaaaagatg

SEQ ID NO: 219617 - DNA, 103 bp, Artificial Sequence
  Synthetic Polynucleotide
taatacgactcactatagggtggtggagagagttcagagagtaggcgtcgaacagaggagacgacgcatgctctctgaaaacctggcggcagcgcaaaagatg

SEQ ID NO: 219618 - DNA, 103 bp, Artificial Sequence
  Synthetic Polynucleotide
taatacgactcactatagggctgttgcgagtggtggagagagttcagagaaacagaggagatctctgatgtctctccacaacctggcggcagcgcaaaagatg

SEQ ID NO: 219619 - DNA, 103 bp, Artificial Sequence
  Synthetic Polynucleotide
taatacgactcactataggggctggtagtactgttgcgagtggtggagagaacagaggagactctccatgactcgcaacaacctggcggcagcgcaaaagatg

SEQ ID NO: 219620 - DNA, 103 bp, Artificial Sequence
  Synthetic Polynucleotide
taatacgactcactatagggtcgtgacgtatctcggcatcgtggactagtaacagaggagaactagtatgcgatgccgaaacctggcggcagcgcaaaagatg

SEQ ID NO: 219621 - DNA, 103 bp, Artificial Sequence
  Synthetic Polynucleotide
taatacgactcactatagggtggtggatctgctggtagtactgttgcgagaacagaggagactcgcaatggtactaccaaacctggcggcagcgcaaaagatg

SEQ ID NO: 219622 - DNA, 103 bp, Artificial Sequence
  Synthetic Polynucleotide
taatacgactcactataggggggctccccgtggtggatctgctggtagtaaacagaggagatactacatgcagatccacaacctggcggcagcgcaaaagatg

SEQ ID NO: 219623 - DNA, 103 bp, Artificial Sequence
  Synthetic Polynucleotide
taatacgactcactatagggtaaagtcggtgggctccccgtggtggatctaacagaggagaagatccatgacggggagcaacctggcggcagcgcaaaagatg

SEQ ID NO: 219624 - DNA, 103 bp, Artificial Sequence
  Synthetic Polynucleotide
taatacgactcactatagggtgcaggttaataaagtcggtgggctccccgaacagaggagacggggaatgcaccgacttaacctggcggcagcgcaaaagatg

SEQ ID NO: 219625 - DNA, 103 bp, Artificial Sequence
  Synthetic Polynucleotide
taatacgactcactatagggccgcgcattgtgcaggttaataaagtcggtaacagaggagaaccgacatgattaacctgaacctggcggcagcgcaaaagatg

SEQ ID NO: 219626 - DNA, 103 bp, Artificial Sequence
  Synthetic Polynucleotide
taatacgactcactatagggacttgagcgcccgcgcattgtgcaggttaaaacagaggagattaaccatgacaatgcgcaacctggcggcagcgcaaaagatg

SEQ ID NO: 219627 - DNA, 103 bp, Artificial Sequence
  Synthetic Polynucleotide
taatacgactcactatagggaggcaggacgacttgagcgcccgcgcattgaacagaggagacaatgcatgggcgctcaaaacctggcggcagcgcaaaagatg

SEQ ID NO: 219628 - DNA, 103 bp, Artificial Sequence
  Synthetic Polynucleotide
taatacgactcactatagggctgctcgtccaggcaggacgacttgagcgcaacagaggagagcgctcatgtcgtcctgcaacctggcggcagcgcaaaagatg

SEQ ID NO: 219629 - DNA, 103 bp, Artificial Sequence
  Synthetic Polynucleotide
taatacgactcactataggggctcccgcctctgctcgtccaggcaggacgaacagaggagacgtcctatgtggacgagcaacctggcggcagcgcaaaagatg

SEQ ID NO: 219630 - DNA, 103 bp, Artificial Sequence
  Synthetic Polynucleotide
taatacgactcactatagggaggcagcccagctcccgcctctgctcgtccaacagaggagaggacgaatggaggcgggaaacctggcggcagcgcaaaagatg

SEQ ID NO: 219631 - DNA, 103 bp, Artificial Sequence
  Synthetic Polynucleotide
taatacgactcactataggggtttgatccgtcgtgacgtatctcggcatcaacagaggagagatgccatgatacgtcacaacctggcggcagcgcaaaagatg

SEQ ID NO: 219632 - DNA, 103 bp, Artificial Sequence
  Synthetic Polynucleotide
taatacgactcactataggggtaggcatcgaggcagcccagctcccgcctaacagaggagaaggcggatgctgggctgcaacctggcggcagcgcaaaagatg

SEQ ID NO: 219633 - DNA, 103 bp, Artificial Sequence
  Synthetic Polynucleotide
taatacgactcactatagggcatggcggcggtaggcatcgaggcagcccaaacagaggagatgggctatgtcgatgcctaacctggcggcagcgcaaaagatg

SEQ ID NO: 219634 - DNA, 103 bp, Artificial Sequence
  Synthetic Polynucleotide
taatacgactcactatagggagggacaggtcatggcggcggtaggcatcgaacagaggagacgatgcatgccgccgccaaacctggcggcagcgcaaaagatg

SEQ ID NO: 219635 - DNA, 103 bp, Artificial Sequence
  Synthetic Polynucleotide
taatacgactcactatagggatggctcatgagggacaggtcatggcggcgaacagaggagacgccgcatggacctgtccaacctggcggcagcgcaaaagatg

SEQ ID NO: 219636 - DNA, 103 bp, Artificial Sequence
  Synthetic Polynucleotide
taatacgactcactatagggactgagagccatggctcatgagggacaggtaacagaggagaacctgtatgtcatgagccaacctggcggcagcgcaaaagatg

SEQ ID NO: 219637 - DNA, 103 bp, Artificial Sequence
  Synthetic Polynucleotide
taatacgactcactatagggtgcattccatactgagagccatggctcatgaacagaggagacatgagatgtggctctcaaacctggcggcagcgcaaaagatg

SEQ ID NO: 219638 - DNA, 103 bp, Artificial Sequence
  Synthetic Polynucleotide
taatacgactcactatagggttgatctgggtgcattccatactgagagccaacagaggagaggctctatgtatggaatgaacctggcggcagcgcaaaagatg

SEQ ID NO: 219639 - DNA, 103 bp, Artificial Sequence
  Synthetic Polynucleotide
taatacgactcactataggggcaggagtctttgatctgggtgcattccataacagaggagaatggaaatgacccagatcaacctggcggcagcgcaaaagatg

SEQ ID NO: 219640 - DNA, 103 bp, Artificial Sequence
  Synthetic Polynucleotide
taatacgactcactatagggctgggccctggcaggagtctttgatctgggaacagaggagacccagaatgaagactcctaacctggcggcagcgcaaaagatg

SEQ ID NO: 219641 - DNA, 103 bp, Artificial Sequence
  Synthetic Polynucleotide
taatacgactcactatagggcagccccaggctgggccctggcaggagtctaacagaggagaagactcatgccagggcccaacctggcggcagcgcaaaagatg

SEQ ID NO: 219642 - DNA, 103 bp, Artificial Sequence
  Synthetic Polynucleotide
taatacgactcactatagggaacggtagctgtttgatccgtcgtgacgtaaacagaggagatacgtcatgacggatcaaaacctggcggcagcgcaaaagatg

SEQ ID NO: 219643 - DNA, 103 bp, Artificial Sequence
  Synthetic Polynucleotide
taatacgactcactatagggccgcggcggccagccccaggctgggccctgaacagaggagacagggcatggcctggggcaacctggcggcagcgcaaaagatg

SEQ ID NO: 219644 - DNA, 103 bp, Artificial Sequence
  Synthetic Polynucleotide
taatacgactcactatagggtcgtctgctcccgcggcggccagccccaggaacagaggagacctgggatgggccgccgcaacctggcggcagcgcaaaagatg

SEQ ID NO: 219645 - DNA, 103 bp, Artificial Sequence
  Synthetic Polynucleotide
taatacgactcactataggggccctgcaagtcgtctgctcccgcggcggcaacagaggagagccgccatgggagcagacaacctggcggcagcgcaaaagatg

SEQ ID NO: 219646 - DNA, 103 bp, Artificial Sequence
  Synthetic Polynucleotide
taatacgactcactatagggcctccacagagccctgcaagtcgtctgctcaacagaggagagagcagatgacttgcaggaacctggcggcagcgcaaaagatg

SEQ ID NO: 219647 - DNA, 103 bp, Artificial Sequence
  Synthetic Polynucleotide
taatacgactcactatagggccacactgggcctccacagagccctgcaagaacagaggagacttgcaatgctctgtggaaacctggcggcagcgcaaaagatg

SEQ ID NO: 219648 - DNA, 103 bp, Artificial Sequence
  Synthetic Polynucleotide
taatacgactcactataggggagaacaagcccacactgggcctccacagaaacagaggagatctgtgatggcccagtgtaacctggcggcagcgcaaaagatg

SEQ ID NO: 219649 - DNA, 103 bp, Artificial Sequence
  Synthetic Polynucleotide
taatacgactcactatagggcttggccattgagaacaagcccacactgggaacagaggagacccagtatgggcttgttcaacctggcggcagcgcaaaagatg

SEQ ID NO: 219650 - DNA, 103 bp, Artificial Sequence
  Synthetic Polynucleotide
taatacgactcactatagggatcactccaccttggccattgagaacaagcaacagaggagagcttgtatgcaatggccaaacctggcggcagcgcaaaagatg

SEQ ID NO: 219651 - DNA, 103 bp, Artificial Sequence
  Synthetic Polynucleotide
taatacgactcactatagggacctcttcttatcactccaccttggccattaacagaggagaaatggcatgggtggagtgaacctggcggcagcgcaaaagatg

SEQ ID NO: 219652 - DNA, 103 bp, Artificial Sequence
  Synthetic Polynucleotide
taatacgactcactatagggcacaggtgccacctcttcttatcactccacaacagaggagagtggagatgtaagaagagaacctggcggcagcgcaaaagatg

SEQ ID NO: 219653 - DNA, 103 bp, Artificial Sequence
  Synthetic Polynucleotide
taatacgactcactatagggagctgcatcaaacggtagctgtttgatccgaacagaggagacggatcatgcagctaccgaacctggcggcagcgcaaaagatg

SEQ ID NO: 219654 - DNA, 103 bp, Artificial Sequence
  Synthetic Polynucleotide
taatacgactcactataggggggttgaccacacaggtgccacctcttcttaacagaggagaaagaagatgtggcacctgaacctggcggcagcgcaaaagatg

SEQ ID NO: 219655 - DNA, 103 bp, Artificial Sequence
  Synthetic Polynucleotide
taatacgactcactatagggtaagtctgtggggttgaccacacaggtgccaacagaggagaggcaccatggtggtcaacaacctggcggcagcgcaaaagatg

SEQ ID NO: 219656 - DNA, 103 bp, Artificial Sequence
  Synthetic Polynucleotide
taatacgactcactatagggcagagcaaaataagtctgtggggttgaccaaacagaggagatggtcaatgccacagactaacctggcggcagcgcaaaagatg

SEQ ID NO: 219657 - DNA, 103 bp, Artificial Sequence
  Synthetic Polynucleotide
taatacgactcactatagggcggccagggacagagcaaaataagtctgtgaacagaggagacacagaatgattttgctcaacctggcggcagcgcaaaagatg

SEQ ID NO: 219658 - DNA, 103 bp, Artificial Sequence
  Synthetic Polynucleotide
taatacgactcactatagggaagggacaaacggccagggacagagcaaaaaacagaggagattttgcatggtccctggcaacctggcggcagcgcaaaagatg

SEQ ID NO: 219659 - DNA, 103 bp, Artificial Sequence
  Synthetic Polynucleotide
taatacgactcactatagggtagaactaagaagggacaaacggccagggaaacagaggagatccctgatggtttgtcccaacctggcggcagcgcaaaagatg

SEQ ID NO: 219660 - DNA, 103 bp, Artificial Sequence
  Synthetic Polynucleotide
taatacgactcactatagggtatttggaagtagaactaagaagggacaaaaacagaggagatttgtcatgtcttagttcaacctggcggcagcgcaaaagatg

SEQ ID NO: 219661 - DNA, 103 bp, Artificial Sequence
  Synthetic Polynucleotide
taatacgactcactatagggggtcaccttgtatttggaagtagaactaagaacagaggagacttagtatgacttccaaaaacctggcggcagcgcaaaagatg

SEQ ID NO: 219662 - DNA, 103 bp, Artificial Sequence
  Synthetic Polynucleotide
taatacgactcactatagggcctcagcaatggtcaccttgtatttggaagaacagaggagacttccaatgacaaggtgaaacctggcggcagcgcaaaagatg

SEQ ID NO: 219663 - DNA, 103 bp, Artificial Sequence
  Synthetic Polynucleotide
taatacgactcactatagggcgcctctttacctcagcaatggtcaccttgaacagaggagacaaggtatgcattgctgaaacctggcggcagcgcaaaagatg

SEQ ID NO: 219664 - DNA, 103 bp, Artificial Sequence
  Synthetic Polynucleotide
taatacgactcactatagggcagacagccaagctgcatcaaacggtagctaacagaggagaagctacatgttgatgcagaacctggcggcagcgcaaaagatg

SEQ ID NO: 219665 - DNA, 103 bp, Artificial Sequence
  Synthetic Polynucleotide
taatacgactcactatagggtggggagaggcgcctctttacctcagcaataacagaggagaattgctatggtaaagaggaacctggcggcagcgcaaaagatg

SEQ ID NO: 219666 - DNA, 103 bp, Artificial Sequence
  Synthetic Polynucleotide
taatacgactcactatagggggcactcaggtggggagaggcgcctctttaaacagaggagataaagaatggcctctcccaacctggcggcagcgcaaaagatg

SEQ ID NO: 219667 - DNA, 103 bp, Artificial Sequence
  Synthetic Polynucleotide
taatacgactcactataggggaagcattgaggcactcaggtggggagaggaacagaggagacctctcatgacctgagtgaacctggcggcagcgcaaaagatg

SEQ ID NO: 219668 - DNA, 103 bp, Artificial Sequence
  Synthetic Polynucleotide
taatacgactcactatagggtcccaagagtgaagcattgaggcactcaggaacagaggagacctgagatgctcaatgctaacctggcggcagcgcaaaagatg

SEQ ID NO: 219669 - DNA, 103 bp, Artificial Sequence
  Synthetic Polynucleotide
taatacgactcactatagggtcaaaatgcctcccaagagtgaagcattgaaacagaggagatcaatgatgcactcttggaacctggcggcagcgcaaaagatg

SEQ ID NO: 219670 - DNA, 103 bp, Artificial Sequence
  Synthetic Polynucleotide
taatacgactcactatagggtttgctcttctcaaaatgcctcccaagagtaacagaggagaactcttatgaggcattttaacctggcggcagcgcaaaagatg

SEQ ID NO: 219671 - DNA, 103 bp, Artificial Sequence
  Synthetic Polynucleotide
taatacgactcactatagggattctttgattttgctcttctcaaaatgccaacagaggagaggcattatgagaagagcaaacctggcggcagcgcaaaagatg

SEQ ID NO: 219672 - DNA, 103 bp, Artificial Sequence
  Synthetic Polynucleotide
taatacgactcactatagggagcggcccccattctttgattttgctcttcaacagaggagagaagagatgaatcaaagaaacctggcggcagcgcaaaagatg

SEQ ID NO: 219673 - DNA, 103 bp, Artificial Sequence
  Synthetic Polynucleotide
taatacgactcactatagggtctctcaggcagcggcccccattctttgataacagaggagaatcaaaatgtgggggccgaacctggcggcagcgcaaaagatg

SEQ ID NO: 219674 - DNA, 103 bp, Artificial Sequence
  Synthetic Polynucleotide
taatacgactcactatagggatccaatttctctctcaggcagcggcccccaacagaggagagggggcatgtgcctgagaaacctggcggcagcgcaaaagatg

SEQ ID NO: 219675 - DNA, 103 bp, Artificial Sequence
  Synthetic Polynucleotide
taatacgactcactatagggctactgactccagacagccaagctgcatcaaacagaggagatgatgcatgttggctgtcaacctggcggcagcgcaaaagatg

SEQ ID NO: 219676 - DNA, 103 bp, Artificial Sequence
  Synthetic Polynucleotide
taatacgactcactatagggagccaagcctatccaatttctctctcaggcaacagaggagagcctgaatgagaaattggaacctggcggcagcgcaaaagatg

SEQ ID NO: 219677 - DNA, 103 bp, Artificial Sequence
  Synthetic Polynucleotide
taatacgactcactatagggggtaagtttaagccaagcctatccaatttcaacagaggagagaaattatgtaggcttggaacctggcggcagcgcaaaagatg

SEQ ID NO: 219678 - DNA, 103 bp, Artificial Sequence
  Synthetic Polynucleotide
taatacgactcactatagggtcttcctgctggtaagtttaagccaagcctaacagaggagaaggcttatgttaaacttaaacctggcggcagcgcaaaagatg

SEQ ID NO: 219679 - DNA, 103 bp, Artificial Sequence
  Synthetic Polynucleotide
taatacgactcactatagggctgctttccgtcttcctgctggtaagtttaaacagaggagataaactatgcagcaggaaaacctggcggcagcgcaaaagatg

SEQ ID NO: 219680 - DNA, 103 bp, Artificial Sequence
  Synthetic Polynucleotide
taatacgactcactataggggtgacattagctgctttccgtcttcctgctaacagaggagaagcaggatgacggaaagcaacctggcggcagcgcaaaagatg

SEQ ID NO: 219681 - DNA, 103 bp, Artificial Sequence
  Synthetic Polynucleotide
taatacgactcactatagggagtaaggagggtgacattagctgctttccgaacagaggagacggaaaatggctaatgtcaacctggcggcagcgcaaaagatg

SEQ ID NO: 219682 - DNA, 103 bp, Artificial Sequence
  Synthetic Polynucleotide
taatacgactcactatagggcaaccaaggaagtaaggagggtgacattagaacagaggagactaatgatgccctccttaaacctggcggcagcgcaaaagatg

SEQ ID NO: 219683 - DNA, 103 bp, Artificial Sequence
  Synthetic Polynucleotide
taatacgactcactataggggcctccccttcaaccaaggaagtaaggaggaacagaggagacctcctatgttccttggtaacctggcggcagcgcaaaagatg

SEQ ID NO: 219684 - DNA, 103 bp, Artificial Sequence
  Synthetic Polynucleotide
taatacgactcactatagggcaagtgcaaagcctccccttcaaccaaggaaacagaggagatccttgatggaaggggagaacctggcggcagcgcaaaagatg

SEQ ID NO: 219685 - DNA, 103 bp, Artificial Sequence
  Synthetic Polynucleotide
taatacgactcactatagggaatcccgagccaagtgcaaagcctccccttaacagaggagaaaggggatgctttgcactaacctggcggcagcgcaaaagatg

SEQ ID NO: 219686 - DNA, 103 bp, Artificial Sequence
  Synthetic Polynucleotide
taatacgactcactataggggtggaattggctactgactccagacagccaaacagaggagatggctgatgggagtcagtaacctggcggcagcgcaaaagatg

SEQ ID NO: 219687 - DNA, 103 bp, Artificial Sequence
  Synthetic Polynucleotide
taatacgactcactataggggtgtagccaaaatcccgagccaagtgcaaaaacagaggagatttgcaatgggctcgggaaacctggcggcagcgcaaaagatg

SEQ ID NO: 219688 - DNA, 103 bp, Artificial Sequence
  Synthetic Polynucleotide
taatacgactcactatagggtgtttcacaagtgtagccaaaatcccgagcaacagaggagagctcggatgtttggctacaacctggcggcagcgcaaaagatg

SEQ ID NO: 219689 - DNA, 103 bp, Artificial Sequence
  Synthetic Polynucleotide
taatacgactcactatagggctggaaactctgtttcacaagtgtagccaaaacagaggagattggctatgcttgtgaaaaacctggcggcagcgcaaaagatg

SEQ ID NO: 219690 - DNA, 103 bp, Artificial Sequence
  Synthetic Polynucleotide
taatacgactcactatagggactgctttggctggaaactctgtttcacaaaacagaggagattgtgaatgagagtttccaacctggcggcagcgcaaaagatg

SEQ ID NO: 219691 - DNA, 103 bp, Artificial Sequence
  Synthetic Polynucleotide
taatacgactcactatagggatgttctcctactgctttggctggaaactcaacagaggagagagtttatggccaaagcaaacctggcggcagcgcaaaagatg

SEQ ID NO: 219692 - DNA, 103 bp, Artificial Sequence
  Synthetic Polynucleotide
taatacgactcactataggggtctggcaagatgttctcctactgctttggaacagaggagaccaaagatgtaggagaacaacctggcggcagcgcaaaagatg

SEQ ID NO: 219693 - DNA, 103 bp, Artificial Sequence
  Synthetic Polynucleotide
taatacgactcactatagggtccatatgttgtctggcaagatgttctcctaacagaggagaaggagaatgtcttgccagaacctggcggcagcgcaaaagatg

SEQ ID NO: 219694 - DNA, 103 bp, Artificial Sequence
  Synthetic Polynucleotide
taatacgactcactatagggttctttctgttccatatgttgtctggcaagaacagaggagacttgccatgcaacatatgaacctggcggcagcgcaaaagatg

SEQ ID NO: 219695 - DNA, 103 bp, Artificial Sequence
  Synthetic Polynucleotide
taatacgactcactatagggttgctgtctgttctttctgttccatatgttaacagaggagaaacataatgaacagaaagaacctggcggcagcgcaaaagatg

SEQ ID NO: 219696 - DNA, 103 bp, Artificial Sequence
  Synthetic Polynucleotide
taatacgactcactatagggatcttttttcttgctgtctgttctttctgtaacagaggagaacagaaatgacagacagcaacctggcggcagcgcaaaagatg

SEQ ID NO: 219697 - DNA, 103 bp, Artificial Sequence
  Synthetic Polynucleotide
taatacgactcactatagggctccatggcggagtaggtgtgcaccagcataacagaggagaatgctgatgcacacctacaacctggcggcagcgcaaaagatg

SEQ ID NO: 219698 - DNA, 103 bp, Artificial Sequence
  Synthetic Polynucleotide
taatacgactcactataggggtggcagagcgggggcgccggcccgtaggcaacagaggagagcctacatgccggcgcccaacctggcggcagcgcaaaagatg

SEQ ID NO: 219699 - DNA, 103 bp, Artificial Sequence
  Synthetic Polynucleotide
taatacgactcactataggggctgtgcagctcccccgggtcagcgtgctgaacagaggagacagcacatggacccggggaacctggcggcagcgcaaaagatg

SEQ ID NO: 219700 - DNA, 103 bp, Artificial Sequence
  Synthetic Polynucleotide
taatacgactcactatagggtgctcttgcggctgtgcagctcccccgggtaacagaggagaacccggatgagctgcacaaacctggcggcagcgcaaaagatg

SEQ ID NO: 219701 - DNA, 103 bp, Artificial Sequence
  Synthetic Polynucleotide
taatacgactcactataggggccagcagcatgctcttgcggctgtgcagcaacagaggagagctgcaatgccgcaagagaacctggcggcagcgcaaaagatg

SEQ ID NO: 219702 - DNA, 103 bp, Artificial Sequence
  Synthetic Polynucleotide
taatacgactcactatagggctgcttggcagccagcagcatgctcttgcgaacagaggagacgcaagatgatgctgctgaacctggcggcagcgcaaaagatg

SEQ ID NO: 219703 - DNA, 103 bp, Artificial Sequence
  Synthetic Polynucleotide
taatacgactcactatagggccttgcagatctgcttggcagccagcagcaaacagaggagatgctgcatgctgccaagcaacctggcggcagcgcaaaagatg

SEQ ID NO: 219704 - DNA, 103 bp, Artificial Sequence
  Synthetic Polynucleotide
taatacgactcactatagggtctgcaaactccttgcagatctgcttggcaaacagaggagatgccaaatggatctgcaaaacctggcggcagcgcaaaagatg

SEQ ID NO: 219705 - DNA, 103 bp, Artificial Sequence
  Synthetic Polynucleotide
taatacgactcactatagggagccatcaagtctgcaaactccttgcagataacagaggagaatctgcatggagtttgcaaacctggcggcagcgcaaaagatg

SEQ ID NO: 219706 - DNA, 103 bp, Artificial Sequence
  Synthetic Polynucleotide
taatacgactcactatagggagcggtcctgagccatcaagtctgcaaactaacagaggagaagtttgatgacttgatggaacctggcggcagcgcaaaagatg

SEQ ID NO: 219707 - DNA, 103 bp, Artificial Sequence
  Synthetic Polynucleotide
taatacgactcactatagggcccagcggtgagcggtcctgagccatcaagaacagaggagacttgatatgtcaggaccgaacctggcggcagcgcaaaagatg

SEQ ID NO: 219708 - DNA, 103 bp, Artificial Sequence
  Synthetic Polynucleotide
taatacgactcactataggggcggctgttgcccagcggtgagcggtcctgaacagaggagacaggacatgtcaccgctgaacctggcggcagcgcaaaagatg

SEQ ID NO: 219709 - DNA, 103 bp, Artificial Sequence
  Synthetic Polynucleotide
taatacgactcactatagggcggccggcgtgtggcagagcgggggcgccgaacagaggagacggcgcatgcgctctgccaacctggcggcagcgcaaaagatg

SEQ ID NO: 219710 - DNA, 103 bp, Artificial Sequence
  Synthetic Polynucleotide
taatacgactcactatagggtgagtgctgggcggctgttgcccagcggtgaacagaggagacaccgcatggcaacagccaacctggcggcagcgcaaaagatg

SEQ ID NO: 219711 - DNA, 103 bp, Artificial Sequence
  Synthetic Polynucleotide
taatacgactcactatagggggctccaggatgagtgctgggcggctgttgaacagaggagacaacagatgcccagcactaacctggcggcagcgcaaaagatg

SEQ ID NO: 219712 - DNA, 103 bp, Artificial Sequence
  Synthetic Polynucleotide
taatacgactcactatagggctgtactccgggctccaggatgagtgctggaacagaggagaccagcaatgatcctggagaacctggcggcagcgcaaaagatg

SEQ ID NO: 219713 - DNA, 103 bp, Artificial Sequence
  Synthetic Polynucleotide
taatacgactcactatagggtcaagcagctctgtactccgggctccaggaaacagaggagatcctggatgccggagtacaacctggcggcagcgcaaaagatg

SEQ ID NO: 219714 - DNA, 103 bp, Artificial Sequence
  Synthetic Polynucleotide
taatacgactcactatagggctaaagtgtgtcaagcagctctgtactccgaacagaggagacggagtatggagctgcttaacctggcggcagcgcaaaagatg

SEQ ID NO: 219715 - DNA, 103 bp, Artificial Sequence
  Synthetic Polynucleotide
taatacgactcactatagggggtgatgaggctaaagtgtgtcaagcagctaacagaggagaagctgcatgacacactttaacctggcggcagcgcaaaagatg

SEQ ID NO: 219716 - DNA, 103 bp, Artificial Sequence
  Synthetic Polynucleotide
taatacgactcactatagggcgaagccatgggtgatgaggctaaagtgtgaacagaggagacacactatggcctcatcaaacctggcggcagcgcaaaagatg

SEQ ID NO: 219717 - DNA, 103 bp, Artificial Sequence
  Synthetic Polynucleotide
taatacgactcactataggggcaggcccaccgaagccatgggtgatgaggaacagaggagacctcatatgccatggcttaacctggcggcagcgcaaaagatg

SEQ ID NO: 219718 - DNA, 103 bp, Artificial Sequence
  Synthetic Polynucleotide
taatacgactcactatagggagcacagatggcaggcccaccgaagccatgaacagaggagacatggcatgggtgggcctaacctggcggcagcgcaaaagatg

SEQ ID NO: 219719 - DNA, 103 bp, Artificial Sequence
  Synthetic Polynucleotide
taatacgactcactatagggcagtgagggcagcacagatggcaggcccacaacagaggagagtgggcatgccatctgtgaacctggcggcagcgcaaaagatg

SEQ ID NO: 219720 - DNA, 103 bp, Artificial Sequence
  Synthetic Polynucleotide
taatacgactcactataggggcagctgtggcggccggcgtgtggcagagcaacagaggagagctctgatgcacgccggcaacctggcggcagcgcaaaagatg

SEQ ID NO: 219721 - DNA, 103 bp, Artificial Sequence
  Synthetic Polynucleotide
taatacgactcactatagggttctggaaggcagtgagggcagcacagatgaacagaggagacatctgatgtgccctcacaacctggcggcagcgcaaaagatg

SEQ ID NO: 219722 - DNA, 103 bp, Artificial Sequence
  Synthetic Polynucleotide
taatacgactcactatagggcagcaaatagttctggaaggcagtgagggcaacagaggagagccctcatggccttccagaacctggcggcagcgcaaaagatg

SEQ ID NO: 219723 - DNA, 103 bp, Artificial Sequence
  Synthetic Polynucleotide
taatacgactcactatagggtgagtgactccagcaaatagttctggaaggaacagaggagaccttccatgactatttgcaacctggcggcagcgcaaaagatg

SEQ ID NO: 219724 - DNA, 103 bp, Artificial Sequence
  Synthetic Polynucleotide
taatacgactcactatagggtccagccccttgagtgactccagcaaatagaacagaggagactatttatgggagtcactaacctggcggcagcgcaaaagatg

SEQ ID NO: 219725 - DNA, 103 bp, Artificial Sequence
  Synthetic Polynucleotide
taatacgactcactatagggaaacatcttgtccagccccttgagtgactcaacagaggagagagtcaatgaaggggctgaacctggcggcagcgcaaaagatg

SEQ ID NO: 219726 - DNA, 103 bp, Artificial Sequence
  Synthetic Polynucleotide
taatacgactcactatagggcactgcttagaaacatcttgtccagcccctaacagaggagaaggggcatgacaagatgtaacctggcggcagcgcaaaagatg

SEQ ID NO: 219727 - DNA, 103 bp, Artificial Sequence
  Synthetic Polynucleotide
taatacgactcactatagggccactgcccacactgcttagaaacatcttgaacagaggagacaagatatgtctaagcagaacctggcggcagcgcaaaagatg

SEQ ID NO: 219728 - DNA, 103 bp, Artificial Sequence
  Synthetic Polynucleotide
taatacgactcactatagggttcaccatgcccactgcccacactgcttagaacagaggagactaagcatggtgggcagtaacctggcggcagcgcaaaagatg

SEQ ID NO: 219729 - DNA, 103 bp, Artificial Sequence
  Synthetic Polynucleotide
taatacgactcactatagggaagccttggtttcaccatgcccactgcccaaacagaggagatgggcaatgggcatggtgaacctggcggcagcgcaaaagatg

SEQ ID NO: 219730 - DNA, 103 bp, Artificial Sequence
  Synthetic Polynucleotide
taatacgactcactatagggtccttctccgaagccttggtttcaccatgcaacagaggagagcatggatgaaccaaggcaacctggcggcagcgcaaaagatg

SEQ ID NO: 219731 - DNA, 103 bp, Artificial Sequence
  Synthetic Polynucleotide
taatacgactcactataggggaattcggcggcagctgtggcggccggcgtaacagaggagaacgccgatggccacagctaacctggcggcagcgcaaaagatg

SEQ ID NO: 219732 - DNA, 103 bp, Artificial Sequence
  Synthetic Polynucleotide
taatacgactcactatagggatgcttggcatccttctccgaagccttggtaacagaggagaaccaagatgtcggagaagaacctggcggcagcgcaaaagatg

SEQ ID NO: 219733 - DNA, 103 bp, Artificial Sequence
  Synthetic Polynucleotide
taatacgactcactatagggagggcggctggaattcggcggcagctgtggaacagaggagaccacagatgccgccgaataacctggcggcagcgcaaaagatg

SEQ ID NO: 219734 - DNA, 103 bp, Artificial Sequence
  Synthetic Polynucleotide
taatacgactcactatagggggcgggaagtagggcggctggaattcggcgaacagaggagacgccgaatgccagccgccaacctggcggcagcgcaaaagatg

SEQ ID NO: 219735 - DNA, 103 bp, Artificial Sequence
  Synthetic Polynucleotide
taatacgactcactatagggcgggtagggcggcgggaagtagggcggctgaacagaggagacagccgatgtacttcccgaacctggcggcagcgcaaaagatg

SEQ ID NO: 219736 - DNA, 103 bp, Artificial Sequence
  Synthetic Polynucleotide
taatacgactcactataggggcggtggctgcgggtagggcggcgggaagtaacagaggagaacttccatgcgccctaccaacctggcggcagcgcaaaagatg

SEQ ID NO: 219737 - DNA, 103 bp, Artificial Sequence
  Synthetic Polynucleotide
taatacgactcactatagggccgtagggcagcggtggctgcgggtagggcaacagaggagagccctaatggcagccaccaacctggcggcagcgcaaaagatg

SEQ ID NO: 219738 - DNA, 103 bp, Artificial Sequence
  Synthetic Polynucleotide
taatacgactcactataggggggcgcctgaccgtagggcagcggtggctgaacagaggagacagccaatgctgccctacaacctggcggcagcgcaaaagatg

SEQ ID NO: 219739 - DNA, 103 bp, Artificial Sequence
  Synthetic Polynucleotide
taatacgactcactatagggcgtcggggcgctccatggcggagtaggtgtaacagaggagaacacctatgccgccatggaacctggcggcagcgcaaaagatg

SEQ ID NO: 219740 - DNA, 103 bp, Artificial Sequence
  Synthetic Polynucleotide
taatacgactcactatagggcggcggcgtcgggcgcctgaccgtagggcaaacagaggagatgccctatggtcaggcgcaacctggcggcagcgcaaaagatg

SEQ ID NO: 219741 - DNA, 103 bp, Artificial Sequence
  Synthetic Polynucleotide
taatacgactcactatagggggaaaggctgcggcggcgtcgggcgcctgaaacagaggagatcaggcatgcgacgccgcaacctggcggcagcgcaaaagatg

SEQ ID NO: 219742 - DNA, 103 bp, Artificial Sequence
  Synthetic Polynucleotide
taatacgactcactatagggtgccaggtggggaaaggctgcggcggcgtcaacagaggagagacgccatggcagcctttaacctggcggcagcgcaaaagatg

SEQ ID NO: 219743 - DNA, 103 bp, Artificial Sequence
  Synthetic Polynucleotide
taatacgactcactatagggatgggtcccctgccaggtggggaaaggctgaacagaggagacagcctatgcccacctggaacctggcggcagcgcaaaagatg

SEQ ID NO: 219744 - DNA, 103 bp, Artificial Sequence
  Synthetic Polynucleotide
taatacgactcactatagggaggccgccatatgggtcccctgccaggtggaacagaggagaccacctatgaggggacccaacctggcggcagcgcaaaagatg

SEQ ID NO: 219745 - DNA, 103 bp, Artificial Sequence
  Synthetic Polynucleotide
taatacgactcactatagggcaggggcgccaggccgccatatgggtccccaacagaggagaggggacatgtatggcggcaacctggcggcagcgcaaaagatg

SEQ ID NO: 219746 - DNA, 103 bp, Artificial Sequence
  Synthetic Polynucleotide
taatacgactcactataggggcggctgcgccaggggcgccaggccgccataacagaggagaatggcgatgtggcgccccaacctggcggcagcgcaaaagatg

SEQ ID NO: 219747 - DNA, 103 bp, Artificial Sequence
  Synthetic Polynucleotide
taatacgactcactatagggtgaggaggctgcggctgcgccaggggcgccaacagaggagaggcgccatgggcgcagccaacctggcggcagcgcaaaagatg

SEQ ID NO: 219748 - DNA, 103 bp, Artificial Sequence
  Synthetic Polynucleotide
taatacgactcactatagggccaggcggcctgaggaggctgcggctgcgcaacagaggagagcgcagatgcagcctcctaacctggcggcagcgcaaaagatg

SEQ ID NO: 219749 - DNA, 103 bp, Artificial Sequence
  Synthetic Polynucleotide
taatacgactcactatagggggggcgcggcccaggcggcctgaggaggctaacagaggagaagcctcatgaggccgcctaacctggcggcagcgcaaaagatg

SEQ ID NO: 219750 - DNA, 103 bp, Artificial Sequence
  Synthetic Polynucleotide
taatacgactcactataggggctcccagcccgtcggggcgctccatggcgaacagaggagacgccatatggcgccccgaaacctggcggcagcgcaaaagatg

SEQ ID NO: 219751 - DNA, 103 bp, Artificial Sequence
  Synthetic Polynucleotide
taatacgactcactataggggcggctgcgcggggcgcggcccaggcggccaacagaggagaggccgcatgggccgcgccaacctggcggcagcgcaaaagatg

SEQ ID NO: 219752 - DNA, 103 bp, Artificial Sequence
  Synthetic Polynucleotide
taatacgactcactataggggtgggcgcgggcggctgcgcggggcgcggcaacagaggagagccgcgatgcgcgcagccaacctggcggcagcgcaaaagatg

SEQ ID NO: 219753 - DNA, 103 bp, Artificial Sequence
  Synthetic Polynucleotide
taatacgactcactataggggaggctcctcgtgggcgcgggcggctgcgcaacagaggagagcgcagatgcccgcgcccaacctggcggcagcgcaaaagatg

SEQ ID NO: 219754 - DNA, 103 bp, Artificial Sequence
  Synthetic Polynucleotide
taatacgactcactatagggagcaggccgggaggctcctcgtgggcgcggaacagaggagaccgcgcatgcgaggagccaacctggcggcagcgcaaaagatg

SEQ ID NO: 219755 - DNA, 103 bp, Artificial Sequence
  Synthetic Polynucleotide
taatacgactcactataggggggcggtgccagcaggccgggaggctcctcaacagaggagagaggagatgcccggcctgaacctggcggcagcgcaaaagatg

SEQ ID NO: 219756 - DNA, 103 bp, Artificial Sequence
  Synthetic Polynucleotide
taatacgactcactataggggggcgcgggcgggcggtgccagcaggccggaacagaggagaccggccatgtggcaccgcaacctggcggcagcgcaaaagatg

SEQ ID NO: 219757 - DNA, 103 bp, Artificial Sequence
  Synthetic Polynucleotide
taatacgactcactatagggtcaaggcccagggcgcgggcgggcggtgccaacagaggagaggcaccatgcgcccgcgcaacctggcggcagcgcaaaagatg

SEQ ID NO: 219758 - DNA, 103 bp, Artificial Sequence
  Synthetic Polynucleotide
taatacgactcactatagggacggcgcgggtcaaggcccagggcgcgggcaacagaggagagcccgcatgctgggccttaacctggcggcagcgcaaaagatg

SEQ ID NO: 219759 - DNA, 103 bp, Artificial Sequence
  Synthetic Polynucleotide
taatacgactcactatagggtggcatagtcacggcgcgggtcaaggcccaaacagaggagatgggccatgacccgcgccaacctggcggcagcgcaaaagatg

SEQ ID NO: 219760 - DNA, 103 bp, Artificial Sequence
  Synthetic Polynucleotide
taatacgactcactatagggggcacggcagtggcatagtcacggcgcgggaacagaggagacccgcgatgtgactatgcaacctggcggcagcgcaaaagatg

SEQ ID NO: 219761 - DNA, 103 bp, Artificial Sequence
  Synthetic Polynucleotide
taatacgactcactataggggccggcagctgctcccagcccgtcggggcgaacagaggagacgccccatggggctgggaaacctggcggcagcgcaaaagatg

SEQ ID NO: 219762 - DNA, 103 bp, Artificial Sequence
  Synthetic Polynucleotide
taatacgactcactatagggcaggagccggggcacggcagtggcatagtcaacagaggagagactatatgactgccgtgaacctggcggcagcgcaaaagatg

SEQ ID NO: 219763 - DNA, 103 bp, Artificial Sequence
  Synthetic Polynucleotide
taatacgactcactatagggccaggccgtgcaggagccggggcacggcagaacagaggagactgccgatgcccggctccaacctggcggcagcgcaaaagatg

SEQ ID NO: 219764 - DNA, 103 bp, Artificial Sequence
  Synthetic Polynucleotide
taatacgactcactataggggcgccgtcggccaggccgtgcaggagccggaacagaggagaccggctatggcacggcctaacctggcggcagcgcaaaagatg

SEQ ID NO: 219765 - DNA, 103 bp, Artificial Sequence
  Synthetic Polynucleotide
taatacgactcactatagggcaggccgtgcgcgccgtcggccaggccgtgaacagaggagacacggcatggccgacggcaacctggcggcagcgcaaaagatg

SEQ ID NO: 219766 - DNA, 103 bp, Artificial Sequence
  Synthetic Polynucleotide
taatacgactcactataggggtgcgtctgccaggccgtgcgcgccgtcggaacagaggagaccgacgatgcgcacggccaacctggcggcagcgcaaaagatg

SEQ ID NO: 219767 - DNA, 103 bp, Artificial Sequence
  Synthetic Polynucleotide
taatacgactcactatagggaggccgagaggtgcgtctgccaggccgtgcaacagaggagagcacggatgggcagacgcaacctggcggcagcgcaaaagatg

SEQ ID NO: 219768 - DNA, 103 bp, Artificial Sequence
  Synthetic Polynucleotide
taatacgactcactatagggcagccccggaaggccgagaggtgcgtctgcaacagaggagagcagacatgcctctcggcaacctggcggcagcgcaaaagatg

SEQ ID NO: 219769 - DNA, 103 bp, Artificial Sequence
  Synthetic Polynucleotide
taatacgactcactataggggggccgccgccagccccggaaggccgagagaacagaggagactctcgatgttccggggcaacctggcggcagcgcaaaagatg

SEQ ID NO: 219770 - DNA, 103 bp, Artificial Sequence
  Synthetic Polynucleotide
taatacgactcactatagggtccagaccgggggccgccgccagccccggaaacagaggagatccgggatgggcggcggcaacctggcggcagcgcaaaagatg

SEQ ID NO: 219771 - DNA, 103 bp, Artificial Sequence
  Synthetic Polynucleotide
taatacgactcactatagggctgcaggtcctccagaccgggggccgccgcaacagaggagagcggcgatgcccggtctgaacctggcggcagcgcaaaagatg

SEQ ID NO: 219772 - DNA, 103 bp, Artificial Sequence
  Synthetic Polynucleotide
taatacgactcactatagggggcgggccccgccggcagctgctcccagccaacagaggagaggctggatgcagctgccgaacctggcggcagcgcaaaagatg

SEQ ID NO: 219773 - DNA, 103 bp, Artificial Sequence
  Synthetic Polynucleotide
taatacgactcactatagggcgtccattgcctgcaggtcctccagaccggaacagaggagaccggtcatgaggacctgcaacctggcggcagcgcaaaagatg

SEQ ID NO: 219774 - DNA, 103 bp, Artificial Sequence
  Synthetic Polynucleotide
taatacgactcactatagggattcccggctcgtccattgcctgcaggtccaacagaggagaggacctatgggcaatggaaacctggcggcagcgcaaaagatg

SEQ ID NO: 219775 - DNA, 103 bp, Artificial Sequence
  Synthetic Polynucleotide
taatacgactcactatagggtaggaggctcattcccggctcgtccattgcaacagaggagagcaatgatggagccgggaaacctggcggcagcgcaaaagatg

SEQ ID NO: 219776 - DNA, 103 bp, Artificial Sequence
  Synthetic Polynucleotide
taatacgactcactatagggcggactggtctaggaggctcattcccggctaacagaggagaagccggatgtgagcctccaacctggcggcagcgcaaaagatg

SEQ ID NO: 219777 - DNA, 103 bp, Artificial Sequence
  Synthetic Polynucleotide
taatacgactcactatagggttcttgatcacggactggtctaggaggctcaacagaggagagagcctatgagaccagtcaacctggcggcagcgcaaaagatg

SEQ ID NO: 219778 - DNA, 103 bp, Artificial Sequence
  Synthetic Polynucleotide
taatacgactcactataggggatgggcactttcttgatcacggactggtcaacagaggagagaccagatggtgatcaagaacctggcggcagcgcaaaagatg

SEQ ID NO: 219779 - DNA, 103 bp, Artificial Sequence
  Synthetic Polynucleotide
taatacgactcactatagggctttggaggggatgggcactttcttgatcaaacagaggagatgatcaatgaagtgcccaaacctggcggcagcgcaaaagatg

SEQ ID NO: 219780 - DNA, 103 bp, Artificial Sequence
  Synthetic Polynucleotide
taatacgactcactatagggaggctgctggctttggaggggatgggcactaacagaggagaagtgccatgcccctccaaaacctggcggcagcgcaaaagatg

SEQ ID NO: 219781 - DNA, 103 bp, Artificial Sequence
  Synthetic Polynucleotide
taatacgactcactataggggagggctgagaggctgctggctttggagggaacagaggagaccctccatggccagcagcaacctggcggcagcgcaaaagatg

SEQ ID NO: 219782 - DNA, 103 bp, Artificial Sequence
  Synthetic Polynucleotide
taatacgactcactatagggtggccaaggagagggctgagaggctgctggaacagaggagaccagcaatgtctcagcccaacctggcggcagcgcaaaagatg

SEQ ID NO: 219783 - DNA, 103 bp, Artificial Sequence
  Synthetic Polynucleotide
taatacgactcactatagggagagacgacaggcgggccccgccggcagctaacagaggagaagctgcatgcggggcccgaacctggcggcagcgcaaaagatg

SEQ ID NO: 219784 - DNA, 103 bp, Artificial Sequence
  Synthetic Polynucleotide
taatacgactcactatagggaggctgtctttggccaaggagagggctgagaacagaggagactcagcatgctccttggcaacctggcggcagcgcaaaagatg

SEQ ID NO: 219785 - DNA, 103 bp, Artificial Sequence
  Synthetic Polynucleotide
taatacgactcactataggggccgcccaccaggctgtctttggccaaggaaacagaggagatccttgatgaaagacagcaacctggcggcagcgcaaaagatg

SEQ ID NO: 219786 - DNA, 103 bp, Artificial Sequence
  Synthetic Polynucleotide
taatacgactcactataggggatttgtgatgccgcccaccaggctgtcttaacagaggagaaagacaatgtggtgggcgaacctggcggcagcgcaaaagatg

SEQ ID NO: 219787 - DNA, 103 bp, Artificial Sequence
  Synthetic Polynucleotide
taatacgactcactatagggacctcaccaggatttgtgatgccgcccaccaacagaggagaggtgggatgcatcacaaaaacctggcggcagcgcaaaagatg

SEQ ID NO: 219788 - DNA, 103 bp, Artificial Sequence
  Synthetic Polynucleotide
taatacgactcactatagggggagcagaagacctcaccaggatttgtgataacagaggagaatcacaatgcctggtgagaacctggcggcagcgcaaaagatg

SEQ ID NO: 219789 - DNA, 103 bp, Artificial Sequence
  Synthetic Polynucleotide
taatacgactcactatagggggccgggcacggagcagaagacctcaccagaacagaggagactggtgatgtcttctgctaacctggcggcagcgcaaaagatg

SEQ ID NO: 219790 - DNA, 103 bp, Artificial Sequence
  Synthetic Polynucleotide
taatacgactcactatagggagtgaaagccggccgggcacggagcagaagaacagaggagacttctgatgcgtgcccggaacctggcggcagcgcaaaagatg

SEQ ID NO: 219791 - DNA, 103 bp, Artificial Sequence
  Synthetic Polynucleotide
taatacgactcactatagggtgagctgagcagtgaaagccggccgggcacaacagaggagagtgcccatgcggctttcaaacctggcggcagcgcaaaagatg

SEQ ID NO: 219792 - DNA, 103 bp, Artificial Sequence
  Synthetic Polynucleotide
taatacgactcactatagggacttggacgttgagctgagcagtgaaagccaacagaggagaggctttatgtgctcagctaacctggcggcagcgcaaaagatg

SEQ ID NO: 219793 - DNA, 103 bp, Artificial Sequence
  Synthetic Polynucleotide
taatacgactcactataggggtcaccttgtacttggacgttgagctgagcaacagaggagagctcagatgaacgtccaaaacctggcggcagcgcaaaagatg

SEQ ID NO: 219794 - DNA, 103 bp, Artificial Sequence
  Synthetic Polynucleotide
taatacgactcactatagggcgcctggggcagagacgacaggcgggccccaacagaggagaggggccatgctgtcgtctaacctggcggcagcgcaaaagatg

SEQ ID NO: 219795 - DNA, 103 bp, Artificial Sequence
  Synthetic Polynucleotide
taatacgactcactatagggctcccccaccgtcaccttgtacttggacgtaacagaggagaacgtccatgtacaaggtgaacctggcggcagcgcaaaagatg

SEQ ID NO: 219796 - DNA, 103 bp, Artificial Sequence
  Synthetic Polynucleotide
taatacgactcactataggggccgctgcacctcccccaccgtcaccttgtaacagaggagaacaaggatgcggtgggggaacctggcggcagcgcaaaagatg

SEQ ID NO: 219797 - DNA, 103 bp, Artificial Sequence
  Synthetic Polynucleotide
taatacgactcactatagggggcgagagtcgccgctgcacctcccccaccaacagaggagaggtgggatgggtgcagcgaacctggcggcagcgcaaaagatg

SEQ ID NO: 219798 - DNA, 103 bp, Artificial Sequence
  Synthetic Polynucleotide
taatacgactcactataggggcactcgggaggcgagagtcgccgctgcacaacagaggagagtgcagatgcgactctcgaacctggcggcagcgcaaaagatg

SEQ ID NO: 219799 - DNA, 103 bp, Artificial Sequence
  Synthetic Polynucleotide
taatacgactcactatagggaggcgttgaggcactcgggaggcgagagtcaacagaggagagactctatgctcccgagtaacctggcggcagcgcaaaagatg

SEQ ID NO: 219800 - DNA, 103 bp, Artificial Sequence
  Synthetic Polynucleotide
taatacgactcactatagggcccaggagggaggcgttgaggcactcgggaaacagaggagatcccgaatgcctcaacgcaacctggcggcagcgcaaaagatg

SEQ ID NO: 219801 - DNA, 103 bp, Artificial Sequence
  Synthetic Polynucleotide
taatacgactcactataggggaggacaccccccaggagggaggcgttgagaacagaggagactcaacatgtccctcctgaacctggcggcagcgcaaaagatg

SEQ ID NO: 219802 - DNA, 103 bp, Artificial Sequence
  Synthetic Polynucleotide
taatacgactcactatagggtggccctgcggaggacaccccccaggagggaacagaggagaccctccatgggggtgtccaacctggcggcagcgcaaaagatg

SEQ ID NO: 219803 - DNA, 103 bp, Artificial Sequence
  Synthetic Polynucleotide
taatacgactcactatagggtttttggacttggccctgcggaggacacccaacagaggagagggtgtatgccgcagggcaacctggcggcagcgcaaaagatg

SEQ ID NO: 219804 - DNA, 103 bp, Artificial Sequence
  Synthetic Polynucleotide
taatacgactcactatagggccggcccccatttttggacttggccctgcgaacagaggagacgcaggatgaagtccaaaaacctggcggcagcgcaaaagatg

SEQ ID NO: 219805 - DNA, 103 bp, Artificial Sequence
  Synthetic Polynucleotide
taatacgactcactataggggcccgtaggccgcctggggcagagacgacaaacagaggagatgtcgtatgtgccccaggaacctggcggcagcgcaaaagatg

SEQ ID NO: 219806 - DNA, 103 bp, Artificial Sequence
  Synthetic Polynucleotide
taatacgactcactatagggcccgcaaacaccggcccccatttttggactaacagaggagaagtccaatgatgggggccaacctggcggcagcgcaaaagatg

SEQ ID NO: 219807 - DNA, 103 bp, Artificial Sequence
  Synthetic Polynucleotide
taatacgactcactatagggtctaaccgttcccgcaaacaccggcccccaaacagaggagatgggggatggtgtttgcgaacctggcggcagcgcaaaagatg

SEQ ID NO: 219808 - DNA, 103 bp, Artificial Sequence
  Synthetic Polynucleotide
taatacgactcactatagggcccaatcttctctaaccgttcccgcaaacaaacagaggagatgtttgatggaacggttaaacctggcggcagcgcaaaagatg

SEQ ID NO: 219809 - DNA, 103 bp, Artificial Sequence
  Synthetic Polynucleotide
taatacgactcactataggggcaggttgagcccaatcttctctaaccgttaacagaggagaaacggtatgagaagattgaacctggcggcagcgcaaaagatg

SEQ ID NO: 219810 - DNA, 103 bp, Artificial Sequence
  Synthetic Polynucleotide
taatacgactcactatagggcggccagctggcaggttgagcccaatcttcaacagaggagagaagatatggctcaacctaacctggcggcagcgcaaaagatg

SEQ ID NO: 219811 - DNA, 103 bp, Artificial Sequence
  Synthetic Polynucleotide
taatacgactcactatagggggccttgcgacggccagctggcaggttgagaacagaggagactcaacatgccagctggcaacctggcggcagcgcaaaagatg

SEQ ID NO: 219812 - DNA, 103 bp, Artificial Sequence
  Synthetic Polynucleotide
taatacgactcactatagggtcacattggcggccttgcgacggccagctgaacagaggagacagctgatggtcgcaaggaacctggcggcagcgcaaaagatg

SEQ ID NO: 219813 - DNA, 103 bp, Artificial Sequence
  Synthetic Polynucleotide
taatacgactcactataggggtcagcagcgtcacattggcggccttgcgaaacagaggagatcgcaaatgcgccaatgtaacctggcggcagcgcaaaagatg

SEQ ID NO: 219814 - DNA, 103 bp, Artificial Sequence
  Synthetic Polynucleotide
taatacgactcactatagggcactagcgaagtcagcagcgtcacattggcaacagaggagagccaatatgacgctgctgaacctggcggcagcgcaaaagatg

SEQ ID NO: 219815 - DNA, 103 bp, Artificial Sequence
  Synthetic Polynucleotide
taatacgactcactatagggcctctccttccactagcgaagtcagcagcgaacagaggagacgctgcatgcttcgctagaacctggcggcagcgcaaaagatg

SEQ ID NO: 219816 - DNA, 103 bp, Artificial Sequence
  Synthetic Polynucleotide
taatacgactcactataggggggggcgccggcccgtaggccgcctggggcaacagaggagagccccaatgggcctacggaacctggcggcagcgcaaaagatg

SEQ ID NO: 219817 - DNA, 103 bp, Artificial Sequence
  Synthetic Polynucleotide
taatacgactcactatagggaggtgcacggcctctccttccactagcgaaaacagaggagattcgctatgggaaggagaaacctggcggcagcgcaaaagatg

SEQ ID NO: 219818 - DNA, 103 bp, Artificial Sequence
  Synthetic Polynucleotide
taatacgactcactataggggtctcgggccaggtgcacggcctctccttcaacagaggagagaaggaatggccgtgcacaacctggcggcagcgcaaaagatg

SEQ ID NO: 219819 - DNA, 103 bp, Artificial Sequence
  Synthetic Polynucleotide
taatacgactcactatagggcgtaaccgaagtctcgggccaggtgcacggaacagaggagaccgtgcatgtggcccgagaacctggcggcagcgcaaaagatg

SEQ ID NO: 219820 - DNA, 103 bp, Artificial Sequence
  Synthetic Polynucleotide
taatacgactcactataggggtctcacagacgtaaccgaagtctcgggccaacagaggagaggcccgatgcttcggttaaacctggcggcagcgcaaaagatg

SEQ ID NO: 219821 - DNA, 103 bp, Artificial Sequence
  Synthetic Polynucleotide
taatacgactcactatagggtgggaactccgtctcacagacgtaaccgaaaacagaggagattcggtatggtctgtgagaacctggcggcagcgcaaaagatg

SEQ ID NO: 219822 - DNA, 103 bp, Artificial Sequence
  Synthetic Polynucleotide
taatacgactcactatagggctgccttggctgggaactccgtctcacagaaacagaggagatctgtgatgcggagttccaacctggcggcagcgcaaaagatg

SEQ ID NO: 219823 - DNA, 103 bp, Artificial Sequence
  Synthetic Polynucleotide
taatacgactcactatagggtactcggcagctgccttggctgggaactccaacagaggagaggagttatgagccaaggcaacctggcggcagcgcaaaagatg

SEQ ID NO: 219824 - DNA, 103 bp, Artificial Sequence
  Synthetic Polynucleotide
taatacgactcactatagggtcggcacaggtactcggcagctgccttggcaacagaggagagccaagatggctgccgagaacctggcggcagcgcaaaagatg

SEQ ID NO: 219825 - DNA, 103 bp, Artificial Sequence
  Synthetic Polynucleotide
taatacgactcactatagggcagcgtgctgtcggcacaggtactcggcagaacagaggagactgccgatgacctgtgccaacctggcggcagcgcaaaagatg

SEQ ID NO: 219826 - DNA, 103 bp, Artificial Sequence
  Synthetic Polynucleotide
taatacgactcactatagggtcccccgggtcagcgtgctgtcggcacaggaacagaggagacctgtgatgacagcacgcaacctggcggcagcgcaaaagatg

SEQ ID NO: 219827 - DNA, 103 bp, Artificial Sequence
  Synthetic Polynucleotide
taatacgactcactatagggcttctgagtgggcaccatgaaatactccataacagaggagaatggagatgttcatggtgaacctggcggcagcgcaaaagatg

SEQ ID NO: 219828 - DNA, 103 bp, Artificial Sequence
  Synthetic Polynucleotide
taatacgactcactatagggagtctcgggggttagtggaatgttggcaagaacagaggagacttgccatgattccactaaacctggcggcagcgcaaaagatg

SEQ ID NO: 219829 - DNA, 103 bp, Artificial Sequence
  Synthetic Polynucleotide
taatacgactcactatagggggtcccgctgagtctcgggggttagtggaaaacagaggagattccacatgcccccgagaaacctggcggcagcgcaaaagatg

SEQ ID NO: 219830 - DNA, 103 bp, Artificial Sequence
  Synthetic Polynucleotide
taatacgactcactatagggcgccgctcctggtcccgctgagtctcggggaacagaggagaccccgaatgtcagcgggaaacctggcggcagcgcaaaagatg

SEQ ID NO: 219831 - DNA, 103 bp, Artificial Sequence
  Synthetic Polynucleotide
taatacgactcactatagggccgccgaatccgccgctcctggtcccgctgaacagaggagacagcggatgcaggagcggaacctggcggcagcgcaaaagatg

SEQ ID NO: 219832 - DNA, 103 bp, Artificial Sequence
  Synthetic Polynucleotide
taatacgactcactatagggtggcgatctcccgccgaatccgccgctcctaacagaggagaaggagcatgggattcggcaacctggcggcagcgcaaaagatg

SEQ ID NO: 219833 - DNA, 103 bp, Artificial Sequence
  Synthetic Polynucleotide
taatacgactcactatagggtcgttgctgttggcgatctcccgccgaatcaacagaggagagattcgatgggagatcgcaacctggcggcagcgcaaaagatg

SEQ ID NO: 219834 - DNA, 103 bp, Artificial Sequence
  Synthetic Polynucleotide
taatacgactcactataggggcgtctccgctcgttgctgttggcgatctcaacagaggagagagatcatgaacagcaacaacctggcggcagcgcaaaagatg

SEQ ID NO: 219835 - DNA, 103 bp, Artificial Sequence
  Synthetic Polynucleotide
taatacgactcactatagggtgctctgcatgcgtctccgctcgttgctgtaacagaggagaacagcaatgagcggagacaacctggcggcagcgcaaaagatg

SEQ ID NO: 219836 - DNA, 103 bp, Artificial Sequence
  Synthetic Polynucleotide
taatacgactcactatagggcccgcgttgatgctctgcatgcgtctccgcaacagaggagagcggagatgcatgcagagaacctggcggcagcgcaaaagatg

SEQ ID NO: 219837 - DNA, 103 bp, Artificial Sequence
  Synthetic Polynucleotide
taatacgactcactatagggggactggaatcccgcgttgatgctctgcataacagaggagaatgcagatgatcaacgcgaacctggcggcagcgcaaaagatg

SEQ ID NO: 219838 - DNA, 103 bp, Artificial Sequence
  Synthetic Polynucleotide
taatacgactcactatagggaagagggcaccttctgagtgggcaccatgaaacagaggagatcatggatgccactcagaaacctggcggcagcgcaaaagatg

SEQ ID NO: 219839 - DNA, 103 bp, Artificial Sequence
  Synthetic Polynucleotide
taatacgactcactataggggggtcttgagggactggaatcccgcgttgaaacagaggagatcaacgatggattccagtaacctggcggcagcgcaaaagatg

SEQ ID NO: 219840 - DNA, 103 bp, Artificial Sequence
  Synthetic Polynucleotide
taatacgactcactatagggtgggggatgagggtcttgagggactggaataacagaggagaattccaatgcctcaagacaacctggcggcagcgcaaaagatg

SEQ ID NO: 219841 - DNA, 103 bp, Artificial Sequence
  Synthetic Polynucleotide
taatacgactcactatagggtccgtctgtgtgggggatgagggtcttgagaacagaggagactcaagatgctcatccccaacctggcggcagcgcaaaagatg

SEQ ID NO: 219842 - DNA, 103 bp, Artificial Sequence
  Synthetic Polynucleotide
taatacgactcactatagggtgagcttctctccgtctgtgtgggggatgaaacagaggagatcatccatgacacagacgaacctggcggcagcgcaaaagatg

SEQ ID NO: 219843 - DNA, 103 bp, Artificial Sequence
  Synthetic Polynucleotide
taatacgactcactataggggctgccttgctgagcttctctccgtctgtgaacagaggagacacagaatgagagaagctaacctggcggcagcgcaaaagatg

SEQ ID NO: 219844 - DNA, 103 bp, Artificial Sequence
  Synthetic Polynucleotide
taatacgactcactatagggctggagaatggctgccttgctgagcttctcaacagaggagagagaagatgagcaaggcaaacctggcggcagcgcaaaagatg

SEQ ID NO: 219845 - DNA, 103 bp, Artificial Sequence
  Synthetic Polynucleotide
taatacgactcactatagggcggctgtctgctggagaatggctgccttgcaacagaggagagcaaggatgccattctccaacctggcggcagcgcaaaagatg

SEQ ID NO: 219846 - DNA, 103 bp, Artificial Sequence
  Synthetic Polynucleotide
taatacgactcactatagggaagatgtactcggctgtctgctggagaatgaacagaggagacattctatggcagacagcaacctggcggcagcgcaaaagatg

SEQ ID NO: 219847 - DNA, 103 bp, Artificial Sequence
  Synthetic Polynucleotide
taatacgactcactatagggctccagggagaagatgtactcggctgtctgaacagaggagacagacaatggagtacatcaacctggcggcagcgcaaaagatg

SEQ ID NO: 219848 - DNA, 103 bp, Artificial Sequence
  Synthetic Polynucleotide
taatacgactcactatagggtcttctcctgctccagggagaagatgtactaacagaggagaagtacaatgtctccctggaacctggcggcagcgcaaaagatg

SEQ ID NO: 219849 - DNA, 103 bp, Artificial Sequence
  Synthetic Polynucleotide
taatacgactcactatagggaaatgttgcaaagagggcaccttctgagtgaacagaggagacactcaatgggtgccctcaacctggcggcagcgcaaaagatg

SEQ ID NO: 219850 - DNA, 103 bp, Artificial Sequence
  Synthetic Polynucleotide
taatacgactcactatagggaagagcctggtcttctcctgctccagggagaacagaggagactccctatggcaggagaaaacctggcggcagcgcaaaagatg

SEQ ID NO: 219851 - DNA, 103 bp, Artificial Sequence
  Synthetic Polynucleotide
taatacgactcactataggggttctgctgcaagagcctggtcttctcctgaacagaggagacaggagatgaccaggctcaacctggcggcagcgcaaaagatg

SEQ ID NO: 219852 - DNA, 103 bp, Artificial Sequence
  Synthetic Polynucleotide
taatacgactcactatagggtgagctgtgtgttctgctgcaagagcctggaacagaggagaccaggcatgtgcagcagaaacctggcggcagcgcaaaagatg

SEQ ID NO: 219853 - DNA, 103 bp, Artificial Sequence
  Synthetic Polynucleotide
taatacgactcactatagggatgaagcgcttgagctgtgtgttctgctgcaacagaggagagcagcaatgcacacagctaacctggcggcagcgcaaaagatg

SEQ ID NO: 219854 - DNA, 103 bp, Artificial Sequence
  Synthetic Polynucleotide
taatacgactcactatagggcagctcctggatgaagcgcttgagctgtgtaacagaggagaacacagatgaagcgcttcaacctggcggcagcgcaaaagatg

SEQ ID NO: 219855 - DNA, 103 bp, Artificial Sequence
  Synthetic Polynucleotide
taatacgactcactatagggacgagccgctcagctcctggatgaagcgctaacagaggagaagcgctatgtccaggagcaacctggcggcagcgcaaaagatg

SEQ ID NO: 219856 - DNA, 103 bp, Artificial Sequence
  Synthetic Polynucleotide
taatacgactcactatagggcgcttgggggacgagccgctcagctcctggaacagaggagaccaggaatggagcggctcaacctggcggcagcgcaaaagatg

SEQ ID NO: 219857 - DNA, 103 bp, Artificial Sequence
  Synthetic Polynucleotide
taatacgactcactatagggtgcccgccgtcgcttgggggacgagccgctaacagaggagaagcggcatgtcccccaagaacctggcggcagcgcaaaagatg

SEQ ID NO: 219858 - DNA, 103 bp, Artificial Sequence
  Synthetic Polynucleotide
taatacgactcactatagggccttgtcctctgcccgccgtcgcttgggggaacagaggagacccccaatggacggcgggaacctggcggcagcgcaaaagatg

SEQ ID NO: 219859 - DNA, 103 bp, Artificial Sequence
  Synthetic Polynucleotide
taatacgactcactatagggatgccttcgtccttgtcctctgcccgccgtaacagaggagaacggcgatgagaggacaaaacctggcggcagcgcaaaagatg

SEQ ID NO: 219860 - DNA, 103 bp, Artificial Sequence
  Synthetic Polynucleotide
taatacgactcactatagggtgttttcctgaaatgttgcaaagagggcacaacagaggagagtgcccatgttgcaacataacctggcggcagcgcaaaagatg

SEQ ID NO: 219861 - DNA, 103 bp, Artificial Sequence
  Synthetic Polynucleotide
taatacgactcactatagggcggggagcctatgccttcgtccttgtcctcaacagaggagagaggacatggacgaaggcaacctggcggcagcgcaaaagatg

SEQ ID NO: 219862 - DNA, 103 bp, Artificial Sequence
  Synthetic Polynucleotide
taatacgactcactatagggcccagatgtccggggagcctatgccttcgtaacagaggagaacgaagatgtaggctcccaacctggcggcagcgcaaaagatg

SEQ ID NO: 219863 - DNA, 103 bp, Artificial Sequence
  Synthetic Polynucleotide
taatacgactcactatagggttctcgtcctcccagatgtccggggagcctaacagaggagaaggctcatgggacatctgaacctggcggcagcgcaaaagatg

SEQ ID NO: 219864 - DNA, 103 bp, Artificial Sequence
  Synthetic Polynucleotide
taatacgactcactataggggtcctccgccttctcgtcctcccagatgtcaacagaggagagacatcatggaggacgagaacctggcggcagcgcaaaagatg

SEQ ID NO: 219865 - DNA, 103 bp, Artificial Sequence
  Synthetic Polynucleotide
taatacgactcactatagggcccgccgcaggtcctccgccttctcgtcctaacagaggagaaggacgatgaggcggaggaacctggcggcagcgcaaaagatg

SEQ ID NO: 219866 - DNA, 103 bp, Artificial Sequence
  Synthetic Polynucleotide
taatacgactcactatagggtcaatcatctcccgccgcaggtcctccgccaacagaggagaggcggaatgcctgcggcgaacctggcggcagcgcaaaagatg

SEQ ID NO: 219867 - DNA, 103 bp, Artificial Sequence
  Synthetic Polynucleotide
taatacgactcactatagggctgccgcagctcaatcatctcccgccgcagaacagaggagactgcggatggagatgattaacctggcggcagcgcaaaagatg

SEQ ID NO: 219868 - DNA, 103 bp, Artificial Sequence
  Synthetic Polynucleotide
taatacgactcactatagggtgtccagctgctgccgcagctcaatcatctaacagaggagaagatgaatgagctgcggcaacctggcggcagcgcaaaagatg

SEQ ID NO: 219869 - DNA, 103 bp, Artificial Sequence
  Synthetic Polynucleotide
taatacgactcactataggggagcgctccttgtccagctgctgccgcagcaacagaggagagctgcgatggcagctggaaacctggcggcagcgcaaaagatg

SEQ ID NO: 219870 - DNA, 103 bp, Artificial Sequence
  Synthetic Polynucleotide
taatacgactcactatagggcatgcgcaccgagcgctccttgtccagctgaacagaggagacagctgatgaaggagcgcaacctggcggcagcgcaaaagatg

SEQ ID NO: 219871 - DNA, 103 bp, Artificial Sequence
  Synthetic Polynucleotide
taatacgactcactatagggcttctttctctgttttcctgaaatgttgcaaacagaggagatgcaacatgtcaggaaaaaacctggcggcagcgcaaaagatg

SEQ ID NO: 219872 - DNA, 103 bp, Artificial Sequence
  Synthetic Polynucleotide
taatacgactcactatagggcctccagcatcatgcgcaccgagcgctcctaacagaggagaaggagcatgcggtgcgcaaacctggcggcagcgcaaaagatg

SEQ ID NO: 219873 - DNA, 103 bp, Artificial Sequence
  Synthetic Polynucleotide
taatacgactcactatagggcgcacctgctcctccagcatcatgcgcaccaacagaggagaggtgcgatggatgctggaaacctggcggcagcgcaaaagatg

SEQ ID NO: 219874 - DNA, 103 bp, Artificial Sequence
  Synthetic Polynucleotide
taatacgactcactatagggctccagcgagcgcacctgctcctccagcataacagaggagaatgctgatggagcaggtgaacctggcggcagcgcaaaagatg

SEQ ID NO: 219875 - DNA, 103 bp, Artificial Sequence
  Synthetic Polynucleotide
taatacgactcactatagggacatgtgggcctccagcgagcgcacctgctaacagaggagaagcaggatggctcgctggaacctggcggcagcgcaaaagatg

SEQ ID NO: 219876 - DNA, 103 bp, Artificial Sequence
  Synthetic Polynucleotide
taatacgactcactatagggttttccgggtacatgtgggcctccagcgagaacagaggagactcgctatgggcccacataacctggcggcagcgcaaaagatg

SEQ ID NO: 219877 - DNA, 103 bp, Artificial Sequence
  Synthetic Polynucleotide
taatacgactcactatagggcaccttgagcttttccgggtacatgtgggcaacagaggagagcccacatgtacccggaaaacctggcggcagcgcaaaagatg

SEQ ID NO: 219878 - DNA, 103 bp, Artificial Sequence
  Synthetic Polynucleotide
taatacgactcactataggggctgcgcaatcaccttgagcttttccgggtaacagaggagaacccggatgagctcaaggaacctggcggcagcgcaaaagatg

SEQ ID NO: 219879 - DNA, 103 bp, Artificial Sequence
  Synthetic Polynucleotide
taatacgactcactatagggagctgcacctgctgcgcaatcaccttgagcaacagaggagagctcaaatggattgcgcaaacctggcggcagcgcaaaagatg

SEQ ID NO: 219880 - DNA, 103 bp, Artificial Sequence
  Synthetic Polynucleotide
taatacgactcactatagggctgctgctgcagctgcacctgctgcgcaataacagaggagaattgcgatgcaggtgcagaacctggcggcagcgcaaaagatg

SEQ ID NO: 219881 - DNA, 103 bp, Artificial Sequence
  Synthetic Polynucleotide
taatacgactcactatagggcctgttcctgctgctgctgcagctgcacctaacagaggagaaggtgcatgtgcagcagcaacctggcggcagcgcaaaagatg

SEQ ID NO: 219882 - DNA, 103 bp, Artificial Sequence
  Synthetic Polynucleotide
taatacgactcactatagggcctcctatcacttctttctctgttttcctgaacagaggagacaggaaatgagagaaagaaacctggcggcagcgcaaaagatg

SEQ ID NO: 219883 - DNA, 103 bp, Artificial Sequence
  Synthetic Polynucleotide
taatacgactcactatagggagcagcctcacctgttcctgctgctgctgcaacagaggagagcagcaatggcaggaacaaacctggcggcagcgcaaaagatg

SEQ ID NO: 219884 - DNA, 103 bp, Artificial Sequence
  Synthetic Polynucleotide
taatacgactcactatagggctcctggtgcagcagcctcacctgttcctgaacagaggagacaggaaatggtgaggctgaacctggcggcagcgcaaaagatg

SEQ ID NO: 219885 - DNA, 103 bp, Artificial Sequence
  Synthetic Polynucleotide
taatacgactcactataggggctccagcttctcctggtgcagcagcctcaaacagaggagatgaggcatgtgcaccaggaacctggcggcagcgcaaaagatg

SEQ ID NO: 219886 - DNA, 103 bp, Artificial Sequence
  Synthetic Polynucleotide
taatacgactcactatagggtgctgttcccgctccagcttctcctggtgcaacagaggagagcaccaatggaagctggaaacctggcggcagcgcaaaagatg

SEQ ID NO: 219887 - DNA, 103 bp, Artificial Sequence
  Synthetic Polynucleotide
taatacgactcactatagggccgcagctgctgctgttcccgctccagcttaacagaggagaaagctgatgcgggaacagaacctggcggcagcgcaaaagatg

SEQ ID NO: 219888 - DNA, 103 bp, Artificial Sequence
  Synthetic Polynucleotide
taatacgactcactataggggaagctgggtccgcagctgctgctgttcccaacagaggagagggaacatgagcagctgcaacctggcggcagcgcaaaagatg

SEQ ID NO: 219889 - DNA, 103 bp, Artificial Sequence
  Synthetic Polynucleotide
taatacgactcactatagggggagggggcagaagctgggtccgcagctgcaacagaggagagcagctatggacccagctaacctggcggcagcgcaaaagatg

SEQ ID NO: 219890 - DNA, 103 bp, Artificial Sequence
  Synthetic Polynucleotide
taatacgactcactatagggggtgggggccggagggggcagaagctgggtaacagaggagaacccagatgctgccccctaacctggcggcagcgcaaaagatg

SEQ ID NO: 219891 - DNA, 103 bp, Artificial Sequence
  Synthetic Polynucleotide
taatacgactcactatagggtggggtggtgggtgggggccggagggggcaaacagaggagatgccccatgcggcccccaaacctggcggcagcgcaaaagatg

SEQ ID NO: 219892 - DNA, 103 bp, Artificial Sequence
  Synthetic Polynucleotide
taatacgactcactatagggacgatcaccgtggggtggtgggtgggggccaacagaggagaggccccatgccaccacccaacctggcggcagcgcaaaagatg

SEQ ID NO: 219893 - DNA, 103 bp, Artificial Sequence
  Synthetic Polynucleotide
taatacgactcactataggggctacagagccctcctatcacttctttctcaacagaggagagagaaaatggtgataggaaacctggcggcagcgcaaaagatg

SEQ ID NO: 219894 - DNA, 103 bp, Artificial Sequence
  Synthetic Polynucleotide
taatacgactcactatagggcggtgctggcacgatcaccgtggggtggtgaacagaggagacaccacatgacggtgatcaacctggcggcagcgcaaaagatg

SEQ ID NO: 219895 - DNA, 103 bp, Artificial Sequence
  Synthetic Polynucleotide
taatacgactcactataggggaggaggaggcggtgctggcacgatcaccgaacagaggagacggtgaatgtgccagcacaacctggcggcagcgcaaaagatg

SEQ ID NO: 219896 - DNA, 103 bp, Artificial Sequence
  Synthetic Polynucleotide
taatacgactcactatagggtggtgggagggaggaggaggcggtgctggcaacagaggagagccagcatggcctcctccaacctggcggcagcgcaaaagatg

SEQ ID NO: 219897 - DNA, 103 bp, Artificial Sequence
  Synthetic Polynucleotide
taatacgactcactataggggacattgatgtggtgggagggaggaggaggaacagaggagacctcctatgccctcccacaacctggcggcagcgcaaaagatg

SEQ ID NO: 219898 - DNA, 103 bp, Artificial Sequence
  Synthetic Polynucleotide
taatacgactcactatagggccatggtgacgacattgatgtggtgggaggaacagaggagacctcccatgacatcaatgaacctggcggcagcgcaaaagatg

SEQ ID NO: 219899 - DNA, 103 bp, Artificial Sequence
  Synthetic Polynucleotide
taatacgactcactataggggaggaggggcccatggtgacgacattgatgaacagaggagacatcaaatgcgtcaccataacctggcggcagcgcaaaagatg

SEQ ID NO: 219900 - DNA, 103 bp, Artificial Sequence
  Synthetic Polynucleotide
taatacgactcactataggggttgatgaccgaggaggggcccatggtgacaacagaggagagtcaccatgggcccctccaacctggcggcagcgcaaaagatg

SEQ ID NO: 219901 - DNA, 103 bp, Artificial Sequence
  Synthetic Polynucleotide
taatacgactcactatagggtggaaacagagttgatgaccgaggaggggcaacagaggagagcccctatgcggtcatcaaacctggcggcagcgcaaaagatg

SEQ ID NO: 219902 - DNA, 103 bp, Artificial Sequence
  Synthetic Polynucleotide
taatacgactcactatagggtgccgggatgtggaaacagagttgatgaccaacagaggagaggtcatatgctctgtttcaacctggcggcagcgcaaaagatg

SEQ ID NO: 219903 - DNA, 103 bp, Artificial Sequence
  Synthetic Polynucleotide
taatacgactcactataggggtccagattttgccgggatgtggaaacagaaacagaggagatctgttatgacatcccggaacctggcggcagcgcaaaagatg

SEQ ID NO: 219904 - DNA, 103 bp, Artificial Sequence
  Synthetic Polynucleotide
taatacgactcactatagggtgttggcaaggctacagagccctcctatcaaacagaggagatgatagatgggctctgtaaacctggcggcagcgcaaaagatg

SEQ ID NO: 219905 - DNA, 103 bp, Artificial Sequence
  Synthetic Polynucleotide
taatacgactcactataggggcacgatggtgtccagattttgccgggatgaacagaggagacatcccatgaaaatctggaacctggcggcagcgcaaaagatg

SEQ ID NO: 219906 - DNA, 103 bp, Artificial Sequence
  Synthetic Polynucleotide
taatacgactcactatagggtggattgcctgcacgatggtgtccagatttaacagaggagaaaatctatgcaccatcgtaacctggcggcagcgcaaaagatg

SEQ ID NO: 219907 - DNA, 103 bp, Artificial Sequence
  Synthetic Polynucleotide
taatacgactcactatagggctcgatgtgctggattgcctgcacgatggtaacagaggagaaccatcatgcaggcaatcaacctggcggcagcgcaaaagatg

SEQ ID NO: 219908 - DNA, 103 bp, Artificial Sequence
  Synthetic Polynucleotide
taatacgactcactatagggcctgggtgccctcgatgtgctggattgcctaacagaggagaaggcaaatgagcacatcgaacctggcggcagcgcaaaagatg

SEQ ID NO: 219909 - DNA, 103 bp, Artificial Sequence
  Synthetic Polynucleotide
taatacgactcactatagggtcctgcttttcctgggtgccctcgatgtgcaacagaggagagcacatatggggcacccaaacctggcggcagcgcaaaagatg

SEQ ID NO: 219910 - DNA, 103 bp, Artificial Sequence
  Synthetic Polynucleotide
taatacgactcactatagggctcctccagctcctgcttttcctgggtgccaacagaggagaggcaccatggaaaagcagaacctggcggcagcgcaaaagatg

SEQ ID NO: 219911 - DNA, 103 bp, Artificial Sequence
  Synthetic Polynucleotide
taatacgactcactataggggccgctgctcctcctccagctcctgcttttaacagaggagaaaaagcatgagctggaggaacctggcggcagcgcaaaagatg

SEQ ID NO: 219912 - DNA, 103 bp, Artificial Sequence
  Synthetic Polynucleotide
taatacgactcactatagggatgacagctcgccgctgctcctcctccagcaacagaggagagctggaatgggagcagcgaacctggcggcagcgcaaaagatg

SEQ ID NO: 219913 - DNA, 103 bp, Artificial Sequence
  Synthetic Polynucleotide
taatacgactcactatagggaggcttcacgatgacagctcgccgctgctcaacagaggagagagcagatgcgagctgtcaacctggcggcagcgcaaaagatg

SEQ ID NO: 219914 - DNA, 103 bp, Artificial Sequence
  Synthetic Polynucleotide
taatacgactcactatagggagctgcggacaggcttcacgatgacagctcaacagaggagagagctgatgtcgtgaagcaacctggcggcagcgcaaaagatg

SEQ ID NO: 219915 - DNA, 103 bp, Artificial Sequence
  Synthetic Polynucleotide
taatacgactcactataggggttagtggaatgttggcaaggctacagagcaacagaggagagctctgatgccttgccaaaacctggcggcagcgcaaaagatg

SEQ ID NO: 219916 - DNA, 103 bp, Artificial Sequence
  Synthetic Polynucleotide
taatacgactcactataggggcctccgggcagctgcggacaggcttcacgaacagaggagacgtgaaatgtgtccgcagaacctggcggcagcgcaaaagatg

SEQ ID NO: 219917 - DNA, 103 bp, Artificial Sequence
  Synthetic Polynucleotide
taatacgactcactatagggagaggtgggggcctccgggcagctgcggacaacagaggagagtccgcatgtgcccggagaacctggcggcagcgcaaaagatg

SEQ ID NO: 219918 - DNA, 103 bp, Artificial Sequence
  Synthetic Polynucleotide
taatacgactcactatagggaggcggtgtcagaggtgggggcctccgggcaacagaggagagcccggatgcccccacctaacctggcggcagcgcaaaagatg

SEQ ID NO: 219919 - DNA, 103 bp, Artificial Sequence
  Synthetic Polynucleotide
taatacgactcactatagggtcggagtcggaggcggtgtcagaggtggggaacagaggagaccccacatgtgacaccgcaacctggcggcagcgcaaaagatg

SEQ ID NO: 219920 - DNA, 103 bp, Artificial Sequence
  Synthetic Polynucleotide
taatacgactcactataggggtctgaggcctcggagtcggaggcggtgtcaacagaggagagacaccatgtccgactccaacctggcggcagcgcaaaagatg

SEQ ID NO: 219921 - DNA, 103 bp, Artificial Sequence
  Synthetic Polynucleotide
taatacgactcactatagggtggcgtcactgtctgaggcctcggagtcggaacagaggagaccgactatgaggcctcagaacctggcggcagcgcaaaagatg

SEQ ID NO: 219922 - DNA, 103 bp, Artificial Sequence
  Synthetic Polynucleotide
taatacgactcactatagggctctggtccatggcgtcactgtctgaggccaacagaggagaggcctcatgcagtgacgcaacctggcggcagcgcaaaagatg

SEQ ID NO: 219923 - DNA, 103 bp, Artificial Sequence
  Synthetic Polynucleotide
taatacgactcactatagggctcctcccggctctggtccatggcgtcactaacagaggagaagtgacatgatggaccagaacctggcggcagcgcaaaagatg

SEQ ID NO: 219924 - DNA, 103 bp, Artificial Sequence
  Synthetic Polynucleotide
taatacgactcactatagggcccccgacggctcctcccggctctggtccaaacagaggagatggaccatggccgggaggaacctggcggcagcgcaaaagatg

SEQ ID NO: 219925 - DNA, 103 bp, Artificial Sequence
  Synthetic Polynucleotide
taatacgactcactatagggagctccccgtcccccgacggctcctcccggaacagaggagaccgggaatggccgtcgggaacctggcggcagcgcaaaagatg

SEQ ID NO: 219926 - DNA, 103 bp, Artificial Sequence
  Synthetic Polynucleotide
taatacgactcactatagggggccagaggcagcttcagagcccaggccataacagaggagaatggccatggctctgaagaacctggcggcagcgcaaaagatg

SEQ ID NO: 219927 - DNA, 103 bp, Artificial Sequence
  Synthetic Polynucleotide
taatacgactcactatagggcatgctataggcaccagcacccagttcctgaacagaggagacaggaaatgggtgctggtaacctggcggcagcgcaaaagatg

SEQ ID NO: 219928 - DNA, 103 bp, Artificial Sequence
  Synthetic Polynucleotide
taatacgactcactatagggatttcgatgcaaccactgctgagcttcctgaacagaggagacaggaaatgcagcagtggaacctggcggcagcgcaaaagatg

SEQ ID NO: 219929 - DNA, 103 bp, Artificial Sequence
  Synthetic Polynucleotide
taatacgactcactatagggtagaaaaacgatttcgatgcaaccactgctaacagaggagaagcagtatgtgcatcgaaaacctggcggcagcgcaaaagatg

SEQ ID NO: 219930 - DNA, 103 bp, Artificial Sequence
  Synthetic Polynucleotide
taatacgactcactatagggcttgtgaatgtagaaaaacgatttcgatgcaacagaggagagcatcgatgtcgtttttcaacctggcggcagcgcaaaagatg

SEQ ID NO: 219931 - DNA, 103 bp, Artificial Sequence
  Synthetic Polynucleotide
taatacgactcactatagggtgtgaaaagccttgtgaatgtagaaaaacgaacagaggagacgttttatgacattcacaaacctggcggcagcgcaaaagatg

SEQ ID NO: 219932 - DNA, 103 bp, Artificial Sequence
  Synthetic Polynucleotide
taatacgactcactatagggctgagaagtttgtgaaaagccttgtgaatgaacagaggagacattcaatgggcttttcaaacctggcggcagcgcaaaagatg

SEQ ID NO: 219933 - DNA, 103 bp, Artificial Sequence
  Synthetic Polynucleotide
taatacgactcactatagggaaatctgcccctgagaagtttgtgaaaagcaacagaggagagcttttatgaaacttctcaacctggcggcagcgcaaaagatg

SEQ ID NO: 219934 - DNA, 103 bp, Artificial Sequence
  Synthetic Polynucleotide
taatacgactcactatagggtaatttcaataaatctgcccctgagaagttaacagaggagaaacttcatgggggcagataacctggcggcagcgcaaaagatg

SEQ ID NO: 219935 - DNA, 103 bp, Artificial Sequence
  Synthetic Polynucleotide
taatacgactcactatagggcatctctagttaatttcaataaatctgcccaacagaggagagggcagatgtattgaaataacctggcggcagcgcaaaagatg

SEQ ID NO: 219936 - DNA, 103 bp, Artificial Sequence
  Synthetic Polynucleotide
taatacgactcactatagggtggatcacatcatctctagttaatttcaataacagaggagaattgaaatgaactagagaaacctggcggcagcgcaaaagatg

SEQ ID NO: 219937 - DNA, 103 bp, Artificial Sequence
  Synthetic Polynucleotide
taatacgactcactataggggccacagatttggatcacatcatctctagtaacagaggagaactagaatggatgtgatcaacctggcggcagcgcaaaagatg

SEQ ID NO: 219938 - DNA, 103 bp, Artificial Sequence
  Synthetic Polynucleotide
taatacgactcactatagggggacatcactcatgctataggcaccagcacaacagaggagagtgctgatgcctatagcaaacctggcggcagcgcaaaagatg

SEQ ID NO: 219939 - DNA, 103 bp, Artificial Sequence
  Synthetic Polynucleotide
taatacgactcactatagggcatctgcagggccacagatttggatcacataacagaggagaatgtgaatgaaatctgtgaacctggcggcagcgcaaaagatg

SEQ ID NO: 219940 - DNA, 103 bp, Artificial Sequence
  Synthetic Polynucleotide
taatacgactcactatagggagtctgattccatctgcagggccacagattaacagaggagaaatctgatgccctgcagaaacctggcggcagcgcaaaagatg

SEQ ID NO: 219941 - DNA, 103 bp, Artificial Sequence
  Synthetic Polynucleotide
taatacgactcactatagggtgcattaaaaagtctgattccatctgcaggaacagaggagacctgcaatgggaatcagaaacctggcggcagcgcaaaagatg

SEQ ID NO: 219942 - DNA, 103 bp, Artificial Sequence
  Synthetic Polynucleotide
taatacgactcactatagggggccttttaatgcattaaaaagtctgattcaacagaggagagaatcaatgtttttaatgaacctggcggcagcgcaaaagatg

SEQ ID NO: 219943 - DNA, 103 bp, Artificial Sequence
  Synthetic Polynucleotide
taatacgactcactatagggcgcaccatccggccttttaatgcattaaaaaacagaggagattttaaatgattaaaaggaacctggcggcagcgcaaaagatg

SEQ ID NO: 219944 - DNA, 103 bp, Artificial Sequence
  Synthetic Polynucleotide
taatacgactcactatagggtaaccttggacgcaccatccggccttttaaaacagaggagattaaaaatgcggatggtgaacctggcggcagcgcaaaagatg

SEQ ID NO: 219945 - DNA, 103 bp, Artificial Sequence
  Synthetic Polynucleotide
taatacgactcactatagggcataaatggttaaccttggacgcaccatccaacagaggagaggatggatggtccaaggtaacctggcggcagcgcaaaagatg

SEQ ID NO: 219946 - DNA, 103 bp, Artificial Sequence
  Synthetic Polynucleotide
taatacgactcactatagggtcctgacaaacataaatggttaaccttggaaacagaggagatccaagatgaaccatttaaacctggcggcagcgcaaaagatg

SEQ ID NO: 219947 - DNA, 103 bp, Artificial Sequence
  Synthetic Polynucleotide
taatacgactcactatagggctgcagtgattcctgacaaacataaatggtaacagaggagaaccattatggtttgtcagaacctggcggcagcgcaaaagatg

SEQ ID NO: 219948 - DNA, 103 bp, Artificial Sequence
  Synthetic Polynucleotide
taatacgactcactataggggctccctcaactgcagtgattcctgacaaaaacagaggagatttgtcatgaatcactgcaacctggcggcagcgcaaaagatg

SEQ ID NO: 219949 - DNA, 103 bp, Artificial Sequence
  Synthetic Polynucleotide
taatacgactcactatagggggcaatgcaaggacatcactcatgctatagaacagaggagactatagatggagtgatgtaacctggcggcagcgcaaaagatg

SEQ ID NO: 219950 - DNA, 103 bp, Artificial Sequence
  Synthetic Polynucleotide
taatacgactcactatagggtgttgttgctgctccctcaactgcagtgataacagaggagaatcactatggttgagggaaacctggcggcagcgcaaaagatg

SEQ ID NO: 219951 - DNA, 103 bp, Artificial Sequence
  Synthetic Polynucleotide
taatacgactcactatagggttgctgctgctgttgttgctgctccctcaaaacagaggagattgaggatgcagcaacaaaacctggcggcagcgcaaaagatg

SEQ ID NO: 219952 - DNA, 103 bp, Artificial Sequence
  Synthetic Polynucleotide
taatacgactcactatagggtctgctgctgttgctgctgctgttgttgctaacagaggagaagcaacatgagcagcagcaacctggcggcagcgcaaaagatg

SEQ ID NO: 219953 - DNA, 103 bp, Artificial Sequence
  Synthetic Polynucleotide
taatacgactcactatagggtcctcatgcttctgctgctgttgctgctgcaacagaggagagcagcaatgacagcagcaaacctggcggcagcgcaaaagatg

SEQ ID NO: 219954 - DNA, 103 bp, Artificial Sequence
  Synthetic Polynucleotide
taatacgactcactatagggtgagtctccatcctcatgcttctgctgctgaacagaggagacagcagatgaagcatgagaacctggcggcagcgcaaaagatg

SEQ ID NO: 219955 - DNA, 103 bp, Artificial Sequence
  Synthetic Polynucleotide
taatacgactcactatagggaagtaccatttgagtctccatcctcatgctaacagaggagaagcatgatgatggagactaacctggcggcagcgcaaaagatg

SEQ ID NO: 219956 - DNA, 103 bp, Artificial Sequence
  Synthetic Polynucleotide
taatacgactcactatagggtaaacgaagaaagtaccatttgagtctccaaacagaggagatggagaatgaaatggtacaacctggcggcagcgcaaaagatg

SEQ ID NO: 219957 - DNA, 103 bp, Artificial Sequence
  Synthetic Polynucleotide
taatacgactcactataggggatagcatggtaaacgaagaaagtaccattaacagaggagaaatggtatgttcttcgttaacctggcggcagcgcaaaagatg

SEQ ID NO: 219958 - DNA, 103 bp, Artificial Sequence
  Synthetic Polynucleotide
taatacgactcactatagggcttctagatagatagcatggtaaacgaagaaacagaggagatcttcgatgaccatgctaaacctggcggcagcgcaaaagatg

SEQ ID NO: 219959 - DNA, 103 bp, Artificial Sequence
  Synthetic Polynucleotide
taatacgactcactataggggctgttagttcttctagatagatagcatggaacagaggagaccatgcatgctatctagaaacctggcggcagcgcaaaagatg

SEQ ID NO: 219960 - DNA, 103 bp, Artificial Sequence
  Synthetic Polynucleotide
taatacgactcactatagggcttaaaaatgggcaatgcaaggacatcactaacagaggagaagtgatatgcttgcattgaacctggcggcagcgcaaaagatg

SEQ ID NO: 219961 - DNA, 103 bp, Artificial Sequence
  Synthetic Polynucleotide
taatacgactcactatagggcaattcaacagctgttagttcttctagataaacagaggagatatctaatggaactaacaaacctggcggcagcgcaaaagatg

SEQ ID NO: 219962 - DNA, 103 bp, Artificial Sequence
  Synthetic Polynucleotide
taatacgactcactatagggttttttctgtcaattcaacagctgttagttaacagaggagaaactaaatgctgttgaataacctggcggcagcgcaaaagatg

SEQ ID NO: 219963 - DNA, 103 bp, Artificial Sequence
  Synthetic Polynucleotide
taatacgactcactatagggagctgagcaattttttctgtcaattcaacaaacagaggagatgttgaatggacagaaaaaacctggcggcagcgcaaaagatg

SEQ ID NO: 219964 - DNA, 103 bp, Artificial Sequence
  Synthetic Polynucleotide
taatacgactcactatagggaatgctgaaaagctgagcaattttttctgtaacagaggagaacagaaatgattgctcagaacctggcggcagcgcaaaagatg

SEQ ID NO: 219965 - DNA, 103 bp, Artificial Sequence
  Synthetic Polynucleotide
taatacgactcactatagggggcaaggggaaatgctgaaaagctgagcaaaacagaggagattgctcatgttttcagcaaacctggcggcagcgcaaaagatg

SEQ ID NO: 219966 - DNA, 103 bp, Artificial Sequence
  Synthetic Polynucleotide
taatacgactcactatagggtggctgatctggcaaggggaaatgctgaaaaacagaggagatttcagatgttccccttgaacctggcggcagcgcaaaagatg

SEQ ID NO: 219967 - DNA, 103 bp, Artificial Sequence
  Synthetic Polynucleotide
taatacgactcactatagggcttgtaaatctggctgatctggcaaggggaaacagaggagatcccctatgcagatcagcaacctggcggcagcgcaaaagatg

SEQ ID NO: 219968 - DNA, 103 bp, Artificial Sequence
  Synthetic Polynucleotide
taatacgactcactatagggttggcccctgcttgtaaatctggctgatctaacagaggagaagatcaatgagatttacaaacctggcggcagcgcaaaagatg

SEQ ID NO: 219969 - DNA, 103 bp, Artificial Sequence
  Synthetic Polynucleotide
taatacgactcactatagggtgaattcctgttggcccctgcttgtaaatcaacagaggagagatttaatggcaggggccaacctggcggcagcgcaaaagatg

SEQ ID NO: 219970 - DNA, 103 bp, Artificial Sequence
  Synthetic Polynucleotide
taatacgactcactataggggatgagcacatgaattcctgttggcccctgaacagaggagacaggggatgacaggaattaacctggcggcagcgcaaaagatg

SEQ ID NO: 219971 - DNA, 103 bp, Artificial Sequence
  Synthetic Polynucleotide
taatacgactcactatagggactcttcttgcttaaaaatgggcaatgcaaaacagaggagattgcatatgccatttttaaacctggcggcagcgcaaaagatg

SEQ ID NO: 219972 - DNA, 103 bp, Artificial Sequence
  Synthetic Polynucleotide
taatacgactcactatagggtctcatcactgatgagcacatgaattcctgaacagaggagacaggaaatgatgtgctcaaacctggcggcagcgcaaaagatg

SEQ ID NO: 219973 - DNA, 103 bp, Artificial Sequence
  Synthetic Polynucleotide
taatacgactcactatagggttctgtatcatctcatcactgatgagcacaaacagaggagatgtgctatgcagtgatgaaacctggcggcagcgcaaaagatg

SEQ ID NO: 219974 - DNA, 103 bp, Artificial Sequence
  Synthetic Polynucleotide
taatacgactcactatagggttcctgaaagttctgtatcatctcatcactaacagaggagaagtgatatgatgatacagaacctggcggcagcgcaaaagatg

SEQ ID NO: 219975 - DNA, 103 bp, Artificial Sequence
  Synthetic Polynucleotide
taatacgactcactatagggaacatgcttcttcctgaaagttctgtatcaaacagaggagatgatacatgactttcaggaacctggcggcagcgcaaaagatg

SEQ ID NO: 219976 - DNA, 103 bp, Artificial Sequence
  Synthetic Polynucleotide
taatacgactcactatagggtccagaataaaacatgcttcttcctgaaagaacagaggagactttcaatgagaagcatgaacctggcggcagcgcaaaagatg

SEQ ID NO: 219977 - DNA, 103 bp, Artificial Sequence
  Synthetic Polynucleotide
taatacgactcactatagggtttcattgtgtccagaataaaacatgcttcaacagaggagagaagcaatgtttattctgaacctggcggcagcgcaaaagatg

SEQ ID NO: 219978 - DNA, 103 bp, Artificial Sequence
  Synthetic Polynucleotide
taatacgactcactatagggtggtttctgctttcattgtgtccagaataaaacagaggagattattcatgacacaatgaaacctggcggcagcgcaaaagatg

SEQ ID NO: 219979 - DNA, 103 bp, Artificial Sequence
  Synthetic Polynucleotide
taatacgactcactatagggtagctatcattggtttctgctttcattgtgaacagaggagacacaatatgagcagaaacaacctggcggcagcgcaaaagatg

SEQ ID NO: 219980 - DNA, 103 bp, Artificial Sequence
  Synthetic Polynucleotide
taatacgactcactatagggtatgatatgatagctatcattggtttctgcaacagaggagagcagaaatgaatgatagcaacctggcggcagcgcaaaagatg

SEQ ID NO: 219981 - DNA, 103 bp, Artificial Sequence
  Synthetic Polynucleotide
taatacgactcactatagggggcaaactcgactcttcttgcttaaaaatgaacagaggagacattttatggcaagaagaaacctggcggcagcgcaaaagatg

SEQ ID NO: 219982 - DNA, 103 bp, Artificial Sequence
  Synthetic Polynucleotide
taatacgactcactatagggattatcaggaggcaaactcgactcttcttgaacagaggagacaagaaatgtcgagtttgaacctggcggcagcgcaaaagatg

SEQ ID NO: 219983 - DNA, 103 bp, Artificial Sequence
  Synthetic Polynucleotide
taatacgactcactatagggttttattctcattatcaggaggcaaactcgaacagaggagacgagttatgctcctgataaacctggcggcagcgcaaaagatg

SEQ ID NO: 219984 - DNA, 103 bp, Artificial Sequence
  Synthetic Polynucleotide
taatacgactcactatagggaaaggcaggattttattctcattatcaggaaacagaggagatcctgaatgtgagaataaaacctggcggcagcgcaaaagatg

SEQ ID NO: 219985 - DNA, 103 bp, Artificial Sequence
  Synthetic Polynucleotide
taatacgactcactatagggcacatattgaaaaggcaggattttattctcaacagaggagagagaatatgatcctgcctaacctggcggcagcgcaaaagatg

SEQ ID NO: 219986 - DNA, 103 bp, Artificial Sequence
  Synthetic Polynucleotide
taatacgactcactatagggtcacttcgtcggccagaggcagcttcagagaacagaggagactctgaatgtgcctctggaacctggcggcagcgcaaaagatg

SEQ ID NO: 219987 - DNA, 103 bp, Artificial Sequence
  Synthetic Polynucleotide
taatacgactcactatagggcagcacaaagcacatattgaaaaggcaggaaacagaggagatcctgcatgttcaatatgaacctggcggcagcgcaaaagatg

SEQ ID NO: 219988 - DNA, 103 bp, Artificial Sequence
  Synthetic Polynucleotide
taatacgactcactatagggggagaggtagcagcacaaagcacatattgaaacagaggagatcaataatggctttgtgcaacctggcggcagcgcaaaagatg

SEQ ID NO: 219989 - DNA, 103 bp, Artificial Sequence
  Synthetic Polynucleotide
taatacgactcactatagggtttcactgctggagaggtagcagcacaaagaacagaggagactttgtatggctacctctaacctggcggcagcgcaaaagatg

SEQ ID NO: 219990 - DNA, 103 bp, Artificial Sequence
  Synthetic Polynucleotide
taatacgactcactatagggcatcatggagtttcactgctggagaggtagaacagaggagactacctatgcagcagtgaaacctggcggcagcgcaaaagatg

SEQ ID NO: 219991 - DNA, 103 bp, Artificial Sequence
  Synthetic Polynucleotide
taatacgactcactataggggttagggtttcatcatggagtttcactgctaacagaggagaagcagtatgactccatgaaacctggcggcagcgcaaaagatg

SEQ ID NO: 219992 - DNA, 103 bp, Artificial Sequence
  Synthetic Polynucleotide
taatacgactcactatagggattgagatacgttagggtttcatcatggagaacagaggagactccatatggaaaccctaaacctggcggcagcgcaaaagatg

SEQ ID NO: 219993 - DNA, 103 bp, Artificial Sequence
  Synthetic Polynucleotide
taatacgactcactatagggactgtccttgattgagatacgttagggtttaacagaggagaaaacccatgcgtatctcaaacctggcggcagcgcaaaagatg

SEQ ID NO: 219994 - DNA, 103 bp, Artificial Sequence
  Synthetic Polynucleotide
taatacgactcactatagggatttcataagactgtccttgattgagatacaacagaggagagtatctatgtcaaggacaaacctggcggcagcgcaaaagatg

SEQ ID NO: 219995 - DNA, 103 bp, Artificial Sequence
  Synthetic Polynucleotide
taatacgactcactatagggtagcattcgaatttcataagactgtccttgaacagaggagacaaggaatgtcttatgaaaacctggcggcagcgcaaaagatg

SEQ ID NO: 219996 - DNA, 103 bp, Artificial Sequence
  Synthetic Polynucleotide
taatacgactcactatagggtcctattgtctagcattcgaatttcataagaacagaggagacttatgatgttcgaatgcaacctggcggcagcgcaaaagatg

SEQ ID NO: 219997 - DNA, 103 bp, Artificial Sequence
  Synthetic Polynucleotide
taatacgactcactatagggccggattcaatcacttcgtcggccagaggcaacagaggagagcctctatgcgacgaagtaacctggcggcagcgcaaaagatg

SEQ ID NO: 219998 - DNA, 103 bp, Artificial Sequence
  Synthetic Polynucleotide
taatacgactcactatagggtctccaagtttcctattgtctagcattcgaaacagaggagatcgaatatgagacaatagaacctggcggcagcgcaaaagatg

SEQ ID NO: 219999 - DNA, 103 bp, Artificial Sequence
  Synthetic Polynucleotide
taatacgactcactatagggttctggaagttctccaagtttcctattgtcaacagaggagagacaatatgaaacttggaaacctggcggcagcgcaaaagatg

SEQ ID NO: 220000 - DNA, 103 bp, Artificial Sequence
  Synthetic Polynucleotide
taatacgactcactatagggtgccattaatttctggaagttctccaagttaacagaggagaaacttgatgaacttccagaacctggcggcagcgcaaaagatg

SEQ ID NO: 220001 - DNA, 103 bp, Artificial Sequence
  Synthetic Polynucleotide
taatacgactcactatagggttcaccaatttgccattaatttctggaagtaacagaggagaacttccatgaattaatggaacctggcggcagcgcaaaagatg

SEQ ID NO: 220002 - DNA, 103 bp, Artificial Sequence
  Synthetic Polynucleotide
taatacgactcactataggggaatatactcttcaccaatttgccattaataacagaggagaattaatatgaaattggtgaacctggcggcagcgcaaaagatg

SEQ ID NO: 220003 - DNA, 103 bp, Artificial Sequence
  Synthetic Polynucleotide
taatacgactcactatagggacaccacacggaatatactcttcaccaattaacagaggagaaattggatgagagtatataacctggcggcagcgcaaaagatg

SEQ ID NO: 220004 - DNA, 103 bp, Artificial Sequence
  Synthetic Polynucleotide
taatacgactcactatagggctgtcatggaacaccacacggaatatactcaacagaggagagagtatatgccgtgtggtaacctggcggcagcgcaaaagatg

SEQ ID NO: 220005 - DNA, 103 bp, Artificial Sequence
  Synthetic Polynucleotide
taatacgactcactatagggctgaagccttctgtcatggaacaccacacgaacagaggagacgtgtgatgttccatgacaacctggcggcagcgcaaaagatg

SEQ ID NO: 220006 - DNA, 103 bp, Artificial Sequence
  Synthetic Polynucleotide
taatacgactcactataggggctcagtgtactgaagccttctgtcatggaaacagaggagatccatgatggaaggcttcaacctggcggcagcgcaaaagatg

SEQ ID NO: 220007 - DNA, 103 bp, Artificial Sequence
  Synthetic Polynucleotide
taatacgactcactatagggagctgctgatgctcagtgtactgaagccttaacagaggagaaaggctatggtacactgaaacctggcggcagcgcaaaagatg

SEQ ID NO: 220008 - DNA, 103 bp, Artificial Sequence
  Synthetic Polynucleotide
taatacgactcactatagggctgcaccaacccggattcaatcacttcgtcaacagaggagagacgaaatgattgaatccaacctggcggcagcgcaaaagatg

SEQ ID NO: 220009 - DNA, 103 bp, Artificial Sequence
  Synthetic Polynucleotide
taatacgactcactatagggccagccctctagctgctgatgctcagtgtaaacagaggagatacactatgcatcagcagaacctggcggcagcgcaaaagatg

SEQ ID NO: 220010 - DNA, 103 bp, Artificial Sequence
  Synthetic Polynucleotide
taatacgactcactatagggggttccacctccagccctctagctgctgataacagaggagaatcagcatgtagagggctaacctggcggcagcgcaaaagatg

SEQ ID NO: 220011 - DNA, 103 bp, Artificial Sequence
  Synthetic Polynucleotide
taatacgactcactatagggtctccaggtcggttccacctccagccctctaacagaggagaagagggatggaggtggaaaacctggcggcagcgcaaaagatg

SEQ ID NO: 220012 - DNA, 103 bp, Artificial Sequence
  Synthetic Polynucleotide
taatacgactcactatagggaagaattctgtctccaggtcggttccacctaacagaggagaaggtggatgcgacctggaaacctggcggcagcgcaaaagatg

SEQ ID NO: 220013 - DNA, 103 bp, Artificial Sequence
  Synthetic Polynucleotide
taatacgactcactatagggtatctatgtcaagaattctgtctccaggtcaacagaggagagacctgatgacagaattcaacctggcggcagcgcaaaagatg

SEQ ID NO: 220014 - DNA, 103 bp, Artificial Sequence
  Synthetic Polynucleotide
taatacgactcactataggggacatcgggatatctatgtcaagaattctgaacagaggagacagaatatgtgacatagaaacctggcggcagcgcaaaagatg

SEQ ID NO: 220015 - DNA, 103 bp, Artificial Sequence
  Synthetic Polynucleotide
taatacgactcactatagggtatacccacagacatcgggatatctatgtcaacagaggagagacataatgatcccgatgaacctggcggcagcgcaaaagatg

SEQ ID NO: 220016 - DNA, 103 bp, Artificial Sequence
  Synthetic Polynucleotide
taatacgactcactatagggtaggatcgattatacccacagacatcgggaaacagaggagatcccgaatgctgtgggtaaacctggcggcagcgcaaaagatg

SEQ ID NO: 220017 - DNA, 103 bp, Artificial Sequence
  Synthetic Polynucleotide
taatacgactcactatagggggattagccctaggatcgattatacccacaaacagaggagatgtgggatgaatcgatccaacctggcggcagcgcaaaagatg

SEQ ID NO: 220018 - DNA, 103 bp, Artificial Sequence
  Synthetic Polynucleotide
taatacgactcactatagggtagttgagttggattagccctaggatcgataacagaggagaatcgatatgagggctaataacctggcggcagcgcaaaagatg

SEQ ID NO: 220019 - DNA, 103 bp, Artificial Sequence
  Synthetic Polynucleotide
taatacgactcactatagggcatcaaagtcctgcaccaacccggattcaaaacagaggagattgaatatgggttggtgcaacctggcggcagcgcaaaagatg

SEQ ID NO: 220020 - DNA, 103 bp, Artificial Sequence
  Synthetic Polynucleotide
taatacgactcactatagggccactgtatttagttgagttggattagcccaacagaggagagggctaatgcaactcaacaacctggcggcagcgcaaaagatg

SEQ ID NO: 220021 - DNA, 103 bp, Artificial Sequence
  Synthetic Polynucleotide
taatacgactcactatagggcacaggaactccactgtatttagttgagttaacagaggagaaactcaatgaaatacagtaacctggcggcagcgcaaaagatg

SEQ ID NO: 220022 - DNA, 103 bp, Artificial Sequence
  Synthetic Polynucleotide
taatacgactcactatagggtgcagggtcccacaggaactccactgtattaacagaggagaaatacaatggagttcctgaacctggcggcagcgcaaaagatg

SEQ ID NO: 220023 - DNA, 103 bp, Artificial Sequence
  Synthetic Polynucleotide
taatacgactcactatagggatgtcctctttgcagggtcccacaggaactaacagaggagaagttccatggggaccctgaacctggcggcagcgcaaaagatg

SEQ ID NO: 220024 - DNA, 103 bp, Artificial Sequence
  Synthetic Polynucleotide
taatacgactcactatagggataaacacagatgtcctctttgcagggtccaacagaggagaggacccatgaaagaggacaacctggcggcagcgcaaaagatg

SEQ ID NO: 220025 - DNA, 103 bp, Artificial Sequence
  Synthetic Polynucleotide
taatacgactcactataggggtgcacctgaataaacacagatgtcctcttaacagaggagaaagaggatgtctgtgtttaacctggcggcagcgcaaaagatg

SEQ ID NO: 220026 - DNA, 103 bp, Artificial Sequence
  Synthetic Polynucleotide
taatacgactcactatagggtgctaatacagtgcacctgaataaacacagaacagaggagactgtgtatgttcaggtgcaacctggcggcagcgcaaaagatg

SEQ ID NO: 220027 - DNA, 103 bp, Artificial Sequence
  Synthetic Polynucleotide
taatacgactcactataggggtgaactctgtgctaatacagtgcacctgaaacagaggagatcaggtatgctgtattagaacctggcggcagcgcaaaagatg

SEQ ID NO: 220028 - DNA, 103 bp, Artificial Sequence
  Synthetic Polynucleotide
taatacgactcactatagggtttcctcatagtgaactctgtgctaatacaaacagaggagatgtattatgacagagttcaacctggcggcagcgcaaaagatg

SEQ ID NO: 220029 - DNA, 103 bp, Artificial Sequence
  Synthetic Polynucleotide
taatacgactcactatagggctccaccatgtttcctcatagtgaactctgaacagaggagacagagtatgctatgaggaaacctggcggcagcgcaaaagatg

SEQ ID NO: 220030 - DNA, 103 bp, Artificial Sequence
  Synthetic Polynucleotide
taatacgactcactataggggacaggctagcatcaaagtcctgcaccaacaacagaggagagttggtatgggactttgaaacctggcggcagcgcaaaagatg

SEQ ID NO: 220031 - DNA, 103 bp, Artificial Sequence
  Synthetic Polynucleotide
taatacgactcactatagggacccccttttctccaccatgtttcctcataaacagaggagatatgagatgacatggtggaacctggcggcagcgcaaaagatg

SEQ ID NO: 220032 - DNA, 103 bp, Artificial Sequence
  Synthetic Polynucleotide
taatacgactcactatagggtcggaatggcacccccttttctccaccatgaacagaggagacatggtatggaaaaggggaacctggcggcagcgcaaaagatg

SEQ ID NO: 220033 - DNA, 103 bp, Artificial Sequence
  Synthetic Polynucleotide
taatacgactcactatagggctatttgtactcggaatggcacccccttttaacagaggagaaaaaggatgtgccattccaacctggcggcagcgcaaaagatg

SEQ ID NO: 220034 - DNA, 103 bp, Artificial Sequence
  Synthetic Polynucleotide
taatacgactcactatagggttgaaggtatctatttgtactcggaatggcaacagaggagagccattatgagtacaaataacctggcggcagcgcaaaagatg

SEQ ID NO: 220035 - DNA, 103 bp, Artificial Sequence
  Synthetic Polynucleotide
taatacgactcactatagggttcattctccttgaaggtatctatttgtacaacagaggagagtacaaatggataccttcaacctggcggcagcgcaaaagatg

SEQ ID NO: 220036 - DNA, 103 bp, Artificial Sequence
  Synthetic Polynucleotide
taatacgactcactatagggattccccgttttcattctccttgaaggtataacagaggagaatacctatgaggagaatgaacctggcggcagcgcaaaagatg

SEQ ID NO: 220037 - DNA, 103 bp, Artificial Sequence
  Synthetic Polynucleotide
taatacgactcactatagggtgctcagtatattccccgttttcattctccaacagaggagaggagaaatgaaacggggaaacctggcggcagcgcaaaagatg

SEQ ID NO: 220038 - DNA, 103 bp, Artificial Sequence
  Synthetic Polynucleotide
taatacgactcactatagggcgagtgtaagtgctcagtatattccccgttaacagaggagaaacgggatgtatactgagaacctggcggcagcgcaaaagatg

SEQ ID NO: 220039 - DNA, 103 bp, Artificial Sequence
  Synthetic Polynucleotide
taatacgactcactatagggggcagctggccgagtgtaagtgctcagtataacagaggagaatactgatgacttacactaacctggcggcagcgcaaaagatg

SEQ ID NO: 220040 - DNA, 103 bp, Artificial Sequence
  Synthetic Polynucleotide
taatacgactcactatagggactttgatctggcagctggccgagtgtaagaacagaggagacttacaatgggccagctgaacctggcggcagcgcaaaagatg

SEQ ID NO: 220041 - DNA, 103 bp, Artificial Sequence
  Synthetic Polynucleotide
taatacgactcactataggggccgatcccggacaggctagcatcaaagtcaacagaggagagactttatggctagcctgaacctggcggcagcgcaaaagatg

SEQ ID NO: 220042 - DNA, 103 bp, Artificial Sequence
  Synthetic Polynucleotide
taatacgactcactataggggggcttgaaaactttgatctggcagctggcaacagaggagagccagcatgcagatcaaaaacctggcggcagcgcaaaagatg

SEQ ID NO: 220043 - DNA, 103 bp, Artificial Sequence
  Synthetic Polynucleotide
taatacgactcactatagggctgcacctttgggcttgaaaactttgatctaacagaggagaagatcaatgttttcaagcaacctggcggcagcgcaaaagatg

SEQ ID NO: 220044 - DNA, 103 bp, Artificial Sequence
  Synthetic Polynucleotide
taatacgactcactatagggtgctttctgtctgcacctttgggcttgaaaaacagaggagatttcaaatgcaaaggtgcaacctggcggcagcgcaaaagatg

SEQ ID NO: 220045 - DNA, 103 bp, Artificial Sequence
  Synthetic Polynucleotide
taatacgactcactatagggatccgttttttgctttctgtctgcacctttaacagaggagaaaaggtatggacagaaagaacctggcggcagcgcaaaagatg

SEQ ID NO: 220046 - DNA, 103 bp, Artificial Sequence
  Synthetic Polynucleotide
taatacgactcactatagggttttttccctatccgttttttgctttctgtaacagaggagaacagaaatgaaaaaacggaacctggcggcagcgcaaaagatg

SEQ ID NO: 220047 - DNA, 103 bp, Artificial Sequence
  Synthetic Polynucleotide
taatacgactcactatagggcgtttctccattttttccctatccgtttttaacagaggagaaaaaacatgtagggaaaaaacctggcggcagcgcaaaagatg

SEQ ID NO: 220048 - DNA, 103 bp, Artificial Sequence
  Synthetic Polynucleotide
taatacgactcactatagggatgaggtgttcgtttctccattttttccctaacagaggagaagggaaatgatggagaaaaacctggcggcagcgcaaaagatg

SEQ ID NO: 220049 - DNA, 103 bp, Artificial Sequence
  Synthetic Polynucleotide
taatacgactcactatagggtctccttttcatgaggtgttcgtttctccaaacagaggagatggagaatggaacacctcaacctggcggcagcgcaaaagatg

SEQ ID NO: 220050 - DNA, 103 bp, Artificial Sequence
  Synthetic Polynucleotide
taatacgactcactatagggggctgatatttctccttttcatgaggtgttaacagaggagaaacaccatgtgaaaaggaaacctggcggcagcgcaaaagatg

SEQ ID NO: 220051 - DNA, 103 bp, Artificial Sequence
  Synthetic Polynucleotide
taatacgactcactatagggctcataggaaggctgatatttctccttttcaacagaggagagaaaagatgaaatatcagaacctggcggcagcgcaaaagatg

SEQ ID NO: 220052 - DNA, 103 bp, Artificial Sequence
  Synthetic Polynucleotide
taatacgactcactatagggccagttcctggccgatcccggacaggctagaacagaggagactagccatgccgggatcgaacctggcggcagcgcaaaagatg

SEQ ID NO: 220053 - DNA, 103 bp, Artificial Sequence
  Synthetic Polynucleotide
taatacgactcactataggggtatggttgtctcataggaaggctgatattaacagaggagaaatatcatgcttcctatgaacctggcggcagcgcaaaagatg

SEQ ID NO: 220054 - DNA, 103 bp, Artificial Sequence
  Synthetic Polynucleotide
taatacgactcactatagggcactctgtgagtatggttgtctcataggaaaacagaggagattcctaatggacaaccataacctggcggcagcgcaaaagatg

SEQ ID NO: 220055 - DNA, 103 bp, Artificial Sequence
  Synthetic Polynucleotide
taatacgactcactatagggccatggagaacactctgtgagtatggttgtaacagaggagaacaaccatgctcacagagaacctggcggcagcgcaaaagatg

SEQ ID NO: 220056 - DNA, 103 bp, Artificial Sequence
  Synthetic Polynucleotide
taatacgactcactatagggtgatctcgggccatggagaacactctgtgaaacagaggagatcacagatggttctccataacctggcggcagcgcaaaagatg

SEQ ID NO: 220057 - DNA, 103 bp, Artificial Sequence
  Synthetic Polynucleotide
taatacgactcactatagggttgacatacgtgatctcgggccatggagaaaacagaggagattctccatggcccgagataacctggcggcagcgcaaaagatg

SEQ ID NO: 220058 - DNA, 103 bp, Artificial Sequence
  Synthetic Polynucleotide
taatacgactcactatagggtggggagttattgacatacgtgatctcgggaacagaggagacccgagatgacgtatgtcaacctggcggcagcgcaaaagatg

SEQ ID NO: 220059 - DNA, 103 bp, Artificial Sequence
  Synthetic Polynucleotide
taatacgactcactatagggagccaggtgatggggagttattgacatacgaacagaggagacgtatgatgataactcccaacctggcggcagcgcaaaagatg

SEQ ID NO: 220060 - DNA, 103 bp, Artificial Sequence
  Synthetic Polynucleotide
taatacgactcactataggggaactgttgaagccaggtgatggggagttaaacagaggagataactcatgatcacctggaacctggcggcagcgcaaaagatg

SEQ ID NO: 220061 - DNA, 103 bp, Artificial Sequence
  Synthetic Polynucleotide
taatacgactcactatagggactgctatgggaactgttgaagccaggtgaaacagaggagatcacctatgttcaacagtaacctggcggcagcgcaaaagatg

SEQ ID NO: 220062 - DNA, 103 bp, Artificial Sequence
  Synthetic Polynucleotide
taatacgactcactatagggcaagagaaaaactgctatgggaactgttgaaacagaggagatcaacaatgcccatagcaaacctggcggcagcgcaaaagatg

SEQ ID NO: 220063 - DNA, 103 bp, Artificial Sequence
  Synthetic Polynucleotide
taatacgactcactataggggcaccagcacccagttcctggccgatcccgaacagaggagacgggatatgccaggaactaacctggcggcagcgcaaaagatg

SEQ ID NO: 220064 - DNA, 103 bp, Artificial Sequence
  Synthetic Polynucleotide
taatacgactcactatagggtttccttccccaagagaaaaactgctatggaacagaggagaccatagatgtttttctctaacctggcggcagcgcaaaagatg

SEQ ID NO: 220065 - DNA, 103 bp, Artificial Sequence
  Synthetic Polynucleotide
taatacgactcactatagggtggtgaaccatttccttccccaagagaaaaaacagaggagattttctatgggggaaggaaacctggcggcagcgcaaaagatg

SEQ ID NO: 220066 - DNA, 103 bp, Artificial Sequence
  Synthetic Polynucleotide
taatacgactcactataggggctggtggtttggtgaaccatttccttcccaacagaggagagggaagatgatggttcacaacctggcggcagcgcaaaagatg

SEQ ID NO: 220067 - DNA, 103 bp, Artificial Sequence
  Synthetic Polynucleotide
taatacgactcactatagggggtggctctggctggtggtttggtgaaccaaacagaggagatggttcatgaaaccaccaaacctggcggcagcgcaaaagatg

SEQ ID NO: 220068 - DNA, 103 bp, Artificial Sequence
  Synthetic Polynucleotide
taatacgactcactataggggactggagggggtggctctggctggtggttaacagaggagaaaccacatgccagagccaaacctggcggcagcgcaaaagatg

SEQ ID NO: 220069 - DNA, 103 bp, Artificial Sequence
  Synthetic Polynucleotide
taatacgactcactatagggggttatctgtgactggagggggtggctctgaacagaggagacagagcatgcccctccagaacctggcggcagcgcaaaagatg

SEQ ID NO: 220070 - DNA, 103 bp, Artificial Sequence
  Synthetic Polynucleotide
taatacgactcactataggggttggtaagaggttatctgtgactggagggaacagaggagaccctccatgcacagataaaacctggcggcagcgcaaaagatg

SEQ ID NO: 220071 - DNA, 103 bp, Artificial Sequence
  Synthetic Polynucleotide
taatacgactcactatagggaggtgtggttgttggtaagaggttatctgtaacagaggagaacagatatgctcttaccaaacctggcggcagcgcaaaagatg

SEQ ID NO: 220072 - DNA, 103 bp, Artificial Sequence
  Synthetic Polynucleotide
taatacgactcactataggggagcttcctgaggtgtggttgttggtaagaaacagaggagatcttacatgcaaccacacaacctggcggcagcgcaaaagatg

SEQ ID NO: 220073 - DNA, 103 bp, Artificial Sequence
  Synthetic Polynucleotide
taatacgactcactatagggaaccactgctgagcttcctgaggtgtggttaacagaggagaaaccacatgtcaggaagcaacctggcggcagcgcaaaagatg

SEQ ID NO: 220074 - DNA, 103 bp, Artificial Sequence
  Synthetic Polynucleotide
taatacgactcactataggggtgctcgggctgcgtgtgccagaagagcataacagaggagaatgctcatgtggcacacgaacctggcggcagcgcaaaagatg

SEQ ID NO: 220075 - DNA, 103 bp, Artificial Sequence
  Synthetic Polynucleotide
taatacgactcactataggggttctcgggggacagctggggttcctcctgaacagaggagacaggagatgccccagctgaacctggcggcagcgcaaaagatg

SEQ ID NO: 220076 - DNA, 103 bp, Artificial Sequence
  Synthetic Polynucleotide
taatacgactcactatagggcttcagcaagtcagcacctgagaagctggcaacagaggagagccagcatgtcaggtgctaacctggcggcagcgcaaaagatg

SEQ ID NO: 220077 - DNA, 103 bp, Artificial Sequence
  Synthetic Polynucleotide
taatacgactcactatagggctcgggacatcttcagcaagtcagcacctgaacagaggagacaggtgatgacttgctgaaacctggcggcagcgcaaaagatg

SEQ ID NO: 220078 - DNA, 103 bp, Artificial Sequence
  Synthetic Polynucleotide
taatacgactcactatagggaccaaatcatctcgggacatcttcagcaagaacagaggagacttgctatggatgtcccgaacctggcggcagcgcaaaagatg

SEQ ID NO: 220079 - DNA, 103 bp, Artificial Sequence
  Synthetic Polynucleotide
taatacgactcactatagggacagatctggaccaaatcatctcgggacataacagaggagaatgtccatggatgatttgaacctggcggcagcgcaaaagatg

SEQ ID NO: 220080 - DNA, 103 bp, Artificial Sequence
  Synthetic Polynucleotide
taatacgactcactatagggctgcgggaccacagatctggaccaaatcataacagaggagaatgattatgtccagatctaacctggcggcagcgcaaaagatg

SEQ ID NO: 220081 - DNA, 103 bp, Artificial Sequence
  Synthetic Polynucleotide
taatacgactcactatagggcggatcccatctgcgggaccacagatctggaacagaggagaccagatatgtggtcccgcaacctggcggcagcgcaaaagatg

SEQ ID NO: 220082 - DNA, 103 bp, Artificial Sequence
  Synthetic Polynucleotide
taatacgactcactataggggttgaagagccggatcccatctgcgggaccaacagaggagaggtcccatggatgggatcaacctggcggcagcgcaaaagatg

SEQ ID NO: 220083 - DNA, 103 bp, Artificial Sequence
  Synthetic Polynucleotide
taatacgactcactatagggctttgatggcgttgaagagccggatcccataacagaggagaatgggaatgggctcttcaaacctggcggcagcgcaaaagatg

SEQ ID NO: 220084 - DNA, 103 bp, Artificial Sequence
  Synthetic Polynucleotide
taatacgactcactatagggacattccggcctttgatggcgttgaagagcaacagaggagagctcttatgcgccatcaaaacctggcggcagcgcaaaagatg

SEQ ID NO: 220085 - DNA, 103 bp, Artificial Sequence
  Synthetic Polynucleotide
taatacgactcactatagggctttggcctcacattccggcctttgatggcaacagaggagagccatcatgggccggaataacctggcggcagcgcaaaagatg

SEQ ID NO: 220086 - DNA, 103 bp, Artificial Sequence
  Synthetic Polynucleotide
taatacgactcactatagggggcgggcctcgttctcgggggacagctgggaacagaggagacccagcatgcccccgagaaacctggcggcagcgcaaaagatg

SEQ ID NO: 220087 - DNA, 103 bp, Artificial Sequence
  Synthetic Polynucleotide
taatacgactcactatagggaaatggtcatctttggcctcacattccggcaacagaggagagccggaatgtgaggccaaaacctggcggcagcgcaaaagatg

SEQ ID NO: 220088 - DNA, 103 bp, Artificial Sequence
  Synthetic Polynucleotide
taatacgactcactatagggtgacagacataaatggtcatctttggcctcaacagaggagagaggccatggatgaccataacctggcggcagcgcaaaagatg

SEQ ID NO: 220089 - DNA, 103 bp, Artificial Sequence
  Synthetic Polynucleotide
taatacgactcactatagggctccagctcctgacagacataaatggtcataacagaggagaatgaccatgtatgtctgtaacctggcggcagcgcaaaagatg

SEQ ID NO: 220090 - DNA, 103 bp, Artificial Sequence
  Synthetic Polynucleotide
taatacgactcactatagggctcgattctgctccagctcctgacagacataacagaggagaatgtctatgaggagctggaacctggcggcagcgcaaaagatg

SEQ ID NO: 220091 - DNA, 103 bp, Artificial Sequence
  Synthetic Polynucleotide
taatacgactcactatagggtgcaggggcactcgattctgctccagctccaacagaggagaggagctatggcagaatcgaacctggcggcagcgcaaaagatg

SEQ ID NO: 220092 - DNA, 103 bp, Artificial Sequence
  Synthetic Polynucleotide
taatacgactcactatagggccgcttctgctgcaggggcactcgattctgaacagaggagacagaatatggtgcccctgaacctggcggcagcgcaaaagatg

SEQ ID NO: 220093 - DNA, 103 bp, Artificial Sequence
  Synthetic Polynucleotide
taatacgactcactatagggcactgccgtcccgcttctgctgcaggggcaaacagaggagatgccccatgagcagaagcaacctggcggcagcgcaaaagatg

SEQ ID NO: 220094 - DNA, 103 bp, Artificial Sequence
  Synthetic Polynucleotide
taatacgactcactatagggttgctgtctccactgccgtcccgcttctgcaacagaggagagcagaaatgggacggcagaacctggcggcagcgcaaaagatg

SEQ ID NO: 220095 - DNA, 103 bp, Artificial Sequence
  Synthetic Polynucleotide
taatacgactcactatagggcacagacaggttgctgtctccactgccgtcaacagaggagagacggcatgggagacagcaacctggcggcagcgcaaaagatg

SEQ ID NO: 220096 - DNA, 103 bp, Artificial Sequence
  Synthetic Polynucleotide
taatacgactcactatagggtggcgtggtacacagacaggttgctgtctcaacagaggagagagacaatgacctgtctgaacctggcggcagcgcaaaagatg

SEQ ID NO: 220097 - DNA, 103 bp, Artificial Sequence
  Synthetic Polynucleotide
taatacgactcactatagggaggggtggcaggcgggcctcgttctcggggaacagaggagaccccgaatgcgaggcccgaacctggcggcagcgcaaaagatg

SEQ ID NO: 220098 - DNA, 103 bp, Artificial Sequence
  Synthetic Polynucleotide
taatacgactcactatagggtccaggaagatggcgtggtacacagacaggaacagaggagacctgtcatggtaccacgcaacctggcggcagcgcaaaagatg

SEQ ID NO: 220099 - DNA, 103 bp, Artificial Sequence
  Synthetic Polynucleotide
taatacgactcactatagggggtcagctcttccaggaagatggcgtggtaaacagaggagataccacatgatcttcctgaacctggcggcagcgcaaaagatg

SEQ ID NO: 220100 - DNA, 103 bp, Artificial Sequence
  Synthetic Polynucleotide
taatacgactcactataggggctccaaggtggtcagctcttccaggaagaaacagaggagatcttccatgaagagctgaaacctggcggcagcgcaaaagatg

SEQ ID NO: 220101 - DNA, 103 bp, Artificial Sequence
  Synthetic Polynucleotide
taatacgactcactatagggttctcaatcagctccaaggtggtcagctctaacagaggagaagagctatgcaccttggaaacctggcggcagcgcaaaagatg

SEQ ID NO: 220102 - DNA, 103 bp, Artificial Sequence
  Synthetic Polynucleotide
taatacgactcactataggggttggcgatcttctcaatcagctccaaggtaacagaggagaaccttgatgctgattgagaacctggcggcagcgcaaaagatg

SEQ ID NO: 220103 - DNA, 103 bp, Artificial Sequence
  Synthetic Polynucleotide
taatacgactcactatagggtgctgtacaggttggcgatcttctcaatcaaacagaggagatgattgatgagatcgccaaacctggcggcagcgcaaaagatg

SEQ ID NO: 220104 - DNA, 103 bp, Artificial Sequence
  Synthetic Polynucleotide
taatacgactcactatagggtggggggagatgctgtacaggttggcgatcaacagaggagagatcgcatgcctgtacagaacctggcggcagcgcaaaagatg

SEQ ID NO: 220105 - DNA, 103 bp, Artificial Sequence
  Synthetic Polynucleotide
taatacgactcactataggggtggatgtgctggggggagatgctgtacagaacagaggagactgtacatgatctcccccaacctggcggcagcgcaaaagatg

SEQ ID NO: 220106 - DNA, 103 bp, Artificial Sequence
  Synthetic Polynucleotide
taatacgactcactatagggggtagactcggtggatgtgctggggggagaaacagaggagatctcccatgagcacatccaacctggcggcagcgcaaaagatg

SEQ ID NO: 220107 - DNA, 103 bp, Artificial Sequence
  Synthetic Polynucleotide
taatacgactcactataggggggccctgccggtagactcggtggatgtgcaacagaggagagcacatatgccgagtctaaacctggcggcagcgcaaaagatg

SEQ ID NO: 220108 - DNA, 103 bp, Artificial Sequence
  Synthetic Polynucleotide
taatacgactcactatagggcacatattgcaggggtggcaggcgggcctcaacagaggagagaggccatgctgccacccaacctggcggcagcgcaaaagatg

SEQ ID NO: 220109 - DNA, 103 bp, Artificial Sequence
  Synthetic Polynucleotide
taatacgactcactataggggatgcccgtggggccctgccggtagactcgaacagaggagacgagtcatgcggcagggcaacctggcggcagcgcaaaagatg

SEQ ID NO: 220110 - DNA, 103 bp, Artificial Sequence
  Synthetic Polynucleotide
taatacgactcactatagggccaccacatggatgcccgtggggccctgccaacagaggagaggcaggatgccacgggcaaacctggcggcagcgcaaaagatg

SEQ ID NO: 220111 - DNA, 103 bp, Artificial Sequence
  Synthetic Polynucleotide
taatacgactcactatagggtcgttgctcaccaccacatggatgcccgtgaacagaggagacacgggatgccatgtggtaacctggcggcagcgcaaaagatg

SEQ ID NO: 220112 - DNA, 103 bp, Artificial Sequence
  Synthetic Polynucleotide
taatacgactcactatagggctgcaccatctcgttgctcaccaccacatgaacagaggagacatgtgatggtgagcaacaacctggcggcagcgcaaaagatg

SEQ ID NO: 220113 - DNA, 103 bp, Artificial Sequence
  Synthetic Polynucleotide
taatacgactcactatagggcttggaagttctgcaccatctcgttgctcaaacagaggagatgagcaatgagatggtgcaacctggcggcagcgcaaaagatg

SEQ ID NO: 220114 - DNA, 103 bp, Artificial Sequence
  Synthetic Polynucleotide
taatacgactcactatagggcaggattcatcttggaagttctgcaccatcaacagaggagagatggtatggaacttccaaacctggcggcagcgcaaaagatg

SEQ ID NO: 220115 - DNA, 103 bp, Artificial Sequence
  Synthetic Polynucleotide
taatacgactcactataggggaggacaaaacaggattcatcttggaagttaacagaggagaaacttcatggatgaatccaacctggcggcagcgcaaaagatg

SEQ ID NO: 220116 - DNA, 103 bp, Artificial Sequence
  Synthetic Polynucleotide
taatacgactcactatagggtaattgtgctgaggacaaaacaggattcataacagaggagaatgaatatggttttgtccaacctggcggcagcgcaaaagatg

SEQ ID NO: 220117 - DNA, 103 bp, Artificial Sequence
  Synthetic Polynucleotide
taatacgactcactatagggctctcagctttaattgtgctgaggacaaaaaacagaggagattttgtatgcagcacaataacctggcggcagcgcaaaagatg

SEQ ID NO: 220118 - DNA, 103 bp, Artificial Sequence
  Synthetic Polynucleotide
taatacgactcactataggggccatcattgctctcagctttaattgtgctaacagaggagaagcacaatgaaagctgagaacctggcggcagcgcaaaagatg

SEQ ID NO: 220119 - DNA, 103 bp, Artificial Sequence
  Synthetic Polynucleotide
taatacgactcactatagggcagcacacaacacatattgcaggggtggcaaacagaggagatgccacatgtgcaatatgaacctggcggcagcgcaaaagatg

SEQ ID NO: 220120 - DNA, 103 bp, Artificial Sequence
  Synthetic Polynucleotide
taatacgactcactatagggtgatgtggtagccatcattgctctcagcttaacagaggagaaagctgatggcaatgatgaacctggcggcagcgcaaaagatg

SEQ ID NO: 220121 - DNA, 103 bp, Artificial Sequence
  Synthetic Polynucleotide
taatacgactcactatagggcatttcaggatgatgtggtagccatcattgaacagaggagacaatgaatgctaccacataacctggcggcagcgcaaaagatg

SEQ ID NO: 220122 - DNA, 103 bp, Artificial Sequence
  Synthetic Polynucleotide
taatacgactcactatagggtcagagtccacatttcaggatgatgtggtaaacagaggagataccacatgatcctgaaaaacctggcggcagcgcaaaagatg

SEQ ID NO: 220123 - DNA, 103 bp, Artificial Sequence
  Synthetic Polynucleotide
taatacgactcactatagggggggacgtggcagcacacaacacatattgcaacagaggagagcaataatggttgtgtgcaacctggcggcagcgcaaaagatg

SEQ ID NO: 220124 - DNA, 103 bp, Artificial Sequence
  Synthetic Polynucleotide
taatacgactcactatagggcttcacggctggggacgtggcagcacacaaaacagaggagattgtgtatggccacgtccaacctggcggcagcgcaaaagatg

SEQ ID NO: 220125 - DNA, 103 bp, Artificial Sequence
  Synthetic Polynucleotide
taatacgactcactatagggcttcatgcagcttcacggctggggacgtggaacagaggagaccacgtatgcagccgtgaaacctggcggcagcgcaaaagatg

SEQ ID NO: 220126 - DNA, 103 bp, Artificial Sequence
  Synthetic Polynucleotide
taatacgactcactataggggtcagcgtctcttcatgcagcttcacggctaacagaggagaagccgtatggctgcatgaaacctggcggcagcgcaaaagatg

SEQ ID NO: 220127 - DNA, 103 bp, Artificial Sequence
  Synthetic Polynucleotide
taatacgactcactataggggttgaggtaggtcagcgtctcttcatgcagaacagaggagactgcatatggagacgctgaacctggcggcagcgcaaaagatg

SEQ ID NO: 220128 - DNA, 103 bp, Artificial Sequence
  Synthetic Polynucleotide
taatacgactcactataggggctggttgtagtgctcgggctgcgtgtgccaacagaggagaggcacaatgagcccgagcaacctggcggcagcgcaaaagatg

SEQ ID NO: 220129 - DNA, 103 bp, Artificial Sequence
  Synthetic Polynucleotide
taatacgactcactatagggactgaccttggttgaggtaggtcagcgtctaacagaggagaagacgcatgcctacctcaaacctggcggcagcgcaaaagatg

SEQ ID NO: 220130 - DNA, 103 bp, Artificial Sequence
  Synthetic Polynucleotide
taatacgactcactatagggatttcataagactgaccttggttgaggtagaacagaggagactacctatgccaaggtcaaacctggcggcagcgcaaaagatg

SEQ ID NO: 220131 - DNA, 103 bp, Artificial Sequence
  Synthetic Polynucleotide
taatacgactcactatagggcagtagtcggatttcataagactgaccttgaacagaggagacaaggtatgtcttatgaaaacctggcggcagcgcaaaagatg

SEQ ID NO: 220132 - DNA, 103 bp, Artificial Sequence
  Synthetic Polynucleotide
taatacgactcactatagggtccgattctccagtagtcggatttcataagaacagaggagacttatgatgtccgactacaacctggcggcagcgcaaaagatg

SEQ ID NO: 220133 - DNA, 103 bp, Artificial Sequence
  Synthetic Polynucleotide
taatacgactcactatagggtctcccagcttccgattctccagtagtcggaacagaggagaccgactatgggagaatcgaacctggcggcagcgcaaaagatg

SEQ ID NO: 220134 - DNA, 103 bp, Artificial Sequence
  Synthetic Polynucleotide
taatacgactcactatagggatcttgaaagtctcccagcttccgattctcaacagaggagagagaatatgaagctgggaaacctggcggcagcgcaaaagatg

SEQ ID NO: 220135 - DNA, 103 bp, Artificial Sequence
  Synthetic Polynucleotide
taatacgactcactatagggttgtgttcagatcttgaaagtctcccagctaacagaggagaagctggatgactttcaagaacctggcggcagcgcaaaagatg

SEQ ID NO: 220136 - DNA, 103 bp, Artificial Sequence
  Synthetic Polynucleotide
taatacgactcactatagggttgacatattttgtgttcagatcttgaaagaacagaggagactttcaatgtctgaacacaacctggcggcagcgcaaaagatg

SEQ ID NO: 220137 - DNA, 103 bp, Artificial Sequence
  Synthetic Polynucleotide
taatacgactcactataggggatgatgctcttgacatattttgtgttcagaacagaggagactgaacatgaaatatgtcaacctggcggcagcgcaaaagatg

SEQ ID NO: 220138 - DNA, 103 bp, Artificial Sequence
  Synthetic Polynucleotide
taatacgactcactatagggagaccacacggatgatgctcttgacatattaacagaggagaaatatgatgagagcatcaaacctggcggcagcgcaaaagatg

SEQ ID NO: 220139 - DNA, 103 bp, Artificial Sequence
  Synthetic Polynucleotide
taatacgactcactatagggccggagttgtgctggttgtagtgctcgggcaacagaggagagcccgaatgctacaaccaaacctggcggcagcgcaaaagatg

SEQ ID NO: 220140 - DNA, 103 bp, Artificial Sequence
  Synthetic Polynucleotide
taatacgactcactatagggcggtcatggaagaccacacggatgatgctcaacagaggagagagcatatgccgtgtggtaacctggcggcagcgcaaaagatg

SEQ ID NO: 220141 - DNA, 103 bp, Artificial Sequence
  Synthetic Polynucleotide
taatacgactcactatagggctgcagccggcggtcatggaagaccacacgaacagaggagacgtgtgatgttccatgacaacctggcggcagcgcaaaagatg

SEQ ID NO: 220142 - DNA, 103 bp, Artificial Sequence
  Synthetic Polynucleotide
taatacgactcactataggggctccgtatactgcagccggcggtcatggaaacagaggagatccatgatggccggctgcaacctggcggcagcgcaaaagatg

SEQ ID NO: 220143 - DNA, 103 bp, Artificial Sequence
  Synthetic Polynucleotide
taatacgactcactatagggagctgctggtgctccgtatactgcagccggaacagaggagaccggctatggtatacggaaacctggcggcagcgcaaaagatg

SEQ ID NO: 220144 - DNA, 103 bp, Artificial Sequence
  Synthetic Polynucleotide
taatacgactcactatagggccagccctccagctgctggtgctccgtataaacagaggagatatacgatgcaccagcagaacctggcggcagcgcaaaagatg

SEQ ID NO: 220145 - DNA, 103 bp, Artificial Sequence
  Synthetic Polynucleotide
taatacgactcactataggggactccaccgccagccctccagctgctggtaacagaggagaaccagcatgtggagggctaacctggcggcagcgcaaaagatg

SEQ ID NO: 220146 - DNA, 103 bp, Artificial Sequence
  Synthetic Polynucleotide
taatacgactcactatagggtcccctggccgactccaccgccagccctccaacagaggagaggagggatggcggtggagaacctggcggcagcgcaaaagatg

SEQ ID NO: 220147 - DNA, 103 bp, Artificial Sequence
  Synthetic Polynucleotide
taatacgactcactatagggcaggatccggtcccctggccgactccaccgaacagaggagacggtggatgcggccagggaacctggcggcagcgcaaaagatg

SEQ ID NO: 220148 - DNA, 103 bp, Artificial Sequence
  Synthetic Polynucleotide
taatacgactcactatagggtatcgatgtccaggatccggtcccctggccaacagaggagaggccagatgaccggatccaacctggcggcagcgcaaaagatg

SEQ ID NO: 220149 - DNA, 103 bp, Artificial Sequence
  Synthetic Polynucleotide
taatacgactcactataggggacagtggaatatcgatgtccaggatccggaacagaggagaccggatatgggacatcgaaacctggcggcagcgcaaaagatg

SEQ ID NO: 220150 - DNA, 103 bp, Artificial Sequence
  Synthetic Polynucleotide
taatacgactcactatagggcaggtagctgccggagttgtgctggttgtaaacagaggagatacaacatgcacaactccaacctggcggcagcgcaaaagatg

SEQ ID NO: 220151 - DNA, 103 bp, Artificial Sequence
  Synthetic Polynucleotide
taatacgactcactataggggataccaacagacagtggaatatcgatgtcaacagaggagagacatcatgattccactgaacctggcggcagcgcaaaagatg

SEQ ID NO: 220152 - DNA, 103 bp, Artificial Sequence
  Synthetic Polynucleotide
taatacgactcactatagggtggggtccaagataccaacagacagtggaaaacagaggagattccacatgctgttggtaaacctggcggcagcgcaaaagatg

SEQ ID NO: 220153 - DNA, 103 bp, Artificial Sequence
  Synthetic Polynucleotide
taatacgactcactataggggggctggccctggggtccaagataccaacaaacagaggagatgttggatgcttggacccaacctggcggcagcgcaaaagatg

SEQ ID NO: 220154 - DNA, 103 bp, Artificial Sequence
  Synthetic Polynucleotide
taatacgactcactatagggcagctgggtcgggctggccctggggtccaaaacagaggagattggacatgagggccagcaacctggcggcagcgcaaaagatg

SEQ ID NO: 220155 - DNA, 103 bp, Artificial Sequence
  Synthetic Polynucleotide
taatacgactcactatagggcgactgcattcagctgggtcgggctggcccaacagaggagagggccaatgcgacccagcaacctggcggcagcgcaaaagatg

SEQ ID NO: 220156 - DNA, 103 bp, Artificial Sequence
  Synthetic Polynucleotide
taatacgactcactatagggcacaaaaactcgactgcattcagctgggtcaacagaggagagacccaatggaatgcagtaacctggcggcagcgcaaaagatg

SEQ ID NO: 220157 - DNA, 103 bp, Artificial Sequence
  Synthetic Polynucleotide
taatacgactcactatagggcgcagggtcccacaaaaactcgactgcattaacagaggagaaatgcaatggagtttttgaacctggcggcagcgcaaaagatg

SEQ ID NO: 220158 - DNA, 103 bp, Artificial Sequence
  Synthetic Polynucleotide
taatacgactcactatagggaagctctcttcgcagggtcccacaaaaactaacagaggagaagttttatggggaccctgaacctggcggcagcgcaaaagatg

SEQ ID NO: 220159 - DNA, 103 bp, Artificial Sequence
  Synthetic Polynucleotide
taatacgactcactatagggatgaatgcagaagctctcttcgcagggtccaacagaggagaggacccatggaagagagcaacctggcggcagcgcaaaagatg

SEQ ID NO: 220160 - DNA, 103 bp, Artificial Sequence
  Synthetic Polynucleotide
taatacgactcactataggggtgtacctgaatgaatgcagaagctctcttaacagaggagaaagagaatgtctgcattcaacctggcggcagcgcaaaagatg

SEQ ID NO: 220161 - DNA, 103 bp, Artificial Sequence
  Synthetic Polynucleotide
taatacgactcactataggggcacatcacgcaggtagctgccggagttgtaacagaggagaacaactatggcagctaccaacctggcggcagcgcaaaagatg

SEQ ID NO: 220162 - DNA, 103 bp, Artificial Sequence
  Synthetic Polynucleotide
taatacgactcactatagggtgctgatgcagtgtacctgaatgaatgcagaacagaggagactgcatatgttcaggtacaacctggcggcagcgcaaaagatg

SEQ ID NO: 220163 - DNA, 103 bp, Artificial Sequence
  Synthetic Polynucleotide
taatacgactcactataggggtgaattctgtgctgatgcagtgtacctgaaacagaggagatcaggtatgctgcatcagaacctggcggcagcgcaaaagatg

SEQ ID NO: 220164 - DNA, 103 bp, Artificial Sequence
  Synthetic Polynucleotide
taatacgactcactatagggcttcctgggggtgaattctgtgctgatgcaaacagaggagatgcatcatgacagaattcaacctggcggcagcgcaaaagatg

SEQ ID NO: 220165 - DNA, 103 bp, Artificial Sequence
  Synthetic Polynucleotide
taatacgactcactatagggcgcccccgtgcttcctgggggtgaattctgaacagaggagacagaatatgcccccaggaaacctggcggcagcgcaaaagatg

SEQ ID NO: 220166 - DNA, 103 bp, Artificial Sequence
  Synthetic Polynucleotide
taatacgactcactatagggactcccttctcgcccccgtgcttcctggggaacagaggagaccccagatggcacgggggaacctggcggcagcgcaaaagatg

SEQ ID NO: 220167 - DNA, 103 bp, Artificial Sequence
  Synthetic Polynucleotide
taatacgactcactatagggtcgaaagggcactcccttctcgcccccgtgaacagaggagacacgggatggagaagggaaacctggcggcagcgcaaaagatg

SEQ ID NO: 220168 - DNA, 103 bp, Artificial Sequence
  Synthetic Polynucleotide
taatacgactcactatagggcaatctggactcgaaagggcactcccttctaacagaggagaagaaggatgtgccctttcaacctggcggcagcgcaaaagatg

SEQ ID NO: 220169 - DNA, 103 bp, Artificial Sequence
  Synthetic Polynucleotide
taatacgactcactatagggttaaacgtgtcaatctggactcgaaagggcaacagaggagagcccttatgagtccagataacctggcggcagcgcaaaagatg

SEQ ID NO: 220170 - DNA, 103 bp, Artificial Sequence
  Synthetic Polynucleotide
taatacgactcactatagggctcgttctgcttaaacgtgtcaatctggacaacagaggagagtccagatggacacgtttaacctggcggcagcgcaaaagatg

SEQ ID NO: 220171 - DNA, 103 bp, Artificial Sequence
  Synthetic Polynucleotide
taatacgactcactatagggactccccattctcgttctgcttaaacgtgtaacagaggagaacacgtatgagcagaacgaacctggcggcagcgcaaaagatg

SEQ ID NO: 220172 - DNA, 103 bp, Artificial Sequence
  Synthetic Polynucleotide
taatacgactcactatagggggcagagcgagcacatcacgcaggtagctgaacagaggagacagctaatggcgtgatgtaacctggcggcagcgcaaaagatg

SEQ ID NO: 220173 - DNA, 103 bp, Artificial Sequence
  Synthetic Polynucleotide
taatacgactcactatagggtgctccgtgtactccccattctcgttctgcaacagaggagagcagaaatggaatggggaaacctggcggcagcgcaaaagatg

SEQ ID NO: 220174 - DNA, 103 bp, Artificial Sequence
  Synthetic Polynucleotide
taatacgactcactatagggtgagtgcaggtgctccgtgtactccccattaacagaggagaaatgggatgtacacggagaacctggcggcagcgcaaaagatg

SEQ ID NO: 220175 - DNA, 103 bp, Artificial Sequence
  Synthetic Polynucleotide
taatacgactcactatagggggcagctggctgagtgcaggtgctccgtgtaacagaggagaacacggatgacctgcactaacctggcggcagcgcaaaagatg

SEQ ID NO: 220176 - DNA, 103 bp, Artificial Sequence
  Synthetic Polynucleotide
taatacgactcactatagggaccttgatctggcagctggctgagtgcaggaacagaggagacctgcaatgagccagctgaacctggcggcagcgcaaaagatg

SEQ ID NO: 220177 - DNA, 103 bp, Artificial Sequence
  Synthetic Polynucleotide
taatacgactcactatagggcggcttgaacaccttgatctggcagctggcaacagaggagagccagcatgcagatcaagaacctggcggcagcgcaaaagatg

SEQ ID NO: 220178 - DNA, 103 bp, Artificial Sequence
  Synthetic Polynucleotide
taatacgactcactatagggcggctcccttcggcttgaacaccttgatctaacagaggagaagatcaatgtgttcaagcaacctggcggcagcgcaaaagatg

SEQ ID NO: 220179 - DNA, 103 bp, Artificial Sequence
  Synthetic Polynucleotide
taatacgactcactatagggtgtttccgatcggctcccttcggcttgaacaacagaggagagttcaaatggaagggagcaacctggcggcagcgcaaaagatg

SEQ ID NO: 220180 - DNA, 103 bp, Artificial Sequence
  Synthetic Polynucleotide
taatacgactcactataggggtcagtcttctgtttccgatcggctcccttaacagaggagaaagggaatggatcggaaaaacctggcggcagcgcaaaagatg

SEQ ID NO: 220181 - DNA, 103 bp, Artificial Sequence
  Synthetic Polynucleotide
taatacgactcactatagggtcttctcccggtcagtcttctgtttccgataacagaggagaatcggaatgagaagactgaacctggcggcagcgcaaaagatg

SEQ ID NO: 220182 - DNA, 103 bp, Artificial Sequence
  Synthetic Polynucleotide
taatacgactcactatagggcttttctccatcttctcccggtcagtcttcaacagaggagagaagacatgccgggagaaaacctggcggcagcgcaaaagatg

SEQ ID NO: 220183 - DNA, 103 bp, Artificial Sequence
  Synthetic Polynucleotide
taatacgactcactatagggcttgaagatgggcagagcgagcacatcacgaacagaggagacgtgatatgctcgctctgaacctggcggcagcgcaaaagatg

SEQ ID NO: 220184 - DNA, 103 bp, Artificial Sequence
  Synthetic Polynucleotide
taatacgactcactatagggttgggcagttcttttctccatcttctcccgaacagaggagacgggagatgatggagaaaaacctggcggcagcgcaaaagatg

SEQ ID NO: 220185 - DNA, 103 bp, Artificial Sequence
  Synthetic Polynucleotide
taatacgactcactatagggtctccttctcttgggcagttcttttctccaaacagaggagatggagaatggaactgcccaacctggcggcagcgcaaaagatg

SEQ ID NO: 220186 - DNA, 103 bp, Artificial Sequence
  Synthetic Polynucleotide
taatacgactcactatagggggctggtatttctccttctcttgggcagttaacagaggagaaactgcatgagagaaggaaacctggcggcagcgcaaaagatg

SEQ ID NO: 220187 - DNA, 103 bp, Artificial Sequence
  Synthetic Polynucleotide
taatacgactcactatagggttcataggacggctggtatttctccttctcaacagaggagagagaagatgaaataccagaacctggcggcagcgcaaaagatg

SEQ ID NO: 220188 - DNA, 103 bp, Artificial Sequence
  Synthetic Polynucleotide
taatacgactcactatagggggatggtggtttcataggacggctggtattaacagaggagaaataccatgcgtcctatgaacctggcggcagcgcaaaagatg

SEQ ID NO: 220189 - DNA, 103 bp, Artificial Sequence
  Synthetic Polynucleotide
taatacgactcactatagggcactctgtgaggatggtggtttcataggacaacagaggagagtcctaatgaaccaccataacctggcggcagcgcaaaagatg

SEQ ID NO: 220190 - DNA, 103 bp, Artificial Sequence
  Synthetic Polynucleotide
taatacgactcactatagggccatggagagcactctgtgaggatggtggtaacagaggagaaccaccatgctcacagagaacctggcggcagcgcaaaagatg

SEQ ID NO: 220191 - DNA, 103 bp, Artificial Sequence
  Synthetic Polynucleotide
taatacgactcactatagggccacgtcgggccatggagagcactctgtgaaacagaggagatcacagatggctctccataacctggcggcagcgcaaaagatg

SEQ ID NO: 220192 - DNA, 103 bp, Artificial Sequence
  Synthetic Polynucleotide
taatacgactcactatagggacctggtaggccacgtcgggccatggagagaacagaggagactctccatggcccgacgtaacctggcggcagcgcaaaagatg

SEQ ID NO: 220193 - DNA, 103 bp, Artificial Sequence
  Synthetic Polynucleotide
taatacgactcactatagggggcgctgttcacctggtaggccacgtcgggaacagaggagacccgacatggcctaccagaacctggcggcagcgcaaaagatg

SEQ ID NO: 220194 - DNA, 103 bp, Artificial Sequence
  Synthetic Polynucleotide
taatacgactcactataggggttcctcctgcttgaagatgggcagagcgaaacagaggagatcgctcatgccatcttcaaacctggcggcagcgcaaaagatg

SEQ ID NO: 220195 - DNA, 103 bp, Artificial Sequence
  Synthetic Polynucleotide
taatacgactcactatagggttggggacggggcgctgttcacctggtaggaacagaggagacctaccatgtgaacagcgaacctggcggcagcgcaaaagatg

SEQ ID NO: 220196 - DNA, 103 bp, Artificial Sequence
  Synthetic Polynucleotide
taatacgactcactatagggccattgtagcttggggacggggcgctgttcaacagaggagagaacagatgcccgtccccaacctggcggcagcgcaaaagatg

SEQ ID NO: 220197 - DNA, 103 bp, Artificial Sequence
  Synthetic Polynucleotide
taatacgactcactataggggtttggagaaccattgtagcttggggacggaacagaggagaccgtccatgagctacaataacctggcggcagcgcaaaagatg

SEQ ID NO: 220198 - DNA, 103 bp, Artificial Sequence
  Synthetic Polynucleotide
taatacgactcactatagggggccaaagctgtttggagaaccattgtagcaacagaggagagctacaatggttctccaaaacctggcggcagcgcaaaagatg

SEQ ID NO: 220199 - DNA, 103 bp, Artificial Sequence
  Synthetic Polynucleotide
taatacgactcactatagggccttcgccgaggccaaagctgtttggagaaaacagaggagattctccatgcagctttggaacctggcggcagcgcaaaagatg

SEQ ID NO: 220200 - DNA, 103 bp, Artificial Sequence
  Synthetic Polynucleotide
taatacgactcactatagggagaggcgttgccttcgccgaggccaaagctaacagaggagaagctttatgctcggcgaaaacctggcggcagcgcaaaagatg

SEQ ID NO: 220201 - DNA, 103 bp, Artificial Sequence
  Synthetic Polynucleotide
taatacgactcactatagggggtgggtcggagaggcgttgccttcgccgaaacagaggagatcggcgatggcaacgcctaacctggcggcagcgcaaaagatg

SEQ ID NO: 220202 - DNA, 103 bp, Artificial Sequence
  Synthetic Polynucleotide
taatacgactcactataggggcctccaccgggtgggtcggagaggcgttgaacagaggagacaacgcatgtccgacccaaacctggcggcagcgcaaaagatg

SEQ ID NO: 220203 - DNA, 103 bp, Artificial Sequence
  Synthetic Polynucleotide
taatacgactcactatagggcacgggcagggcctccaccgggtgggtcggaacagaggagaccgaccatgccggtggagaacctggcggcagcgcaaaagatg

SEQ ID NO: 220204 - DNA, 103 bp, Artificial Sequence
  Synthetic Polynucleotide
taatacgactcactatagggggtcactgcccacgggcagggcctccaccgaacagaggagacggtggatgccctgcccgaacctggcggcagcgcaaaagatg

SEQ ID NO: 220205 - DNA, 103 bp, Artificial Sequence
  Synthetic Polynucleotide
taatacgactcactataggggacagctggggttcctcctgcttgaagatgaacagaggagacatcttatggcaggaggaaacctggcggcagcgcaaaagatg

SEQ ID NO: 220206 - DNA, 103 bp, Artificial Sequence
  Synthetic Polynucleotide
taatacgactcactataggggggagcaggtggtcactgcccacgggcaggaacagaggagacctgccatggggcagtgaaacctggcggcagcgcaaaagatg

SEQ ID NO: 220207 - DNA, 103 bp, Artificial Sequence
  Synthetic Polynucleotide
taatacgactcactatagggcgaagctgatgggagcaggtggtcactgccaacagaggagaggcagtatgcacctgctcaacctggcggcagcgcaaaagatg

SEQ ID NO: 220208 - DNA, 103 bp, Artificial Sequence
  Synthetic Polynucleotide
taatacgactcactatagggcatcctggatcgaagctgatgggagcaggtaacagaggagaacctgcatgcatcagcttaacctggcggcagcgcaaaagatg

SEQ ID NO: 220209 - DNA, 103 bp, Artificial Sequence
  Synthetic Polynucleotide
taatacgactcactatagggcactgctgggcatcctggatcgaagctgataacagaggagaatcagcatggatccaggaaacctggcggcagcgcaaaagatg

SEQ ID NO: 220210 - DNA, 103 bp, Artificial Sequence
  Synthetic Polynucleotide
taatacgactcactataggggcggtgaagccactgctgggcatcctggataacagaggagaatccagatggcccagcagaacctggcggcagcgcaaaagatg

SEQ ID NO: 220211 - DNA, 103 bp, Artificial Sequence
  Synthetic Polynucleotide
taatacgactcactatagggagaacctgttgcggtgaagccactgctgggaacagaggagacccagcatgggcttcaccaacctggcggcagcgcaaaagatg

SEQ ID NO: 220212 - DNA, 103 bp, Artificial Sequence
  Synthetic Polynucleotide
taatacgactcactatagggcagaactgcgagaacctgttgcggtgaagcaacagaggagagcttcaatgcaacaggttaacctggcggcagcgcaaaagatg

SEQ ID NO: 220213 - DNA, 103 bp, Artificial Sequence
  Synthetic Polynucleotide
taatacgactcactatagggaaagagccggcagaactgcgagaacctgttaacagaggagaaacaggatgtcgcagttcaacctggcggcagcgcaaaagatg

SEQ ID NO: 220214 - DNA, 103 bp, Artificial Sequence
  Synthetic Polynucleotide
taatacgactcactatagggagaagctggcaaagagccggcagaactgcgaacagaggagacgcagtatggccggctctaacctggcggcagcgcaaaagatg

SEQ ID NO: 220215 - DNA, 103 bp, Artificial Sequence
  Synthetic Polynucleotide
taatacgactcactatagggtcagcacctgagaagctggcaaagagccggaacagaggagaccggctatgtgccagcttaacctggcggcagcgcaaaagatg

SEQ ID NO: 220216 - DNA, 103 bp, Artificial Sequence
  Synthetic Polynucleotide
taatacgactcactatagggggcttcaattagaccggcatcttttgccataacagaggagaatggcaatggatgccggtaacctggcggcagcgcaaaagatg

SEQ ID NO: 220217 - DNA, 103 bp, Artificial Sequence
  Synthetic Polynucleotide
taatacgactcactataggggttgacggtggaggggtgaacggccacgagaacagaggagactcgtgatggttcaccccaacctggcggcagcgcaaaagatg

SEQ ID NO: 220218 - DNA, 103 bp, Artificial Sequence
  Synthetic Polynucleotide
taatacgactcactatagggtccctgagccatttctgtcacgtatggctcaacagaggagagagccaatggtgacagaaaacctggcggcagcgcaaaagatg

SEQ ID NO: 220219 - DNA, 103 bp, Artificial Sequence
  Synthetic Polynucleotide
taatacgactcactatagggctccaacagttccctgagccatttctgtcaaacagaggagatgacagatgtggctcaggaacctggcggcagcgcaaaagatg

SEQ ID NO: 220220 - DNA, 103 bp, Artificial Sequence
  Synthetic Polynucleotide
taatacgactcactatagggatgaacacgcctccaacagttccctgagccaacagaggagaggctcaatgaactgttggaacctggcggcagcgcaaaagatg

SEQ ID NO: 220221 - DNA, 103 bp, Artificial Sequence
  Synthetic Polynucleotide
taatacgactcactatagggtgccgtcgtgatgaacacgcctccaacagtaacagaggagaactgttatgggcgtgttcaacctggcggcagcgcaaaagatg

SEQ ID NO: 220222 - DNA, 103 bp, Artificial Sequence
  Synthetic Polynucleotide
taatacgactcactatagggacgtggaacctgccgtcgtgatgaacacgcaacagaggagagcgtgtatgtcacgacggaacctggcggcagcgcaaaagatg

SEQ ID NO: 220223 - DNA, 103 bp, Artificial Sequence
  Synthetic Polynucleotide
taatacgactcactataggggtgccgttagacgtggaacctgccgtcgtgaacagaggagacacgacatgaggttccacaacctggcggcagcgcaaaagatg

SEQ ID NO: 220224 - DNA, 103 bp, Artificial Sequence
  Synthetic Polynucleotide
taatacgactcactatagggagagaaccttgtgccgttagacgtggaaccaacagaggagaggttccatgtctaacggcaacctggcggcagcgcaaaagatg

SEQ ID NO: 220225 - DNA, 103 bp, Artificial Sequence
  Synthetic Polynucleotide
taatacgactcactatagggggtcactggcagagaaccttgtgccgttagaacagaggagactaacgatgcaaggttctaacctggcggcagcgcaaaagatg

SEQ ID NO: 220226 - DNA, 103 bp, Artificial Sequence
  Synthetic Polynucleotide
taatacgactcactatagggccgttggtcaggtcactggcagagaaccttaacagaggagaaaggttatgtgccagtgaaacctggcggcagcgcaaaagatg

SEQ ID NO: 220227 - DNA, 103 bp, Artificial Sequence
  Synthetic Polynucleotide
taatacgactcactatagggcccatctgcaccgttggtcaggtcactggcaacagaggagagccagtatgctgaccaacaacctggcggcagcgcaaaagatg

SEQ ID NO: 220228 - DNA, 103 bp, Artificial Sequence
  Synthetic Polynucleotide
taatacgactcactatagggtcccgagcgggttgacggtggaggggtgaaaacagaggagattcaccatgccaccgtcaaacctggcggcagcgcaaaagatg

SEQ ID NO: 220229 - DNA, 103 bp, Artificial Sequence
  Synthetic Polynucleotide
taatacgactcactatagggtggccagcatcccatctgcaccgttggtcaaacagaggagatgaccaatggtgcagatgaacctggcggcagcgcaaaagatg

SEQ ID NO: 220230 - DNA, 103 bp, Artificial Sequence
  Synthetic Polynucleotide
taatacgactcactatagggttggagcttgtggccagcatcccatctgcaaacagaggagatgcagaatggatgctggcaacctggcggcagcgcaaaagatg

SEQ ID NO: 220231 - DNA, 103 bp, Artificial Sequence
  Synthetic Polynucleotide
taatacgactcactatagggctgagacccattggagcttgtggccagcataacagaggagaatgctgatgacaagctccaacctggcggcagcgcaaaagatg

SEQ ID NO: 220232 - DNA, 103 bp, Artificial Sequence
  Synthetic Polynucleotide
taatacgactcactatagggagccgctgtactgagacccattggagcttgaacagaggagacaagctatgatgggtctcaacctggcggcagcgcaaaagatg

SEQ ID NO: 220233 - DNA, 103 bp, Artificial Sequence
  Synthetic Polynucleotide
taatacgactcactatagggtccaccctggagccgctgtactgagacccaaacagaggagatgggtcatggtacagcggaacctggcggcagcgcaaaagatg

SEQ ID NO: 220234 - DNA, 103 bp, Artificial Sequence
  Synthetic Polynucleotide
taatacgactcactatagggcaccggagtctccaccctggagccgctgtaaacagaggagatacagcatgtccagggtgaacctggcggcagcgcaaaagatg

SEQ ID NO: 220235 - DNA, 103 bp, Artificial Sequence
  Synthetic Polynucleotide
taatacgactcactatagggcgacgtaggacaccggagtctccaccctggaacagaggagaccagggatgagactccggaacctggcggcagcgcaaaagatg

SEQ ID NO: 220236 - DNA, 103 bp, Artificial Sequence
  Synthetic Polynucleotide
taatacgactcactatagggtcgtcctccccgacgtaggacaccggagtcaacagaggagagactccatggtcctacgtaacctggcggcagcgcaaaagatg

SEQ ID NO: 220237 - DNA, 103 bp, Artificial Sequence
  Synthetic Polynucleotide
taatacgactcactataggggtcctcctcgtcgtcctccccgacgtaggaaacagaggagatcctacatgggggaggacaacctggcggcagcgcaaaagatg

SEQ ID NO: 220238 - DNA, 103 bp, Artificial Sequence
  Synthetic Polynucleotide
taatacgactcactatagggtgaagtcatcgtcctcctcgtcgtcctcccaacagaggagagggaggatgacgaggaggaacctggcggcagcgcaaaagatg

SEQ ID NO: 220239 - DNA, 103 bp, Artificial Sequence
  Synthetic Polynucleotide
taatacgactcactatagggaagagctgcttcccgagcgggttgacggtgaacagaggagacaccgtatgcccgctcggaacctggcggcagcgcaaaagatg

SEQ ID NO: 220240 - DNA, 103 bp, Artificial Sequence
  Synthetic Polynucleotide
taatacgactcactatagggtcattctcgttgaagtcatcgtcctcctcgaacagaggagacgaggaatgcgatgacttaacctggcggcagcgcaaaagatg

SEQ ID NO: 220241 - DNA, 103 bp, Artificial Sequence
  Synthetic Polynucleotide
taatacgactcactataggggtcgtcctcgtcattctcgttgaagtcatcaacagaggagagatgacatgaacgagaataacctggcggcagcgcaaaagatg

SEQ ID NO: 220242 - DNA, 103 bp, Artificial Sequence
  Synthetic Polynucleotide
taatacgactcactatagggggtttttggcaagagctgcttcccgagcggaacagaggagaccgctcatgaagcagctcaacctggcggcagcgcaaaagatg

SEQ ID NO: 220243 - DNA, 103 bp, Artificial Sequence
  Synthetic Polynucleotide
taatacgactcactatagggactgtccaaaggtttttggcaagagctgctaacagaggagaagcagcatgtgccaaaaaaacctggcggcagcgcaaaagatg

SEQ ID NO: 220244 - DNA, 103 bp, Artificial Sequence
  Synthetic Polynucleotide
taatacgactcactatagggttgacattggactgtccaaaggtttttggcaacagaggagagccaaaatgctttggacaaacctggcggcagcgcaaaagatg

SEQ ID NO: 220245 - DNA, 103 bp, Artificial Sequence
  Synthetic Polynucleotide
taatacgactcactatagggctgggcaatgttgacattggactgtccaaaaacagaggagatttggaatgtccaatgtcaacctggcggcagcgcaaaagatg

SEQ ID NO: 220246 - DNA, 103 bp, Artificial Sequence
  Synthetic Polynucleotide
taatacgactcactatagggttaccacttgctgggcaatgttgacattggaacagaggagaccaatgatgacattgcccaacctggcggcagcgcaaaagatg

SEQ ID NO: 220247 - DNA, 103 bp, Artificial Sequence
  Synthetic Polynucleotide
taatacgactcactatagggggcgtaccaattaccacttgctgggcaatgaacagaggagacattgcatggcaagtggtaacctggcggcagcgcaaaagatg

SEQ ID NO: 220248 - DNA, 103 bp, Artificial Sequence
  Synthetic Polynucleotide
taatacgactcactatagggcggtctctgaggcgtaccaattaccacttgaacagaggagacaagtgatgattggtacgaacctggcggcagcgcaaaagatg

SEQ ID NO: 220249 - DNA, 103 bp, Artificial Sequence
  Synthetic Polynucleotide
taatacgactcactataggggttctccgttggcttcaattagaccggcataacagaggagaatgccgatgtaattgaagaacctggcggcagcgcaaaagatg

SEQ ID NO: 220250 - DNA, 103 bp, Artificial Sequence
  Synthetic Polynucleotide
taatacgactcactatagggttgacgctgccggtctctgaggcgtaccaaaacagaggagattggtaatgctcagagacaacctggcggcagcgcaaaagatg

SEQ ID NO: 220251 - DNA, 103 bp, Artificial Sequence
  Synthetic Polynucleotide
taatacgactcactatagggaccagggtgtttgacgctgccggtctctgaaacagaggagatcagagatgggcagcgtcaacctggcggcagcgcaaaagatg

SEQ ID NO: 220252 - DNA, 103 bp, Artificial Sequence
  Synthetic Polynucleotide
taatacgactcactataggggcttcctaccaccagggtgtttgacgctgcaacagaggagagcagcgatgaacaccctgaacctggcggcagcgcaaaagatg

SEQ ID NO: 220253 - DNA, 103 bp, Artificial Sequence
  Synthetic Polynucleotide
taatacgactcactataggggggtgtgtgggcttcctaccaccagggtgtaacagaggagaacacccatgtggtaggaaaacctggcggcagcgcaaaagatg

SEQ ID NO: 220254 - DNA, 103 bp, Artificial Sequence
  Synthetic Polynucleotide
taatacgactcactatagggtgagtgctgggggtgtgtgggcttcctaccaacagaggagaggtaggatgcccacacacaacctggcggcagcgcaaaagatg

SEQ ID NO: 220255 - DNA, 103 bp, Artificial Sequence
  Synthetic Polynucleotide
taatacgactcactatagggagaggcaaagtgagtgctgggggtgtgtggaacagaggagaccacacatgcccagcactaacctggcggcagcgcaaaagatg

SEQ ID NO: 220256 - DNA, 103 bp, Artificial Sequence
  Synthetic Polynucleotide
taatacgactcactataggggctggttctgagaggcaaagtgagtgctggaacagaggagaccagcaatgactttgcctaacctggcggcagcgcaaaagatg

SEQ ID NO: 220257 - DNA, 103 bp, Artificial Sequence
  Synthetic Polynucleotide
taatacgactcactataggggagtcggaaggctggttctgagaggcaaagaacagaggagactttgcatgtcagaaccaaacctggcggcagcgcaaaagatg

SEQ ID NO: 220258 - DNA, 103 bp, Artificial Sequence
  Synthetic Polynucleotide
taatacgactcactatagggccaaggtgaggagtcggaaggctggttctgaacagaggagacagaacatgccttccgacaacctggcggcagcgcaaaagatg

SEQ ID NO: 220259 - DNA, 103 bp, Artificial Sequence
  Synthetic Polynucleotide
taatacgactcactatagggtcccggcagaccaaggtgaggagtcggaagaacagaggagacttccgatgcctcaccttaacctggcggcagcgcaaaagatg

SEQ ID NO: 220260 - DNA, 103 bp, Artificial Sequence
  Synthetic Polynucleotide
taatacgactcactatagggaagaccttgagttctccgttggcttcaattaacagaggagaaattgaatgcaacggagaaacctggcggcagcgcaaaagatg

SEQ ID NO: 220261 - DNA, 103 bp, Artificial Sequence
  Synthetic Polynucleotide
taatacgactcactatagggctgttgcgcttcccggcagaccaaggtgagaacagaggagactcaccatggtctgccggaacctggcggcagcgcaaaagatg

SEQ ID NO: 220262 - DNA, 103 bp, Artificial Sequence
  Synthetic Polynucleotide
taatacgactcactatagggctctcctttcctgttgcgcttcccggcagaaacagaggagatctgccatgaagcgcaacaacctggcggcagcgcaaaagatg

SEQ ID NO: 220263 - DNA, 103 bp, Artificial Sequence
  Synthetic Polynucleotide
taatacgactcactatagggtgccattcttctctcctttcctgttgcgctaacagaggagaagcgcaatgggaaaggagaacctggcggcagcgcaaaagatg

SEQ ID NO: 220264 - DNA, 103 bp, Artificial Sequence
  Synthetic Polynucleotide
taatacgactcactatagggcgtaggcccttgccattcttctctcctttcaacagaggagagaaaggatggaagaatggaacctggcggcagcgcaaaagatg

SEQ ID NO: 220265 - DNA, 103 bp, Artificial Sequence
  Synthetic Polynucleotide
taatacgactcactatagggggagaaatgccgtaggcccttgccattcttaacagaggagaaagaatatgaagggcctaaacctggcggcagcgcaaaagatg

SEQ ID NO: 220266 - DNA, 103 bp, Artificial Sequence
  Synthetic Polynucleotide
taatacgactcactatagggagaccttcatggagaaatgccgtaggccctaacagaggagaagggccatgggcatttctaacctggcggcagcgcaaaagatg

SEQ ID NO: 220267 - DNA, 103 bp, Artificial Sequence
  Synthetic Polynucleotide
taatacgactcactatagggaccttctcgcagaccttcatggagaaatgcaacagaggagagcatttatgcatgaaggtaacctggcggcagcgcaaaagatg

SEQ ID NO: 220268 - DNA, 103 bp, Artificial Sequence
  Synthetic Polynucleotide
taatacgactcactatagggtttcctctgcaccttctcgcagaccttcataacagaggagaatgaagatgtgcgagaagaacctggcggcagcgcaaaagatg

SEQ ID NO: 220269 - DNA, 103 bp, Artificial Sequence
  Synthetic Polynucleotide
taatacgactcactatagggaagtggtccctttcctctgcaccttctcgcaacagaggagagcgagaatgtgcagaggaaacctggcggcagcgcaaaagatg

SEQ ID NO: 220270 - DNA, 103 bp, Artificial Sequence
  Synthetic Polynucleotide
taatacgactcactatagggtcgttgtaggaagtggtccctttcctctgcaacagaggagagcagagatgagggaccacaacctggcggcagcgcaaaagatg

SEQ ID NO: 220271 - DNA, 103 bp, Artificial Sequence
  Synthetic Polynucleotide
taatacgactcactatagggctggtctatgaagaccttgagttctccgttaacagaggagaaacggaatgctcaaggtcaacctggcggcagcgcaaaagatg

SEQ ID NO: 220272 - DNA, 103 bp, Artificial Sequence
  Synthetic Polynucleotide
taatacgactcactataggggtctgccacttcgttgtaggaagtggtcccaacagaggagagggaccatgtcctacaacaacctggcggcagcgcaaaagatg

SEQ ID NO: 220273 - DNA, 103 bp, Artificial Sequence
  Synthetic Polynucleotide
taatacgactcactatagggcaaccagctcgtctgccacttcgttgtaggaacagaggagacctacaatgaagtggcagaacctggcggcagcgcaaaagatg

SEQ ID NO: 220274 - DNA, 103 bp, Artificial Sequence
  Synthetic Polynucleotide
taatacgactcactatagggctgaactccgcaaccagctcgtctgccactaacagaggagaagtggcatgcgagctggtaacctggcggcagcgcaaaagatg

SEQ ID NO: 220275 - DNA, 103 bp, Artificial Sequence
  Synthetic Polynucleotide
taatacgactcactataggggtcggcagcactgaactccgcaaccagctcaacagaggagagagctgatggcggagttcaacctggcggcagcgcaaaagatg

SEQ ID NO: 220276 - DNA, 103 bp, Artificial Sequence
  Synthetic Polynucleotide
taatacgactcactatagggagatgtggttgtcggcagcactgaactccgaacagaggagacggagtatggtgctgccgaacctggcggcagcgcaaaagatg

SEQ ID NO: 220277 - DNA, 103 bp, Artificial Sequence
  Synthetic Polynucleotide
taatacgactcactatagggtcgtttggtaagatgtggttgtcggcagcaaacagaggagatgctgcatgcaaccacataacctggcggcagcgcaaaagatg

SEQ ID NO: 220278 - DNA, 103 bp, Artificial Sequence
  Synthetic Polynucleotide
taatacgactcactatagggataagctgactcgtttggtaagatgtggttaacagaggagaaaccacatgttaccaaacaacctggcggcagcgcaaaagatg

SEQ ID NO: 220279 - DNA, 103 bp, Artificial Sequence
  Synthetic Polynucleotide
taatacgactcactatagggttttctggtcataagctgactcgtttggtaaacagaggagataccaaatgagtcagcttaacctggcggcagcgcaaaagatg

SEQ ID NO: 220280 - DNA, 103 bp, Artificial Sequence
  Synthetic Polynucleotide
taatacgactcactatagggcgtcttatgtttttctggtcataagctgacaacagaggagagtcagcatgtgaccagaaaacctggcggcagcgcaaaagatg

SEQ ID NO: 220281 - DNA, 103 bp, Artificial Sequence
  Synthetic Polynucleotide
taatacgactcactataggggtagacgcgccgtcttatgtttttctggtcaacagaggagagaccagatgaacataagaaacctggcggcagcgcaaaagatg

SEQ ID NO: 220282 - DNA, 103 bp, Artificial Sequence
  Synthetic Polynucleotide
taatacgactcactataggggactaaggttctggtctatgaagaccttgaaacagaggagatcaaggatgtcatagaccaacctggcggcagcgcaaaagatg

SEQ ID NO: 220283 - DNA, 103 bp, Artificial Sequence
  Synthetic Polynucleotide
taatacgactcactatagggttaaggcatcgtagacgcgccgtcttatgtaacagaggagaacataaatgggcgcgtctaacctggcggcagcgcaaaagatg

SEQ ID NO: 220284 - DNA, 103 bp, Artificial Sequence
  Synthetic Polynucleotide
taatacgactcactatagggattagcacgtttaaggcatcgtagacgcgcaacagaggagagcgcgtatgcgatgccttaacctggcggcagcgcaaaagatg

SEQ ID NO: 220285 - DNA, 103 bp, Artificial Sequence
  Synthetic Polynucleotide
taatacgactcactataggggttcatggccattagcacgtttaaggcatcaacagaggagagatgccatgaacgtgctaaacctggcggcagcgcaaaagatg

SEQ ID NO: 220286 - DNA, 103 bp, Artificial Sequence
  Synthetic Polynucleotide
taatacgactcactatagggtggagatgatgttcatggccattagcacgtaacagaggagaacgtgcatgtggccatgaaacctggcggcagcgcaaaagatg

SEQ ID NO: 220287 - DNA, 103 bp, Artificial Sequence
  Synthetic Polynucleotide
taatacgactcactatagggttcttctccttggagatgatgttcatggccaacagaggagaggccatatgcatcatctcaacctggcggcagcgcaaaagatg

SEQ ID NO: 220288 - DNA, 103 bp, Artificial Sequence
  Synthetic Polynucleotide
taatacgactcactatagggcttgatctccttcttctccttggagatgataacagaggagaatcatcatgaaggagaagaacctggcggcagcgcaaaagatg

SEQ ID NO: 220289 - DNA, 103 bp, Artificial Sequence
  Synthetic Polynucleotide
taatacgactcactataggggaccaatccacttgatctccttcttctcctaacagaggagaaggagaatgaggagatcaaacctggcggcagcgcaaaagatg

SEQ ID NO: 220290 - DNA, 103 bp, Artificial Sequence
  Synthetic Polynucleotide
taatacgactcactatagggttggtgggcagaccaatccacttgatctccaacagaggagaggagatatggtggattggaacctggcggcagcgcaaaagatg

SEQ ID NO: 220291 - DNA, 103 bp, Artificial Sequence
  Synthetic Polynucleotide
taatacgactcactatagggctgagccgagttggtgggcagaccaatccaaacagaggagatggattatgctgcccaccaacctggcggcagcgcaaaagatg

SEQ ID NO: 220292 - DNA, 103 bp, Artificial Sequence
  Synthetic Polynucleotide
taatacgactcactatagggtctgacattcctgagccgagttggtgggcaaacagaggagatgcccaatgactcggctcaacctggcggcagcgcaaaagatg

SEQ ID NO: 220293 - DNA, 103 bp, Artificial Sequence
  Synthetic Polynucleotide
taatacgactcactatagggcctttcccgggactaaggttctggtctatgaacagaggagacatagaatggaaccttagaacctggcggcagcgcaaaagatg

SEQ ID NO: 220294 - DNA, 103 bp, Artificial Sequence
  Synthetic Polynucleotide
taatacgactcactatagggacctctaagttctgacattcctgagccgagaacagaggagactcggcatgggaatgtcaaacctggcggcagcgcaaaagatg

SEQ ID NO: 220295 - DNA, 103 bp, Artificial Sequence
  Synthetic Polynucleotide
taatacgactcactatagggctgtctttccacctctaagttctgacattcaacagaggagagaatgtatgaacttagagaacctggcggcagcgcaaaagatg

SEQ ID NO: 220296 - DNA, 103 bp, Artificial Sequence
  Synthetic Polynucleotide
taatacgactcactatagggcaagtctcctctgtctttccacctctaagtaacagaggagaacttagatgtggaaagacaacctggcggcagcgcaaaagatg

SEQ ID NO: 220297 - DNA, 103 bp, Artificial Sequence
  Synthetic Polynucleotide
taatacgactcactatagggtttattctttcaagtctcctctgtctttccaacagaggagaggaaagatggaggagactaacctggcggcagcgcaaaagatg

SEQ ID NO: 220298 - DNA, 103 bp, Artificial Sequence
  Synthetic Polynucleotide
taatacgactcactatagggctgtttctgttttattctttcaagtctcctaacagaggagaaggagaatggaaagaataaacctggcggcagcgcaaaagatg

SEQ ID NO: 220299 - DNA, 103 bp, Artificial Sequence
  Synthetic Polynucleotide
taatacgactcactataggggaagttgagactgtttctgttttattctttaacagaggagaaaagaaatgaacagaaacaacctggcggcagcgcaaaagatg

SEQ ID NO: 220300 - DNA, 103 bp, Artificial Sequence
  Synthetic Polynucleotide
taatacgactcactatagggataagttcttgaagttgagactgtttctgtaacagaggagaacagaaatggtctcaactaacctggcggcagcgcaaaagatg

SEQ ID NO: 220301 - DNA, 103 bp, Artificial Sequence
  Synthetic Polynucleotide
taatacgactcactatagggttgctgtagaataagttcttgaagttgagaaacagaggagatctcaaatgcaagaacttaacctggcggcagcgcaaaagatg

SEQ ID NO: 220302 - DNA, 103 bp, Artificial Sequence
  Synthetic Polynucleotide
taatacgactcactatagggtgaaggcaatttgctgtagaataagttcttaacagaggagaaagaacatgttctacagcaacctggcggcagcgcaaaagatg

SEQ ID NO: 220303 - DNA, 103 bp, Artificial Sequence
  Synthetic Polynucleotide
taatacgactcactatagggaccaggttcttgaaggcaatttgctgtagaaacagaggagatctacaatgaattgccttaacctggcggcagcgcaaaagatg

SEQ ID NO: 220304 - DNA, 103 bp, Artificial Sequence
  Synthetic Polynucleotide
taatacgactcactatagggggacaccacgcctttcccgggactaaggttaacagaggagaaaccttatgcccgggaaaaacctggcggcagcgcaaaagatg

SEQ ID NO: 220305 - DNA, 103 bp, Artificial Sequence
  Synthetic Polynucleotide
taatacgactcactataggggtttctctgcaccaggttcttgaaggcaataacagaggagaattgccatgaagaacctgaacctggcggcagcgcaaaagatg

SEQ ID NO: 220306 - DNA, 103 bp, Artificial Sequence
  Synthetic Polynucleotide
taatacgactcactatagggccgcatgccggtttctctgcaccaggttctaacagaggagaagaaccatgtgcagagaaaacctggcggcagcgcaaaagatg

SEQ ID NO: 220307 - DNA, 103 bp, Artificial Sequence
  Synthetic Polynucleotide
taatacgactcactataggggcctgctgctccgcatgccggtttctctgcaacagaggagagcagagatgccggcatgcaacctggcggcagcgcaaaagatg

SEQ ID NO: 220308 - DNA, 103 bp, Artificial Sequence
  Synthetic Polynucleotide
taatacgactcactatagggtggccggctggcctgctgctccgcatgccgaacagaggagacggcatatggagcagcagaacctggcggcagcgcaaaagatg

SEQ ID NO: 220309 - DNA, 103 bp, Artificial Sequence
  Synthetic Polynucleotide
taatacgactcactatagggtgggtggcggtggccggctggcctgctgctaacagaggagaagcagcatgccagccggcaacctggcggcagcgcaaaagatg

SEQ ID NO: 220310 - DNA, 103 bp, Artificial Sequence
  Synthetic Polynucleotide
taatacgactcactatagggatgactgagttgggtggcggtggccggctgaacagaggagacagccgatgaccgccaccaacctggcggcagcgcaaaagatg

SEQ ID NO: 220311 - DNA, 103 bp, Artificial Sequence
  Synthetic Polynucleotide
taatacgactcactataggggggcaggtggatgactgagttgggtggcggaacagaggagaccgccaatgaactcagtcaacctggcggcagcgcaaaagatg

SEQ ID NO: 220312 - DNA, 103 bp, Artificial Sequence
  Synthetic Polynucleotide
taatacgactcactatagggcgatgatgaagggcaggtggatgactgagtaacagaggagaactcagatgtccacctgcaacctggcggcagcgcaaaagatg

SEQ ID NO: 220313 - DNA, 103 bp, Artificial Sequence
  Synthetic Polynucleotide
taatacgactcactatagggctggtgttgacgatgatgaagggcaggtggaacagaggagaccacctatgcttcatcataacctggcggcagcgcaaaagatg

SEQ ID NO: 220314 - DNA, 103 bp, Artificial Sequence
  Synthetic Polynucleotide
taatacgactcactatagggcgtcttcttgctggtgttgacgatgatgaaaacagaggagattcatcatggtcaacaccaacctggcggcagcgcaaaagatg

SEQ ID NO: 220315 - DNA, 103 bp, Artificial Sequence
  Synthetic Polynucleotide
taatacgactcactatagggcggccacgagggacaccacgcctttcccggaacagaggagaccgggaatggcgtggtgtaacctggcggcagcgcaaaagatg

SEQ ID NO: 220316 - DNA, 103 bp, Artificial Sequence
  Synthetic Polynucleotide
taatacgactcactatagggagtcgatgaccgtcttcttgctggtgttgaaacagaggagatcaacaatggcaagaagaaacctggcggcagcgcaaaagatg

SEQ ID NO: 220317 - DNA, 103 bp, Artificial Sequence
  Synthetic Polynucleotide
taatacgactcactataggggagatgctgcagtcgatgaccgtcttcttgaacagaggagacaagaaatgggtcatcgaaacctggcggcagcgcaaaagatg

SEQ ID NO: 220318 - DNA, 103 bp, Artificial Sequence
  Synthetic Polynucleotide
taatacgactcactatagggtttgtcattggagatgctgcagtcgatgacaacagaggagagtcatcatgtgcagcatcaacctggcggcagcgcaaaagatg

SEQ ID NO: 220319 - DNA, 103 bp, Artificial Sequence
  Synthetic Polynucleotide
taatacgactcactataggggatactcaaatttgtcattggagatgctgcaacagaggagagcagcaatgccaatgacaaacctggcggcagcgcaaaagatg

SEQ ID NO: 220320 - DNA, 103 bp, Artificial Sequence
  Synthetic Polynucleotide
taatacgactcactatagggaaattaaacagatactcaaatttgtcattgaacagaggagacaatgaatgatttgagtaaacctggcggcagcgcaaaagatg

SEQ ID NO: 220321 - DNA, 103 bp, Artificial Sequence
  Synthetic Polynucleotide
taatacgactcactatagggtgtgttgtcaaaattaaacagatactcaaaaacagaggagatttgagatgctgtttaataacctggcggcagcgcaaaagatg

SEQ ID NO: 220322 - DNA, 103 bp, Artificial Sequence
  Synthetic Polynucleotide
taatacgactcactatagggggatttcaaatgtgttgtcaaaattaaacaaacagaggagatgtttaatgttgacaacaaacctggcggcagcgcaaaagatg

SEQ ID NO: 220323 - DNA, 103 bp, Artificial Sequence
  Synthetic Polynucleotide
taatacgactcactatagggatgtcatcgtggatttcaaatgtgttgtcaaacagaggagatgacaaatgatttgaaataacctggcggcagcgcaaaagatg

SEQ ID NO: 220324 - DNA, 103 bp, Artificial Sequence
  Synthetic Polynucleotide
taatacgactcactatagggcagcacttctatgtcatcgtggatttcaaaaacagaggagatttgaaatgcacgatgacaacctggcggcagcgcaaaagatg

SEQ ID NO: 220325 - DNA, 103 bp, Artificial Sequence
  Synthetic Polynucleotide
taatacgactcactatagggccatccgcttcagcacttctatgtcatcgtaacagaggagaacgatgatgtagaagtgcaacctggcggcagcgcaaaagatg

SEQ ID NO: 220326 - DNA, 103 bp, Artificial Sequence
  Synthetic Polynucleotide
taatacgactcactataggggaggggtgaacggccacgagggacaccacgaacagaggagacgtggtatgcctcgtggcaacctggcggcagcgcaaaagatg

SEQ ID NO: 220327 - DNA, 103 bp, Artificial Sequence
  Synthetic Polynucleotide
taatacgactcactatagggcaagccatgcccatccgcttcagcacttctaacagaggagaagaagtatggaagcggataacctggcggcagcgcaaaagatg

SEQ ID NO: 220328 - DNA, 103 bp, Artificial Sequence
  Synthetic Polynucleotide
taatacgactcactatagggctccagcccgcaagccatgcccatccgcttaacagaggagaaagcggatgggcatggctaacctggcggcagcgcaaaagatg

SEQ ID NO: 220329 - DNA, 103 bp, Artificial Sequence
  Synthetic Polynucleotide
taatacgactcactatagggagctccccgactccagcccgcaagccatgcaacagaggagagcatggatggcgggctggaacctggcggcagcgcaaaagatg

SEQ ID NO: 220330 - DNA, 103 bp, Artificial Sequence
  Synthetic Polynucleotide
taatacgactcactatagggtcggcagagcagctccccgactccagcccgaacagaggagacgggctatggtcggggagaacctggcggcagcgcaaaagatg

SEQ ID NO: 220331 - DNA, 103 bp, Artificial Sequence
  Synthetic Polynucleotide
taatacgactcactatagggtttaaggtcttcggcagagcagctccccgaaacagaggagatcggggatgtgctctgccaacctggcggcagcgcaaaagatg

SEQ ID NO: 220332 - DNA, 103 bp, Artificial Sequence
  Synthetic Polynucleotide
taatacgactcactatagggttctggccattttaaggtcttcggcagagcaacagaggagagctctgatgaagaccttaaacctggcggcagcgcaaaagatg

SEQ ID NO: 220333 - DNA, 103 bp, Artificial Sequence
  Synthetic Polynucleotide
taatacgactcactataggggggaccagacttctggccattttaaggtctaacagaggagaagacctatgaatggccagaacctggcggcagcgcaaaagatg

SEQ ID NO: 220334 - DNA, 103 bp, Artificial Sequence
  Synthetic Polynucleotide
taatacgactcactatagggcagagccttggggaccagacttctggccataacagaggagaatggccatgagtctggtcaacctggcggcagcgcaaaagatg

SEQ ID NO: 220335 - DNA, 103 bp, Artificial Sequence
  Synthetic Polynucleotide
taatacgactcactatagggcgtatggctccagagccttggggaccagacaacagaggagagtctggatgccaaggctcaacctggcggcagcgcaaaagatg

SEQ ID NO: 220336 - DNA, 103 bp, Artificial Sequence
  Synthetic Polynucleotide
taatacgactcactatagggatttctgtcacgtatggctccagagccttgaacagaggagacaaggcatgggagccataaacctggcggcagcgcaaaagatg

SEQ ID NO: 220337 - DNA, 103 bp, Artificial Sequence
  Synthetic Polynucleotide
taatacgactcactatagggggttagtctctgtggtgtgcttataatcataacagaggagaatgattatgagcacaccaaacctggcggcagcgcaaaagatg

SEQ ID NO: 220338 - DNA, 103 bp, Artificial Sequence
  Synthetic Polynucleotide
taatacgactcactataggggacccagccagtagcttctgctatgtgtgtaacagaggagaacacacatggcagaagctaacctggcggcagcgcaaaagatg

SEQ ID NO: 220339 - DNA, 103 bp, Artificial Sequence
  Synthetic Polynucleotide
taatacgactcactatagggagttgctaaggccacttctgcatccaagcaaacagaggagatgcttgatggcagaagtgaacctggcggcagcgcaaaagatg

SEQ ID NO: 220340 - DNA, 103 bp, Artificial Sequence
  Synthetic Polynucleotide
taatacgactcactatagggggaactgcccagttgctaaggccacttctgaacagaggagacagaagatgccttagcaaaacctggcggcagcgcaaaagatg

SEQ ID NO: 220341 - DNA, 103 bp, Artificial Sequence
  Synthetic Polynucleotide
taatacgactcactatagggtttggggccaggaactgcccagttgctaagaacagaggagacttagcatgtgggcagttaacctggcggcagcgcaaaagatg

SEQ ID NO: 220342 - DNA, 103 bp, Artificial Sequence
  Synthetic Polynucleotide
taatacgactcactatagggctggtgactgtttggggccaggaactgcccaacagaggagagggcagatgctggccccaaacctggcggcagcgcaaaagatg

SEQ ID NO: 220343 - DNA, 103 bp, Artificial Sequence
  Synthetic Polynucleotide
taatacgactcactatagggcactgctggactggtgactgtttggggccaaacagaggagatggcccatgacagtcaccaacctggcggcagcgcaaaagatg

SEQ ID NO: 220344 - DNA, 103 bp, Artificial Sequence
  Synthetic Polynucleotide
taatacgactcactatagggtgagaggccgcactgctggactggtgactgaacagaggagacagtcaatggtccagcagaacctggcggcagcgcaaaagatg

SEQ ID NO: 220345 - DNA, 103 bp, Artificial Sequence
  Synthetic Polynucleotide
taatacgactcactatagggctcggagcagtgagaggccgcactgctggaaacagaggagatccagcatggcggcctctaacctggcggcagcgcaaaagatg

SEQ ID NO: 220346 - DNA, 103 bp, Artificial Sequence
  Synthetic Polynucleotide
taatacgactcactatagggcgcctcgggactcggagcagtgagaggccgaacagaggagacggcctatgactgctccgaacctggcggcagcgcaaaagatg

SEQ ID NO: 220347 - DNA, 103 bp, Artificial Sequence
  Synthetic Polynucleotide
taatacgactcactatagggcagggggtctcgcctcgggactcggagcagaacagaggagactgctcatggtcccgaggaacctggcggcagcgcaaaagatg

SEQ ID NO: 220348 - DNA, 103 bp, Artificial Sequence
  Synthetic Polynucleotide
taatacgactcactatagggattgaacgaacagggggtctcgcctcgggaaacagaggagatcccgaatggagacccccaacctggcggcagcgcaaaagatg

SEQ ID NO: 220349 - DNA, 103 bp, Artificial Sequence
  Synthetic Polynucleotide
taatacgactcactatagggtatcaccagggacccagccagtagcttctgaacagaggagacagaagatgctggctgggaacctggcggcagcgcaaaagatg

SEQ ID NO: 220350 - DNA, 103 bp, Artificial Sequence
  Synthetic Polynucleotide
taatacgactcactatagggcatcttcatcattgaacgaacagggggtctaacagaggagaagacccatggttcgttcaaacctggcggcagcgcaaaagatg

SEQ ID NO: 220351 - DNA, 103 bp, Artificial Sequence
  Synthetic Polynucleotide
taatacgactcactatagggtcatcttcctcatcttcatcattgaacgaaaacagaggagattcgttatgtgatgaagaaacctggcggcagcgcaaaagatg

SEQ ID NO: 220352 - DNA, 103 bp, Artificial Sequence
  Synthetic Polynucleotide
taatacgactcactatagggatcctcctcatcatcttcctcatcttcatcaacagaggagagatgaaatggaggaagataacctggcggcagcgcaaaagatg

SEQ ID NO: 220353 - DNA, 103 bp, Artificial Sequence
  Synthetic Polynucleotide
taatacgactcactataggggggaggaggaatcctcctcatcatcttcctaacagaggagaaggaagatgatgaggaggaacctggcggcagcgcaaaagatg

SEQ ID NO: 220354 - DNA, 103 bp, Artificial Sequence
  Synthetic Polynucleotide
taatacgactcactataggggcccgttttctatcaccagggacccagccaaacagaggagatggctgatgccctggtgaaacctggcggcagcgcaaaagatg

SEQ ID NO: 220355 - DNA, 103 bp, Artificial Sequence
  Synthetic Polynucleotide
taatacgactcactatagggaaattttctagcccgttttctatcaccaggaacagaggagacctggtatgagaaaacggaacctggcggcagcgcaaaagatg

SEQ ID NO: 220356 - DNA, 103 bp, Artificial Sequence
  Synthetic Polynucleotide
taatacgactcactatagggcagagtctataaattttctagcccgttttcaacagaggagagaaaacatgctagaaaataacctggcggcagcgcaaaagatg

SEQ ID NO: 220357 - DNA, 103 bp, Artificial Sequence
  Synthetic Polynucleotide
taatacgactcactatagggtctgaaaaatcagagtctataaattttctaaacagaggagatagaaaatgtatagactcaacctggcggcagcgcaaaagatg

SEQ ID NO: 220358 - DNA, 103 bp, Artificial Sequence
  Synthetic Polynucleotide
taatacgactcactatagggtcgtttactttctgaaaaatcagagtctataacagaggagaatagacatggatttttcaaacctggcggcagcgcaaaagatg

SEQ ID NO: 220359 - DNA, 103 bp, Artificial Sequence
  Synthetic Polynucleotide
taatacgactcactatagggcttttttgcttcgtttactttctgaaaaataacagaggagaatttttatgaaagtaaacaacctggcggcagcgcaaaagatg

SEQ ID NO: 220360 - DNA, 103 bp, Artificial Sequence
  Synthetic Polynucleotide
taatacgactcactatagggtttttatctccttttttgcttcgtttacttaacagaggagaaagtaaatgaagcaaaaaaacctggcggcagcgcaaaagatg

SEQ ID NO: 220361 - DNA, 103 bp, Artificial Sequence
  Synthetic Polynucleotide
taatacgactcactataggggcctttcccatttttatctccttttttgctaacagaggagaagcaaaatgggagataaaaacctggcggcagcgcaaaagatg

SEQ ID NO: 220362 - DNA, 103 bp, Artificial Sequence
  Synthetic Polynucleotide
taatacgactcactatagggttcctgaactggttagtctctgtggtgtgcaacagaggagagcacacatgagagactaaaacctggcggcagcgcaaaagatg

SEQ ID NO: 220363 - DNA, 103 bp, Artificial Sequence
  Synthetic Polynucleotide
taatacgactcactatagggagtgtctcaagcctttcccatttttatctcaacagaggagagagataatgatgggaaagaacctggcggcagcgcaaaagatg

SEQ ID NO: 220364 - DNA, 103 bp, Artificial Sequence
  Synthetic Polynucleotide
taatacgactcactatagggttcattgaaaagtgtctcaagcctttcccaaacagaggagatgggaaatgcttgagacaaacctggcggcagcgcaaaagatg

SEQ ID NO: 220365 - DNA, 103 bp, Artificial Sequence
  Synthetic Polynucleotide
taatacgactcactatagggctcacacactttcattgaaaagtgtctcaaaacagaggagattgagaatgttttcaatgaacctggcggcagcgcaaaagatg

SEQ ID NO: 220366 - DNA, 103 bp, Artificial Sequence
  Synthetic Polynucleotide
taatacgactcactataggggttgaactttctcacacactttcattgaaaaacagaggagatttcaaatgaagtgtgtgaacctggcggcagcgcaaaagatg

SEQ ID NO: 220367 - DNA, 103 bp, Artificial Sequence
  Synthetic Polynucleotide
taatacgactcactataggggtaccttttcgttgaactttctcacacactaacagaggagaagtgtgatggaaagttcaaacctggcggcagcgcaaaagatg

SEQ ID NO: 220368 - DNA, 103 bp, Artificial Sequence
  Synthetic Polynucleotide
taatacgactcactataggggtacgatgttgtaccttttcgttgaactttaacagaggagaaaagttatgcgaaaaggtaacctggcggcagcgcaaaagatg

SEQ ID NO: 220369 - DNA, 103 bp, Artificial Sequence
  Synthetic Polynucleotide
taatacgactcactatagggcgacttcattgtacgatgttgtaccttttcaacagaggagagaaaagatgcaacatcgtaacctggcggcagcgcaaaagatg

SEQ ID NO: 220370 - DNA, 103 bp, Artificial Sequence
  Synthetic Polynucleotide
taatacgactcactatagggagctcatcagcgacttcattgtacgatgttaacagaggagaaacatcatgcaatgaagtaacctggcggcagcgcaaaagatg

SEQ ID NO: 220371 - DNA, 103 bp, Artificial Sequence
  Synthetic Polynucleotide
taatacgactcactatagggctctgacaccagctcatcagcgacttcattaacagaggagaaatgaaatggctgatgagaacctggcggcagcgcaaaagatg

SEQ ID NO: 220372 - DNA, 103 bp, Artificial Sequence
  Synthetic Polynucleotide
taatacgactcactatagggaattggtgaactctgacaccagctcatcagaacagaggagactgatgatgtggtgtcagaacctggcggcagcgcaaaagatg

SEQ ID NO: 220373 - DNA, 103 bp, Artificial Sequence
  Synthetic Polynucleotide
taatacgactcactatagggatcagaacacttcctgaactggttagtctcaacagaggagagagactatgcagttcaggaacctggcggcagcgcaaaagatg

SEQ ID NO: 220374 - DNA, 103 bp, Artificial Sequence
  Synthetic Polynucleotide
taatacgactcactatagggtggttatttgaattggtgaactctgacaccaacagaggagaggtgtcatggttcaccaaaacctggcggcagcgcaaaagatg

SEQ ID NO: 220375 - DNA, 103 bp, Artificial Sequence
  Synthetic Polynucleotide
taatacgactcactatagggagcagccaaatggttatttgaattggtgaaaacagaggagattcaccatgtcaaataacaacctggcggcagcgcaaaagatg

SEQ ID NO: 220376 - DNA, 103 bp, Artificial Sequence
  Synthetic Polynucleotide
taatacgactcactatagggaagccgaatcagcagccaaatggttatttgaacagaggagacaaataatgatttggctgaacctggcggcagcgcaaaagatg

SEQ ID NO: 220377 - DNA, 103 bp, Artificial Sequence
  Synthetic Polynucleotide
taatacgactcactatagggttctgatcataagccgaatcagcagccaaaaacagaggagatttggcatgtgattcggcaacctggcggcagcgcaaaagatg

SEQ ID NO: 220378 - DNA, 103 bp, Artificial Sequence
  Synthetic Polynucleotide
taatacgactcactatagggcctaatgttcttctgatcataagccgaatcaacagaggagagattcgatgtatgatcagaacctggcggcagcgcaaaagatg

SEQ ID NO: 220379 - DNA, 103 bp, Artificial Sequence
  Synthetic Polynucleotide
taatacgactcactatagggaaactcttcgcctaatgttcttctgatcataacagaggagaatgatcatgagaacattaaacctggcggcagcgcaaaagatg

SEQ ID NO: 220380 - DNA, 103 bp, Artificial Sequence
  Synthetic Polynucleotide
taatacgactcactatagggaaagcatcataaactcttcgcctaatgttcaacagaggagagaacatatggcgaagagtaacctggcggcagcgcaaaagatg

SEQ ID NO: 220381 - DNA, 103 bp, Artificial Sequence
  Synthetic Polynucleotide
taatacgactcactatagggtagcacatttaaagcatcataaactcttcgaacagaggagacgaagaatgtatgatgctaacctggcggcagcgcaaaagatg

SEQ ID NO: 220382 - DNA, 103 bp, Artificial Sequence
  Synthetic Polynucleotide
taatacgactcactatagggtcattgccattagcacatttaaagcatcataacagaggagaatgatgatgtaaatgtgcaacctggcggcagcgcaaaagatg

SEQ ID NO: 220383 - DNA, 103 bp, Artificial Sequence
  Synthetic Polynucleotide
taatacgactcactataggggaaattatgttcattgccattagcacatttaacagaggagaaaatgtatgaatggcaataacctggcggcagcgcaaaagatg

SEQ ID NO: 220384 - DNA, 103 bp, Artificial Sequence
  Synthetic Polynucleotide
taatacgactcactatagggtggactcccaatcagaacacttcctgaactaacagaggagaagttcaatgagtgttctgaacctggcggcagcgcaaaagatg

SEQ ID NO: 220385 - DNA, 103 bp, Artificial Sequence
  Synthetic Polynucleotide
taatacgactcactatagggtttttcctttgaaattatgttcattgccataacagaggagaatggcaatgaacataattaacctggcggcagcgcaaaagatg

SEQ ID NO: 220386 - DNA, 103 bp, Artificial Sequence
  Synthetic Polynucleotide
taatacgactcactatagggtgatttcttttttttcctttgaaattatgtaacagaggagaacataaatgcaaaggaaaaacctggcggcagcgcaaaagatg

SEQ ID NO: 220387 - DNA, 103 bp, Artificial Sequence
  Synthetic Polynucleotide
taatacgactcactatagggccaatccacttgatttcttttttttcctttaacagaggagaaaaggaatgaaaagaaataacctggcggcagcgcaaaagatg

SEQ ID NO: 220388 - DNA, 103 bp, Artificial Sequence
  Synthetic Polynucleotide
taatacgactcactatagggggtaggcaggccaatccacttgatttctttaacagaggagaaaagaaatgaagtggattaacctggcggcagcgcaaaagatg

SEQ ID NO: 220389 - DNA, 103 bp, Artificial Sequence
  Synthetic Polynucleotide
taatacgactcactataggggagcagaattggtaggcaggccaatccactaacagaggagaagtggaatggcctgcctaaacctggcggcagcgcaaaagatg

SEQ ID NO: 220390 - DNA, 103 bp, Artificial Sequence
  Synthetic Polynucleotide
taatacgactcactatagggtgacattcctgagcagaattggtaggcaggaacagaggagacctgccatgcaattctgcaacctggcggcagcgcaaaagatg

SEQ ID NO: 220391 - DNA, 103 bp, Artificial Sequence
  Synthetic Polynucleotide
taatacgactcactatagggctccagattctgacattcctgagcagaattaacagaggagaaattctatgcaggaatgtaacctggcggcagcgcaaaagatg

SEQ ID NO: 220392 - DNA, 103 bp, Artificial Sequence
  Synthetic Polynucleotide
taatacgactcactataggggcttctctatctccagattctgacattcctaacagaggagaaggaatatgagaatctggaacctggcggcagcgcaaaagatg

SEQ ID NO: 220393 - DNA, 103 bp, Artificial Sequence
  Synthetic Polynucleotide
taatacgactcactatagggatccgcctctgcttctctatctccagattcaacagaggagagaatctatggatagagaaaacctggcggcagcgcaaaagatg

SEQ ID NO: 220394 - DNA, 103 bp, Artificial Sequence
  Synthetic Polynucleotide
taatacgactcactatagggtatccgttctatccgcctctgcttctctataacagaggagaatagagatgcagaggcggaacctggcggcagcgcaaaagatg

SEQ ID NO: 220395 - DNA, 103 bp, Artificial Sequence
  Synthetic Polynucleotide
taatacgactcactatagggcaggggtatatggactcccaatcagaacacaacagaggagagtgttcatgttgggagtcaacctggcggcagcgcaaaagatg

SEQ ID NO: 220396 - DNA, 103 bp, Artificial Sequence
  Synthetic Polynucleotide
taatacgactcactataggggcttctgctttatccgttctatccgcctctaacagaggagaagaggcatgtagaacggaaacctggcggcagcgcaaaagatg

SEQ ID NO: 220397 - DNA, 103 bp, Artificial Sequence
  Synthetic Polynucleotide
taatacgactcactatagggagctgggcccgcttctgctttatccgttctaacagaggagaagaacgatgaaagcagaaaacctggcggcagcgcaaaagatg

SEQ ID NO: 220398 - DNA, 103 bp, Artificial Sequence
  Synthetic Polynucleotide
taatacgactcactatagggaagttcttgcagctgggcccgcttctgcttaacagaggagaaagcagatgcgggcccagaacctggcggcagcgcaaaagatg

SEQ ID NO: 220399 - DNA, 103 bp, Artificial Sequence
  Synthetic Polynucleotide
taatacgactcactataggggctgtaggagaagttcttgcagctgggcccaacagaggagagggcccatgtgcaagaacaacctggcggcagcgcaaaagatg

SEQ ID NO: 220400 - DNA, 103 bp, Artificial Sequence
  Synthetic Polynucleotide
taatacgactcactatagggaaagcgatttgctgtaggagaagttcttgcaacagaggagagcaagaatgtctcctacaaacctggcggcagcgcaaaagatg

SEQ ID NO: 220401 - DNA, 103 bp, Artificial Sequence
  Synthetic Polynucleotide
taatacgactcactatagggcaggtttttgaaagcgatttgctgtaggagaacagaggagactcctaatgcaaatcgctaacctggcggcagcgcaaaagatg

SEQ ID NO: 220402 - DNA, 103 bp, Artificial Sequence
  Synthetic Polynucleotide
taatacgactcactatagggttctctgtaccaggtttttgaaagcgatttaacagaggagaaaatcgatgtcaaaaaccaacctggcggcagcgcaaaagatg

SEQ ID NO: 220403 - DNA, 103 bp, Artificial Sequence
  Synthetic Polynucleotide
taatacgactcactatagggttttgtcgatttctctgtaccaggtttttgaacagaggagacaaaaaatgggtacagagaacctggcggcagcgcaaaagatg

SEQ ID NO: 220404 - DNA, 103 bp, Artificial Sequence
  Synthetic Polynucleotide
taatacgactcactatagggttgctgctcattttgtcgatttctctgtacaacagaggagagtacagatgaatcgacaaaacctggcggcagcgcaaaagatg

SEQ ID NO: 220405 - DNA, 103 bp, Artificial Sequence
  Synthetic Polynucleotide
taatacgactcactatagggggccctggttttgctgctcattttgtcgataacagaggagaatcgacatgatgagcagcaacctggcggcagcgcaaaagatg

SEQ ID NO: 220406 - DNA, 103 bp, Artificial Sequence
  Synthetic Polynucleotide
taatacgactcactatagggattgctggtgcaggggtatatggactcccaaacagaggagatgggagatgatataccccaacctggcggcagcgcaaaagatg

SEQ ID NO: 220407 - DNA, 103 bp, Artificial Sequence
  Synthetic Polynucleotide
taatacgactcactatagggagagccggcgggccctggttttgctgctcaaacagaggagatgagcaatgaaaccagggaacctggcggcagcgcaaaagatg

SEQ ID NO: 220408 - DNA, 103 bp, Artificial Sequence
  Synthetic Polynucleotide
taatacgactcactatagggggtagagttcagagccggcgggccctggttaacagaggagaaaccagatgccgccggctaacctggcggcagcgcaaaagatg

SEQ ID NO: 220409 - DNA, 103 bp, Artificial Sequence
  Synthetic Polynucleotide
taatacgactcactataggggcagctgaatggtagagttcagagccggcgaacagaggagacgccggatgtgaactctaaacctggcggcagcgcaaaagatg

SEQ ID NO: 220410 - DNA, 103 bp, Artificial Sequence
  Synthetic Polynucleotide
taatacgactcactatagggattatgaatggcagctgaatggtagagttcaacagaggagagaactcatgcattcagctaacctggcggcagcgcaaaagatg

SEQ ID NO: 220411 - DNA, 103 bp, Artificial Sequence
  Synthetic Polynucleotide
taatacgactcactatagggtgtattgatgattatgaatggcagctgaataacagaggagaattcagatgccattcataaacctggcggcagcgcaaaagatg

SEQ ID NO: 220412 - DNA, 103 bp, Artificial Sequence
  Synthetic Polynucleotide
taatacgactcactatagggtttttctgcttgtattgatgattatgaatgaacagaggagacattcaatgtcatcaataaacctggcggcagcgcaaaagatg

SEQ ID NO: 220413 - DNA, 103 bp, Artificial Sequence
  Synthetic Polynucleotide
taatacgactcactatagggtctatgactgtttttctgcttgtattgatgaacagaggagacatcaaatgaagcagaaaaacctggcggcagcgcaaaagatg

SEQ ID NO: 220414 - DNA, 103 bp, Artificial Sequence
  Synthetic Polynucleotide
taatacgactcactataggggatgctgcaatctatgactgtttttctgctaacagaggagaagcagaatgacagtcataaacctggcggcagcgcaaaagatg

SEQ ID NO: 220415 - DNA, 103 bp, Artificial Sequence
  Synthetic Polynucleotide
taatacgactcactatagggtgtcactggagatgctgcaatctatgactgaacagaggagacagtcaatgattgcagcaaacctggcggcagcgcaaaagatg

SEQ ID NO: 220416 - DNA, 103 bp, Artificial Sequence
  Synthetic Polynucleotide
taatacgactcactatagggtactcaaacttgtcactggagatgctgcaaaacagaggagattgcagatgctccagtgaaacctggcggcagcgcaaaagatg

SEQ ID NO: 220417 - DNA, 103 bp, Artificial Sequence
  Synthetic Polynucleotide
taatacgactcactatagggctgagtaaccattgctggtgcaggggtataaacagaggagatataccatggcaccagcaaacctggcggcagcgcaaaagatg

SEQ ID NO: 220418 - DNA, 103 bp, Artificial Sequence
  Synthetic Polynucleotide
taatacgactcactatagggattgaaaagatactcaaacttgtcactggaaacagaggagatccagtatgaagtttgagaacctggcggcagcgcaaaagatg

SEQ ID NO: 220419 - DNA, 103 bp, Artificial Sequence
  Synthetic Polynucleotide
taatacgactcactatagggtgttgtcaaaattgaaaagatactcaaactaacagaggagaagtttgatgatcttttcaaacctggcggcagcgcaaaagatg

SEQ ID NO: 220420 - DNA, 103 bp, Artificial Sequence
  Synthetic Polynucleotide
taatacgactcactatagggatctcaaaggtgttgtcaaaattgaaaagaaacagaggagatcttttatgttttgacaaaacctggcggcagcgcaaaagatg

SEQ ID NO: 220421 - DNA, 103 bp, Artificial Sequence
  Synthetic Polynucleotide
taatacgactcactataggggtcatcatggatctcaaaggtgttgtcaaaaacagaggagatttgacatgacctttgagaacctggcggcagcgcaaaagatg

SEQ ID NO: 220422 - DNA, 103 bp, Artificial Sequence
  Synthetic Polynucleotide
taatacgactcactataggggtacttctatgtcatcatggatctcaaaggaacagaggagacctttgatgtccatgatgaacctggcggcagcgcaaaagatg

SEQ ID NO: 220423 - DNA, 103 bp, Artificial Sequence
  Synthetic Polynucleotide
taatacgactcactatagggatccgctttagtacttctatgtcatcatggaacagaggagaccatgaatgcatagaagtaacctggcggcagcgcaaaagatg

SEQ ID NO: 220424 - DNA, 103 bp, Artificial Sequence
  Synthetic Polynucleotide
taatacgactcactatagggcgacattcccatccgctttagtacttctataacagaggagaatagaaatgctaaagcggaacctggcggcagcgcaaaagatg

SEQ ID NO: 220425 - DNA, 103 bp, Artificial Sequence
  Synthetic Polynucleotide
taatacgactcactatagggccaggccaaacgacattcccatccgctttaaacagaggagataaagcatgtgggaatgtaacctggcggcagcgcaaaagatg

SEQ ID NO: 220426 - DNA, 103 bp, Artificial Sequence
  Synthetic Polynucleotide
taatacgactcactatagggttgcctgactccaggccaaacgacattcccaacagaggagagggaatatggtttggcctaacctggcggcagcgcaaaagatg

SEQ ID NO: 220427 - DNA, 103 bp, Artificial Sequence
  Synthetic Polynucleotide
taatacgactcactatagggcagagagcatttgcctgactccaggccaaaaacagaggagatttggcatggagtcaggcaacctggcggcagcgcaaaagatg

SEQ ID NO: 220428 - DNA, 103 bp, Artificial Sequence
  Synthetic Polynucleotide
taatacgactcactatagggctatgtgtgtctgagtaaccattgctggtgaacagaggagacaccagatgtggttactcaacctggcggcagcgcaaaagatg

SEQ ID NO: 220429 - DNA, 103 bp, Artificial Sequence
  Synthetic Polynucleotide
taatacgactcactatagggtcagatcctccagagagcatttgcctgactaacagaggagaagtcagatgaatgctctcaacctggcggcagcgcaaaagatg

SEQ ID NO: 220430 - DNA, 103 bp, Artificial Sequence
  Synthetic Polynucleotide
taatacgactcactatagggttcgcaagtttcagatcctccagagagcataacagaggagaatgctcatgggaggatctaacctggcggcagcgcaaaagatg

SEQ ID NO: 220431 - DNA, 103 bp, Artificial Sequence
  Synthetic Polynucleotide
taatacgactcactatagggcaccagggatttcgcaagtttcagatcctcaacagaggagagaggatatgaaacttgcgaacctggcggcagcgcaaaagatg

SEQ ID NO: 220432 - DNA, 103 bp, Artificial Sequence
  Synthetic Polynucleotide
taatacgactcactatagggaagcctttggcaccagggatttcgcaagttaacagaggagaaacttgatgaatccctggaacctggcggcagcgcaaaagatg

SEQ ID NO: 220433 - DNA, 103 bp, Artificial Sequence
  Synthetic Polynucleotide
taatacgactcactatagggtaaccttctaaagcctttggcaccagggataacagaggagaatccctatggccaaaggcaacctggcggcagcgcaaaagatg

SEQ ID NO: 220434 - DNA, 103 bp, Artificial Sequence
  Synthetic Polynucleotide
taatacgactcactatagggatctgtgatataaccttctaaagcctttggaacagaggagaccaaagatgttagaaggtaacctggcggcagcgcaaaagatg

SEQ ID NO: 220435 - DNA, 103 bp, Artificial Sequence
  Synthetic Polynucleotide
taatacgactcactatagggctgtggagatatctgtgatataaccttctaaacagaggagatagaagatgatatcacagaacctggcggcagcgcaaaagatg

SEQ ID NO: 220436 - DNA, 103 bp, Artificial Sequence
  Synthetic Polynucleotide
taatacgactcactatagggcaagaaggtcctgtggagatatctgtgataaacagaggagatatcacatgtatctccacaacctggcggcagcgcaaaagatg

SEQ ID NO: 220437 - DNA, 103 bp, Artificial Sequence
  Synthetic Polynucleotide
taatacgactcactatagggctgatttaaccaagaaggtcctgtggagataacagaggagaatctccatgggaccttctaacctggcggcagcgcaaaagatg

SEQ ID NO: 220438 - DNA, 103 bp, Artificial Sequence
  Synthetic Polynucleotide
taatacgactcactataggggaagtagtccctgatttaaccaagaaggtcaacagaggagagaccttatgggttaaatcaacctggcggcagcgcaaaagatg

SEQ ID NO: 220439 - DNA, 103 bp, Artificial Sequence
  Synthetic Polynucleotide
taatacgactcactataggggtagcttctgctatgtgtgtctgagtaaccaacagaggagaggttacatggacacacataacctggcggcagcgcaaaagatg

SEQ ID NO: 220440 - DNA, 103 bp, Artificial Sequence
  Synthetic Polynucleotide
taatacgactcactataggggtagagttcagaagtagtccctgatttaacaacagaggagagttaaaatggggactactaacctggcggcagcgcaaaagatg

SEQ ID NO: 220441 - DNA, 103 bp, Artificial Sequence
  Synthetic Polynucleotide
taatacgactcactatagggaactgattgggtagagttcagaagtagtccaacagaggagaggactaatgctgaactctaacctggcggcagcgcaaaagatg

SEQ ID NO: 220442 - DNA, 103 bp, Artificial Sequence
  Synthetic Polynucleotide
taatacgactcactatagggctaaatttgaaactgattgggtagagttcaaacagaggagatgaactatgcccaatcagaacctggcggcagcgcaaaagatg

SEQ ID NO: 220443 - DNA, 103 bp, Artificial Sequence
  Synthetic Polynucleotide
taatacgactcactataggggtggtcaggtctaaatttgaaactgattggaacagaggagaccaatcatgttcaaatttaacctggcggcagcgcaaaagatg

SEQ ID NO: 220444 - DNA, 103 bp, Artificial Sequence
  Synthetic Polynucleotide
taatacgactcactatagggggtggcaccagtggtcaggtctaaatttgaaacagaggagatcaaatatggacctgaccaacctggcggcagcgcaaaagatg

SEQ ID NO: 220445 - DNA, 103 bp, Artificial Sequence
  Synthetic Polynucleotide
taatacgactcactatagggactggggtaaggtggcaccagtggtcaggtaacagaggagaacctgaatgctggtgccaaacctggcggcagcgcaaaagatg

SEQ ID NO: 220446 - DNA, 103 bp, Artificial Sequence
  Synthetic Polynucleotide
taatacgactcactatagggtttacacttgactggggtaaggtggcaccaaacagaggagatggtgcatgcttaccccaaacctggcggcagcgcaaaagatg

SEQ ID NO: 220447 - DNA, 103 bp, Artificial Sequence
  Synthetic Polynucleotide
taatacgactcactatagggtaacccttggtttacacttgactggggtaaaacagaggagattacccatgtcaagtgtaaacctggcggcagcgcaaaagatg

SEQ ID NO: 220448 - DNA, 103 bp, Artificial Sequence
  Synthetic Polynucleotide
taatacgactcactatagggcatccaagcataacccttggtttacacttgaacagaggagacaagtgatgaccaagggtaacctggcggcagcgcaaaagatg

SEQ ID NO: 220449 - DNA, 103 bp, Artificial Sequence
  Synthetic Polynucleotide
taatacgactcactataggggccacttctgcatccaagcataacccttggaacagaggagaccaaggatgatgcttggaaacctggcggcagcgcaaaagatg

SEQ ID NO: 220450 - DNA, 103 bp, Artificial Sequence
  Synthetic Polynucleotide
taatacgactcactatagggatcccgagctggttcggccgcatgagacataacagaggagaatgtctatggcggccgaaaacctggcggcagcgcaaaagatg

SEQ ID NO: 220451 - DNA, 103 bp, Artificial Sequence
  Synthetic Polynucleotide
taatacgactcactatagggcaggctgagcagctgagccgagtcggccggaacagaggagaccggccatgtcggctcagaacctggcggcagcgcaaaagatg

SEQ ID NO: 220452 - DNA, 103 bp, Artificial Sequence
  Synthetic Polynucleotide
taatacgactcactatagggggcctttgcctcggtctcagagatctcccgaacagaggagacgggagatgtctgagaccaacctggcggcagcgcaaaagatg

SEQ ID NO: 220453 - DNA, 103 bp, Artificial Sequence
  Synthetic Polynucleotide
taatacgactcactatagggccttcaaaagggcctttgcctcggtctcagaacagaggagactgagaatgaggcaaaggaacctggcggcagcgcaaaagatg

SEQ ID NO: 220454 - DNA, 103 bp, Artificial Sequence
  Synthetic Polynucleotide
taatacgactcactatagggttctgccgttccttcaaaagggcctttgccaacagaggagaggcaaaatgccttttgaaaacctggcggcagcgcaaaagatg

SEQ ID NO: 220455 - DNA, 103 bp, Artificial Sequence
  Synthetic Polynucleotide
taatacgactcactatagggattgtctttcttctgccgttccttcaaaagaacagaggagacttttgatggaacggcagaacctggcggcagcgcaaaagatg

SEQ ID NO: 220456 - DNA, 103 bp, Artificial Sequence
  Synthetic Polynucleotide
taatacgactcactatagggttaggttgtgattgtctttcttctgccgttaacagaggagaaacggcatgagaaagacaaacctggcggcagcgcaaaagatg

SEQ ID NO: 220457 - DNA, 103 bp, Artificial Sequence
  Synthetic Polynucleotide
taatacgactcactatagggcgacgctcaattaggttgtgattgtctttcaacagaggagagaaagaatgtcacaacctaacctggcggcagcgcaaaagatg

SEQ ID NO: 220458 - DNA, 103 bp, Artificial Sequence
  Synthetic Polynucleotide
taatacgactcactataggggaatcgcctgcgacgctcaattaggttgtgaacagaggagacacaacatgattgagcgtaacctggcggcagcgcaaaagatg

SEQ ID NO: 220459 - DNA, 103 bp, Artificial Sequence
  Synthetic Polynucleotide
taatacgactcactatagggcgttaatgttgaatcgcctgcgacgctcaaaacagaggagattgagcatggcaggcgataacctggcggcagcgcaaaagatg

SEQ ID NO: 220460 - DNA, 103 bp, Artificial Sequence
  Synthetic Polynucleotide
taatacgactcactatagggttgatcctgtcgttaatgttgaatcgcctgaacagaggagacaggcgatgcaacattaaaacctggcggcagcgcaaaagatg

SEQ ID NO: 220461 - DNA, 103 bp, Artificial Sequence
  Synthetic Polynucleotide
taatacgactcactataggggcccagttccttgatcctgtcgttaatgttaacagaggagaaacattatggacaggatcaacctggcggcagcgcaaaagatg

SEQ ID NO: 220462 - DNA, 103 bp, Artificial Sequence
  Synthetic Polynucleotide
taatacgactcactataggggcaaagagttcaggctgagcagctgagccgaacagaggagacggctcatgtgctcagccaacctggcggcagcgcaaaagatg

SEQ ID NO: 220463 - DNA, 103 bp, Artificial Sequence
  Synthetic Polynucleotide
taatacgactcactatagggggatgagagtgcccagttccttgatcctgtaacagaggagaacaggaatgaggaactggaacctggcggcagcgcaaaagatg

SEQ ID NO: 220464 - DNA, 103 bp, Artificial Sequence
  Synthetic Polynucleotide
taatacgactcactatagggctggacttagggatgagagtgcccagttccaacagaggagaggaactatgcactctcataacctggcggcagcgcaaaagatg

SEQ ID NO: 220465 - DNA, 103 bp, Artificial Sequence
  Synthetic Polynucleotide
taatacgactcactatagggctccgggtcactggacttagggatgagagtaacagaggagaactctcatgcctaagtccaacctggcggcagcgcaaaagatg

SEQ ID NO: 220466 - DNA, 103 bp, Artificial Sequence
  Synthetic Polynucleotide
taatacgactcactatagggtccagcgcatctccgggtcactggacttagaacagaggagactaagtatggtgacccggaacctggcggcagcgcaaaagatg

SEQ ID NO: 220467 - DNA, 103 bp, Artificial Sequence
  Synthetic Polynucleotide
taatacgactcactataggggtgcccttgttccagcgcatctccgggtcaaacagaggagatgacccatggatgcgctgaacctggcggcagcgcaaaagatg

SEQ ID NO: 220468 - DNA, 103 bp, Artificial Sequence
  Synthetic Polynucleotide
taatacgactcactatagggcttcaggatggtgcccttgttccagcgcataacagaggagaatgcgcatgaacaagggcaacctggcggcagcgcaaaagatg

SEQ ID NO: 220469 - DNA, 103 bp, Artificial Sequence
  Synthetic Polynucleotide
taatacgactcactatagggccacagaggccttcaggatggtgcccttgtaacagaggagaacaaggatgccatcctgaaacctggcggcagcgcaaaagatg

SEQ ID NO: 220470 - DNA, 103 bp, Artificial Sequence
  Synthetic Polynucleotide
taatacgactcactatagggcggatataatccacagaggccttcaggatgaacagaggagacatcctatgggcctctgtaacctggcggcagcgcaaaagatg

SEQ ID NO: 220471 - DNA, 103 bp, Artificial Sequence
  Synthetic Polynucleotide
taatacgactcactatagggctgcagcttgcggatataatccacagaggcaacagaggagagcctctatggattatatcaacctggcggcagcgcaaaagatg

SEQ ID NO: 220472 - DNA, 103 bp, Artificial Sequence
  Synthetic Polynucleotide
taatacgactcactataggggctgctccttctgcagcttgcggatataataacagaggagaattataatggcaagctgcaacctggcggcagcgcaaaagatg

SEQ ID NO: 220473 - DNA, 103 bp, Artificial Sequence
  Synthetic Polynucleotide
taatacgactcactataggggattccggaagcaaagagttcaggctgagcaacagaggagagctcagatggaactctttaacctggcggcagcgcaaaagatg

SEQ ID NO: 220474 - DNA, 103 bp, Artificial Sequence
  Synthetic Polynucleotide
taatacgactcactatagggttggagcgctgctgctccttctgcagcttgaacagaggagacaagctatggaaggagcaaacctggcggcagcgcaaaagatg

SEQ ID NO: 220475 - DNA, 103 bp, Artificial Sequence
  Synthetic Polynucleotide
taatacgactcactatagggctccaggtctttggagcgctgctgctccttaacagaggagaaaggagatgcagcgctccaacctggcggcagcgcaaaagatg

SEQ ID NO: 220476 - DNA, 103 bp, Artificial Sequence
  Synthetic Polynucleotide
taatacgactcactataggggctgccggctctccaggtctttggagcgctaacagaggagaagcgctatgaagacctggaacctggcggcagcgcaaaagatg

SEQ ID NO: 220477 - DNA, 103 bp, Artificial Sequence
  Synthetic Polynucleotide
taatacgactcactatagggtccagggatcgctgccggctctccaggtctaacagaggagaagacctatggagccggcaaacctggcggcagcgcaaaagatg

SEQ ID NO: 220478 - DNA, 103 bp, Artificial Sequence
  Synthetic Polynucleotide
taatacgactcactataggggttggcctgctccagggatcgctgccggctaacagaggagaagccggatgcgatccctgaacctggcggcagcgcaaaagatg

SEQ ID NO: 220479 - DNA, 103 bp, Artificial Sequence
  Synthetic Polynucleotide
taatacgactcactataggggcaggctgcggttggcctgctccagggatcaacagaggagagatcccatgagcaggccaaacctggcggcagcgcaaaagatg

SEQ ID NO: 220480 - DNA, 103 bp, Artificial Sequence
  Synthetic Polynucleotide
taatacgactcactatagggattcggagctgcaggctgcggttggcctgcaacagaggagagcaggcatgccgcagcctaacctggcggcagcgcaaaagatg

SEQ ID NO: 220481 - DNA, 103 bp, Artificial Sequence
  Synthetic Polynucleotide
taatacgactcactatagggtagttcctgaattcggagctgcaggctgcgaacagaggagacgcagcatgcagctccgaaacctggcggcagcgcaaaagatg

SEQ ID NO: 220482 - DNA, 103 bp, Artificial Sequence
  Synthetic Polynucleotide
taatacgactcactatagggcctgcagttctagttcctgaattcggagctaacagaggagaagctccatgttcaggaacaacctggcggcagcgcaaaagatg

SEQ ID NO: 220483 - DNA, 103 bp, Artificial Sequence
  Synthetic Polynucleotide
taatacgactcactatagggtggatctgggcctgcagttctagttcctgaaacagaggagatcaggaatgagaactgcaaacctggcggcagcgcaaaagatg

SEQ ID NO: 220484 - DNA, 103 bp, Artificial Sequence
  Synthetic Polynucleotide
taatacgactcactatagggaacaatcccggattccggaagcaaagagttaacagaggagaaactctatgcttccggaaaacctggcggcagcgcaaaagatg

SEQ ID NO: 220485 - DNA, 103 bp, Artificial Sequence
  Synthetic Polynucleotide
taatacgactcactatagggtggcaggccatggatctgggcctgcagttcaacagaggagagaactgatggcccagatcaacctggcggcagcgcaaaagatg

SEQ ID NO: 220486 - DNA, 103 bp, Artificial Sequence
  Synthetic Polynucleotide
taatacgactcactatagggtgggaggtactggcaggccatggatctgggaacagaggagacccagaatgatggcctgcaacctggcggcagcgcaaaagatg

SEQ ID NO: 220487 - DNA, 103 bp, Artificial Sequence
  Synthetic Polynucleotide
taatacgactcactatagggagccctggagtgggaggtactggcaggccaaacagaggagatggcctatgagtacctccaacctggcggcagcgcaaaagatg

SEQ ID NO: 220488 - DNA, 103 bp, Artificial Sequence
  Synthetic Polynucleotide
taatacgactcactatagggcaaggaaagcagccctggagtgggaggtacaacagaggagagtacctatgactccagggaacctggcggcagcgcaaaagatg

SEQ ID NO: 220489 - DNA, 103 bp, Artificial Sequence
  Synthetic Polynucleotide
taatacgactcactatagggaagtcgtggccaaggaaagcagccctggagaacagaggagactccagatgtgctttcctaacctggcggcagcgcaaaagatg

SEQ ID NO: 220490 - DNA, 103 bp, Artificial Sequence
  Synthetic Polynucleotide
taatacgactcactatagggtcagaagccgaagtcgtggccaaggaaagcaacagaggagagctttcatgggccacgacaacctggcggcagcgcaaaagatg

SEQ ID NO: 220491 - DNA, 103 bp, Artificial Sequence
  Synthetic Polynucleotide
taatacgactcactatagggcttgaggctgtcagaagccgaagtcgtggcaacagaggagagccacgatgtcggcttctaacctggcggcagcgcaaaagatg

SEQ ID NO: 220492 - DNA, 103 bp, Artificial Sequence
  Synthetic Polynucleotide
taatacgactcactataggggctgctctggcttgaggctgtcagaagccgaacagaggagacggcttatgacagcctcaaacctggcggcagcgcaaaagatg

SEQ ID NO: 220493 - DNA, 103 bp, Artificial Sequence
  Synthetic Polynucleotide
taatacgactcactatagggtcaatgtccagctgctctggcttgaggctgaacagaggagacagcctatggccagagcaaacctggcggcagcgcaaaagatg

SEQ ID NO: 220494 - DNA, 103 bp, Artificial Sequence
  Synthetic Polynucleotide
taatacgactcactataggggccctcctcctcaatgtccagctgctctggaacagaggagaccagagatgctggacattaacctggcggcagcgcaaaagatg

SEQ ID NO: 220495 - DNA, 103 bp, Artificial Sequence
  Synthetic Polynucleotide
taatacgactcactatagggctatgtcagcaacaatcccggattccggaaaacagaggagattccggatgccgggattgaacctggcggcagcgcaaaagatg

SEQ ID NO: 220496 - DNA, 103 bp, Artificial Sequence
  Synthetic Polynucleotide
taatacgactcactatagggcgcctggcctgccctcctcctcaatgtccaaacagaggagatggacaatgaggaggaggaacctggcggcagcgcaaaagatg

SEQ ID NO: 220497 - DNA, 103 bp, Artificial Sequence
  Synthetic Polynucleotide
taatacgactcactatagggaacgttgctgcgcctggcctgccctcctccaacagaggagaggaggaatgcaggccaggaacctggcggcagcgcaaaagatg

SEQ ID NO: 220498 - DNA, 103 bp, Artificial Sequence
  Synthetic Polynucleotide
taatacgactcactatagggccctacatggaacgttgctgcgcctggcctaacagaggagaaggccaatggcagcaacgaacctggcggcagcgcaaaagatg

SEQ ID NO: 220499 - DNA, 103 bp, Artificial Sequence
  Synthetic Polynucleotide
taatacgactcactatagggcaggtcccccccctacatggaacgttgctgaacagaggagacagcaaatgtccatgtagaacctggcggcagcgcaaaagatg

SEQ ID NO: 220500 - DNA, 103 bp, Artificial Sequence
  Synthetic Polynucleotide
taatacgactcactataggggcattctgggcaggtcccccccctacatggaacagaggagaccatgtatgggggggaccaacctggcggcagcgcaaaagatg

SEQ ID NO: 220501 - DNA, 103 bp, Artificial Sequence
  Synthetic Polynucleotide
taatacgactcactatagggctgatggggagcattctgggcaggtcccccaacagaggagagggggaatggcccagaataacctggcggcagcgcaaaagatg

SEQ ID NO: 220502 - DNA, 103 bp, Artificial Sequence
  Synthetic Polynucleotide
taatacgactcactatagggcagggggctgctgatggggagcattctgggaacagaggagacccagaatgctccccatcaacctggcggcagcgcaaaagatg

SEQ ID NO: 220503 - DNA, 103 bp, Artificial Sequence
  Synthetic Polynucleotide
taatacgactcactataggggagggcggtgcagggggctgctgatggggaaacagaggagatccccaatggcagcccccaacctggcggcagcgcaaaagatg

SEQ ID NO: 220504 - DNA, 103 bp, Artificial Sequence
  Synthetic Polynucleotide
taatacgactcactatagggaagggcatctgagggcggtgcagggggctgaacagaggagacagcccatggcaccgcccaacctggcggcagcgcaaaagatg

SEQ ID NO: 220505 - DNA, 103 bp, Artificial Sequence
  Synthetic Polynucleotide
taatacgactcactataggggcaggtccagaagggcatctgagggcggtgaacagaggagacaccgcatgcagatgcccaacctggcggcagcgcaaaagatg

SEQ ID NO: 220506 - DNA, 103 bp, Artificial Sequence
  Synthetic Polynucleotide
taatacgactcactatagggttttctaattctatgtcagcaacaatcccgaacagaggagacgggatatgtgctgacataacctggcggcagcgcaaaagatg

SEQ ID NO: 220507 - DNA, 103 bp, Artificial Sequence
  Synthetic Polynucleotide
taatacgactcactatagggctgggaaagtgcaggtccagaagggcatctaacagaggagaagatgcatgtctggacctaacctggcggcagcgcaaaagatg

SEQ ID NO: 220508 - DNA, 103 bp, Artificial Sequence
  Synthetic Polynucleotide
taatacgactcactatagggcaggtggtcgctgggaaagtgcaggtccagaacagaggagactggacatgcactttcccaacctggcggcagcgcaaaagatg

SEQ ID NO: 220509 - DNA, 103 bp, Artificial Sequence
  Synthetic Polynucleotide
taatacgactcactatagggccaggtcccccaggtggtcgctgggaaagtaacagaggagaactttcatggcgaccaccaacctggcggcagcgcaaaagatg

SEQ ID NO: 220510 - DNA, 103 bp, Artificial Sequence
  Synthetic Polynucleotide
taatacgactcactatagggaaggggtctcccaggtcccccaggtggtcgaacagaggagacgaccaatggggggacctaacctggcggcagcgcaaaagatg

SEQ ID NO: 220511 - DNA, 103 bp, Artificial Sequence
  Synthetic Polynucleotide
taatacgactcactatagggccccaggtggaaggggtctcccaggtccccaacagaggagaggggacatgggagaccccaacctggcggcagcgcaaaagatg

SEQ ID NO: 220512 - DNA, 103 bp, Artificial Sequence
  Synthetic Polynucleotide
taatacgactcactatagggtgtcctccagccccaggtggaaggggtctcaacagaggagagagaccatgtccacctggaacctggcggcagcgcaaaagatg

SEQ ID NO: 220513 - DNA, 103 bp, Artificial Sequence
  Synthetic Polynucleotide
taatacgactcactatagggtccatcagaatgtcctccagccccaggtggaacagaggagaccacctatggctggaggaaacctggcggcagcgcaaaagatg

SEQ ID NO: 220514 - DNA, 103 bp, Artificial Sequence
  Synthetic Polynucleotide
taatacgactcactatagggctcctcctcctccatcagaatgtcctccagaacagaggagactggagatgattctgatgaacctggcggcagcgcaaaagatg

SEQ ID NO: 220515 - DNA, 103 bp, Artificial Sequence
  Synthetic Polynucleotide
taatacgactcactatagggccaccaccccctcctcctcctccatcagaaaacagaggagattctgaatgaggaggaggaacctggcggcagcgcaaaagatg

SEQ ID NO: 220516 - DNA, 103 bp, Artificial Sequence
  Synthetic Polynucleotide
taatacgactcactataggggacagtcctcccaccaccccctcctcctccaacagaggagaggaggaatggggggtggtaacctggcggcagcgcaaaagatg

SEQ ID NO: 220517 - DNA, 103 bp, Artificial Sequence
  Synthetic Polynucleotide
taatacgactcactatagggatcaaggacgttttctaattctatgtcagcaacagaggagagctgacatggaattagaaaacctggcggcagcgcaaaagatg

SEQ ID NO: 220518 - DNA, 103 bp, Artificial Sequence
  Synthetic Polynucleotide
taatacgactcactatagggggcaccccccgacagtcctcccaccaccccaacagaggagaggggtgatgggaggactgaacctggcggcagcgcaaaagatg

SEQ ID NO: 220519 - DNA, 103 bp, Artificial Sequence
  Synthetic Polynucleotide
taatacgactcactataggggtggggacagggcaccccccgacagtcctcaacagaggagagaggacatgcggggggtgaacctggcggcagcgcaaaagatg

SEQ ID NO: 220520 - DNA, 103 bp, Artificial Sequence
  Synthetic Polynucleotide
taatacgactcactataggggcagcccgcagtggggacagggcaccccccaacagaggagaggggggatgcctgtccccaacctggcggcagcgcaaaagatg

SEQ ID NO: 220521 - DNA, 103 bp, Artificial Sequence
  Synthetic Polynucleotide
taatacgactcactataggggggatcggaggcagcccgcagtggggacagaacagaggagactgtccatgctgcgggctaacctggcggcagcgcaaaagatg

SEQ ID NO: 220522 - DNA, 103 bp, Artificial Sequence
  Synthetic Polynucleotide
taatacgactcactatagggaagagagcaggggatcggaggcagcccgcaaacagaggagatgcgggatgcctccgatcaacctggcggcagcgcaaaagatg

SEQ ID NO: 220523 - DNA, 103 bp, Artificial Sequence
  Synthetic Polynucleotide
taatacgactcactatagggggggacactgaagagagcaggggatcggagaacagaggagactccgaatgcctgctctcaacctggcggcagcgcaaaagatg

SEQ ID NO: 220524 - DNA, 103 bp, Artificial Sequence
  Synthetic Polynucleotide
taatacgactcactatagggggagacagcaggggacactgaagagagcagaacagaggagactgctcatgtcagtgtccaacctggcggcagcgcaaaagatg

SEQ ID NO: 220525 - DNA, 103 bp, Artificial Sequence
  Synthetic Polynucleotide
taatacgactcactatagggtgctggccttggagacagcaggggacactgaacagaggagacagtgtatgctgctgtctaacctggcggcagcgcaaaagatg

SEQ ID NO: 220526 - DNA, 103 bp, Artificial Sequence
  Synthetic Polynucleotide
taatacgactcactatagggctgcggcggctgctggccttggagacagcaaacagaggagatgctgtatgcaaggccagaacctggcggcagcgcaaaagatg

SEQ ID NO: 220527 - DNA, 103 bp, Artificial Sequence
  Synthetic Polynucleotide
taatacgactcactataggggctgaagctgctgcggcggctgctggccttaacagaggagaaaggccatgagccgccgcaacctggcggcagcgcaaaagatg

SEQ ID NO: 220528 - DNA, 103 bp, Artificial Sequence
  Synthetic Polynucleotide
taatacgactcactatagggagctgtcaggatcaaggacgttttctaattaacagaggagaaattagatgacgtccttgaacctggcggcagcgcaaaagatg

SEQ ID NO: 220529 - DNA, 103 bp, Artificial Sequence
  Synthetic Polynucleotide
taatacgactcactatagggcctcttccatgctgaagctgctgcggcggcaacagaggagagccgccatggcagcttcaaacctggcggcagcgcaaaagatg

SEQ ID NO: 220530 - DNA, 103 bp, Artificial Sequence
  Synthetic Polynucleotide
taatacgactcactatagggagctcgtagaagctgtcaggatcaaggacgaacagaggagacgtcctatgtcctgacagaacctggcggcagcgcaaaagatg

SEQ ID NO: 220531 - DNA, 103 bp, Artificial Sequence
  Synthetic Polynucleotide
taatacgactcactatagggttggcttttgagctcgtagaagctgtcaggaacagaggagacctgacatgttctacgagaacctggcggcagcgcaaaagatg

SEQ ID NO: 220532 - DNA, 103 bp, Artificial Sequence
  Synthetic Polynucleotide
taatacgactcactatagggcctctacgccatcccgagctggttcggccgaacagaggagacggccgatgcagctcgggaacctggcggcagcgcaaaagatg

SEQ ID NO: 220533 - DNA, 103 bp, Artificial Sequence
  Synthetic Polynucleotide
taatacgactcactatagggggggtaagggttggcttttgagctcgtagaaacagaggagatctacgatgtcaaaagccaacctggcggcagcgcaaaagatg

SEQ ID NO: 220534 - DNA, 103 bp, Artificial Sequence
  Synthetic Polynucleotide
taatacgactcactatagggcttgagcgaaggggtaagggttggcttttgaacagaggagacaaaagatgacccttaccaacctggcggcagcgcaaaagatg

SEQ ID NO: 220535 - DNA, 103 bp, Artificial Sequence
  Synthetic Polynucleotide
taatacgactcactatagggtattgggaggcttgagcgaaggggtaagggaacagaggagacccttaatgcttcgctcaaacctggcggcagcgcaaaagatg

SEQ ID NO: 220536 - DNA, 103 bp, Artificial Sequence
  Synthetic Polynucleotide
taatacgactcactatagggcctgcagtgatattgggaggcttgagcgaaaacagaggagattcgctatggcctcccaaaacctggcggcagcgcaaaagatg

SEQ ID NO: 220537 - DNA, 103 bp, Artificial Sequence
  Synthetic Polynucleotide
taatacgactcactataggggctggtgtggcctgcagtgatattgggaggaacagaggagacctcccatgatcactgcaaacctggcggcagcgcaaaagatg

SEQ ID NO: 220538 - DNA, 103 bp, Artificial Sequence
  Synthetic Polynucleotide
taatacgactcactatagggagctggggtggctggtgtggcctgcagtgaaacagaggagatcactgatggccacaccaaacctggcggcagcgcaaaagatg

SEQ ID NO: 220539 - DNA, 103 bp, Artificial Sequence
  Synthetic Polynucleotide
taatacgactcactatagggcagagagtgtagctggggtggctggtgtggaacagaggagaccacacatgccaccccagaacctggcggcagcgcaaaagatg

SEQ ID NO: 220540 - DNA, 103 bp, Artificial Sequence
  Synthetic Polynucleotide
taatacgactcactataggggaagacgatgcagagagtgtagctggggtgaacagaggagacaccccatgtacactctcaacctggcggcagcgcaaaagatg

SEQ ID NO: 220541 - DNA, 103 bp, Artificial Sequence
  Synthetic Polynucleotide
taatacgactcactataggggccccctgcagaagacgatgcagagagtgtaacagaggagaacactcatggcatcgtctaacctggcggcagcgcaaaagatg

SEQ ID NO: 220542 - DNA, 103 bp, Artificial Sequence
  Synthetic Polynucleotide
taatacgactcactataggggggtcctggagccccctgcagaagacgatgaacagaggagacatcgtatgctgcaggggaacctggcggcagcgcaaaagatg

SEQ ID NO: 220543 - DNA, 103 bp, Artificial Sequence
  Synthetic Polynucleotide
taatacgactcactatagggtccgcgctggcctctacgccatcccgagctaacagaggagaagctcgatgtggcgtagaaacctggcggcagcgcaaaagatg

SEQ ID NO: 220544 - DNA, 103 bp, Artificial Sequence
  Synthetic Polynucleotide
taatacgactcactataggggacatggcaggggtcctggagccccctgcaaacagaggagatgcaggatgctccaggacaacctggcggcagcgcaaaagatg

SEQ ID NO: 220545 - DNA, 103 bp, Artificial Sequence
  Synthetic Polynucleotide
taatacgactcactatagggagaagatgacgacatggcaggggtcctggaaacagaggagatccaggatgcctgccatgaacctggcggcagcgcaaaagatg

SEQ ID NO: 220546 - DNA, 103 bp, Artificial Sequence
  Synthetic Polynucleotide
taatacgactcactatagggccctcgatgaagaagatgacgacatggcagaacagaggagactgccaatgcgtcatcttaacctggcggcagcgcaaaagatg

SEQ ID NO: 220547 - DNA, 103 bp, Artificial Sequence
  Synthetic Polynucleotide
taatacgactcactatagggcgcagcaagaccctcgatgaagaagatgacaacagaggagagtcatcatgttcatcgagaacctggcggcagcgcaaaagatg

SEQ ID NO: 220548 - DNA, 103 bp, Artificial Sequence
  Synthetic Polynucleotide
taatacgactcactatagggtagctgctgccgcagcaagaccctcgatgaaacagaggagatcatcgatggtcttgctgaacctggcggcagcgcaaaagatg

SEQ ID NO: 220549 - DNA, 103 bp, Artificial Sequence
  Synthetic Polynucleotide
taatacgactcactataggggggcccgcattagctgctgccgcagcaagaaacagaggagatcttgcatgggcagcagcaacctggcggcagcgcaaaagatg

SEQ ID NO: 220550 - DNA, 103 bp, Artificial Sequence
  Synthetic Polynucleotide
taatacgactcactatagggtcctgcgcctgggcccgcattagctgctgcaacagaggagagcagcaatgaatgcgggcaacctggcggcagcgcaaaagatg

SEQ ID NO: 220551 - DNA, 103 bp, Artificial Sequence
  Synthetic Polynucleotide
taatacgactcactatagggcctctcctgctcctgcgcctgggcccgcataacagaggagaatgcggatgcaggcgcagaacctggcggcagcgcaaaagatg

SEQ ID NO: 220552 - DNA, 103 bp, Artificial Sequence
  Synthetic Polynucleotide
taatacgactcactataggggacgctcacgcctctcctgctcctgcgcctaacagaggagaaggcgcatgagcaggagaaacctggcggcagcgcaaaagatg

SEQ ID NO: 220553 - DNA, 103 bp, Artificial Sequence
  Synthetic Polynucleotide
taatacgactcactataggggcctgttcccgacgctcacgcctctcctgcaacagaggagagcaggaatggcgtgagcgaacctggcggcagcgcaaaagatg

SEQ ID NO: 220554 - DNA, 103 bp, Artificial Sequence
  Synthetic Polynucleotide
taatacgactcactatagggtcgagggccctccgcgctggcctctacgccaacagaggagaggcgtaatggccagcgcgaacctggcggcagcgcaaaagatg

SEQ ID NO: 220555 - DNA, 103 bp, Artificial Sequence
  Synthetic Polynucleotide
taatacgactcactatagggagccgcggcggcctgttcccgacgctcacgaacagaggagacgtgagatgcgggaacagaacctggcggcagcgcaaaagatg

SEQ ID NO: 220556 - DNA, 103 bp, Artificial Sequence
  Synthetic Polynucleotide
taatacgactcactatagggtggggaagggagccgcggcggcctgttcccaacagaggagagggaacatgccgccgcggaacctggcggcagcgcaaaagatg

SEQ ID NO: 220557 - DNA, 103 bp, Artificial Sequence
  Synthetic Polynucleotide
taatacgactcactatagggggtgcaggactggggaagggagccgcggcgaacagaggagacgccgcatgtcccttcccaacctggcggcagcgcaaaagatg

SEQ ID NO: 220558 - DNA, 103 bp, Artificial Sequence
  Synthetic Polynucleotide
taatacgactcactatagggaggagaggcaggtgcaggactggggaagggaacagaggagacccttcatgagtcctgcaaacctggcggcagcgcaaaagatg

SEQ ID NO: 220559 - DNA, 103 bp, Artificial Sequence
  Synthetic Polynucleotide
taatacgactcactatagggcagagatggcaggagaggcaggtgcaggacaacagaggagagtcctgatgctgcctctcaacctggcggcagcgcaaaagatg

SEQ ID NO: 220560 - DNA, 103 bp, Artificial Sequence
  Synthetic Polynucleotide
taatacgactcactatagggacgccaaccacagagatggcaggagaggcaaacagaggagatgcctcatgtgccatctcaacctggcggcagcgcaaaagatg

SEQ ID NO: 220561 - DNA, 103 bp, Artificial Sequence
  Synthetic Polynucleotide
taatacgactcactatagggcccagcagagacgccaaccacagagatggcaacagaggagagccatcatggtggttggcaacctggcggcagcgcaaaagatg

SEQ ID NO: 220562 - DNA, 103 bp, Artificial Sequence
  Synthetic Polynucleotide
taatacgactcactatagggatgtgtggcccccagcagagacgccaaccaaacagaggagatggttgatgtctctgctgaacctggcggcagcgcaaaagatg

SEQ ID NO: 220563 - DNA, 103 bp, Artificial Sequence
  Synthetic Polynucleotide
taatacgactcactatagggggacggctcaatgtgtggcccccagcagagaacagaggagactctgcatggggccacacaacctggcggcagcgcaaaagatg

SEQ ID NO: 220564 - DNA, 103 bp, Artificial Sequence
  Synthetic Polynucleotide
taatacgactcactatagggagcagggggtggacggctcaatgtgtggccaacagaggagaggccacatgttgagccgtaacctggcggcagcgcaaaagatg

SEQ ID NO: 220565 - DNA, 103 bp, Artificial Sequence
  Synthetic Polynucleotide
taatacgactcactatagggcgaacacggctcgagggccctccgcgctggaacagaggagaccagcgatgagggccctcaacctggcggcagcgcaaaagatg

SEQ ID NO: 220566 - DNA, 103 bp, Artificial Sequence
  Synthetic Polynucleotide
taatacgactcactatagggtgggcacctgagcagggggtggacggctcaaacagaggagatgagccatgcaccccctgaacctggcggcagcgcaaaagatg

SEQ ID NO: 220567 - DNA, 103 bp, Artificial Sequence
  Synthetic Polynucleotide
taatacgactcactatagggagcacctccctgggcacctgagcagggggtaacagaggagaacccccatgtcaggtgccaacctggcggcagcgcaaaagatg

SEQ ID NO: 220568 - DNA, 103 bp, Artificial Sequence
  Synthetic Polynucleotide
taatacgactcactatagggctgcaccttgagcacctccctgggcacctgaacagaggagacaggtgatgagggaggtgaacctggcggcagcgcaaaagatg

SEQ ID NO: 220569 - DNA, 103 bp, Artificial Sequence
  Synthetic Polynucleotide
taatacgactcactatagggccagatgggtctgcaccttgagcacctcccaacagaggagagggaggatgtcaaggtgcaacctggcggcagcgcaaaagatg

SEQ ID NO: 220570 - DNA, 103 bp, Artificial Sequence
  Synthetic Polynucleotide
taatacgactcactataggggttgggttctccagatgggtctgcaccttgaacagaggagacaaggtatggacccatctaacctggcggcagcgcaaaagatg

SEQ ID NO: 220571 - DNA, 103 bp, Artificial Sequence
  Synthetic Polynucleotide
taatacgactcactataggggtggtagcgcgttgggttctccagatgggtaacagaggagaacccatatggagaacccaaacctggcggcagcgcaaaagatg

SEQ ID NO: 220572 - DNA, 103 bp, Artificial Sequence
  Synthetic Polynucleotide
taatacgactcactatagggcctgctgcaggtggtagcgcgttgggttctaacagaggagaagaaccatgcgcgctaccaacctggcggcagcgcaaaagatg

SEQ ID NO: 220573 - DNA, 103 bp, Artificial Sequence
  Synthetic Polynucleotide
taatacgactcactatagggtgccggcgcgcctgctgcaggtggtagcgcaacagaggagagcgctaatgcctgcagcaaacctggcggcagcgcaaaagatg

SEQ ID NO: 220574 - DNA, 103 bp, Artificial Sequence
  Synthetic Polynucleotide
taatacgactcactatagggtttcacctgctgccggcgcgcctgctgcagaacagaggagactgcagatggcgcgccggaacctggcggcagcgcaaaagatg

SEQ ID NO: 220575 - DNA, 103 bp, Artificial Sequence
  Synthetic Polynucleotide
taatacgactcactatagggacaggtactgtttcacctgctgccggcgcgaacagaggagacgcgccatgagcaggtgaaacctggcggcagcgcaaaagatg

SEQ ID NO: 220576 - DNA, 103 bp, Artificial Sequence
  Synthetic Polynucleotide
taatacgactcactatagggtccaacagcacgaacacggctcgagggcccaacagaggagagggcccatgagccgtgttaacctggcggcagcgcaaaagatg

SEQ ID NO: 220577 - DNA, 103 bp, Artificial Sequence
  Synthetic Polynucleotide
taatacgactcactatagggagtgtggtggacaggtactgtttcacctgcaacagaggagagcaggtatgacagtacctaacctggcggcagcgcaaaagatg

SEQ ID NO: 220578 - DNA, 103 bp, Artificial Sequence
  Synthetic Polynucleotide
taatacgactcactatagggcttgggcccgagtgtggtggacaggtactgaacagaggagacagtacatgtccaccacaaacctggcggcagcgcaaaagatg

SEQ ID NO: 220579 - DNA, 103 bp, Artificial Sequence
  Synthetic Polynucleotide
taatacgactcactataggggggaagccagcttgggcccgagtgtggtggaacagaggagaccaccaatgtcgggcccaaacctggcggcagcgcaaaagatg

SEQ ID NO: 220580 - DNA, 103 bp, Artificial Sequence
  Synthetic Polynucleotide
taatacgactcactataggggtgagggcctgggaagccagcttgggcccgaacagaggagacgggccatggctggcttcaacctggcggcagcgcaaaagatg

SEQ ID NO: 220581 - DNA, 103 bp, Artificial Sequence
  Synthetic Polynucleotide
taatacgactcactatagggcggcggtggggtgagggcctgggaagccagaacagaggagactggctatgcaggccctcaacctggcggcagcgcaaaagatg

SEQ ID NO: 220582 - DNA, 103 bp, Artificial Sequence
  Synthetic Polynucleotide
taatacgactcactatagggttgcgggccccggcggtggggtgagggcctaacagaggagaaggcccatgccccaccgcaacctggcggcagcgcaaaagatg

SEQ ID NO: 220583 - DNA, 103 bp, Artificial Sequence
  Synthetic Polynucleotide
taatacgactcactatagggggctgggcacttgcgggccccggcggtgggaacagaggagacccaccatgggggcccgcaacctggcggcagcgcaaaagatg

SEQ ID NO: 220584 - DNA, 103 bp, Artificial Sequence
  Synthetic Polynucleotide
taatacgactcactatagggggcaggcagtggctgggcacttgcgggcccaacagaggagagggcccatgagtgcccagaacctggcggcagcgcaaaagatg

SEQ ID NO: 220585 - DNA, 103 bp, Artificial Sequence
  Synthetic Polynucleotide
taatacgactcactatagggcagcctcaggggcaggcagtggctgggcacaacagaggagagtgcccatgcactgcctgaacctggcggcagcgcaaaagatg

SEQ ID NO: 220586 - DNA, 103 bp, Artificial Sequence
  Synthetic Polynucleotide
taatacgactcactataggggtagtgtgggcagcctcaggggcaggcagtaacagaggagaactgccatgccctgaggcaacctggcggcagcgcaaaagatg

SEQ ID NO: 220587 - DNA, 103 bp, Artificial Sequence
  Synthetic Polynucleotide
taatacgactcactatagggcctgcgctcctccaacagcacgaacacggcaacagaggagagccgtgatggtgctgttgaacctggcggcagcgcaaaagatg

SEQ ID NO: 220588 - DNA, 103 bp, Artificial Sequence
  Synthetic Polynucleotide
taatacgactcactatagggtgtggggccggtagtgtgggcagcctcaggaacagaggagacctgagatggcccacactaacctggcggcagcgcaaaagatg

SEQ ID NO: 220589 - DNA, 103 bp, Artificial Sequence
  Synthetic Polynucleotide
taatacgactcactataggggcgcactgcctgtggggccggtagtgtgggaacagaggagacccacaatgccggccccaaacctggcggcagcgcaaaagatg

SEQ ID NO: 220590 - DNA, 103 bp, Artificial Sequence
  Synthetic Polynucleotide
taatacgactcactataggggggctgttgggcgcactgcctgtggggccgaacagaggagacggcccatgaggcagtgcaacctggcggcagcgcaaaagatg

SEQ ID NO: 220591 - DNA, 103 bp, Artificial Sequence
  Synthetic Polynucleotide
taatacgactcactatagggcagcgccatggggctgttgggcgcactgccaacagaggagaggcagtatgcccaacagcaacctggcggcagcgcaaaagatg

SEQ ID NO: 220592 - DNA, 103 bp, Artificial Sequence
  Synthetic Polynucleotide
taatacgactcactatagggcgatggtgagcagcgccatggggctgttggaacagaggagaccaacaatgccatggcgcaacctggcggcagcgcaaaagatg

SEQ ID NO: 220593 - DNA, 103 bp, Artificial Sequence
  Synthetic Polynucleotide
taatacgactcactataggggagctggacccgatggtgagcagcgccatgaacagaggagacatggcatggctcaccataacctggcggcagcgcaaaagatg

SEQ ID NO: 220594 - DNA, 103 bp, Artificial Sequence
  Synthetic Polynucleotide
taatacgactcactatagggctccttctctgagctggacccgatggtgagaacagaggagactcaccatggggtccagcaacctggcggcagcgcaaaagatg

SEQ ID NO: 220595 - DNA, 103 bp, Artificial Sequence
  Synthetic Polynucleotide
taatacgactcactatagggcatcatcaatctccttctctgagctggaccaacagaggagaggtccaatgcagagaaggaacctggcggcagcgcaaaagatg

SEQ ID NO: 220596 - DNA, 103 bp, Artificial Sequence
  Synthetic Polynucleotide
taatacgactcactatagggtcatcaatgacatcatcaatctccttctctaacagaggagaagagaaatggattgatgaaacctggcggcagcgcaaaagatg

SEQ ID NO: 220597 - DNA, 103 bp, Artificial Sequence
  Synthetic Polynucleotide
taatacgactcactataggggctgatgatctcatcaatgacatcatcaataacagaggagaattgatatggtcattgataacctggcggcagcgcaaaagatg

SEQ ID NO: 220598 - DNA, 103 bp, Artificial Sequence
  Synthetic Polynucleotide
taatacgactcactatagggagtcggccggcctgcgctcctccaacagcaaacagaggagatgctgtatgaggagcgcaaacctggcggcagcgcaaaagatg

SEQ ID NO: 220599 - DNA, 103 bp, Artificial Sequence
  Synthetic Polynucleotide
taatacgactcactatagggtggactccaggctgatgatctcatcaatgaaacagaggagatcattgatgagatcatcaaacctggcggcagcgcaaaagatg

SEQ ID NO: 220600 - DNA, 103 bp, Artificial Sequence
  Synthetic Polynucleotide
taatacgactcactatagggtcattgtaactggactccaggctgatgatcaacagaggagagatcatatgcctggagtcaacctggcggcagcgcaaaagatg

SEQ ID NO: 220601 - DNA, 103 bp, Artificial Sequence
  Synthetic Polynucleotide
taatacgactcactataggggagcatttcatcattgtaactggactccagaacagaggagactggagatgagttacaataacctggcggcagcgcaaaagatg

SEQ ID NO: 220602 - DNA, 103 bp, Artificial Sequence
  Synthetic Polynucleotide
taatacgactcactataggggcagatagctgagcatttcatcattgtaacaacagaggagagttacaatgatgaaatgcaacctggcggcagcgcaaaagatg

SEQ ID NO: 220603 - DNA, 103 bp, Artificial Sequence
  Synthetic Polynucleotide
taatacgactcactataggggtgcctccgggcagatagctgagcatttcaaacagaggagatgaaatatgcagctatctaacctggcggcagcgcaaaagatg

SEQ ID NO: 220604 - DNA, 103 bp, Artificial Sequence
  Synthetic Polynucleotide
taatacgactcactatagggcagtcctgtggtgcctccgggcagatagctaacagaggagaagctatatgcccggaggcaacctggcggcagcgcaaaagatg

SEQ ID NO: 220605 - DNA, 103 bp, Artificial Sequence
  Synthetic Polynucleotide
taatacgactcactatagggtggggagctgcagtcctgtggtgcctccggaacagaggagaccggagatgccacaggacaacctggcggcagcgcaaaagatg

SEQ ID NO: 220606 - DNA, 103 bp, Artificial Sequence
  Synthetic Polynucleotide
taatacgactcactatagggggcagcgtgctggggagctgcagtcctgtgaacagaggagacacaggatggcagctcccaacctggcggcagcgcaaaagatg

SEQ ID NO: 220607 - DNA, 103 bp, Artificial Sequence
  Synthetic Polynucleotide
taatacgactcactatagggccctgacacaggcagcgtgctggggagctgaacagaggagacagctcatgagcacgctgaacctggcggcagcgcaaaagatg

SEQ ID NO: 220608 - DNA, 103 bp, Artificial Sequence
  Synthetic Polynucleotide
taatacgactcactatagggcaagcagattccctgacacaggcagcgtgcaacagaggagagcacgcatgctgtgtcagaacctggcggcagcgcaaaagatg

SEQ ID NO: 220609 - DNA, 103 bp, Artificial Sequence
  Synthetic Polynucleotide
taatacgactcactatagggagctgagccgagtcggccggcctgcgctccaacagaggagaggagcgatggccggccgaaacctggcggcagcgcaaaagatg

SEQ ID NO: 220610 - DNA, 103 bp, Artificial Sequence
  Synthetic Polynucleotide
taatacgactcactatagggctgtacacatcaagcagattccctgacacaaacagaggagatgtgtcatggaatctgctaacctggcggcagcgcaaaagatg

SEQ ID NO: 220611 - DNA, 103 bp, Artificial Sequence
  Synthetic Polynucleotide
taatacgactcactataggggccttgactactgtacacatcaagcagattaacagaggagaaatctgatggatgtgtacaacctggcggcagcgcaaaagatg

SEQ ID NO: 220612 - DNA, 103 bp, Artificial Sequence
  Synthetic Polynucleotide
taatacgactcactataggggtgtggccacgccttgactactgtacacataacagaggagaatgtgtatggtagtcaagaacctggcggcagcgcaaaagatg

SEQ ID NO: 220613 - DNA, 103 bp, Artificial Sequence
  Synthetic Polynucleotide
taatacgactcactataggggtgatggctggtgtggccacgccttgactaaacagaggagatagtcaatgcgtggccacaacctggcggcagcgcaaaagatg

SEQ ID NO: 220614 - DNA, 103 bp, Artificial Sequence
  Synthetic Polynucleotide
taatacgactcactataggggttgctgacagtgatggctggtgtggccacaacagaggagagtggccatgccagccatcaacctggcggcagcgcaaaagatg

SEQ ID NO: 220615 - DNA, 103 bp, Artificial Sequence
  Synthetic Polynucleotide
taatacgactcactatagggctgggcaggagttgctgacagtgatggctgaacagaggagacagccaatgctgtcagcaaacctggcggcagcgcaaaagatg

SEQ ID NO: 220616 - DNA, 103 bp, Artificial Sequence
  Synthetic Polynucleotide
taatacgactcactatagggggcagctcagctgggcaggagttgctgacaaacagaggagatgtcagatgctcctgcccaacctggcggcagcgcaaaagatg

SEQ ID NO: 220617 - DNA, 103 bp, Artificial Sequence
  Synthetic Polynucleotide
taatacgactcactatagggtttgatgttgggcagctcagctgggcaggaaacagaggagatcctgcatggctgagctgaacctggcggcagcgcaaaagatg

SEQ ID NO: 220618 - DNA, 103 bp, Artificial Sequence
  Synthetic Polynucleotide
taatacgactcactatagggagatctcccgtttgatgttgggcagctcagaacagaggagactgagcatgccaacatcaaacctggcggcagcgcaaaagatg

SEQ ID NO: 220619 - DNA, 103 bp, Artificial Sequence
  Synthetic Polynucleotide
taatacgactcactatagggtcggtctcagagatctcccgtttgatgttgaacagaggagacaacatatgacgggagataacctggcggcagcgcaaaagatg

SEQ ID NO: 220620 - DNA, 103 bp, Artificial Sequence
  Synthetic Polynucleotide
taatacgactcactatagggctgcatgcgcaaccctatgcgtgacgccataacagaggagaatggcgatgcgcatagggaacctggcggcagcgcaaaagatg

SEQ ID NO: 220621 - DNA, 103 bp, Artificial Sequence
  Synthetic Polynucleotide
taatacgactcactatagggctgctgctgctgctgctgcatgtaatgcataacagaggagaatgcatatgatgcagcagaacctggcggcagcgcaaaagatg

SEQ ID NO: 220622 - DNA, 103 bp, Artificial Sequence
  Synthetic Polynucleotide
taatacgactcactatagggctcagccatgttcatgccggacggggaggtaacagaggagaacctccatgtccggcatgaacctggcggcagcgcaaaagatg

SEQ ID NO: 220623 - DNA, 103 bp, Artificial Sequence
  Synthetic Polynucleotide
taatacgactcactataggggctgggccagctcagccatgttcatgccggaacagaggagaccggcaatgacatggctgaacctggcggcagcgcaaaagatg

SEQ ID NO: 220624 - DNA, 103 bp, Artificial Sequence
  Synthetic Polynucleotide
taatacgactcactatagggttcaccacctgctgggccagctcagccatgaacagaggagacatggcatggctggcccaaacctggcggcagcgcaaaagatg

SEQ ID NO: 220625 - DNA, 103 bp, Artificial Sequence
  Synthetic Polynucleotide
taatacgactcactatagggcagctcctgcttcaccacctgctgggccagaacagaggagactggccatgcaggtggtgaacctggcggcagcgcaaaagatg

SEQ ID NO: 220626 - DNA, 103 bp, Artificial Sequence
  Synthetic Polynucleotide
taatacgactcactatagggcttcgctaggcagctcctgcttcaccacctaacagaggagaaggtggatgagcaggagcaacctggcggcagcgcaaaagatg

SEQ ID NO: 220627 - DNA, 103 bp, Artificial Sequence
  Synthetic Polynucleotide
taatacgactcactatagggcctgggccctcttcgctaggcagctcctgcaacagaggagagcaggaatggcctagcgaaacctggcggcagcgcaaaagatg

SEQ ID NO: 220628 - DNA, 103 bp, Artificial Sequence
  Synthetic Polynucleotide
taatacgactcactatagggcagggcctcccctgggccctcttcgctaggaacagaggagacctagcatggagggcccaaacctggcggcagcgcaaaagatg

SEQ ID NO: 220629 - DNA, 103 bp, Artificial Sequence
  Synthetic Polynucleotide
taatacgactcactatagggcccccagcatcagggcctcccctgggccctaacagaggagaagggccatggggaggcccaacctggcggcagcgcaaaagatg

SEQ ID NO: 220630 - DNA, 103 bp, Artificial Sequence
  Synthetic Polynucleotide
taatacgactcactataggggggacctcagcccccagcatcagggcctccaacagaggagaggaggcatggatgctgggaacctggcggcagcgcaaaagatg

SEQ ID NO: 220631 - DNA, 103 bp, Artificial Sequence
  Synthetic Polynucleotide
taatacgactcactatagggctcagggtcagggacctcagcccccagcataacagaggagaatgctgatggctgaggtcaacctggcggcagcgcaaaagatg

SEQ ID NO: 220632 - DNA, 103 bp, Artificial Sequence; identical to SEQ ID NO: 150356
  Synthetic Polynucleotide

SEQ ID NO: 220633 - DNA, 103 bp, Artificial Sequence
  Synthetic Polynucleotide
taatacgactcactatagggctggcagtggctcagggtcagggacctcagaacagaggagactgaggatgctgaccctgaacctggcggcagcgcaaaagatg

SEQ ID NO: 220634 - DNA, 103 bp, Artificial Sequence
  Synthetic Polynucleotide
taatacgactcactataggggggggcagagctggcagtggctcagggtcaaacagaggagatgacccatggccactgccaacctggcggcagcgcaaaagatg

SEQ ID NO: 220635 - DNA, 103 bp, Artificial Sequence
  Synthetic Polynucleotide
taatacgactcactatagggcggggcttgcgggggcagagctggcagtggaacagaggagaccactgatggctctgcccaacctggcggcagcgcaaaagatg

SEQ ID NO: 220636 - DNA, 103 bp, Artificial Sequence
  Synthetic Polynucleotide
taatacgactcactataggggcaggggcagcggggcttgcgggggcagagaacagaggagactctgcatgcgcaagcccaacctggcggcagcgcaaaagatg

SEQ ID NO: 220637 - DNA, 103 bp, Artificial Sequence
  Synthetic Polynucleotide
taatacgactcactatagggggctgggtgggcaggggcagcggggcttgcaacagaggagagcaagcatggctgcccctaacctggcggcagcgcaaaagatg

SEQ ID NO: 220638 - DNA, 103 bp, Artificial Sequence
  Synthetic Polynucleotide
taatacgactcactatagggtggggatggtggctgggtgggcaggggcagaacagaggagactgcccatgcccacccagaacctggcggcagcgcaaaagatg

SEQ ID NO: 220639 - DNA, 103 bp, Artificial Sequence
  Synthetic Polynucleotide
taatacgactcactatagggggtgatggaatggggatggtggctgggtggaacagaggagaccacccatgcaccatcccaacctggcggcagcgcaaaagatg

SEQ ID NO: 220640 - DNA, 103 bp, Artificial Sequence
  Synthetic Polynucleotide
taatacgactcactatagggctgaagtccaggtgatggaatggggatggtaacagaggagaaccatcatgattccatcaaacctggcggcagcgcaaaagatg

SEQ ID NO: 220641 - DNA, 103 bp, Artificial Sequence
  Synthetic Polynucleotide
taatacgactcactatagggcaggctgtggctgaagtccaggtgatggaaaacagaggagattccatatgctggacttcaacctggcggcagcgcaaaagatg

SEQ ID NO: 220642 - DNA, 103 bp, Artificial Sequence
  Synthetic Polynucleotide
taatacgactcactatagggccccaaagctcaggctgtggctgaagtccaaacagaggagatggactatggccacagccaacctggcggcagcgcaaaagatg

SEQ ID NO: 220643 - DNA, 103 bp, Artificial Sequence
  Synthetic Polynucleotide
taatacgactcactatagggcctccgagctgctgctgttgctgctgctgcaacagaggagagcagcaatggcaacagcaaacctggcggcagcgcaaaagatg

SEQ ID NO: 220644 - DNA, 103 bp, Artificial Sequence
  Synthetic Polynucleotide
taatacgactcactatagggtcctccctgcccccaaagctcaggctgtggaacagaggagaccacagatggagctttggaacctggcggcagcgcaaaagatg

SEQ ID NO: 220645 - DNA, 103 bp, Artificial Sequence
  Synthetic Polynucleotide
taatacgactcactataggggggaccctcgtcctccctgcccccaaagctaacagaggagaagctttatgggcagggagaacctggcggcagcgcaaaagatg

SEQ ID NO: 220646 - DNA, 103 bp, Artificial Sequence
  Synthetic Polynucleotide
taatacgactcactatagggggtagcccgggggaccctcgtcctccctgcaacagaggagagcagggatgacgagggtcaacctggcggcagcgcaaaagatg

SEQ ID NO: 220647 - DNA, 103 bp, Artificial Sequence
  Synthetic Polynucleotide
taatacgactcactatagggaggggttcggggtagcccgggggaccctcgaacagaggagacgagggatgcccgggctaaacctggcggcagcgcaaaagatg

SEQ ID NO: 220648 - DNA, 103 bp, Artificial Sequence
  Synthetic Polynucleotide
taatacgactcactatagggccccggcgccaggggttcggggtagcccggaacagaggagaccgggcatgcccgaacccaacctggcggcagcgcaaaagatg

SEQ ID NO: 220649 - DNA, 103 bp, Artificial Sequence
  Synthetic Polynucleotide
taatacgactcactataggggggagccatgccccggcgccaggggttcggaacagaggagaccgaacatgtggcgccggaacctggcggcagcgcaaaagatg

SEQ ID NO: 220650 - DNA, 103 bp, Artificial Sequence
  Synthetic Polynucleotide
taatacgactcactatagggctggggaatggggagccatgccccggcgccaacagaggagaggcgccatggcatggctcaacctggcggcagcgcaaaagatg

SEQ ID NO: 220651 - DNA, 103 bp, Artificial Sequence
  Synthetic Polynucleotide
taatacgactcactatagggcttggacaggctggggaatggggagccatgaacagaggagacatggcatgccattccccaacctggcggcagcgcaaaagatg

SEQ ID NO: 220652 - DNA, 103 bp, Artificial Sequence
  Synthetic Polynucleotide
taatacgactcactatagggccagatccttcttggacaggctggggaatgaacagaggagacattccatggcctgtccaaacctggcggcagcgcaaaagatg

SEQ ID NO: 220653 - DNA, 103 bp, Artificial Sequence
  Synthetic Polynucleotide
taatacgactcactatagggagcatgaggtccagatccttcttggacaggaacagaggagacctgtcatggaaggatctaacctggcggcagcgcaaaagatg

SEQ ID NO: 220654 - DNA, 103 bp, Artificial Sequence
  Synthetic Polynucleotide
taatacgactcactatagggggtgggcggccctccgagctgctgctgttgaacagaggagacaacagatgcagctcggaaacctggcggcagcgcaaaagatg

SEQ ID NO: 220655 - DNA, 103 bp, Artificial Sequence
  Synthetic Polynucleotide
taatacgactcactataggggtcgtccaggagcatgaggtccagatccttaacagaggagaaaggatatggacctcatgaacctggcggcagcgcaaaagatg

SEQ ID NO: 220656 - DNA, 103 bp, Artificial Sequence
  Synthetic Polynucleotide
taatacgactcactataggggtagcagtgagtcgtccaggagcatgaggtaacagaggagaacctcaatgtcctggacgaacctggcggcagcgcaaaagatg

SEQ ID NO: 220657 - DNA, 103 bp, Artificial Sequence
  Synthetic Polynucleotide
taatacgactcactataggggaggccagcggtagcagtgagtcgtccaggaacagaggagacctggaatgctcactgctaacctggcggcagcgcaaaagatg

SEQ ID NO: 220658 - DNA, 103 bp, Artificial Sequence
  Synthetic Polynucleotide
taatacgactcactatagggaagtggatcagaggccagcggtagcagtgaaacagaggagatcactgatgccgctggccaacctggcggcagcgcaaaagatg

SEQ ID NO: 220659 - DNA, 103 bp, Artificial Sequence
  Synthetic Polynucleotide
taatacgactcactatagggtggtggacagaagtggatcagaggccagcgaacagaggagacgctggatgctgatccacaacctggcggcagcgcaaaagatg

SEQ ID NO: 220660 - DNA, 103 bp, Artificial Sequence
  Synthetic Polynucleotide
taatacgactcactatagggtcgggggacatggtggacagaagtggatcaaacagaggagatgatccatgtctgtccacaacctggcggcagcgcaaaagatg

SEQ ID NO: 220661 - DNA, 103 bp, Artificial Sequence
  Synthetic Polynucleotide
taatacgactcactatagggcttggaggcctcgggggacatggtggacagaacagaggagactgtccatgatgtcccccaacctggcggcagcgcaaaagatg

SEQ ID NO: 220662 - DNA, 103 bp, Artificial Sequence
  Synthetic Polynucleotide
taatacgactcactatagggggctgctggccttggaggcctcgggggacaaacagaggagatgtcccatgaggcctccaaacctggcggcagcgcaaaagatg

SEQ ID NO: 220663 - DNA, 103 bp, Artificial Sequence
  Synthetic Polynucleotide
taatacgactcactatagggctgctccggcggctgctggccttggaggccaacagaggagaggcctcatgggccagcagaacctggcggcagcgcaaaagatg

SEQ ID NO: 220664 - DNA, 103 bp, Artificial Sequence
  Synthetic Polynucleotide
taatacgactcactatagggcatgctgaagctgctccggcggctgctggcaacagaggagagccagcatgcgccggagcaacctggcggcagcgcaaaagatg

SEQ ID NO: 220665 - DNA, 103 bp, Artificial Sequence
  Synthetic Polynucleotide
taatacgactcactatagggtgatggccggggtgggcggccctccgagctaacagaggagaagctcgatgggccgcccaaacctggcggcagcgcaaaagatg

SEQ ID NO: 220666 - DNA, 103 bp, Artificial Sequence
  Synthetic Polynucleotide
taatacgactcactatagggcgccctcctccatgctgaagctgctccggcaacagaggagagccggaatggcttcagcaaacctggcggcagcgcaaaagatg

SEQ ID NO: 220667 - DNA, 103 bp, Artificial Sequence
  Synthetic Polynucleotide
taatacgactcactatagggcacagcacatcgccctcctccatgctgaagaacagaggagacttcagatgggaggagggaacctggcggcagcgcaaaagatg

SEQ ID NO: 220668 - DNA, 103 bp, Artificial Sequence
  Synthetic Polynucleotide
taatacgactcactatagggacgggggtattgatggccggggtgggcggcaacagaggagagccgccatgcccggccataacctggcggcagcgcaaaagatg

SEQ ID NO: 220669 - DNA, 103 bp, Artificial Sequence
  Synthetic Polynucleotide
taatacgactcactatagggctggaagtggacgggggtattgatggccggaacagaggagaccggccatgaatacccccaacctggcggcagcgcaaaagatg

SEQ ID NO: 220670 - DNA, 103 bp, Artificial Sequence
  Synthetic Polynucleotide
taatacgactcactataggggtggtggcgactggaagtggacgggggtataacagaggagaatacccatgtccacttccaacctggcggcagcgcaaaagatg

SEQ ID NO: 220671 - DNA, 103 bp, Artificial Sequence
  Synthetic Polynucleotide
taatacgactcactatagggccaggcacaggtggtggcgactggaagtggaacagaggagaccacttatggtcgccaccaacctggcggcagcgcaaaagatg

SEQ ID NO: 220672 - DNA, 103 bp, Artificial Sequence
  Synthetic Polynucleotide
taatacgactcactatagggcaacacctccccaggcacaggtggtggcgaaacagaggagatcgccaatgcctgtgcctaacctggcggcagcgcaaaagatg

SEQ ID NO: 220673 - DNA, 103 bp, Artificial Sequence
  Synthetic Polynucleotide
taatacgactcactatagggcccgcatgagctgcatgcgcaaccctatgcaacagaggagagcatagatgtgcgcatgcaacctggcggcagcgcaaaagatg

SEQ ID NO: 220674 - DNA, 103 bp, Artificial Sequence
  Synthetic Polynucleotide
taatacgactcactatagggactgcaccttcaacacctccccaggcacagaacagaggagactgtgcatggggaggtgtaacctggcggcagcgcaaaagatg

SEQ ID NO: 220675 - DNA, 103 bp, Artificial Sequence
  Synthetic Polynucleotide
taatacgactcactatagggtccaggtaggactgcaccttcaacacctccaacagaggagaggaggtatggaaggtgcaaacctggcggcagcgcaaaagatg

SEQ ID NO: 220676 - DNA, 103 bp, Artificial Sequence
  Synthetic Polynucleotide
taatacgactcactatagggtgtgggattctccaggtaggactgcaccttaacagaggagaaaggtgatgtcctacctgaacctggcggcagcgcaaaagatg

SEQ ID NO: 220677 - DNA, 103 bp, Artificial Sequence
  Synthetic Polynucleotide
taatacgactcactataggggatggtaggatgtgggattctccaggtaggaacagaggagacctaccatgagaatcccaaacctggcggcagcgcaaaagatg

SEQ ID NO: 220678 - DNA, 103 bp, Artificial Sequence
  Synthetic Polynucleotide
taatacgactcactataggggactgctgcagatggtaggatgtgggattcaacagaggagagaatccatgatcctaccaaacctggcggcagcgcaaaagatg

SEQ ID NO: 220679 - DNA, 103 bp, Artificial Sequence
  Synthetic Polynucleotide
taatacgactcactatagggctgatgctgcgactgctgcagatggtaggaaacagaggagatcctacatgctgcagcagaacctggcggcagcgcaaaagatg

SEQ ID NO: 220680 - DNA, 103 bp, Artificial Sequence
  Synthetic Polynucleotide
taatacgactcactatagggcccgcaccttctgatgctgcgactgctgcaaacagaggagatgcagcatgcgcagcatcaacctggcggcagcgcaaaagatg

SEQ ID NO: 220681 - DNA, 103 bp, Artificial Sequence
  Synthetic Polynucleotide
taatacgactcactataggggacaggtactcccgcaccttctgatgctgcaacagaggagagcagcaatggaaggtgcgaacctggcggcagcgcaaaagatg

SEQ ID NO: 220682 - DNA, 103 bp, Artificial Sequence
  Synthetic Polynucleotide
taatacgactcactatagggataggtctcggacaggtactcccgcaccttaacagaggagaaaggtgatggagtacctgaacctggcggcagcgcaaaagatg

SEQ ID NO: 220683 - DNA, 103 bp, Artificial Sequence
  Synthetic Polynucleotide
taatacgactcactatagggacttgttcccataggtctcggacaggtactaacagaggagaagtaccatgccgagacctaacctggcggcagcgcaaaagatg

SEQ ID NO: 220684 - DNA, 103 bp, Artificial Sequence
  Synthetic Polynucleotide
taatacgactcactatagggtgcgcctgctcccgcatgagctgcatgcgcaacagaggagagcgcatatggctcatgcgaacctggcggcagcgcaaaagatg

SEQ ID NO: 220685 - DNA, 103 bp, Artificial Sequence
  Synthetic Polynucleotide
taatacgactcactatagggtgggcagcaaacttgttcccataggtctcgaacagaggagacgagacatgtgggaacaaaacctggcggcagcgcaaaagatg

SEQ ID NO: 220686 - DNA, 103 bp, Artificial Sequence
  Synthetic Polynucleotide
taatacgactcactatagggtgggctgatgtgggcagcaaacttgttcccaacagaggagagggaacatgtttgctgccaacctggcggcagcgcaaaagatg

SEQ ID NO: 220687 - DNA, 103 bp, Artificial Sequence
  Synthetic Polynucleotide
taatacgactcactatagggagccctgggctgggctgatgtgggcagcaaaacagaggagattgctgatgacatcagccaacctggcggcagcgcaaaagatg

SEQ ID NO: 220688 - DNA, 103 bp, Artificial Sequence
  Synthetic Polynucleotide
taatacgactcactatagggggtttcggagagccctgggctgggctgatgaacagaggagacatcagatgagcccagggaacctggcggcagcgcaaaagatg

SEQ ID NO: 220689 - DNA, 103 bp, Artificial Sequence
  Synthetic Polynucleotide
taatacgactcactatagggggctggtgggggtttcggagagccctgggcaacagaggagagcccagatgtctccgaaaaacctggcggcagcgcaaaagatg

SEQ ID NO: 220690 - DNA, 103 bp, Artificial Sequence
  Synthetic Polynucleotide
taatacgactcactatagggctggggaggcggctggtgggggtttcggagaacagaggagactccgaatgccccaccagaacctggcggcagcgcaaaagatg

SEQ ID NO: 220691 - DNA, 103 bp, Artificial Sequence
  Synthetic Polynucleotide
taatacgactcactataggggctcgcacccctggggaggcggctggtgggaacagaggagacccaccatgcgcctccccaacctggcggcagcgcaaaagatg

SEQ ID NO: 220692 - DNA, 103 bp, Artificial Sequence
  Synthetic Polynucleotide
taatacgactcactatagggcacgtgtccagctcgcacccctggggaggcaacagaggagagcctccatgggggtgcgaaacctggcggcagcgcaaaagatg

SEQ ID NO: 220693 - DNA, 103 bp, Artificial Sequence
  Synthetic Polynucleotide
taatacgactcactatagggaggaggacagcacgtgtccagctcgcacccaacagaggagagggtgcatgctggacacgaacctggcggcagcgcaaaagatg

SEQ ID NO: 220694 - DNA, 103 bp, Artificial Sequence
  Synthetic Polynucleotide
taatacgactcactatagggttgccagcggaggaggacagcacgtgtccaaacagaggagatggacaatggctgtcctcaacctggcggcagcgcaaaagatg

SEQ ID NO: 220695 - DNA, 103 bp, Artificial Sequence
  Synthetic Polynucleotide
taatacgactcactatagggctcctcctgctgcgcctgctcccgcatgagaacagaggagactcatgatggagcaggcgaacctggcggcagcgcaaaagatg

SEQ ID NO: 220696 - DNA, 103 bp, Artificial Sequence
  Synthetic Polynucleotide
taatacgactcactataggggggagcactgttgccagcggaggaggacagaacagaggagactgtccatgtccgctggcaacctggcggcagcgcaaaagatg

SEQ ID NO: 220697 - DNA, 103 bp, Artificial Sequence
  Synthetic Polynucleotide
taatacgactcactatagggtggggctattgggagcactgttgccagcggaacagaggagaccgctgatgacagtgctcaacctggcggcagcgcaaaagatg

SEQ ID NO: 220698 - DNA, 103 bp, Artificial Sequence
  Synthetic Polynucleotide
taatacgactcactatagggagcatggccatggggctattgggagcactgaacagaggagacagtgcatgcaatagcccaacctggcggcagcgcaaaagatg

SEQ ID NO: 220699 - DNA, 103 bp, Artificial Sequence
  Synthetic Polynucleotide
taatacgactcactataggggccaatgtgcagcatggccatggggctattaacagaggagaaatagcatgatggccatgaacctggcggcagcgcaaaagatg

SEQ ID NO: 220700 - DNA, 103 bp, Artificial Sequence
  Synthetic Polynucleotide
taatacgactcactatagggcagggttggagccaatgtgcagcatggccaaacagaggagatggccaatgtgcacattgaacctggcggcagcgcaaaagatg

SEQ ID NO: 220701 - DNA, 103 bp, Artificial Sequence
  Synthetic Polynucleotide
taatacgactcactatagggaactccctctcagggttggagccaatgtgcaacagaggagagcacatatgctccaacccaacctggcggcagcgcaaaagatg

SEQ ID NO: 220702 - DNA, 103 bp, Artificial Sequence
  Synthetic Polynucleotide
taatacgactcactataggggacatcatccaactccctctcagggttggaaacagaggagatccaacatggagagggagaacctggcggcagcgcaaaagatg

SEQ ID NO: 220703 - DNA, 103 bp, Artificial Sequence
  Synthetic Polynucleotide
taatacgactcactatagggtgttgtcaatgacatcatccaactccctctaacagaggagaagagggatgtggatgatgaacctggcggcagcgcaaaagatg

SEQ ID NO: 220704 - DNA, 103 bp, Artificial Sequence
  Synthetic Polynucleotide
taatacgactcactatagggagacgcataatgttgtcaatgacatcatccaacagaggagaggatgaatgcattgacaaaacctggcggcagcgcaaaagatg

SEQ ID NO: 220705 - DNA, 103 bp, Artificial Sequence
  Synthetic Polynucleotide
taatacgactcactataggggacatcgtccagacgcataatgttgtcaataacagaggagaattgacatgattatgcgtaacctggcggcagcgcaaaagatg

SEQ ID NO: 220706 - DNA, 103 bp, Artificial Sequence
  Synthetic Polynucleotide
taatacgactcactataggggctcccgctgctcctcctgctgcgcctgctaacagaggagaagcaggatgagcaggaggaacctggcggcagcgcaaaagatg

SEQ ID NO: 220707 - DNA, 103 bp, Artificial Sequence
  Synthetic Polynucleotide
taatacgactcactatagggtgtagccaaggacatcgtccagacgcataaaacagaggagattatgcatgtggacgatgaacctggcggcagcgcaaaagatg

SEQ ID NO: 220708 - DNA, 103 bp, Artificial Sequence
  Synthetic Polynucleotide
taatacgactcactatagggtcaggattgatgtagccaaggacatcgtccaacagaggagaggacgaatgccttggctaaacctggcggcagcgcaaaagatg

SEQ ID NO: 220709 - DNA, 103 bp, Artificial Sequence
  Synthetic Polynucleotide
taatacgactcactatagggcatctgcatttcaggattgatgtagccaagaacagaggagacttggcatgatcaatcctaacctggcggcagcgcaaaagatg

SEQ ID NO: 220710 - DNA, 103 bp, Artificial Sequence
  Synthetic Polynucleotide
taatacgactcactataggggcgtgttgggcatctgcatttcaggattgaaacagaggagatcaatcatgaaatgcagaaacctggcggcagcgcaaaagatg

SEQ ID NO: 220711 - DNA, 103 bp, Artificial Sequence
  Synthetic Polynucleotide
taatacgactcactataggggacaggggtagcgtgttgggcatctgcattaacagaggagaaatgcaatggcccaacacaacctggcggcagcgcaaaagatg

SEQ ID NO: 220712 - DNA, 103 bp, Artificial Sequence
  Synthetic Polynucleotide
taatacgactcactataggggtggctgctggacaggggtagcgtgttgggaacagaggagacccaacatgctacccctgaacctggcggcagcgcaaaagatg

SEQ ID NO: 220713 - DNA, 103 bp, Artificial Sequence
  Synthetic Polynucleotide
taatacgactcactatagggacacattcaggtggctgctggacaggggtaaacagaggagataccccatgccagcagccaacctggcggcagcgcaaaagatg

SEQ ID NO: 220714 - DNA, 103 bp, Artificial Sequence
  Synthetic Polynucleotide
taatacgactcactatagggtcgctgctgtacacattcaggtggctgctgaacagaggagacagcagatgcctgaatgtaacctggcggcagcgcaaaagatg

SEQ ID NO: 220715 - DNA, 103 bp, Artificial Sequence
  Synthetic Polynucleotide
taatacgactcactataggggacctgggggtcgctgctgtacacattcagaacagaggagactgaatatgtacagcagcaacctggcggcagcgcaaaagatg

SEQ ID NO: 220716 - DNA, 103 bp, Artificial Sequence
  Synthetic Polynucleotide
taatacgactcactataggggggaggctgtgacctgggggtcgctgctgtaacagaggagaacagcaatgacccccaggaacctggcggcagcgcaaaagatg

SEQ ID NO: 220717 - DNA, 103 bp, Artificial Sequence
  Synthetic Polynucleotide
taatacgactcactatagggtgctgcatgcgctcccgctgctcctcctgcaacagaggagagcaggaatggcagcgggaaacctggcggcagcgcaaaagatg

SEQ ID NO: 220718 - DNA, 103 bp, Artificial Sequence
  Synthetic Polynucleotide
taatacgactcactatagggacgcccaccagggaggctgtgacctgggggaacagaggagacccccaatgcacagcctcaacctggcggcagcgcaaaagatg

SEQ ID NO: 220719 - DNA, 103 bp, Artificial Sequence
  Synthetic Polynucleotide
taatacgactcactataggggctgctggtgacgcccaccagggaggctgtaacagaggagaacagccatgctggtgggcaacctggcggcagcgcaaaagatg

SEQ ID NO: 220720 - DNA, 103 bp, Artificial Sequence
  Synthetic Polynucleotide
taatacgactcactatagggcagggcaggagctgctggtgacgcccaccaaacagaggagatggtggatgtcaccagcaaacctggcggcagcgcaaaagatg

SEQ ID NO: 220721 - DNA, 103 bp, Artificial Sequence
  Synthetic Polynucleotide
taatacgactcactataggggtcaggtccgcagggcaggagctgctggtgaacagaggagacaccagatgctcctgcccaacctggcggcagcgcaaaagatg

SEQ ID NO: 220722 - DNA, 103 bp, Artificial Sequence
  Synthetic Polynucleotide
taatacgactcactatagggtcgcttctgggtcaggtccgcagggcaggaaacagaggagatcctgcatggcggacctgaacctggcggcagcgcaaaagatg

SEQ ID NO: 220723 - DNA, 103 bp, Artificial Sequence
  Synthetic Polynucleotide
taatacgactcactatagggctgtgagctctcgcttctgggtcaggtccgaacagaggagacggaccatgcccagaagcaacctggcggcagcgcaaaagatg

SEQ ID NO: 220724 - DNA, 103 bp, Artificial Sequence
  Synthetic Polynucleotide
taatacgactcactatagggctctcagcatctgtgagctctcgcttctggaacagaggagaccagaaatgagagctcacaacctggcggcagcgcaaaagatg

SEQ ID NO: 220725 - DNA, 103 bp, Artificial Sequence
  Synthetic Polynucleotide
taatacgactcactatagggcagggccctgctctcagcatctgtgagctcaacagaggagagagctcatggatgctgagaacctggcggcagcgcaaaagatg

SEQ ID NO: 220726 - DNA, 103 bp, Artificial Sequence
  Synthetic Polynucleotide
taatacgactcactataggggctccttggccagggccctgctctcagcataacagaggagaatgctgatggcagggcccaacctggcggcagcgcaaaagatg

SEQ ID NO: 220727 - DNA, 103 bp, Artificial Sequence
  Synthetic Polynucleotide
taatacgactcactatagggttcttctgccgctccttggccagggccctgaacagaggagacagggcatgggccaaggaaacctggcggcagcgcaaaagatg

SEQ ID NO: 220728 - DNA, 103 bp, Artificial Sequence
  Synthetic Polynucleotide
taatacgactcactataggggacagcctgttgctgcatgcgctcccgctgaacagaggagacagcggatgcgcatgcagaacctggcggcagcgcaaaagatg

SEQ ID NO: 220729 - DNA, 103 bp, Artificial Sequence
  Synthetic Polynucleotide
taatacgactcactataggggtgattgtctttcttctgccgctccttggcaacagaggagagccaagatgcggcagaagaacctggcggcagcgcaaaagatg

SEQ ID NO: 220730 - DNA, 103 bp, Artificial Sequence
  Synthetic Polynucleotide
taatacgactcactatagggcaattaagttgtgattgtctttcttctgccaacagaggagaggcagaatgaagacaatcaacctggcggcagcgcaaaagatg

SEQ ID NO: 220731 - DNA, 103 bp, Artificial Sequence
  Synthetic Polynucleotide
taatacgactcactatagggcgtctcctttcaattaagttgtgattgtctaacagaggagaagacaaatgcaacttaataacctggcggcagcgcaaaagatg

SEQ ID NO: 220732 - DNA, 103 bp, Artificial Sequence
  Synthetic Polynucleotide
taatacgactcactataggggttgaaccttcgtctcctttcaattaagttaacagaggagaaacttaatggaaaggagaaacctggcggcagcgcaaaagatg

SEQ ID NO: 220733 - DNA, 103 bp, Artificial Sequence
  Synthetic Polynucleotide
taatacgactcactatagggggtcattgatgttgaaccttcgtctcctttaacagaggagaaaaggaatggaaggttcaaacctggcggcagcgcaaaagatg

SEQ ID NO: 220734 - DNA, 103 bp, Artificial Sequence
  Synthetic Polynucleotide
taatacgactcactatagggtccttgatgcggtcattgatgttgaaccttaacagaggagaaaggttatgcatcaatgaaacctggcggcagcgcaaaagatg

SEQ ID NO: 220735 - DNA, 103 bp, Artificial Sequence
  Synthetic Polynucleotide
taatacgactcactatagggcattcccaactccttgatgcggtcattgataacagaggagaatcaatatgcgcatcaagaacctggcggcagcgcaaaagatg

SEQ ID NO: 220736 - DNA, 103 bp, Artificial Sequence
  Synthetic Polynucleotide
taatacgactcactatagggtggggatcagcattcccaactccttgatgcaacagaggagagcatcaatgagttgggaaaacctggcggcagcgcaaaagatg

SEQ ID NO: 220737 - DNA, 103 bp, Artificial Sequence
  Synthetic Polynucleotide
taatacgactcactatagggtcattggccttggggatcagcattcccaacaacagaggagagttgggatggctgatcccaacctggcggcagcgcaaaagatg

SEQ ID NO: 220738 - DNA, 103 bp, Artificial Sequence
  Synthetic Polynucleotide
taatacgactcactatagggcacgtccaggtcattggccttggggatcagaacagaggagactgatcatgaaggccaataacctggcggcagcgcaaaagatg

SEQ ID NO: 220739 - DNA, 103 bp, Artificial Sequence
  Synthetic Polynucleotide
taatacgactcactatagggtgtaatgcatgacagcctgttgctgcatgcaacagaggagagcatgcatgaacaggctgaacctggcggcagcgcaaaagatg

SEQ ID NO: 220740 - DNA, 103 bp, Artificial Sequence
  Synthetic Polynucleotide
taatacgactcactatagggtgttccagcgcacgtccaggtcattggcctaacagaggagaaggccaatgacctggacgaacctggcggcagcgcaaaagatg

SEQ ID NO: 220741 - DNA, 103 bp, Artificial Sequence
  Synthetic Polynucleotide
taatacgactcactatagggatggtgcccttgttccagcgcacgtccaggaacagaggagacctggaatggcgctggaaaacctggcggcagcgcaaaagatg

SEQ ID NO: 220742 - DNA, 103 bp, Artificial Sequence
  Synthetic Polynucleotide
taatacgactcactatagggggccttgaggatggtgcccttgttccagcgaacagaggagacgctggatgaagggcaccaacctggcggcagcgcaaaagatg

SEQ ID NO: 220743 - DNA, 103 bp, Artificial Sequence
  Synthetic Polynucleotide
taatacgactcactatagggaatccacagaggccttgaggatggtgccctaacagaggagaagggcaatgtcctcaaggaacctggcggcagcgcaaaagatg

SEQ ID NO: 220744 - DNA, 103 bp, Artificial Sequence
  Synthetic Polynucleotide
taatacgactcactatagggctccggatgtaatccacagaggccttgaggaacagaggagacctcaaatgctctgtggaaacctggcggcagcgcaaaagatg

SEQ ID NO: 220745 - DNA, 103 bp, Artificial Sequence
  Synthetic Polynucleotide
taatacgactcactatagggcttctgcatcctccggatgtaatccacagaaacagaggagatctgtgatgtacatccggaacctggcggcagcgcaaaagatg

SEQ ID NO: 220746 - DNA, 103 bp, Artificial Sequence
  Synthetic Polynucleotide
taatacgactcactatagggtttgcaggtccttctgcatcctccggatgtaacagaggagaacatccatgggatgcagaaacctggcggcagcgcaaaagatg

SEQ ID NO: 220747 - DNA, 103 bp, Artificial Sequence
  Synthetic Polynucleotide
taatacgactcactatagggtccctggacttttgcaggtccttctgcatcaacagaggagagatgcaatgggacctgcaaacctggcggcagcgcaaaagatg

SEQ ID NO: 220748 - DNA, 103 bp, Artificial Sequence
  Synthetic Polynucleotide
taatacgactcactataggggttctccagctccctggacttttgcaggtcaacagaggagagacctgatgaagtccaggaacctggcggcagcgcaaaagatg

SEQ ID NO: 220749 - DNA, 103 bp, Artificial Sequence
  Synthetic Polynucleotide
taatacgactcactatagggggcgagagtggttctccagctccctggactaacagaggagaagtccaatgagctggagaaacctggcggcagcgcaaaagatg

SEQ ID NO: 220750 - DNA, 103 bp, Artificial Sequence
  Synthetic Polynucleotide
taatacgactcactatagggtgctgctgcatgtaatgcatgacagcctgtaacagaggagaacaggcatgcatgcattaaacctggcggcagcgcaaaagatg

SEQ ID NO: 220751 - DNA, 103 bp, Artificial Sequence
  Synthetic Polynucleotide
taatacgactcactatagggatctccaggcggcgagagtggttctccagcaacagaggagagctggaatgccactctcgaacctggcggcagcgcaaaagatg

SEQ ID NO: 220752 - DNA, 103 bp, Artificial Sequence
  Synthetic Polynucleotide
taatacgactcactatagggcttgttggtcatctccaggcggcgagagtgaacagaggagacactctatgcgcctggagaacctggcggcagcgcaaaagatg

SEQ ID NO: 220753 - DNA, 103 bp, Artificial Sequence
  Synthetic Polynucleotide
taatacgactcactataggggccagagctgcttgttggtcatctccaggcaacagaggagagcctggatgtgaccaacaaacctggcggcagcgcaaaagatg

SEQ ID NO: 220754 - DNA, 103 bp, Artificial Sequence
  Synthetic Polynucleotide
taatacgactcactatagggtggatacggagccagagctgcttgttggtcaacagaggagagaccaaatggcagctctgaacctggcggcagcgcaaaagatg

SEQ ID NO: 220755 - DNA, 103 bp, Artificial Sequence
  Synthetic Polynucleotide
taatacgactcactatagggctccagctcctggatacggagccagagctgaacagaggagacagctcatgctccgtatcaacctggcggcagcgcaaaagatg

SEQ ID NO: 220756 - DNA, 103 bp, Artificial Sequence
  Synthetic Polynucleotide
taatacgactcactataggggagcctgcatctccagctcctggatacggaaacagaggagatccgtaatgaggagctggaacctggcggcagcgcaaaagatg

SEQ ID NO: 220757 - DNA, 103 bp, Artificial Sequence
  Synthetic Polynucleotide
taatacgactcactatagggccgtgcactcgagcctgcatctccagctccaacagaggagaggagctatggatgcaggcaacctggcggcagcgcaaaagatg

SEQ ID NO: 220758 - DNA, 103 bp, Artificial Sequence
  Synthetic Polynucleotide
taatacgactcactatagggggtagggaggccgtgcactcgagcctgcataacagaggagaatgcagatgcgagtgcacaacctggcggcagcgcaaaagatg

SEQ ID NO: 220759 - DNA, 103 bp, Artificial Sequence
  Synthetic Polynucleotide
taatacgactcactatagggacggggaggtggtagggaggccgtgcactcaacagaggagagagtgcatggcctccctaaacctggcggcagcgcaaaagatg

SEQ ID NO: 220760 - DNA, 103 bp, Artificial Sequence
  Synthetic Polynucleotide
taatacgactcactatagggttcatgccggacggggaggtggtagggaggaacagaggagacctcccatgcacctccccaacctggcggcagcgcaaaagatg

SEQ ID NO: 220761 - DNA, 103 bp, Artificial Sequence
  Synthetic Polynucleotide
taatacgactcactatagggtggattgatgatctgatgatcaagggtcataacagaggagaatgaccatggatcatcagaacctggcggcagcgcaaaagatg

SEQ ID NO: 220762 - DNA, 103 bp, Artificial Sequence
  Synthetic Polynucleotide
taatacgactcactatagggtgtgaggccagcatcactgtccagagttgtaacagaggagaacaactatggacagtgataacctggcggcagcgcaaaagatg

SEQ ID NO: 220763 - DNA, 103 bp, Artificial Sequence
  Synthetic Polynucleotide
taatacgactcactataggggctaaagctacttctcctactgctttctttaacagaggagaaaagaaatgagtaggagaaacctggcggcagcgcaaaagatg

SEQ ID NO: 220764 - DNA, 103 bp, Artificial Sequence
  Synthetic Polynucleotide
taatacgactcactatagggcatcatctgagctaaagctacttctcctacaacagaggagagtaggaatggtagctttaaacctggcggcagcgcaaaagatg

SEQ ID NO: 220765 - DNA, 103 bp, Artificial Sequence
  Synthetic Polynucleotide
taatacgactcactatagggaattcatcaccatcatctgagctaaagctaaacagaggagatagcttatgctcagatgaaacctggcggcagcgcaaaagatg

SEQ ID NO: 220766 - DNA, 103 bp, Artificial Sequence
  Synthetic Polynucleotide
taatacgactcactataggggtgggttttctgtgaggccagcatcactgtaacagaggagaacagtgatgctggcctcaaacctggcggcagcgcaaaagatg

SEQ ID NO: 220767 - DNA, 103 bp, Artificial Sequence
  Synthetic Polynucleotide
taatacgactcactatagggaacttggtgagtgggttttctgtgaggccaaacagaggagatggcctatgagaaaacccaacctggcggcagcgcaaaagatg

SEQ ID NO: 220768 - DNA, 103 bp, Artificial Sequence
  Synthetic Polynucleotide
taatacgactcactatagggaatagctagtaacttggtgagtgggttttcaacagaggagagaaaacatgctcaccaagaacctggcggcagcgcaaaagatg

SEQ ID NO: 220769 - DNA, 103 bp, Artificial Sequence
  Synthetic Polynucleotide
taatacgactcactatagggcttctttcccaatagctagtaacttggtgaaacagaggagatcaccaatgtactagctaaacctggcggcagcgcaaaagatg

SEQ ID NO: 220770 - DNA, 103 bp, Artificial Sequence
  Synthetic Polynucleotide
taatacgactcactataggggcattgtcatcttctttcccaatagctagtaacagaggagaactagcatgtgggaaagaaacctggcggcagcgcaaaagatg

SEQ ID NO: 220771 - DNA, 103 bp, Artificial Sequence
  Synthetic Polynucleotide
taatacgactcactatagggatgccattgtgcattgtcatcttctttcccaacagaggagagggaaaatggatgacaataacctggcggcagcgcaaaagatg

SEQ ID NO: 220772 - DNA, 103 bp, Artificial Sequence
  Synthetic Polynucleotide
taatacgactcactatagggcgtcctccatatgccattgtgcattgtcataacagaggagaatgacaatgcacaatggcaacctggcggcagcgcaaaagatg

SEQ ID NO: 220773 - DNA, 103 bp, Artificial Sequence
  Synthetic Polynucleotide
taatacgactcactatagggtcctcaataacgtcctccatatgccattgtaacagaggagaacaatgatgtatggaggaaacctggcggcagcgcaaaagatg

SEQ ID NO: 220774 - DNA, 103 bp, Artificial Sequence
  Synthetic Polynucleotide
taatacgactcactatagggaccgattatatcctcaataacgtcctccataacagaggagaatggagatggttattgagaacctggcggcagcgcaaaagatg

SEQ ID NO: 220775 - DNA, 103 bp, Artificial Sequence
  Synthetic Polynucleotide
taatacgactcactatagggatttaagagttggattgatgatctgatgataacagaggagaatcatcatgtcatcaatcaacctggcggcagcgcaaaagatg

SEQ ID NO: 220776 - DNA, 103 bp, Artificial Sequence
  Synthetic Polynucleotide
taatacgactcactatagggttgattccataccgattatatcctcaataaaacagaggagattattgatgatataatcgaacctggcggcagcgcaaaagatg

SEQ ID NO: 220777 - DNA, 103 bp, Artificial Sequence
  Synthetic Polynucleotide
taatacgactcactatagggtctttaaaacttgattccataccgattataaacagaggagatataatatgtatggaatcaacctggcggcagcgcaaaagatg

SEQ ID NO: 220778 - DNA, 103 bp, Artificial Sequence
  Synthetic Polynucleotide
taatacgactcactatagggtgctccttcctctttaaaacttgattccataacagaggagaatggaaatgagttttaaaaacctggcggcagcgcaaaagatg

SEQ ID NO: 220779 - DNA, 103 bp, Artificial Sequence
  Synthetic Polynucleotide
taatacgactcactataggggaggagagtctgctccttcctctttaaaacaacagaggagagttttaatgaggaaggagaacctggcggcagcgcaaaagatg

SEQ ID NO: 220780 - DNA, 103 bp, Artificial Sequence
  Synthetic Polynucleotide
taatacgactcactatagggtgcattagcagaggagagtctgctccttccaacagaggagaggaaggatgagactctccaacctggcggcagcgcaaaagatg

SEQ ID NO: 220781 - DNA, 103 bp, Artificial Sequence
  Synthetic Polynucleotide
taatacgactcactatagggtaatgttctttgcattagcagaggagagtcaacagaggagagactctatgctgctaatgaacctggcggcagcgcaaaagatg

SEQ ID NO: 220782 - DNA, 103 bp, Artificial Sequence
  Synthetic Polynucleotide
taatacgactcactatagggtacttccagataatgttctttgcattagcaaacagaggagatgctaaatgaaagaacataacctggcggcagcgcaaaagatg

SEQ ID NO: 220783 - DNA, 103 bp, Artificial Sequence
  Synthetic Polynucleotide
taatacgactcactatagggacatccaaaatacttccagataatgttcttaacagaggagaaagaacatgatctggaagaacctggcggcagcgcaaaagatg

SEQ ID NO: 220784 - DNA, 103 bp, Artificial Sequence
  Synthetic Polynucleotide
taatacgactcactatagggaccgctatacacatccaaaatacttccagaaacagaggagatctggaatgattttggataacctggcggcagcgcaaaagatg

SEQ ID NO: 220785 - DNA, 103 bp, Artificial Sequence
  Synthetic Polynucleotide
taatacgactcactatagggttccttgttcaccgctatacacatccaaaaaacagaggagattttggatgtgtatagcgaacctggcggcagcgcaaaagatg

SEQ ID NO: 220786 - DNA, 103 bp, Artificial Sequence
  Synthetic Polynucleotide
taatacgactcactatagggggttgtgaccatttaagagttggattgatgaacagaggagacatcaaatgaactcttaaaacctggcggcagcgcaaaagatg

SEQ ID NO: 220787 - DNA, 103 bp, Artificial Sequence
  Synthetic Polynucleotide
taatacgactcactatagggattggtgaaattccttgttcaccgctatacaacagaggagagtatagatgtgaacaaggaacctggcggcagcgcaaaagatg

SEQ ID NO: 220788 - DNA, 103 bp, Artificial Sequence
  Synthetic Polynucleotide
taatacgactcactatagggccccatgttaattggtgaaattccttgttcaacagaggagagaacaaatgatttcaccaaacctggcggcagcgcaaaagatg

SEQ ID NO: 220789 - DNA, 103 bp, Artificial Sequence
  Synthetic Polynucleotide
taatacgactcactatagggcacttgtaagccccatgttaattggtgaaaaacagaggagatttcacatgttaacatggaacctggcggcagcgcaaaagatg

SEQ ID NO: 220790 - DNA, 103 bp, Artificial Sequence
  Synthetic Polynucleotide
taatacgactcactatagggggacaagaagcacttgtaagccccatgttaaacagaggagataacatatggcttacaagaacctggcggcagcgcaaaagatg

SEQ ID NO: 220791 - DNA, 103 bp, Artificial Sequence
  Synthetic Polynucleotide
taatacgactcactatagggtagactacttggacaagaagcacttgtaagaacagaggagacttacaatggcttcttgtaacctggcggcagcgcaaaagatg

SEQ ID NO: 220792 - DNA, 103 bp, Artificial Sequence
  Synthetic Polynucleotide
taatacgactcactatagggttttcattggtagactacttggacaagaagaacagaggagacttcttatgcaagtagtcaacctggcggcagcgcaaaagatg

SEQ ID NO: 220793 - DNA, 103 bp, Artificial Sequence
  Synthetic Polynucleotide
taatacgactcactataggggtaatttctcttttcattggtagactacttaacagaggagaaagtagatgaccaatgaaaacctggcggcagcgcaaaagatg

SEQ ID NO: 220794 - DNA, 103 bp, Artificial Sequence
  Synthetic Polynucleotide
taatacgactcactataggggtcagtttctgtaatttctcttttcattggaacagaggagaccaatgatgagagaaattaacctggcggcagcgcaaaagatg

SEQ ID NO: 220795 - DNA, 103 bp, Artificial Sequence
  Synthetic Polynucleotide
taatacgactcactatagggaagctctagtgtcagtttctgtaatttctcaacagaggagagagaaaatgcagaaactgaacctggcggcagcgcaaaagatg

SEQ ID NO: 220796 - DNA, 103 bp, Artificial Sequence
  Synthetic Polynucleotide
taatacgactcactatagggtcttttgctaaagctctagtgtcagtttctaacagaggagaagaaacatgcactagagcaacctggcggcagcgcaaaagatg

SEQ ID NO: 220797 - DNA, 103 bp, Artificial Sequence
  Synthetic Polynucleotide
taatacgactcactatagggtggcactgcaggttgtgaccatttaagagtaacagaggagaactcttatgtggtcacaaaacctggcggcagcgcaaaagatg

SEQ ID NO: 220798 - DNA, 103 bp, Artificial Sequence
  Synthetic Polynucleotide
taatacgactcactatagggtttttgtctctcttttgctaaagctctagtaacagaggagaactagaatgttagcaaaaaacctggcggcagcgcaaaagatg

SEQ ID NO: 220799 - DNA, 103 bp, Artificial Sequence
  Synthetic Polynucleotide
taatacgactcactatagggggttgtcctttttttgtctctcttttgctaaacagaggagatagcaaatgagagacaaaaacctggcggcagcgcaaaagatg

SEQ ID NO: 220800 - DNA, 103 bp, Artificial Sequence
  Synthetic Polynucleotide
taatacgactcactatagggatgaggttgtggttgtcctttttttgtctcaacagaggagagagacaatgaaaggacaaaacctggcggcagcgcaaaagatg

SEQ ID NO: 220801 - DNA, 103 bp, Artificial Sequence
  Synthetic Polynucleotide
taatacgactcactatagggtcttctttcaatgaggttgtggttgtccttaacagaggagaaaggacatgcacaacctcaacctggcggcagcgcaaaagatg

SEQ ID NO: 220802 - DNA, 103 bp, Artificial Sequence
  Synthetic Polynucleotide
taatacgactcactatagggtataccttcttcttctttcaatgaggttgtaacagaggagaacaaccatgttgaaagaaaacctggcggcagcgcaaaagatg

SEQ ID NO: 220803 - DNA, 103 bp, Artificial Sequence
  Synthetic Polynucleotide
taatacgactcactatagggtaattaatattataccttcttcttctttcaaacagaggagatgaaagatgaagaaggtaaacctggcggcagcgcaaaagatg

SEQ ID NO: 220804 - DNA, 103 bp, Artificial Sequence
  Synthetic Polynucleotide
taatacgactcactatagggcttgattcggtaattaatattataccttctaacagaggagaagaaggatgaatattaataacctggcggcagcgcaaaagatg

SEQ ID NO: 220805 - DNA, 103 bp, Artificial Sequence
  Synthetic Polynucleotide
taatacgactcactatagggtgccaagctccttgattcggtaattaatataacagaggagaatattaatgaccgaatcaaacctggcggcagcgcaaaagatg

SEQ ID NO: 220806 - DNA, 103 bp, Artificial Sequence
  Synthetic Polynucleotide
taatacgactcactatagggggaataagagtgccaagctccttgattcggaacagaggagaccgaatatgggagcttggaacctggcggcagcgcaaaagatg

SEQ ID NO: 220807 - DNA, 103 bp, Artificial Sequence
  Synthetic Polynucleotide
taatacgactcactatagggattagactttggaataagagtgccaagctcaacagaggagagagcttatgactcttattaacctggcggcagcgcaaaagatg

SEQ ID NO: 220808 - DNA, 103 bp, Artificial Sequence
  Synthetic Polynucleotide
taatacgactcactataggggcccaccacttggcactgcaggttgtgaccaacagaggagaggtcacatgctgcagtgcaacctggcggcagcgcaaaagatg

SEQ ID NO: 220809 - DNA, 103 bp, Artificial Sequence
  Synthetic Polynucleotide
taatacgactcactatagggtatcaggatcattagactttggaataagagaacagaggagactcttaatgcaaagtctaaacctggcggcagcgcaaaagatg

SEQ ID NO: 220810 - DNA, 103 bp, Artificial Sequence
  Synthetic Polynucleotide
taatacgactcactatagggttccagcgcatatcaggatcattagactttaacagaggagaaaagtcatgtgatcctgaaacctggcggcagcgcaaaagatg

SEQ ID NO: 220811 - DNA, 103 bp, Artificial Sequence
  Synthetic Polynucleotide
taatacgactcactatagggggttcctttgttccagcgcatatcaggatcaacagaggagagatcctatgatgcgctggaacctggcggcagcgcaaaagatg

SEQ ID NO: 220812 - DNA, 103 bp, Artificial Sequence
  Synthetic Polynucleotide
taatacgactcactatagggcttttagaatggttcctttgttccagcgcaaacagaggagatgcgctatgacaaaggaaaacctggcggcagcgcaaaagatg

SEQ ID NO: 220813 - DNA, 103 bp, Artificial Sequence
  Synthetic Polynucleotide
taatacgactcactatagggtccactgatgcttttagaatggttcctttgaacagaggagacaaaggatgcattctaaaaacctggcggcagcgcaaaagatg

SEQ ID NO: 220814 - DNA, 103 bp, Artificial Sequence
  Synthetic Polynucleotide
taatacgactcactatagggcttgatgtactccactgatgcttttagaataacagaggagaattctaatggcatcagtgaacctggcggcagcgcaaaagatg

SEQ ID NO: 220815 - DNA, 103 bp, Artificial Sequence
  Synthetic Polynucleotide
taatacgactcactatagggtttgtagccacttgatgtactccactgatgaacagaggagacatcagatgagtacatcaaacctggcggcagcgcaaaagatg

SEQ ID NO: 220816 - DNA, 103 bp, Artificial Sequence
  Synthetic Polynucleotide
taatacgactcactatagggtgttgttctttttgtagccacttgatgtacaacagaggagagtacatatggtggctacaaacctggcggcagcgcaaaagatg

SEQ ID NO: 220817 - DNA, 103 bp, Artificial Sequence
  Synthetic Polynucleotide
taatacgactcactatagggtcgggctctctgttgttctttttgtagccaaacagaggagatggctaatgaaagaacaaaacctggcggcagcgcaaaagatg

SEQ ID NO: 220818 - DNA, 103 bp, Artificial Sequence
  Synthetic Polynucleotide
taatacgactcactataggggttccaattctcgggctctctgttgttcttaacagaggagaaagaacatgagagagcccaacctggcggcagcgcaaaagatg

SEQ ID NO: 220819 - DNA, 103 bp, Artificial Sequence
  Synthetic Polynucleotide
taatacgactcactatagggtgcacaagaggcccaccacttggcactgcaaacagaggagatgcagtatgaagtggtggaacctggcggcagcgcaaaagatg

SEQ ID NO: 220820 - DNA, 103 bp, Artificial Sequence
  Synthetic Polynucleotide
taatacgactcactatagggttctgtctgtgttccaattctcgggctctcaacagaggagagagagcatgagaattggaaacctggcggcagcgcaaaagatg

SEQ ID NO: 220821 - DNA, 103 bp, Artificial Sequence
  Synthetic Polynucleotide
taatacgactcactatagggctctaatttcttctgtctgtgttccaattcaacagaggagagaattgatgcacagacagaacctggcggcagcgcaaaagatg

SEQ ID NO: 220822 - DNA, 103 bp, Artificial Sequence
  Synthetic Polynucleotide
taatacgactcactatagggtgttagcctgctctaatttcttctgtctgtaacagaggagaacagacatgagaaattagaacctggcggcagcgcaaaagatg

SEQ ID NO: 220823 - DNA, 103 bp, Artificial Sequence
  Synthetic Polynucleotide
taatacgactcactatagggagaagtcgcctgttagcctgctctaatttcaacagaggagagaaattatggcaggctaaaacctggcggcagcgcaaaagatg

SEQ ID NO: 220824 - DNA, 103 bp, Artificial Sequence
  Synthetic Polynucleotide
taatacgactcactatagggaatccgaagtagaagtcgcctgttagcctgaacagaggagacaggctatgaggcgacttaacctggcggcagcgcaaaagatg

SEQ ID NO: 220825 - DNA, 103 bp, Artificial Sequence
  Synthetic Polynucleotide
taatacgactcactatagggctagttcctgaatccgaagtagaagtcgccaacagaggagaggcgacatgtacttcggaaacctggcggcagcgcaaaagatg

SEQ ID NO: 220826 - DNA, 103 bp, Artificial Sequence
  Synthetic Polynucleotide
taatacgactcactataggggcctgaatttctagttcctgaatccgaagtaacagaggagaacttcgatgtcaggaactaacctggcggcagcgcaaaagatg

SEQ ID NO: 220827 - DNA, 103 bp, Artificial Sequence
  Synthetic Polynucleotide
taatacgactcactatagggatgagtacgagcctgaatttctagttcctgaacagaggagacaggaaatggaaattcagaacctggcggcagcgcaaaagatg

SEQ ID NO: 220828 - DNA, 103 bp, Artificial Sequence
  Synthetic Polynucleotide
taatacgactcactatagggttggcagaccatgagtacgagcctgaatttaacagaggagaaaattcatgctcgtactcaacctggcggcagcgcaaaagatg

SEQ ID NO: 220829 - DNA, 103 bp, Artificial Sequence
  Synthetic Polynucleotide
taatacgactcactataggggaagccagggttggcagaccatgagtacgaaacagaggagatcgtacatgtggtctgccaacctggcggcagcgcaaaagatg

SEQ ID NO: 220830 - DNA, 103 bp, Artificial Sequence
  Synthetic Polynucleotide
taatacgactcactataggggtgtgcatgctgcacaagaggcccaccactaacagaggagaagtggtatgcctcttgtgaacctggcggcagcgcaaaagatg

SEQ ID NO: 220831 - DNA, 103 bp, Artificial Sequence
  Synthetic Polynucleotide
taatacgactcactatagggcgtgccaagtgaagccagggttggcagaccaacagaggagaggtctgatgaccctggctaacctggcggcagcgcaaaagatg

SEQ ID NO: 220832 - DNA, 103 bp, Artificial Sequence
  Synthetic Polynucleotide
taatacgactcactatagggctaaatcaaccgtgccaagtgaagccagggaacagaggagaccctggatgcacttggcaaacctggcggcagcgcaaaagatg

SEQ ID NO: 220833 - DNA, 103 bp, Artificial Sequence
  Synthetic Polynucleotide
taatacgactcactatagggacatgagcacctaaatcaaccgtgccaagtaacagaggagaacttggatgggttgatttaacctggcggcagcgcaaaagatg

SEQ ID NO: 220834 - DNA, 103 bp, Artificial Sequence
  Synthetic Polynucleotide
taatacgactcactatagggctgtttggtgacatgagcacctaaatcaacaacagaggagagttgatatgggtgctcataacctggcggcagcgcaaaagatg

SEQ ID NO: 220835 - DNA, 103 bp, Artificial Sequence
  Synthetic Polynucleotide
taatacgactcactataggggatggctctgctgtttggtgacatgagcacaacagaggagagtgctcatgtcaccaaacaacctggcggcagcgcaaaagatg

SEQ ID NO: 220836 - DNA, 103 bp, Artificial Sequence
  Synthetic Polynucleotide
taatacgactcactatagggttctgctcaggatggctctgctgtttggtgaacagaggagacaccaaatggcagagccaaacctggcggcagcgcaaaagatg

SEQ ID NO: 220837 - DNA, 103 bp, Artificial Sequence
  Synthetic Polynucleotide
taatacgactcactataggggtctactgaattctgctcaggatggctctgaacagaggagacagagcatgcctgagcagaacctggcggcagcgcaaaagatg

SEQ ID NO: 220838 - DNA, 103 bp, Artificial Sequence
  Synthetic Polynucleotide
taatacgactcactataggggttggcaatagtctactgaattctgctcagaacagaggagactgagcatgattcagtagaacctggcggcagcgcaaaagatg

SEQ ID NO: 220839 - DNA, 103 bp, Artificial Sequence
  Synthetic Polynucleotide
taatacgactcactatagggacagtcagttgttggcaatagtctactgaaaacagaggagattcagtatgctattgccaaacctggcggcagcgcaaaagatg

SEQ ID NO: 220840 - DNA, 103 bp, Artificial Sequence
  Synthetic Polynucleotide
taatacgactcactatagggcccctgagacacagtcagttgttggcaataaacagaggagatattgcatgcaactgactaacctggcggcagcgcaaaagatg

SEQ ID NO: 220841 - DNA, 103 bp, Artificial Sequence
  Synthetic Polynucleotide
taatacgactcactatagggccagagttgtgtgtgcatgctgcacaagagaacagaggagactcttgatgagcatgcacaacctggcggcagcgcaaaagatg

SEQ ID NO: 220842 - DNA, 103 bp, Artificial Sequence
  Synthetic Polynucleotide
taatacgactcactatagggcagggcttggcccctgagacacagtcagttaacagaggagaaactgaatgtgtctcaggaacctggcggcagcgcaaaagatg

SEQ ID NO: 220843 - DNA, 103 bp, Artificial Sequence
  Synthetic Polynucleotide
taatacgactcactatagggtcacagagctcagggcttggcccctgagacaacagaggagagtctcaatggccaagcccaacctggcggcagcgcaaaagatg

SEQ ID NO: 220844 - DNA, 103 bp, Artificial Sequence
  Synthetic Polynucleotide
taatacgactcactatagggtatagcttgatcacagagctcagggcttggaacagaggagaccaagcatggagctctgtaacctggcggcagcgcaaaagatg

SEQ ID NO: 220845 - DNA, 103 bp, Artificial Sequence
  Synthetic Polynucleotide
taatacgactcactatagggcagaaaaggctatagcttgatcacagagctaacagaggagaagctctatgatcaagctaaacctggcggcagcgcaaaagatg

SEQ ID NO: 220846 - DNA, 103 bp, Artificial Sequence
  Synthetic Polynucleotide
taatacgactcactataggggacaaaggatcagaaaaggctatagcttgaaacagaggagatcaagcatgagccttttcaacctggcggcagcgcaaaagatg

SEQ ID NO: 220847 - DNA, 103 bp, Artificial Sequence
  Synthetic Polynucleotide
taatacgactcactatagggtgtgaagtatgacaaaggatcagaaaaggcaacagaggagagcctttatggatcctttgaacctggcggcagcgcaaaagatg

SEQ ID NO: 220848 - DNA, 103 bp, Artificial Sequence
  Synthetic Polynucleotide
taatacgactcactatagggatgataaatctgtgaagtatgacaaaggataacagaggagaatccttatgcatacttcaaacctggcggcagcgcaaaagatg

SEQ ID NO: 220849 - DNA, 103 bp, Artificial Sequence
  Synthetic Polynucleotide
taatacgactcactataggggcagcactaaatgataaatctgtgaagtataacagaggagaatacttatgagatttatcaacctggcggcagcgcaaaagatg

SEQ ID NO: 220850 - DNA, 103 bp, Artificial Sequence
  Synthetic Polynucleotide
taatacgactcactatagggctctttcaatgcagcactaaatgataaatcaacagaggagagatttaatgtttagtgctaacctggcggcagcgcaaaagatg

SEQ ID NO: 220851 - DNA, 103 bp, Artificial Sequence
  Synthetic Polynucleotide
taatacgactcactatagggatctttgttcctctttcaatgcagcactaaaacagaggagattagtgatgcattgaaagaacctggcggcagcgcaaaagatg

SEQ ID NO: 220852 - DNA, 103 bp, Artificial Sequence
  Synthetic Polynucleotide
taatacgactcactataggggcatcactgtccagagttgtgtgtgcatgcaacagaggagagcatgcatgcacaactctaacctggcggcagcgcaaaagatg

SEQ ID NO: 220853 - DNA, 103 bp, Artificial Sequence
  Synthetic Polynucleotide
taatacgactcactatagggatgccatccaatctttgttcctctttcaataacagaggagaattgaaatgggaacaaagaacctggcggcagcgcaaaagatg

SEQ ID NO: 220854 - DNA, 103 bp, Artificial Sequence
  Synthetic Polynucleotide
taatacgactcactatagggatccaatagcatgccatccaatctttgttcaacagaggagagaacaaatgttggatggcaacctggcggcagcgcaaaagatg

SEQ ID NO: 220855 - DNA, 103 bp, Artificial Sequence
  Synthetic Polynucleotide
taatacgactcactatagggagattgtgtcatccaatagcatgccatccaaacagaggagatggatgatgtgctattggaacctggcggcagcgcaaaagatg

SEQ ID NO: 220856 - DNA, 103 bp, Artificial Sequence
  Synthetic Polynucleotide
taatacgactcactatagggccaaatggagagattgtgtcatccaatagcaacagaggagagctattatgtgacacaataacctggcggcagcgcaaaagatg

SEQ ID NO: 220857 - DNA, 103 bp, Artificial Sequence
  Synthetic Polynucleotide
taatacgactcactatagggaggatctgttccaaatggagagattgtgtcaacagaggagagacacaatgtctccatttaacctggcggcagcgcaaaagatg

SEQ ID NO: 220858 - DNA, 103 bp, Artificial Sequence
  Synthetic Polynucleotide
taatacgactcactatagggcagatagcagaggatctgttccaaatggagaacagaggagactccatatggaacagatcaacctggcggcagcgcaaaagatg

SEQ ID NO: 220859 - DNA, 103 bp, Artificial Sequence
  Synthetic Polynucleotide
taatacgactcactatagggggggaagtggcagatagcagaggatctgttaacagaggagaaacagaatgtctgctatcaacctggcggcagcgcaaaagatg

SEQ ID NO: 220860 - DNA, 103 bp, Artificial Sequence
  Synthetic Polynucleotide
taatacgactcactatagggggaaactgcaggggaagtggcagatagcagaacagaggagactgctaatggccacttccaacctggcggcagcgcaaaagatg

SEQ ID NO: 220861 - DNA, 103 bp, Artificial Sequence
  Synthetic Polynucleotide
taatacgactcactatagggtgctttctttggaaactgcaggggaagtggaacagaggagaccacttatgctgcagtttaacctggcggcagcgcaaaagatg

SEQ ID NO: 220862 - DNA, 103 bp, Artificial Sequence
  Synthetic Polynucleotide
taatacgactcactatagggcttctcctactgctttctttggaaactgcaaacagaggagatgcagtatgcaaagaaagaacctggcggcagcgcaaaagatg

SEQ ID NO: 220863 - DNA, 103 bp, Artificial Sequence
  Synthetic Polynucleotide
taatacgactcactatagggggcagacacccggctctgcgctagaaccataacagaggagaatggttatggcgcagagcaacctggcggcagcgcaaaagatg

SEQ ID NO: 220864 - DNA, 103 bp, Artificial Sequence
  Synthetic Polynucleotide
taatacgactcactataggggcactggggattcccggggtgggaggcgggaacagaggagacccgccatgcaccccgggaacctggcggcagcgcaaaagatg

SEQ ID NO: 220865 - DNA, 103 bp, Artificial Sequence
  Synthetic Polynucleotide
taatacgactcactatagggggtgtctgtgaagtttttggccgctatctgaacagaggagacagataatggccaaaaacaacctggcggcagcgcaaaagatg

SEQ ID NO: 220866 - DNA, 103 bp, Artificial Sequence
  Synthetic Polynucleotide
taatacgactcactatagggacatgagagaggtgtctgtgaagtttttggaacagaggagaccaaaaatgtcacagacaaacctggcggcagcgcaaaagatg

SEQ ID NO: 220867 - DNA, 103 bp, Artificial Sequence
  Synthetic Polynucleotide
taatacgactcactatagggtcctctgggtacatgagagaggtgtctgtgaacagaggagacacagaatgctctctcataacctggcggcagcgcaaaagatg

SEQ ID NO: 220868 - DNA, 103 bp, Artificial Sequence
  Synthetic Polynucleotide
taatacgactcactatagggtttacaagtgtcctctgggtacatgagagaaacagaggagatctctcatgtacccagagaacctggcggcagcgcaaaagatg

SEQ ID NO: 220869 - DNA, 103 bp, Artificial Sequence
  Synthetic Polynucleotide
taatacgactcactatagggttggtccagatttacaagtgtcctctgggtaacagaggagaacccagatgacacttgtaaacctggcggcagcgcaaaagatg

SEQ ID NO: 220870 - DNA, 103 bp, Artificial Sequence
  Synthetic Polynucleotide
taatacgactcactataggggtattcgtacttggtccagatttacaagtgaacagaggagacacttgatgatctggaccaacctggcggcagcgcaaaagatg

SEQ ID NO: 220871 - DNA, 103 bp, Artificial Sequence
  Synthetic Polynucleotide
taatacgactcactatagggaccactctgtgtattcgtacttggtccagaaacagaggagatctggaatgagtacgaataacctggcggcagcgcaaaagatg

SEQ ID NO: 220872 - DNA, 103 bp, Artificial Sequence
  Synthetic Polynucleotide
taatacgactcactatagggtgttgaaaagaccactctgtgtattcgtacaacagaggagagtacgaatgcacagagtgaacctggcggcagcgcaaaagatg

SEQ ID NO: 220873 - DNA, 103 bp, Artificial Sequence
  Synthetic Polynucleotide
taatacgactcactataggggggggaggagtgttgaaaagaccactctgtaacagaggagaacagagatgtcttttcaaaacctggcggcagcgcaaaagatg

SEQ ID NO: 220874 - DNA, 103 bp, Artificial Sequence
  Synthetic Polynucleotide
taatacgactcactatagggcggtggagtagggggaggagtgttgaaaagaacagaggagacttttcatgactcctcccaacctggcggcagcgcaaaagatg

SEQ ID NO: 220875 - DNA, 103 bp, Artificial Sequence
  Synthetic Polynucleotide
taatacgactcactatagggtggaaaaggagcactggggattcccggggtaacagaggagaaccccgatgatccccagtaacctggcggcagcgcaaaagatg

SEQ ID NO: 220876 - DNA, 103 bp, Artificial Sequence
  Synthetic Polynucleotide
taatacgactcactatagggggttgaggtccggtggagtagggggaggagaacagaggagactcctcatgctactccacaacctggcggcagcgcaaaagatg

SEQ ID NO: 220877 - DNA, 103 bp, Artificial Sequence
  Synthetic Polynucleotide
taatacgactcactatagggctgaagtcctggttgaggtccggtggagtaaacagaggagatactccatgggacctcaaaacctggcggcagcgcaaaagatg

SEQ ID NO: 220878 - DNA, 103 bp, Artificial Sequence
  Synthetic Polynucleotide
taatacgactcactatagggctgaaatccactgaagtcctggttgaggtcaacagaggagagacctcatgcaggacttcaacctggcggcagcgcaaaagatg

SEQ ID NO: 220879 - DNA, 103 bp, Artificial Sequence
  Synthetic Polynucleotide
taatacgactcactatagggccactagaagctgaaatccactgaagtcctaacagaggagaaggactatggtggatttcaacctggcggcagcgcaaaagatg

SEQ ID NO: 220880 - DNA, 103 bp, Artificial Sequence
  Synthetic Polynucleotide
taatacgactcactatagggagtgcaacatccactagaagctgaaatccaaacagaggagatggattatggcttctagtaacctggcggcagcgcaaaagatg

SEQ ID NO: 220881 - DNA, 103 bp, Artificial Sequence
  Synthetic Polynucleotide
taatacgactcactatagggagcccgtttgagtgcaacatccactagaagaacagaggagacttctaatggatgttgcaaacctggcggcagcgcaaaagatg

SEQ ID NO: 220882 - DNA, 103 bp, Artificial Sequence
  Synthetic Polynucleotide
taatacgactcactatagggccatctctgcagcccgtttgagtgcaacataacagaggagaatgttgatgtcaaacgggaacctggcggcagcgcaaaagatg

SEQ ID NO: 220883 - DNA, 103 bp, Artificial Sequence
  Synthetic Polynucleotide
taatacgactcactataggggcctgaagctccatctctgcagcccgtttgaacagaggagacaaacgatgtgcagagataacctggcggcagcgcaaaagatg

SEQ ID NO: 220884 - DNA, 103 bp, Artificial Sequence
  Synthetic Polynucleotide
taatacgactcactatagggtgtaagttttgcctgaagctccatctctgcaacagaggagagcagagatggagcttcagaacctggcggcagcgcaaaagatg

SEQ ID NO: 220885 - DNA, 103 bp, Artificial Sequence
  Synthetic Polynucleotide
taatacgactcactatagggagaaaagccgtggaaaaggagcactggggaaacagaggagatccccaatgctccttttcaacctggcggcagcgcaaaagatg

SEQ ID NO: 220886 - DNA, 103 bp, Artificial Sequence
  Synthetic Polynucleotide
taatacgactcactataggggggggacgccagaaaagccgtggaaaaggaaacagaggagatcctttatgacggcttttaacctggcggcagcgcaaaagatg

SEQ ID NO: 220887 - DNA, 103 bp, Artificial Sequence
  Synthetic Polynucleotide
taatacgactcactataggggggagagtcggggggacgccagaaaagccgaacagaggagacggcttatgtggcgtcccaacctggcggcagcgcaaaagatg

SEQ ID NO: 220888 - DNA, 103 bp, Artificial Sequence
  Synthetic Polynucleotide
taatacgactcactatagggaaagtgccgcgggagagtcggggggacgccaacagaggagaggcgtcatgccgactctcaacctggcggcagcgcaaaagatg

SEQ ID NO: 220889 - DNA, 103 bp, Artificial Sequence
  Synthetic Polynucleotide
taatacgactcactatagggaaggtaggccaaagtgccgcgggagagtcgaacagaggagacgactcatgcgcggcactaacctggcggcagcgcaaaagatg

SEQ ID NO: 220890 - DNA, 103 bp, Artificial Sequence
  Synthetic Polynucleotide
taatacgactcactataggggcgctgggggaaggtaggccaaagtgccgcaacagaggagagcggcaatgtggcctaccaacctggcggcagcgcaaaagatg

SEQ ID NO: 220891 - DNA, 103 bp, Artificial Sequence
  Synthetic Polynucleotide
taatacgactcactataggggaggaccacggcgctgggggaaggtaggccaacagaggagaggcctaatgtcccccagcaacctggcggcagcgcaaaagatg

SEQ ID NO: 220892 - DNA, 103 bp, Artificial Sequence
  Synthetic Polynucleotide
taatacgactcactatagggggtcgccagggaggaccacggcgctgggggaacagaggagacccccaatgccgtggtccaacctggcggcagcgcaaaagatg

SEQ ID NO: 220893 - DNA, 103 bp, Artificial Sequence
  Synthetic Polynucleotide
taatacgactcactatagggagcccaccccggcagacacccggctctgcgaacagaggagacgcagaatggggtgtctgaacctggcggcagcgcaaaagatg

SEQ ID NO: 220894 - DNA, 103 bp, Artificial Sequence
  Synthetic Polynucleotide
taatacgactcactataggggcgcagagggggtcgccagggaggaccacgaacagaggagacgtggtatgccctggcgaaacctggcggcagcgcaaaagatg

SEQ ID NO: 220895 - DNA, 103 bp, Artificial Sequence
  Synthetic Polynucleotide
taatacgactcactataggggaccccaggagcgcagagggggtcgccaggaacagaggagacctggcatgcccctctgcaacctggcggcagcgcaaaagatg

SEQ ID NO: 220896 - DNA, 103 bp, Artificial Sequence
  Synthetic Polynucleotide
taatacgactcactatagggggcgcaggaggaccccaggagcgcagagggaacagaggagaccctctatgctcctggggaacctggcggcagcgcaaaagatg

SEQ ID NO: 220897 - DNA, 103 bp, Artificial Sequence
  Synthetic Polynucleotide
taatacgactcactataggggaggagggggggcgcaggaggaccccaggaaacagaggagatcctggatgcctcctgcgaacctggcggcagcgcaaaagatg

SEQ ID NO: 220898 - DNA, 103 bp, Artificial Sequence
  Synthetic Polynucleotide
taatacgactcactatagggcgcgccggtggaggagggggggcgcaggagaacagaggagactcctgatgcccccctccaacctggcggcagcgcaaaagatg

SEQ ID NO: 220899 - DNA, 103 bp, Artificial Sequence
  Synthetic Polynucleotide
taatacgactcactatagggctgtgggcagcgcgccggtggaggagggggaacagaggagaccccctatgccaccggcgaacctggcggcagcgcaaaagatg

SEQ ID NO: 220900 - DNA, 103 bp, Artificial Sequence
  Synthetic Polynucleotide
taatacgactcactataggggggcacgcggctgtgggcagcgcgccggtgaacagaggagacaccggatggctgcccacaacctggcggcagcgcaaaagatg

SEQ ID NO: 220901 - DNA, 103 bp, Artificial Sequence
  Synthetic Polynucleotide
taatacgactcactatagggtccggggagagggcacgcggctgtgggcagaacagaggagactgcccatggccgcgtgcaacctggcggcagcgcaaaagatg

SEQ ID NO: 220902 - DNA, 103 bp, Artificial Sequence
  Synthetic Polynucleotide
taatacgactcactatagggggtccccagctccggggagagggcacgcggaacagaggagaccgcgtatgctctccccgaacctggcggcagcgcaaaagatg

SEQ ID NO: 220903 - DNA, 103 bp, Artificial Sequence
  Synthetic Polynucleotide
taatacgactcactataggggcccagccttggtccccagctccggggagaaacagaggagatctcccatgagctggggaaacctggcggcagcgcaaaagatg

SEQ ID NO: 220904 - DNA, 103 bp, Artificial Sequence
  Synthetic Polynucleotide
taatacgactcactatagggcaatgcggggagcccaccccggcagacaccaacagaggagaggtgtcatgcggggtgggaacctggcggcagcgcaaaagatg

SEQ ID NO: 220905 - DNA, 103 bp, Artificial Sequence
  Synthetic Polynucleotide
taatacgactcactatagggggccggcggggcccagccttggtccccagcaacagaggagagctgggatgcaaggctggaacctggcggcagcgcaaaagatg

SEQ ID NO: 220906 - DNA, 103 bp, Artificial Sequence
  Synthetic Polynucleotide
taatacgactcactatagggccaccgatgcggccggcggggcccagccttaacagaggagaaaggctatgccccgccggaacctggcggcagcgcaaaagatg

SEQ ID NO: 220907 - DNA, 103 bp, Artificial Sequence
  Synthetic Polynucleotide
taatacgactcactataggggcggaagttcccaccgatgcggccggcgggaacagaggagacccgccatgcgcatcggtaacctggcggcagcgcaaaagatg

SEQ ID NO: 220908 - DNA, 103 bp, Artificial Sequence
  Synthetic Polynucleotide
taatacgactcactataggggatggggaccgcggaagttcccaccgatgcaacagaggagagcatcgatgggaacttccaacctggcggcagcgcaaaagatg

SEQ ID NO: 220909 - DNA, 103 bp, Artificial Sequence
  Synthetic Polynucleotide
taatacgactcactatagggtgcgccctgggatggggaccgcggaagttcaacagaggagagaacttatgcggtccccaaacctggcggcagcgcaaaagatg

SEQ ID NO: 220910 - DNA, 103 bp, Artificial Sequence
  Synthetic Polynucleotide
taatacgactcactatagggctggaccctgtgcgccctgggatggggaccaacagaggagaggtcccatgcccagggcgaacctggcggcagcgcaaaagatg

SEQ ID NO: 220911 - DNA, 103 bp, Artificial Sequence
  Synthetic Polynucleotide
taatacgactcactatagggcgccgaggagctggaccctgtgcgccctggaacagaggagaccagggatgacagggtccaacctggcggcagcgcaaaagatg

SEQ ID NO: 220912 - DNA, 103 bp, Artificial Sequence
  Synthetic Polynucleotide
taatacgactcactatagggcaggagtcggcgccgaggagctggaccctgaacagaggagacagggtatggctcctcggaacctggcggcagcgcaaaagatg

SEQ ID NO: 220913 - DNA, 103 bp, Artificial Sequence
  Synthetic Polynucleotide
taatacgactcactatagggtcattgtttccaggagtcggcgccgaggagaacagaggagactcctcatggccgactccaacctggcggcagcgcaaaagatg

SEQ ID NO: 220914 - DNA, 103 bp, Artificial Sequence
  Synthetic Polynucleotide
taatacgactcactatagggacaatacctttcattgtttccaggagtcggaacagaggagaccgactatgggaaacaataacctggcggcagcgcaaaagatg

SEQ ID NO: 220915 - DNA, 103 bp, Artificial Sequence
  Synthetic Polynucleotide
taatacgactcactatagggggagcccgaacaatgcggggagcccaccccaacagaggagaggggtgatgtccccgcataacctggcggcagcgcaaaagatg

SEQ ID NO: 220916 - DNA, 103 bp, Artificial Sequence
  Synthetic Polynucleotide
taatacgactcactatagggagatgctgcaacaatacctttcattgtttcaacagaggagagaaacaatgaaaggtattaacctggcggcagcgcaaaagatg

SEQ ID NO: 220917 - DNA, 103 bp, Artificial Sequence
  Synthetic Polynucleotide
taatacgactcactatagggtctcactgccagatgctgcaacaataccttaacagaggagaaaggtaatgttgcagcataacctggcggcagcgcaaaagatg

SEQ ID NO: 220918 - DNA, 103 bp, Artificial Sequence
  Synthetic Polynucleotide
taatacgactcactatagggtcatcctcagtctcactgccagatgctgcaaacagaggagatgcagcatgtggcagtgaaacctggcggcagcgcaaaagatg

SEQ ID NO: 220919 - DNA, 103 bp, Artificial Sequence
  Synthetic Polynucleotide
taatacgactcactatagggcatgctgtcctcatcctcagtctcactgccaacagaggagaggcagtatgactgaggataacctggcggcagcgcaaaagatg

SEQ ID NO: 220920 - DNA, 103 bp, Artificial Sequence
  Synthetic Polynucleotide
taatacgactcactatagggagggaatgtccatgctgtcctcatcctcagaacagaggagactgaggatgaggacagcaaacctggcggcagcgcaaaagatg

SEQ ID NO: 220921 - DNA, 103 bp, Artificial Sequence
  Synthetic Polynucleotide
taatacgactcactataggggaaaggtccaagggaatgtccatgctgtccaacagaggagaggacagatgggacattccaacctggcggcagcgcaaaagatg

SEQ ID NO: 220922 - DNA, 103 bp, Artificial Sequence
  Synthetic Polynucleotide
taatacgactcactatagggagcggatgaagaaaggtccaagggaatgtcaacagaggagagacattatgttggaccttaacctggcggcagcgcaaaagatg

SEQ ID NO: 220923 - DNA, 103 bp, Artificial Sequence
  Synthetic Polynucleotide
taatacgactcactatagggtgcctgagccagcggatgaagaaaggtccaaacagaggagatggaccatgcttcatccgaacctggcggcagcgcaaaagatg

SEQ ID NO: 220924 - DNA, 103 bp, Artificial Sequence
  Synthetic Polynucleotide
taatacgactcactatagggctccttctcttgcctgagccagcggatgaaaacagaggagattcatcatgtggctcaggaacctggcggcagcgcaaaagatg

SEQ ID NO: 220925 - DNA, 103 bp, Artificial Sequence
  Synthetic Polynucleotide
taatacgactcactataggggttgccccttctccttctcttgcctgagccaacagaggagaggctcaatgaagagaaggaacctggcggcagcgcaaaagatg

SEQ ID NO: 220926 - DNA, 103 bp, Artificial Sequence
  Synthetic Polynucleotide
taatacgactcactatagggcgcccccgccggagcccgaacaatgcggggaacagaggagaccccgcatggttcgggctaacctggcggcagcgcaaaagatg

SEQ ID NO: 220927 - DNA, 103 bp, Artificial Sequence
  Synthetic Polynucleotide
taatacgactcactatagggccttgggtaggttgccccttctccttctctaacagaggagaagagaaatggaaggggcaaacctggcggcagcgcaaaagatg

SEQ ID NO: 220928 - DNA, 103 bp, Artificial Sequence
  Synthetic Polynucleotide
taatacgactcactatagggtgcacagactccttgggtaggttgccccttaacagaggagaaaggggatgcctacccaaaacctggcggcagcgcaaaagatg

SEQ ID NO: 220929 - DNA, 103 bp, Artificial Sequence
  Synthetic Polynucleotide
taatacgactcactatagggccgaagaatctgcacagactccttgggtagaacagaggagactacccatggagtctgtgaacctggcggcagcgcaaaagatg

SEQ ID NO: 220930 - DNA, 103 bp, Artificial Sequence
  Synthetic Polynucleotide
taatacgactcactatagggacagccaatcccgaagaatctgcacagactaacagaggagaagtctgatgagattcttcaacctggcggcagcgcaaaagatg

SEQ ID NO: 220931 - DNA, 103 bp, Artificial Sequence
  Synthetic Polynucleotide
taatacgactcactatagggcggtgctcatacagccaatcccgaagaatcaacagaggagagattctatgggattggctaacctggcggcagcgcaaaagatg

SEQ ID NO: 220932 - DNA, 103 bp, Artificial Sequence
  Synthetic Polynucleotide
taatacgactcactatagggggcattgtaacggtgctcatacagccaatcaacagaggagagattggatgtatgagcacaacctggcggcagcgcaaaagatg

SEQ ID NO: 220933 - DNA, 103 bp, Artificial Sequence
  Synthetic Polynucleotide
taatacgactcactatagggctgaaggataggcattgtaacggtgctcataacagaggagaatgagcatggttacaatgaacctggcggcagcgcaaaagatg

SEQ ID NO: 220934 - DNA, 103 bp, Artificial Sequence
  Synthetic Polynucleotide
taatacgactcactatagggttttcttgctctgaaggataggcattgtaaaacagaggagattacaaatgctatccttcaacctggcggcagcgcaaaagatg

SEQ ID NO: 220935 - DNA, 103 bp, Artificial Sequence
  Synthetic Polynucleotide
taatacgactcactatagggcagcaacgctttttcttgctctgaaggataaacagaggagatatcctatggagcaagaaaacctggcggcagcgcaaaagatg

SEQ ID NO: 220936 - DNA, 103 bp, Artificial Sequence
  Synthetic Polynucleotide
taatacgactcactatagggtttgctgggacagcaacgctttttcttgctaacagaggagaagcaagatgaagcgttgcaacctggcggcagcgcaaaagatg

SEQ ID NO: 220937 - DNA, 103 bp, Artificial Sequence
  Synthetic Polynucleotide
taatacgactcactataggggaatcagagccgcccccgccggagcccgaaaacagaggagattcgggatgcggcgggggaacctggcggcagcgcaaaagatg

SEQ ID NO: 220938 - DNA, 103 bp, Artificial Sequence
  Synthetic Polynucleotide
taatacgactcactataggggacaggtgtgtttgctgggacagcaacgctaacagaggagaagcgttatggtcccagcaaacctggcggcagcgcaaaagatg

SEQ ID NO: 220939 - DNA, 103 bp, Artificial Sequence
  Synthetic Polynucleotide
taatacgactcactatagggctgtagcgtagacaggtgtgtttgctgggaaacagaggagatcccagatgacacacctgaacctggcggcagcgcaaaagatg

SEQ ID NO: 220940 - DNA, 103 bp, Artificial Sequence
  Synthetic Polynucleotide
taatacgactcactatagggagttacagacctgtagcgtagacaggtgtgaacagaggagacacaccatgctacgctacaacctggcggcagcgcaaaagatg

SEQ ID NO: 220941 - DNA, 103 bp, Artificial Sequence
  Synthetic Polynucleotide
taatacgactcactatagggttgatgaaccagttacagacctgtagcgtaaacagaggagatacgctatgggtctgtaaaacctggcggcagcgcaaaagatg

SEQ ID NO: 220942 - DNA, 103 bp, Artificial Sequence
  Synthetic Polynucleotide
taatacgactcactataggggcggcgggcgttgatgaaccagttacagacaacagaggagagtctgtatgtggttcatcaacctggcggcagcgcaaaagatg

SEQ ID NO: 220943 - DNA, 103 bp, Artificial Sequence
  Synthetic Polynucleotide
taatacgactcactatagggggaggagcctgcggcgggcgttgatgaaccaacagaggagaggttcaatgacgcccgccaacctggcggcagcgcaaaagatg

SEQ ID NO: 220944 - DNA, 103 bp, Artificial Sequence
  Synthetic Polynucleotide
taatacgactcactatagggagcatgtcagggaggagcctgcggcgggcgaacagaggagacgcccgatgcaggctcctaacctggcggcagcgcaaaagatg

SEQ ID NO: 220945 - DNA, 103 bp, Artificial Sequence
  Synthetic Polynucleotide
taatacgactcactatagggatcctttctcagcatgtcagggaggagcctaacagaggagaaggctcatgcctgacatgaacctggcggcagcgcaaaagatg

SEQ ID NO: 220946 - DNA, 103 bp, Artificial Sequence
  Synthetic Polynucleotide
taatacgactcactataggggatctttgccatcctttctcagcatgtcagaacagaggagactgacaatgtgagaaaggaacctggcggcagcgcaaaagatg

SEQ ID NO: 220947 - DNA, 103 bp, Artificial Sequence
  Synthetic Polynucleotide
taatacgactcactatagggaactgatttggatctttgccatcctttctcaacagaggagagagaaaatgtggcaaagaaacctggcggcagcgcaaaagatg

SEQ ID NO: 220948 - DNA, 103 bp, Artificial Sequence
  Synthetic Polynucleotide
taatacgactcactatagggccatggaaaggaatcagagccgcccccgccaacagaggagaggcgggatgggctctgataacctggcggcagcgcaaaagatg

SEQ ID NO: 220949 - DNA, 103 bp, Artificial Sequence
  Synthetic Polynucleotide
taatacgactcactatagggggaaattgtgaactgatttggatctttgccaacagaggagaggcaaaatgccaaatcagaacctggcggcagcgcaaaagatg

SEQ ID NO: 220950 - DNA, 103 bp, Artificial Sequence
  Synthetic Polynucleotide
taatacgactcactatagggccccacggcgggaaattgtgaactgatttgaacagaggagacaaatcatgtcacaatttaacctggcggcagcgcaaaagatg

SEQ ID NO: 220951 - DNA, 103 bp, Artificial Sequence
  Synthetic Polynucleotide
taatacgactcactataggggaaatcttggccccacggcgggaaattgtgaacagaggagacacaatatgccgccgtggaacctggcggcagcgcaaaagatg

SEQ ID NO: 220952 - DNA, 103 bp, Artificial Sequence
  Synthetic Polynucleotide
taatacgactcactataggggctcgtttcagaaatcttggccccacggcgaacagaggagacgccgtatggccaagattaacctggcggcagcgcaaaagatg

SEQ ID NO: 220953 - DNA, 103 bp, Artificial Sequence
  Synthetic Polynucleotide
taatacgactcactatagggactccacagagctcgtttcagaaatcttggaacagaggagaccaagaatgctgaaacgaaacctggcggcagcgcaaaagatg

SEQ ID NO: 220954 - DNA, 103 bp, Artificial Sequence
  Synthetic Polynucleotide
taatacgactcactatagggcccatcacggactccacagagctcgtttcaaacagaggagatgaaacatgctctgtggaaacctggcggcagcgcaaaagatg

SEQ ID NO: 220955 - DNA, 103 bp, Artificial Sequence
  Synthetic Polynucleotide
taatacgactcactataggggtttttgatgcccatcacggactccacagaaacagaggagatctgtgatgtccgtgatgaacctggcggcagcgcaaaagatg

SEQ ID NO: 220956 - DNA, 103 bp, Artificial Sequence
  Synthetic Polynucleotide
taatacgactcactatagggctggcatgaagtttttgatgcccatcacggaacagaggagaccgtgaatggcatcaaaaaacctggcggcagcgcaaaagatg

SEQ ID NO: 220957 - DNA, 103 bp, Artificial Sequence
  Synthetic Polynucleotide
taatacgactcactatagggtcctctagagctggcatgaagtttttgatgaacagaggagacatcaaatgcttcatgccaacctggcggcagcgcaaaagatg

SEQ ID NO: 220958 - DNA, 103 bp, Artificial Sequence
  Synthetic Polynucleotide
taatacgactcactatagggaaatggggtctcctctagagctggcatgaaaacagaggagattcatgatggctctagagaacctggcggcagcgcaaaagatg

SEQ ID NO: 220959 - DNA, 103 bp, Artificial Sequence
  Synthetic Polynucleotide
taatacgactcactataggggggaggcgggccatggaaaggaatcagagcaacagaggagagctctgatgcctttccataacctggcggcagcgcaaaagatg

SEQ ID NO: 220960 - DNA, 103 bp, Artificial Sequence
  Synthetic Polynucleotide
taatacgactcactatagggtacaggaatgaaatggggtctcctctagagaacagaggagactctagatgagaccccataacctggcggcagcgcaaaagatg

SEQ ID NO: 220961 - DNA, 103 bp, Artificial Sequence
  Synthetic Polynucleotide
taatacgactcactatagggggcccagctgtacaggaatgaaatggggtcaacagaggagagaccccatgtcattcctgaacctggcggcagcgcaaaagatg

SEQ ID NO: 220962 - DNA, 103 bp, Artificial Sequence
  Synthetic Polynucleotide
taatacgactcactatagggggttgggtttggcccagctgtacaggaatgaacagaggagacattccatgacagctgggaacctggcggcagcgcaaaagatg

SEQ ID NO: 220963 - DNA, 103 bp, Artificial Sequence
  Synthetic Polynucleotide
taatacgactcactataggggcctccctagggttgggtttggcccagctgaacagaggagacagctgatgcaaacccaaaacctggcggcagcgcaaaagatg

SEQ ID NO: 220964 - DNA, 103 bp, Artificial Sequence
  Synthetic Polynucleotide
taatacgactcactatagggggagacagtggcctccctagggttgggtttaacagaggagaaaacccatgcctagggagaacctggcggcagcgcaaaagatg

SEQ ID NO: 220965 - DNA, 103 bp, Artificial Sequence
  Synthetic Polynucleotide
taatacgactcactatagggtgacggcttaggagacagtggcctccctagaacagaggagactagggatgccactgtctaacctggcggcagcgcaaaagatg

SEQ ID NO: 220966 - DNA, 103 bp, Artificial Sequence
  Synthetic Polynucleotide
taatacgactcactatagggatcccggggatgacggcttaggagacagtgaacagaggagacactgtatgctaagccgtaacctggcggcagcgcaaaagatg

SEQ ID NO: 220967 - DNA, 103 bp, Artificial Sequence
  Synthetic Polynucleotide
taatacgactcactataggggccaaaactgatcccggggatgacggcttaaacagaggagataagccatgatccccgggaacctggcggcagcgcaaaagatg

SEQ ID NO: 220968 - DNA, 103 bp, Artificial Sequence
  Synthetic Polynucleotide
taatacgactcactatagggtgatggacgagccaaaactgatcccggggaaacagaggagatccccgatgtcagttttgaacctggcggcagcgcaaaagatg

SEQ ID NO: 220969 - DNA, 103 bp, Artificial Sequence
  Synthetic Polynucleotide
taatacgactcactatagggggcagatcactgatggacgagccaaaactgaacagaggagacagtttatgctcgtccataacctggcggcagcgcaaaagatg

SEQ ID NO: 220970 - DNA, 103 bp, Artificial Sequence
  Synthetic Polynucleotide
taatacgactcactatagggttcccggggtgggaggcgggccatggaaagaacagaggagactttccatggcccgcctcaacctggcggcagcgcaaaagatg

SEQ ID NO: 220971 - DNA, 103 bp, Artificial Sequence
  Synthetic Polynucleotide
taatacgactcactatagggacagtggtatggcagatcactgatggacgaaacagaggagatcgtccatgagtgatctgaacctggcggcagcgcaaaagatg

SEQ ID NO: 220972 - DNA, 103 bp, Artificial Sequence
  Synthetic Polynucleotide
taatacgactcactatagggcaatgcagtcacagtggtatggcagatcacaacagaggagagtgatcatgcataccactaacctggcggcagcgcaaaagatg

SEQ ID NO: 220973 - DNA, 103 bp, Artificial Sequence
  Synthetic Polynucleotide
taatacgactcactatagggggacatctttcaatgcagtcacagtggtataacagaggagaataccaatgtgactgcataacctggcggcagcgcaaaagatg

SEQ ID NO: 220974 - DNA, 103 bp, Artificial Sequence
  Synthetic Polynucleotide
taatacgactcactatagggagagagaaagggacatctttcaatgcagtcaacagaggagagactgcatggaaagatgtaacctggcggcagcgcaaaagatg

SEQ ID NO: 220975 - DNA, 103 bp, Artificial Sequence
  Synthetic Polynucleotide
taatacgactcactatagggcgactggcagagagagaaagggacatctttaacagaggagaaaagatatgcctttctctaacctggcggcagcgcaaaagatg

SEQ ID NO: 220976 - DNA, 103 bp, Artificial Sequence
  Synthetic Polynucleotide
taatacgactcactatagggccacaccgaccgactggcagagagagaaagaacagaggagactttctatgtctgccagtaacctggcggcagcgcaaaagatg

SEQ ID NO: 220977 - DNA, 103 bp, Artificial Sequence
  Synthetic Polynucleotide
taatacgactcactataggggtgttttgtcccacaccgaccgactggcagaacagaggagactgccaatgggtcggtgtaacctggcggcagcgcaaaagatg

SEQ ID NO: 220978 - DNA, 103 bp, Artificial Sequence
  Synthetic Polynucleotide
taatacgactcactatagggctgtatatctgtgttttgtcccacaccgacaacagaggagagtcggtatgggacaaaacaacctggcggcagcgcaaaagatg

SEQ ID NO: 220979 - DNA, 103 bp, Artificial Sequence
  Synthetic Polynucleotide
taatacgactcactatagggccgctatctgctgtatatctgtgttttgtcaacagaggagagacaaaatgcagatatacaacctggcggcagcgcaaaagatg

SEQ ID NO: 220980 - DNA, 103 bp, Artificial Sequence
  Synthetic Polynucleotide
taatacgactcactatagggaagtttttggccgctatctgctgtatatctaacagaggagaagatatatggcagatagcaacctggcggcagcgcaaaagatg

SEQ ID NO: 220981 - DNA, 103 bp, Artificial Sequence
  Synthetic Polynucleotide
taatacgactcactataggggcagccgtaggcggagcaggactgcaccataacagaggagaatggtgatgtcctgctccaacctggcggcagcgcaaaagatg

SEQ ID NO: 220982 - DNA, 103 bp, Artificial Sequence
  Synthetic Polynucleotide
taatacgactcactataggggacagctgcctcccattctttacaaagactaacagaggagaagtcttatgaaagaatggaacctggcggcagcgcaaaagatg

SEQ ID NO: 220983 - DNA, 103 bp, Artificial Sequence
  Synthetic Polynucleotide
taatacgactcactatagggtttttcttctgacagctgcctcccattcttaacagaggagaaagaatatgaggcagctgaacctggcggcagcgcaaaagatg

SEQ ID NO: 220984 - DNA, 103 bp, Artificial Sequence
  Synthetic Polynucleotide
taatacgactcactatagggggtttaaagttttttcttctgacagctgccaacagaggagaggcagcatgcagaagaaaaacctggcggcagcgcaaaagatg

SEQ ID NO: 220985 - DNA, 103 bp, Artificial Sequence
  Synthetic Polynucleotide
taatacgactcactatagggatacttggtgggtttaaagttttttcttctaacagaggagaagaagaatgaactttaaaaacctggcggcagcgcaaaagatg

SEQ ID NO: 220986 - DNA, 103 bp, Artificial Sequence
  Synthetic Polynucleotide
taatacgactcactatagggaaatactgctatacttggtgggtttaaagtaacagaggagaactttaatgccaccaagtaacctggcggcagcgcaaaagatg

SEQ ID NO: 220987 - DNA, 103 bp, Artificial Sequence
  Synthetic Polynucleotide
taatacgactcactatagggtgctctgaacaaatactgctatacttggtgaacagaggagacaccaaatgtagcagtataacctggcggcagcgcaaaagatg

SEQ ID NO: 220988 - DNA, 103 bp, Artificial Sequence
  Synthetic Polynucleotide
taatacgactcactatagggtggagtaaagtgctctgaacaaatactgctaacagaggagaagcagtatgtgttcagagaacctggcggcagcgcaaaagatg

SEQ ID NO: 220989 - DNA, 103 bp, Artificial Sequence
  Synthetic Polynucleotide
taatacgactcactatagggtaaagcagtctggagtaaagtgctctgaacaacagaggagagttcagatgactttactcaacctggcggcagcgcaaaagatg

SEQ ID NO: 220990 - DNA, 103 bp, Artificial Sequence
  Synthetic Polynucleotide
taatacgactcactatagggcactctctcttaaagcagtctggagtaaagaacagaggagactttacatgagactgcttaacctggcggcagcgcaaaagatg

SEQ ID NO: 220991 - DNA, 103 bp, Artificial Sequence
  Synthetic Polynucleotide
taatacgactcactatagggcttgttgttgcactctctcttaaagcagtcaacagaggagagactgcatgaagagagagaacctggcggcagcgcaaaagatg

SEQ ID NO: 220992 - DNA, 103 bp, Artificial Sequence
  Synthetic Polynucleotide
taatacgactcactatagggagcggttcttgcagccgtaggcggagcaggaacagaggagacctgctatgcctacggctaacctggcggcagcgcaaaagatg

SEQ ID NO: 220993 - DNA, 103 bp, Artificial Sequence
  Synthetic Polynucleotide
taatacgactcactatagggctttcagtaacttgttgttgcactctctctaacagaggagaagagagatggcaacaacaaacctggcggcagcgcaaaagatg

SEQ ID NO: 220994 - DNA, 103 bp, Artificial Sequence
  Synthetic Polynucleotide
taatacgactcactatagggacagcattctctttcagtaacttgttgttgaacagaggagacaacaaatggttactgaaaacctggcggcagcgcaaaagatg

SEQ ID NO: 220995 - DNA, 103 bp, Artificial Sequence
  Synthetic Polynucleotide
taatacgactcactatagggtattgtgggcacagcattctctttcagtaaaacagaggagattactgatggagaatgctaacctggcggcagcgcaaaagatg

SEQ ID NO: 220996 - DNA, 103 bp, Artificial Sequence
  Synthetic Polynucleotide
taatacgactcactatagggtacaaagaaatattgtgggcacagcattctaacagaggagaagaatgatgtgcccacaaaacctggcggcagcgcaaaagatg

SEQ ID NO: 220997 - DNA, 103 bp, Artificial Sequence
  Synthetic Polynucleotide
taatacgactcactatagggtgtggctcagtacaaagaaatattgtgggcaacagaggagagcccacatgatttctttgaacctggcggcagcgcaaaagatg

SEQ ID NO: 220998 - DNA, 103 bp, Artificial Sequence
  Synthetic Polynucleotide
taatacgactcactatagggtttcttgtcatgtggctcagtacaaagaaaaacagaggagatttcttatgactgagccaaacctggcggcagcgcaaaagatg

SEQ ID NO: 220999 - DNA, 103 bp, Artificial Sequence
  Synthetic Polynucleotide
taatacgactcactataggggaagatcttctttcttgtcatgtggctcagaacagaggagactgagcatgatgacaagaaacctggcggcagcgcaaaagatg

SEQ ID NO: 221000 - DNA, 103 bp, Artificial Sequence
  Synthetic Polynucleotide
taatacgactcactatagggtgtggctccagaagatcttctttcttgtcaaacagaggagatgacaaatgagaagatctaacctggcggcagcgcaaaagatg

SEQ ID NO: 221001 - DNA, 103 bp, Artificial Sequence
  Synthetic Polynucleotide
taatacgactcactatagggaagctgttcctgtggctccagaagatcttcaacagaggagagaagatatgctggagccaaacctggcggcagcgcaaaagatg

SEQ ID NO: 221002 - DNA, 103 bp, Artificial Sequence
  Synthetic Polynucleotide
taatacgactcactataggggaggtgggggaagctgttcctgtggctccaaacagaggagatggagcatgaggaacagcaacctggcggcagcgcaaaagatg

SEQ ID NO: 221003 - DNA, 103 bp, Artificial Sequence
  Synthetic Polynucleotide
taatacgactcactatagggtccttgtcgtagcggttcttgcagccgtagaacagaggagactacggatgcaagaaccgaacctggcggcagcgcaaaagatg

SEQ ID NO: 221004 - DNA, 103 bp, Artificial Sequence
  Synthetic Polynucleotide
taatacgactcactatagggggcggtaaaggaggtgggggaagctgttccaacagaggagaggaacaatgtcccccaccaacctggcggcagcgcaaaagatg

SEQ ID NO: 221005 - DNA, 103 bp, Artificial Sequence
  Synthetic Polynucleotide
taatacgactcactatagggggaaacaggaggcggtaaaggaggtgggggaacagaggagacccccaatgcctttaccgaacctggcggcagcgcaaaagatg

SEQ ID NO: 221006 - DNA, 103 bp, Artificial Sequence
  Synthetic Polynucleotide
taatacgactcactatagggcatcaacctgggaaacaggaggcggtaaagaacagaggagactttacatgctcctgtttaacctggcggcagcgcaaaagatg

SEQ ID NO: 221007 - DNA, 103 bp, Artificial Sequence
  Synthetic Polynucleotide
taatacgactcactatagggccaatagcagcatcaacctgggaaacaggaaacagaggagatcctgtatgccaggttgaaacctggcggcagcgcaaaagatg

SEQ ID NO: 221008 - DNA, 103 bp, Artificial Sequence
  Synthetic Polynucleotide
taatacgactcactatagggcattagtaatccaatagcagcatcaacctgaacagaggagacaggttatggctgctattaacctggcggcagcgcaaaagatg

SEQ ID NO: 221009 - DNA, 103 bp, Artificial Sequence
  Synthetic Polynucleotide
taatacgactcactataggggaagaggcggcattagtaatccaatagcagaacagaggagactgctaatggattactaaaacctggcggcagcgcaaaagatg

SEQ ID NO: 221010 - DNA, 103 bp, Artificial Sequence
  Synthetic Polynucleotide
taatacgactcactatagggacaggggtctgaagaggcggcattagtaataacagaggagaattactatggccgcctctaacctggcggcagcgcaaaagatg

SEQ ID NO: 221011 - DNA, 103 bp, Artificial Sequence
  Synthetic Polynucleotide
taatacgactcactatagggtgagagattaacaggggtctgaagaggcggaacagaggagaccgcctatgcagacccctaacctggcggcagcgcaaaagatg

SEQ ID NO: 221012 - DNA, 103 bp, Artificial Sequence
  Synthetic Polynucleotide
taatacgactcactatagggcacagaaaactgagagattaacaggggtctaacagaggagaagacccatgttaatctctaacctggcggcagcgcaaaagatg

SEQ ID NO: 221013 - DNA, 103 bp, Artificial Sequence
  Synthetic Polynucleotide
taatacgactcactatagggtagttgtggtcacagaaaactgagagattaaacagaggagataatctatgagttttctgaacctggcggcagcgcaaaagatg

SEQ ID NO: 221014 - DNA, 103 bp, Artificial Sequence
  Synthetic Polynucleotide
taatacgactcactatagggaacgggcttgtccttgtcgtagcggttcttaacagaggagaaagaacatgtacgacaagaacctggcggcagcgcaaaagatg

SEQ ID NO: 221015 - DNA, 103 bp, Artificial Sequence
  Synthetic Polynucleotide
taatacgactcactatagggctccacagtatagttgtggtcacagaaaacaacagaggagagttttcatggaccacaacaacctggcggcagcgcaaaagatg

SEQ ID NO: 221016 - DNA, 103 bp, Artificial Sequence
  Synthetic Polynucleotide
taatacgactcactataggggcattgtatcctccacagtatagttgtggtaacagaggagaaccacaatgatactgtggaacctggcggcagcgcaaaagatg

SEQ ID NO: 221017 - DNA, 103 bp, Artificial Sequence
  Synthetic Polynucleotide
taatacgactcactatagggttccgctggtgcattgtatcctccacagtaaacagaggagatactgtatgggatacaataacctggcggcagcgcaaaagatg

SEQ ID NO: 221018 - DNA, 103 bp, Artificial Sequence
  Synthetic Polynucleotide
taatacgactcactatagggatgaatccttttccgctggtgcattgtatcaacagaggagagatacaatgcaccagcggaacctggcggcagcgcaaaagatg

SEQ ID NO: 221019 - DNA, 103 bp, Artificial Sequence
  Synthetic Polynucleotide
taatacgactcactataggggttctagctgatgaatccttttccgctggtaacagaggagaaccagcatgaaaggattcaacctggcggcagcgcaaaagatg

SEQ ID NO: 221020 - DNA, 103 bp, Artificial Sequence
  Synthetic Polynucleotide
taatacgactcactatagggtcaacttgctgttctagctgatgaatccttaacagaggagaaaggatatgtcagctagaaacctggcggcagcgcaaaagatg

SEQ ID NO: 221021 - DNA, 103 bp, Artificial Sequence
  Synthetic Polynucleotide
taatacgactcactatagggtctgagtttttcaacttgctgttctagctgaacagaggagacagctaatgcagcaagttaacctggcggcagcgcaaaagatg

SEQ ID NO: 221022 - DNA, 103 bp, Artificial Sequence
  Synthetic Polynucleotide
taatacgactcactatagggtgagcttctttctgagtttttcaacttgctaacagaggagaagcaagatgaaaaactcaaacctggcggcagcgcaaaagatg

SEQ ID NO: 221023 - DNA, 103 bp, Artificial Sequence
  Synthetic Polynucleotide
taatacgactcactatagggtgtgcggtcttgagcttctttctgagttttaacagaggagaaaaactatgaaagaagctaacctggcggcagcgcaaaagatg

SEQ ID NO: 221024 - DNA, 103 bp, Artificial Sequence
  Synthetic Polynucleotide
taatacgactcactataggggcatcgctgctgtgcggtcttgagcttcttaacagaggagaaagaagatgaagaccgcaaacctggcggcagcgcaaaagatg

SEQ ID NO: 221025 - DNA, 103 bp, Artificial Sequence
  Synthetic Polynucleotide
taatacgactcactatagggtgtggaaagaaacgggcttgtccttgtcgtaacagaggagaacgacaatgacaagcccgaacctggcggcagcgcaaaagatg

SEQ ID NO: 221026 - DNA, 103 bp, Artificial Sequence
  Synthetic Polynucleotide
taatacgactcactatagggcttgccttctgcatcgctgctgtgcggtctaacagaggagaagaccgatgagcagcgataacctggcggcagcgcaaaagatg

SEQ ID NO: 221027 - DNA, 103 bp, Artificial Sequence
  Synthetic Polynucleotide
taatacgactcactatagggagctgccgttcttgccttctgcatcgctgcaacagaggagagcagcgatgcagaaggcaaacctggcggcagcgcaaaagatg

SEQ ID NO: 221028 - DNA, 103 bp, Artificial Sequence
  Synthetic Polynucleotide
taatacgactcactatagggtaatttttcaagctgccgttcttgccttctaacagaggagaagaaggatggaacggcagaacctggcggcagcgcaaaagatg

SEQ ID NO: 221029 - DNA, 103 bp, Artificial Sequence
  Synthetic Polynucleotide
taatacgactcactatagggcaacctcctttaatttttcaagctgccgttaacagaggagaaacggcatgttgaaaaataacctggcggcagcgcaaaagatg

SEQ ID NO: 221030 - DNA, 103 bp, Artificial Sequence
  Synthetic Polynucleotide
taatacgactcactatagggtggaagtgaacaacctcctttaatttttcaaacagaggagatgaaaaatgaaaggaggtaacctggcggcagcgcaaaagatg

SEQ ID NO: 221031 - DNA, 103 bp, Artificial Sequence
  Synthetic Polynucleotide
taatacgactcactatagggtttctctttctggaagtgaacaacctccttaacagaggagaaaggagatggttcacttcaacctggcggcagcgcaaaagatg

SEQ ID NO: 221032 - DNA, 103 bp, Artificial Sequence
  Synthetic Polynucleotide
taatacgactcactatagggatacgtcgtctttctctttctggaagtgaaaacagaggagattcactatgagaaagagaaacctggcggcagcgcaaaagatg

SEQ ID NO: 221033 - DNA, 103 bp, Artificial Sequence
  Synthetic Polynucleotide
taatacgactcactatagggcctctttctgatacgtcgtctttctctttcaacagaggagagaaagaatgagacgacgtaacctggcggcagcgcaaaagatg

SEQ ID NO: 221034 - DNA, 103 bp, Artificial Sequence
  Synthetic Polynucleotide
taatacgactcactatagggaatcacataacctctttctgatacgtcgtcaacagaggagagacgacatgtcagaaagaaacctggcggcagcgcaaaagatg

SEQ ID NO: 221035 - DNA, 103 bp, Artificial Sequence
  Synthetic Polynucleotide
taatacgactcactatagggcatttggtagaatcacataacctctttctgaacagaggagacagaaaatggttatgtgaaacctggcggcagcgcaaaagatg

SEQ ID NO: 221036 - DNA, 103 bp, Artificial Sequence
  Synthetic Polynucleotide
taatacgactcactatagggagaggaaacttgtggaaagaaacgggcttgaacagaggagacaagccatgttctttccaaacctggcggcagcgcaaaagatg

SEQ ID NO: 221037 - DNA, 103 bp, Artificial Sequence
  Synthetic Polynucleotide
taatacgactcactatagggtcaaagtagtcatttggtagaatcacataaaacagaggagattatgtatgtctaccaaaaacctggcggcagcgcaaaagatg

SEQ ID NO: 221038 - DNA, 103 bp, Artificial Sequence
  Synthetic Polynucleotide
taatacgactcactatagggttcaactatttcaaagtagtcatttggtagaacagaggagactaccaatggactactttaacctggcggcagcgcaaaagatg

SEQ ID NO: 221039 - DNA, 103 bp, Artificial Sequence
  Synthetic Polynucleotide
taatacgactcactatagggatgctggtacttcaactatttcaaagtagtaacagaggagaactactatgaaatagttgaacctggcggcagcgcaaaagatg

SEQ ID NO: 221040 - DNA, 103 bp, Artificial Sequence
  Synthetic Polynucleotide
taatacgactcactataggggggtcgagtaagaggaaacttgtggaaagaaacagaggagatctttcatgaagtttcctaacctggcggcagcgcaaaagatg

SEQ ID NO: 221041 - DNA, 103 bp, Artificial Sequence
  Synthetic Polynucleotide
taatacgactcactatagggtacaaagactgggtcgagtaagaggaaactaacagaggagaagtttcatgttactcgacaacctggcggcagcgcaaaagatg

SEQ ID NO: 221042 - DNA, 103 bp, Artificial Sequence
  Synthetic Polynucleotide
taatacgactcactatagggtcccattctttacaaagactgggtcgagtaaacagaggagatactcgatgcagtctttgaacctggcggcagcgcaaaagatg

SEQ ID NO: 221043 - DNA, 103 bp, Artificial Sequence
  Synthetic Polynucleotide
taatacgactcactataggggcctggcacgcagcacgtaaagccaggcataacagaggagaatgcctatgtttacgtgcaacctggcggcagcgcaaaagatg

SEQ ID NO: 221044 - DNA, 103 bp, Artificial Sequence
  Synthetic Polynucleotide
taatacgactcactatagggcacgttcttgagccagaggcgccgcaactcaacagaggagagagttgatgcgcctctggaacctggcggcagcgcaaaagatg

SEQ ID NO: 221045 - DNA, 103 bp, Artificial Sequence
  Synthetic Polynucleotide
taatacgactcactatagggcggcacgcgacacgttcttgagccagaggcaacagaggagagcctctatgtcaagaacgaacctggcggcagcgcaaaagatg

SEQ ID NO: 221046 - DNA, 103 bp, Artificial Sequence
  Synthetic Polynucleotide
taatacgactcactatagggccactgacgccggcacgcgacacgttcttgaacagaggagacaagaaatggtcgcgtgcaacctggcggcagcgcaaaagatg

SEQ ID NO: 221047 - DNA, 103 bp, Artificial Sequence
  Synthetic Polynucleotide
taatacgactcactatagggggagaagcacccactgacgccggcacgcgaaacagaggagatcgcgtatgggcgtcagtaacctggcggcagcgcaaaagatg

SEQ ID NO: 221048 - DNA, 103 bp, Artificial Sequence
  Synthetic Polynucleotide
taatacgactcactataggggctggaaggtggagaagcacccactgacgcaacagaggagagcgtcaatgggtgcttctaacctggcggcagcgcaaaagatg

SEQ ID NO: 221049 - DNA, 103 bp, Artificial Sequence
  Synthetic Polynucleotide
taatacgactcactatagggcctgtggtgggctggaaggtggagaagcacaacagaggagagtgcttatgcaccttccaaacctggcggcagcgcaaaagatg

SEQ ID NO: 221050 - DNA, 103 bp, Artificial Sequence
  Synthetic Polynucleotide
taatacgactcactataggggagacggtggcctgtggtgggctggaaggtaacagaggagaaccttcatgcccaccacaaacctggcggcagcgcaaaagatg

SEQ ID NO: 221051 - DNA, 103 bp, Artificial Sequence
  Synthetic Polynucleotide
taatacgactcactataggggaacgctgcagagacggtggcctgtggtggaacagaggagaccaccaatggccaccgtcaacctggcggcagcgcaaaagatg

SEQ ID NO: 221052 - DNA, 103 bp, Artificial Sequence
  Synthetic Polynucleotide
taatacgactcactatagggccctggaagtgaacgctgcagagacggtggaacagaggagaccaccgatgctgcagcgtaacctggcggcagcgcaaaagatg

SEQ ID NO: 221053 - DNA, 103 bp, Artificial Sequence
  Synthetic Polynucleotide
taatacgactcactatagggcttgcggccgccctggaagtgaacgctgcaaacagaggagatgcagcatgcacttccagaacctggcggcagcgcaaaagatg

SEQ ID NO: 221054 - DNA, 103 bp, Artificial Sequence
  Synthetic Polynucleotide
taatacgactcactatagggtgttgtagcagcctggcacgcagcacgtaaaacagaggagattacgtatggcgtgccagaacctggcggcagcgcaaaagatg

SEQ ID NO: 221055 - DNA, 103 bp, Artificial Sequence
  Synthetic Polynucleotide
taatacgactcactatagggccgtgtaggtcttgcggccgccctggaagtaacagaggagaacttccatggcggccgcaaacctggcggcagcgcaaaagatg

SEQ ID NO: 221056 - DNA, 103 bp, Artificial Sequence
  Synthetic Polynucleotide
taatacgactcactataggggggacgcgtaccgtgtaggtcttgcggccgaacagaggagacggccgatggacctacacaacctggcggcagcgcaaaagatg

SEQ ID NO: 221057 - DNA, 103 bp, Artificial Sequence
  Synthetic Polynucleotide
taatacgactcactataggggaagatggtggggacgcgtaccgtgtaggtaacagaggagaacctacatggtacgcgtcaacctggcggcagcgcaaaagatg

SEQ ID NO: 221058 - DNA, 103 bp, Artificial Sequence
  Synthetic Polynucleotide
taatacgactcactatagggcgcgcagcgggaagatggtggggacgcgtaaacagaggagatacgcgatgccaccatctaacctggcggcagcgcaaaagatg

SEQ ID NO: 221059 - DNA, 103 bp, Artificial Sequence
  Synthetic Polynucleotide
taatacgactcactatagggtcattgacgccgcgcagcgggaagatggtgaacagaggagacaccatatgcccgctgcgaacctggcggcagcgcaaaagatg

SEQ ID NO: 221060 - DNA, 103 bp, Artificial Sequence
  Synthetic Polynucleotide
taatacgactcactatagggtactttgcgctcattgacgccgcgcagcggaacagaggagaccgctgatgggcgtcaataacctggcggcagcgcaaaagatg

SEQ ID NO: 221061 - DNA, 103 bp, Artificial Sequence
  Synthetic Polynucleotide
taatacgactcactataggggtctgcgcgctactttgcgctcattgacgcaacagaggagagcgtcaatgagcgcaaagaacctggcggcagcgcaaaagatg

SEQ ID NO: 221062 - DNA, 103 bp, Artificial Sequence
  Synthetic Polynucleotide
taatacgactcactataggggccccagcgggtctgcgcgctactttgcgcaacagaggagagcgcaaatgagcgcgcagaacctggcggcagcgcaaaagatg

SEQ ID NO: 221063 - DNA, 103 bp, Artificial Sequence
  Synthetic Polynucleotide
taatacgactcactatagggggcggccgcggccccagcgggtctgcgcgcaacagaggagagcgcgcatgcccgctgggaacctggcggcagcgcaaaagatg

SEQ ID NO: 221064 - DNA, 103 bp, Artificial Sequence
  Synthetic Polynucleotide
taatacgactcactataggggcctgcggcgggcggccgcggccccagcggaacagaggagaccgctgatgccgcggccgaacctggcggcagcgcaaaagatg

SEQ ID NO: 221065 - DNA, 103 bp, Artificial Sequence
  Synthetic Polynucleotide
taatacgactcactatagggcggtgcgagttgttgtagcagcctggcacgaacagaggagacgtgccatgctgctacaaaacctggcggcagcgcaaaagatg

SEQ ID NO: 221066 - DNA, 103 bp, Artificial Sequence
  Synthetic Polynucleotide
taatacgactcactatagggtgctgctgctgcctgcggcgggcggccgcgaacagaggagacgcggcatgccgccgcagaacctggcggcagcgcaaaagatg

SEQ ID NO: 221067 - DNA, 103 bp, Artificial Sequence
  Synthetic Polynucleotide
taatacgactcactatagggctgctgctgttgctgctgctgcctgcggcgaacagaggagacgccgcatgcagcagcagaacctggcggcagcgcaaaagatg

SEQ ID NO: 221068 - DNA, 103 bp, Artificial Sequence
  Synthetic Polynucleotide
taatacgactcactataggggttgctgctgctgctgctgttgctgctgctaacagaggagaagcagcatgaacagcagcaacctggcggcagcgcaaaagatg

SEQ ID NO: 221069 - DNA, 103 bp, Artificial Sequence
  Synthetic Polynucleotide
taatacgactcactatagggtgttgctgctgttgctgctgctgctgctgtaacagaggagaacagcaatggcagcagcaaacctggcggcagcgcaaaagatg

SEQ ID NO: 221070 - DNA, 103 bp, Artificial Sequence
  Synthetic Polynucleotide
taatacgactcactatagggctgctgctgctgttgctgctgttgctgctgaacagaggagacagcagatgcagcagcaaaacctggcggcagcgcaaaagatg

SEQ ID NO: 221071 - DNA, 103 bp, Artificial Sequence
  Synthetic Polynucleotide
taatacgactcactataggggctgttgctgctgctgctgctgttgctgctaacagaggagaagcagcatgagcagcagcaacctggcggcagcgcaaaagatg

SEQ ID NO: 221072 - DNA, 103 bp, Artificial Sequence
  Synthetic Polynucleotide
taatacgactcactatagggtgctgctgctgctgttgctgctgctgctgcaacagaggagagcagcaatggcagcaacaaacctggcggcagcgcaaaagatg

SEQ ID NO: 221073 - DNA, 103 bp, Artificial Sequence; identical to SEQ ID NO: 203903
  Synthetic Polynucleotide

SEQ ID NO: 221074 - DNA, 103 bp, Artificial Sequence
  Synthetic Polynucleotide
taatacgactcactatagggaggactgctgctgctgctgctgctgctgctaacagaggagaagcagcatgagcagcagcaacctggcggcagcgcaaaagatg

SEQ ID NO: 221075 - DNA, 103 bp, Artificial Sequence
  Synthetic Polynucleotide
taatacgactcactataggggcagagggtgaggactgctgctgctgctgcaacagaggagagcagcaatggcagcagtcaacctggcggcagcgcaaaagatg

SEQ ID NO: 221076 - DNA, 103 bp, Artificial Sequence
  Synthetic Polynucleotide
taatacgactcactatagggcgccttgtcccggtgcgagttgttgtagcaaacagaggagatgctacatgaactcgcacaacctggcggcagcgcaaaagatg

SEQ ID NO: 221077 - DNA, 103 bp, Artificial Sequence
  Synthetic Polynucleotide
taatacgactcactatagggggcagtggaggcagagggtgaggactgctgaacagaggagacagcagatgtcaccctctaacctggcggcagcgcaaaagatg

SEQ ID NO: 221078 - DNA, 103 bp, Artificial Sequence
  Synthetic Polynucleotide
taatacgactcactataggggggcagtctgggcagtggaggcagagggtgaacagaggagacaccctatgcctccactgaacctggcggcagcgcaaaagatg

SEQ ID NO: 221079 - DNA, 103 bp, Artificial Sequence
  Synthetic Polynucleotide
taatacgactcactatagggggctgcagctgggcagtctgggcagtggagaacagaggagactccacatgccagactgcaacctggcggcagcgcaaaagatg

SEQ ID NO: 221080 - DNA, 103 bp, Artificial Sequence
  Synthetic Polynucleotide
taatacgactcactatagggtaccaggttcggctgcagctgggcagtctgaacagaggagacagactatgcagctgcagaacctggcggcagcgcaaaagatg

SEQ ID NO: 221081 - DNA, 103 bp, Artificial Sequence
  Synthetic Polynucleotide
taatacgactcactatagggcggaagcagataccaggttcggctgcagctaacagaggagaagctgcatgcgaacctggaacctggcggcagcgcaaaagatg

SEQ ID NO: 221082 - DNA, 103 bp, Artificial Sequence
  Synthetic Polynucleotide
taatacgactcactatagggagcacggccgcggaagcagataccaggttcaacagaggagagaacctatgatctgcttcaacctggcggcagcgcaaaagatg

SEQ ID NO: 221083 - DNA, 103 bp, Artificial Sequence
  Synthetic Polynucleotide
taatacgactcactatagggaagggtgagaagcacggccgcggaagcagaaacagaggagatctgctatggcggccgtgaacctggcggcagcgcaaaagatg

SEQ ID NO: 221084 - DNA, 103 bp, Artificial Sequence
  Synthetic Polynucleotide
taatacgactcactatagggcagtggcctgaagggtgagaagcacggccgaacagaggagacggccgatgttctcacccaacctggcggcagcgcaaaagatg

SEQ ID NO: 221085 - DNA, 103 bp, Artificial Sequence
  Synthetic Polynucleotide
taatacgactcactatagggctgctgtctacagtggcctgaagggtgagaaacagaggagatctcacatgtcaggccacaacctggcggcagcgcaaaagatg

SEQ ID NO: 221086 - DNA, 103 bp, Artificial Sequence
  Synthetic Polynucleotide
taatacgactcactatagggcggagcctgactgctgtctacagtggcctgaacagaggagacaggccatggtagacagcaacctggcggcagcgcaaaagatg

SEQ ID NO: 221087 - DNA, 103 bp, Artificial Sequence
  Synthetic Polynucleotide
taatacgactcactatagggagaagtgcagcgccttgtcccggtgcgagtaacagaggagaactcgcatggggacaaggaacctggcggcagcgcaaaagatg

SEQ ID NO: 221088 - DNA, 103 bp, Artificial Sequence
  Synthetic Polynucleotide
taatacgactcactataggggtacggatcccggagcctgactgctgtctaaacagaggagatagacaatggtcaggctcaacctggcggcagcgcaaaagatg

SEQ ID NO: 221089 - DNA, 103 bp, Artificial Sequence
  Synthetic Polynucleotide
taatacgactcactatagggggcgccggctgtacggatcccggagcctgaaacagaggagatcaggcatggggatccgtaacctggcggcagcgcaaaagatg

SEQ ID NO: 221090 - DNA, 103 bp, Artificial Sequence
  Synthetic Polynucleotide
taatacgactcactataggggggagtgatgggcgccggctgtacggatccaacagaggagaggatccatgcagccggcgaacctggcggcagcgcaaaagatg

SEQ ID NO: 221091 - DNA, 103 bp, Artificial Sequence
  Synthetic Polynucleotide
taatacgactcactatagggcttctccagtgggagtgatgggcgccggctaacagaggagaagccggatgccatcactcaacctggcggcagcgcaaaagatg

SEQ ID NO: 221092 - DNA, 103 bp, Artificial Sequence
  Synthetic Polynucleotide
taatacgactcactatagggggcttcacgtcttctccagtgggagtgatgaacagaggagacatcacatgcactggagaaacctggcggcagcgcaaaagatg

SEQ ID NO: 221093 - DNA, 103 bp, Artificial Sequence
  Synthetic Polynucleotide
taatacgactcactataggggagatcgatgggcttcacgtcttctccagtaacagaggagaactggaatggacgtgaagaacctggcggcagcgcaaaagatg

SEQ ID NO: 221094 - DNA, 103 bp, Artificial Sequence
  Synthetic Polynucleotide
taatacgactcactatagggcttgcactgtgagatcgatgggcttcacgtaacagaggagaacgtgaatgccatcgatcaacctggcggcagcgcaaaagatg

SEQ ID NO: 221095 - DNA, 103 bp, Artificial Sequence
  Synthetic Polynucleotide
taatacgactcactataggggcaaactccacttgcactgtgagatcgatgaacagaggagacatcgaatgcacagtgcaaacctggcggcagcgcaaaagatg

SEQ ID NO: 221096 - DNA, 103 bp, Artificial Sequence
  Synthetic Polynucleotide
taatacgactcactatagggctctgcggctgcaaactccacttgcactgtaacagaggagaacagtgatggtggagtttaacctggcggcagcgcaaaagatg

SEQ ID NO: 221097 - DNA, 103 bp, Artificial Sequence
  Synthetic Polynucleotide
taatacgactcactatagggcggctgcgccctctgcggctgcaaactccaaacagaggagatggagtatgcagccgcagaacctggcggcagcgcaaaagatg

SEQ ID NO: 221098 - DNA, 103 bp, Artificial Sequence
  Synthetic Polynucleotide
taatacgactcactatagggggaaacgtgtagaagtgcagcgccttgtccaacagaggagaggacaaatggctgcacttaacctggcggcagcgcaaaagatg

SEQ ID NO: 221099 - DNA, 103 bp, Artificial Sequence
  Synthetic Polynucleotide
taatacgactcactataggggcggccgcagcggctgcgccctctgcggctaacagaggagaagccgcatggggcgcagcaacctggcggcagcgcaaaagatg

SEQ ID NO: 221100 - DNA, 103 bp, Artificial Sequence
  Synthetic Polynucleotide
taatacgactcactatagggctccgacgcggcggccgcagcggctgcgccaacagaggagaggcgcaatggctgcggccaacctggcggcagcgcaaaagatg

SEQ ID NO: 221101 - DNA, 103 bp, Artificial Sequence
  Synthetic Polynucleotide
taatacgactcactatagggcagcctgtaactccgacgcggcggccgcagaacagaggagactgcggatgccgcgtcggaacctggcggcagcgcaaaagatg

SEQ ID NO: 221102 - DNA, 103 bp, Artificial Sequence
  Synthetic Polynucleotide
taatacgactcactatagggcctgcggtagcagcctgtaactccgacgcgaacagaggagacgcgtcatggttacaggcaacctggcggcagcgcaaaagatg

SEQ ID NO: 221103 - DNA, 103 bp, Artificial Sequence
  Synthetic Polynucleotide
taatacgactcactatagggagcctccagccctgcggtagcagcctgtaaaacagaggagattacagatggctaccgcaaacctggcggcagcgcaaaagatg

SEQ ID NO: 221104 - DNA, 103 bp, Artificial Sequence
  Synthetic Polynucleotide
taatacgactcactatagggggcactcggcagcctccagccctgcggtagaacagaggagactaccgatgggctggaggaacctggcggcagcgcaaaagatg

SEQ ID NO: 221105 - DNA, 103 bp, Artificial Sequence
  Synthetic Polynucleotide
taatacgactcactataggggggcccatagggcactcggcagcctccagcaacagaggagagctggaatgtgccgagtgaacctggcggcagcgcaaaagatg

SEQ ID NO: 221106 - DNA, 103 bp, Artificial Sequence
  Synthetic Polynucleotide
taatacgactcactatagggcaccaactgggggcccatagggcactcggcaacagaggagagccgagatgcctatgggcaacctggcggcagcgcaaaagatg

SEQ ID NO: 221107 - DNA, 103 bp, Artificial Sequence
  Synthetic Polynucleotide
taatacgactcactatagggcccctaccaccaccaactgggggcccatagaacagaggagactatggatgcccagttggaacctggcggcagcgcaaaagatg

SEQ ID NO: 221108 - DNA, 103 bp, Artificial Sequence
  Synthetic Polynucleotide
taatacgactcactatagggaagccctcttcccctaccaccaccaactggaacagaggagaccagttatgggtggtaggaacctggcggcagcgcaaaagatg

SEQ ID NO: 221109 - DNA, 103 bp, Artificial Sequence
  Synthetic Polynucleotide
taatacgactcactatagggagcgtcctttggaaacgtgtagaagtgcagaacagaggagactgcacatgtacacgtttaacctggcggcagcgcaaaagatg

SEQ ID NO: 221110 - DNA, 103 bp, Artificial Sequence
  Synthetic Polynucleotide
taatacgactcactatagggagtatcagggaagccctcttcccctaccacaacagaggagagtggtaatggaagagggcaacctggcggcagcgcaaaagatg

SEQ ID NO: 221111 - DNA, 103 bp, Artificial Sequence
  Synthetic Polynucleotide
taatacgactcactatagggggtcggagccagtatcagggaagccctcttaacagaggagaaagaggatgtccctgataaacctggcggcagcgcaaaagatg

SEQ ID NO: 221112 - DNA, 103 bp, Artificial Sequence
  Synthetic Polynucleotide
taatacgactcactataggggagtacgaatggtcggagccagtatcagggaacagaggagaccctgaatgtggctccgaaacctggcggcagcgcaaaagatg

SEQ ID NO: 221113 - DNA, 103 bp, Artificial Sequence
  Synthetic Polynucleotide
taatacgactcactatagggtgacgacaaggagtacgaatggtcggagccaacagaggagaggctccatgcattcgtacaacctggcggcagcgcaaaagatg

SEQ ID NO: 221114 - DNA, 103 bp, Artificial Sequence
  Synthetic Polynucleotide
taatacgactcactatagggccgtggtgcctgacgacaaggagtacgaataacagaggagaattcgtatgccttgtcgtaacctggcggcagcgcaaaagatg

SEQ ID NO: 221115 - DNA, 103 bp, Artificial Sequence
  Synthetic Polynucleotide
taatacgactcactatagggagctcctcctccgtggtgcctgacgacaagaacagaggagacttgtcatgaggcaccacaacctggcggcagcgcaaaagatg

SEQ ID NO: 221116 - DNA, 103 bp, Artificial Sequence
  Synthetic Polynucleotide
taatacgactcactatagggcttgcgcaggagctcctcctccgtggtgccaacagaggagaggcaccatggaggaggagaacctggcggcagcgcaaaagatg

SEQ ID NO: 221117 - DNA, 103 bp, Artificial Sequence
  Synthetic Polynucleotide
taatacgactcactataggggctcattcagcttgcgcaggagctcctcctaacagaggagaaggaggatgtcctgcgcaaacctggcggcagcgcaaaagatg

SEQ ID NO: 221118 - DNA, 103 bp, Artificial Sequence
  Synthetic Polynucleotide
taatacgactcactatagggatgtcccgctgctcattcagcttgcgcaggaacagaggagacctgcgatggctgaatgaaacctggcggcagcgcaaaagatg

SEQ ID NO: 221119 - DNA, 103 bp, Artificial Sequence
  Synthetic Polynucleotide
taatacgactcactatagggcagagccaggatgtcccgctgctcattcagaacagaggagactgaatatgcagcgggacaacctggcggcagcgcaaaagatg

SEQ ID NO: 221120 - DNA, 103 bp, Artificial Sequence
  Synthetic Polynucleotide
taatacgactcactataggggccgcaactcagcgtcctttggaaacgtgtaacagaggagaacacgtatgcaaaggacgaacctggcggcagcgcaaaagatg

SEQ ID NO: 221121 - DNA, 103 bp, Artificial Sequence
  Synthetic Polynucleotide
taatacgactcactatagggtcacttccatcagagccaggatgtcccgctaacagaggagaagcgggatgtcctggctcaacctggcggcagcgcaaaagatg

SEQ ID NO: 221122 - DNA, 103 bp, Artificial Sequence
  Synthetic Polynucleotide
taatacgactcactatagggtctttcatcttcacttccatcagagccaggaacagaggagacctggcatggatggaagtaacctggcggcagcgcaaaagatg

SEQ ID NO: 221123 - DNA, 103 bp, Artificial Sequence
  Synthetic Polynucleotide
taatacgactcactataggggcctttcatctctttcatcttcacttccataacagaggagaatggaaatgaagatgaaaaacctggcggcagcgcaaaagatg

SEQ ID NO: 221124 - DNA, 103 bp, Artificial Sequence
  Synthetic Polynucleotide
taatacgactcactatagggggcgaatgctgcctttcatctctttcatctaacagaggagaagatgaatgagatgaaagaacctggcggcagcgcaaaagatg

SEQ ID NO: 221125 - DNA, 103 bp, Artificial Sequence
  Synthetic Polynucleotide
taatacgactcactatagggagacgcaggtggcgaatgctgcctttcatcaacagaggagagatgaaatgcagcattcgaacctggcggcagcgcaaaagatg

SEQ ID NO: 221126 - DNA, 103 bp, Artificial Sequence
  Synthetic Polynucleotide
taatacgactcactatagggggcctcagtgagacgcaggtggcgaatgctaacagaggagaagcattatgcacctgcgtaacctggcggcagcgcaaaagatg

SEQ ID NO: 221127 - DNA, 103 bp, Artificial Sequence
  Synthetic Polynucleotide
taatacgactcactatagggcgcgcagcttggcctcagtgagacgcaggtaacagaggagaacctgcatgtcactgaggaacctggcggcagcgcaaaagatg

SEQ ID NO: 221128 - DNA, 103 bp, Artificial Sequence
  Synthetic Polynucleotide
taatacgactcactatagggcgcagttcttcgcgcagcttggcctcagtgaacagaggagacactgaatgcaagctgcgaacctggcggcagcgcaaaagatg

SEQ ID NO: 221129 - DNA, 103 bp, Artificial Sequence
  Synthetic Polynucleotide
taatacgactcactatagggatccttctcacgcagttcttcgcgcagcttaacagaggagaaagctgatggaagaactgaacctggcggcagcgcaaaagatg

SEQ ID NO: 221130 - DNA, 103 bp, Artificial Sequence
  Synthetic Polynucleotide
taatacgactcactatagggcaagcagccgatccttctcacgcagttcttaacagaggagaaagaacatggtgagaaggaacctggcggcagcgcaaaagatg

SEQ ID NO: 221131 - DNA, 103 bp, Artificial Sequence
  Synthetic Polynucleotide
taatacgactcactatagggagccagaggcgccgcaactcagcgtcctttaacagaggagaaaaggaatgtgagttgcgaacctggcggcagcgcaaaagatg

SEQ ID NO: 221132 - DNA, 103 bp, Artificial Sequence
  Synthetic Polynucleotide
taatacgactcactatagggacagccatggcaagcagccgatccttctcaaacagaggagatgagaaatgtcggctgctaacctggcggcagcgcaaaagatg

SEQ ID NO: 221133 - DNA, 103 bp, Artificial Sequence
  Synthetic Polynucleotide
taatacgactcactatagggcttgcggatgacagccatggcaagcagccgaacagaggagacggctgatggccatggctaacctggcggcagcgcaaaagatg

SEQ ID NO: 221134 - DNA, 103 bp, Artificial Sequence
  Synthetic Polynucleotide
taatacgactcactatagggttccgtgcttcttgcggatgacagccatggaacagaggagaccatggatgtcatccgcaaacctggcggcagcgcaaaagatg

SEQ ID NO: 221135 - DNA, 103 bp, Artificial Sequence
  Synthetic Polynucleotide
taatacgactcactatagggacactccaccttgcttggcttctgttccataacagaggagaatggaaatgaagccaagcaacctggcggcagcgcaaaagatg

SEQ ID NO: 221136 - DNA, 103 bp, Artificial Sequence
  Synthetic Polynucleotide
taatacgactcactatagggtgacatgctggttttcagggaacattggccaacagaggagaggccaaatgtccctgaaaaacctggcggcagcgcaaaagatg

SEQ ID NO: 221137 - DNA, 103 bp, Artificial Sequence
  Synthetic Polynucleotide
taatacgactcactatagggcttctcgatcttgtccacacacagcaggccaacagaggagaggcctgatgtgtgtggacaacctggcggcagcgcaaaagatg

SEQ ID NO: 221138 - DNA, 103 bp, Artificial Sequence
  Synthetic Polynucleotide
taatacgactcactatagggcctcctgactcttctcgatcttgtccacacaacagaggagagtgtggatgagatcgagaaacctggcggcagcgcaaaagatg

SEQ ID NO: 221139 - DNA, 103 bp, Artificial Sequence
  Synthetic Polynucleotide
taatacgactcactatagggagcaggtacgcctcctgactcttctcgatcaacagaggagagatcgaatggagtcaggaaacctggcggcagcgcaaaagatg

SEQ ID NO: 221140 - DNA, 103 bp, Artificial Sequence
  Synthetic Polynucleotide
taatacgactcactatagggctcgaacgccagcaggtacgcctcctgactaacagaggagaagtcagatggcgtacctgaacctggcggcagcgcaaaagatg

SEQ ID NO: 221141 - DNA, 103 bp, Artificial Sequence
  Synthetic Polynucleotide
taatacgactcactatagggtgacgtagtgctcgaacgccagcaggtacgaacagaggagacgtaccatgtggcgttcgaacctggcggcagcgcaaaagatg

SEQ ID NO: 221142 - DNA, 103 bp, Artificial Sequence
  Synthetic Polynucleotide
taatacgactcactatagggttgcggtggttgacgtagtgctcgaacgccaacagaggagaggcgttatggcactacgtaacctggcggcagcgcaaaagatg

SEQ ID NO: 221143 - DNA, 103 bp, Artificial Sequence
  Synthetic Polynucleotide
taatacgactcactatagggaatgttgtgtttgcggtggttgacgtagtgaacagaggagacactacatgaaccaccgcaacctggcggcagcgcaaaagatg

SEQ ID NO: 221144 - DNA, 103 bp, Artificial Sequence
  Synthetic Polynucleotide
taatacgactcactatagggagaagtgcggaatgttgtgtttgcggtggtaacagaggagaaccaccatgaacacaacaaacctggcggcagcgcaaaagatg

SEQ ID NO: 221145 - DNA, 103 bp, Artificial Sequence
  Synthetic Polynucleotide
taatacgactcactatagggagcttgggccagaagtgcggaatgttgtgtaacagaggagaacacaaatgtccgcacttaacctggcggcagcgcaaaagatg

SEQ ID NO: 221146 - DNA, 103 bp, Artificial Sequence
  Synthetic Polynucleotide
taatacgactcactatagggcttcatcagcagcttgggccagaagtgcggaacagaggagaccgcacatgtggcccaagaacctggcggcagcgcaaaagatg

SEQ ID NO: 221147 - DNA, 103 bp, Artificial Sequence
  Synthetic Polynucleotide
taatacgactcactatagggggatataccctgacatgctggttttcagggaacagaggagaccctgaatgccagcatgtaacctggcggcagcgcaaaagatg

SEQ ID NO: 221148 - DNA, 103 bp, Artificial Sequence
  Synthetic Polynucleotide
taatacgactcactatagggcttctctctccttcatcagcagcttgggccaacagaggagaggcccaatgtgctgatgaaacctggcggcagcgcaaaagatg

SEQ ID NO: 221149 - DNA, 103 bp, Artificial Sequence
  Synthetic Polynucleotide
taatacgactcactataggggaactctgcacttctctctccttcatcagcaacagaggagagctgatatgggagagagaaacctggcggcagcgcaaaagatg

SEQ ID NO: 221150 - DNA, 103 bp, Artificial Sequence
  Synthetic Polynucleotide
taatacgactcactataggggtacagaatcgaactctgcacttctctctcaacagaggagagagagaatggtgcagagtaacctggcggcagcgcaaaagatg

SEQ ID NO: 221151 - DNA, 103 bp, Artificial Sequence
  Synthetic Polynucleotide
taatacgactcactatagggctgcccccttgtacagaatcgaactctgcaaacagaggagatgcagaatgcgattctgtaacctggcggcagcgcaaaagatg

SEQ ID NO: 221152 - DNA, 103 bp, Artificial Sequence
  Synthetic Polynucleotide
taatacgactcactatagggccttctgccgctgcccccttgtacagaatcaacagaggagagattctatgcaagggggcaacctggcggcagcgcaaaagatg

SEQ ID NO: 221153 - DNA, 103 bp, Artificial Sequence
  Synthetic Polynucleotide
taatacgactcactataggggcccggccggccttctgccgctgcccccttaacagaggagaaaggggatggcggcagaaaacctggcggcagcgcaaaagatg

SEQ ID NO: 221154 - DNA, 103 bp, Artificial Sequence
  Synthetic Polynucleotide
taatacgactcactatagggccagtgacccgcccggccggccttctgccgaacagaggagacggcagatggccggccggaacctggcggcagcgcaaaagatg

SEQ ID NO: 221155 - DNA, 103 bp, Artificial Sequence
  Synthetic Polynucleotide
taatacgactcactataggggggtggacgcccagtgacccgcccggccggaacagaggagaccggccatgcgggtcactaacctggcggcagcgcaaaagatg

SEQ ID NO: 221156 - DNA, 103 bp, Artificial Sequence
  Synthetic Polynucleotide
taatacgactcactatagggctgtccttccgggtggacgcccagtgacccaacagaggagagggtcaatgggcgtccacaacctggcggcagcgcaaaagatg

SEQ ID NO: 221157 - DNA, 103 bp, Artificial Sequence
  Synthetic Polynucleotide
taatacgactcactatagggcgagaagctgctgtccttccgggtggacgcaacagaggagagcgtccatgcggaaggacaacctggcggcagcgcaaaagatg

SEQ ID NO: 221158 - DNA, 103 bp, Artificial Sequence
  Synthetic Polynucleotide
taatacgactcactatagggaggtaactagggatataccctgacatgctgaacagaggagacagcatatgagggtatataacctggcggcagcgcaaaagatg

SEQ ID NO: 221159 - DNA, 103 bp, Artificial Sequence
  Synthetic Polynucleotide
taatacgactcactatagggacatgcattccgagaagctgctgtccttccaacagaggagaggaaggatggcagcttctaacctggcggcagcgcaaaagatg

SEQ ID NO: 221160 - DNA, 103 bp, Artificial Sequence
  Synthetic Polynucleotide
taatacgactcactatagggaccctgaacaacatgcattccgagaagctgaacagaggagacagcttatgggaatgcataacctggcggcagcgcaaaagatg

SEQ ID NO: 221161 - DNA, 103 bp, Artificial Sequence
  Synthetic Polynucleotide
taatacgactcactatagggggacctgcggaccctgaacaacatgcattcaacagaggagagaatgcatgttgttcaggaacctggcggcagcgcaaaagatg

SEQ ID NO: 221162 - DNA, 103 bp, Artificial Sequence
  Synthetic Polynucleotide
taatacgactcactatagggtcaagctgccggacctgcggaccctgaacaaacagaggagatgttcaatgtccgcaggtaacctggcggcagcgcaaaagatg

SEQ ID NO: 221163 - DNA, 103 bp, Artificial Sequence
  Synthetic Polynucleotide
taatacgactcactatagggaagctgctgctcaagctgccggacctgcggaacagaggagaccgcagatgcggcagcttaacctggcggcagcgcaaaagatg

SEQ ID NO: 221164 - DNA, 103 bp, Artificial Sequence
  Synthetic Polynucleotide
taatacgactcactatagggccgcttcaccaagctgctgctcaagctgccaacagaggagaggcagcatgagcagcagcaacctggcggcagcgcaaaagatg

SEQ ID NO: 221165 - DNA, 103 bp, Artificial Sequence
  Synthetic Polynucleotide
taatacgactcactatagggtggagacttcccgcttcaccaagctgctgcaacagaggagagcagcaatgtggtgaagcaacctggcggcagcgcaaaagatg

SEQ ID NO: 221166 - DNA, 103 bp, Artificial Sequence
  Synthetic Polynucleotide
taatacgactcactatagggaaccggcccttggagacttcccgcttcaccaacagaggagaggtgaaatgggaagtctcaacctggcggcagcgcaaaagatg

SEQ ID NO: 221167 - DNA, 103 bp, Artificial Sequence
  Synthetic Polynucleotide
taatacgactcactatagggggtgctgaagaaccggcccttggagacttcaacagaggagagaagtcatgaagggccggaacctggcggcagcgcaaaagatg

SEQ ID NO: 221168 - DNA, 103 bp, Artificial Sequence
  Synthetic Polynucleotide
taatacgactcactatagggttcgggctctggtgctgaagaaccggccctaacagaggagaagggccatgtcttcagcaaacctggcggcagcgcaaaagatg

SEQ ID NO: 221169 - DNA, 103 bp, Artificial Sequence
  Synthetic Polynucleotide
taatacgactcactataggggtctttgtccaggtaactagggatatacccaacagaggagagggtatatgcctagttacaacctggcggcagcgcaaaagatg

SEQ ID NO: 221170 - DNA, 103 bp, Artificial Sequence
  Synthetic Polynucleotide
taatacgactcactatagggctgcgggctcttcgggctctggtgctgaagaacagaggagacttcagatgcagagcccgaacctggcggcagcgcaaaagatg

SEQ ID NO: 221171 - DNA, 103 bp, Artificial Sequence
  Synthetic Polynucleotide
taatacgactcactatagggggagacgctgctgcgggctcttcgggctctaacagaggagaagagccatgagagcccgcaacctggcggcagcgcaaaagatg

SEQ ID NO: 221172 - DNA, 103 bp, Artificial Sequence
  Synthetic Polynucleotide
taatacgactcactatagggagcagctccaggagacgctgctgcgggctcaacagaggagagagcccatggcagcgtctaacctggcggcagcgcaaaagatg

SEQ ID NO: 221173 - DNA, 103 bp, Artificial Sequence
  Synthetic Polynucleotide
taatacgactcactataggggcttcggtggagcagctccaggagacgctgaacagaggagacagcgtatgctggagctgaacctggcggcagcgcaaaagatg

SEQ ID NO: 221174 - DNA, 103 bp, Artificial Sequence
  Synthetic Polynucleotide
taatacgactcactatagggggagaattccgcttcggtggagcagctccaaacagaggagatggagcatgtccaccgaaaacctggcggcagcgcaaaagatg

SEQ ID NO: 221175 - DNA, 103 bp, Artificial Sequence
  Synthetic Polynucleotide
taatacgactcactataggggctcgggcatggagaattccgcttcggtggaacagaggagaccaccgatgcggaattctaacctggcggcagcgcaaaagatg

SEQ ID NO: 221176 - DNA, 103 bp, Artificial Sequence
  Synthetic Polynucleotide
taatacgactcactatagggcccacagaccgctcgggcatggagaattccaacagaggagaggaattatgcatgcccgaaacctggcggcagcgcaaaagatg

SEQ ID NO: 221177 - DNA, 103 bp, Artificial Sequence
  Synthetic Polynucleotide
taatacgactcactatagggtgtcgtcttccccacagaccgctcgggcataacagaggagaatgcccatgcggtctgtgaacctggcggcagcgcaaaagatg

SEQ ID NO: 221178 - DNA, 103 bp, Artificial Sequence
  Synthetic Polynucleotide
taatacgactcactataggggcctcactgctgtcgtcttccccacagaccaacagaggagaggtctgatgggaagacgaaacctggcggcagcgcaaaagatg

SEQ ID NO: 221179 - DNA, 103 bp, Artificial Sequence
  Synthetic Polynucleotide
taatacgactcactatagggcggggagtccgcctcactgctgtcgtcttcaacagaggagagaagacatgagcagtgagaacctggcggcagcgcaaaagatg

SEQ ID NO: 221180 - DNA, 103 bp, Artificial Sequence
  Synthetic Polynucleotide
taatacgactcactatagggcacactgctcgtctttgtccaggtaactagaacagaggagactagttatgtggacaaagaacctggcggcagcgcaaaagatg

SEQ ID NO: 221181 - DNA, 103 bp, Artificial Sequence
  Synthetic Polynucleotide
taatacgactcactatagggcagaggagctcggggagtccgcctcactgcaacagaggagagcagtgatgcggactcccaacctggcggcagcgcaaaagatg

SEQ ID NO: 221182 - DNA, 103 bp, Artificial Sequence
  Synthetic Polynucleotide
taatacgactcactatagggggttcctcctcagaggagctcggggagtccaacagaggagaggactcatggagctcctcaacctggcggcagcgcaaaagatg

SEQ ID NO: 221183 - DNA, 103 bp, Artificial Sequence
  Synthetic Polynucleotide
taatacgactcactataggggcagacctccggttcctcctcagaggagctaacagaggagaagctccatggaggaggaaaacctggcggcagcgcaaaagatg

SEQ ID NO: 221184 - DNA, 103 bp, Artificial Sequence
  Synthetic Polynucleotide
taatacgactcactatagggccaggtcctcgcagacctccggttcctcctaacagaggagaaggaggatgcggaggtctaacctggcggcagcgcaaaagatg

SEQ ID NO: 221185 - DNA, 103 bp, Artificial Sequence
  Synthetic Polynucleotide
taatacgactcactataggggcattgcctgccaggtcctcgcagacctccaacagaggagaggaggtatgcgaggacctaacctggcggcagcgcaaaagatg

SEQ ID NO: 221186 - DNA, 103 bp, Artificial Sequence
  Synthetic Polynucleotide
taatacgactcactataggggggagaggctgcattgcctgccaggtcctcaacagaggagagaggacatggcaggcaataacctggcggcagcgcaaaagatg

SEQ ID NO: 221187 - DNA, 103 bp, Artificial Sequence
  Synthetic Polynucleotide
taatacgactcactatagggccacacacgacacactgctcgtctttgtccaacagaggagaggacaaatgcgagcagtgaacctggcggcagcgcaaaagatg

SEQ ID NO: 221188 - DNA, 103 bp, Artificial Sequence
  Synthetic Polynucleotide
taatacgactcactatagggtgccttgtccccacacacgacacactgctcaacagaggagagagcagatggtcgtgtgtaacctggcggcagcgcaaaagatg

SEQ ID NO: 221189 - DNA, 103 bp, Artificial Sequence
  Synthetic Polynucleotide
taatacgactcactataggggataaccagttgccttgtccccacacacgaaacagaggagatcgtgtatggggacaaggaacctggcggcagcgcaaaagatg

SEQ ID NO: 221190 - DNA, 103 bp, Artificial Sequence
  Synthetic Polynucleotide
taatacgactcactatagggcagcggtagtgataaccagttgccttgtccaacagaggagaggacaaatgaactggttaaacctggcggcagcgcaaaagatg

SEQ ID NO: 221191 - DNA, 103 bp, Artificial Sequence
  Synthetic Polynucleotide
taatacgactcactatagggacaagtgatacagcggtagtgataaccagtaacagaggagaactggtatgcactaccgcaacctggcggcagcgcaaaagatg

SEQ ID NO: 221192 - DNA, 103 bp, Artificial Sequence
  Synthetic Polynucleotide
taatacgactcactatagggggtctgacccacactccaccttgcttggctaacagaggagaagccaaatgaggtggagtaacctggcggcagcgcaaaagatg

SEQ ID NO: 221193 - DNA, 103 bp, Artificial Sequence
  Synthetic Polynucleotide
taatacgactcactatagggtgcagccctcacaagtgatacagcggtagtaacagaggagaactaccatggtatcacttaacctggcggcagcgcaaaagatg

SEQ ID NO: 221194 - DNA, 103 bp, Artificial Sequence
  Synthetic Polynucleotide
taatacgactcactatagggaagaagcccttgcagccctcacaagtgataaacagaggagatatcacatgtgagggctgaacctggcggcagcgcaaaagatg

SEQ ID NO: 221195 - DNA, 103 bp, Artificial Sequence
  Synthetic Polynucleotide
taatacgactcactatagggtgtgcggcgaaagaagcccttgcagccctcaacagaggagagagggcatgaagggcttcaacctggcggcagcgcaaaagatg

SEQ ID NO: 221196 - DNA, 103 bp, Artificial Sequence
  Synthetic Polynucleotide
taatacgactcactatagggtcttctggattgtgcggcgaaagaagccctaacagaggagaagggctatgttcgccgcaaacctggcggcagcgcaaaagatg

SEQ ID NO: 221197 - DNA, 103 bp, Artificial Sequence
  Synthetic Polynucleotide
taatacgactcactatagggggatggaggttcttctggattgtgcggcgaaacagaggagatcgccgatgaatccagaaaacctggcggcagcgcaaaagatg

SEQ ID NO: 221198 - DNA, 103 bp, Artificial Sequence
  Synthetic Polynucleotide
taatacgactcactatagggggaataggtgggatggaggttcttctggataacagaggagaatccagatgaacctccataacctggcggcagcgcaaaagatg

SEQ ID NO: 221199 - DNA, 103 bp, Artificial Sequence
  Synthetic Polynucleotide
taatacgactcactatagggcatatttgcaggaataggtgggatggaggtaacagaggagaacctccatgccacctattaacctggcggcagcgcaaaagatg

SEQ ID NO: 221200 - DNA, 103 bp, Artificial Sequence
  Synthetic Polynucleotide
taatacgactcactatagggcagcagctgtcatatttgcaggaataggtgaacagaggagacacctaatgctgcaaataaacctggcggcagcgcaaaagatg

SEQ ID NO: 221201 - DNA, 103 bp, Artificial Sequence
  Synthetic Polynucleotide
taatacgactcactataggggtcaatgacacagcagctgtcatatttgcaaacagaggagatgcaaaatggacagctgcaacctggcggcagcgcaaaagatg

SEQ ID NO: 221202 - DNA, 103 bp, Artificial Sequence
  Synthetic Polynucleotide
taatacgactcactataggggggtgatcttgtcaatgacacagcagctgtaacagaggagaacagctatggtgtcattgaacctggcggcagcgcaaaagatg

SEQ ID NO: 221203 - DNA, 103 bp, Artificial Sequence
  Synthetic Polynucleotide
taatacgactcactatagggttctcctctgggtctgacccacactccaccaacagaggagaggtggaatgtgggtcagaaacctggcggcagcgcaaaagatg

SEQ ID NO: 221204 - DNA, 103 bp, Artificial Sequence
  Synthetic Polynucleotide
taatacgactcactatagggcactgattgcgggtgatcttgtcaatgacaaacagaggagatgtcatatgcaagatcacaacctggcggcagcgcaaaagatg

SEQ ID NO: 221205 - DNA, 103 bp, Artificial Sequence
  Synthetic Polynucleotide
taatacgactcactataggggcacagctggcactgattgcgggtgatcttaacagaggagaaagatcatgcgcaatcagaacctggcggcagcgcaaaagatg

SEQ ID NO: 221206 - DNA, 103 bp, Artificial Sequence
  Synthetic Polynucleotide
taatacgactcactatagggtcttgaagcggcacagctggcactgattgcaacagaggagagcaatcatggccagctgtaacctggcggcagcgcaaaagatg

SEQ ID NO: 221207 - DNA, 103 bp, Artificial Sequence
  Synthetic Polynucleotide
taatacgactcactataggggcgatgcacttcttgaagcggcacagctggaacagaggagaccagctatgccgcttcaaaacctggcggcagcgcaaaagatg

SEQ ID NO: 221208 - DNA, 103 bp, Artificial Sequence
  Synthetic Polynucleotide
taatacgactcactatagggcatgcccacggcgatgcacttcttgaagcgaacagaggagacgcttcatgaagtgcatcaacctggcggcagcgcaaaagatg

SEQ ID NO: 221209 - DNA, 103 bp, Artificial Sequence
  Synthetic Polynucleotide
taatacgactcactatagggagtccatggccatgcccacggcgatgcactaacagaggagaagtgcaatgccgtgggcaaacctggcggcagcgcaaaagatg

SEQ ID NO: 221210 - DNA, 103 bp, Artificial Sequence
  Synthetic Polynucleotide
taatacgactcactatagggtctagaaccaagtccatggccatgcccacgaacagaggagacgtgggatgggccatggaaacctggcggcagcgcaaaagatg

SEQ ID NO: 221211 - DNA, 103 bp, Artificial Sequence
  Synthetic Polynucleotide
taatacgactcactatagggcttcgagtcatctagaaccaagtccatggcaacagaggagagccatgatgttggttctaaacctggcggcagcgcaaaagatg

SEQ ID NO: 221212 - DNA, 103 bp, Artificial Sequence
  Synthetic Polynucleotide
taatacgactcactatagggtggccacccgcttcgagtcatctagaaccaaacagaggagatggttcatgatgactcgaaacctggcggcagcgcaaaagatg

SEQ ID NO: 221213 - DNA, 103 bp, Artificial Sequence
  Synthetic Polynucleotide
taatacgactcactatagggagcttacgcttggccacccgcttcgagtcaaacagaggagatgactcatggcgggtggcaacctggcggcagcgcaaaagatg

SEQ ID NO: 221214 - DNA, 103 bp, Artificial Sequence
  Synthetic Polynucleotide
taatacgactcactatagggcctggcactgttctcctctgggtctgacccaacagaggagagggtcaatgccagaggagaacctggcggcagcgcaaaagatg

SEQ ID NO: 221215 - DNA, 103 bp, Artificial Sequence
  Synthetic Polynucleotide
taatacgactcactatagggctgctcaatcagcttacgcttggccacccgaacagaggagacgggtgatgaagcgtaagaacctggcggcagcgcaaaagatg

SEQ ID NO: 221216 - DNA, 103 bp, Artificial Sequence
  Synthetic Polynucleotide
taatacgactcactataggggctcccggttctgctcaatcagcttacgctaacagaggagaagcgtaatgtgattgagcaacctggcggcagcgcaaaagatg

SEQ ID NO: 221217 - DNA, 103 bp, Artificial Sequence
  Synthetic Polynucleotide
taatacgactcactatagggttccgccgccgctcccggttctgctcaatcaacagaggagagattgaatggaaccgggaaacctggcggcagcgcaaaagatg

SEQ ID NO: 221218 - DNA, 103 bp, Artificial Sequence
  Synthetic Polynucleotide
taatacgactcactatagggcatctcctccttccgccgccgctcccggttaacagaggagaaaccggatgcggcggcggaacctggcggcagcgcaaaagatg

SEQ ID NO: 221219 - DNA, 103 bp, Artificial Sequence
  Synthetic Polynucleotide
taatacgactcactataggggtgatcggatcatctcctccttccgccgccaacagaggagaggcggcatgaggaggagaaacctggcggcagcgcaaaagatg

SEQ ID NO: 221220 - DNA, 103 bp, Artificial Sequence
  Synthetic Polynucleotide
taatacgactcactatagggcgctgctgcagtgatcggatcatctcctccaacagaggagaggaggaatggatccgatcaacctggcggcagcgcaaaagatg

SEQ ID NO: 221221 - DNA, 103 bp, Artificial Sequence
  Synthetic Polynucleotide
taatacgactcactataggggggctctggtcgctgctgcagtgatcggataacagaggagaatccgaatgctgcagcagaacctggcggcagcgcaaaagatg

SEQ ID NO: 221222 - DNA, 103 bp, Artificial Sequence
  Synthetic Polynucleotide
taatacgactcactatagggcttcaggagtgggctctggtcgctgctgcaaacagaggagatgcagcatggaccagagcaacctggcggcagcgcaaaagatg

SEQ ID NO: 221223 - DNA, 103 bp, Artificial Sequence
  Synthetic Polynucleotide
taatacgactcactatagggagatcccactcttcaggagtgggctctggtaacagaggagaaccagaatgcactcctgaaacctggcggcagcgcaaaagatg

SEQ ID NO: 221224 - DNA, 103 bp, Artificial Sequence
  Synthetic Polynucleotide
taatacgactcactatagggaatgtggatcagatcccactcttcaggagtaacagaggagaactcctatggagtgggataacctggcggcagcgcaaaagatg

SEQ ID NO: 221225 - DNA, 103 bp, Artificial Sequence
  Synthetic Polynucleotide
taatacgactcactatagggcatctggtgacctggcactgttctcctctgaacagaggagacagaggatgacagtgccaaacctggcggcagcgcaaaagatg

SEQ ID NO: 221226 - DNA, 103 bp, Artificial Sequence
  Synthetic Polynucleotide
taatacgactcactatagggcctctgtggcaatgtggatcagatcccactaacagaggagaagtgggatgtgatccacaaacctggcggcagcgcaaaagatg

SEQ ID NO: 221227 - DNA, 103 bp, Artificial Sequence
  Synthetic Polynucleotide
taatacgactcactatagggctgcgatgggcctctgtggcaatgtggatcaacagaggagagatccaatgtgccacagaaacctggcggcagcgcaaaagatg

SEQ ID NO: 221228 - DNA, 103 bp, Artificial Sequence
  Synthetic Polynucleotide
taatacgactcactatagggggcattggtgctgcgatgggcctctgtggcaacagaggagagccacaatggcccatcgcaacctggcggcagcgcaaaagatg

SEQ ID NO: 221229 - DNA, 103 bp, Artificial Sequence
  Synthetic Polynucleotide
taatacgactcactatagggggctgccctgggcattggtgctgcgatgggaacagaggagacccatcatggcaccaatgaacctggcggcagcgcaaaagatg

SEQ ID NO: 221230 - DNA, 103 bp, Artificial Sequence
  Synthetic Polynucleotide
taatacgactcactatagggtgtttccaatggctgccctgggcattggtgaacagaggagacaccaaatgccagggcagaacctggcggcagcgcaaaagatg

SEQ ID NO: 221231 - DNA, 103 bp, Artificial Sequence
  Synthetic Polynucleotide
taatacgactcactatagggtttccgcctctgtttccaatggctgccctgaacagaggagacagggcatgcattggaaaaacctggcggcagcgcaaaagatg

SEQ ID NO: 221232 - DNA, 103 bp, Artificial Sequence
  Synthetic Polynucleotide
taatacgactcactatagggcgggcaggaatttccgcctctgtttccaataacagaggagaattggaatgagaggcggaaacctggcggcagcgcaaaagatg

SEQ ID NO: 221233 - DNA, 103 bp, Artificial Sequence
  Synthetic Polynucleotide
taatacgactcactatagggccaatgtcatcgggcaggaatttccgcctcaacagaggagagaggcgatgattcctgccaacctggcggcagcgcaaaagatg

SEQ ID NO: 221234 - DNA, 103 bp, Artificial Sequence
  Synthetic Polynucleotide
taatacgactcactataggggggtgactggccaatgtcatcgggcaggaaaacagaggagattcctgatggatgacattaacctggcggcagcgcaaaagatg

SEQ ID NO: 221235 - DNA, 103 bp, Artificial Sequence
  Synthetic Polynucleotide
taatacgactcactatagggtggagacaatgggtgactggccaatgtcataacagaggagaatgacaatggccagtcacaacctggcggcagcgcaaaagatg

SEQ ID NO: 221236 - DNA, 103 bp, Artificial Sequence
  Synthetic Polynucleotide
taatacgactcactatagggtttcgctttccatctggtgacctggcactgaacagaggagacagtgcatggtcaccagaaacctggcggcagcgcaaaagatg

SEQ ID NO: 221237 - DNA, 103 bp, Artificial Sequence
  Synthetic Polynucleotide
taatacgactcactatagggccgtccggcatggagacaatgggtgactggaacagaggagaccagtcatgcattgtctcaacctggcggcagcgcaaaagatg

SEQ ID NO: 221238 - DNA, 103 bp, Artificial Sequence
  Synthetic Polynucleotide
taatacgactcactatagggcaccttgtctccgtccggcatggagacaataacagaggagaattgtcatgatgccggacaacctggcggcagcgcaaaagatg

SEQ ID NO: 221239 - DNA, 103 bp, Artificial Sequence
  Synthetic Polynucleotide
taatacgactcactatagggcttccaggtccaccttgtctccgtccggcaaacagaggagatgccggatggagacaaggaacctggcggcagcgcaaaagatg

SEQ ID NO: 221240 - DNA, 103 bp, Artificial Sequence
  Synthetic Polynucleotide
taatacgactcactatagggtcgctgaaggcttccaggtccaccttgtctaacagaggagaagacaaatgggacctggaaacctggcggcagcgcaaaagatg

SEQ ID NO: 221241 - DNA, 103 bp, Artificial Sequence
  Synthetic Polynucleotide
taatacgactcactatagggcttggtaaactcgctgaaggcttccaggtcaacagaggagagacctgatggccttcagcaacctggcggcagcgcaaaagatg

SEQ ID NO: 221242 - DNA, 103 bp, Artificial Sequence
  Synthetic Polynucleotide
taatacgactcactataggggggtgatgatcttggtaaactcgctgaaggaacagaggagaccttcaatgagtttaccaaacctggcggcagcgcaaaagatg

SEQ ID NO: 221243 - DNA, 103 bp, Artificial Sequence
  Synthetic Polynucleotide
taatacgactcactataggggtgatggccggggtgatgatcttggtaaacaacagaggagagtttacatggatcatcacaacctggcggcagcgcaaaagatg

SEQ ID NO: 221244 - DNA, 103 bp, Artificial Sequence
  Synthetic Polynucleotide
taatacgactcactatagggcaccacacgggtgatggccggggtgatgataacagaggagaatcatcatgccggccatcaacctggcggcagcgcaaaagatg

SEQ ID NO: 221245 - DNA, 103 bp, Artificial Sequence
  Synthetic Polynucleotide
taatacgactcactatagggtggcaaagtccaccacacgggtgatggccgaacagaggagacggccaatgcccgtgtggaacctggcggcagcgcaaaagatg

SEQ ID NO: 221246 - DNA, 103 bp, Artificial Sequence
  Synthetic Polynucleotide
taatacgactcactatagggggcagttttttggcaaagtccaccacacggaacagaggagaccgtgtatgggactttgcaacctggcggcagcgcaaaagatg

SEQ ID NO: 221247 - DNA, 103 bp, Artificial Sequence
  Synthetic Polynucleotide
taatacgactcactataggggttctttctttttcgctttccatctggtgaaacagaggagatcaccaatgggaaagcgaaacctggcggcagcgcaaaagatg

SEQ ID NO: 221248 - DNA, 103 bp, Artificial Sequence
  Synthetic Polynucleotide
taatacgactcactatagggggagaacatgggcagttttttggcaaagtcaacagaggagagactttatgaaaaaactgaacctggcggcagcgcaaaagatg

SEQ ID NO: 221249 - DNA, 103 bp, Artificial Sequence
  Synthetic Polynucleotide
taatacgactcactatagggaaggcagctcggagaacatgggcagtttttaacagaggagaaaaaacatgccatgttctaacctggcggcagcgcaaaagatg

SEQ ID NO: 221250 - DNA, 103 bp, Artificial Sequence
  Synthetic Polynucleotide
taatacgactcactatagggtggtcttcgcaaggcagctcggagaacatgaacagaggagacatgttatgcgagctgccaacctggcggcagcgcaaaagatg

SEQ ID NO: 221251 - DNA, 103 bp, Artificial Sequence
  Synthetic Polynucleotide
taatacgactcactataggggaggatgatctggtcttcgcaaggcagctcaacagaggagagagctgatgtgcgaagacaacctggcggcagcgcaaaagatg

SEQ ID NO: 221252 - DNA, 103 bp, Artificial Sequence
  Synthetic Polynucleotide
taatacgactcactatagggaccccttcaggaggatgatctggtcttcgcaacagaggagagcgaagatgagatcatccaacctggcggcagcgcaaaagatg

SEQ ID NO: 221253 - DNA, 103 bp, Artificial Sequence
  Synthetic Polynucleotide
taatacgactcactatagggtccatgcagcaccccttcaggaggatgatcaacagaggagagatcatatgcctgaagggaacctggcggcagcgcaaaagatg

SEQ ID NO: 221254 - DNA, 103 bp, Artificial Sequence
  Synthetic Polynucleotide
taatacgactcactatagggggacatgatctccatgcagcaccccttcagaacagaggagactgaagatgtgctgcatgaacctggcggcagcgcaaaagatg

SEQ ID NO: 221255 - DNA, 103 bp, Artificial Sequence
  Synthetic Polynucleotide
taatacgactcactatagggccgcccgcagggacatgatctccatgcagcaacagaggagagctgcaatgagatcatgtaacctggcggcagcgcaaaagatg

SEQ ID NO: 221256 - DNA, 103 bp, Artificial Sequence
  Synthetic Polynucleotide
taatacgactcactatagggtagcggacagccgcccgcagggacatgatcaacagaggagagatcatatgcctgcgggcaacctggcggcagcgcaaaagatg

SEQ ID NO: 221257 - DNA, 103 bp, Artificial Sequence
  Synthetic Polynucleotide
taatacgactcactatagggctcagggtcgtagcggacagccgcccgcagaacagaggagactgcggatggctgtccgcaacctggcggcagcgcaaaagatg

SEQ ID NO: 221258 - DNA, 103 bp, Artificial Sequence
  Synthetic Polynucleotide
taatacgactcactatagggaacattggccgttctttctttttcgctttcaacagaggagagaaagcatgaaagaaagaaacctggcggcagcgcaaaagatg

SEQ ID NO: 221259 - DNA, 103 bp, Artificial Sequence
  Synthetic Polynucleotide
taatacgactcactataggggggtgtcgctctcagggtcgtagcggacagaacagaggagactgtccatgacgaccctgaacctggcggcagcgcaaaagatg

SEQ ID NO: 221260 - DNA, 103 bp, Artificial Sequence
  Synthetic Polynucleotide
taatacgactcactatagggctcagcgtcagggtgtcgctctcagggtcgaacagaggagacgacccatggagcgacacaacctggcggcagcgcaaaagatg

SEQ ID NO: 221261 - DNA, 103 bp, Artificial Sequence
  Synthetic Polynucleotide
taatacgactcactatagggcatctccccactcagcgtcagggtgtcgctaacagaggagaagcgacatgctgacgctgaacctggcggcagcgcaaaagatg

SEQ ID NO: 221262 - DNA, 103 bp, Artificial Sequence
  Synthetic Polynucleotide
taatacgactcactataggggcttgacagccatctccccactcagcgtcaaacagaggagatgacgcatggtggggagaaacctggcggcagcgcaaaagatg

SEQ ID NO: 221263 - DNA, 103 bp, Artificial Sequence
  Synthetic Polynucleotide
taatacgactcactatagggagctgctcccgcttgacagccatctccccaaacagaggagatggggaatgggctgtcaaaacctggcggcagcgcaaaagatg

SEQ ID NO: 221264 - DNA, 103 bp, Artificial Sequence
  Synthetic Polynucleotide
taatacgactcactataggggccattcttgagctgctcccgcttgacagcaacagaggagagctgtcatgcgggagcagaacctggcggcagcgcaaaagatg

SEQ ID NO: 221265 - DNA, 103 bp, Artificial Sequence
  Synthetic Polynucleotide
taatacgactcactatagggcgcccaggccgccattcttgagctgctcccaacagaggagagggagcatgtcaagaatgaacctggcggcagcgcaaaagatg

SEQ ID NO: 221266 - DNA, 103 bp, Artificial Sequence
  Synthetic Polynucleotide
taatacgactcactatagggtcggagactacgcccaggccgccattcttgaacagaggagacaagaaatgcggcctgggaacctggcggcagcgcaaaagatg

SEQ ID NO: 221267 - DNA, 103 bp, Artificial Sequence
  Synthetic Polynucleotide
taatacgactcactatagggaaagatggcgtcggagactacgcccaggccaacagaggagaggcctgatggtagtctccaacctggcggcagcgcaaaagatg

SEQ ID NO: 221268 - DNA, 103 bp, Artificial Sequence
  Synthetic Polynucleotide
taatacgactcactatagggtgcccagttcaaagatggcgtcggagactaaacagaggagatagtctatgacgccatctaacctggcggcagcgcaaaagatg

SEQ ID NO: 221269 - DNA, 103 bp, Artificial Sequence
  Synthetic Polynucleotide
taatacgactcactataggggttttcagggaacattggccgttctttcttaacagaggagaaagaaaatgcggccaatgaacctggcggcagcgcaaaagatg

SEQ ID NO: 221270 - DNA, 103 bp, Artificial Sequence
  Synthetic Polynucleotide
taatacgactcactataggggagagtgacttgcccagttcaaagatggcgaacagaggagacgccatatgtgaactgggaacctggcggcagcgcaaaagatg

SEQ ID NO: 221271 - DNA, 103 bp, Artificial Sequence
  Synthetic Polynucleotide
taatacgactcactataggggttaaaggcagagagtgacttgcccagttcaacagaggagagaactgatgaagtcactcaacctggcggcagcgcaaaagatg

SEQ ID NO: 221272 - DNA, 103 bp, Artificial Sequence
  Synthetic Polynucleotide
taatacgactcactatagggtgtcatccaggttaaaggcagagagtgactaacagaggagaagtcacatgctgcctttaaacctggcggcagcgcaaaagatg

SEQ ID NO: 221273 - DNA, 103 bp, Artificial Sequence
  Synthetic Polynucleotide
taatacgactcactataggggccacttccgtgtcatccaggttaaaggcaaacagaggagatgccttatgcctggatgaaacctggcggcagcgcaaaagatg

SEQ ID NO: 221274 - DNA, 103 bp, Artificial Sequence
  Synthetic Polynucleotide
taatacgactcactatagggctgcagcagagccacttccgtgtcatccagaacagaggagactggatatgacggaagtgaacctggcggcagcgcaaaagatg

SEQ ID NO: 221275 - DNA, 103 bp, Artificial Sequence
  Synthetic Polynucleotide
taatacgactcactataggggcagcacagcctgcagcagagccacttccgaacagaggagacggaagatgctctgctgcaacctggcggcagcgcaaaagatg

SEQ ID NO: 221276 - DNA, 103 bp, Artificial Sequence
  Synthetic Polynucleotide
taatacgactcactataggggttgacattagcagcacagcctgcagcagaaacagaggagatctgctatgggctgtgctaacctggcggcagcgcaaaagatg

SEQ ID NO: 221277 - DNA, 103 bp, Artificial Sequence
  Synthetic Polynucleotide
taatacgactcactatagggcgagcggtctgttgacattagcagcacagcaacagaggagagctgtgatgctaatgtcaaacctggcggcagcgcaaaagatg

SEQ ID NO: 221278 - DNA, 103 bp, Artificial Sequence
  Synthetic Polynucleotide
taatacgactcactatagggacagcaggcccgagcggtctgttgacattaaacagaggagataatgtatgcagaccgctaacctggcggcagcgcaaaagatg

SEQ ID NO: 221279 - DNA, 103 bp, Artificial Sequence
  Synthetic Polynucleotide
taatacgactcactatagggttgtccacacacagcaggcccgagcggtctaacagaggagaagaccgatggggcctgctaacctggcggcagcgcaaaagatg

SEQ ID NO: 221280 - DNA, 103 bp, Artificial Sequence
  Synthetic Polynucleotide
taatacgactcactatagggtccagacttggatttgtttgtttttgacataacagaggagaatgtcaatgacaaacaaaaacctggcggcagcgcaaaagatg

SEQ ID NO: 221281 - DNA, 103 bp, Artificial Sequence
  Synthetic Polynucleotide
taatacgactcactatagggtgaacgagagagagatcggcttcgggaccgaacagaggagacggtccatgagccgatctaacctggcggcagcgcaaaagatg

SEQ ID NO: 221282 - DNA, 103 bp, Artificial Sequence
  Synthetic Polynucleotide
taatacgactcactatagggtcctgaagcagcactctcctccttctgagaaacagaggagatctcagatggaggagagtaacctggcggcagcgcaaaagatg

SEQ ID NO: 221283 - DNA, 103 bp, Artificial Sequence
  Synthetic Polynucleotide
taatacgactcactatagggaggctgctcctcctgaagcagcactctcctaacagaggagaaggagaatgctgcttcagaacctggcggcagcgcaaaagatg

SEQ ID NO: 221284 - DNA, 103 bp, Artificial Sequence
  Synthetic Polynucleotide
taatacgactcactatagggctctttgtataggctgctcctcctgaagcaaacagaggagatgcttcatgaggagcagcaacctggcggcagcgcaaaagatg

SEQ ID NO: 221285 - DNA, 103 bp, Artificial Sequence
  Synthetic Polynucleotide
taatacgactcactatagggttctagatacctctttgtataggctgctccaacagaggagaggagcaatgtatacaaagaacctggcggcagcgcaaaagatg

SEQ ID NO: 221286 - DNA, 103 bp, Artificial Sequence
  Synthetic Polynucleotide
taatacgactcactatagggtcttctgctcttctagatacctctttgtataacagaggagaatacaaatgggtatctagaacctggcggcagcgcaaaagatg

SEQ ID NO: 221287 - DNA, 103 bp, Artificial Sequence
  Synthetic Polynucleotide
taatacgactcactatagggccattctctgtcttctgctcttctagatacaacagaggagagtatctatgagagcagaaaacctggcggcagcgcaaaagatg

SEQ ID NO: 221288 - DNA, 103 bp, Artificial Sequence
  Synthetic Polynucleotide
taatacgactcactatagggcttatcttttccattctctgtcttctgctcaacagaggagagagcagatgacagagaataacctggcggcagcgcaaaagatg

SEQ ID NO: 221289 - DNA, 103 bp, Artificial Sequence
  Synthetic Polynucleotide
taatacgactcactataggggtttctgttccttatcttttccattctctgaacagaggagacagagaatggaaaagataaacctggcggcagcgcaaaagatg

SEQ ID NO: 221290 - DNA, 103 bp, Artificial Sequence
  Synthetic Polynucleotide
taatacgactcactataggggtatttgtttgtttctgttccttatcttttaacagaggagaaaaagaatgggaacagaaaacctggcggcagcgcaaaagatg

SEQ ID NO: 221291 - DNA, 103 bp, Artificial Sequence
  Synthetic Polynucleotide
taatacgactcactatagggttctttatcggtatttgtttgtttctgttcaacagaggagagaacagatgcaaacaaataacctggcggcagcgcaaaagatg

SEQ ID NO: 221292 - DNA, 103 bp, Artificial Sequence
  Synthetic Polynucleotide
taatacgactcactatagggtgcgcttccttgaacgagagagagatcggcaacagaggagagccgatatgtctctcgttaacctggcggcagcgcaaaagatg

SEQ ID NO: 221293 - DNA, 103 bp, Artificial Sequence
  Synthetic Polynucleotide
taatacgactcactatagggcttttattttttctttatcggtatttgtttaacagaggagaaaacaaatgccgataaagaacctggcggcagcgcaaaagatg

SEQ ID NO: 221294 - DNA, 103 bp, Artificial Sequence
  Synthetic Polynucleotide
taatacgactcactatagggctccctttctcttttattttttctttatcgaacagaggagacgataaatgaaaaataaaaacctggcggcagcgcaaaagatg

SEQ ID NO: 221295 - DNA, 103 bp, Artificial Sequence
  Synthetic Polynucleotide
taatacgactcactataggggtcagagaagctccctttctcttttattttaacagaggagaaaaataatggagaaagggaacctggcggcagcgcaaaagatg

SEQ ID NO: 221296 - DNA, 103 bp, Artificial Sequence
  Synthetic Polynucleotide
taatacgactcactatagggccaagcctgtgtcagagaagctccctttctaacagaggagaagaaagatggcttctctgaacctggcggcagcgcaaaagatg

SEQ ID NO: 221297 - DNA, 103 bp, Artificial Sequence
  Synthetic Polynucleotide
taatacgactcactatagggtttccatcacccaagcctgtgtcagagaagaacagaggagacttctcatgcacaggcttaacctggcggcagcgcaaaagatg

SEQ ID NO: 221298 - DNA, 103 bp, Artificial Sequence
  Synthetic Polynucleotide
taatacgactcactatagggagatttcatttttccatcacccaagcctgtaacagaggagaacaggcatgggtgatggaaacctggcggcagcgcaaaagatg

SEQ ID NO: 221299 - DNA, 103 bp, Artificial Sequence
  Synthetic Polynucleotide
taatacgactcactatagggcaaaagaatcagatttcatttttccatcacaacagaggagagtgatgatgaaatgaaataacctggcggcagcgcaaaagatg

SEQ ID NO: 221300 - DNA, 103 bp, Artificial Sequence
  Synthetic Polynucleotide
taatacgactcactataggggttttgggagcaaaagaatcagatttcattaacagaggagaaatgaaatgtgattctttaacctggcggcagcgcaaaagatg

SEQ ID NO: 221301 - DNA, 103 bp, Artificial Sequence
  Synthetic Polynucleotide
taatacgactcactatagggctcagaatcagttttgggagcaaaagaatcaacagaggagagattctatggctcccaaaaacctggcggcagcgcaaaagatg

SEQ ID NO: 221302 - DNA, 103 bp, Artificial Sequence
  Synthetic Polynucleotide
taatacgactcactataggggaaaaggcttctcagaatcagttttgggagaacagaggagactcccaatgctgattctgaacctggcggcagcgcaaaagatg

SEQ ID NO: 221303 - DNA, 103 bp, Artificial Sequence
  Synthetic Polynucleotide
taatacgactcactataggggaactcagcctgcgcttccttgaacgagagaacagaggagactctcgatgaaggaagcgaacctggcggcagcgcaaaagatg

SEQ ID NO: 221304 - DNA, 103 bp, Artificial Sequence
  Synthetic Polynucleotide
taatacgactcactatagggtgactgccccgaaaaggcttctcagaatcaaacagaggagatgattcatggaagcctttaacctggcggcagcgcaaaagatg

SEQ ID NO: 221305 - DNA, 103 bp, Artificial Sequence
  Synthetic Polynucleotide
taatacgactcactatagggtttgggagactgactgccccgaaaaggcttaacagaggagaaagcctatgcggggcagtaacctggcggcagcgcaaaagatg

SEQ ID NO: 221306 - DNA, 103 bp, Artificial Sequence
  Synthetic Polynucleotide
taatacgactcactataggggcttataccttttgggagactgactgccccaacagaggagaggggcaatgagtctcccaaacctggcggcagcgcaaaagatg

SEQ ID NO: 221307 - DNA, 103 bp, Artificial Sequence
  Synthetic Polynucleotide
taatacgactcactatagggtcatctcggagcttataccttttgggagacaacagaggagagtctccatgaaggtataaaacctggcggcagcgcaaaagatg

SEQ ID NO: 221308 - DNA, 103 bp, Artificial Sequence
  Synthetic Polynucleotide
taatacgactcactatagggcttctcaaagtcatctcggagcttatacctaacagaggagaaggtatatgctccgagataacctggcggcagcgcaaaagatg

SEQ ID NO: 221309 - DNA, 103 bp, Artificial Sequence
  Synthetic Polynucleotide
taatacgactcactatagggcagccatcttcttctcaaagtcatctcggaaacagaggagatccgagatgactttgagaaacctggcggcagcgcaaaagatg

SEQ ID NO: 221310 - DNA, 103 bp, Artificial Sequence
  Synthetic Polynucleotide
taatacgactcactatagggttgtggaagtcagccatcttcttctcaaagaacagaggagactttgaatggaagatggcaacctggcggcagcgcaaaagatg

SEQ ID NO: 221311 - DNA, 103 bp, Artificial Sequence
  Synthetic Polynucleotide
taatacgactcactatagggcatctcctccttgtggaagtcagccatcttaacagaggagaaagatgatggacttccacaacctggcggcagcgcaaaagatg

SEQ ID NO: 221312 - DNA, 103 bp, Artificial Sequence
  Synthetic Polynucleotide
taatacgactcactatagggcttgatcatccatctcctccttgtggaagtaacagaggagaacttccatgaggaggagaaacctggcggcagcgcaaaagatg

SEQ ID NO: 221313 - DNA, 103 bp, Artificial Sequence
  Synthetic Polynucleotide
taatacgactcactatagggttgtccttatcttgatcatccatctcctccaacagaggagaggaggaatgggatgatcaaacctggcggcagcgcaaaagatg

SEQ ID NO: 221314 - DNA, 103 bp, Artificial Sequence
  Synthetic Polynucleotide
taatacgactcactatagggacgagacctagaactcagcctgcgcttcctaacagaggagaaggaagatgaggctgagtaacctggcggcagcgcaaaagatg

SEQ ID NO: 221315 - DNA, 103 bp, Artificial Sequence
  Synthetic Polynucleotide
taatacgactcactatagggtcccttagctttgtccttatcttgatcatcaacagaggagagatgatatggataaggacaacctggcggcagcgcaaaagatg

SEQ ID NO: 221316 - DNA, 103 bp, Artificial Sequence
  Synthetic Polynucleotide
taatacgactcactatagggattcctttcttcccttagctttgtccttataacagaggagaataaggatgaagctaaggaacctggcggcagcgcaaaagatg

SEQ ID NO: 221317 - DNA, 103 bp, Artificial Sequence
  Synthetic Polynucleotide
taatacgactcactatagggtcaaactcagattcctttcttcccttagctaacagaggagaagctaaatgaagaaaggaaacctggcggcagcgcaaaagatg

SEQ ID NO: 221318 - DNA, 103 bp, Artificial Sequence
  Synthetic Polynucleotide
taatacgactcactataggggggttcatcatcaaactcagattcctttctaacagaggagaagaaagatgtctgagtttaacctggcggcagcgcaaaagatg

SEQ ID NO: 221319 - DNA, 103 bp, Artificial Sequence
  Synthetic Polynucleotide
taatacgactcactatagggacataaatttgggttcatcatcaaactcagaacagaggagactgagtatgatgatgaacaacctggcggcagcgcaaaagatg

SEQ ID NO: 221320 - DNA, 103 bp, Artificial Sequence
  Synthetic Polynucleotide
taatacgactcactatagggatgactttagacataaatttgggttcatcaaacagaggagatgatgaatgcaaatttataacctggcggcagcgcaaaagatg

SEQ ID NO: 221321 - DNA, 103 bp, Artificial Sequence
  Synthetic Polynucleotide
taatacgactcactataggggtttgcacctatgactttagacataaatttaacagaggagaaaatttatgtctaaagtcaacctggcggcagcgcaaaagatg

SEQ ID NO: 221322 - DNA, 103 bp, Artificial Sequence
  Synthetic Polynucleotide
taatacgactcactatagggcctggtttttgtttgcacctatgactttagaacagaggagactaaagatgtaggtgcaaaacctggcggcagcgcaaaagatg

SEQ ID NO: 221323 - DNA, 103 bp, Artificial Sequence
  Synthetic Polynucleotide
taatacgactcactatagggttctcctcctcctggtttttgtttgcacctaacagaggagaaggtgcatgcaaaaaccaaacctggcggcagcgcaaaagatg

SEQ ID NO: 221324 - DNA, 103 bp, Artificial Sequence
  Synthetic Polynucleotide
taatacgactcactatagggtttgcctgacttctcctcctcctggtttttaacagaggagaaaaaacatggaggaggagaacctggcggcagcgcaaaagatg

SEQ ID NO: 221325 - DNA, 103 bp, Artificial Sequence
  Synthetic Polynucleotide
taatacgactcactatagggatgatctggaacgagacctagaactcagccaacagaggagaggctgaatgctaggtctcaacctggcggcagcgcaaaagatg

SEQ ID NO: 221326 - DNA, 103 bp, Artificial Sequence
  Synthetic Polynucleotide
taatacgactcactatagggggccctcccatttgcctgacttctcctcctaacagaggagaaggaggatgagtcaggcaaacctggcggcagcgcaaaagatg

SEQ ID NO: 221327 - DNA, 103 bp, Artificial Sequence
  Synthetic Polynucleotide
taatacgactcactataggggcatataccaggccctcccatttgcctgacaacagaggagagtcaggatgatgggagggaacctggcggcagcgcaaaagatg

SEQ ID NO: 221328 - DNA, 103 bp, Artificial Sequence
  Synthetic Polynucleotide
taatacgactcactatagggccctggaggtgcatataccaggccctcccaaacagaggagatgggagatgctggtatataacctggcggcagcgcaaaagatg

SEQ ID NO: 221329 - DNA, 103 bp, Artificial Sequence
  Synthetic Polynucleotide
taatacgactcactataggggcttttccttccctggaggtgcatataccaaacagaggagatggtatatgcacctccagaacctggcggcagcgcaaaagatg

SEQ ID NO: 221330 - DNA, 103 bp, Artificial Sequence
  Synthetic Polynucleotide
taatacgactcactataggggtttttctctgcttttccttccctggaggtaacagaggagaacctccatggaaggaaaaaacctggcggcagcgcaaaagatg

SEQ ID NO: 221331 - DNA, 103 bp, Artificial Sequence
  Synthetic Polynucleotide
taatacgactcactatagggcagctcctctgtttttctctgcttttccttaacagaggagaaaggaaatgcagagaaaaaacctggcggcagcgcaaaagatg

SEQ ID NO: 221332 - DNA, 103 bp, Artificial Sequence
  Synthetic Polynucleotide
taatacgactcactatagggactcctcctccagctcctctgtttttctctaacagaggagaagagaaatgcagaggagcaacctggcggcagcgcaaaagatg

SEQ ID NO: 221333 - DNA, 103 bp, Artificial Sequence
  Synthetic Polynucleotide
taatacgactcactatagggtctgggaaagactcctcctccagctcctctaacagaggagaagaggaatgggaggaggaaacctggcggcagcgcaaaagatg

SEQ ID NO: 221334 - DNA, 103 bp, Artificial Sequence
  Synthetic Polynucleotide
taatacgactcactatagggtttggatctctctgggaaagactcctcctcaacagaggagagaggagatgtctttcccaaacctggcggcagcgcaaaagatg

SEQ ID NO: 221335 - DNA, 103 bp, Artificial Sequence
  Synthetic Polynucleotide
taatacgactcactataggggatcttcctttttggatctctctgggaaagaacagaggagactttccatgagagatccaaacctggcggcagcgcaaaagatg

SEQ ID NO: 221336 - DNA, 103 bp, Artificial Sequence
  Synthetic Polynucleotide
taatacgactcactataggggctggagaatatgatctggaacgagacctaaacagaggagataggtcatgttccagatcaacctggcggcagcgcaaaagatg

SEQ ID NO: 221337 - DNA, 103 bp, Artificial Sequence
  Synthetic Polynucleotide
taatacgactcactatagggctcttgccccgatcttcctttttggatctcaacagaggagagagatcatgaaaggaagaaacctggcggcagcgcaaaagatg

SEQ ID NO: 221338 - DNA, 103 bp, Artificial Sequence
  Synthetic Polynucleotide
taatacgactcactatagggaccttcgcttctcttgccccgatcttccttaacagaggagaaaggaaatgcggggcaagaacctggcggcagcgcaaaagatg

SEQ ID NO: 221339 - DNA, 103 bp, Artificial Sequence
  Synthetic Polynucleotide
taatacgactcactatagggccctgtgcccaccttcgcttctcttgccccaacagaggagaggggcaatggaagcgaagaacctggcggcagcgcaaaagatg

SEQ ID NO: 221340 - DNA, 103 bp, Artificial Sequence
  Synthetic Polynucleotide
taatacgactcactatagggggcacaaagcccctgtgcccaccttcgcttaacagaggagaaagcgaatgtgggcacagaacctggcggcagcgcaaaagatg

SEQ ID NO: 221341 - DNA, 103 bp, Artificial Sequence
  Synthetic Polynucleotide
taatacgactcactatagggattcttctcaggcacaaagcccctgtgcccaacagaggagagggcacatgggctttgtgaacctggcggcagcgcaaaagatg

SEQ ID NO: 221342 - DNA, 103 bp, Artificial Sequence
  Synthetic Polynucleotide
taatacgactcactatagggtcactcggaaattcttctcaggcacaaagcaacagaggagagctttgatgctgagaagaaacctggcggcagcgcaaaagatg

SEQ ID NO: 221343 - DNA, 103 bp, Artificial Sequence
  Synthetic Polynucleotide
taatacgactcactatagggttataagcagtcactcggaaattcttctcaaacagaggagatgagaaatgtttccgagtaacctggcggcagcgcaaaagatg

SEQ ID NO: 221344 - DNA, 103 bp, Artificial Sequence
  Synthetic Polynucleotide
taatacgactcactatagggctggactgctttataagcagtcactcggaaaacagaggagattccgaatgactgcttataacctggcggcagcgcaaaagatg

SEQ ID NO: 221345 - DNA, 103 bp, Artificial Sequence
  Synthetic Polynucleotide
taatacgactcactatagggagcttttctcctggactgctttataagcagaacagaggagactgcttatgaagcagtccaacctggcggcagcgcaaaagatg

SEQ ID NO: 221346 - DNA, 103 bp, Artificial Sequence
  Synthetic Polynucleotide
taatacgactcactatagggggaggtgatgagcttttctcctggactgctaacagaggagaagcagtatgggagaaaagaacctggcggcagcgcaaaagatg

SEQ ID NO: 221347 - DNA, 103 bp, Artificial Sequence
  Synthetic Polynucleotide
taatacgactcactatagggtctgttatgagctggagaatatgatctggaaacagaggagatccagaatgtattctccaaacctggcggcagcgcaaaagatg

SEQ ID NO: 221348 - DNA, 103 bp, Artificial Sequence
  Synthetic Polynucleotide
taatacgactcactatagggctttcttgggggaggtgatgagcttttctcaacagaggagagagaaaatgtcatcacctaacctggcggcagcgcaaaagatg

SEQ ID NO: 221349 - DNA, 103 bp, Artificial Sequence
  Synthetic Polynucleotide
taatacgactcactatagggtctcagaggtctttcttgggggaggtgatgaacagaggagacatcacatgccccaagaaaacctggcggcagcgcaaaagatg

SEQ ID NO: 221350 - DNA, 103 bp, Artificial Sequence
  Synthetic Polynucleotide
taatacgactcactatagggttgtctcggctctcagaggtctttcttgggaacagaggagacccaagatggacctctgaaacctggcggcagcgcaaaagatg

SEQ ID NO: 221351 - DNA, 103 bp, Artificial Sequence
  Synthetic Polynucleotide
taatacgactcactatagggcgctcccagcttgtctcggctctcagaggtaacagaggagaacctctatgagccgagacaacctggcggcagcgcaaaagatg

SEQ ID NO: 221352 - DNA, 103 bp, Artificial Sequence
  Synthetic Polynucleotide
taatacgactcactatagggaatctcctttcgctcccagcttgtctcggcaacagaggagagccgagatgagctgggagaacctggcggcagcgcaaaagatg

SEQ ID NO: 221353 - DNA, 103 bp, Artificial Sequence
  Synthetic Polynucleotide
taatacgactcactatagggcctgtgggaaaatctcctttcgctcccagcaacagaggagagctgggatggaaaggagaaacctggcggcagcgcaaaagatg

SEQ ID NO: 221354 - DNA, 103 bp, Artificial Sequence
  Synthetic Polynucleotide
taatacgactcactatagggggaagactttcctgtgggaaaatctcctttaacagaggagaaaaggaatgtttcccacaaacctggcggcagcgcaaaagatg

SEQ ID NO: 221355 - DNA, 103 bp, Artificial Sequence
  Synthetic Polynucleotide
taatacgactcactatagggtaatggaaaaggaagactttcctgtgggaaaacagaggagattcccaatggaaagtcttaacctggcggcagcgcaaaagatg

SEQ ID NO: 221356 - DNA, 103 bp, Artificial Sequence
  Synthetic Polynucleotide
taatacgactcactataggggcctctcgagtaatggaaaaggaagactttaacagaggagaaaagtcatgcttttccataacctggcggcagcgcaaaagatg

SEQ ID NO: 221357 - DNA, 103 bp, Artificial Sequence
  Synthetic Polynucleotide
taatacgactcactatagggattgacctgtgcctctcgagtaatggaaaaaacagaggagattttccatgactcgagagaacctggcggcagcgcaaaagatg

SEQ ID NO: 221358 - DNA, 103 bp, Artificial Sequence
  Synthetic Polynucleotide
taatacgactcactatagggggtttctttctctgttatgagctggagaataacagaggagaattctcatgctcataacaaacctggcggcagcgcaaaagatg

SEQ ID NO: 221359 - DNA, 103 bp, Artificial Sequence
  Synthetic Polynucleotide
taatacgactcactatagggccatccggacattgacctgtgcctctcgagaacagaggagactcgagatgcacaggtcaaacctggcggcagcgcaaaagatg

SEQ ID NO: 221360 - DNA, 103 bp, Artificial Sequence
  Synthetic Polynucleotide
taatacgactcactatagggtcaaaagagtccatccggacattgacctgtaacagaggagaacaggtatgtgtccggataacctggcggcagcgcaaaagatg

SEQ ID NO: 221361 - DNA, 103 bp, Artificial Sequence
  Synthetic Polynucleotide
taatacgactcactataggggaggtcctcatcaaaagagtccatccggacaacagaggagagtccggatggactcttttaacctggcggcagcgcaaaagatg

SEQ ID NO: 221362 - DNA, 103 bp, Artificial Sequence
  Synthetic Polynucleotide
taatacgactcactatagggtgggtcgtgcgaggtcctcatcaaaagagtaacagaggagaactcttatgatgaggaccaacctggcggcagcgcaaaagatg

SEQ ID NO: 221363 - DNA, 103 bp, Artificial Sequence
  Synthetic Polynucleotide
taatacgactcactatagggaataagccactgggtcgtgcgaggtcctcaaacagaggagatgaggaatgcgcacgaccaacctggcggcagcgcaaaagatg

SEQ ID NO: 221364 - DNA, 103 bp, Artificial Sequence
  Synthetic Polynucleotide
taatacgactcactatagggttcctgagccaataagccactgggtcgtgcaacagaggagagcacgaatgagtggcttaaacctggcggcagcgcaaaagatg

SEQ ID NO: 221365 - DNA, 103 bp, Artificial Sequence
  Synthetic Polynucleotide
taatacgactcactatagggaaagcttgcgttcctgagccaataagccacaacagaggagagtggctatgtggctcaggaacctggcggcagcgcaaaagatg

SEQ ID NO: 221366 - DNA, 103 bp, Artificial Sequence
  Synthetic Polynucleotide
taatacgactcactatagggagatctcggcaaagcttgcgttcctgagccaacagaggagaggctcaatgacgcaagctaacctggcggcagcgcaaaagatg

SEQ ID NO: 221367 - DNA, 103 bp, Artificial Sequence
  Synthetic Polynucleotide
taatacgactcactataggggctatggactagatctcggcaaagcttgcgaacagaggagacgcaagatgtgccgagataacctggcggcagcgcaaaagatg

SEQ ID NO: 221368 - DNA, 103 bp, Artificial Sequence
  Synthetic Polynucleotide
taatacgactcactatagggcctttttgttgctatggactagatctcggcaacagaggagagccgagatgtagtccataaacctggcggcagcgcaaaagatg

SEQ ID NO: 221369 - DNA, 103 bp, Artificial Sequence
  Synthetic Polynucleotide
taatacgactcactatagggactcttgggtggtttctttctctgttatgaaacagaggagatcataaatgagaaagaaaaacctggcggcagcgcaaaagatg

SEQ ID NO: 221370 - DNA, 103 bp, Artificial Sequence
  Synthetic Polynucleotide
taatacgactcactatagggaactcctgttcctttttgttgctatggactaacagaggagaagtccaatgcaacaaaaaaacctggcggcagcgcaaaagatg

SEQ ID NO: 221371 - DNA, 103 bp, Artificial Sequence
  Synthetic Polynucleotide
taatacgactcactatagggaatggaacgaaactcctgttcctttttgttaacagaggagaaacaaaatggaacaggagaacctggcggcagcgcaaaagatg

SEQ ID NO: 221372 - DNA, 103 bp, Artificial Sequence
  Synthetic Polynucleotide
taatacgactcactatagggtgtgctggaaaatggaacgaaactcctgttaacagaggagaaacaggatgttcgttccaaacctggcggcagcgcaaaagatg

SEQ ID NO: 221373 - DNA, 103 bp, Artificial Sequence
  Synthetic Polynucleotide
taatacgactcactataggggctgattgtatgtgctggaaaatggaacgaaacagaggagatcgttcatgtttccagcaaacctggcggcagcgcaaaagatg

SEQ ID NO: 221374 - DNA, 103 bp, Artificial Sequence
  Synthetic Polynucleotide
taatacgactcactatagggctgagactgagctgattgtatgtgctggaaaacagaggagattccagatgatacaatcaaacctggcggcagcgcaaaagatg

SEQ ID NO: 221375 - DNA, 103 bp, Artificial Sequence
  Synthetic Polynucleotide
taatacgactcactatagggaggggctacgctgagactgagctgattgtaaacagaggagatacaatatgctcagtctcaacctggcggcagcgcaaaagatg

SEQ ID NO: 221376 - DNA, 103 bp, Artificial Sequence
  Synthetic Polynucleotide
taatacgactcactatagggaacagttctgaggggctacgctgagactgaaacagaggagatcagtcatggcgtagcccaacctggcggcagcgcaaaagatg

SEQ ID NO: 221377 - DNA, 103 bp, Artificial Sequence
  Synthetic Polynucleotide
taatacgactcactatagggatgttgggcaaacagttctgaggggctacgaacagaggagacgtagcatgtcagaactgaacctggcggcagcgcaaaagatg

SEQ ID NO: 221378 - DNA, 103 bp, Artificial Sequence
  Synthetic Polynucleotide
taatacgactcactatagggtggtcactatatgttgggcaaacagttctgaacagaggagacagaacatgttgcccaacaacctggcggcagcgcaaaagatg

SEQ ID NO: 221379 - DNA, 103 bp, Artificial Sequence
  Synthetic Polynucleotide
taatacgactcactatagggtggtgaacaatggtcactatatgttgggcaaacagaggagatgcccaatgtatagtgacaacctggcggcagcgcaaaagatg

SEQ ID NO: 221380 - DNA, 103 bp, Artificial Sequence
  Synthetic Polynucleotide
taatacgactcactatagggattctgatatactcttgggtggtttctttcaacagaggagagaaagaatgcacccaagaaacctggcggcagcgcaaaagatg

SEQ ID NO: 221381 - DNA, 103 bp, Artificial Sequence
  Synthetic Polynucleotide
taatacgactcactatagggctctttaacatggtgaacaatggtcactataacagaggagaatagtgatgattgttcacaacctggcggcagcgcaaaagatg

SEQ ID NO: 221382 - DNA, 103 bp, Artificial Sequence
  Synthetic Polynucleotide
taatacgactcactatagggcaaagtgatgctctttaacatggtgaacaaaacagaggagattgttcatgatgttaaagaacctggcggcagcgcaaaagatg

SEQ ID NO: 221383 - DNA, 103 bp, Artificial Sequence
  Synthetic Polynucleotide
taatacgactcactatagggcctgaggacccaaagtgatgctctttaacaaacagaggagatgttaaatggcatcacttaacctggcggcagcgcaaaagatg

SEQ ID NO: 221384 - DNA, 103 bp, Artificial Sequence
  Synthetic Polynucleotide
taatacgactcactatagggtaatgtcattcctgaggacccaaagtgatgaacagaggagacatcacatggggtcctcaaacctggcggcagcgcaaaagatg

SEQ ID NO: 221385 - DNA, 103 bp, Artificial Sequence
  Synthetic Polynucleotide
taatacgactcactatagggagcgttcatgtaatgtcattcctgaggaccaacagaggagaggtcctatggaatgacataacctggcggcagcgcaaaagatg

SEQ ID NO: 221386 - DNA, 103 bp, Artificial Sequence
  Synthetic Polynucleotide
taatacgactcactatagggtatttagtaaagcgttcatgtaatgtcattaacagaggagaaatgacatgacatgaacgaacctggcggcagcgcaaaagatg

SEQ ID NO: 221387 - DNA, 103 bp, Artificial Sequence
  Synthetic Polynucleotide
taatacgactcactatagggtctctttaggtatttagtaaagcgttcatgaacagaggagacatgaaatgtttactaaaaacctggcggcagcgcaaaagatg

SEQ ID NO: 221388 - DNA, 103 bp, Artificial Sequence
  Synthetic Polynucleotide
taatacgactcactataggggctcagttcctctctttaggtatttagtaaaacagaggagattactaatgacctaaagaaacctggcggcagcgcaaaagatg

SEQ ID NO: 221389 - DNA, 103 bp, Artificial Sequence
  Synthetic Polynucleotide
taatacgactcactataggggctgcctcctgctcagttcctctctttaggaacagaggagacctaaaatgaggaactgaaacctggcggcagcgcaaaagatg

SEQ ID NO: 221390 - DNA, 103 bp, Artificial Sequence
  Synthetic Polynucleotide
taatacgactcactatagggcttgtttttggctgcctcctgctcagttccaacagaggagaggaactatgcaggaggcaaacctggcggcagcgcaaaagatg

SEQ ID NO: 221391 - DNA, 103 bp, Artificial Sequence
  Synthetic Polynucleotide
taatacgactcactatagggaagagcgagatccagacttggatttgtttgaacagaggagacaaacaatgccaagtctgaacctggcggcagcgcaaaagatg

SEQ ID NO: 221392 - DNA, 103 bp, Artificial Sequence
  Synthetic Polynucleotide
taatacgactcactatagggggaaatcccgattctgatatactcttgggtaacagaggagaacccaaatgtatatcagaaacctggcggcagcgcaaaagatg

SEQ ID NO: 221393 - DNA, 103 bp, Artificial Sequence
  Synthetic Polynucleotide
taatacgactcactatagggctgggcttttcttgtttttggctgcctcctaacagaggagaaggaggatgccaaaaacaaacctggcggcagcgcaaaagatg

SEQ ID NO: 221394 - DNA, 103 bp, Artificial Sequence
  Synthetic Polynucleotide
taatacgactcactatagggctgtgtatctctgggcttttcttgtttttgaacagaggagacaaaaaatggaaaagcccaacctggcggcagcgcaaaagatg

SEQ ID NO: 221395 - DNA, 103 bp, Artificial Sequence
  Synthetic Polynucleotide
taatacgactcactataggggtctattctcctgtgtatctctgggcttttaacagaggagaaaaagcatggagatacacaacctggcggcagcgcaaaagatg

SEQ ID NO: 221396 - DNA, 103 bp, Artificial Sequence
  Synthetic Polynucleotide
taatacgactcactatagggtgggggaaatgtctattctcctgtgtatctaacagaggagaagatacatgggagaatagaacctggcggcagcgcaaaagatg

SEQ ID NO: 221397 - DNA, 103 bp, Artificial Sequence
  Synthetic Polynucleotide
taatacgactcactatagggctgaatgtactgggggaaatgtctattctcaacagaggagagagaatatgcatttccccaacctggcggcagcgcaaaagatg

SEQ ID NO: 221398 - DNA, 103 bp, Artificial Sequence
  Synthetic Polynucleotide
taatacgactcactatagggaccatgttttctgaatgtactgggggaaataacagaggagaatttccatgagtacattcaacctggcggcagcgcaaaagatg

SEQ ID NO: 221399 - DNA, 103 bp, Artificial Sequence
  Synthetic Polynucleotide
taatacgactcactatagggcatgagccaaaccatgttttctgaatgtacaacagaggagagtacatatggaaaacatgaacctggcggcagcgcaaaagatg

SEQ ID NO: 221400 - DNA, 103 bp, Artificial Sequence
  Synthetic Polynucleotide
taatacgactcactatagggttcatttcatcatgagccaaaccatgttttaacagaggagaaaaacaatgtttggctcaaacctggcggcagcgcaaaagatg

SEQ ID NO: 221401 - DNA, 103 bp, Artificial Sequence
  Synthetic Polynucleotide
taatacgactcactatagggccggggacttttcatttcatcatgagccaaaacagaggagattggctatggatgaaatgaacctggcggcagcgcaaaagatg

SEQ ID NO: 221402 - DNA, 103 bp, Artificial Sequence
  Synthetic Polynucleotide
taatacgactcactatagggagccaggttcccggggacttttcatttcataacagaggagaatgaaaatgaaagtccccaacctggcggcagcgcaaaagatg

SEQ ID NO: 221403 - DNA, 103 bp, Artificial Sequence
  Synthetic Polynucleotide
taatacgactcactatagggttgtgacctcggaaatcccgattctgatataacagaggagaatatcaatgtcgggatttaacctggcggcagcgcaaaagatg

SEQ ID NO: 221404 - DNA, 103 bp, Artificial Sequence
  Synthetic Polynucleotide
taatacgactcactatagggtcagccttgtagccaggttcccggggacttaacagaggagaaagtccatgggaacctggaacctggcggcagcgcaaaagatg

SEQ ID NO: 221405 - DNA, 103 bp, Artificial Sequence
  Synthetic Polynucleotide
taatacgactcactataggggtattttccctcagccttgtagccaggttcaacagaggagagaacctatgtacaaggctaacctggcggcagcgcaaaagatg

SEQ ID NO: 221406 - DNA, 103 bp, Artificial Sequence
  Synthetic Polynucleotide
taatacgactcactataggggatcatctttgtattttccctcagccttgtaacagaggagaacaaggatgagggaaaataacctggcggcagcgcaaaagatg

SEQ ID NO: 221407 - DNA, 103 bp, Artificial Sequence
  Synthetic Polynucleotide
taatacgactcactatagggagatcaacaggatcatctttgtattttcccaacagaggagagggaaaatgcaaagatgaaacctggcggcagcgcaaaagatg

SEQ ID NO: 221408 - DNA, 103 bp, Artificial Sequence
  Synthetic Polynucleotide
taatacgactcactatagggatcaaggcggagatcaacaggatcatctttaacagaggagaaaagatatgcctgttgataacctggcggcagcgcaaaagatg

SEQ ID NO: 221409 - DNA, 103 bp, Artificial Sequence
  Synthetic Polynucleotide
taatacgactcactataggggacgttcaatatcaaggcggagatcaacagaacagaggagactgttgatgtccgccttgaacctggcggcagcgcaaaagatg

SEQ ID NO: 221410 - DNA, 103 bp, Artificial Sequence
  Synthetic Polynucleotide
taatacgactcactatagggtgttttttacgacgttcaatatcaaggcggaacagaggagaccgcctatgtattgaacgaacctggcggcagcgcaaaagatg

SEQ ID NO: 221411 - DNA, 103 bp, Artificial Sequence
  Synthetic Polynucleotide
taatacgactcactatagggtctctccttatgttttttacgacgttcaataacagaggagaattgaaatgcgtaaaaaaaacctggcggcagcgcaaaagatg

SEQ ID NO: 221412 - DNA, 103 bp, Artificial Sequence
  Synthetic Polynucleotide
taatacgactcactataggggtttaagatctctctccttatgttttttacaacagaggagagtaaaaatgataaggagaaacctggcggcagcgcaaaagatg

SEQ ID NO: 221413 - DNA, 103 bp, Artificial Sequence
  Synthetic Polynucleotide
taatacgactcactataggggatttacctcgtttaagatctctctccttaaacagaggagataaggaatgagatcttaaaacctggcggcagcgcaaaagatg

SEQ ID NO: 221414 - DNA, 103 bp, Artificial Sequence
  Synthetic Polynucleotide
taatacgactcactatagggatagcctctgttgtgacctcggaaatcccgaacagaggagacgggatatgcgaggtcacaacctggcggcagcgcaaaagatg

SEQ ID NO: 221415 - DNA, 103 bp, Artificial Sequence
  Synthetic Polynucleotide
taatacgactcactatagggtgattctctcgatttacctcgtttaagatcaacagaggagagatcttatgcgaggtaaaaacctggcggcagcgcaaaagatg

SEQ ID NO: 221416 - DNA, 103 bp, Artificial Sequence
  Synthetic Polynucleotide
taatacgactcactataggggggaatccactgattctctcgatttacctcaacagaggagagaggtaatgcgagagaataacctggcggcagcgcaaaagatg

SEQ ID NO: 221417 - DNA, 103 bp, Artificial Sequence
  Synthetic Polynucleotide
taatacgactcactatagggctggagtctcgggaatccactgattctctcaacagaggagagagagaatgagtggattcaacctggcggcagcgcaaaagatg

SEQ ID NO: 221418 - DNA, 103 bp, Artificial Sequence
  Synthetic Polynucleotide
taatacgactcactatagggccttgagtgactggagtctcgggaatccacaacagaggagagtggatatgcgagactccaacctggcggcagcgcaaaagatg

SEQ ID NO: 221419 - DNA, 103 bp, Artificial Sequence
  Synthetic Polynucleotide
taatacgactcactatagggctgacctttcccttgagtgactggagtctcaacagaggagagagactatggtcactcaaaacctggcggcagcgcaaaagatg

SEQ ID NO: 221420 - DNA, 103 bp, Artificial Sequence
  Synthetic Polynucleotide
taatacgactcactataggggttttttcagctgacctttcccttgagtgaaacagaggagatcactcatgggaaaggtcaacctggcggcagcgcaaaagatg

SEQ ID NO: 221421 - DNA, 103 bp, Artificial Sequence
  Synthetic Polynucleotide
taatacgactcactatagggagttttctctgttttttcagctgacctttcaacagaggagagaaaggatggctgaaaaaaacctggcggcagcgcaaaagatg

SEQ ID NO: 221422 - DNA, 103 bp, Artificial Sequence
  Synthetic Polynucleotide
taatacgactcactatagggatcctttatgagttttctctgttttttcagaacagaggagactgaaaatgcagagaaaaaacctggcggcagcgcaaaagatg

SEQ ID NO: 221423 - DNA, 103 bp, Artificial Sequence
  Synthetic Polynucleotide
taatacgactcactatagggtgtttctttgatcctttatgagttttctctaacagaggagaagagaaatgtcataaaggaacctggcggcagcgcaaaagatg

SEQ ID NO: 221424 - DNA, 103 bp, Artificial Sequence
  Synthetic Polynucleotide
taatacgactcactatagggatgcttcttctgtttctttgatcctttatgaacagaggagacataaaatgtcaaagaaaaacctggcggcagcgcaaaagatg

SEQ ID NO: 221425 - DNA, 103 bp, Artificial Sequence
  Synthetic Polynucleotide
taatacgactcactatagggagggccttctatagcctctgttgtgacctcaacagaggagagaggtcatgacagaggctaacctggcggcagcgcaaaagatg

SEQ ID NO: 221426 - DNA, 103 bp, Artificial Sequence
  Synthetic Polynucleotide
taatacgactcactatagggttgctctccgatgcttcttctgtttctttgaacagaggagacaaagaatgagaagaagcaacctggcggcagcgcaaaagatg

SEQ ID NO: 221427 - DNA, 103 bp, Artificial Sequence
  Synthetic Polynucleotide
taatacgactcactataggggacctgtctcttgctctccgatgcttcttcaacagaggagagaagaaatgtcggagagcaacctggcggcagcgcaaaagatg

SEQ ID NO: 221428 - DNA, 103 bp, Artificial Sequence
  Synthetic Polynucleotide
taatacgactcactatagggggaggatctggacctgtctcttgctctccgaacagaggagacggagaatgagagacaggaacctggcggcagcgcaaaagatg

SEQ ID NO: 221429 - DNA, 103 bp, Artificial Sequence
  Synthetic Polynucleotide
taatacgactcactatagggaggaagaggaggaggatctggacctgtctcaacagaggagagagacaatgccagatcctaacctggcggcagcgcaaaagatg

SEQ ID NO: 221430 - DNA, 103 bp, Artificial Sequence
  Synthetic Polynucleotide
taatacgactcactataggggatgactgggaggaagaggaggaggatctgaacagaggagacagatcatgctcctcttcaacctggcggcagcgcaaaagatg

SEQ ID NO: 221431 - DNA, 103 bp, Artificial Sequence
  Synthetic Polynucleotide
taatacgactcactataggggtaggagtgagatgactgggaggaagaggaaacagaggagatcctctatgtcccagtcaaacctggcggcagcgcaaaagatg

SEQ ID NO: 221432 - DNA, 103 bp, Artificial Sequence
  Synthetic Polynucleotide
taatacgactcactatagggcttctgctttgtaggagtgagatgactgggaacagaggagacccagtatgctcactcctaacctggcggcagcgcaaaagatg

SEQ ID NO: 221433 - DNA, 103 bp, Artificial Sequence
  Synthetic Polynucleotide
taatacgactcactatagggtcagtgtactcttctgctttgtaggagtgaaacagaggagatcactcatgcaaagcagaaacctggcggcagcgcaaaagatg

SEQ ID NO: 221434 - DNA, 103 bp, Artificial Sequence
  Synthetic Polynucleotide
taatacgactcactatagggctctgtctcttcagtgtactcttctgctttaacagaggagaaaagcaatggagtacactaacctggcggcagcgcaaaagatg

SEQ ID NO: 221435 - DNA, 103 bp, Artificial Sequence
  Synthetic Polynucleotide
taatacgactcactatagggcctctctttcctctgtctcttcagtgtactaacagaggagaagtacaatgaagagacagaacctggcggcagcgcaaaagatg

SEQ ID NO: 221436 - DNA, 103 bp, Artificial Sequence
  Synthetic Polynucleotide
taatacgactcactatagggcggaaataatagggccttctatagcctctgaacagaggagacagaggatgtagaaggccaacctggcggcagcgcaaaagatg

SEQ ID NO: 221437 - DNA, 103 bp, Artificial Sequence
  Synthetic Polynucleotide
taatacgactcactataggggtggtgctctcctctctttcctctgtctctaacagaggagaagagacatgggaaagagaaacctggcggcagcgcaaaagatg

SEQ ID NO: 221438 - DNA, 103 bp, Artificial Sequence
  Synthetic Polynucleotide
taatacgactcactataggggtcaaagcccgtggtgctctcctctctttcaacagaggagagaaagaatggagagcaccaacctggcggcagcgcaaaagatg

SEQ ID NO: 221439 - DNA, 103 bp, Artificial Sequence
  Synthetic Polynucleotide
taatacgactcactataggggtcttgatttgtcaaagcccgtggtgctctaacagaggagaagagcaatgcgggctttgaacctggcggcagcgcaaaagatg

SEQ ID NO: 221440 - DNA, 103 bp, Artificial Sequence
  Synthetic Polynucleotide
taatacgactcactatagggttggtccccagtcttgatttgtcaaagcccaacagaggagagggcttatgcaaatcaagaacctggcggcagcgcaaaagatg

SEQ ID NO: 221441 - DNA, 103 bp, Artificial Sequence
  Synthetic Polynucleotide
taatacgactcactatagggcacaaagtctttggtccccagtcttgatttaacagaggagaaaatcaatgctggggaccaacctggcggcagcgcaaaagatg

SEQ ID NO: 221442 - DNA, 103 bp, Artificial Sequence
  Synthetic Polynucleotide
taatacgactcactatagggcacttggacccacaaagtctttggtccccaaacagaggagatggggaatgaagactttgaacctggcggcagcgcaaaagatg

SEQ ID NO: 221443 - DNA, 103 bp, Artificial Sequence
  Synthetic Polynucleotide
taatacgactcactatagggcctcctctttcacttggacccacaaagtctaacagaggagaagacttatggggtccaagaacctggcggcagcgcaaaagatg

SEQ ID NO: 221444 - DNA, 103 bp, Artificial Sequence
  Synthetic Polynucleotide
taatacgactcactatagggagctctgccacctcctctttcacttggaccaacagaggagaggtccaatggaaagaggaaacctggcggcagcgcaaaagatg

SEQ ID NO: 221445 - DNA, 103 bp, Artificial Sequence
  Synthetic Polynucleotide
taatacgactcactatagggaggttcctcgagctctgccacctcctctttaacagaggagaaaagagatggtggcagagaacctggcggcagcgcaaaagatg

SEQ ID NO: 221446 - DNA, 103 bp, Artificial Sequence
  Synthetic Polynucleotide
taatacgactcactatagggcgaaactgaaaggttcctcgagctctgccaaacagaggagatggcagatgtcgaggaacaacctggcggcagcgcaaaagatg

SEQ ID NO: 221447 - DNA, 103 bp, Artificial Sequence
  Synthetic Polynucleotide
taatacgactcactataggggttacgcccacggaaataatagggccttctaacagaggagaagaaggatgtattatttcaacctggcggcagcgcaaaagatg

SEQ ID NO: 221448 - DNA, 103 bp, Artificial Sequence
  Synthetic Polynucleotide
taatacgactcactatagggtcctctggctcgaaactgaaaggttcctcgaacagaggagacgaggaatgtttcagtttaacctggcggcagcgcaaaagatg

SEQ ID NO: 221449 - DNA, 103 bp, Artificial Sequence
  Synthetic Polynucleotide
taatacgactcactatagggcccagcctcttcctctggctcgaaactgaaaacagaggagattcagtatggagccagagaacctggcggcagcgcaaaagatg

SEQ ID NO: 221450 - DNA, 103 bp, Artificial Sequence
  Synthetic Polynucleotide
taatacgactcactatagggttgcctctgccccagcctcttcctctggctaacagaggagaagccagatgaagaggctgaacctggcggcagcgcaaaagatg

SEQ ID NO: 221451 - DNA, 103 bp, Artificial Sequence
  Synthetic Polynucleotide
taatacgactcactatagggcccagagtagttgcctctgccccagcctctaacagaggagaagaggcatgggcagaggcaacctggcggcagcgcaaaagatg

SEQ ID NO: 221452 - DNA, 103 bp, Artificial Sequence
  Synthetic Polynucleotide
taatacgactcactatagggtgttattgttcccagagtagttgcctctgcaacagaggagagcagagatgactactctgaacctggcggcagcgcaaaagatg

SEQ ID NO: 221453 - DNA, 103 bp, Artificial Sequence
  Synthetic Polynucleotide
taatacgactcactatagggttgctgttgttgttattgttcccagagtagaacagaggagactactcatggaacaataaaacctggcggcagcgcaaaagatg

SEQ ID NO: 221454 - DNA, 103 bp, Artificial Sequence
  Synthetic Polynucleotide
taatacgactcactatagggaaaatcgttgttgctgttgttgttattgttaacagaggagaaacaatatgaacaacagcaacctggcggcagcgcaaaagatg

SEQ ID NO: 221455 - DNA, 103 bp, Artificial Sequence
  Synthetic Polynucleotide
taatacgactcactatagggttcttttttgaaaatcgttgttgctgttgtaacagaggagaacaacaatgacaacgattaacctggcggcagcgcaaaagatg

SEQ ID NO: 221456 - DNA, 103 bp, Artificial Sequence
  Synthetic Polynucleotide
taatacgactcactatagggtcttcccggtttcttttttgaaaatcgttgaacagaggagacaacgaatgtcaaaaaagaacctggcggcagcgcaaaagatg

SEQ ID NO: 221457 - DNA, 103 bp, Artificial Sequence
  Synthetic Polynucleotide
taatacgactcactataggggtcccactcctcttcccggtttcttttttgaacagaggagacaaaaaatgaaccgggaaaacctggcggcagcgcaaaagatg

SEQ ID NO: 221458 - DNA, 103 bp, Artificial Sequence
  Synthetic Polynucleotide
taatacgactcactatagggaaaagcctctgttacgcccacggaaataataacagaggagaattattatggtgggcgtaaacctggcggcagcgcaaaagatg

SEQ ID NO: 221459 - DNA, 103 bp, Artificial Sequence
  Synthetic Polynucleotide
taatacgactcactatagggtgtactctgggtcccactcctcttcccggtaacagaggagaaccgggatgaggagtgggaacctggcggcagcgcaaaagatg

SEQ ID NO: 221460 - DNA, 103 bp, Artificial Sequence
  Synthetic Polynucleotide
taatacgactcactatagggcttttgggtgtgtactctgggtcccactccaacagaggagaggagtgatgcccagagtaaacctggcggcagcgcaaaagatg

SEQ ID NO: 221461 - DNA, 103 bp, Artificial Sequence
  Synthetic Polynucleotide
taatacgactcactatagggatacttcttgcttttgggtgtgtactctggaacagaggagaccagagatgacacccaaaaacctggcggcagcgcaaaagatg

SEQ ID NO: 221462 - DNA, 103 bp, Artificial Sequence
  Synthetic Polynucleotide
taatacgactcactatagggcatgcaagtaatacttcttgcttttgggtgaacagaggagacacccaatggcaagaagtaacctggcggcagcgcaaaagatg

SEQ ID NO: 221463 - DNA, 103 bp, Artificial Sequence
  Synthetic Polynucleotide
taatacgactcactatagggtcacggtcatcatgcaagtaatacttcttgaacagaggagacaagaaatgttacttgcaaacctggcggcagcgcaaaagatg

SEQ ID NO: 221464 - DNA, 103 bp, Artificial Sequence
  Synthetic Polynucleotide
taatacgactcactataggggccttcgccttcacggtcatcatgcaagtaaacagaggagatacttgatggatgaccgtaacctggcggcagcgcaaaagatg

SEQ ID NO: 221465 - DNA, 103 bp, Artificial Sequence
  Synthetic Polynucleotide
taatacgactcactatagggacttgtcactgccttcgccttcacggtcataacagaggagaatgaccatgaaggcgaagaacctggcggcagcgcaaaagatg

SEQ ID NO: 221466 - DNA, 103 bp, Artificial Sequence
  Synthetic Polynucleotide
taatacgactcactatagggcggctcacccacttgtcactgccttcgcctaacagaggagaaggcgaatgcagtgacaaaacctggcggcagcgcaaaagatg

SEQ ID NO: 221467 - DNA, 103 bp, Artificial Sequence
  Synthetic Polynucleotide
taatacgactcactataggggccccggccccggctcacccacttgtcactaacagaggagaagtgacatgtgggtgagcaacctggcggcagcgcaaaagatg

SEQ ID NO: 221468 - DNA, 103 bp, Artificial Sequence
  Synthetic Polynucleotide
taatacgactcactatagggaggctcctcggccccggccccggctcacccaacagaggagagggtgaatgggggccgggaacctggcggcagcgcaaaagatg

SEQ ID NO: 221469 - DNA, 103 bp, Artificial Sequence
  Synthetic Polynucleotide
taatacgactcactatagggccccatggataaaagcctctgttacgcccaaacagaggagatgggcgatgcagaggcttaacctggcggcagcgcaaaagatg

SEQ ID NO: 221470 - DNA, 103 bp, Artificial Sequence
  Synthetic Polynucleotide
taatacgactcactatagggccccgaggaaaggctcctcggccccggcccaacagaggagagggccgatgccgaggagcaacctggcggcagcgcaaaagatg

SEQ ID NO: 221471 - DNA, 103 bp, Artificial Sequence
  Synthetic Polynucleotide
taatacgactcactatagggccggccccgaccccgaggaaaggctcctcgaacagaggagacgaggaatgtttcctcggaacctggcggcagcgcaaaagatg

SEQ ID NO: 221472 - DNA, 103 bp, Artificial Sequence
  Synthetic Polynucleotide
taatacgactcactatagggggaacatgaaccggccccgaccccgaggaaaacagaggagattcctcatggtcggggccaacctggcggcagcgcaaaagatg

SEQ ID NO: 221473 - DNA, 103 bp, Artificial Sequence
  Synthetic Polynucleotide
taatacgactcactatagggcttgatttccggaacatgaaccggccccgaaacagaggagatcggggatggttcatgttaacctggcggcagcgcaaaagatg

SEQ ID NO: 221474 - DNA, 103 bp, Artificial Sequence
  Synthetic Polynucleotide
taatacgactcactatagggggggctggtacttgatttccggaacatgaaaacagaggagattcatgatgcggaaatcaaacctggcggcagcgcaaaagatg

SEQ ID NO: 221475 - DNA, 103 bp, Artificial Sequence
  Synthetic Polynucleotide
taatacgactcactataggggggcccacttggggctggtacttgatttccaacagaggagaggaaatatggtaccagccaacctggcggcagcgcaaaagatg

SEQ ID NO: 221476 - DNA, 103 bp, Artificial Sequence
  Synthetic Polynucleotide
taatacgactcactatagggaacttgtcatgggcccacttggggctggtaaacagaggagataccagatgcaagtgggcaacctggcggcagcgcaaaagatg

SEQ ID NO: 221477 - DNA, 103 bp, Artificial Sequence
  Synthetic Polynucleotide
taatacgactcactatagggctccccactgaacttgtcatgggcccacttaacagaggagaaagtggatgcatgacaagaacctggcggcagcgcaaaagatg

SEQ ID NO: 221478 - DNA, 103 bp, Artificial Sequence
  Synthetic Polynucleotide
taatacgactcactatagggtctccccttcctccccactgaacttgtcataacagaggagaatgacaatgtcagtggggaacctggcggcagcgcaaaagatg

SEQ ID NO: 221479 - DNA, 103 bp, Artificial Sequence
  Synthetic Polynucleotide
taatacgactcactatagggtcgtcttcaatctccccttcctccccactgaacagaggagacagtggatgggaaggggaaacctggcggcagcgcaaaagatg

SEQ ID NO: 221480 - DNA, 103 bp, Artificial Sequence
  Synthetic Polynucleotide
taatacgactcactataggggttatattggccccatggataaaagcctctaacagaggagaagaggcatgtatccatggaacctggcggcagcgcaaaagatg

SEQ ID NO: 221481 - DNA, 103 bp, Artificial Sequence
  Synthetic Polynucleotide
taatacgactcactatagggcccactctcgtcgtcttcaatctccccttcaacagaggagagaagggatgattgaagacaacctggcggcagcgcaaaagatg

SEQ ID NO: 221482 - DNA, 103 bp, Artificial Sequence
  Synthetic Polynucleotide
taatacgactcactatagggggttctctgtcccactctcgtcgtcttcaaaacagaggagattgaagatgacgagagtgaacctggcggcagcgcaaaagatg

SEQ ID NO: 221483 - DNA, 103 bp, Artificial Sequence
  Synthetic Polynucleotide
taatacgactcactatagggttctcttctcggttctctgtcccactctcgaacagaggagacgagagatggacagagaaaacctggcggcagcgcaaaagatg

SEQ ID NO: 221484 - DNA, 103 bp, Artificial Sequence
  Synthetic Polynucleotide
taatacgactcactatagggtatattgtccttctcttctcggttctctgtaacagaggagaacagagatgcgagaagagaacctggcggcagcgcaaaagatg

SEQ ID NO: 221485 - DNA, 103 bp, Artificial Sequence
  Synthetic Polynucleotide
taatacgactcactatagggttgtgggctgtatattgtccttctcttctcaacagaggagagagaagatgaggacaataaacctggcggcagcgcaaaagatg

SEQ ID NO: 221486 - DNA, 103 bp, Artificial Sequence
  Synthetic Polynucleotide
taatacgactcactatagggagcctcctcggttatattggccccatggataacagaggagaatccatatggccaatataaacctggcggcagcgcaaaagatg

SEQ ID NO: 221487 - DNA, 103 bp, Artificial Sequence
  Synthetic Polynucleotide
taatacgactcactatagggcttgagcgagaagagcgagatccagacttgaacagaggagacaagtcatgatctcgctcaacctggcggcagcgcaaaagatg

SEQ ID NO: 221488 - DNA, 103 bp, Artificial Sequence
  Synthetic Polynucleotide
taatacgactcactatagggtagtttccatagcctcctcggttatattggaacagaggagaccaataatgccgaggaggaacctggcggcagcgcaaaagatg

SEQ ID NO: 221489 - DNA, 103 bp, Artificial Sequence
  Synthetic Polynucleotide
taatacgactcactatagggatttgagcggtagtttccatagcctcctcgaacagaggagacgaggaatgtatggaaacaacctggcggcagcgcaaaagatg

SEQ ID NO: 221490 - DNA, 103 bp, Artificial Sequence
  Synthetic Polynucleotide
taatacgactcactatagggaattctgccaatttgagcggtagtttccataacagaggagaatggaaatgaccgctcaaaacctggcggcagcgcaaaagatg

SEQ ID NO: 221491 - DNA, 103 bp, Artificial Sequence
  Synthetic Polynucleotide
taatacgactcactataggggcttgccggtaattctgccaatttgagcggaacagaggagaccgctcatgttggcagaaaacctggcggcagcgcaaaagatg

SEQ ID NO: 221492 - DNA, 103 bp, Artificial Sequence
  Synthetic Polynucleotide
taatacgactcactatagggaggactgtatgcttgccggtaattctgccaaacagaggagatggcagatgtaccggcaaaacctggcggcagcgcaaaagatg

SEQ ID NO: 221493 - DNA, 103 bp, Artificial Sequence
  Synthetic Polynucleotide
taatacgactcactatagggggcctcgacgaggactgtatgcttgccggtaacagaggagaaccggcatgcatacagtcaacctggcggcagcgcaaaagatg

SEQ ID NO: 221494 - DNA, 103 bp, Artificial Sequence
  Synthetic Polynucleotide
taatacgactcactataggggatcttgaacggcctcgacgaggactgtataacagaggagaatacagatgtcgtcgaggaacctggcggcagcgcaaaagatg

SEQ ID NO: 221495 - DNA, 103 bp, Artificial Sequence
  Synthetic Polynucleotide
taatacgactcactatagggtggggaccgggatcttgaacggcctcgacgaacagaggagacgtcgaatgcgttcaagaaacctggcggcagcgcaaaagatg

SEQ ID NO: 221496 - DNA, 103 bp, Artificial Sequence
  Synthetic Polynucleotide
taatacgactcactatagggaccttctctttggggaccgggatcttgaacaacagaggagagttcaaatgcccggtcccaacctggcggcagcgcaaaagatg

SEQ ID NO: 221497 - DNA, 103 bp, Artificial Sequence
  Synthetic Polynucleotide
taatacgactcactatagggggtgaaggggaccttctctttggggaccggaacagaggagaccggtcatgaaagagaagaacctggcggcagcgcaaaagatg

SEQ ID NO: 221498 - DNA, 103 bp, Artificial Sequence
  Synthetic Polynucleotide
taatacgactcactatagggtgatgcagatcttgagcgagaagagcgagaaacagaggagatctcgcatgtctcgctcaaacctggcggcagcgcaaaagatg

SEQ ID NO: 221499 - DNA, 103 bp, Artificial Sequence
  Synthetic Polynucleotide
taatacgactcactatagggcctggaccttggtgaaggggaccttctcttaacagaggagaaagagaatgtccccttcaaacctggcggcagcgcaaaagatg

SEQ ID NO: 221500 - DNA, 103 bp, Artificial Sequence
  Synthetic Polynucleotide
taatacgactcactatagggtagaatggctcctggaccttggtgaaggggaacagaggagaccccttatgcaaggtccaaacctggcggcagcgcaaaagatg

SEQ ID NO: 221501 - DNA, 103 bp, Artificial Sequence
  Synthetic Polynucleotide
taatacgactcactatagggtcagagtttctagaatggctcctggaccttaacagaggagaaaggtcatggagccattcaacctggcggcagcgcaaaagatg

SEQ ID NO: 221502 - DNA, 103 bp, Artificial Sequence
  Synthetic Polynucleotide
taatacgactcactatagggagacgacttatcagagtttctagaatggctaacagaggagaagccatatgagaaactctaacctggcggcagcgcaaaagatg

SEQ ID NO: 221503 - DNA, 103 bp, Artificial Sequence
  Synthetic Polynucleotide
taatacgactcactatagggaccggtcagaagacgacttatcagagtttcaacagaggagagaaactatgataagtcgtaacctggcggcagcgcaaaagatg

SEQ ID NO: 221504 - DNA, 103 bp, Artificial Sequence
  Synthetic Polynucleotide
taatacgactcactataggggagcgccttgaccggtcagaagacgacttaaacagaggagataagtcatgttctgaccgaacctggcggcagcgcaaaagatg

SEQ ID NO: 221505 - DNA, 103 bp, Artificial Sequence
  Synthetic Polynucleotide
taatacgactcactatagggggaggatgaggagcgccttgaccggtcagaaacagaggagatctgacatgtcaaggcgcaacctggcggcagcgcaaaagatg

SEQ ID NO: 221506 - DNA, 103 bp, Artificial Sequence
  Synthetic Polynucleotide
taatacgactcactatagggaggaagaacgggaggatgaggagcgccttgaacagaggagacaaggcatgcctcatcctaacctggcggcagcgcaaaagatg

SEQ ID NO: 221507 - DNA, 103 bp, Artificial Sequence
  Synthetic Polynucleotide
taatacgactcactatagggctatggttggaggaagaacgggaggatgagaacagaggagactcatcatgccgttcttcaacctggcggcagcgcaaaagatg

SEQ ID NO: 221508 - DNA, 103 bp, Artificial Sequence
  Synthetic Polynucleotide
taatacgactcactatagggttcaactcggctatggttggaggaagaacgaacagaggagacgttctatgtccaaccataacctggcggcagcgcaaaagatg

SEQ ID NO: 221509 - DNA, 103 bp, Artificial Sequence
  Synthetic Polynucleotide
taatacgactcactatagggaacgagatcttgatgcagatcttgagcgagaacagaggagactcgctatggatctgcataacctggcggcagcgcaaaagatg

SEQ ID NO: 221510 - DNA, 103 bp, Artificial Sequence
  Synthetic Polynucleotide
taatacgactcactataggggcttagaagattcaactcggctatggttggaacagaggagaccaaccatggccgagttgaacctggcggcagcgcaaaagatg

SEQ ID NO: 221511 - DNA, 103 bp, Artificial Sequence
  Synthetic Polynucleotide
taatacgactcactataggggcagacttgcgcttagaagattcaactcggaacagaggagaccgagtatgatcttctaaaacctggcggcagcgcaaaagatg

SEQ ID NO: 221512 - DNA, 103 bp, Artificial Sequence
  Synthetic Polynucleotide
taatacgactcactatagggtttctcctttgcagacttgcgcttagaagaaacagaggagatcttctatgcgcaagtctaacctggcggcagcgcaaaagatg

SEQ ID NO: 221513 - DNA, 103 bp, Artificial Sequence
  Synthetic Polynucleotide
taatacgactcactatagggaagaggactttttctcctttgcagacttgcaacagaggagagcaagtatgcaaaggagaaacctggcggcagcgcaaaagatg

SEQ ID NO: 221514 - DNA, 103 bp, Artificial Sequence
  Synthetic Polynucleotide
taatacgactcactatagggctatccttagaagaggactttttctcctttaacagaggagaaaaggaatgaaagtcctcaacctggcggcagcgcaaaagatg

SEQ ID NO: 221515 - DNA, 103 bp, Artificial Sequence
  Synthetic Polynucleotide
taatacgactcactatagggagatggccggctatccttagaagaggacttaacagaggagaaagtccatgtctaaggataacctggcggcagcgcaaaagatg

SEQ ID NO: 221516 - DNA, 103 bp, Artificial Sequence
  Synthetic Polynucleotide
taatacgactcactatagggcggcagcctgagatggccggctatccttagaacagaggagactaaggatggccggccataacctggcggcagcgcaaaagatg

SEQ ID NO: 221517 - DNA, 103 bp, Artificial Sequence
  Synthetic Polynucleotide
taatacgactcactatagggtggttatccccggcagcctgagatggccggaacagaggagaccggccatgtcaggctgcaacctggcggcagcgcaaaagatg

SEQ ID NO: 221518 - DNA, 103 bp, Artificial Sequence
  Synthetic Polynucleotide
taatacgactcactatagggctcatctccctggttatccccggcagcctgaacagaggagacaggctatgggggataacaacctggcggcagcgcaaaagatg

SEQ ID NO: 221519 - DNA, 103 bp, Artificial Sequence
  Synthetic Polynucleotide
taatacgactcactataggggctccttggcctcatctccctggttatcccaacagaggagagggataatgagggagatgaacctggcggcagcgcaaaagatg

SEQ ID NO: 221520 - DNA, 103 bp, Artificial Sequence
  Synthetic Polynucleotide
taatacgactcactatagggaatgaacgagaacgagatcttgatgcagataacagaggagaatctgcatgaagatctcgaacctggcggcagcgcaaaagatg

SEQ ID NO: 221521 - DNA, 103 bp, Artificial Sequence
  Synthetic Polynucleotide
taatacgactcactataggggagaatgtctgctccttggcctcatctcccaacagaggagagggagaatgggccaaggaaacctggcggcagcgcaaaagatg

SEQ ID NO: 221522 - DNA, 103 bp, Artificial Sequence
  Synthetic Polynucleotide
taatacgactcactatagggggtgcctccagagaatgtctgctccttggcaacagaggagagccaagatgcagacattcaacctggcggcagcgcaaaagatg

SEQ ID NO: 221523 - DNA, 103 bp, Artificial Sequence
  Synthetic Polynucleotide
taatacgactcactatagggtatcttgagaggtgcctccagagaatgtctaacagaggagaagacatatgctggaggcaaacctggcggcagcgcaaaagatg

SEQ ID NO: 221524 - DNA, 103 bp, Artificial Sequence
  Synthetic Polynucleotide
taatacgactcactataggggatgcttttgtatcttgagaggtgcctccaaacagaggagatggaggatgctctcaagaaacctggcggcagcgcaaaagatg

SEQ ID NO: 221525 - DNA, 103 bp, Artificial Sequence
  Synthetic Polynucleotide
taatacgactcactatagggcgagctctcagatgcttttgtatcttgagaaacagaggagatctcaaatgacaaaagcaaacctggcggcagcgcaaaagatg

SEQ ID NO: 221526 - DNA, 103 bp, Artificial Sequence
  Synthetic Polynucleotide
taatacgactcactataggggccatggcttcgagctctcagatgcttttgaacagaggagacaaaagatgctgagagctaacctggcggcagcgcaaaagatg

SEQ ID NO: 221527 - DNA, 103 bp, Artificial Sequence
  Synthetic Polynucleotide
taatacgactcactataggggtggcatctggccatggcttcgagctctcaaacagaggagatgagagatggaagccatgaacctggcggcagcgcaaaagatg

SEQ ID NO: 221528 - DNA, 103 bp, Artificial Sequence
  Synthetic Polynucleotide
taatacgactcactatagggagtgccgtaggtggcatctggccatggcttaacagaggagaaagccaatgccagatgccaacctggcggcagcgcaaaagatg

SEQ ID NO: 221529 - DNA, 103 bp, Artificial Sequence
  Synthetic Polynucleotide
taatacgactcactatagggatgcagaaccagtgccgtaggtggcatctgaacagaggagacagatgatgcctacggcaaacctggcggcagcgcaaaagatg

SEQ ID NO: 221530 - DNA, 103 bp, Artificial Sequence
  Synthetic Polynucleotide
taatacgactcactataggggaggcccgtgatgcagaaccagtgccgtagaacagaggagactacggatgtggttctgcaacctggcggcagcgcaaaagatg

SEQ ID NO: 221531 - DNA, 103 bp, Artificial Sequence
  Synthetic Polynucleotide
taatacgactcactatagggagacttcgaaaatgaacgagaacgagatctaacagaggagaagatctatgtctcgttcaaacctggcggcagcgcaaaagatg

SEQ ID NO: 221532 - DNA, 103 bp, Artificial Sequence
  Synthetic Polynucleotide
taatacgactcactatagggagaaactgctgaggcccgtgatgcagaaccaacagaggagaggttctatgtcacgggccaacctggcggcagcgcaaaagatg

SEQ ID NO: 221533 - DNA, 103 bp, Artificial Sequence
  Synthetic Polynucleotide
taatacgactcactataggggactcagctcagaaactgctgaggcccgtgaacagaggagacacgggatgcagcagtttaacctggcggcagcgcaaaagatg

SEQ ID NO: 221534 - DNA, 103 bp, Artificial Sequence
  Synthetic Polynucleotide
taatacgactcactatagggcgctcccgaggactcagctcagaaactgctaacagaggagaagcagtatgtgagctgagaacctggcggcagcgcaaaagatg

SEQ ID NO: 221535 - DNA, 103 bp, Artificial Sequence
  Synthetic Polynucleotide
taatacgactcactatagggagctgggcttcgctcccgaggactcagctcaacagaggagagagctgatgcctcgggagaacctggcggcagcgcaaaagatg

SEQ ID NO: 221536 - DNA, 103 bp, Artificial Sequence
  Synthetic Polynucleotide
taatacgactcactatagggggcttttgagagctgggcttcgctcccgagaacagaggagactcgggatggaagcccagaacctggcggcagcgcaaaagatg

SEQ ID NO: 221537 - DNA, 103 bp, Artificial Sequence
  Synthetic Polynucleotide
taatacgactcactataggggactggagggggcttttgagagctgggcttaacagaggagaaagcccatgtctcaaaagaacctggcggcagcgcaaaagatg

SEQ ID NO: 221538 - DNA, 103 bp, Artificial Sequence
  Synthetic Polynucleotide
taatacgactcactatagggcaccaccacagactggagggggcttttgagaacagaggagactcaaaatgcccctccagaacctggcggcagcgcaaaagatg

SEQ ID NO: 221539 - DNA, 103 bp, Artificial Sequence
  Synthetic Polynucleotide
taatacgactcactatagggaccgccgcctcaccaccacagactggagggaacagaggagaccctccatgctgtggtggaacctggcggcagcgcaaaagatg

SEQ ID NO: 221540 - DNA, 103 bp, Artificial Sequence
  Synthetic Polynucleotide
taatacgactcactatagggggacggggtgaccgccgcctcaccaccacaaacagaggagatgtggtatggaggcggcgaacctggcggcagcgcaaaagatg

SEQ ID NO: 221541 - DNA, 103 bp, Artificial Sequence
  Synthetic Polynucleotide
taatacgactcactatagggcacggggctaggacggggtgaccgccgcctaacagaggagaaggcggatgtcaccccgtaacctggcggcagcgcaaaagatg

SEQ ID NO: 221542 - DNA, 103 bp, Artificial Sequence
  Synthetic Polynucleotide
taatacgactcactatagggttcgggaccgagacttcgaaaatgaacgagaacagaggagactcgttatgtttcgaagtaacctggcggcagcgcaaaagatg

SEQ ID NO: 221543 - DNA, 103 bp, Artificial Sequence
  Synthetic Polynucleotide
taatacgactcactatagggtaggttttggcacggggctaggacggggtgaacagaggagacaccccatgctagccccgaacctggcggcagcgcaaaagatg

SEQ ID NO: 221544 - DNA, 103 bp, Artificial Sequence
  Synthetic Polynucleotide
taatacgactcactatagggagtggaggactaggttttggcacggggctaaacagaggagatagcccatggccaaaaccaacctggcggcagcgcaaaagatg

SEQ ID NO: 221545 - DNA, 103 bp, Artificial Sequence
  Synthetic Polynucleotide
taatacgactcactatagggtgtgctggaaagtggaggactaggttttggaacagaggagaccaaaaatgagtcctccaaacctggcggcagcgcaaaagatg

SEQ ID NO: 221546 - DNA, 103 bp, Artificial Sequence
  Synthetic Polynucleotide
taatacgactcactatagggccatctgggatgtgctggaaagtggaggacaacagaggagagtcctcatgtttccagcaaacctggcggcagcgcaaaagatg

SEQ ID NO: 221547 - DNA, 103 bp, Artificial Sequence
  Synthetic Polynucleotide
taatacgactcactatagggagagttgagcccatctgggatgtgctggaaaacagaggagattccagatgatcccagataacctggcggcagcgcaaaagatg

SEQ ID NO: 221548 - DNA, 103 bp, Artificial Sequence
  Synthetic Polynucleotide
taatacgactcactatagggaccactcggcagagttgagcccatctgggaaacagaggagatcccagatgggctcaactaacctggcggcagcgcaaaagatg

SEQ ID NO: 221549 - DNA, 103 bp, Artificial Sequence
  Synthetic Polynucleotide
taatacgactcactataggggatacccggcaccactcggcagagttgagcaacagaggagagctcaaatgtgccgagtgaacctggcggcagcgcaaaagatg

SEQ ID NO: 221550 - DNA, 103 bp, Artificial Sequence
  Synthetic Polynucleotide
taatacgactcactataggggtcccagactgatacccggcaccactcggcaacagaggagagccgagatgtgccgggtaaacctggcggcagcgcaaaagatg

SEQ ID NO: 221551 - DNA, 103 bp, Artificial Sequence
  Synthetic Polynucleotide
taatacgactcactatagggaccttggtgtgtcccagactgatacccggcaacagaggagagccgggatgcagtctgggaacctggcggcagcgcaaaagatg

SEQ ID NO: 221552 - DNA, 103 bp, Artificial Sequence
  Synthetic Polynucleotide
taatacgactcactatagggggtcgaactgaccttggtgtgtcccagactaacagaggagaagtctgatgcacaccaagaacctggcggcagcgcaaaagatg

SEQ ID NO: 221553 - DNA, 103 bp, Artificial Sequence
  Synthetic Polynucleotide
taatacgactcactatagggagagatcggcttcgggaccgagacttcgaaaacagaggagattcgaaatgtcggtcccgaacctggcggcagcgcaaaagatg

SEQ ID NO: 221554 - DNA, 103 bp, Artificial Sequence
  Synthetic Polynucleotide
taatacgactcactatagggccagaaccatggtcgaactgaccttggtgtaacagaggagaacaccaatgtcagttcgaaacctggcggcagcgcaaaagatg

SEQ ID NO: 221555 - DNA, 103 bp, Artificial Sequence
  Synthetic Polynucleotide
taatacgactcactatagggactcagggacccagaaccatggtcgaactgaacagaggagacagttcatgcatggttctaacctggcggcagcgcaaaagatg

SEQ ID NO: 221556 - DNA, 103 bp, Artificial Sequence
  Synthetic Polynucleotide
taatacgactcactatagggttttggatggactcagggacccagaaccataacagaggagaatggttatgggtccctgaaacctggcggcagcgcaaaagatg

SEQ ID NO: 221557 - DNA, 103 bp, Artificial Sequence
  Synthetic Polynucleotide
taatacgactcactatagggacagggctctttttggatggactcagggacaacagaggagagtccctatgtccatccaaaacctggcggcagcgcaaaagatg

SEQ ID NO: 221558 - DNA, 103 bp, Artificial Sequence
  Synthetic Polynucleotide
taatacgactcactatagggactcttacccacagggctctttttggatggaacagaggagaccatccatgaagagccctaacctggcggcagcgcaaaagatg

SEQ ID NO: 221559 - DNA, 103 bp, Artificial Sequence
  Synthetic Polynucleotide
taatacgactcactatagggtggatggtggactcttacccacagggctctaacagaggagaagagccatgtgggtaagaaacctggcggcagcgcaaaagatg

SEQ ID NO: 221560 - DNA, 103 bp, Artificial Sequence
  Synthetic Polynucleotide
taatacgactcactataggggtggagccagtggatggtggactcttacccaacagaggagagggtaaatgtccaccatcaacctggcggcagcgcaaaagatg

SEQ ID NO: 221561 - DNA, 103 bp, Artificial Sequence
  Synthetic Polynucleotide
taatacgactcactatagggtgagccatatgtggagccagtggatggtggaacagaggagaccaccaatgactggctccaacctggcggcagcgcaaaagatg

SEQ ID NO: 221562 - DNA, 103 bp, Artificial Sequence
  Synthetic Polynucleotide
taatacgactcactatagggccttctgagatgagccatatgtggagccagaacagaggagactggctatgcatatggctaacctggcggcagcgcaaaagatg

SEQ ID NO: 221563 - DNA, 103 bp, Artificial Sequence
  Synthetic Polynucleotide
taatacgactcactataggggcactctcctccttctgagatgagccatataacagaggagaatatggatgatctcagaaaacctggcggcagcgcaaaagatg

SEQ ID NO: 221564 - DNA, 103 bp, Artificial Sequence
  Synthetic Polynucleotide
taatacgactcactatagggttcatatatttcttgcatacagtagttcataacagaggagaatgaacatgtgtatgcaaaacctggcggcagcgcaaaagatg

SEQ ID NO: 221565 - DNA, 103 bp, Artificial Sequence
  Synthetic Polynucleotide
taatacgactcactatagggatcgcaaccgctgtaacccggactatcttcaacagaggagagaagatatgccgggttacaacctggcggcagcgcaaaagatg

SEQ ID NO: 221566 - DNA, 103 bp, Artificial Sequence
  Synthetic Polynucleotide
taatacgactcactatagggactttctgggtcatagcgcacagcagcgcgaacagaggagacgcgctatggtgcgctataacctggcggcagcgcaaaagatg

SEQ ID NO: 221567 - DNA, 103 bp, Artificial Sequence
  Synthetic Polynucleotide
taatacgactcactatagggttaaagtctcactttctgggtcatagcgcaaacagaggagatgcgctatgacccagaaaaacctggcggcagcgcaaaagatg

SEQ ID NO: 221568 - DNA, 103 bp, Artificial Sequence
  Synthetic Polynucleotide
taatacgactcactatagggccattcaaggttaaagtctcactttctgggaacagaggagacccagaatgtgagactttaacctggcggcagcgcaaaagatg

SEQ ID NO: 221569 - DNA, 103 bp, Artificial Sequence
  Synthetic Polynucleotide
taatacgactcactatagggtgccatttccccattcaaggttaaagtctcaacagaggagagagactatgaccttgaataacctggcggcagcgcaaaagatg

SEQ ID NO: 221570 - DNA, 103 bp, Artificial Sequence
  Synthetic Polynucleotide
taatacgactcactatagggcccgtgtcactgccatttccccattcaaggaacagaggagaccttgaatggggaaatggaacctggcggcagcgcaaaagatg

SEQ ID NO: 221571 - DNA, 103 bp, Artificial Sequence
  Synthetic Polynucleotide
taatacgactcactatagggttcagctggccccgtgtcactgccatttccaacagaggagaggaaatatgagtgacacgaacctggcggcagcgcaaaagatg

SEQ ID NO: 221572 - DNA, 103 bp, Artificial Sequence
  Synthetic Polynucleotide
taatacgactcactatagggacccccatttttcagctggccccgtgtcacaacagaggagagtgacaatgggccagctgaacctggcggcagcgcaaaagatg

SEQ ID NO: 221573 - DNA, 103 bp, Artificial Sequence
  Synthetic Polynucleotide
taatacgactcactatagggccaccccaagacccccatttttcagctggcaacagaggagagccagcatgaaaatggggaacctggcggcagcgcaaaagatg

SEQ ID NO: 221574 - DNA, 103 bp, Artificial Sequence
  Synthetic Polynucleotide
taatacgactcactataggggcgtctgacaccaccccaagacccccatttaacagaggagaaaatggatgtcttggggtaacctggcggcagcgcaaaagatg

SEQ ID NO: 221575 - DNA, 103 bp, Artificial Sequence
  Synthetic Polynucleotide
taatacgactcactataggggtcaaagatggcgtctgacaccaccccaagaacagaggagacttgggatggtgtcagacaacctggcggcagcgcaaaagatg

SEQ ID NO: 221576 - DNA, 103 bp, Artificial Sequence
  Synthetic Polynucleotide
taatacgactcactatagggcagcctgagcatcgcaaccgctgtaacccgaacagaggagacgggttatggcggttgcgaacctggcggcagcgcaaaagatg

SEQ ID NO: 221577 - DNA, 103 bp, Artificial Sequence
  Synthetic Polynucleotide
taatacgactcactatagggacatgcccaggtcaaagatggcgtctgacaaacagaggagatgtcagatgccatctttgaacctggcggcagcgcaaaagatg

SEQ ID NO: 221578 - DNA, 103 bp, Artificial Sequence
  Synthetic Polynucleotide
taatacgactcactataggggaagacagagacatgcccaggtcaaagatgaacagaggagacatcttatgcctgggcataacctggcggcagcgcaaaagatg

SEQ ID NO: 221579 - DNA, 103 bp, Artificial Sequence
  Synthetic Polynucleotide
taatacgactcactatagggcaggttgaaagaagacagagacatgcccagaacagaggagactgggcatgtctctgtctaacctggcggcagcgcaaaagatg

SEQ ID NO: 221580 - DNA, 103 bp, Artificial Sequence
  Synthetic Polynucleotide
taatacgactcactatagggcagtgtcatccaggttgaaagaagacagagaacagaggagactctgtatgctttcaaccaacctggcggcagcgcaaaagatg

SEQ ID NO: 221581 - DNA, 103 bp, Artificial Sequence
  Synthetic Polynucleotide
taatacgactcactatagggagggctacttcagtgtcatccaggttgaaaaacagaggagatttcaaatgggatgacacaacctggcggcagcgcaaaagatg

SEQ ID NO: 221582 - DNA, 103 bp, Artificial Sequence
  Synthetic Polynucleotide
taatacgactcactatagggggcctgaaggagggctacttcagtgtcatcaacagaggagagatgacatggaagtagccaacctggcggcagcgcaaaagatg

SEQ ID NO: 221583 - DNA, 103 bp, Artificial Sequence
  Synthetic Polynucleotide
taatacgactcactatagggtcagcaggacggcctgaaggagggctacttaacagaggagaaagtagatgtccttcaggaacctggcggcagcgcaaaagatg

SEQ ID NO: 221584 - DNA, 103 bp, Artificial Sequence
  Synthetic Polynucleotide
taatacgactcactatagggtctgaagacatcagcaggacggcctgaaggaacagaggagaccttcaatgcgtcctgctaacctggcggcagcgcaaaagatg

SEQ ID NO: 221585 - DNA, 103 bp, Artificial Sequence
  Synthetic Polynucleotide
taatacgactcactatagggccccgggcgatctgaagacatcagcaggacaacagaggagagtcctgatgatgtcttcaaacctggcggcagcgcaaaagatg

SEQ ID NO: 221586 - DNA, 103 bp, Artificial Sequence
  Synthetic Polynucleotide
taatacgactcactatagggcacaggcaagccccgggcgatctgaagacaaacagaggagatgtcttatgatcgcccggaacctggcggcagcgcaaaagatg

SEQ ID NO: 221587 - DNA, 103 bp, Artificial Sequence
  Synthetic Polynucleotide
taatacgactcactatagggttactgggcacagcctgagcatcgcaaccgaacagaggagacggttgatgtgctcaggcaacctggcggcagcgcaaaagatg

SEQ ID NO: 221588 - DNA, 103 bp, Artificial Sequence
  Synthetic Polynucleotide
taatacgactcactatagggattctctcaacacaggcaagccccgggcgaaacagaggagatcgcccatggcttgcctgaacctggcggcagcgcaaaagatg

SEQ ID NO: 221589 - DNA, 103 bp, Artificial Sequence
  Synthetic Polynucleotide
taatacgactcactataggggtacttttctattctctcaacacaggcaagaacagaggagacttgccatggttgagagaaacctggcggcagcgcaaaagatg

SEQ ID NO: 221590 - DNA, 103 bp, Artificial Sequence
  Synthetic Polynucleotide
taatacgactcactatagggaactatcttggtacttttctattctctcaaaacagaggagattgagaatgtagaaaagtaacctggcggcagcgcaaaagatg

SEQ ID NO: 221591 - DNA, 103 bp, Artificial Sequence
  Synthetic Polynucleotide
taatacgactcactataggggccagcaggaaactatcttggtacttttctaacagaggagaagaaaaatgccaagatagaacctggcggcagcgcaaaagatg

SEQ ID NO: 221592 - DNA, 103 bp, Artificial Sequence
  Synthetic Polynucleotide
taatacgactcactataggggtgttcaaaggccagcaggaaactatcttgaacagaggagacaagatatgttcctgctgaacctggcggcagcgcaaaagatg

SEQ ID NO: 221593 - DNA, 103 bp, Artificial Sequence
  Synthetic Polynucleotide
taatacgactcactatagggaattgatatagtgttcaaaggccagcaggaaacagaggagatcctgcatgcctttgaacaacctggcggcagcgcaaaagatg

SEQ ID NO: 221594 - DNA, 103 bp, Artificial Sequence
  Synthetic Polynucleotide
taatacgactcactatagggtgttttcggtaattgatatagtgttcaaagaacagaggagactttgaatgctatatcaaaacctggcggcagcgcaaaagatg

SEQ ID NO: 221595 - DNA, 103 bp, Artificial Sequence
  Synthetic Polynucleotide
taatacgactcactatagggtgtcacgtggtgttttcggtaattgatataaacagaggagatatatcatgtaccgaaaaaacctggcggcagcgcaaaagatg

SEQ ID NO: 221596 - DNA, 103 bp, Artificial Sequence
  Synthetic Polynucleotide
taatacgactcactataggggccaaaagtgtgtcacgtggtgttttcggtaacagaggagaaccgaaatgaccacgtgaaacctggcggcagcgcaaaagatg

SEQ ID NO: 221597 - DNA, 103 bp, Artificial Sequence
  Synthetic Polynucleotide
taatacgactcactatagggaggagttttggccaaaagtgtgtcacgtggaacagaggagaccacgtatgacacttttgaacctggcggcagcgcaaaagatg

SEQ ID NO: 221598 - DNA, 103 bp, Artificial Sequence
  Synthetic Polynucleotide
taatacgactcactatagggatatatgttgttactgggcacagcctgagcaacagaggagagctcagatggtgcccagtaacctggcggcagcgcaaaagatg

SEQ ID NO: 221599 - DNA, 103 bp, Artificial Sequence
  Synthetic Polynucleotide
taatacgactcactatagggcaccttcatcaggagttttggccaaaagtgaacagaggagacactttatgccaaaactcaacctggcggcagcgcaaaagatg

SEQ ID NO: 221600 - DNA, 103 bp, Artificial Sequence
  Synthetic Polynucleotide
taatacgactcactataggggcagatctgtcaccttcatcaggagttttgaacagaggagacaaaacatgtgatgaaggaacctggcggcagcgcaaaagatg

SEQ ID NO: 221601 - DNA, 103 bp, Artificial Sequence
  Synthetic Polynucleotide
taatacgactcactatagggcctatcatccgcagatctgtcaccttcatcaacagaggagagatgaaatggacagatctaacctggcggcagcgcaaaagatg

SEQ ID NO: 221602 - DNA, 103 bp, Artificial Sequence
  Synthetic Polynucleotide
taatacgactcactatagggatggcaggctcctatcatccgcagatctgtaacagaggagaacagatatgcggatgataaacctggcggcagcgcaaaagatg

SEQ ID NO: 221603 - DNA, 103 bp, Artificial Sequence
  Synthetic Polynucleotide
taatacgactcactatagggagcggctggcatggcaggctcctatcatccaacagaggagaggatgaatggagcctgccaacctggcggcagcgcaaaagatg

SEQ ID NO: 221604 - DNA, 103 bp, Artificial Sequence
  Synthetic Polynucleotide
taatacgactcactatagggatgtgcaggaagcggctggcatggcaggctaacagaggagaagcctgatgtgccagccgaacctggcggcagcgcaaaagatg

SEQ ID NO: 221605 - DNA, 103 bp, Artificial Sequence
  Synthetic Polynucleotide
taatacgactcactatagggttccaccttcatgtgcaggaagcggctggcaacagaggagagccagcatgttcctgcacaacctggcggcagcgcaaaagatg

SEQ ID NO: 221606 - DNA, 103 bp, Artificial Sequence
  Synthetic Polynucleotide
taatacgactcactatagggctgtggggcattccaccttcatgtgcaggaaacagaggagatcctgcatgtgaaggtggaacctggcggcagcgcaaaagatg

SEQ ID NO: 221607 - DNA, 103 bp, Artificial Sequence
  Synthetic Polynucleotide
taatacgactcactataggggggaagagttctgtggggcattccaccttcaacagaggagagaaggtatgatgccccacaacctggcggcagcgcaaaagatg

SEQ ID NO: 221608 - DNA, 103 bp, Artificial Sequence
  Synthetic Polynucleotide
taatacgactcactataggggaacaaaggggggaagagttctgtggggcaaacagaggagatgccccatggaactcttcaacctggcggcagcgcaaaagatg

SEQ ID NO: 221609 - DNA, 103 bp, Artificial Sequence
  Synthetic Polynucleotide
taatacgactcactatagggcctgttccatatatatgttgttactgggcaaacagaggagatgcccaatgacaacatataacctggcggcagcgcaaaagatg

SEQ ID NO: 221610 - DNA, 103 bp, Artificial Sequence
  Synthetic Polynucleotide
taatacgactcactatagggacacttccaagaacaaaggggggaagagttaacagaggagaaactctatgcccctttgtaacctggcggcagcgcaaaagatg

SEQ ID NO: 221611 - DNA, 103 bp, Artificial Sequence
  Synthetic Polynucleotide
taatacgactcactatagggtaatcctcgaacacttccaagaacaaagggaacagaggagaccctttatgcttggaagtaacctggcggcagcgcaaaagatg

SEQ ID NO: 221612 - DNA, 103 bp, Artificial Sequence
  Synthetic Polynucleotide
taatacgactcactatagggactgcccaggcctgttccatatatatgttgaacagaggagacaacatatgtatggaacaaacctggcggcagcgcaaaagatg

SEQ ID NO: 221613 - DNA, 103 bp, Artificial Sequence
  Synthetic Polynucleotide
taatacgactcactatagggaggctgattcactgcccaggcctgttccataacagaggagaatggaaatggcctgggcaaacctggcggcagcgcaaaagatg

SEQ ID NO: 221614 - DNA, 103 bp, Artificial Sequence
  Synthetic Polynucleotide
taatacgactcactatagggtacaggtataaggctgattcactgcccaggaacagaggagacctgggatgtgaatcagcaacctggcggcagcgcaaaagatg

SEQ ID NO: 221615 - DNA, 103 bp, Artificial Sequence
  Synthetic Polynucleotide
taatacgactcactatagggccagggtaactacaggtataaggctgattcaacagaggagagaatcaatgttatacctgaacctggcggcagcgcaaaagatg

SEQ ID NO: 221616 - DNA, 103 bp, Artificial Sequence
  Synthetic Polynucleotide
taatacgactcactatagggaaacatgtttccagggtaactacaggtataaacagaggagatataccatgagttaccctaacctggcggcagcgcaaaagatg

SEQ ID NO: 221617 - DNA, 103 bp, Artificial Sequence
  Synthetic Polynucleotide
taatacgactcactatagggctgggtgcacttcatatatttcttgcatacaacagaggagagtatgcatgaaatatatgaacctggcggcagcgcaaaagatg

SEQ ID NO: 221618 - DNA, 103 bp, Artificial Sequence
  Synthetic Polynucleotide
taatacgactcactatagggccttgcttttaaacatgtttccagggtaacaacagaggagagttaccatggaaacatgtaacctggcggcagcgcaaaagatg

SEQ ID NO: 221619 - DNA, 103 bp, Artificial Sequence
  Synthetic Polynucleotide
taatacgactcactatagggaagtcagagtccttgcttttaaacatgtttaacagaggagaaaacatatgtaaaagcaaaacctggcggcagcgcaaaagatg

SEQ ID NO: 221620 - DNA, 103 bp, Artificial Sequence
  Synthetic Polynucleotide
taatacgactcactatagggggccatgtccaagtcagagtccttgcttttaacagaggagaaaaagcatggactctgacaacctggcggcagcgcaaaagatg

SEQ ID NO: 221621 - DNA, 103 bp, Artificial Sequence
  Synthetic Polynucleotide
taatacgactcactatagggattgattcagggccatgtccaagtcagagtaacagaggagaactctgatgtggacatggaacctggcggcagcgcaaaagatg

SEQ ID NO: 221622 - DNA, 103 bp, Artificial Sequence
  Synthetic Polynucleotide
taatacgactcactatagggggttggctgtattgattcagggccatgtccaacagaggagaggacatatgcctgaatcaaacctggcggcagcgcaaaagatg

SEQ ID NO: 221623 - DNA, 103 bp, Artificial Sequence
  Synthetic Polynucleotide
taatacgactcactataggggaaatattcaggttggctgtattgattcagaacagaggagactgaatatgtacagccaaaacctggcggcagcgcaaaagatg

SEQ ID NO: 221624 - DNA, 103 bp, Artificial Sequence
  Synthetic Polynucleotide
taatacgactcactatagggtttcttcagtgaaatattcaggttggctgtaacagaggagaacagccatgctgaatattaacctggcggcagcgcaaaagatg

SEQ ID NO: 221625 - DNA, 103 bp, Artificial Sequence
  Synthetic Polynucleotide
taatacgactcactatagggaaagtaggcttttcttcagtgaaatattcaaacagaggagatgaataatgcactgaagaaacctggcggcagcgcaaaagatg

SEQ ID NO: 221626 - DNA, 103 bp, Artificial Sequence
  Synthetic Polynucleotide
taatacgactcactatagggcacttgagaaaaagtaggcttttcttcagtaacagaggagaactgaaatgaagcctactaacctggcggcagcgcaaaagatg

SEQ ID NO: 221627 - DNA, 103 bp, Artificial Sequence
  Synthetic Polynucleotide
taatacgactcactatagggatggcgactgcacttgagaaaaagtaggctaacagaggagaagcctaatgtttctcaagaacctggcggcagcgcaaaagatg

SEQ ID NO: 221628 - DNA, 103 bp, Artificial Sequence
  Synthetic Polynucleotide
taatacgactcactatagggctgccggcagctgggtgcacttcatatattaacagaggagaaatataatgagtgcacccaacctggcggcagcgcaaaagatg

SEQ ID NO: 221629 - DNA, 103 bp, Artificial Sequence
  Synthetic Polynucleotide
taatacgactcactatagggtgagaatacgatggcgactgcacttgagaaaacagaggagattctcaatggcagtcgccaacctggcggcagcgcaaaagatg

SEQ ID NO: 221630 - DNA, 103 bp, Artificial Sequence
  Synthetic Polynucleotide
taatacgactcactatagggcccttttttttgagaatacgatggcgactgaacagaggagacagtcgatgtcgtattctaacctggcggcagcgcaaaagatg

SEQ ID NO: 221631 - DNA, 103 bp, Artificial Sequence
  Synthetic Polynucleotide
taatacgactcactatagggtggggatgtacccttttttttgagaatacgaacagaggagacgtattatgaaaaaaaagaacctggcggcagcgcaaaagatg

SEQ ID NO: 221632 - DNA, 103 bp, Artificial Sequence
  Synthetic Polynucleotide
taatacgactcactatagggtctaagtaactggggatgtaccctttttttaacagaggagaaaaaaaatggtacatcccaacctggcggcagcgcaaaagatg

SEQ ID NO: 221633 - DNA, 103 bp, Artificial Sequence
  Synthetic Polynucleotide
taatacgactcactatagggctcgtccttgtctaagtaactggggatgtaaacagaggagatacatcatgagttacttaaacctggcggcagcgcaaaagatg

SEQ ID NO: 221634 - DNA, 103 bp, Artificial Sequence
  Synthetic Polynucleotide
taatacgactcactatagggctacacagagctcgtccttgtctaagtaacaacagaggagagttactatgacaaggacgaacctggcggcagcgcaaaagatg

SEQ ID NO: 221635 - DNA, 103 bp, Artificial Sequence
  Synthetic Polynucleotide
taatacgactcactatagggtcaccacacactacacagagctcgtccttgaacagaggagacaaggaatggctctgtgtaacctggcggcagcgcaaaagatg

SEQ ID NO: 221636 - DNA, 103 bp, Artificial Sequence
  Synthetic Polynucleotide
taatacgactcactatagggggtggctttgtcaccacacactacacagagaacagaggagactctgtatggtgtgtggtaacctggcggcagcgcaaaagatg

SEQ ID NO: 221637 - DNA, 103 bp, Artificial Sequence
  Synthetic Polynucleotide
taatacgactcactatagggagtgatacccggtggctttgtcaccacacaaacagaggagatgtgtgatgacaaagccaaacctggcggcagcgcaaaagatg

SEQ ID NO: 221638 - DNA, 103 bp, Artificial Sequence
  Synthetic Polynucleotide
taatacgactcactatagggatacagcggtagtgatacccggtggctttgaacagaggagacaaagcatgcgggtatcaaacctggcggcagcgcaaaagatg

SEQ ID NO: 221639 - DNA, 103 bp, Artificial Sequence
  Synthetic Polynucleotide
taatacgactcactataggggtagcaattgctgccggcagctgggtgcacaacagaggagagtgcacatggctgccggcaacctggcggcagcgcaaaagatg

SEQ ID NO: 221640 - DNA, 103 bp, Artificial Sequence
  Synthetic Polynucleotide
taatacgactcactatagggttcacacgtgatacagcggtagtgatacccaacagaggagagggtatatgtaccgctgtaacctggcggcagcgcaaaagatg

SEQ ID NO: 221641 - DNA, 103 bp, Artificial Sequence
  Synthetic Polynucleotide
taatacgactcactatagggccttgcagccttcacacgtgatacagcggtaacagaggagaaccgctatgtcacgtgtgaacctggcggcagcgcaaaagatg

SEQ ID NO: 221642 - DNA, 103 bp, Artificial Sequence
  Synthetic Polynucleotide
taatacgactcactatagggctaaagaaacccttgcagccttcacacgtgaacagaggagacacgtgatgaggctgcaaaacctggcggcagcgcaaaagatg

SEQ ID NO: 221643 - DNA, 103 bp, Artificial Sequence
  Synthetic Polynucleotide
taatacgactcactatagggaatggttcttctaaagaaacccttgcagccaacagaggagaggctgcatgggtttctttaacctggcggcagcgcaaaagatg

SEQ ID NO: 221644 - DNA, 103 bp, Artificial Sequence
  Synthetic Polynucleotide
taatacgactcactataggggatttttctgaatggttcttctaaagaaacaacagaggagagtttctatggaagaaccaaacctggcggcagcgcaaaagatg

SEQ ID NO: 221645 - DNA, 103 bp, Artificial Sequence
  Synthetic Polynucleotide
taatacgactcactataggggatggatggagatttttctgaatggttcttaacagaggagaaagaacatgtcagaaaaaaacctggcggcagcgcaaaagatg

SEQ ID NO: 221646 - DNA, 103 bp, Artificial Sequence
  Synthetic Polynucleotide
taatacgactcactatagggacaggaataggatggatggagatttttctgaacagaggagacagaaaatgctccatccaaacctggcggcagcgcaaaagatg

SEQ ID NO: 221647 - DNA, 103 bp, Artificial Sequence
  Synthetic Polynucleotide
taatacgactcactatagggcttcatatttacaggaataggatggatggaaacagaggagatccatcatgcctattcctaacctggcggcagcgcaaaagatg

SEQ ID NO: 221648 - DNA, 103 bp, Artificial Sequence
  Synthetic Polynucleotide
taatacgactcactatagggacacattttccttcatatttacaggaatagaacagaggagactattcatgtaaatatgaaacctggcggcagcgcaaaagatg

SEQ ID NO: 221649 - DNA, 103 bp, Artificial Sequence
  Synthetic Polynucleotide
taatacgactcactatagggtttgtctatgacacattttccttcatatttaacagaggagaaaatatatgggaaaatgtaacctggcggcagcgcaaaagatg

SEQ ID NO: 221650 - DNA, 103 bp, Artificial Sequence
  Synthetic Polynucleotide
taatacgactcactatagggtggactgcatgtagcaattgctgccggcagaacagaggagactgccgatggcaattgctaacctggcggcagcgcaaaagatg

SEQ ID NO: 221651 - DNA, 103 bp, Artificial Sequence
  Synthetic Polynucleotide
taatacgactcactatagggttcgcgtgactttgtctatgacacattttcaacagaggagagaaaatatgtcatagacaaacctggcggcagcgcaaaagatg

SEQ ID NO: 221652 - DNA, 103 bp, Artificial Sequence
  Synthetic Polynucleotide
taatacgactcactatagggtggcactgatttcgcgtgactttgtctatgaacagaggagacatagaatgagtcacgcgaacctggcggcagcgcaaaagatg

SEQ ID NO: 221653 - DNA, 103 bp, Artificial Sequence
  Synthetic Polynucleotide
taatacgactcactataggggcgacattcctggcactgatttcgcgtgacaacagaggagagtcacgatgaatcagtgcaacctggcggcagcgcaaaagatg

SEQ ID NO: 221654 - DNA, 103 bp, Artificial Sequence
  Synthetic Polynucleotide
taatacgactcactatagggatttcttaaagcgacattcctggcactgataacagaggagaatcagtatgaggaatgtcaacctggcggcagcgcaaaagatg

SEQ ID NO: 221655 - DNA, 103 bp, Artificial Sequence
  Synthetic Polynucleotide
taatacgactcactatagggacatagatgcatttcttaaagcgacattccaacagaggagaggaatgatgctttaagaaaacctggcggcagcgcaaaagatg

SEQ ID NO: 221656 - DNA, 103 bp, Artificial Sequence
  Synthetic Polynucleotide
taatacgactcactatagggtgccatgccaacatagatgcatttcttaaaaacagaggagatttaagatgtgcatctataacctggcggcagcgcaaaagatg

SEQ ID NO: 221657 - DNA, 103 bp, Artificial Sequence
  Synthetic Polynucleotide
taatacgactcactatagggccaaatctgttgccatgccaacatagatgcaacagaggagagcatctatgttggcatggaacctggcggcagcgcaaaagatg

SEQ ID NO: 221658 - DNA, 103 bp, Artificial Sequence
  Synthetic Polynucleotide
taatacgactcactatagggtcatccagcaccaaatctgttgccatgccaaacagaggagatggcatatgaacagatttaacctggcggcagcgcaaaagatg

SEQ ID NO: 221659 - DNA, 103 bp, Artificial Sequence
  Synthetic Polynucleotide
taatacgactcactatagggcctcttgctgtcatccagcaccaaatctgtaacagaggagaacagatatggtgctggataacctggcggcagcgcaaaagatg

SEQ ID NO: 221660 - DNA, 103 bp, Artificial Sequence
  Synthetic Polynucleotide
taatacgactcactatagggtcttggccagcctcttgctgtcatccagcaaacagaggagatgctggatgacagcaagaaacctggcggcagcgcaaaagatg

SEQ ID NO: 221661 - DNA, 103 bp, Artificial Sequence
  Synthetic Polynucleotide
taatacgactcactatagggtaataatcagtggactgcatgtagcaattgaacagaggagacaattgatgcatgcagtcaacctggcggcagcgcaaaagatg

SEQ ID NO: 221662 - DNA, 103 bp, Artificial Sequence
  Synthetic Polynucleotide
taatacgactcactatagggatcagcttcctcttggccagcctcttgctgaacagaggagacagcaaatggctggccaaaacctggcggcagcgcaaaagatg

SEQ ID NO: 221663 - DNA, 103 bp, Artificial Sequence
  Synthetic Polynucleotide
taatacgactcactataggggttctcctctatcagcttcctcttggccagaacagaggagactggccatgaggaagctgaacctggcggcagcgcaaaagatg

SEQ ID NO: 221664 - DNA, 103 bp, Artificial Sequence
  Synthetic Polynucleotide
taatacgactcactatagggttttctcccggttctcctctatcagcttccaacagaggagaggaagcatgtagaggagaaacctggcggcagcgcaaaagatg

SEQ ID NO: 221665 - DNA, 103 bp, Artificial Sequence
  Synthetic Polynucleotide
taatacgactcactatagggtcccgccgtcttttctcccggttctcctctaacagaggagaagaggaatgccgggagaaaacctggcggcagcgcaaaagatg

SEQ ID NO: 221666 - DNA, 103 bp, Artificial Sequence
  Synthetic Polynucleotide
taatacgactcactatagggctgcagctcttcccgccgtcttttctcccgaacagaggagacgggagatgagacggcggaacctggcggcagcgcaaaagatg

SEQ ID NO: 221667 - DNA, 103 bp, Artificial Sequence
  Synthetic Polynucleotide
taatacgactcactatagggcgatggacttctgcagctcttcccgccgtcaacagaggagagacggcatgaagagctgcaacctggcggcagcgcaaaagatg

SEQ ID NO: 221668 - DNA, 103 bp, Artificial Sequence
  Synthetic Polynucleotide
taatacgactcactatagggggcttgtgcccgatggacttctgcagctctaacagaggagaagagctatggaagtccataacctggcggcagcgcaaaagatg

SEQ ID NO: 221669 - DNA, 103 bp, Artificial Sequence
  Synthetic Polynucleotide
taatacgactcactatagggtgtgggctctggcttgtgcccgatggacttaacagaggagaaagtccatggggcacaagaacctggcggcagcgcaaaagatg

SEQ ID NO: 221670 - DNA, 103 bp, Artificial Sequence
  Synthetic Polynucleotide
taatacgactcactatagggattcctcgtctgtgggctctggcttgtgccaacagaggagaggcacaatgcagagcccaaacctggcggcagcgcaaaagatg

SEQ ID NO: 221671 - DNA, 103 bp, Artificial Sequence
  Synthetic Polynucleotide
taatacgactcactatagggatgagctcccattcctcgtctgtgggctctaacagaggagaagagccatgagacgaggaaacctggcggcagcgcaaaagatg

SEQ ID NO: 221672 - DNA, 103 bp, Artificial Sequence
  Synthetic Polynucleotide
taatacgactcactatagggaaaatacgcgtaataatcagtggactgcataacagaggagaatgcagatgactgattataacctggcggcagcgcaaaagatg

SEQ ID NO: 221673 - DNA, 103 bp, Artificial Sequence
  Synthetic Polynucleotide
taatacgactcactataggggacagttttgatgagctcccattcctcgtcaacagaggagagacgagatgtgggagctcaacctggcggcagcgcaaaagatg

SEQ ID NO: 221674 - DNA, 103 bp, Artificial Sequence
  Synthetic Polynucleotide
taatacgactcactataggggggcttcggtgacagttttgatgagctcccaacagaggagagggagcatgtcaaaactgaacctggcggcagcgcaaaagatg

SEQ ID NO: 221675 - DNA, 103 bp, Artificial Sequence
  Synthetic Polynucleotide
taatacgactcactataggggtcgccacatgggcttcggtgacagttttgaacagaggagacaaaacatgcaccgaagcaacctggcggcagcgcaaaagatg

SEQ ID NO: 221676 - DNA, 103 bp, Artificial Sequence
  Synthetic Polynucleotide
taatacgactcactatagggttgggcgttggtcgccacatgggcttcggtaacagaggagaaccgaaatgcatgtggcgaacctggcggcagcgcaaaagatg

SEQ ID NO: 221677 - DNA, 103 bp, Artificial Sequence
  Synthetic Polynucleotide
taatacgactcactatagggagtggctgccttgggcgttggtcgccacataacagaggagaatgtggatgccaacgcccaacctggcggcagcgcaaaagatg

SEQ ID NO: 221678 - DNA, 103 bp, Artificial Sequence
  Synthetic Polynucleotide
taatacgactcactatagggttttgcttccagtggctgccttgggcgttgaacagaggagacaacgcatgaggcagccaaacctggcggcagcgcaaaagatg

SEQ ID NO: 221679 - DNA, 103 bp, Artificial Sequence
  Synthetic Polynucleotide
taatacgactcactataggggaatttccgtttttgcttccagtggctgccaacagaggagaggcagcatgtggaagcaaaacctggcggcagcgcaaaagatg

SEQ ID NO: 221680 - DNA, 103 bp, Artificial Sequence
  Synthetic Polynucleotide
taatacgactcactatagggcttctggcaggaatttccgtttttgcttccaacagaggagaggaagcatgaacggaaataacctggcggcagcgcaaaagatg

SEQ ID NO: 221681 - DNA, 103 bp, Artificial Sequence
  Synthetic Polynucleotide
taatacgactcactatagggtgtccaatgtcttctggcaggaatttccgtaacagaggagaacggaaatgcctgccagaaacctggcggcagcgcaaaagatg

SEQ ID NO: 221682 - DNA, 103 bp, Artificial Sequence
  Synthetic Polynucleotide
taatacgactcactatagggtattggtgcttgtccaatgtcttctggcagaacagaggagactgccaatggacattggaaacctggcggcagcgcaaaagatg

SEQ ID NO: 221683 - DNA, 103 bp, Artificial Sequence
  Synthetic Polynucleotide
taatacgactcactataggggactatcttcaaaatacgcgtaataatcagaacagaggagactgattatgacgcgtattaacctggcggcagcgcaaaagatg

SEQ ID NO: 221684 - DNA, 103 bp, Artificial Sequence
  Synthetic Polynucleotide
taatacgactcactataggggggcattgactattggtgcttgtccaatgtaacagaggagaacattgatgaagcaccaaaacctggcggcagcgcaaaagatg

SEQ ID NO: 221685 - DNA, 103 bp, Artificial Sequence
  Synthetic Polynucleotide
taatacgactcactatagggccaccttctggggcattgactattggtgctaacagaggagaagcaccatgagtcaatgcaacctggcggcagcgcaaaagatg

SEQ ID NO: 221686 - DNA, 103 bp, Artificial Sequence
  Synthetic Polynucleotide
taatacgactcactataggggtcaacctttccaccttctggggcattgacaacagaggagagtcaatatgccagaaggtaacctggcggcagcgcaaaagatg

SEQ ID NO: 221687 - DNA, 103 bp, Artificial Sequence
  Synthetic Polynucleotide
taatacgactcactatagggaggcttccaagtcaacctttccaccttctgaacagaggagacagaagatggaaaggttgaacctggcggcagcgcaaaagatg

SEQ ID NO: 221688 - DNA, 103 bp, Artificial Sequence
  Synthetic Polynucleotide
taatacgactcactatagggaaatggctgaaggcttccaagtcaacctttaacagaggagaaaaggtatgcttggaagcaacctggcggcagcgcaaaagatg

SEQ ID NO: 221689 - DNA, 103 bp, Artificial Sequence
  Synthetic Polynucleotide
taatacgactcactataggggatttttgtaaaatggctgaaggcttccaaaacagaggagattggaaatgttcagccataacctggcggcagcgcaaaagatg

SEQ ID NO: 221690 - DNA, 103 bp, Artificial Sequence
  Synthetic Polynucleotide
taatacgactcactatagggctggtgtgatgatttttgtaaaatggctgaaacagaggagatcagccatgttacaaaaaaacctggcggcagcgcaaaagatg

SEQ ID NO: 221691 - DNA, 103 bp, Artificial Sequence
  Synthetic Polynucleotide
taatacgactcactatagggctggtaattgctggtgtgatgatttttgtaaacagaggagatacaaaatgcatcacaccaacctggcggcagcgcaaaagatg

SEQ ID NO: 221692 - DNA, 103 bp, Artificial Sequence
  Synthetic Polynucleotide
taatacgactcactatagggatccaccactctggtaattgctggtgtgataacagaggagaatcacaatggcaattaccaacctggcggcagcgcaaaagatg

SEQ ID NO: 221693 - DNA, 103 bp, Artificial Sequence
  Synthetic Polynucleotide
taatacgactcactatagggttttggcaaaatccaccactctggtaattgaacagaggagacaattaatggagtggtggaacctggcggcagcgcaaaagatg

SEQ ID NO: 221694 - DNA, 103 bp, Artificial Sequence
  Synthetic Polynucleotide
taatacgactcactatagggctgtaacccggactatcttcaaaatacgcgaacagaggagacgcgtaatgtgaagatagaacctggcggcagcgcaaaagatg

SEQ ID NO: 221695 - DNA, 103 bp, Artificial Sequence
  Synthetic Polynucleotide
taatacgactcactatagggataggcaactttttggcaaaatccaccactaacagaggagaagtggtatgttttgccaaaacctggcggcagcgcaaaagatg

SEQ ID NO: 221696 - DNA, 103 bp, Artificial Sequence
  Synthetic Polynucleotide
taatacgactcactatagggctcacaaaacataggcaactttttggcaaaaacagaggagatttgccatgaagttgcctaacctggcggcagcgcaaaagatg

SEQ ID NO: 221697 - DNA, 103 bp, Artificial Sequence
  Synthetic Polynucleotide
taatacgactcactatagggcacatggcagctcacaaaacataggcaactaacagaggagaagttgcatgtgttttgtgaacctggcggcagcgcaaaagatg

SEQ ID NO: 221698 - DNA, 103 bp, Artificial Sequence
  Synthetic Polynucleotide
taatacgactcactatagggatctggtcttcacatggcagctcacaaaacaacagaggagagttttgatggctgccatgaacctggcggcagcgcaaaagatg

SEQ ID NO: 221699 - DNA, 103 bp, Artificial Sequence
  Synthetic Polynucleotide
taatacgactcactataggggaggaggatgatctggtcttcacatggcagaacagaggagactgccaatggaagaccagaacctggcggcagcgcaaaagatg

SEQ ID NO: 221700 - DNA, 103 bp, Artificial Sequence
  Synthetic Polynucleotide
taatacgactcactatagggagcagcctttgaggaggatgatctggtcttaacagaggagaaagaccatgtcatcctccaacctggcggcagcgcaaaagatg

SEQ ID NO: 221701 - DNA, 103 bp, Artificial Sequence
  Synthetic Polynucleotide
taatacgactcactatagggatctccatgcagcagcctttgaggaggatgaacagaggagacatcctatgcaaaggctgaacctggcggcagcgcaaaagatg

SEQ ID NO: 221702 - DNA, 103 bp, Artificial Sequence
  Synthetic Polynucleotide
taatacgactcactatagggaagggacatgatctccatgcagcagcctttaacagaggagaaaaggcatgtgcatggagaacctggcggcagcgcaaaagatg

SEQ ID NO: 221703 - DNA, 103 bp, Artificial Sequence
  Synthetic Polynucleotide
taatacgactcactatagggcagcagcgcgaagggacatgatctccatgcaacagaggagagcatggatgtcatgtcccaacctggcggcagcgcaaaagatg

SEQ ID NO: 221704 - DNA, 103 bp, Artificial Sequence
  Synthetic Polynucleotide
taatacgactcactatagggtcatagcgcacagcagcgcgaagggacatgaacagaggagacatgtcatgtcgcgctgcaacctggcggcagcgcaaaagatg

SEQ ID NO: 221705 - DNA, 103 bp, Artificial Sequence
  Synthetic Polynucleotide
taatacgactcactatagggtggctcaggttcggtggtttccatttccataacagaggagaatggaaatggaaaccaccaacctggcggcagcgcaaaagatg

SEQ ID NO: 221706 - DNA, 103 bp, Artificial Sequence
  Synthetic Polynucleotide
taatacgactcactatagggaaaacaagtcttcaatggagtgatcttctcaacagaggagagagaagatgactccattgaacctggcggcagcgcaaaagatg

SEQ ID NO: 221707 - DNA, 103 bp, Artificial Sequence
  Synthetic Polynucleotide
taatacgactcactataggggttgacattgctagagggtggtgtggacagaacagaggagactgtccatgccaccctctaacctggcggcagcgcaaaagatg

SEQ ID NO: 221708 - DNA, 103 bp, Artificial Sequence
  Synthetic Polynucleotide
taatacgactcactatagggggtaaatagagttgacattgctagagggtgaacagaggagacaccctatggcaatgtcaaacctggcggcagcgcaaaagatg

SEQ ID NO: 221709 - DNA, 103 bp, Artificial Sequence
  Synthetic Polynucleotide
taatacgactcactatagggcagactgtgtggtaaatagagttgacattgaacagaggagacaatgtatgctctatttaaacctggcggcagcgcaaaagatg

SEQ ID NO: 221710 - DNA, 103 bp, Artificial Sequence
  Synthetic Polynucleotide
taatacgactcactataggggaagaatttccagactgtgtggtaaatagaaacagaggagatctattatgcacacagtcaacctggcggcagcgcaaaagatg

SEQ ID NO: 221711 - DNA, 103 bp, Artificial Sequence
  Synthetic Polynucleotide
taatacgactcactatagggggtccctacagaagaatttccagactgtgtaacagaggagaacacagatgggaaattctaacctggcggcagcgcaaaagatg

SEQ ID NO: 221712 - DNA, 103 bp, Artificial Sequence
  Synthetic Polynucleotide
taatacgactcactatagggcatccaaagtggtccctacagaagaatttcaacagaggagagaaattatgctgtagggaaacctggcggcagcgcaaaagatg

SEQ ID NO: 221713 - DNA, 103 bp, Artificial Sequence
  Synthetic Polynucleotide
taatacgactcactatagggatactctctccatccaaagtggtccctacaaacagaggagatgtaggatgcactttggaaacctggcggcagcgcaaaagatg

SEQ ID NO: 221714 - DNA, 103 bp, Artificial Sequence
  Synthetic Polynucleotide
taatacgactcactatagggcagactcgggatactctctccatccaaagtaacagaggagaactttgatgggagagagtaacctggcggcagcgcaaaagatg

SEQ ID NO: 221715 - DNA, 103 bp, Artificial Sequence
  Synthetic Polynucleotide
taatacgactcactatagggaatcgaatgacagactcgggatactctctcaacagaggagagagagaatgtcccgagtcaacctggcggcagcgcaaaagatg

SEQ ID NO: 221716 - DNA, 103 bp, Artificial Sequence
  Synthetic Polynucleotide
taatacgactcactatagggttcttcaatcaatcgaatgacagactcgggaacagaggagacccgagatggtcattcgaaacctggcggcagcgcaaaagatg

SEQ ID NO: 221717 - DNA, 103 bp, Artificial Sequence
  Synthetic Polynucleotide
taatacgactcactatagggcctttttcttaaaacaagtcttcaatggagaacagaggagactccatatgagacttgttaacctggcggcagcgcaaaagatg

SEQ ID NO: 221718 - DNA, 103 bp, Artificial Sequence
  Synthetic Polynucleotide
taatacgactcactataggggagagttggcttcttcaatcaatcgaatgaaacagaggagatcattcatgtgattgaagaacctggcggcagcgcaaaagatg

SEQ ID NO: 221719 - DNA, 103 bp, Artificial Sequence
  Synthetic Polynucleotide
taatacgactcactatagggttcagaccccgagagttggcttcttcaatcaacagaggagagattgaatgagccaactcaacctggcggcagcgcaaaagatg

SEQ ID NO: 221720 - DNA, 103 bp, Artificial Sequence
  Synthetic Polynucleotide
taatacgactcactatagggtcgaacctctttcagaccccgagagttggcaacagaggagagccaacatgcggggtctgaacctggcggcagcgcaaaagatg

SEQ ID NO: 221721 - DNA, 103 bp, Artificial Sequence
  Synthetic Polynucleotide
taatacgactcactatagggacatcataaatcgaacctctttcagaccccaacagaggagaggggtcatgaagaggttcaacctggcggcagcgcaaaagatg

SEQ ID NO: 221722 - DNA, 103 bp, Artificial Sequence
  Synthetic Polynucleotide
taatacgactcactatagggtggttattccacatcataaatcgaacctctaacagaggagaagaggtatgatttatgataacctggcggcagcgcaaaagatg

SEQ ID NO: 221723 - DNA, 103 bp, Artificial Sequence
  Synthetic Polynucleotide
taatacgactcactataggggaggatgtagtggttattccacatcataaaaacagaggagatttatgatgtggaataacaacctggcggcagcgcaaaagatg

SEQ ID NO: 221724 - DNA, 103 bp, Artificial Sequence
  Synthetic Polynucleotide
taatacgactcactatagggatgaattgtggaggatgtagtggttattccaacagaggagaggaataatgactacatccaacctggcggcagcgcaaaagatg

SEQ ID NO: 221725 - DNA, 103 bp, Artificial Sequence
  Synthetic Polynucleotide
taatacgactcactatagggctcctgaagaatgaattgtggaggatgtagaacagaggagactacatatgccacaattcaacctggcggcagcgcaaaagatg

SEQ ID NO: 221726 - DNA, 103 bp, Artificial Sequence
  Synthetic Polynucleotide
taatacgactcactatagggttttatctctctcctgaagaatgaattgtgaacagaggagacacaatatgttcttcaggaacctggcggcagcgcaaaagatg

SEQ ID NO: 221727 - DNA, 103 bp, Artificial Sequence
  Synthetic Polynucleotide
taatacgactcactatagggggggtctcctttttatctctctcctgaagaaacagaggagatcttcaatggagagataaaacctggcggcagcgcaaaagatg

SEQ ID NO: 221728 - DNA, 103 bp, Artificial Sequence
  Synthetic Polynucleotide
taatacgactcactatagggcttttctgatcctttttcttaaaacaagtcaacagaggagagacttgatgtaagaaaaaaacctggcggcagcgcaaaagatg

SEQ ID NO: 221729 - DNA, 103 bp, Artificial Sequence
  Synthetic Polynucleotide
taatacgactcactataggggagcggaagaggggtctcctttttatctctaacagaggagaagagatatgaaggagaccaacctggcggcagcgcaaaagatg

SEQ ID NO: 221730 - DNA, 103 bp, Artificial Sequence
  Synthetic Polynucleotide
taatacgactcactatagggtataaaacaggagcggaagaggggtctcctaacagaggagaaggagaatgctcttccgcaacctggcggcagcgcaaaagatg

SEQ ID NO: 221731 - DNA, 103 bp, Artificial Sequence
  Synthetic Polynucleotide
taatacgactcactatagggatggaagcagtataaaacaggagcggaagaaacagaggagatcttccatgcctgttttaaacctggcggcagcgcaaaagatg

SEQ ID NO: 221732 - DNA, 103 bp, Artificial Sequence
  Synthetic Polynucleotide
taatacgactcactataggggtctgtaaatatggaagcagtataaaacagaacagaggagactgtttatgactgcttccaacctggcggcagcgcaaaagatg

SEQ ID NO: 221733 - DNA, 103 bp, Artificial Sequence
  Synthetic Polynucleotide
taatacgactcactatagggcccaccaagtgtctgtaaatatggaagcagaacagaggagactgcttatgtatttacagaacctggcggcagcgcaaaagatg

SEQ ID NO: 221734 - DNA, 103 bp, Artificial Sequence
  Synthetic Polynucleotide
taatacgactcactataggggtgtgggaaccccaccaagtgtctgtaaataacagaggagaatttacatgcacttggtgaacctggcggcagcgcaaaagatg

SEQ ID NO: 221735 - DNA, 103 bp, Artificial Sequence
  Synthetic Polynucleotide
taatacgactcactatagggggaggagcttgtgtgggaaccccaccaagtaacagaggagaacttggatgggttcccacaacctggcggcagcgcaaaagatg

SEQ ID NO: 221736 - DNA, 103 bp, Artificial Sequence
  Synthetic Polynucleotide
taatacgactcactatagggttcaagaggtggaggagcttgtgtgggaacaacagaggagagttcccatgcaagctcctaacctggcggcagcgcaaaagatg

SEQ ID NO: 221737 - DNA, 103 bp, Artificial Sequence
  Synthetic Polynucleotide
taatacgactcactatagggatgaagttgcttcaagaggtggaggagcttaacagaggagaaagctcatgcacctcttgaacctggcggcagcgcaaaagatg

SEQ ID NO: 221738 - DNA, 103 bp, Artificial Sequence
  Synthetic Polynucleotide
taatacgactcactatagggatttgtgatgatgaagttgcttcaagaggtaacagaggagaacctctatgagcaacttcaacctggcggcagcgcaaaagatg

SEQ ID NO: 221739 - DNA, 103 bp, Artificial Sequence
  Synthetic Polynucleotide
taatacgactcactatagggagttcccaatcttttctgatcctttttcttaacagaggagaaagaaaatggatcagaaaaacctggcggcagcgcaaaagatg

SEQ ID NO: 221740 - DNA, 103 bp, Artificial Sequence
  Synthetic Polynucleotide
taatacgactcactatagggtgggcagataatttgtgatgatgaagttgcaacagaggagagcaactatgtcatcacaaaacctggcggcagcgcaaaagatg

SEQ ID NO: 221741 - DNA, 103 bp, Artificial Sequence
  Synthetic Polynucleotide
taatacgactcactatagggtgaccccatctgggcagataatttgtgatgaacagaggagacatcacatgttatctgccaacctggcggcagcgcaaaagatg

SEQ ID NO: 221742 - DNA, 103 bp, Artificial Sequence
  Synthetic Polynucleotide
taatacgactcactatagggtttgctgaagtgaccccatctgggcagataaacagaggagatatctgatgagatggggtaacctggcggcagcgcaaaagatg

SEQ ID NO: 221743 - DNA, 103 bp, Artificial Sequence
  Synthetic Polynucleotide
taatacgactcactatagggagggtaaaagtttgctgaagtgaccccatcaacagaggagagatgggatgacttcagcaaacctggcggcagcgcaaaagatg

SEQ ID NO: 221744 - DNA, 103 bp, Artificial Sequence
  Synthetic Polynucleotide
taatacgactcactatagggcccaagtttcagggtaaaagtttgctgaagaacagaggagacttcagatgacttttaccaacctggcggcagcgcaaaagatg

SEQ ID NO: 221745 - DNA, 103 bp, Artificial Sequence
  Synthetic Polynucleotide
taatacgactcactatagggtgcatataaacccaagtttcagggtaaaagaacagaggagacttttaatgtgaaacttgaacctggcggcagcgcaaaagatg

SEQ ID NO: 221746 - DNA, 103 bp, Artificial Sequence
  Synthetic Polynucleotide
taatacgactcactatagggctgagatggatgcatataaacccaagtttcaacagaggagagaaactatggtttatatgaacctggcggcagcgcaaaagatg

SEQ ID NO: 221747 - DNA, 103 bp, Artificial Sequence
  Synthetic Polynucleotide
taatacgactcactatagggggatgaagtcctgagatggatgcatataaaaacagaggagatttataatgatccatctcaacctggcggcagcgcaaaagatg

SEQ ID NO: 221748 - DNA, 103 bp, Artificial Sequence
  Synthetic Polynucleotide
taatacgactcactatagggacagggacttggatgaagtcctgagatggaaacagaggagatccatcatgggacttcataacctggcggcagcgcaaaagatg

SEQ ID NO: 221749 - DNA, 103 bp, Artificial Sequence
  Synthetic Polynucleotide
taatacgactcactatagggctctgcagaaacagggacttggatgaagtcaacagaggagagacttcatgcaagtccctaacctggcggcagcgcaaaagatg

SEQ ID NO: 221750 - DNA, 103 bp, Artificial Sequence
  Synthetic Polynucleotide
taatacgactcactatagggtcagggttccagttcccaatcttttctgataacagaggagaatcagaatggattgggaaaacctggcggcagcgcaaaagatg

SEQ ID NO: 221751 - DNA, 103 bp, Artificial Sequence
  Synthetic Polynucleotide
taatacgactcactatagggaacttttatcctctgcagaaacagggacttaacagaggagaaagtccatgtttctgcagaacctggcggcagcgcaaaagatg

SEQ ID NO: 221752 - DNA, 103 bp, Artificial Sequence
  Synthetic Polynucleotide
taatacgactcactatagggatgatccgataacttttatcctctgcagaaaacagaggagattctgcatgggataaaagaacctggcggcagcgcaaaagatg

SEQ ID NO: 221753 - DNA, 103 bp, Artificial Sequence
  Synthetic Polynucleotide
taatacgactcactatagggaagattgtaaatgatccgataacttttatcaacagaggagagataaaatgtatcggatcaacctggcggcagcgcaaaagatg

SEQ ID NO: 221754 - DNA, 103 bp, Artificial Sequence
  Synthetic Polynucleotide
taatacgactcactatagggtcttatgaaaaagattgtaaatgatccgataacagaggagaatcggaatgtttacaatcaacctggcggcagcgcaaaagatg

SEQ ID NO: 221755 - DNA, 103 bp, Artificial Sequence
  Synthetic Polynucleotide
taatacgactcactatagggtcaggcacagtcttatgaaaaagattgtaaaacagaggagattacaaatgttttcataaaacctggcggcagcgcaaaagatg

SEQ ID NO: 221756 - DNA, 103 bp, Artificial Sequence
  Synthetic Polynucleotide
taatacgactcactataggggtatttaaactcaggcacagtcttatgaaaaacagaggagatttcatatgactgtgcctaacctggcggcagcgcaaaagatg

SEQ ID NO: 221757 - DNA, 103 bp, Artificial Sequence
  Synthetic Polynucleotide
taatacgactcactataggggcaaaattctgtatttaaactcaggcacagaacagaggagactgtgcatgagtttaaataacctggcggcagcgcaaaagatg

SEQ ID NO: 221758 - DNA, 103 bp, Artificial Sequence
  Synthetic Polynucleotide
taatacgactcactatagggctcaatatctgcaaaattctgtatttaaacaacagaggagagtttaaatgcagaattttaacctggcggcagcgcaaaagatg

SEQ ID NO: 221759 - DNA, 103 bp, Artificial Sequence
  Synthetic Polynucleotide
taatacgactcactataggggttttggactctcaatatctgcaaaattctaacagaggagaagaattatgcagatattgaacctggcggcagcgcaaaagatg

SEQ ID NO: 221760 - DNA, 103 bp, Artificial Sequence
  Synthetic Polynucleotide
taatacgactcactatagggaaagaaactggttttggactctcaatatctaacagaggagaagatatatggagtccaaaaacctggcggcagcgcaaaagatg

SEQ ID NO: 221761 - DNA, 103 bp, Artificial Sequence
  Synthetic Polynucleotide
taatacgactcactatagggctcaaagacctcagggttccagttcccaataacagaggagaattgggatgtggaaccctaacctggcggcagcgcaaaagatg

SEQ ID NO: 221762 - DNA, 103 bp, Artificial Sequence
  Synthetic Polynucleotide
taatacgactcactatagggtatttctcccaaagaaactggttttggactaacagaggagaagtccaatgccagtttctaacctggcggcagcgcaaaagatg

SEQ ID NO: 221763 - DNA, 103 bp, Artificial Sequence
  Synthetic Polynucleotide
taatacgactcactatagggtttccttttatatttctcccaaagaaactgaacagaggagacagtttatgtgggagaaaaacctggcggcagcgcaaaagatg

SEQ ID NO: 221764 - DNA, 103 bp, Artificial Sequence
  Synthetic Polynucleotide
taatacgactcactatagggtatattcctttttccttttatatttctcccaacagaggagagggagaatgataaaaggaaacctggcggcagcgcaaaagatg

SEQ ID NO: 221765 - DNA, 103 bp, Artificial Sequence
  Synthetic Polynucleotide
taatacgactcactatagggttcctgttcatatattcctttttccttttaaacagaggagataaaagatgaaaggaataaacctggcggcagcgcaaaagatg

SEQ ID NO: 221766 - DNA, 103 bp, Artificial Sequence
  Synthetic Polynucleotide
taatacgactcactataggggccaaacattttcctgttcatatattccttaacagaggagaaaggaaatgatgaacaggaacctggcggcagcgcaaaagatg

SEQ ID NO: 221767 - DNA, 103 bp, Artificial Sequence
  Synthetic Polynucleotide
taatacgactcactatagggtcctgtcacggccaaacattttcctgttcaaacagaggagatgaacaatgaaatgtttgaacctggcggcagcgcaaaagatg

SEQ ID NO: 221768 - DNA, 103 bp, Artificial Sequence
  Synthetic Polynucleotide
taatacgactcactatagggtcatttattatcctgtcacggccaaacattaacagaggagaaatgttatgccgtgacagaacctggcggcagcgcaaaagatg

SEQ ID NO: 221769 - DNA, 103 bp, Artificial Sequence
  Synthetic Polynucleotide
taatacgactcactatagggtaaatgtctctcatttattatcctgtcacgaacagaggagacgtgacatgataataaataacctggcggcagcgcaaaagatg

SEQ ID NO: 221770 - DNA, 103 bp, Artificial Sequence
  Synthetic Polynucleotide
taatacgactcactatagggttccatgaaataaatgtctctcatttattaaacagaggagataataaatgagagacattaacctggcggcagcgcaaaagatg

SEQ ID NO: 221771 - DNA, 103 bp, Artificial Sequence
  Synthetic Polynucleotide
taatacgactcactatagggtcctgggatgttccatgaaataaatgtctcaacagaggagagagacaatgatttcatggaacctggcggcagcgcaaaagatg

SEQ ID NO: 221772 - DNA, 103 bp, Artificial Sequence
  Synthetic Polynucleotide
taatacgactcactatagggtaatattggcctcaaagacctcagggttccaacagaggagaggaaccatgaggtctttgaacctggcggcagcgcaaaagatg

SEQ ID NO: 221773 - DNA, 103 bp, Artificial Sequence
  Synthetic Polynucleotide
taatacgactcactatagggatctaccacatcctgggatgttccatgaaaaacagaggagatttcatatgacatcccagaacctggcggcagcgcaaaagatg

SEQ ID NO: 221774 - DNA, 103 bp, Artificial Sequence
  Synthetic Polynucleotide
taatacgactcactatagggtgcagattccatctaccacatcctgggatgaacagaggagacatcccatgatgtggtagaacctggcggcagcgcaaaagatg

SEQ ID NO: 221775 - DNA, 103 bp, Artificial Sequence
  Synthetic Polynucleotide
taatacgactcactatagggaagttgtgtttgcagattccatctaccacaaacagaggagatgtggtatgtggaatctgaacctggcggcagcgcaaaagatg

SEQ ID NO: 221776 - DNA, 103 bp, Artificial Sequence
  Synthetic Polynucleotide
taatacgactcactatagggtcgagggtcaaagttgtgtttgcagattccaacagaggagaggaatcatgaaacacaacaacctggcggcagcgcaaaagatg

SEQ ID NO: 221777 - DNA, 103 bp, Artificial Sequence
  Synthetic Polynucleotide
taatacgactcactatagggttccacagactcgagggtcaaagttgtgttaacagaggagaaacacaatgttgaccctcaacctggcggcagcgcaaaagatg

SEQ ID NO: 221778 - DNA, 103 bp, Artificial Sequence
  Synthetic Polynucleotide
taatacgactcactataggggtagcatgctttccacagactcgagggtcaaacagaggagatgacccatgagtctgtggaacctggcggcagcgcaaaagatg

SEQ ID NO: 221779 - DNA, 103 bp, Artificial Sequence
  Synthetic Polynucleotide
taatacgactcactatagggtccaaacattgtagcatgctttccacagacaacagaggagagtctgtatgaagcatgctaacctggcggcagcgcaaaagatg

SEQ ID NO: 221780 - DNA, 103 bp, Artificial Sequence
  Synthetic Polynucleotide
taatacgactcactatagggaactgccttgtccaaacattgtagcatgctaacagaggagaagcatgatgcaatgtttgaacctggcggcagcgcaaaagatg

SEQ ID NO: 221781 - DNA, 103 bp, Artificial Sequence
  Synthetic Polynucleotide
taatacgactcactatagggtttgcaaaataactgccttgtccaaacattaacagaggagaaatgttatgacaaggcagaacctggcggcagcgcaaaagatg

SEQ ID NO: 221782 - DNA, 103 bp, Artificial Sequence
  Synthetic Polynucleotide
taatacgactcactataggggcttgccttctttgcaaaataactgccttgaacagaggagacaaggcatgtattttgcaaacctggcggcagcgcaaaagatg

SEQ ID NO: 221783 - DNA, 103 bp, Artificial Sequence
  Synthetic Polynucleotide
taatacgactcactataggggaagagtgtttaatattggcctcaaagaccaacagaggagaggtcttatgggccaatataacctggcggcagcgcaaaagatg

SEQ ID NO: 221784 - DNA, 103 bp, Artificial Sequence
  Synthetic Polynucleotide
taatacgactcactatagggtatgagagtagcttgccttctttgcaaaataacagaggagaattttgatgagaaggcaaaacctggcggcagcgcaaaagatg

SEQ ID NO: 221785 - DNA, 103 bp, Artificial Sequence
  Synthetic Polynucleotide
taatacgactcactatagggttagaaaagttatgagagtagcttgccttcaacagaggagagaaggcatgctactctcaaacctggcggcagcgcaaaagatg

SEQ ID NO: 221786 - DNA, 103 bp, Artificial Sequence
  Synthetic Polynucleotide
taatacgactcactatagggggaggacttcttagaaaagttatgagagtaaacagaggagatactctatgaacttttctaacctggcggcagcgcaaaagatg

SEQ ID NO: 221787 - DNA, 103 bp, Artificial Sequence
  Synthetic Polynucleotide
taatacgactcactatagggggactcctttggaggacttcttagaaaagtaacagaggagaacttttatgagaagtcctaacctggcggcagcgcaaaagatg

SEQ ID NO: 221788 - DNA, 103 bp, Artificial Sequence
  Synthetic Polynucleotide
taatacgactcactatagggaacatgaagtggactcctttggaggacttcaacagaggagagaagtcatgcaaaggagtaacctggcggcagcgcaaaagatg

SEQ ID NO: 221789 - DNA, 103 bp, Artificial Sequence
  Synthetic Polynucleotide
taatacgactcactatagggtttggccagaaacatgaagtggactcctttaacagaggagaaaaggaatgcacttcatgaacctggcggcagcgcaaaagatg

SEQ ID NO: 221790 - DNA, 103 bp, Artificial Sequence
  Synthetic Polynucleotide
taatacgactcactatagggccgtcagcactttggccagaaacatgaagtaacagaggagaacttcaatgttctggccaaacctggcggcagcgcaaaagatg

SEQ ID NO: 221791 - DNA, 103 bp, Artificial Sequence
  Synthetic Polynucleotide
taatacgactcactataggggtgtatctgcccgtcagcactttggccagaaacagaggagatctggcatgagtgctgacaacctggcggcagcgcaaaagatg

SEQ ID NO: 221792 - DNA, 103 bp, Artificial Sequence
  Synthetic Polynucleotide
taatacgactcactatagggactgcccattgtgtatctgcccgtcagcacaacagaggagagtgctgatgggcagatacaacctggcggcagcgcaaaagatg

SEQ ID NO: 221793 - DNA, 103 bp, Artificial Sequence
  Synthetic Polynucleotide
taatacgactcactatagggtcatgccatgactgcccattgtgtatctgcaacagaggagagcagatatgcaatgggcaaacctggcggcagcgcaaaagatg

SEQ ID NO: 221794 - DNA, 103 bp, Artificial Sequence
  Synthetic Polynucleotide
taatacgactcactatagggccagattctagaagagtgtttaatattggcaacagaggagagccaatatgaaacactctaacctggcggcagcgcaaaagatg

SEQ ID NO: 221795 - DNA, 103 bp, Artificial Sequence
  Synthetic Polynucleotide
taatacgactcactataggggggggccttctcatgccatgactgcccattaacagaggagaaatgggatgtcatggcataacctggcggcagcgcaaaagatg

SEQ ID NO: 221796 - DNA, 103 bp, Artificial Sequence
  Synthetic Polynucleotide
taatacgactcactatagggattgactggcgggggccttctcatgccatgaacagaggagacatggcatgagaaggcccaacctggcggcagcgcaaaagatg

SEQ ID NO: 221797 - DNA, 103 bp, Artificial Sequence
  Synthetic Polynucleotide
taatacgactcactatagggcactgccaggattgactggcgggggccttcaacagaggagagaaggcatgcgccagtcaaacctggcggcagcgcaaaagatg

SEQ ID NO: 221798 - DNA, 103 bp, Artificial Sequence
  Synthetic Polynucleotide
taatacgactcactatagggtcactggtgacactgccaggattgactggcaacagaggagagccagtatgtcctggcagaacctggcggcagcgcaaaagatg

SEQ ID NO: 221799 - DNA, 103 bp, Artificial Sequence
  Synthetic Polynucleotide
taatacgactcactataggggtcataaaggtcactggtgacactgccaggaacagaggagacctggcatggtcaccagtaacctggcggcagcgcaaaagatg

SEQ ID NO: 221800 - DNA, 103 bp, Artificial Sequence
  Synthetic Polynucleotide
taatacgactcactatagggccacacaagagtcataaaggtcactggtgaaacagaggagatcaccaatgacctttatgaacctggcggcagcgcaaaagatg

SEQ ID NO: 221801 - DNA, 103 bp, Artificial Sequence
  Synthetic Polynucleotide
taatacgactcactatagggaagaaattatccacacaagagtcataaaggaacagaggagacctttaatgctcttgtgtaacctggcggcagcgcaaaagatg

SEQ ID NO: 221802 - DNA, 103 bp, Artificial Sequence
  Synthetic Polynucleotide
taatacgactcactatagggctgaggctcaaagaaattatccacacaagaaacagaggagatcttgtatggataatttcaacctggcggcagcgcaaaagatg

SEQ ID NO: 221803 - DNA, 103 bp, Artificial Sequence
  Synthetic Polynucleotide
taatacgactcactatagggtgacaaaaatctgaggctcaaagaaattataacagaggagaataattatgttgagcctcaacctggcggcagcgcaaaagatg

SEQ ID NO: 221804 - DNA, 103 bp, Artificial Sequence
  Synthetic Polynucleotide
taatacgactcactatagggtcattaaaaatgacaaaaatctgaggctcaaacagaggagatgagccatggatttttgtaacctggcggcagcgcaaaagatg

SEQ ID NO: 221805 - DNA, 103 bp, Artificial Sequence
  Synthetic Polynucleotide
taatacgactcactatagggatcaagtgagccagattctagaagagtgttaacagaggagaaacactatgctagaatctaacctggcggcagcgcaaaagatg

SEQ ID NO: 221806 - DNA, 103 bp, Artificial Sequence
  Synthetic Polynucleotide
taatacgactcactatagggactctggtcatcattaaaaatgacaaaaataacagaggagaatttttatgatttttaataacctggcggcagcgcaaaagatg

SEQ ID NO: 221807 - DNA, 103 bp, Artificial Sequence
  Synthetic Polynucleotide
taatacgactcactatagggaataagggtaactctggtcatcattaaaaaaacagaggagatttttaatgatgaccagaaacctggcggcagcgcaaaagatg

SEQ ID NO: 221808 - DNA, 103 bp, Artificial Sequence
  Synthetic Polynucleotide
taatacgactcactatagggtggataacaaaataagggtaactctggtcaaacagaggagatgaccaatgttacccttaaacctggcggcagcgcaaaagatg

SEQ ID NO: 221809 - DNA, 103 bp, Artificial Sequence
  Synthetic Polynucleotide
taatacgactcactatagggttcttcatattggataacaaaataagggtaaacagaggagataccctatgtttgttatcaacctggcggcagcgcaaaagatg

SEQ ID NO: 221810 - DNA, 103 bp, Artificial Sequence
  Synthetic Polynucleotide
taatacgactcactatagggtgttactgacttcttcatattggataacaaaacagaggagattgttaatgaatatgaagaacctggcggcagcgcaaaagatg

SEQ ID NO: 221811 - DNA, 103 bp, Artificial Sequence
  Synthetic Polynucleotide
taatacgactcactatagggatggaaacagtgttactgacttcttcatataacagaggagaatatgaatgagtcagtaaaacctggcggcagcgcaaaagatg

SEQ ID NO: 221812 - DNA, 103 bp, Artificial Sequence
  Synthetic Polynucleotide
taatacgactcactatagggctacacagtctggctcaggttcggtggtttaacagaggagaaaaccaatgaacctgagcaacctggcggcagcgcaaaagatg

SEQ ID NO: 221813 - DNA, 103 bp, Artificial Sequence
  Synthetic Polynucleotide
taatacgactcactatagggtaaaaaccccatcaagtgagccagattctaaacagaggagatagaatatggctcacttgaacctggcggcagcgcaaaagatg

SEQ ID NO: 221814 - DNA, 103 bp, Artificial Sequence
  Synthetic Polynucleotide
taatacgactcactatagggttcctagatctaaaaaccccatcaagtgagaacagaggagactcactatgtggggttttaacctggcggcagcgcaaaagatg

SEQ ID NO: 221815 - DNA, 103 bp, Artificial Sequence
  Synthetic Polynucleotide
taatacgactcactatagggtgtactctggttcctagatctaaaaaccccaacagaggagaggggttatgagatctaggaacctggcggcagcgcaaaagatg

SEQ ID NO: 221816 - DNA, 103 bp, Artificial Sequence
  Synthetic Polynucleotide
taatacgactcactatagggtgttctcatctgtactctggttcctagatcaacagaggagagatctaatgaccagagtaaacctggcggcagcgcaaaagatg

SEQ ID NO: 221817 - DNA, 103 bp, Artificial Sequence
  Synthetic Polynucleotide
taatacgactcactatagggtcatgtaagctgttctcatctgtactctggaacagaggagaccagagatgagatgagaaaacctggcggcagcgcaaaagatg

SEQ ID NO: 221818 - DNA, 103 bp, Artificial Sequence
  Synthetic Polynucleotide
taatacgactcactatagggcatcataggttcatgtaagctgttctcatcaacagaggagagatgagatgagcttacataacctggcggcagcgcaaaagatg

SEQ ID NO: 221819 - DNA, 103 bp, Artificial Sequence
  Synthetic Polynucleotide
taatacgactcactatagggtggctttcttcatcataggttcatgtaagcaacagaggagagcttacatgaacctatgaaacctggcggcagcgcaaaagatg

SEQ ID NO: 221820 - DNA, 103 bp, Artificial Sequence
  Synthetic Polynucleotide
taatacgactcactatagggttgatttccatggctttcttcatcataggtaacagaggagaacctatatggaagaaagcaacctggcggcagcgcaaaagatg

SEQ ID NO: 221821 - DNA, 103 bp, Artificial Sequence
  Synthetic Polynucleotide
taatacgactcactataggggcatgatgaattgatttccatggctttcttaacagaggagaaagaaaatgatggaaatcaacctggcggcagcgcaaaagatg

SEQ ID NO: 221822 - DNA, 103 bp, Artificial Sequence
  Synthetic Polynucleotide
taatacgactcactatagggctgctggtgggcatgatgaattgatttccaaacagaggagatggaaaatgattcatcataacctggcggcagcgcaaaagatg

SEQ ID NO: 221823 - DNA, 103 bp, Artificial Sequence
  Synthetic Polynucleotide
taatacgactcactatagggggaggctgcactacacagtctggctcaggtaacagaggagaacctgaatgagactgtgtaacctggcggcagcgcaaaagatg

SEQ ID NO: 221824 - DNA, 103 bp, Artificial Sequence
  Synthetic Polynucleotide
taatacgactcactatagggatattattttctgctggtgggcatgatgaaaacagaggagattcatcatgcccaccagcaacctggcggcagcgcaaaagatg

SEQ ID NO: 221825 - DNA, 103 bp, Artificial Sequence
  Synthetic Polynucleotide
taatacgactcactatagggcagaacagacatattattttctgctggtggaacagaggagaccaccaatggaaaataataacctggcggcagcgcaaaagatg

SEQ ID NO: 221826 - DNA, 103 bp, Artificial Sequence
  Synthetic Polynucleotide
taatacgactcactatagggtatcaggaatcagaacagacatattattttaacagaggagaaaaataatgtgtctgttcaacctggcggcagcgcaaaagatg

SEQ ID NO: 221827 - DNA, 103 bp, Artificial Sequence
  Synthetic Polynucleotide
taatacgactcactatagggacatttgtcctatcaggaatcagaacagacaacagaggagagtctgtatggattcctgaaacctggcggcagcgcaaaagatg

SEQ ID NO: 221828 - DNA, 103 bp, Artificial Sequence
  Synthetic Polynucleotide
taatacgactcactatagggctggtccccaacatttgtcctatcaggaataacagaggagaattcctatgaggacaaataacctggcggcagcgcaaaagatg

SEQ ID NO: 221829 - DNA, 103 bp, Artificial Sequence
  Synthetic Polynucleotide
taatacgactcactatagggcttccggtatctggtccccaacatttgtccaacagaggagaggacaaatgttggggaccaacctggcggcagcgcaaaagatg

SEQ ID NO: 221830 - DNA, 103 bp, Artificial Sequence
  Synthetic Polynucleotide
taatacgactcactataggggaaggatgggcttccggtatctggtccccaaacagaggagatggggaatggataccggaaacctggcggcagcgcaaaagatg

SEQ ID NO: 221831 - DNA, 103 bp, Artificial Sequence
  Synthetic Polynucleotide
taatacgactcactatagggagcttcagtggaaggatgggcttccggtataacagaggagaataccgatggcccatcctaacctggcggcagcgcaaaagatg

SEQ ID NO: 221832 - DNA, 103 bp, Artificial Sequence
  Synthetic Polynucleotide
taatacgactcactatagggctcgttctggagcttcagtggaaggatgggaacagaggagacccatcatgccactgaagaacctggcggcagcgcaaaagatg

SEQ ID NO: 221833 - DNA, 103 bp, Artificial Sequence
  Synthetic Polynucleotide
taatacgactcactatagggattggaaccactcgttctggagcttcagtgaacagaggagacactgaatgtccagaacgaacctggcggcagcgcaaaagatg

SEQ ID NO: 221834 - DNA, 103 bp, Artificial Sequence
  Synthetic Polynucleotide
taatacgactcactatagggaggaggagagggaggctgcactacacagtcaacagaggagagactgtatggtgcagcctaacctggcggcagcgcaaaagatg

SEQ ID NO: 221835 - DNA, 103 bp, Artificial Sequence
  Synthetic Polynucleotide
taatacgactcactataggggtgatcttggattggaaccactcgttctggaacagaggagaccagaaatggtggttccaaacctggcggcagcgcaaaagatg

SEQ ID NO: 221836 - DNA, 103 bp, Artificial Sequence
  Synthetic Polynucleotide
taatacgactcactatagggatggaaagctgtgatcttggattggaaccaaacagaggagatggttcatgtccaagatcaacctggcggcagcgcaaaagatg

SEQ ID NO: 221837 - DNA, 103 bp, Artificial Sequence
  Synthetic Polynucleotide
taatacgactcactatagggagggtttctgatggaaagctgtgatcttggaacagaggagaccaagaatgcagctttccaacctggcggcagcgcaaaagatg

SEQ ID NO: 221838 - DNA, 103 bp, Artificial Sequence
  Synthetic Polynucleotide
taatacgactcactatagggcgtcccactgagggtttctgatggaaagctaacagaggagaagctttatgtcagaaaccaacctggcggcagcgcaaaagatg

SEQ ID NO: 221839 - DNA, 103 bp, Artificial Sequence
  Synthetic Polynucleotide
taatacgactcactatagggaatctgccaccgtcccactgagggtttctgaacagaggagacagaaaatgtcagtgggaaacctggcggcagcgcaaaagatg

SEQ ID NO: 221840 - DNA, 103 bp, Artificial Sequence
  Synthetic Polynucleotide
taatacgactcactataggggctggtgtggaatctgccaccgtcccactgaacagaggagacagtggatgggtggcagaaacctggcggcagcgcaaaagatg

SEQ ID NO: 221841 - DNA, 103 bp, Artificial Sequence
  Synthetic Polynucleotide
taatacgactcactatagggctggaagtgagctggtgtggaatctgccacaacagaggagagtggcaatgtccacaccaaacctggcggcagcgcaaaagatg

SEQ ID NO: 221842 - DNA, 103 bp, Artificial Sequence
  Synthetic Polynucleotide
taatacgactcactatagggaaagatcagtctggaagtgagctggtgtggaacagaggagaccacacatgctcacttccaacctggcggcagcgcaaaagatg

SEQ ID NO: 221843 - DNA, 103 bp, Artificial Sequence
  Synthetic Polynucleotide
taatacgactcactatagggactgggtgcaaaagatcagtctggaagtgaaacagaggagatcacttatggactgatctaacctggcggcagcgcaaaagatg

SEQ ID NO: 221844 - DNA, 103 bp, Artificial Sequence
  Synthetic Polynucleotide
taatacgactcactatagggatcacttgaaactgggtgcaaaagatcagtaacagaggagaactgatatgttgcacccaaacctggcggcagcgcaaaagatg

SEQ ID NO: 221845 - DNA, 103 bp, Artificial Sequence
  Synthetic Polynucleotide
taatacgactcactatagggaaaagtcatcaggaggagagggaggctgcaaacagaggagatgcagcatgcctctcctcaacctggcggcagcgcaaaagatg

SEQ ID NO: 221846 - DNA, 103 bp, Artificial Sequence
  Synthetic Polynucleotide
taatacgactcactatagggtagtaggaacatcacttgaaactgggtgcaaacagaggagatgcaccatgtttcaagtgaacctggcggcagcgcaaaagatg

SEQ ID NO: 221847 - DNA, 103 bp, Artificial Sequence
  Synthetic Polynucleotide
taatacgactcactatagggcagtcaggactagtaggaacatcacttgaaaacagaggagattcaagatgtgttcctacaacctggcggcagcgcaaaagatg

SEQ ID NO: 221848 - DNA, 103 bp, Artificial Sequence
  Synthetic Polynucleotide
taatacgactcactatagggtttgtctaagcagtcaggactagtaggaacaacagaggagagttcctatgagtcctgacaacctggcggcagcgcaaaagatg

SEQ ID NO: 221849 - DNA, 103 bp, Artificial Sequence
  Synthetic Polynucleotide
taatacgactcactatagggaatctatgactttgtctaagcagtcaggacaacagaggagagtcctgatggcttagacaaacctggcggcagcgcaaaagatg

SEQ ID NO: 221850 - DNA, 103 bp, Artificial Sequence
  Synthetic Polynucleotide
taatacgactcactatagggcctggaacataatctatgactttgtctaagaacagaggagacttagaatgagtcatagaaacctggcggcagcgcaaaagatg

SEQ ID NO: 221851 - DNA, 103 bp, Artificial Sequence
  Synthetic Polynucleotide
taatacgactcactatagggttggaaaatgcctggaacataatctatgacaacagaggagagtcataatgtatgttccaaacctggcggcagcgcaaaagatg

SEQ ID NO: 221852 - DNA, 103 bp, Artificial Sequence
  Synthetic Polynucleotide
taatacgactcactatagggaactgttttcttggaaaatgcctggaacataacagaggagaatgttcatggcattttccaacctggcggcagcgcaaaagatg

SEQ ID NO: 221853 - DNA, 103 bp, Artificial Sequence
  Synthetic Polynucleotide
taatacgactcactatagggtggattgtaaaactgttttcttggaaaatgaacagaggagacattttatgagaaaacagaacctggcggcagcgcaaaagatg

SEQ ID NO: 221854 - DNA, 103 bp, Artificial Sequence
  Synthetic Polynucleotide
taatacgactcactatagggcagaatgtattggattgtaaaactgttttcaacagaggagagaaaacatgtttacaatcaacctggcggcagcgcaaaagatg

SEQ ID NO: 221855 - DNA, 103 bp, Artificial Sequence
  Synthetic Polynucleotide
taatacgactcactatagggcactggtgtccagaatgtattggattgtaaaacagaggagattacaaatgaatacattcaacctggcggcagcgcaaaagatg

SEQ ID NO: 221856 - DNA, 103 bp, Artificial Sequence
  Synthetic Polynucleotide
taatacgactcactatagggatttggcatgaaaagtcatcaggaggagagaacagaggagactctccatgtgatgacttaacctggcggcagcgcaaaagatg

SEQ ID NO: 221857 - DNA, 103 bp, Artificial Sequence
  Synthetic Polynucleotide
taatacgactcactatagggctcagcttatcactggtgtccagaatgtataacagaggagaatacatatgggacaccagaacctggcggcagcgcaaaagatg

SEQ ID NO: 221858 - DNA, 103 bp, Artificial Sequence
  Synthetic Polynucleotide
taatacgactcactataggggagctcagtactcagcttatcactggtgtcaacagaggagagacaccatggataagctgaacctggcggcagcgcaaaagatg

SEQ ID NO: 221859 - DNA, 103 bp, Artificial Sequence
  Synthetic Polynucleotide
taatacgactcactatagggtgtcctgaaagagctcagtactcagcttataacagaggagaataagcatggtactgagcaacctggcggcagcgcaaaagatg

SEQ ID NO: 221860 - DNA, 103 bp, Artificial Sequence
  Synthetic Polynucleotide
taatacgactcactatagggtcttcacttttgtcctgaaagagctcagtaaacagaggagatactgaatgctttcaggaaacctggcggcagcgcaaaagatg

SEQ ID NO: 221861 - DNA, 103 bp, Artificial Sequence
  Synthetic Polynucleotide
taatacgactcactatagggaagggaagcctcttcacttttgtcctgaaaaacagaggagatttcagatgaaaagtgaaaacctggcggcagcgcaaaagatg

SEQ ID NO: 221862 - DNA, 103 bp, Artificial Sequence
  Synthetic Polynucleotide
taatacgactcactatagggacacgaggtcaagggaagcctcttcactttaacagaggagaaaagtgatgaggcttcccaacctggcggcagcgcaaaagatg

SEQ ID NO: 221863 - DNA, 103 bp, Artificial Sequence
  Synthetic Polynucleotide
taatacgactcactatagggaccagctcaaacacgaggtcaagggaagccaacagaggagaggcttcatgtgacctcgtaacctggcggcagcgcaaaagatg

SEQ ID NO: 221864 - DNA, 103 bp, Artificial Sequence
  Synthetic Polynucleotide
taatacgactcactatagggcaactggttcaccagctcaaacacgaggtcaacagaggagagacctcatgtttgagctgaacctggcggcagcgcaaaagatg

SEQ ID NO: 221865 - DNA, 103 bp, Artificial Sequence
  Synthetic Polynucleotide
taatacgactcactatagggtgtggtactgcaactggttcaccagctcaaaacagaggagattgagcatgtgaaccagtaacctggcggcagcgcaaaagatg

SEQ ID NO: 221866 - DNA, 103 bp, Artificial Sequence
  Synthetic Polynucleotide
taatacgactcactatagggtcttggtgagtgtggtactgcaactggttcaacagaggagagaaccaatggcagtaccaaacctggcggcagcgcaaaagatg

SEQ ID NO: 221867 - DNA, 103 bp, Artificial Sequence
  Synthetic Polynucleotide
taatacgactcactatagggagagagtctcatttggcatgaaaagtcatcaacagaggagagatgacatgtcatgccaaaacctggcggcagcgcaaaagatg

SEQ ID NO: 221868 - DNA, 103 bp, Artificial Sequence
  Synthetic Polynucleotide
taatacgactcactatagggaattccgttctcttggtgagtgtggtactgaacagaggagacagtacatgactcaccaaaacctggcggcagcgcaaaagatg

SEQ ID NO: 221869 - DNA, 103 bp, Artificial Sequence
  Synthetic Polynucleotide
taatacgactcactatagggtgcaaatttcaattccgttctcttggtgagaacagaggagactcaccatgagaacggaaaacctggcggcagcgcaaaagatg

SEQ ID NO: 221870 - DNA, 103 bp, Artificial Sequence
  Synthetic Polynucleotide
taatacgactcactatagggagaaagtccatgcaaatttcaattccgttcaacagaggagagaacggatgtgaaatttgaacctggcggcagcgcaaaagatg

SEQ ID NO: 221871 - DNA, 103 bp, Artificial Sequence
  Synthetic Polynucleotide
taatacgactcactatagggagtgccttgcagaaagtccatgcaaatttcaacagaggagagaaattatgatggactttaacctggcggcagcgcaaaagatg

SEQ ID NO: 221872 - DNA, 103 bp, Artificial Sequence
  Synthetic Polynucleotide
taatacgactcactatagggcataaatacaagtgccttgcagaaagtccaaacagaggagatggactatgtgcaaggcaaacctggcggcagcgcaaaagatg

SEQ ID NO: 221873 - DNA, 103 bp, Artificial Sequence
  Synthetic Polynucleotide
taatacgactcactatagggcaatccctgccataaatacaagtgccttgcaacagaggagagcaaggatgttgtatttaaacctggcggcagcgcaaaagatg

SEQ ID NO: 221874 - DNA, 103 bp, Artificial Sequence
  Synthetic Polynucleotide
taatacgactcactataggggtgcttcaaacaatccctgccataaatacaaacagaggagatgtattatgggcagggataacctggcggcagcgcaaaagatg

SEQ ID NO: 221875 - DNA, 103 bp, Artificial Sequence
  Synthetic Polynucleotide
taatacgactcactatagggagacagtgtggtgcttcaaacaatccctgcaacagaggagagcagggatggtttgaagcaacctggcggcagcgcaaaagatg

SEQ ID NO: 221876 - DNA, 103 bp, Artificial Sequence
  Synthetic Polynucleotide
taatacgactcactatagggtgatatggcaagacagtgtggtgcttcaaaaacagaggagatttgaaatgccacactgtaacctggcggcagcgcaaaagatg

SEQ ID NO: 221877 - DNA, 103 bp, Artificial Sequence
  Synthetic Polynucleotide
taatacgactcactataggggatctgccaatgatatggcaagacagtgtgaacagaggagacacactatgttgccatataacctggcggcagcgcaaaagatg

SEQ ID NO: 221878 - DNA, 103 bp, Artificial Sequence
  Synthetic Polynucleotide
taatacgactcactatagggtgatcttctcagagagtctcatttggcatgaacagaggagacatgccatgtgagactctaacctggcggcagcgcaaaagatg

SEQ ID NO: 221879 - DNA, 103 bp, Artificial Sequence
  Synthetic Polynucleotide
taatacgactcactatagggttgtccttttgatctgccaatgatatggcaaacagaggagatgccatatgattggcagaaacctggcggcagcgcaaaagatg

SEQ ID NO: 221880 - DNA, 103 bp, Artificial Sequence
  Synthetic Polynucleotide
taatacgactcactatagggttttgagtagttgtccttttgatctgccaaaacagaggagattggcaatgcaaaaggacaacctggcggcagcgcaaaagatg

SEQ ID NO: 221881 - DNA, 103 bp, Artificial Sequence
  Synthetic Polynucleotide
taatacgactcactatagggactctgccacttttgagtagttgtccttttaacagaggagaaaaaggatgactactcaaaacctggcggcagcgcaaaagatg

SEQ ID NO: 221882 - DNA, 103 bp, Artificial Sequence
  Synthetic Polynucleotide
taatacgactcactatagggcattgaatacactctgccacttttgagtagaacagaggagactactcatgagtggcagaaacctggcggcagcgcaaaagatg

SEQ ID NO: 221883 - DNA, 103 bp, Artificial Sequence
  Synthetic Polynucleotide
taatacgactcactatagggtcctgagaatcattgaatacactctgccacaacagaggagagtggcaatgtgtattcaaaacctggcggcagcgcaaaagatg

SEQ ID NO: 221884 - DNA, 103 bp, Artificial Sequence
  Synthetic Polynucleotide
taatacgactcactatagggttccaagtgctcctgagaatcattgaatacaacagaggagagtattcatggattctcagaacctggcggcagcgcaaaagatg

SEQ ID NO: 221885 - DNA, 103 bp, Artificial Sequence
  Synthetic Polynucleotide
taatacgactcactatagggagtaaaatctttccaagtgctcctgagaataacagaggagaattctcatgagcacttggaacctggcggcagcgcaaaagatg

SEQ ID NO: 221886 - DNA, 103 bp, Artificial Sequence
  Synthetic Polynucleotide
taatacgactcactatagggtctgggttacagtaaaatctttccaagtgcaacagaggagagcacttatgaagattttaaacctggcggcagcgcaaaagatg

SEQ ID NO: 221887 - DNA, 103 bp, Artificial Sequence
  Synthetic Polynucleotide
taatacgactcactatagggtctatcattttctgggttacagtaaaatctaacagaggagaagatttatgtgtaacccaaacctggcggcagcgcaaaagatg

SEQ ID NO: 221888 - DNA, 103 bp, Artificial Sequence
  Synthetic Polynucleotide
taatacgactcactatagggtcattctcattctatcattttctgggttacaacagaggagagtaaccatgaaaatgataaacctggcggcagcgcaaaagatg

SEQ ID NO: 221889 - DNA, 103 bp, Artificial Sequence
  Synthetic Polynucleotide
taatacgactcactatagggttcaatggagtgatcttctcagagagtctcaacagaggagagagactatgtgagaagataacctggcggcagcgcaaaagatg

SEQ ID NO: 221890 - DNA, 103 bp, Artificial Sequence
  Synthetic Polynucleotide
taatacgactcactatagggcctccatacttcattctcattctatcatttaacagaggagaaaatgaatgaatgagaataacctggcggcagcgcaaaagatg

SEQ ID NO: 221891 - DNA, 103 bp, Artificial Sequence
  Synthetic Polynucleotide
taatacgactcactatagggaaattcttgtcctccatacttcattctcataacagaggagaatgagaatgaagtatggaaacctggcggcagcgcaaaagatg

SEQ ID NO: 221892 - DNA, 103 bp, Artificial Sequence
  Synthetic Polynucleotide
taatacgactcactatagggaatctgcccaaaattcttgtcctccatactaacagaggagaagtatgatggacaagaataacctggcggcagcgcaaaagatg

SEQ ID NO: 221893 - DNA, 103 bp, Artificial Sequence
  Synthetic Polynucleotide
taatacgactcactatagggatggcattcaaatctgcccaaaattcttgtaacagaggagaacaagaatgttgggcagaaacctggcggcagcgcaaaagatg

SEQ ID NO: 221894 - DNA, 103 bp, Artificial Sequence
  Synthetic Polynucleotide
taatacgactcactatagggatacacgttcatggcattcaaatctgcccaaacagaggagatgggcaatgttgaatgccaacctggcggcagcgcaaaagatg

SEQ ID NO: 221895 - DNA, 103 bp, Artificial Sequence
  Synthetic Polynucleotide
taatacgactcactatagggcagttgtttcatacacgttcatggcattcaaacagaggagatgaatgatgtgaacgtgtaacctggcggcagcgcaaaagatg

SEQ ID NO: 221896 - DNA, 103 bp, Artificial Sequence
  Synthetic Polynucleotide
taatacgactcactatagggtggtcaaattcagttgtttcatacacgttcaacagaggagagaacgtatgtgaaacaacaacctggcggcagcgcaaaagatg

SEQ ID NO: 221897 - DNA, 103 bp, Artificial Sequence
  Synthetic Polynucleotide
taatacgactcactatagggccttcgtagttggtcaaattcagttgtttcaacagaggagagaaacaatggaatttgacaacctggcggcagcgcaaaagatg

SEQ ID NO: 221898 - DNA, 103 bp, Artificial Sequence
  Synthetic Polynucleotide
taatacgactcactataggggtgtggacagccttcgtagttggtcaaattaacagaggagaaatttgatgaactacgaaaacctggcggcagcgcaaaagatg

SEQ ID NO: 221899 - DNA, 103 bp, Artificial Sequence
  Synthetic Polynucleotide
taatacgactcactatagggctagagggtggtgtggacagccttcgtagtaacagaggagaactacgatggctgtccacaacctggcggcagcgcaaaagatg

SEQ ID NO: 221900 - DNA, 103 bp, Artificial Sequence
  Synthetic Polynucleotide
taatacgactcactataggggtggaggtggtgcggacccaggtgctccataacagaggagaatggagatgctgggtccgaacctggcggcagcgcaaaagatg

SEQ ID NO: 221901 - DNA, 103 bp, Artificial Sequence
  Synthetic Polynucleotide
taatacgactcactataggggaggcgcgaggcgggtcccatgcagccaccaacagaggagaggtggcatgatgggacccaacctggcggcagcgcaaaagatg

SEQ ID NO: 221902 - DNA, 103 bp, Artificial Sequence
  Synthetic Polynucleotide
taatacgactcactatagggctccgtcctggaggcgcgaggcgggtcccaaacagaggagatgggacatgcctcgcgccaacctggcggcagcgcaaaagatg

SEQ ID NO: 221903 - DNA, 103 bp, Artificial Sequence
  Synthetic Polynucleotide
taatacgactcactatagggaggccgtattctccgtcctggaggcgcgagaacagaggagactcgcgatgccaggacggaacctggcggcagcgcaaaagatg

SEQ ID NO: 221904 - DNA, 103 bp, Artificial Sequence
  Synthetic Polynucleotide
taatacgactcactatagggcaagcagccaaggccgtattctccgtcctgaacagaggagacaggacatggaatacggcaacctggcggcagcgcaaaagatg

SEQ ID NO: 221905 - DNA, 103 bp, Artificial Sequence
  Synthetic Polynucleotide
taatacgactcactatagggcgcctccgaccaagcagccaaggccgtattaacagaggagaaatacgatgttggctgctaacctggcggcagcgcaaaagatg

SEQ ID NO: 221906 - DNA, 103 bp, Artificial Sequence
  Synthetic Polynucleotide
taatacgactcactatagggtaagtgtaggcgcctccgaccaagcagccaaacagaggagatggctgatgggtcggaggaacctggcggcagcgcaaaagatg

SEQ ID NO: 221907 - DNA, 103 bp, Artificial Sequence
  Synthetic Polynucleotide
taatacgactcactatagggcccgccgccgtaagtgtaggcgcctccgacaacagaggagagtcggaatggcctacactaacctggcggcagcgcaaaagatg

SEQ ID NO: 221908 - DNA, 103 bp, Artificial Sequence
  Synthetic Polynucleotide
taatacgactcactatagggccgcggagcccccgccgccgtaagtgtaggaacagaggagacctacaatgacggcggcgaacctggcggcagcgcaaaagatg

SEQ ID NO: 221909 - DNA, 103 bp, Artificial Sequence
  Synthetic Polynucleotide
taatacgactcactatagggcccgtcgcggccgcggagcccccgccgccgaacagaggagacggcggatggggctccgcaacctggcggcagcgcaaaagatg

SEQ ID NO: 221910 - DNA, 103 bp, Artificial Sequence
  Synthetic Polynucleotide
taatacgactcactatagggtcctccagcccccgtcgcggccgcggagccaacagaggagaggctccatggccgcgacgaacctggcggcagcgcaaaagatg

SEQ ID NO: 221911 - DNA, 103 bp, Artificial Sequence
  Synthetic Polynucleotide
taatacgactcactatagggcgtgacccgggtggaggtggtgcggacccaaacagaggagatgggtcatgaccacctccaacctggcggcagcgcaaaagatg

SEQ ID NO: 221912 - DNA, 103 bp, Artificial Sequence
  Synthetic Polynucleotide
taatacgactcactatagggaggcccccgctcctccagcccccgtcgcggaacagaggagaccgcgaatggggctggagaacctggcggcagcgcaaaagatg

SEQ ID NO: 221913 - DNA, 103 bp, Artificial Sequence
  Synthetic Polynucleotide
taatacgactcactatagggccagtaccataggcccccgctcctccagccaacagaggagaggctggatgagcgggggcaacctggcggcagcgcaaaagatg

SEQ ID NO: 221914 - DNA, 103 bp, Artificial Sequence
  Synthetic Polynucleotide
taatacgactcactataggggccgggacctccagtaccataggcccccgcaacagaggagagcggggatgtatggtactaacctggcggcagcgcaaaagatg

SEQ ID NO: 221915 - DNA, 103 bp, Artificial Sequence
  Synthetic Polynucleotide
taatacgactcactatagggctccggggccgccgggacctccagtaccataacagaggagaatggtaatggaggtcccgaacctggcggcagcgcaaaagatg

SEQ ID NO: 221916 - DNA, 103 bp, Artificial Sequence
  Synthetic Polynucleotide
taatacgactcactatagggcctgccgggcctccggggccgccgggacctaacagaggagaaggtccatgcggccccggaacctggcggcagcgcaaaagatg

SEQ ID NO: 221917 - DNA, 103 bp, Artificial Sequence
  Synthetic Polynucleotide
taatacgactcactataggggccgccgccgcctgccgggcctccggggccaacagaggagaggccccatgggcccggcaaacctggcggcagcgcaaaagatg

SEQ ID NO: 221918 - DNA, 103 bp, Artificial Sequence
  Synthetic Polynucleotide
taatacgactcactatagggtgctgcaggcgccgccgccgcctgccgggcaacagaggagagcccggatggcggcggcgaacctggcggcagcgcaaaagatg

SEQ ID NO: 221919 - DNA, 103 bp, Artificial Sequence
  Synthetic Polynucleotide
taatacgactcactatagggagaggacccatgctgcaggcgccgccgccgaacagaggagacggcggatgcgcctgcagaacctggcggcagcgcaaaagatg

SEQ ID NO: 221920 - DNA, 103 bp, Artificial Sequence
  Synthetic Polynucleotide
taatacgactcactatagggggagccggtcagaggacccatgctgcaggcaacagaggagagcctgcatgatgggtcctaacctggcggcagcgcaaaagatg

SEQ ID NO: 221921 - DNA, 103 bp, Artificial Sequence
  Synthetic Polynucleotide
taatacgactcactatagggtcacgttgtaggagccggtcagaggacccaaacagaggagatgggtcatgtgaccggctaacctggcggcagcgcaaaagatg

SEQ ID NO: 221922 - DNA, 103 bp, Artificial Sequence
  Synthetic Polynucleotide
taatacgactcactatagggatgggctctgcgtgacccgggtggaggtggaacagaggagaccacctatgcccgggtcaaacctggcggcagcgcaaaagatg

SEQ ID NO: 221923 - DNA, 103 bp, Artificial Sequence
  Synthetic Polynucleotide
taatacgactcactatagggaaggccatgttcacgttgtaggagccggtcaacagaggagagaccggatgctacaacgtaacctggcggcagcgcaaaagatg

SEQ ID NO: 221924 - DNA, 103 bp, Artificial Sequence
  Synthetic Polynucleotide
taatacgactcactataggggccgcctgccaaggccatgttcacgttgtaaacagaggagatacaacatgaacatggccaacctggcggcagcgcaaaagatg

SEQ ID NO: 221925 - DNA, 103 bp, Artificial Sequence
  Synthetic Polynucleotide
taatacgactcactatagggcaggaccggggccgcctgccaaggccatgtaacagaggagaacatggatgtggcaggcgaacctggcggcagcgcaaaagatg

SEQ ID NO: 221926 - DNA, 103 bp, Artificial Sequence
  Synthetic Polynucleotide
taatacgactcactatagggccgccgccgccaggaccggggccgcctgccaacagaggagaggcaggatgccccggtccaacctggcggcagcgcaaaagatg

SEQ ID NO: 221927 - DNA, 103 bp, Artificial Sequence
  Synthetic Polynucleotide
taatacgactcactataggggctgctgccgccgccgccgccaggaccgggaacagaggagacccggtatgggcggcggcaacctggcggcagcgcaaaagatg

SEQ ID NO: 221928 - DNA, 103 bp, Artificial Sequence
  Synthetic Polynucleotide
taatacgactcactatagggcggcaccgccgctgctgccgccgccgccgcaacagaggagagcggcgatggcggcagcaaacctggcggcagcgcaaaagatg

SEQ ID NO: 221929 - DNA, 103 bp, Artificial Sequence
  Synthetic Polynucleotide
taatacgactcactatagggctgagtgccccggcaccgccgctgctgccgaacagaggagacggcagatgcggcggtgcaacctggcggcagcgcaaaagatg

SEQ ID NO: 221930 - DNA, 103 bp, Artificial Sequence
  Synthetic Polynucleotide
taatacgactcactatagggccccgcagcgctgagtgccccggcaccgccaacagaggagaggcggtatgggggcactcaacctggcggcagcgcaaaagatg

SEQ ID NO: 221931 - DNA, 103 bp, Artificial Sequence
  Synthetic Polynucleotide
taatacgactcactatagggcccggattacccccgcagcgctgagtgcccaacagaggagagggcacatggcgctgcggaacctggcggcagcgcaaaagatg

SEQ ID NO: 221932 - DNA, 103 bp, Artificial Sequence
  Synthetic Polynucleotide
taatacgactcactatagggtgtgccggcacccggattacccccgcagcgaacagaggagacgctgcatgggtaatccgaacctggcggcagcgcaaaagatg

SEQ ID NO: 221933 - DNA, 103 bp, Artificial Sequence
  Synthetic Polynucleotide
taatacgactcactataggggccgaagctaatgggctctgcgtgacccggaacagaggagaccgggtatggcagagcccaacctggcggcagcgcaaaagatg

SEQ ID NO: 221934 - DNA, 103 bp, Artificial Sequence
  Synthetic Polynucleotide
taatacgactcactataggggagcggcctgtgtgccggcacccggattacaacagaggagagtaatcatggtgccggcaaacctggcggcagcgcaaaagatg

SEQ ID NO: 221935 - DNA, 103 bp, Artificial Sequence
  Synthetic Polynucleotide
taatacgactcactatagggcggctccggcgagcggcctgtgtgccggcaaacagaggagatgccggatgacaggccgcaacctggcggcagcgcaaaagatg

SEQ ID NO: 221936 - DNA, 103 bp, Artificial Sequence
  Synthetic Polynucleotide
taatacgactcactataggggggtgggccacggctccggcgagcggcctgaacagaggagacaggccatgcgccggagcaacctggcggcagcgcaaaagatg

SEQ ID NO: 221937 - DNA, 103 bp, Artificial Sequence
  Synthetic Polynucleotide
taatacgactcactatagggcaggggctgggggtgggccacggctccggcaacagaggagagccggaatggtggcccacaacctggcggcagcgcaaaagatg

SEQ ID NO: 221938 - DNA, 103 bp, Artificial Sequence
  Synthetic Polynucleotide
taatacgactcactatagggagccggtggccaggggctgggggtgggccaaacagaggagatggcccatgcccagccccaacctggcggcagcgcaaaagatg

SEQ ID NO: 221939 - DNA, 103 bp, Artificial Sequence
  Synthetic Polynucleotide
taatacgactcactatagggacggtgggcaagccggtggccaggggctggaacagaggagaccagccatgggccaccggaacctggcggcagcgcaaaagatg

SEQ ID NO: 221940 - DNA, 103 bp, Artificial Sequence
  Synthetic Polynucleotide
taatacgactcactatagggcacagagggcacggtgggcaagccggtggcaacagaggagagccaccatgttgcccaccaacctggcggcagcgcaaaagatg

SEQ ID NO: 221941 - DNA, 103 bp, Artificial Sequence
  Synthetic Polynucleotide
taatacgactcactataggggcatggcaggcacagagggcacggtgggcaaacagaggagatgcccaatgtgccctctgaacctggcggcagcgcaaaagatg

SEQ ID NO: 221942 - DNA, 103 bp, Artificial Sequence
  Synthetic Polynucleotide
taatacgactcactatagggttgacgcccggcatggcaggcacagagggcaacagaggagagccctcatggcctgccataacctggcggcagcgcaaaagatg

SEQ ID NO: 221943 - DNA, 103 bp, Artificial Sequence
  Synthetic Polynucleotide
taatacgactcactatagggagtgaggttgttgacgcccggcatggcaggaacagaggagacctgccatgccgggcgtcaacctggcggcagcgcaaaagatg

SEQ ID NO: 221944 - DNA, 103 bp, Artificial Sequence
  Synthetic Polynucleotide
taatacgactcactatagggtctggtcgatgccgaagctaatgggctctgaacagaggagacagagcatgttagcttcgaacctggcggcagcgcaaaagatg

SEQ ID NO: 221945 - DNA, 103 bp, Artificial Sequence
  Synthetic Polynucleotide
taatacgactcactatagggaggtgaggccagtgaggttgttgacgcccgaacagaggagacgggcgatgacaacctcaaacctggcggcagcgcaaaagatg

SEQ ID NO: 221946 - DNA, 103 bp, Artificial Sequence
  Synthetic Polynucleotide
taatacgactcactatagggatccaggggaaggtgaggccagtgaggttgaacagaggagacaacctatgtggcctcacaacctggcggcagcgcaaaagatg

SEQ ID NO: 221947 - DNA, 103 bp, Artificial Sequence
  Synthetic Polynucleotide
taatacgactcactataggggttactctccatccaggggaaggtgaggccaacagaggagaggcctcatgttcccctggaacctggcggcagcgcaaaagatg

SEQ ID NO: 221948 - DNA, 103 bp, Artificial Sequence
  Synthetic Polynucleotide
taatacgactcactatagggtgtatctgcggttactctccatccaggggaaacagaggagatcccctatgtggagagtaaacctggcggcagcgcaaaagatg

SEQ ID NO: 221949 - DNA, 103 bp, Artificial Sequence
  Synthetic Polynucleotide
taatacgactcactatagggctgtcctttgtgtatctgcggttactctccaacagaggagaggagagatgccgcagataaacctggcggcagcgcaaaagatg

SEQ ID NO: 221950 - DNA, 103 bp, Artificial Sequence
  Synthetic Polynucleotide
taatacgactcactatagggacctgtgaacctgtcctttgtgtatctgcgaacagaggagacgcagaatgacaaaggacaacctggcggcagcgcaaaagatg

SEQ ID NO: 221951 - DNA, 103 bp, Artificial Sequence
  Synthetic Polynucleotide
taatacgactcactataggggataggggtgacctgtgaacctgtcctttgaacagaggagacaaaggatgggttcacagaacctggcggcagcgcaaaagatg

SEQ ID NO: 221952 - DNA, 103 bp, Artificial Sequence
  Synthetic Polynucleotide
taatacgactcactataggggtccggttctgataggggtgacctgtgaacaacagaggagagttcacatgtcacccctaaacctggcggcagcgcaaaagatg

SEQ ID NO: 221953 - DNA, 103 bp, Artificial Sequence
  Synthetic Polynucleotide
taatacgactcactatagggcttggggggcgtccggttctgataggggtgaacagaggagacaccccatgcagaaccggaacctggcggcagcgcaaaagatg

SEQ ID NO: 221954 - DNA, 103 bp, Artificial Sequence
  Synthetic Polynucleotide
taatacgactcactataggggcttcttcttcttggggggcgtccggttctaacagaggagaagaaccatgcgccccccaaacctggcggcagcgcaaaagatg

SEQ ID NO: 221955 - DNA, 103 bp, Artificial Sequence
  Synthetic Polynucleotide
taatacgactcactatagggctgttgaggatctggtcgatgccgaagctaaacagaggagatagcttatgcatcgaccaaacctggcggcagcgcaaaagatg

SEQ ID NO: 221956 - DNA, 103 bp, Artificial Sequence
  Synthetic Polynucleotide
taatacgactcactataggggacgtgcgcggcttcttcttcttggggggcaacagaggagagcccccatggaagaagaaaacctggcggcagcgcaaaagatg

SEQ ID NO: 221957 - DNA, 103 bp, Artificial Sequence
  Synthetic Polynucleotide
taatacgactcactataggggcgtgtgaaggacgtgcgcggcttcttcttaacagaggagaaagaagatgccgcgcacgaacctggcggcagcgcaaaagatg

SEQ ID NO: 221958 - DNA, 103 bp, Artificial Sequence
  Synthetic Polynucleotide
taatacgactcactatagggagatctgcaggcgtgtgaaggacgtgcgcgaacagaggagacgcgcaatgccttcacacaacctggcggcagcgcaaaagatg

SEQ ID NO: 221959 - DNA, 103 bp, Artificial Sequence
  Synthetic Polynucleotide
taatacgactcactatagggtccagctcgcagatctgcaggcgtgtgaagaacagaggagacttcacatgcctgcagataacctggcggcagcgcaaaagatg

SEQ ID NO: 221960 - DNA, 103 bp, Artificial Sequence
  Synthetic Polynucleotide
taatacgactcactataggggaagcgcttctccagctcgcagatctgcagaacagaggagactgcagatgtgcgagctgaacctggcggcagcgcaaaagatg

SEQ ID NO: 221961 - DNA, 103 bp, Artificial Sequence
  Synthetic Polynucleotide
taatacgactcactatagggtctggcggtggaagcgcttctccagctcgcaacagaggagagcgagcatgagaagcgctaacctggcggcagcgcaaaagatg

SEQ ID NO: 221962 - DNA, 103 bp, Artificial Sequence
  Synthetic Polynucleotide
taatacgactcactataggggccaggtacttctggcggtggaagcgcttcaacagaggagagaagcgatgccaccgccaaacctggcggcagcgcaaaagatg

SEQ ID NO: 221963 - DNA, 103 bp, Artificial Sequence
  Synthetic Polynucleotide
taatacgactcactatagggctcggccgaggccaggtacttctggcggtgaacagaggagacaccgcatgaagtacctgaacctggcggcagcgcaaaagatg

SEQ ID NO: 221964 - DNA, 103 bp, Artificial Sequence
  Synthetic Polynucleotide
taatacgactcactataggggggcggcgcgctcggccgaggccaggtactaacagaggagaagtaccatgcctcggccgaacctggcggcagcgcaaaagatg

SEQ ID NO: 221965 - DNA, 103 bp, Artificial Sequence
  Synthetic Polynucleotide
taatacgactcactataggggccttggccagggcggcgcgctcggccgagaacagaggagactcggcatggcgcgccgcaacctggcggcagcgcaaaagatg

SEQ ID NO: 221966 - DNA, 103 bp, Artificial Sequence
  Synthetic Polynucleotide
taatacgactcactatagggctggtccgggctgttgaggatctggtcgataacagaggagaatcgacatgatcctcaacaacctggcggcagcgcaaaagatg

SEQ ID NO: 221967 - DNA, 103 bp, Artificial Sequence
  Synthetic Polynucleotide
taatacgactcactatagggcattttgagcgccttggccagggcggcgcgaacagaggagacgcgccatgctggccaagaacctggcggcagcgcaaaagatg

SEQ ID NO: 221968 - DNA, 103 bp, Artificial Sequence
  Synthetic Polynucleotide
taatacgactcactataggggcgcatcggtcattttgagcgccttggccaaacagaggagatggccaatgcgctcaaaaaacctggcggcagcgcaaaagatg

SEQ ID NO: 221969 - DNA, 103 bp, Artificial Sequence
  Synthetic Polynucleotide
taatacgactcactataggggttttgacctgcgcatcggtcattttgagcaacagaggagagctcaaatggaccgatgcaacctggcggcagcgcaaaagatg

SEQ ID NO: 221970 - DNA, 103 bp, Artificial Sequence
  Synthetic Polynucleotide
taatacgactcactatagggctggaaccaggttttgacctgcgcatcggtaacagaggagaaccgatatgcaggtcaaaaacctggcggcagcgcaaaagatg

SEQ ID NO: 221971 - DNA, 103 bp, Artificial Sequence
  Synthetic Polynucleotide
taatacgactcactatagggtccgccggttctggaaccaggttttgacctaacagaggagaaggtcaatgcctggttccaacctggcggcagcgcaaaagatg

SEQ ID NO: 221972 - DNA, 103 bp, Artificial Sequence
  Synthetic Polynucleotide
taatacgactcactatagggctccactttgtccgccggttctggaaccagaacagaggagactggttatggaaccggcgaacctggcggcagcgcaaaagatg

SEQ ID NO: 221973 - DNA, 103 bp, Artificial Sequence
  Synthetic Polynucleotide
taatacgactcactatagggagtctgccgtctccactttgtccgccggttaacagaggagaaaccggatgacaaagtggaacctggcggcagcgcaaaagatg

SEQ ID NO: 221974 - DNA, 103 bp, Artificial Sequence
  Synthetic Polynucleotide
taatacgactcactataggggttcctccgcagtctgccgtctccactttgaacagaggagacaaagtatggacggcagaaacctggcggcagcgcaaaagatg

SEQ ID NO: 221975 - DNA, 103 bp, Artificial Sequence
  Synthetic Polynucleotide
taatacgactcactatagggtcggcctcccgttcctccgcagtctgccgtaacagaggagaacggcaatgtgcggaggaaacctggcggcagcgcaaaagatg

SEQ ID NO: 221976 - DNA, 103 bp, Artificial Sequence
  Synthetic Polynucleotide
taatacgactcactatagggttgctgcctctcggcctcccgttcctccgcaacagaggagagcggagatgcgggaggccaacctggcggcagcgcaaaagatg

SEQ ID NO: 221977 - DNA, 103 bp, Artificial Sequence
  Synthetic Polynucleotide
taatacgactcactatagggtgcagccaccctggtccgggctgttgaggaaacagaggagatcctcaatggcccggaccaacctggcggcagcgcaaaagatg

SEQ ID NO: 221978 - DNA, 103 bp, Artificial Sequence
  Synthetic Polynucleotide
taatacgactcactatagggtgcggttcgcttgctgcctctcggcctcccaacagaggagagggaggatgagaggcagcaacctggcggcagcgcaaaagatg

SEQ ID NO: 221979 - DNA, 103 bp, Artificial Sequence
  Synthetic Polynucleotide
taatacgactcactatagggtgcaggaggatgcggttcgcttgctgcctcaacagaggagagaggcaatgagcgaaccgaacctggcggcagcgcaaaagatg

SEQ ID NO: 221980 - DNA, 103 bp, Artificial Sequence
  Synthetic Polynucleotide
taatacgactcactatagggctgctgcaactgcaggaggatgcggttcgcaacagaggagagcgaacatgatcctcctgaacctggcggcagcgcaaaagatg

SEQ ID NO: 221981 - DNA, 103 bp, Artificial Sequence
  Synthetic Polynucleotide
taatacgactcactatagggggaaggcctcctgctgcaactgcaggaggaaacagaggagatcctccatgagttgcagcaacctggcggcagcgcaaaagatg

SEQ ID NO: 221982 - DNA, 103 bp, Artificial Sequence
  Synthetic Polynucleotide
taatacgactcactatagggaggctcttctggaaggcctcctgctgcaacaacagaggagagttgcaatgggaggccttaacctggcggcagcgcaaaagatg

SEQ ID NO: 221983 - DNA, 103 bp, Artificial Sequence
  Synthetic Polynucleotide
taatacgactcactatagggcggctgtgccaggctcttctggaaggcctcaacagaggagagaggccatgcagaagagcaacctggcggcagcgcaaaagatg

SEQ ID NO: 221984 - DNA, 103 bp, Artificial Sequence
  Synthetic Polynucleotide
taatacgactcactatagggcagcgggcagcggctgtgccaggctcttctaacagaggagaagaagaatgtggcacagcaacctggcggcagcgcaaaagatg

SEQ ID NO: 221985 - DNA, 103 bp, Artificial Sequence
  Synthetic Polynucleotide
taatacgactcactatagggcacagagggtcagcgggcagcggctgtgccaacagaggagaggcacaatggctgcccgcaacctggcggcagcgcaaaagatg

SEQ ID NO: 221986 - DNA, 103 bp, Artificial Sequence
  Synthetic Polynucleotide
taatacgactcactataggggttgtgcacgcacagagggtcagcgggcagaacagaggagactgcccatggaccctctgaacctggcggcagcgcaaaagatg

SEQ ID NO: 221987 - DNA, 103 bp, Artificial Sequence
  Synthetic Polynucleotide
taatacgactcactatagggagagcgacgagttgtgcacgcacagagggtaacagaggagaaccctcatggcgtgcacaaacctggcggcagcgcaaaagatg

SEQ ID NO: 221988 - DNA, 103 bp, Artificial Sequence
  Synthetic Polynucleotide
taatacgactcactataggggcgggtcccatgcagccaccctggtccgggaacagaggagacccggaatggggtggctgaacctggcggcagcgcaaaagatg

SEQ ID NO: 221989 - DNA, 103 bp, Artificial Sequence
  Synthetic Polynucleotide
taatacgactcactatagggtgcagggcgaagagcgacgagttgtgcacgaacagaggagacgtgcaatgctcgtcgctaacctggcggcagcgcaaaagatg

SEQ ID NO: 221990 - DNA, 103 bp, Artificial Sequence
  Synthetic Polynucleotide
taatacgactcactatagggctgcagattctgcagggcgaagagcgacgaaacagaggagatcgtcgatgttcgccctgaacctggcggcagcgcaaaagatg

SEQ ID NO: 221991 - DNA, 103 bp, Artificial Sequence
  Synthetic Polynucleotide
taatacgactcactatagggcagaccacggctgcagattctgcagggcgaaacagaggagatcgcccatgagaatctgcaacctggcggcagcgcaaaagatg

SEQ ID NO: 221992 - DNA, 103 bp, Artificial Sequence
  Synthetic Polynucleotide
taatacgactcactataggggtcgagtcgtcagaccacggctgcagattcaacagaggagagaatctatggccgtggtcaacctggcggcagcgcaaaagatg

SEQ ID NO: 221993 - DNA, 103 bp, Artificial Sequence
  Synthetic Polynucleotide
taatacgactcactatagggagtgattttggtcgagtcgtcagaccacggaacagaggagaccgtggatggacgactcgaacctggcggcagcgcaaaagatg

SEQ ID NO: 221994 - DNA, 103 bp, Artificial Sequence
  Synthetic Polynucleotide
taatacgactcactatagggacgtgacgctagtgattttggtcgagtcgtaacagaggagaacgactatgccaaaatcaaacctggcggcagcgcaaaagatg

SEQ ID NO: 221995 - DNA, 103 bp, Artificial Sequence
  Synthetic Polynucleotide
taatacgactcactataggggacgccaccgacgtgacgctagtgattttgaacagaggagacaaaatatgtagcgtcacaacctggcggcagcgcaaaagatg

SEQ ID NO: 221996 - DNA, 103 bp, Artificial Sequence
  Synthetic Polynucleotide
taatacgactcactatagggctcgcaggccgacgccaccgacgtgacgctaacagaggagaagcgtcatgtcggtggcgaacctggcggcagcgcaaaagatg

SEQ ID NO: 221997 - DNA, 103 bp, Artificial Sequence
  Synthetic Polynucleotide
taatacgactcactatagggcacgtcccggatcatgctttcagtgctcataacagaggagaatgagcatggaaagcatgaacctggcggcagcgcaaaagatg

SEQ ID NO: 221998 - DNA, 103 bp, Artificial Sequence
  Synthetic Polynucleotide
taatacgactcactataggggatcaggaaggagaagaggctgaggaacaaaacagaggagattgttcatgagcctcttcaacctggcggcagcgcaaaagatg

SEQ ID NO: 221999 - DNA, 103 bp, Artificial Sequence
  Synthetic Polynucleotide
taatacgactcactatagggcgcctgccacgatcaggaaggagaagaggcaacagaggagagcctctatgccttcctgaaacctggcggcagcgcaaaagatg

SEQ ID NO: 222000 - DNA, 103 bp, Artificial Sequence
  Synthetic Polynucleotide
taatacgactcactatagggagcgtggtggcgcctgccacgatcaggaagaacagaggagacttcctatgcgtggcaggaacctggcggcagcgcaaaagatg

SEQ ID NO: 222001 - DNA, 103 bp, Artificial Sequence
  Synthetic Polynucleotide
taatacgactcactatagggcaggcagaagagcgtggtggcgcctgccacaacagaggagagtggcaatggccaccacgaacctggcggcagcgcaaaagatg

SEQ ID NO: 222002 - DNA, 103 bp, Artificial Sequence
  Synthetic Polynucleotide
taatacgactcactatagggcaaagtgcagcaggcagaagagcgtggtggaacagaggagaccaccaatgtcttctgccaacctggcggcagcgcaaaagatg

SEQ ID NO: 222003 - DNA, 103 bp, Artificial Sequence
  Synthetic Polynucleotide
taatacgactcactatagggccgatcactccaaagtgcagcaggcagaagaacagaggagacttctgatggctgcacttaacctggcggcagcgcaaaagatg

SEQ ID NO: 222004 - DNA, 103 bp, Artificial Sequence
  Synthetic Polynucleotide
taatacgactcactatagggcctctgggggccgatcactccaaagtgcagaacagaggagactgcacatgggagtgatcaacctggcggcagcgcaaaagatg

SEQ ID NO: 222005 - DNA, 103 bp, Artificial Sequence
  Synthetic Polynucleotide
taatacgactcactatagggggaactcttccctctgggggccgatcactcaacagaggagagagtgaatggcccccagaaacctggcggcagcgcaaaagatg

SEQ ID NO: 222006 - DNA, 103 bp, Artificial Sequence
  Synthetic Polynucleotide
taatacgactcactatagggaggtccctggggaactcttccctctgggggaacagaggagacccccaatgggaagagttaacctggcggcagcgcaaaagatg

SEQ ID NO: 222007 - DNA, 103 bp, Artificial Sequence
  Synthetic Polynucleotide
taatacgactcactataggggattagagagaggtccctggggaactcttcaacagaggagagaagagatgcccagggacaacctggcggcagcgcaaaagatg

SEQ ID NO: 222008 - DNA, 103 bp, Artificial Sequence
  Synthetic Polynucleotide
taatacgactcactatagggcggccagctccacgtcccggatcatgctttaacagaggagaaaagcaatgtccgggacgaacctggcggcagcgcaaaagatg

SEQ ID NO: 222009 - DNA, 103 bp, Artificial Sequence
  Synthetic Polynucleotide
taatacgactcactatagggccagagggctgattagagagaggtccctggaacagaggagaccagggatgtctctctaaaacctggcggcagcgcaaaagatg

SEQ ID NO: 222010 - DNA, 103 bp, Artificial Sequence
  Synthetic Polynucleotide
taatacgactcactatagggactgcctgggccagagggctgattagagagaacagaggagactctctatgcagccctctaacctggcggcagcgcaaaagatg

SEQ ID NO: 222011 - DNA, 103 bp, Artificial Sequence
  Synthetic Polynucleotide
taatacgactcactatagggagatgatctgactgcctgggccagagggctaacagaggagaagccctatggcccaggcaaacctggcggcagcgcaaaagatg

SEQ ID NO: 222012 - DNA, 103 bp, Artificial Sequence
  Synthetic Polynucleotide
taatacgactcactataggggggttcgagaagatgatctgactgcctgggaacagaggagacccaggatgtcagatcataacctggcggcagcgcaaaagatg

SEQ ID NO: 222013 - DNA, 103 bp, Artificial Sequence
  Synthetic Polynucleotide
taatacgactcactatagggttgtcactcggggttcgagaagatgatctgaacagaggagacagatcatgttctcgaacaacctggcggcagcgcaaaagatg

SEQ ID NO: 222014 - DNA, 103 bp, Artificial Sequence
  Synthetic Polynucleotide
taatacgactcactatagggggctacaggcttgtcactcggggttcgagaaacagaggagatctcgaatgccgagtgacaacctggcggcagcgcaaaagatg

SEQ ID NO: 222015 - DNA, 103 bp, Artificial Sequence
  Synthetic Polynucleotide
taatacgactcactatagggctacaacatgggctacaggcttgtcactcgaacagaggagacgagtgatgagcctgtagaacctggcggcagcgcaaaagatg

SEQ ID NO: 222016 - DNA, 103 bp, Artificial Sequence
  Synthetic Polynucleotide
taatacgactcactatagggtgagggtttgctacaacatgggctacaggcaacagaggagagcctgtatgccatgttgtaacctggcggcagcgcaaaagatg

SEQ ID NO: 222017 - DNA, 103 bp, Artificial Sequence
  Synthetic Polynucleotide
taatacgactcactatagggcccctcagcttgagggtttgctacaacatgaacagaggagacatgttatggcaaaccctaacctggcggcagcgcaaaagatg

SEQ ID NO: 222018 - DNA, 103 bp, Artificial Sequence
  Synthetic Polynucleotide
taatacgactcactatagggactggagctgcccctcagcttgagggtttgaacagaggagacaaaccatgaagctgaggaacctggcggcagcgcaaaagatg

SEQ ID NO: 222019 - DNA, 103 bp, Artificial Sequence
  Synthetic Polynucleotide
taatacgactcactatagggagcgcctcctcggccagctccacgtcccggaacagaggagaccgggaatgggagctggcaacctggcggcagcgcaaaagatg

SEQ ID NO: 222020 - DNA, 103 bp, Artificial Sequence
  Synthetic Polynucleotide
taatacgactcactatagggcggttcagccactggagctgcccctcagctaacagaggagaagctgaatggcagctccaaacctggcggcagcgcaaaagatg

SEQ ID NO: 222021 - DNA, 103 bp, Artificial Sequence
  Synthetic Polynucleotide
taatacgactcactatagggattggcccggcggttcagccactggagctgaacagaggagacagctcatgtggctgaacaacctggcggcagcgcaaaagatg

SEQ ID NO: 222022 - DNA, 103 bp, Artificial Sequence
  Synthetic Polynucleotide
taatacgactcactatagggccaggagggcattggcccggcggttcagccaacagaggagaggctgaatggccgggccaaacctggcggcagcgcaaaagatg

SEQ ID NO: 222023 - DNA, 103 bp, Artificial Sequence
  Synthetic Polynucleotide
taatacgactcactatagggacgccattggccaggagggcattggcccggaacagaggagaccgggcatgtgccctcctaacctggcggcagcgcaaaagatg

SEQ ID NO: 222024 - DNA, 103 bp, Artificial Sequence
  Synthetic Polynucleotide
taatacgactcactatagggtctcagctccacgccattggccaggagggcaacagaggagagccctcatggccaatggcaacctggcggcagcgcaaaagatg

SEQ ID NO: 222025 - DNA, 103 bp, Artificial Sequence
  Synthetic Polynucleotide
taatacgactcactataggggctggttatctctcagctccacgccattggaacagaggagaccaatgatgtggagctgaaacctggcggcagcgcaaaagatg

SEQ ID NO: 222026 - DNA, 103 bp, Artificial Sequence
  Synthetic Polynucleotide
taatacgactcactatagggggcaccaccagctggttatctctcagctccaacagaggagaggagctatgagataaccaaacctggcggcagcgcaaaagatg

SEQ ID NO: 222027 - DNA, 103 bp, Artificial Sequence
  Synthetic Polynucleotide
taatacgactcactataggggccctctgatggcaccaccagctggttatcaacagaggagagataacatgctggtggtgaacctggcggcagcgcaaaagatg

SEQ ID NO: 222028 - DNA, 103 bp, Artificial Sequence
  Synthetic Polynucleotide
taatacgactcactatagggtgaggtacaggccctctgatggcaccaccaaacagaggagatggtggatgcatcagaggaacctggcggcagcgcaaaagatg

SEQ ID NO: 222029 - DNA, 103 bp, Artificial Sequence
  Synthetic Polynucleotide
taatacgactcactatagggtgggagtagatgaggtacaggccctctgataacagaggagaatcagaatgcctgtacctaacctggcggcagcgcaaaagatg

SEQ ID NO: 222030 - DNA, 103 bp, Artificial Sequence
  Synthetic Polynucleotide
taatacgactcactatagggcttcttggggagcgcctcctcggccagctcaacagaggagagagctgatggaggaggcgaacctggcggcagcgcaaaagatg

SEQ ID NO: 222031 - DNA, 103 bp, Artificial Sequence
  Synthetic Polynucleotide
taatacgactcactataggggaagaggacctgggagtagatgaggtacagaacagaggagactgtacatgatctactccaacctggcggcagcgcaaaagatg

SEQ ID NO: 222032 - DNA, 103 bp, Artificial Sequence
  Synthetic Polynucleotide
taatacgactcactatagggcttggcccttgaagaggacctgggagtagaaacagaggagatctactatgaggtcctctaacctggcggcagcgcaaaagatg

SEQ ID NO: 222033 - DNA, 103 bp, Artificial Sequence
  Synthetic Polynucleotide
taatacgactcactataggggaggggcagccttggcccttgaagaggaccaacagaggagaggtcctatgcaagggccaaacctggcggcagcgcaaaagatg

SEQ ID NO: 222034 - DNA, 103 bp, Artificial Sequence
  Synthetic Polynucleotide
taatacgactcactatagggcacatgggtggaggggcagccttggcccttaacagaggagaaagggcatgggctgccccaacctggcggcagcgcaaaagatg

SEQ ID NO: 222035 - DNA, 103 bp, Artificial Sequence
  Synthetic Polynucleotide
taatacgactcactataggggggtgaggagcacatgggtggaggggcagcaacagaggagagctgccatgccacccatgaacctggcggcagcgcaaaagatg

SEQ ID NO: 222036 - DNA, 103 bp, Artificial Sequence
  Synthetic Polynucleotide
taatacgactcactatagggctgatggtgtgggtgaggagcacatgggtgaacagaggagacacccaatggctcctcacaacctggcggcagcgcaaaagatg

SEQ ID NO: 222037 - DNA, 103 bp, Artificial Sequence
  Synthetic Polynucleotide
taatacgactcactatagggggcgatgcggctgatggtgtgggtgaggagaacagaggagactcctcatgcacaccatcaacctggcggcagcgcaaaagatg

SEQ ID NO: 222038 - DNA, 103 bp, Artificial Sequence
  Synthetic Polynucleotide
taatacgactcactatagggggtaggagacggcgatgcggctgatggtgtaacagaggagaacaccaatggccgcatcgaacctggcggcagcgcaaaagatg

SEQ ID NO: 222039 - DNA, 103 bp, Artificial Sequence
  Synthetic Polynucleotide
taatacgactcactatagggaccttggtctggtaggagacggcgatgcggaacagaggagaccgcatatgcgtctcctaaacctggcggcagcgcaaaagatg

SEQ ID NO: 222040 - DNA, 103 bp, Artificial Sequence
  Synthetic Polynucleotide
taatacgactcactataggggaggaggttgaccttggtctggtaggagacaacagaggagagtctccatgcagaccaagaacctggcggcagcgcaaaagatg

SEQ ID NO: 222041 - DNA, 103 bp, Artificial Sequence
  Synthetic Polynucleotide
taatacgactcactataggggcccccctgtcttcttggggagcgcctcctaacagaggagaaggaggatgtccccaagaaacctggcggcagcgcaaaagatg

SEQ ID NO: 222042 - DNA, 103 bp, Artificial Sequence
  Synthetic Polynucleotide
taatacgactcactatagggtgatggcagagaggaggttgaccttggtctaacagaggagaagaccaatgtcaacctccaacctggcggcagcgcaaaagatg

SEQ ID NO: 222043 - DNA, 103 bp, Artificial Sequence
  Synthetic Polynucleotide
taatacgactcactatagggcaggggctcttgatggcagagaggaggttgaacagaggagacaacctatgctctgccataacctggcggcagcgcaaaagatg

SEQ ID NO: 222044 - DNA, 103 bp, Artificial Sequence
  Synthetic Polynucleotide
taatacgactcactatagggctccctctggcaggggctcttgatggcagaaacagaggagatctgccatgaagagccccaacctggcggcagcgcaaaagatg

SEQ ID NO: 222045 - DNA, 103 bp, Artificial Sequence
  Synthetic Polynucleotide
taatacgactcactatagggcctctggggtctccctctggcaggggctctaacagaggagaagagccatggccagagggaacctggcggcagcgcaaaagatg

SEQ ID NO: 222046 - DNA, 103 bp, Artificial Sequence
  Synthetic Polynucleotide
taatacgactcactataggggcctcagccccctctggggtctccctctggaacagaggagaccagagatggaccccagaaacctggcggcagcgcaaaagatg

SEQ ID NO: 222047 - DNA, 103 bp, Artificial Sequence
  Synthetic Polynucleotide
taatacgactcactatagggccagggcttggcctcagccccctctggggtaacagaggagaaccccaatgggggctgagaacctggcggcagcgcaaaagatg

SEQ ID NO: 222048 - DNA, 103 bp, Artificial Sequence
  Synthetic Polynucleotide
taatacgactcactatagggtgggctcataccagggcttggcctcagcccaacagaggagagggctgatgccaagccctaacctggcggcagcgcaaaagatg

SEQ ID NO: 222049 - DNA, 103 bp, Artificial Sequence
  Synthetic Polynucleotide
taatacgactcactatagggcccagatagatgggctcataccagggcttgaacagaggagacaagccatggtatgagccaacctggcggcagcgcaaaagatg

SEQ ID NO: 222050 - DNA, 103 bp, Artificial Sequence
  Synthetic Polynucleotide
taatacgactcactataggggaagacccctcccagatagatgggctcataaacagaggagatatgagatgatctatctgaacctggcggcagcgcaaaagatg

SEQ ID NO: 222051 - DNA, 103 bp, Artificial Sequence
  Synthetic Polynucleotide
taatacgactcactatagggtctccagctggaagacccctcccagatagaaacagaggagatctatcatggaggggtctaacctggcggcagcgcaaaagatg

SEQ ID NO: 222052 - DNA, 103 bp, Artificial Sequence
  Synthetic Polynucleotide
taatacgactcactataggggagccctggggcccccctgtcttcttggggaacagaggagaccccaaatggacagggggaacctggcggcagcgcaaaagatg

SEQ ID NO: 222053 - DNA, 103 bp, Artificial Sequence
  Synthetic Polynucleotide
taatacgactcactatagggcggtcacccttctccagctggaagacccctaacagaggagaaggggtatgccagctggaaacctggcggcagcgcaaaagatg

SEQ ID NO: 222054 - DNA, 103 bp, Artificial Sequence
  Synthetic Polynucleotide
taatacgactcactatagggagcgctgagtcggtcacccttctccagctgaacagaggagacagctgatgaagggtgacaacctggcggcagcgcaaaagatg

SEQ ID NO: 222055 - DNA, 103 bp, Artificial Sequence
  Synthetic Polynucleotide
taatacgactcactataggggattgatctcagcgctgagtcggtcaccctaacagaggagaagggtgatggactcagcgaacctggcggcagcgcaaaagatg

SEQ ID NO: 222056 - DNA, 103 bp, Artificial Sequence
  Synthetic Polynucleotide
taatacgactcactatagggtagtcgggccgattgatctcagcgctgagtaacagaggagaactcagatgtgagatcaaaacctggcggcagcgcaaaagatg

SEQ ID NO: 222057 - DNA, 103 bp, Artificial Sequence
  Synthetic Polynucleotide
taatacgactcactatagggaaagtcgagatagtcgggccgattgatctcaacagaggagagagatcatgcggcccgacaacctggcggcagcgcaaaagatg

SEQ ID NO: 222058 - DNA, 103 bp, Artificial Sequence
  Synthetic Polynucleotide
taatacgactcactatagggcagactcggcaaagtcgagatagtcgggccaacagaggagaggcccgatgatctcgactaacctggcggcagcgcaaaagatg

SEQ ID NO: 222059 - DNA, 103 bp, Artificial Sequence
  Synthetic Polynucleotide
taatacgactcactatagggtagacctgcccagactcggcaaagtcgagaaacagaggagatctcgaatgtgccgagtcaacctggcggcagcgcaaaagatg

SEQ ID NO: 222060 - DNA, 103 bp, Artificial Sequence
  Synthetic Polynucleotide
taatacgactcactataggggatcccaaagtagacctgcccagactcggcaacagaggagagccgagatggggcaggtcaacctggcggcagcgcaaaagatg

SEQ ID NO: 222061 - DNA, 103 bp, Artificial Sequence
  Synthetic Polynucleotide
taatacgactcactatagggacagggcaatgatcccaaagtagacctgccaacagaggagaggcaggatgactttgggaaacctggcggcagcgcaaaagatg

SEQ ID NO: 222062 - DNA, 103 bp, Artificial Sequence
  Synthetic Polynucleotide
taatacgactcactataggggcaccgcctggagccctggggcccccctgtaacagaggagaacagggatgccccagggcaacctggcggcagcgcaaaagatg

SEQ ID NO: 222063 - DNA, 103 bp, Artificial Sequence
  Synthetic Polynucleotide
taatacgactcactatagggtgaggaacaagcaccgcctggagccctgggaacagaggagacccaggatgccaggcggtaacctggcggcagcgcaaaagatg

SEQ ID NO: 222064 - DNA, 103 bp, Artificial Sequence
  Synthetic Polynucleotide
taatacgactcactataggggagaagaggctgaggaacaagcaccgcctgaacagaggagacaggcgatgcttgttcctaacctggcggcagcgcaaaagatg

SEQ ID NO: 222065 - DNA, 103 bp, Artificial Sequence
  Synthetic Polynucleotide
taatacgactcactatagggggaatcgttgtggaggtggtccccactcataacagaggagaatgagtatggaccacctcaacctggcggcagcgcaaaagatg

SEQ ID NO: 222066 - DNA, 103 bp, Artificial Sequence
  Synthetic Polynucleotide
taatacgactcactatagggcttcttgtgttctttgtgccggtgttctcgaacagaggagacgagaaatgcggcacaaaaacctggcggcagcgcaaaagatg

SEQ ID NO: 222067 - DNA, 103 bp, Artificial Sequence
  Synthetic Polynucleotide
taatacgactcactataggggaatccatattctttcagtaatttttcattaacagaggagaaatgaaatgttactgaaaaacctggcggcagcgcaaaagatg

SEQ ID NO: 222068 - DNA, 103 bp, Artificial Sequence
  Synthetic Polynucleotide
taatacgactcactatagggccataatacagaatccatattctttcagtaaacagaggagatactgaatgaatatggataacctggcggcagcgcaaaagatg

SEQ ID NO: 222069 - DNA, 103 bp, Artificial Sequence
  Synthetic Polynucleotide
taatacgactcactatagggttgtggttatccataatacagaatccatataacagaggagaatatggatgctgtattataacctggcggcagcgcaaaagatg

SEQ ID NO: 222070 - DNA, 103 bp, Artificial Sequence
  Synthetic Polynucleotide
taatacgactcactatagggaatcctctctttgtggttatccataatacaaacagaggagatgtattatggataaccacaacctggcggcagcgcaaaagatg

SEQ ID NO: 222071 - DNA, 103 bp, Artificial Sequence
  Synthetic Polynucleotide
taatacgactcactatagggtgaagttagcaatcctctctttgtggttataacagaggagaataaccatgaagagaggaaacctggcggcagcgcaaaagatg

SEQ ID NO: 222072 - DNA, 103 bp, Artificial Sequence
  Synthetic Polynucleotide
taatacgactcactatagggggctctatcttgaagttagcaatcctctctaacagaggagaagagagatgtgctaacttaacctggcggcagcgcaaaagatg

SEQ ID NO: 222073 - DNA, 103 bp, Artificial Sequence
  Synthetic Polynucleotide
taatacgactcactatagggaagtccaggaggctctatcttgaagttagcaacagaggagagctaacatgaagatagagaacctggcggcagcgcaaaagatg

SEQ ID NO: 222074 - DNA, 103 bp, Artificial Sequence
  Synthetic Polynucleotide
taatacgactcactatagggggccacggaaaagtccaggaggctctatctaacagaggagaagatagatgctcctggacaacctggcggcagcgcaaaagatg

SEQ ID NO: 222075 - DNA, 103 bp, Artificial Sequence
  Synthetic Polynucleotide
taatacgactcactatagggtggttgccgcggccacggaaaagtccaggaaacagaggagatcctggatgtttccgtggaacctggcggcagcgcaaaagatg

SEQ ID NO: 222076 - DNA, 103 bp, Artificial Sequence
  Synthetic Polynucleotide
taatacgactcactatagggcatcttggggtggttgccgcggccacggaaaacagaggagattccgtatgcgcggcaacaacctggcggcagcgcaaaagatg

SEQ ID NO: 222077 - DNA, 103 bp, Artificial Sequence
  Synthetic Polynucleotide
taatacgactcactatagggggtccttctccttcttgtgttctttgtgccaacagaggagaggcacaatgaacacaagaaacctggcggcagcgcaaaagatg

SEQ ID NO: 222078 - DNA, 103 bp, Artificial Sequence
  Synthetic Polynucleotide
taatacgactcactatagggtcagcatgcccatcttggggtggttgccgcaacagaggagagcggcaatgaccccaagaaacctggcggcagcgcaaaagatg

SEQ ID NO: 222079 - DNA, 103 bp, Artificial Sequence
  Synthetic Polynucleotide
taatacgactcactatagggattcgtctcttcagcatgcccatcttggggaacagaggagaccccaaatggggcatgctaacctggcggcagcgcaaaagatg

SEQ ID NO: 222080 - DNA, 103 bp, Artificial Sequence
  Synthetic Polynucleotide
taatacgactcactatagggctcgggcatgattcgtctcttcagcatgccaacagaggagaggcatgatgaagagacgaaacctggcggcagcgcaaaagatg

SEQ ID NO: 222081 - DNA, 103 bp, Artificial Sequence
  Synthetic Polynucleotide
taatacgactcactatagggtgattatatcctcgggcatgattcgtctctaacagaggagaagagacatgtcatgcccgaacctggcggcagcgcaaaagatg

SEQ ID NO: 222082 - DNA, 103 bp, Artificial Sequence
  Synthetic Polynucleotide
taatacgactcactatagggctacagttgatgattatatcctcgggcatgaacagaggagacatgccatgggatataataacctggcggcagcgcaaaagatg

SEQ ID NO: 222083 - DNA, 103 bp, Artificial Sequence
  Synthetic Polynucleotide
taatacgactcactatagggggcatctttgctacagttgatgattatatcaacagaggagagatataatgatcaactgtaacctggcggcagcgcaaaagatg

SEQ ID NO: 222084 - DNA, 103 bp, Artificial Sequence
  Synthetic Polynucleotide
taatacgactcactatagggaaggaaccttggcatctttgctacagttgaaacagaggagatcaactatggcaaagatgaacctggcggcagcgcaaaagatg

SEQ ID NO: 222085 - DNA, 103 bp, Artificial Sequence
  Synthetic Polynucleotide
taatacgactcactatagggggaggaggagaaggaaccttggcatctttgaacagaggagacaaagaatgcaaggttccaacctggcggcagcgcaaaagatg

SEQ ID NO: 222086 - DNA, 103 bp, Artificial Sequence
  Synthetic Polynucleotide
taatacgactcactatagggcttatgtcctggaggaggagaaggaaccttaacagaggagaaaggttatgtctcctcctaacctggcggcagcgcaaaagatg

SEQ ID NO: 222087 - DNA, 103 bp, Artificial Sequence
  Synthetic Polynucleotide
taatacgactcactatagggcttctttccacttatgtcctggaggaggagaacagaggagactcctcatgcaggacataaacctggcggcagcgcaaaagatg

SEQ ID NO: 222088 - DNA, 103 bp, Artificial Sequence
  Synthetic Polynucleotide
taatacgactcactataggggacttttcccggtccttctccttcttgtgtaacagaggagaacacaaatgggagaaggaaacctggcggcagcgcaaaagatg

SEQ ID NO: 222089 - DNA, 103 bp, Artificial Sequence
  Synthetic Polynucleotide
taatacgactcactatagggtcatgccggacttctttccacttatgtcctaacagaggagaaggacaatggtggaaagaaacctggcggcagcgcaaaagatg

SEQ ID NO: 222090 - DNA, 103 bp, Artificial Sequence
  Synthetic Polynucleotide
taatacgactcactatagggaaccttgttatcatgccggacttctttccaaacagaggagatggaaaatggtccggcataacctggcggcagcgcaaaagatg

SEQ ID NO: 222091 - DNA, 103 bp, Artificial Sequence
  Synthetic Polynucleotide
taatacgactcactatagggccagccaagtaaccttgttatcatgccggaaacagaggagatccggcatgataacaaggaacctggcggcagcgcaaaagatg

SEQ ID NO: 222092 - DNA, 103 bp, Artificial Sequence
  Synthetic Polynucleotide
taatacgactcactataggggtccaggaaaccagccaagtaaccttgttaaacagaggagataacaaatgtacttggctaacctggcggcagcgcaaaagatg

SEQ ID NO: 222093 - DNA, 103 bp, Artificial Sequence
  Synthetic Polynucleotide
taatacgactcactataggggatgttctctgtccaggaaaccagccaagtaacagaggagaacttggatggtttcctggaacctggcggcagcgcaaaagatg

SEQ ID NO: 222094 - DNA, 103 bp, Artificial Sequence
  Synthetic Polynucleotide
taatacgactcactatagggtggaaccttggatgttctctgtccaggaaaaacagaggagatttcctatgcagagaacaaacctggcggcagcgcaaaagatg

SEQ ID NO: 222095 - DNA, 103 bp, Artificial Sequence
  Synthetic Polynucleotide
taatacgactcactatagggatgtatttaatggaaccttggatgttctctaacagaggagaagagaaatgccaaggttcaacctggcggcagcgcaaaagatg

SEQ ID NO: 222096 - DNA, 103 bp, Artificial Sequence
  Synthetic Polynucleotide
taatacgactcactataggggttaagcatgatgtatttaatggaaccttgaacagaggagacaaggtatgattaaatacaacctggcggcagcgcaaaagatg

SEQ ID NO: 222097 - DNA, 103 bp, Artificial Sequence
  Synthetic Polynucleotide
taatacgactcactataggggtgaactagggttaagcatgatgtatttaaaacagaggagattaaatatgtcatgcttaaacctggcggcagcgcaaaagatg

SEQ ID NO: 222098 - DNA, 103 bp, Artificial Sequence
  Synthetic Polynucleotide
taatacgactcactatagggcccttgattcgtgaactagggttaagcatgaacagaggagacatgctatgccctagttcaacctggcggcagcgcaaaagatg

SEQ ID NO: 222099 - DNA, 103 bp, Artificial Sequence
  Synthetic Polynucleotide
taatacgactcactataggggctatgcttggacttttcccggtccttctcaacagaggagagagaagatgcgggaaaagaacctggcggcagcgcaaaagatg

SEQ ID NO: 222100 - DNA, 103 bp, Artificial Sequence
  Synthetic Polynucleotide
taatacgactcactataggggtccttctcacccttgattcgtgaactaggaacagaggagacctagtatgcgaatcaagaacctggcggcagcgcaaaagatg

SEQ ID NO: 222101 - DNA, 103 bp, Artificial Sequence
  Synthetic Polynucleotide
taatacgactcactatagggatttctgccagtccttctcacccttgattcaacagaggagagaatcaatggtgagaaggaacctggcggcagcgcaaaagatg

SEQ ID NO: 222102 - DNA, 103 bp, Artificial Sequence
  Synthetic Polynucleotide
taatacgactcactataggggcagtctcgtatttctgccagtccttctcaaacagaggagatgagaaatgctggcagaaaacctggcggcagcgcaaaagatg

SEQ ID NO: 222103 - DNA, 103 bp, Artificial Sequence
  Synthetic Polynucleotide
taatacgactcactatagggcagccgccgagcagtctcgtatttctgccaaacagaggagatggcagatgtacgagactaacctggcggcagcgcaaaagatg

SEQ ID NO: 222104 - DNA, 103 bp, Artificial Sequence
  Synthetic Polynucleotide
taatacgactcactatagggcacattttttcagccgccgagcagtctcgtaacagaggagaacgagaatgctcggcggcaacctggcggcagcgcaaaagatg

SEQ ID NO: 222105 - DNA, 103 bp, Artificial Sequence
  Synthetic Polynucleotide
taatacgactcactatagggatcttgtccacacattttttcagccgccgaaacagaggagatcggcgatggaaaaaatgaacctggcggcagcgcaaaagatg

SEQ ID NO: 222106 - DNA, 103 bp, Artificial Sequence
  Synthetic Polynucleotide
taatacgactcactatagggctggttccggatcttgtccacacattttttaacagaggagaaaaaaaatggtggacaagaacctggcggcagcgcaaaagatg

SEQ ID NO: 222107 - DNA, 103 bp, Artificial Sequence
  Synthetic Polynucleotide
taatacgactcactatagggcttctcgatactggttccggatcttgtccaaacagaggagatggacaatgtccggaaccaacctggcggcagcgcaaaagatg

SEQ ID NO: 222108 - DNA, 103 bp, Artificial Sequence
  Synthetic Polynucleotide
taatacgactcactataggggacttccagtcttctcgatactggttccggaacagaggagaccggaaatggtatcgagaaacctggcggcagcgcaaaagatg

SEQ ID NO: 222109 - DNA, 103 bp, Artificial Sequence
  Synthetic Polynucleotide
taatacgactcactatagggcatctctttggacttccagtcttctcgataaacagaggagatatcgaatggactggaagaacctggcggcagcgcaaaagatg

SEQ ID NO: 222110 - DNA, 103 bp, Artificial Sequence
  Synthetic Polynucleotide
taatacgactcactataggggttcactgttgctatgcttggacttttcccaacagaggagagggaaaatgccaagcataaacctggcggcagcgcaaaagatg

SEQ ID NO: 222111 - DNA, 103 bp, Artificial Sequence
  Synthetic Polynucleotide
taatacgactcactataggggccggactttcatctctttggacttccagtaacagaggagaactggaatgccaaagagaaacctggcggcagcgcaaaagatg

SEQ ID NO: 222112 - DNA, 103 bp, Artificial Sequence
  Synthetic Polynucleotide
taatacgactcactatagggacagctctctgccggactttcatctctttgaacagaggagacaaagaatggaaagtccgaacctggcggcagcgcaaaagatg

SEQ ID NO: 222113 - DNA, 103 bp, Artificial Sequence
  Synthetic Polynucleotide
taatacgactcactataggggtacagggctacagctctctgccggactttaacagaggagaaaagtcatgcagagagctaacctggcggcagcgcaaaagatg

SEQ ID NO: 222114 - DNA, 103 bp, Artificial Sequence
  Synthetic Polynucleotide
taatacgactcactatagggtgtcgatgaagtacagggctacagctctctaacagaggagaagagagatgtagccctgtaacctggcggcagcgcaaaagatg

SEQ ID NO: 222115 - DNA, 103 bp, Artificial Sequence
  Synthetic Polynucleotide
taatacgactcactatagggagagcaagcttgtcgatgaagtacagggctaacagaggagaagccctatgcttcatcgaaacctggcggcagcgcaaaagatg

SEQ ID NO: 222116 - DNA, 103 bp, Artificial Sequence
  Synthetic Polynucleotide
taatacgactcactataggggcctgctctcagagcaagcttgtcgatgaaaacagaggagattcatcatgaagcttgctaacctggcggcagcgcaaaagatg

SEQ ID NO: 222117 - DNA, 103 bp, Artificial Sequence
  Synthetic Polynucleotide
taatacgactcactatagggccttttcattgcctgctctcagagcaagctaacagaggagaagcttgatgtgagagcagaacctggcggcagcgcaaaagatg

SEQ ID NO: 222118 - DNA, 103 bp, Artificial Sequence
  Synthetic Polynucleotide
taatacgactcactatagggtctccttcctccttttcattgcctgctctcaacagaggagagagagcatgcaatgaaaaaacctggcggcagcgcaaaagatg

SEQ ID NO: 222119 - DNA, 103 bp, Artificial Sequence
  Synthetic Polynucleotide
taatacgactcactataggggtccgctgtttctccttcctccttttcattaacagaggagaaatgaaatggaggaaggaaacctggcggcagcgcaaaagatg

SEQ ID NO: 222120 - DNA, 103 bp, Artificial Sequence
  Synthetic Polynucleotide
taatacgactcactatagggagcccacagtgtccgctgtttctccttcctaacagaggagaaggaagatgaaacagcggaacctggcggcagcgcaaaagatg

SEQ ID NO: 222121 - DNA, 103 bp, Artificial Sequence
  Synthetic Polynucleotide
taatacgactcactataggggaatctttatgttcactgttgctatgcttgaacagaggagacaagcaatgcaacagtgaaacctggcggcagcgcaaaagatg

SEQ ID NO: 222122 - DNA, 103 bp, Artificial Sequence
  Synthetic Polynucleotide
taatacgactcactatagggagtgagcagcagcccacagtgtccgctgttaacagaggagaaacagcatgcactgtgggaacctggcggcagcgcaaaagatg

SEQ ID NO: 222123 - DNA, 103 bp, Artificial Sequence
  Synthetic Polynucleotide
taatacgactcactatagggctccacacgaagtgagcagcagcccacagtaacagaggagaactgtgatgtgctgctcaaacctggcggcagcgcaaaagatg

SEQ ID NO: 222124 - DNA, 103 bp, Artificial Sequence
  Synthetic Polynucleotide
taatacgactcactataggggattgatgtgctccacacgaagtgagcagcaacagaggagagctgctatgttcgtgtggaacctggcggcagcgcaaaagatg

SEQ ID NO: 222125 - DNA, 103 bp, Artificial Sequence
  Synthetic Polynucleotide
taatacgactcactatagggtctgggtgtagattgatgtgctccacacgaaacagaggagatcgtgtatggcacatcaaaacctggcggcagcgcaaaagatg

SEQ ID NO: 222126 - DNA, 103 bp, Artificial Sequence
  Synthetic Polynucleotide
taatacgactcactatagggaccatccaactctgggtgtagattgatgtgaacagaggagacacatcatgctacacccaaacctggcggcagcgcaaaagatg

SEQ ID NO: 222127 - DNA, 103 bp, Artificial Sequence
  Synthetic Polynucleotide
taatacgactcactatagggcatattcctgaccatccaactctgggtgtaaacagaggagatacaccatgagttggatgaacctggcggcagcgcaaaagatg

SEQ ID NO: 222128 - DNA, 103 bp, Artificial Sequence
  Synthetic Polynucleotide
taatacgactcactatagggaactctaccacatattcctgaccatccaacaacagaggagagttggaatgtcaggaataaacctggcggcagcgcaaaagatg

SEQ ID NO: 222129 - DNA, 103 bp, Artificial Sequence
  Synthetic Polynucleotide
taatacgactcactataggggaggaagtcaaactctaccacatattcctgaacagaggagacaggaaatggtggtagagaacctggcggcagcgcaaaagatg

SEQ ID NO: 222130 - DNA, 103 bp, Artificial Sequence
  Synthetic Polynucleotide
taatacgactcactatagggagtccttcccgaggaagtcaaactctaccaaacagaggagatggtagatgttgacttccaacctggcggcagcgcaaaagatg

SEQ ID NO: 222131 - DNA, 103 bp, Artificial Sequence
  Synthetic Polynucleotide
taatacgactcactatagggtatctgatggagtccttcccgaggaagtcaaacagaggagatgacttatgcgggaaggaaacctggcggcagcgcaaaagatg

SEQ ID NO: 222132 - DNA, 103 bp, Artificial Sequence
  Synthetic Polynucleotide
taatacgactcactatagggtttcttttcagaatctttatgttcactgttaacagaggagaaacagtatgcataaagataacctggcggcagcgcaaaagatg

SEQ ID NO: 222133 - DNA, 103 bp, Artificial Sequence
  Synthetic Polynucleotide
taatacgactcactatagggcttgttatagtatctgatggagtccttcccaacagaggagagggaagatgtccatcagaaacctggcggcagcgcaaaagatg

SEQ ID NO: 222134 - DNA, 103 bp, Artificial Sequence
  Synthetic Polynucleotide
taatacgactcactatagggcaacagggaccttgttatagtatctgatggaacagaggagaccatcaatgactataacaaacctggcggcagcgcaaaagatg

SEQ ID NO: 222135 - DNA, 103 bp, Artificial Sequence
  Synthetic Polynucleotide
taatacgactcactatagggactcgtttctcaacagggaccttgttatagaacagaggagactataaatgggtccctgtaacctggcggcagcgcaaaagatg

SEQ ID NO: 222136 - DNA, 103 bp, Artificial Sequence
  Synthetic Polynucleotide
taatacgactcactataggggttcttaaaaactcgtttctcaacagggacaacagaggagagtccctatggagaaacgaaacctggcggcagcgcaaaagatg

SEQ ID NO: 222137 - DNA, 103 bp, Artificial Sequence
  Synthetic Polynucleotide
taatacgactcactatagggatagttgtaggttcttaaaaactcgtttctaacagaggagaagaaacatgtttttaagaaacctggcggcagcgcaaaagatg

SEQ ID NO: 222138 - DNA, 103 bp, Artificial Sequence
  Synthetic Polynucleotide
taatacgactcactatagggttctccataaatagttgtaggttcttaaaaaacagaggagattttaaatgcctacaactaacctggcggcagcgcaaaagatg

SEQ ID NO: 222139 - DNA, 103 bp, Artificial Sequence
  Synthetic Polynucleotide
taatacgactcactataggggggctgcttgttctccataaatagttgtagaacagaggagactacaaatgtttatggagaacctggcggcagcgcaaaagatg

SEQ ID NO: 222140 - DNA, 103 bp, Artificial Sequence
  Synthetic Polynucleotide
taatacgactcactataggggatcatcctcgggctgcttgttctccataaaacagaggagattatggatgacaagcagcaacctggcggcagcgcaaaagatg

SEQ ID NO: 222141 - DNA, 103 bp, Artificial Sequence
  Synthetic Polynucleotide
taatacgactcactatagggctatcaaaaagatcatcctcgggctgcttgaacagaggagacaagcaatgcgaggatgaaacctggcggcagcgcaaaagatg

SEQ ID NO: 222142 - DNA, 103 bp, Artificial Sequence
  Synthetic Polynucleotide
taatacgactcactatagggagtattgagtctatcaaaaagatcatcctcaacagaggagagaggatatgctttttgataacctggcggcagcgcaaaagatg

SEQ ID NO: 222143 - DNA, 103 bp, Artificial Sequence
  Synthetic Polynucleotide
taatacgactcactatagggtctctttgtgtttcttttcagaatctttataacagaggagaataaagatgctgaaaagaaacctggcggcagcgcaaaagatg

SEQ ID NO: 222144 - DNA, 103 bp, Artificial Sequence
  Synthetic Polynucleotide
taatacgactcactatagggtcagaataccagtattgagtctatcaaaaaaacagaggagatttttgatggactcaataaacctggcggcagcgcaaaagatg

SEQ ID NO: 222145 - DNA, 103 bp, Artificial Sequence
  Synthetic Polynucleotide
taatacgactcactatagggagatgcttattcagaataccagtattgagtaacagaggagaactcaaatgtggtattctaacctggcggcagcgcaaaagatg

SEQ ID NO: 222146 - DNA, 103 bp, Artificial Sequence
  Synthetic Polynucleotide
taatacgactcactataggggagatcctgaagatgcttattcagaataccaacagaggagaggtattatgaataagcataacctggcggcagcgcaaaagatg

SEQ ID NO: 222147 - DNA, 103 bp, Artificial Sequence
  Synthetic Polynucleotide
taatacgactcactatagggagccctccatgagatcctgaagatgcttataacagaggagaataagcatgttcaggatcaacctggcggcagcgcaaaagatg

SEQ ID NO: 222148 - DNA, 103 bp, Artificial Sequence
  Synthetic Polynucleotide
taatacgactcactatagggttggctgtcaagccctccatgagatcctgaaacagaggagatcaggaatgcatggagggaacctggcggcagcgcaaaagatg

SEQ ID NO: 222149 - DNA, 103 bp, Artificial Sequence
  Synthetic Polynucleotide
taatacgactcactatagggacggaataccttggctgtcaagccctccataacagaggagaatggagatgttgacagccaacctggcggcagcgcaaaagatg

SEQ ID NO: 222150 - DNA, 103 bp, Artificial Sequence
  Synthetic Polynucleotide
taatacgactcactatagggcattgtatgtacggaataccttggctgtcaaacagaggagatgacagatgaggtattccaacctggcggcagcgcaaaagatg

SEQ ID NO: 222151 - DNA, 103 bp, Artificial Sequence
  Synthetic Polynucleotide
taatacgactcactataggggtgatggaggcattgtatgtacggaataccaacagaggagaggtattatgtacatacaaaacctggcggcagcgcaaaagatg

SEQ ID NO: 222152 - DNA, 103 bp, Artificial Sequence
  Synthetic Polynucleotide
taatacgactcactatagggctgctgtagcgtgatggaggcattgtatgtaacagaggagaacatacatggcctccatcaacctggcggcagcgcaaaagatg

SEQ ID NO: 222153 - DNA, 103 bp, Artificial Sequence
  Synthetic Polynucleotide
taatacgactcactatagggcttttagctgctgctgtagcgtgatggaggaacagaggagacctccaatgcgctacagcaacctggcggcagcgcaaaagatg

SEQ ID NO: 222154 - DNA, 103 bp, Artificial Sequence
  Synthetic Polynucleotide
taatacgactcactataggggtcttctccttctctttgtgtttcttttcaaacagaggagatgaaaaatgacacaaagaaacctggcggcagcgcaaaagatg

SEQ ID NO: 222155 - DNA, 103 bp, Artificial Sequence
  Synthetic Polynucleotide
taatacgactcactataggggctgtcagttcttttagctgctgctgtagcaacagaggagagctacaatggcagctaaaaacctggcggcagcgcaaaagatg

SEQ ID NO: 222156 - DNA, 103 bp, Artificial Sequence
  Synthetic Polynucleotide
taatacgactcactatagggctcatccggggctgtcagttcttttagctgaacagaggagacagctaatggaactgacaaacctggcggcagcgcaaaagatg

SEQ ID NO: 222157 - DNA, 103 bp, Artificial Sequence
  Synthetic Polynucleotide
taatacgactcactatagggctgggatgttctcatccggggctgtcagttaacagaggagaaactgaatgccccggatgaacctggcggcagcgcaaaagatg

SEQ ID NO: 222158 - DNA, 103 bp, Artificial Sequence
  Synthetic Polynucleotide
taatacgactcactatagggaggatcttcgctgggatgttctcatccgggaacagaggagacccggaatggaacatcccaacctggcggcagcgcaaaagatg

SEQ ID NO: 222159 - DNA, 103 bp, Artificial Sequence
  Synthetic Polynucleotide
taatacgactcactataggggttataagaaaggatcttcgctgggatgttaacagaggagaaacatcatggcgaagatcaacctggcggcagcgcaaaagatg

SEQ ID NO: 222160 - DNA, 103 bp, Artificial Sequence
  Synthetic Polynucleotide
taatacgactcactataggggattggcacggttataagaaaggatcttcgaacagaggagacgaagaatgtttcttataaacctggcggcagcgcaaaagatg

SEQ ID NO: 222161 - DNA, 103 bp, Artificial Sequence
  Synthetic Polynucleotide
taatacgactcactataggggcaacagctcgattggcacggttataagaaaacagaggagattcttaatgccgtgccaaaacctggcggcagcgcaaaagatg

SEQ ID NO: 222162 - DNA, 103 bp, Artificial Sequence
  Synthetic Polynucleotide
taatacgactcactatagggacaaagaattgcaacagctcgattggcacgaacagaggagacgtgccatgcgagctgttaacctggcggcagcgcaaaagatg

SEQ ID NO: 222163 - DNA, 103 bp, Artificial Sequence
  Synthetic Polynucleotide
taatacgactcactatagggtctgatggttacaaagaattgcaacagctcaacagaggagagagctgatgcaattctttaacctggcggcagcgcaaaagatg

SEQ ID NO: 222164 - DNA, 103 bp, Artificial Sequence
  Synthetic Polynucleotide
taatacgactcactatagggggtggtgccctctgatggttacaaagaattaacagaggagaaattctatgtaaccatcaaacctggcggcagcgcaaaagatg

SEQ ID NO: 222165 - DNA, 103 bp, Artificial Sequence
  Synthetic Polynucleotide
taatacgactcactatagggtttgtgtttggtcttctccttctctttgtgaacagaggagacacaaaatgaaggagaagaacctggcggcagcgcaaaagatg

SEQ ID NO: 222166 - DNA, 103 bp, Artificial Sequence
  Synthetic Polynucleotide
taatacgactcactatagggaaaagtttttggtggtgccctctgatggttaacagaggagaaaccatatgagggcaccaaacctggcggcagcgcaaaagatg

SEQ ID NO: 222167 - DNA, 103 bp, Artificial Sequence
  Synthetic Polynucleotide
taatacgactcactatagggtagacttctcaaaagtttttggtggtgcccaacagaggagagggcacatgcaaaaacttaacctggcggcagcgcaaaagatg

SEQ ID NO: 222168 - DNA, 103 bp, Artificial Sequence
  Synthetic Polynucleotide
taatacgactcactatagggaagttcatcatagacttctcaaaagtttttaacagaggagaaaaaacatgtgagaagtcaacctggcggcagcgcaaaagatg

SEQ ID NO: 222169 - DNA, 103 bp, Artificial Sequence
  Synthetic Polynucleotide
taatacgactcactatagggcttagtttgcaagttcatcatagacttctcaacagaggagagagaagatgatgatgaacaacctggcggcagcgcaaaagatg

SEQ ID NO: 222170 - DNA, 103 bp, Artificial Sequence
  Synthetic Polynucleotide
taatacgactcactatagggtggcatcaatcttagtttgcaagttcatcaaacagaggagatgatgaatgtgcaaactaaacctggcggcagcgcaaaagatg

SEQ ID NO: 222171 - DNA, 103 bp, Artificial Sequence
  Synthetic Polynucleotide
taatacgactcactatagggtgttccttcttggcatcaatcttagtttgcaacagaggagagcaaacatggattgatgcaacctggcggcagcgcaaaagatg

SEQ ID NO: 222172 - DNA, 103 bp, Artificial Sequence
  Synthetic Polynucleotide
taatacgactcactatagggatctgctagctgttccttcttggcatcaataacagaggagaattgatatgaagaaggaaaacctggcggcagcgcaaaagatg

SEQ ID NO: 222173 - DNA, 103 bp, Artificial Sequence
  Synthetic Polynucleotide
taatacgactcactatagggctctccgggcatctgctagctgttccttctaacagaggagaagaaggatgagctagcagaacctggcggcagcgcaaaagatg

SEQ ID NO: 222174 - DNA, 103 bp, Artificial Sequence
  Synthetic Polynucleotide
taatacgactcactatagggcttttcaggtctctccgggcatctgctagcaacagaggagagctagcatgtgcccggagaacctggcggcagcgcaaaagatg

SEQ ID NO: 222175 - DNA, 103 bp, Artificial Sequence
  Synthetic Polynucleotide
taatacgactcactatagggagccttagcacttttcaggtctctccgggcaacagaggagagcccggatggacctgaaaaacctggcggcagcgcaaaagatg

SEQ ID NO: 222176 - DNA, 103 bp, Artificial Sequence
  Synthetic Polynucleotide
taatacgactcactatagggcttcgatctgggaatcgttgtggaggtggtaacagaggagaaccaccatgacaacgattaacctggcggcagcgcaaaagatg

SEQ ID NO: 222177 - DNA, 103 bp, Artificial Sequence
  Synthetic Polynucleotide
taatacgactcactatagggagcttccatctttgtgtttggtcttctcctaacagaggagaaggagaatgccaaacacaaacctggcggcagcgcaaaagatg

SEQ ID NO: 222178 - DNA, 103 bp, Artificial Sequence
  Synthetic Polynucleotide
taatacgactcactatagggccttggcatcagccttagcacttttcaggtaacagaggagaacctgaatggtgctaaggaacctggcggcagcgcaaaagatg

SEQ ID NO: 222179 - DNA, 103 bp, Artificial Sequence
  Synthetic Polynucleotide
taatacgactcactatagggtccttcatgaccttggcatcagccttagcaaacagaggagatgctaaatgtgatgccaaaacctggcggcagcgcaaaagatg

SEQ ID NO: 222180 - DNA, 103 bp, Artificial Sequence
  Synthetic Polynucleotide
taatacgactcactatagggcgtctttgcatccttcatgaccttggcatcaacagaggagagatgccatggtcatgaagaacctggcggcagcgcaaaagatg

SEQ ID NO: 222181 - DNA, 103 bp, Artificial Sequence
  Synthetic Polynucleotide
taatacgactcactatagggctaccttcttcgtctttgcatccttcatgaaacagaggagatcatgaatgatgcaaagaaacctggcggcagcgcaaaagatg

SEQ ID NO: 222182 - DNA, 103 bp, Artificial Sequence
  Synthetic Polynucleotide
taatacgactcactatagggtttgactctactaccttcttcgtctttgcaaacagaggagatgcaaaatggaagaaggtaacctggcggcagcgcaaaagatg

SEQ ID NO: 222183 - DNA, 103 bp, Artificial Sequence
  Synthetic Polynucleotide
taatacgactcactatagggagccttcttctttgactctactaccttcttaacagaggagaaagaagatggtagagtcaaacctggcggcagcgcaaaagatg

SEQ ID NO: 222184 - DNA, 103 bp, Artificial Sequence
  Synthetic Polynucleotide
taatacgactcactataggggtctctgaacagccttcttctttgactctaaacagaggagatagagtatgagaagaaggaacctggcggcagcgcaaaagatg

SEQ ID NO: 222185 - DNA, 103 bp, Artificial Sequence
  Synthetic Polynucleotide
taatacgactcactatagggtgttcctccagtctctgaacagccttcttcaacagaggagagaagaaatgtgttcagagaacctggcggcagcgcaaaagatg

SEQ ID NO: 222186 - DNA, 103 bp, Artificial Sequence
  Synthetic Polynucleotide
taatacgactcactatagggcttcatcaactgttcctccagtctctgaacaacagaggagagttcagatgctggaggaaaacctggcggcagcgcaaaagatg

SEQ ID NO: 222187 - DNA, 103 bp, Artificial Sequence
  Synthetic Polynucleotide
taatacgactcactataggggaacttccagcttcatcaactgttcctccaaacagaggagatggaggatgagttgatgaaacctggcggcagcgcaaaagatg

SEQ ID NO: 222188 - DNA, 103 bp, Artificial Sequence
  Synthetic Polynucleotide
taatacgactcactatagggtgcttttctgagcttccatctttgtgtttgaacagaggagacaaacaatgagatggaagaacctggcggcagcgcaaaagatg

SEQ ID NO: 222189 - DNA, 103 bp, Artificial Sequence
  Synthetic Polynucleotide
taatacgactcactatagggtctgtggcttgaacttccagcttcatcaacaacagaggagagttgatatggctggaagtaacctggcggcagcgcaaaagatg

SEQ ID NO: 222190 - DNA, 103 bp, Artificial Sequence
  Synthetic Polynucleotide
taatacgactcactatagggttcctctcggtctgtggcttgaacttccagaacagaggagactggaaatgcaagccacaaacctggcggcagcgcaaaagatg

SEQ ID NO: 222191 - DNA, 103 bp, Artificial Sequence
  Synthetic Polynucleotide
taatacgactcactatagggtctgtttattttcctctcggtctgtggcttaacagaggagaaagccaatgaccgagaggaacctggcggcagcgcaaaagatg

SEQ ID NO: 222192 - DNA, 103 bp, Artificial Sequence
  Synthetic Polynucleotide
taatacgactcactatagggcccagggcaatctgtttattttcctctcggaacagaggagaccgagaatgaaataaacaaacctggcggcagcgcaaaagatg

SEQ ID NO: 222193 - DNA, 103 bp, Artificial Sequence
  Synthetic Polynucleotide
taatacgactcactatagggtttggaggttcccagggcaatctgtttattaacagaggagaaataaaatgattgccctgaacctggcggcagcgcaaaagatg

SEQ ID NO: 222194 - DNA, 103 bp, Artificial Sequence
  Synthetic Polynucleotide
taatacgactcactataggggataattgagtttggaggttcccagggcaaaacagaggagattgcccatggaacctccaaacctggcggcagcgcaaaagatg

SEQ ID NO: 222195 - DNA, 103 bp, Artificial Sequence
  Synthetic Polynucleotide
taatacgactcactatagggctagggtccagataattgagtttggaggttaacagaggagaaacctcatgactcaattaaacctggcggcagcgcaaaagatg

SEQ ID NO: 222196 - DNA, 103 bp, Artificial Sequence
  Synthetic Polynucleotide
taatacgactcactatagggcactgtgatcctagggtccagataattgagaacagaggagactcaatatgctggaccctaacctggcggcagcgcaaaagatg

SEQ ID NO: 222197 - DNA, 103 bp, Artificial Sequence
  Synthetic Polynucleotide
taatacgactcactatagggtgcaccaagccactgtgatcctagggtccaaacagaggagatggaccatgggatcacagaacctggcggcagcgcaaaagatg

SEQ ID NO: 222198 - DNA, 103 bp, Artificial Sequence
  Synthetic Polynucleotide
taatacgactcactatagggccccacttcttgcaccaagccactgtgatcaacagaggagagatcacatgggcttggtgaacctggcggcagcgcaaaagatg

SEQ ID NO: 222199 - DNA, 103 bp, Artificial Sequence
  Synthetic Polynucleotide
taatacgactcactatagggtttgtctttatgcttttctgagcttccatcaacagaggagagatggaatgtcagaaaagaacctggcggcagcgcaaaagatg

SEQ ID NO: 222200 - DNA, 103 bp, Artificial Sequence
  Synthetic Polynucleotide
taatacgactcactatagggaattgggacaccccacttcttgcaccaagcaacagaggagagcttggatgaagaagtggaacctggcggcagcgcaaaagatg

SEQ ID NO: 222201 - DNA, 103 bp, Artificial Sequence
  Synthetic Polynucleotide
taatacgactcactatagggaaatcttctcaattgggacaccccacttctaacagaggagaagaagtatggtgtcccaaaacctggcggcagcgcaaaagatg

SEQ ID NO: 222202 - DNA, 103 bp, Artificial Sequence
  Synthetic Polynucleotide
taatacgactcactataggggttttgttgtaaatcttctcaattgggacaaacagaggagatgtcccatgtgagaagataacctggcggcagcgcaaaagatg

SEQ ID NO: 222203 - DNA, 103 bp, Artificial Sequence
  Synthetic Polynucleotide
taatacgactcactatagggctcccgctgggttttgttgtaaatcttctcaacagaggagagagaagatgtacaacaaaaacctggcggcagcgcaaaagatg

SEQ ID NO: 222204 - DNA, 103 bp, Artificial Sequence
  Synthetic Polynucleotide
taatacgactcactatagggaggcaaacttctcccgctgggttttgttgtaacagaggagaacaacaatgcccagcgggaacctggcggcagcgcaaaagatg

SEQ ID NO: 222205 - DNA, 103 bp, Artificial Sequence
  Synthetic Polynucleotide
taatacgactcactatagggtcaatggcccaggcaaacttctcccgctggaacagaggagaccagcgatggaagtttgcaacctggcggcagcgcaaaagatg

SEQ ID NO: 222206 - DNA, 103 bp, Artificial Sequence
  Synthetic Polynucleotide
taatacgactcactatagggatcagccatgtcaatggcccaggcaaacttaacagaggagaaagtttatgtgggccattaacctggcggcagcgcaaaagatg

SEQ ID NO: 222207 - DNA, 103 bp, Artificial Sequence
  Synthetic Polynucleotide
taatacgactcactatagggcatagtcttcatcagccatgtcaatggcccaacagaggagagggccaatgacatggctgaacctggcggcagcgcaaaagatg

SEQ ID NO: 222208 - DNA, 103 bp, Artificial Sequence
  Synthetic Polynucleotide
taatacgactcactatagggtgtctttatgtttgtctttatgcttttctgaacagaggagacagaaaatgataaagacaaacctggcggcagcgcaaaagatg

SEQ ID NO: 222209 - DNA, 103 bp, Artificial Sequence
  Synthetic Polynucleotide
taatacgactcactatagggtccttgtctctgtctttatgtttgtctttaaacagaggagataaagaatgacataaagaaacctggcggcagcgcaaaagatg

SEQ ID NO: 222210 - DNA, 103 bp, Artificial Sequence
  Synthetic Polynucleotide
taatacgactcactatagggttttcgtttttccttgtctctgtctttatgaacagaggagacataaaatgagagacaagaacctggcggcagcgcaaaagatg

SEQ ID NO: 222211 - DNA, 103 bp, Artificial Sequence
  Synthetic Polynucleotide
taatacgactcactatagggccttttcctcttttcgtttttccttgtctcaacagaggagagagacaatgaaaaacgaaaacctggcggcagcgcaaaagatg

SEQ ID NO: 222212 - DNA, 103 bp, Artificial Sequence
  Synthetic Polynucleotide
taatacgactcactataggggaggctcgaaccttttcctcttttcgttttaacagaggagaaaaacgatgagaggaaaaaacctggcggcagcgcaaaagatg

SEQ ID NO: 222213 - DNA, 103 bp, Artificial Sequence
  Synthetic Polynucleotide
taatacgactcactatagggtgcatccccagaggctcgaaccttttcctcaacagaggagagaggaaatggttcgagccaacctggcggcagcgcaaaagatg

SEQ ID NO: 222214 - DNA, 103 bp, Artificial Sequence
  Synthetic Polynucleotide
taatacgactcactatagggtctttatttttgcatccccagaggctcgaaaacagaggagattcgagatgctggggatgaacctggcggcagcgcaaaagatg

SEQ ID NO: 222215 - DNA, 103 bp, Artificial Sequence
  Synthetic Polynucleotide
taatacgactcactatagggcggaaatccgcttcgatctgggaatcgttgaacagaggagacaacgaatgccagatcgaaacctggcggcagcgcaaaagatg

SEQ ID NO: 222216 - DNA, 103 bp, Artificial Sequence
  Synthetic Polynucleotide
taatacgactcactatagggtccttctccttctttatttttgcatccccaaacagaggagatggggaatgaaaaataaaaacctggcggcagcgcaaaagatg

SEQ ID NO: 222217 - DNA, 103 bp, Artificial Sequence
  Synthetic Polynucleotide
taatacgactcactataggggaagccattttccttctccttctttattttaacagaggagaaaaataatgaaggagaagaacctggcggcagcgcaaaagatg

SEQ ID NO: 222218 - DNA, 103 bp, Artificial Sequence
  Synthetic Polynucleotide
taatacgactcactataggggtggactagagaagccattttccttctcctaacagaggagaaggagaatgaaaatggctaacctggcggcagcgcaaaagatg

SEQ ID NO: 222219 - DNA, 103 bp, Artificial Sequence
  Synthetic Polynucleotide
taatacgactcactatagggttaatttgtggtggactagagaagccatttaacagaggagaaaatggatgctctagtccaacctggcggcagcgcaaaagatg

SEQ ID NO: 222220 - DNA, 103 bp, Artificial Sequence
  Synthetic Polynucleotide
taatacgactcactatagggaggttcatctttaatttgtggtggactagaaacagaggagatctagtatgccacaaattaacctggcggcagcgcaaaagatg

SEQ ID NO: 222221 - DNA, 103 bp, Artificial Sequence
  Synthetic Polynucleotide
taatacgactcactatagggcatcatcttcaggttcatctttaatttgtgaacagaggagacacaaaatgaagatgaacaacctggcggcagcgcaaaagatg

SEQ ID NO: 222222 - DNA, 103 bp, Artificial Sequence
  Synthetic Polynucleotide
taatacgactcactatagggacaaaatagccatcatcttcaggttcatctaacagaggagaagatgaatgtgaagatgaaacctggcggcagcgcaaaagatg

SEQ ID NO: 222223 - DNA, 103 bp, Artificial Sequence
  Synthetic Polynucleotide
taatacgactcactatagggtttaggaggaacaaaatagccatcatcttcaacagaggagagaagatatgggctattttaacctggcggcagcgcaaaagatg

SEQ ID NO: 222224 - DNA, 103 bp, Artificial Sequence
  Synthetic Polynucleotide
taatacgactcactatagggttatatcctctttaggaggaacaaaatagcaacagaggagagctattatgttcctcctaaacctggcggcagcgcaaaagatg

SEQ ID NO: 222225 - DNA, 103 bp, Artificial Sequence
  Synthetic Polynucleotide
taatacgactcactatagggtttaatggctttatatcctctttaggaggaaacagaggagatcctccatgagaggatataacctggcggcagcgcaaaagatg

SEQ ID NO: 222226 - DNA, 103 bp, Artificial Sequence
  Synthetic Polynucleotide
taatacgactcactatagggatcattcaatcggaaatccgcttcgatctgaacagaggagacagatcatggcggatttcaacctggcggcagcgcaaaagatg

SEQ ID NO: 222227 - DNA, 103 bp, Artificial Sequence
  Synthetic Polynucleotide
taatacgactcactatagggtcgaggtctctttaatggctttatatcctcaacagaggagagaggatatgaagccattaaacctggcggcagcgcaaaagatg

SEQ ID NO: 222228 - DNA, 103 bp, Artificial Sequence
  Synthetic Polynucleotide
taatacgactcactatagggcatcctcatctcgaggtctctttaatggctaacagaggagaagccatatgagagacctcaacctggcggcagcgcaaaagatg

SEQ ID NO: 222229 - DNA, 103 bp, Artificial Sequence
  Synthetic Polynucleotide
taatacgactcactatagggtaatcagcatcatcctcatctcgaggtctcaacagaggagagagaccatgagatgaggaaacctggcggcagcgcaaaagatg

SEQ ID NO: 222230 - DNA, 103 bp, Artificial Sequence
  Synthetic Polynucleotide
taatacgactcactatagggcttaggtttataatcagcatcatcctcatcaacagaggagagatgagatggatgctgataacctggcggcagcgcaaaagatg

SEQ ID NO: 222231 - DNA, 103 bp, Artificial Sequence
  Synthetic Polynucleotide
taatacgactcactatagggttttaattttcttaggtttataatcagcataacagaggagaatgctgatgataaacctaaacctggcggcagcgcaaaagatg

SEQ ID NO: 222232 - DNA, 103 bp, Artificial Sequence
  Synthetic Polynucleotide
taatacgactcactataggggtatcttctgttttaattttcttaggtttaaacagaggagataaaccatggaaaattaaaacctggcggcagcgcaaaagatg

SEQ ID NO: 222233 - DNA, 103 bp, Artificial Sequence
  Synthetic Polynucleotide
taatacgactcactatagggctccttcttggtatcttctgttttaattttaacagaggagaaaaattatgacagaagataacctggcggcagcgcaaaagatg

SEQ ID NO: 222234 - DNA, 103 bp, Artificial Sequence
  Synthetic Polynucleotide
taatacgactcactatagggttcttttcttctccttcttggtatcttctgaacagaggagacagaagatgccaagaaggaacctggcggcagcgcaaaagatg

SEQ ID NO: 222235 - DNA, 103 bp, Artificial Sequence
  Synthetic Polynucleotide
taatacgactcactatagggtcttctagttttcttttcttctccttcttgaacagaggagacaagaaatggaagaaaagaacctggcggcagcgcaaaagatg

SEQ ID NO: 222236 - DNA, 103 bp, Artificial Sequence
  Synthetic Polynucleotide
taatacgactcactatagggatcctcttcttcttctagttttcttttcttaacagaggagaaagaaaatgaaactagaaaacctggcggcagcgcaaaagatg

SEQ ID NO: 222237 - DNA, 103 bp, Artificial Sequence
  Synthetic Polynucleotide
taatacgactcactataggggtttatgagaatcattcaatcggaaatccgaacagaggagacggattatggattgaatgaacctggcggcagcgcaaaagatg

SEQ ID NO: 222238 - DNA, 103 bp, Artificial Sequence
  Synthetic Polynucleotide
taatacgactcactatagggtcaatttaccatcctcttcttcttctagttaacagaggagaaactagatgaagaagaggaacctggcggcagcgcaaaagatg

SEQ ID NO: 222239 - DNA, 103 bp, Artificial Sequence
  Synthetic Polynucleotide
taatacgactcactatagggttgggttttttcaatttaccatcctcttctaacagaggagaagaagaatgtggtaaattaacctggcggcagcgcaaaagatg

SEQ ID NO: 222240 - DNA, 103 bp, Artificial Sequence
  Synthetic Polynucleotide
taatacgactcactatagggatctttattcttgggttttttcaatttaccaacagaggagaggtaaaatgaaaaaacccaacctggcggcagcgcaaaagatg

SEQ ID NO: 222241 - DNA, 103 bp, Artificial Sequence
  Synthetic Polynucleotide
taatacgactcactatagggttttatctttatctttattcttgggtttttaacagaggagaaaaaacatgagaataaagaacctggcggcagcgcaaaagatg

SEQ ID NO: 222242 - DNA, 103 bp, Artificial Sequence
  Synthetic Polynucleotide
taatacgactcactatagggtcaggaacttttttatctttatctttattcaacagaggagagaataaatgtaaagataaaacctggcggcagcgcaaaagatg

SEQ ID NO: 222243 - DNA, 103 bp, Artificial Sequence
  Synthetic Polynucleotide
taatacgactcactataggggttatctggctcaggaacttttttatctttaacagaggagaaaagatatgaaagttcctaacctggcggcagcgcaaaagatg

SEQ ID NO: 222244 - DNA, 103 bp, Artificial Sequence
  Synthetic Polynucleotide
taatacgactcactatagggtctttttcttgttatctggctcaggaacttaacagaggagaaagttcatgagccagataaacctggcggcagcgcaaaagatg

SEQ ID NO: 222245 - DNA, 103 bp, Artificial Sequence
  Synthetic Polynucleotide
taatacgactcactatagggttcttcggcttctttttcttgttatctggcaacagaggagagccagaatgcaagaaaaaaacctggcggcagcgcaaaagatg

SEQ ID NO: 222246 - DNA, 103 bp, Artificial Sequence
  Synthetic Polynucleotide
taatacgactcactatagggttcctcttctttcttcggcttctttttcttaacagaggagaaagaaaatgaagccgaagaacctggcggcagcgcaaaagatg

SEQ ID NO: 222247 - DNA, 103 bp, Artificial Sequence
  Synthetic Polynucleotide
taatacgactcactatagggtccacttctgttcctcttctttcttcggctaacagaggagaagccgaatgaagaagaggaacctggcggcagcgcaaaagatg

SEQ ID NO: 222248 - DNA, 103 bp, Artificial Sequence
  Synthetic Polynucleotide
taatacgactcactatagggttatctttgtgtttatgagaatcattcaataacagaggagaattgaaatgttctcataaaacctggcggcagcgcaaaagatg

SEQ ID NO: 222249 - DNA, 103 bp, Artificial Sequence
  Synthetic Polynucleotide
taatacgactcactatagggtcccaccatttccacttctgttcctcttctaacagaggagaagaagaatgacagaagtgaacctggcggcagcgcaaaagatg

SEQ ID NO: 222250 - DNA, 103 bp, Artificial Sequence
  Synthetic Polynucleotide
taatacgactcactataggggcgctcttcttcccaccatttccacttctgaacagaggagacagaagatgaaatggtggaacctggcggcagcgcaaaagatg

SEQ ID NO: 222251 - DNA, 103 bp, Artificial Sequence
  Synthetic Polynucleotide
taatacgactcactatagggcttcaggatagcgctcttcttcccaccattaacagaggagaaatggtatgaagaagagcaacctggcggcagcgcaaaagatg

SEQ ID NO: 222252 - DNA, 103 bp, Artificial Sequence
  Synthetic Polynucleotide
taatacgactcactatagggcacttgatgccttcaggatagcgctcttctaacagaggagaagaagaatgctatcctgaaacctggcggcagcgcaaaagatg

SEQ ID NO: 222253 - DNA, 103 bp, Artificial Sequence
  Synthetic Polynucleotide
taatacgactcactatagggtaggaatttccacttgatgccttcaggataaacagaggagatatcctatgggcatcaagaacctggcggcagcgcaaaagatg

SEQ ID NO: 222254 - DNA, 103 bp, Artificial Sequence
  Synthetic Polynucleotide
taatacgactcactatagggctttatgttctaggaatttccacttgatgcaacagaggagagcatcaatgggaaattccaacctggcggcagcgcaaaagatg

SEQ ID NO: 222255 - DNA, 103 bp, Artificial Sequence
  Synthetic Polynucleotide
taatacgactcactatagggaatactggacctttatgttctaggaatttcaacagaggagagaaattatgagaacataaaacctggcggcagcgcaaaagatg

SEQ ID NO: 222256 - DNA, 103 bp, Artificial Sequence
  Synthetic Polynucleotide
taatacgactcactatagggtggtggggcaaatactggacctttatgttcaacagaggagagaacatatgggtccagtaaacctggcggcagcgcaaaagatg

SEQ ID NO: 222257 - DNA, 103 bp, Artificial Sequence
  Synthetic Polynucleotide
taatacgactcactataggggaggctcatatggtggggcaaatactggacaacagaggagagtccagatgttgccccacaacctggcggcagcgcaaaagatg

SEQ ID NO: 222258 - DNA, 103 bp, Artificial Sequence
  Synthetic Polynucleotide
taatacgactcactatagggttctctggaagaggctcatatggtggggcaaacagaggagatgccccatgatatgagccaacctggcggcagcgcaaaagatg

SEQ ID NO: 222259 - DNA, 103 bp, Artificial Sequence
  Synthetic Polynucleotide
taatacgactcactatagggatctttgtgtttatctttgtgtttatgagaaacagaggagatctcatatgcacaaagataacctggcggcagcgcaaaagatg

SEQ ID NO: 222260 - DNA, 103 bp, Artificial Sequence
  Synthetic Polynucleotide
taatacgactcactatagggaaacttgacattctctggaagaggctcataaacagaggagatatgagatgcttccagagaacctggcggcagcgcaaaagatg

SEQ ID NO: 222261 - DNA, 103 bp, Artificial Sequence
  Synthetic Polynucleotide
taatacgactcactatagggcatcataataaaacttgacattctctggaaaacagaggagattccagatgatgtcaagtaacctggcggcagcgcaaaagatg

SEQ ID NO: 222262 - DNA, 103 bp, Artificial Sequence
  Synthetic Polynucleotide
taatacgactcactatagggatgactttaccatcataataaaacttgacaaacagaggagatgtcaaatgttattatgaaacctggcggcagcgcaaaagatg

SEQ ID NO: 222263 - DNA, 103 bp, Artificial Sequence
  Synthetic Polynucleotide
taatacgactcactataggggctcagcttcatgactttaccatcataataaacagaggagatattatatgggtaaagtcaacctggcggcagcgcaaaagatg

SEQ ID NO: 222264 - DNA, 103 bp, Artificial Sequence
  Synthetic Polynucleotide
taatacgactcactatagggctgctttggggctcagcttcatgactttacaacagaggagagtaaagatgtgaagctgaaacctggcggcagcgcaaaagatg

SEQ ID NO: 222265 - DNA, 103 bp, Artificial Sequence
  Synthetic Polynucleotide
taatacgactcactataggggctacttcctctgctttggggctcagcttcaacagaggagagaagctatgccccaaagcaacctggcggcagcgcaaaagatg

SEQ ID NO: 222266 - DNA, 103 bp, Artificial Sequence
  Synthetic Polynucleotide
taatacgactcactatagggaaagaacgtagctacttcctctgctttgggaacagaggagacccaaaatggaggaagtaaacctggcggcagcgcaaaagatg

SEQ ID NO: 222267 - DNA, 103 bp, Artificial Sequence
  Synthetic Polynucleotide
taatacgactcactataggggcatttttgcaaagaacgtagctacttcctaacagaggagaaggaagatgctacgttctaacctggcggcagcgcaaaagatg

SEQ ID NO: 222268 - DNA, 103 bp, Artificial Sequence
  Synthetic Polynucleotide
taatacgactcactatagggtcatggtcgagcatttttgcaaagaacgtaaacagaggagatacgttatgtgcaaaaataacctggcggcagcgcaaaagatg

SEQ ID NO: 222269 - DNA, 103 bp, Artificial Sequence
  Synthetic Polynucleotide
taatacgactcactatagggggtagtatattcatggtcgagcatttttgcaacagaggagagcaaaaatgctcgaccataacctggcggcagcgcaaaagatg

SEQ ID NO: 222270 - DNA, 103 bp, Artificial Sequence
  Synthetic Polynucleotide
taatacgactcactatagggggtgttctcgatctttgtgtttatctttgtaacagaggagaacaaagatgaacacaaagaacctggcggcagcgcaaaagatg

SEQ ID NO: 222271 - DNA, 103 bp, Artificial Sequence
  Synthetic Polynucleotide
taatacgactcactatagggatatttccttggtagtatattcatggtcgaaacagaggagatcgaccatgaatatactaaacctggcggcagcgcaaaagatg

SEQ ID NO: 222272 - DNA, 103 bp, Artificial Sequence
  Synthetic Polynucleotide
taatacgactcactatagggtttttcctaaatatttccttggtagtatataacagaggagaatatacatgcaaggaaataacctggcggcagcgcaaaagatg

SEQ ID NO: 222273 - DNA, 103 bp, Artificial Sequence
  Synthetic Polynucleotide
taatacgactcactatagggtttaaagaaatttttcctaaatatttccttaacagaggagaaaggaaatgtttaggaaaaacctggcggcagcgcaaaagatg

SEQ ID NO: 222274 - DNA, 103 bp, Artificial Sequence
  Synthetic Polynucleotide
taatacgactcactatagggttctccagtctttaaagaaatttttcctaaaacagaggagattaggaatgatttctttaaacctggcggcagcgcaaaagatg

SEQ ID NO: 222275 - DNA, 103 bp, Artificial Sequence
  Synthetic Polynucleotide
taatacgactcactataggggtcatttcctttctccagtctttaaagaaaaacagaggagatttcttatgagactggagaacctggcggcagcgcaaaagatg

SEQ ID NO: 222276 - DNA, 103 bp, Artificial Sequence
  Synthetic Polynucleotide
taatacgactcactatagggctcttcattagtcatttcctttctccagtcaacagaggagagactggatgaaggaaatgaacctggcggcagcgcaaaagatg

SEQ ID NO: 222277 - DNA, 103 bp, Artificial Sequence
  Synthetic Polynucleotide
taatacgactcactatagggtaatattcttctcttcattagtcatttcctaacagaggagaaggaaaatgctaatgaagaacctggcggcagcgcaaaagatg

SEQ ID NO: 222278 - DNA, 103 bp, Artificial Sequence
  Synthetic Polynucleotide
taatacgactcactatagggaggttggtgataatattcttctcttcattaaacagaggagataatgaatggaagaatataacctggcggcagcgcaaaagatg

SEQ ID NO: 222279 - DNA, 103 bp, Artificial Sequence
  Synthetic Polynucleotide
taatacgactcactatagggacatttgcttaggttggtgataatattcttaacagaggagaaagaatatgatcaccaacaacctggcggcagcgcaaaagatg

SEQ ID NO: 222280 - DNA, 103 bp, Artificial Sequence
  Synthetic Polynucleotide
taatacgactcactataggggggtaaaatcacatttgcttaggttggtgaaacagaggagatcaccaatgtaagcaaataacctggcggcagcgcaaaagatg

SEQ ID NO: 222281 - DNA, 103 bp, Artificial Sequence
  Synthetic Polynucleotide
taatacgactcactatagggtctttgtgccggtgttctcgatctttgtgtaacagaggagaacacaaatgtcgagaacaaacctggcggcagcgcaaaagatg

SEQ ID NO: 222282 - DNA, 103 bp, Artificial Sequence
  Synthetic Polynucleotide
taatacgactcactatagggtggctcatctgggtaaaatcacatttgcttaacagaggagaaagcaaatgtgattttacaacctggcggcagcgcaaaagatg

SEQ ID NO: 222283 - DNA, 103 bp, Artificial Sequence
  Synthetic Polynucleotide
taatacgactcactatagggtttgaaatactggctcatctgggtaaaatcaacagaggagagattttatgcagatgagcaacctggcggcagcgcaaaagatg

SEQ ID NO: 222284 - DNA, 103 bp, Artificial Sequence
  Synthetic Polynucleotide
taatacgactcactatagggccgtctgggctttgaaatactggctcatctaacagaggagaagatgaatgagtatttcaaacctggcggcagcgcaaaagatg

SEQ ID NO: 222285 - DNA, 103 bp, Artificial Sequence
  Synthetic Polynucleotide
taatacgactcactatagggttccgagcttccgtctgggctttgaaatacaacagaggagagtatttatgagcccagacaacctggcggcagcgcaaaagatg

SEQ ID NO: 222286 - DNA, 103 bp, Artificial Sequence
  Synthetic Polynucleotide
taatacgactcactataggggctcatctgtttccgagcttccgtctgggcaacagaggagagcccagatggaagctcggaacctggcggcagcgcaaaagatg

SEQ ID NO: 222287 - DNA, 103 bp, Artificial Sequence
  Synthetic Polynucleotide
taatacgactcactatagggtctcttccttgctcatctgtttccgagcttaacagaggagaaagctcatgaacagatgaaacctggcggcagcgcaaaagatg

SEQ ID NO: 222288 - DNA, 103 bp, Artificial Sequence
  Synthetic Polynucleotide
taatacgactcactatagggattttcagtttctcttccttgctcatctgtaacagaggagaacagatatgcaaggaagaaacctggcggcagcgcaaaagatg

SEQ ID NO: 222289 - DNA, 103 bp, Artificial Sequence
  Synthetic Polynucleotide
taatacgactcactatagggctcctctttgattttcagtttctcttccttaacagaggagaaaggaaatgaaactgaaaaacctggcggcagcgcaaaagatg

SEQ ID NO: 222290 - DNA, 103 bp, Artificial Sequence
  Synthetic Polynucleotide
taatacgactcactatagggatttttcattctcctctttgattttcagttaacagaggagaaactgaatgtcaaagaggaacctggcggcagcgcaaaagatg

SEQ ID NO: 222291 - DNA, 103 bp, Artificial Sequence
  Synthetic Polynucleotide
taatacgactcactatagggtctttcagtaatttttcattctcctctttgaacagaggagacaaagaatggaatgaaaaaacctggcggcagcgcaaaagatg

SEQ ID NO: 222292 - DNA, 103 bp, Artificial Sequence
  Synthetic Polynucleotide
taatacgactcactataggggggcgccgaggggtacaggcggacgtccataacagaggagaatggacatgcgcctgtacaacctggcggcagcgcaaaagatg

SEQ ID NO: 222293 - DNA, 103 bp, Artificial Sequence
  Synthetic Polynucleotide
taatacgactcactataggggtaggcactgtcaccatcaaacttgccgccaacagaggagaggcggcatgtttgatggtaacctggcggcagcgcaaaagatg

SEQ ID NO: 222294 - DNA, 103 bp, Artificial Sequence
  Synthetic Polynucleotide
taatacgactcactataggggagcattttggctggtgggtttgcctgagtaacagaggagaactcagatgaacccaccaaacctggcggcagcgcaaaagatg

SEQ ID NO: 222295 - DNA, 103 bp, Artificial Sequence
  Synthetic Polynucleotide
taatacgactcactataggggcttgggtgggagcattttggctggtgggtaacagaggagaacccacatgccaaaatgcaacctggcggcagcgcaaaagatg

SEQ ID NO: 222296 - DNA, 103 bp, Artificial Sequence
  Synthetic Polynucleotide
taatacgactcactatagggtacatgggctgcttgggtgggagcattttgaacagaggagacaaaatatgcccacccaaaacctggcggcagcgcaaaagatg

SEQ ID NO: 222297 - DNA, 103 bp, Artificial Sequence
  Synthetic Polynucleotide
taatacgactcactatagggtggcatggcatacatgggctgcttgggtggaacagaggagaccacccatgcagcccatgaacctggcggcagcgcaaaagatg

SEQ ID NO: 222298 - DNA, 103 bp, Artificial Sequence
  Synthetic Polynucleotide
taatacgactcactatagggaggccaggcctggcatggcatacatgggctaacagaggagaagcccaatgatgccatgcaacctggcggcagcgcaaaagatg

SEQ ID NO: 222299 - DNA, 103 bp, Artificial Sequence
  Synthetic Polynucleotide
taatacgactcactataggggtcaggaaggaggccaggcctggcatggcaaacagaggagatgccatatgaggcctggcaacctggcggcagcgcaaaagatg

SEQ ID NO: 222300 - DNA, 103 bp, Artificial Sequence
  Synthetic Polynucleotide
taatacgactcactataggggtccgacggcgtcaggaaggaggccaggccaacagaggagaggcctgatgtccttcctgaacctggcggcagcgcaaaagatg

SEQ ID NO: 222301 - DNA, 103 bp, Artificial Sequence
  Synthetic Polynucleotide
taatacgactcactatagggaggcctgcaggtccgacggcgtcaggaaggaacagaggagaccttccatgcgccgtcggaacctggcggcagcgcaaaagatg

SEQ ID NO: 222302 - DNA, 103 bp, Artificial Sequence
  Synthetic Polynucleotide
taatacgactcactatagggccactgcggaaggcctgcaggtccgacggcaacagaggagagccgtcatgcctgcaggcaacctggcggcagcgcaaaagatg

SEQ ID NO: 222303 - DNA, 103 bp, Artificial Sequence
  Synthetic Polynucleotide
taatacgactcactatagggaggggaggccccactgcggaaggcctgcagaacagaggagactgcagatgttccgcagtaacctggcggcagcgcaaaagatg

SEQ ID NO: 222304 - DNA, 103 bp, Artificial Sequence
  Synthetic Polynucleotide
taatacgactcactatagggtcatccccacgtaggcactgtcaccatcaaaacagaggagattgatgatgacagtgcctaacctggcggcagcgcaaaagatg

SEQ ID NO: 222305 - DNA, 103 bp, Artificial Sequence
  Synthetic Polynucleotide
taatacgactcactatagggcgaggctggcaggggaggccccactgcggaaacagaggagatccgcaatggggcctcccaacctggcggcagcgcaaaagatg

SEQ ID NO: 222306 - DNA, 103 bp, Artificial Sequence
  Synthetic Polynucleotide
taatacgactcactatagggagcgtccgggcgaggctggcaggggaggccaacagaggagaggcctcatgtgccagcctaacctggcggcagcgcaaaagatg

SEQ ID NO: 222307 - DNA, 103 bp, Artificial Sequence
  Synthetic Polynucleotide
taatacgactcactatagggcttggagcccagcgtccgggcgaggctggcaacagaggagagccagcatggcccggacgaacctggcggcagcgcaaaagatg

SEQ ID NO: 222308 - DNA, 103 bp, Artificial Sequence
  Synthetic Polynucleotide
taatacgactcactataggggcagcagagacttggagcccagcgtccgggaacagaggagacccggaatgtgggctccaaacctggcggcagcgcaaaagatg

SEQ ID NO: 222309 - DNA, 103 bp, Artificial Sequence
  Synthetic Polynucleotide
taatacgactcactatagggctgaggcctggcagcagagacttggagcccaacagaggagagggctcatggtctctgctaacctggcggcagcgcaaaagatg

SEQ ID NO: 222310 - DNA, 103 bp, Artificial Sequence
  Synthetic Polynucleotide
taatacgactcactatagggcggggacgcactgaggcctggcagcagagaaacagaggagatctctgatgccaggcctcaacctggcggcagcgcaaaagatg

SEQ ID NO: 222311 - DNA, 103 bp, Artificial Sequence
  Synthetic Polynucleotide
taatacgactcactataggggtggcggcggcggggacgcactgaggcctgaacagaggagacaggccatggtgcgtcccaacctggcggcagcgcaaaagatg

SEQ ID NO: 222312 - DNA, 103 bp, Artificial Sequence
  Synthetic Polynucleotide
taatacgactcactataggggggaaggagggtggcggcggcggggacgcaaacagaggagatgcgtcatggccgccgccaacctggcggcagcgcaaaagatg

SEQ ID NO: 222313 - DNA, 103 bp, Artificial Sequence
  Synthetic Polynucleotide
taatacgactcactatagggggggctgagcgggaaggagggtggcggcggaacagaggagaccgccgatgccctccttcaacctggcggcagcgcaaaagatg

SEQ ID NO: 222314 - DNA, 103 bp, Artificial Sequence
  Synthetic Polynucleotide
taatacgactcactatagggggtgcagtgtggggctgagcgggaaggaggaacagaggagacctcctatgcgctcagccaacctggcggcagcgcaaaagatg

SEQ ID NO: 222315 - DNA, 103 bp, Artificial Sequence
  Synthetic Polynucleotide
taatacgactcactatagggtttccgtcactcatccccacgtaggcactgaacagaggagacagtgcatgcgtggggataacctggcggcagcgcaaaagatg

SEQ ID NO: 222316 - DNA, 103 bp, Artificial Sequence
  Synthetic Polynucleotide
taatacgactcactataggggacagctgctggtgcagtgtggggctgagcaacagaggagagctcagatgcacactgcaaacctggcggcagcgcaaaagatg

SEQ ID NO: 222317 - DNA, 103 bp, Artificial Sequence
  Synthetic Polynucleotide
taatacgactcactatagggagggggcagtgacagctgctggtgcagtgtaacagaggagaacactgatgcagcagctgaacctggcggcagcgcaaaagatg

SEQ ID NO: 222318 - DNA, 103 bp, Artificial Sequence
  Synthetic Polynucleotide
taatacgactcactatagggcctgggcgtgagggggcagtgacagctgctaacagaggagaagcagcatgcactgccccaacctggcggcagcgcaaaagatg

SEQ ID NO: 222319 - DNA, 103 bp, Artificial Sequence
  Synthetic Polynucleotide
taatacgactcactatagggaggagggcgccctgggcgtgagggggcagtaacagaggagaactgccatgtcacgcccaaacctggcggcagcgcaaaagatg

SEQ ID NO: 222320 - DNA, 103 bp, Artificial Sequence
  Synthetic Polynucleotide
taatacgactcactatagggaggtggactgaggagggcgccctgggcgtgaacagaggagacacgccatgggcgccctcaacctggcggcagcgcaaaagatg

SEQ ID NO: 222321 - DNA, 103 bp, Artificial Sequence
  Synthetic Polynucleotide
taatacgactcactatagggacatgctaacaggtggactgaggagggcgcaacagaggagagcgcccatgtcagtccacaacctggcggcagcgcaaaagatg

SEQ ID NO: 222322 - DNA, 103 bp, Artificial Sequence
  Synthetic Polynucleotide
taatacgactcactatagggggggctggggacatgctaacaggtggactgaacagaggagacagtccatgtgttagcataacctggcggcagcgcaaaagatg

SEQ ID NO: 222323 - DNA, 103 bp, Artificial Sequence
  Synthetic Polynucleotide
taatacgactcactatagggagggggctggggggctggggacatgctaacaacagaggagagttagcatgtccccagccaacctggcggcagcgcaaaagatg

SEQ ID NO: 222324 - DNA, 103 bp, Artificial Sequence
  Synthetic Polynucleotide
taatacgactcactatagggtgggcaggacagggggctggggggctggggaacagaggagaccccagatgcccagccccaacctggcggcagcgcaaaagatg

SEQ ID NO: 222325 - DNA, 103 bp, Artificial Sequence
  Synthetic Polynucleotide
taatacgactcactataggggccatgggggtgggcaggacagggggctggaacagaggagaccagccatgtgtcctgccaacctggcggcagcgcaaaagatg

SEQ ID NO: 222326 - DNA, 103 bp, Artificial Sequence
  Synthetic Polynucleotide
taatacgactcactataggggagctctgggtttccgtcactcatccccacaacagaggagagtggggatgagtgacggaaacctggcggcagcgcaaaagatg

SEQ ID NO: 222327 - DNA, 103 bp, Artificial Sequence
  Synthetic Polynucleotide
taatacgactcactatagggcacctggagtgccatgggggtgggcaggacaacagaggagagtcctgatgacccccatgaacctggcggcagcgcaaaagatg

SEQ ID NO: 222328 - DNA, 103 bp, Artificial Sequence
  Synthetic Polynucleotide
taatacgactcactatagggtcgccagctgcacctggagtgccatgggggaacagaggagacccccaatgcactccaggaacctggcggcagcgcaaaagatg

SEQ ID NO: 222329 - DNA, 103 bp, Artificial Sequence
  Synthetic Polynucleotide
taatacgactcactataggggaggggctcatcgccagctgcacctggagtaacagaggagaactccaatggcagctggcaacctggcggcagcgcaaaagatg

SEQ ID NO: 222330 - DNA, 103 bp, Artificial Sequence
  Synthetic Polynucleotide
taatacgactcactatagggccctggaggtgaggggctcatcgccagctgaacagaggagacagctgatgatgagccccaacctggcggcagcgcaaaagatg

SEQ ID NO: 222331 - DNA, 103 bp, Artificial Sequence
  Synthetic Polynucleotide
taatacgactcactatagggagtcctgtggccctggaggtgaggggctcaaacagaggagatgagccatgcacctccagaacctggcggcagcgcaaaagatg

SEQ ID NO: 222332 - DNA, 103 bp, Artificial Sequence
  Synthetic Polynucleotide
taatacgactcactatagggatgtgcgggaagtcctgtggccctggaggtaacagaggagaacctccatggccacaggaaacctggcggcagcgcaaaagatg

SEQ ID NO: 222333 - DNA, 103 bp, Artificial Sequence
  Synthetic Polynucleotide
taatacgactcactataggggaactcagagatgtgcgggaagtcctgtggaacagaggagaccacagatgttcccgcacaacctggcggcagcgcaaaagatg

SEQ ID NO: 222334 - DNA, 103 bp, Artificial Sequence
  Synthetic Polynucleotide
taatacgactcactatagggagctgctggggaactcagagatgtgcgggaaacagaggagatcccgcatgtctctgagtaacctggcggcagcgcaaaagatg

SEQ ID NO: 222335 - DNA, 103 bp, Artificial Sequence
  Synthetic Polynucleotide
taatacgactcactatagggcaggatcccgagctgctggggaactcagagaacagaggagactctgaatgccccagcagaacctggcggcagcgcaaaagatg

SEQ ID NO: 222336 - DNA, 103 bp, Artificial Sequence
  Synthetic Polynucleotide
taatacgactcactataggggccaggtgagcaggatcccgagctgctgggaacagaggagacccagcatgtcgggatccaacctggcggcagcgcaaaagatg

SEQ ID NO: 222337 - DNA, 103 bp, Artificial Sequence
  Synthetic Polynucleotide
taatacgactcactatagggtggttgacaggagctctgggtttccgtcacaacagaggagagtgacgatgacccagagcaacctggcggcagcgcaaaagatg

SEQ ID NO: 222338 - DNA, 103 bp, Artificial Sequence
  Synthetic Polynucleotide
taatacgactcactatagggggttggatgggccaggtgagcaggatcccgaacagaggagacgggatatggctcacctgaacctggcggcagcgcaaaagatg

SEQ ID NO: 222339 - DNA, 103 bp, Artificial Sequence
  Synthetic Polynucleotide
taatacgactcactatagggctgctggtggggttggatgggccaggtgagaacagaggagactcaccatgcccatccaaaacctggcggcagcgcaaaagatg

SEQ ID NO: 222340 - DNA, 103 bp, Artificial Sequence
  Synthetic Polynucleotide
taatacgactcactatagggccagtccccgctgctggtggggttggatggaacagaggagaccatccatgcccaccagcaacctggcggcagcgcaaaagatg

SEQ ID NO: 222341 - DNA, 103 bp, Artificial Sequence
  Synthetic Polynucleotide
taatacgactcactatagggagctgctgtcccagtccccgctgctggtggaacagaggagaccaccaatggcggggactaacctggcggcagcgcaaaagatg

SEQ ID NO: 222342 - DNA, 103 bp, Artificial Sequence
  Synthetic Polynucleotide
taatacgactcactatagggccactggggtagctgctgtcccagtccccgaacagaggagacggggaatgggacagcagaacctggcggcagcgcaaaagatg

SEQ ID NO: 222343 - DNA, 103 bp, Artificial Sequence
  Synthetic Polynucleotide
taatacgactcactataggggccacactccccactggggtagctgctgtcaacagaggagagacagcatgtaccccagtaacctggcggcagcgcaaaagatg

SEQ ID NO: 222344 - DNA, 103 bp, Artificial Sequence
  Synthetic Polynucleotide
taatacgactcactatagggaggtgctgatgccacactccccactggggtaacagaggagaaccccaatggggagtgtgaacctggcggcagcgcaaaagatg

SEQ ID NO: 222345 - DNA, 103 bp, Artificial Sequence
  Synthetic Polynucleotide
taatacgactcactatagggagcaggctgcaggtgctgatgccacactccaacagaggagaggagtgatgcatcagcacaacctggcggcagcgcaaaagatg

SEQ ID NO: 222346 - DNA, 103 bp, Artificial Sequence
  Synthetic Polynucleotide
taatacgactcactataggggtccctggggagcaggctgcaggtgctgataacagaggagaatcagcatgtgcagcctgaacctggcggcagcgcaaaagatg

SEQ ID NO: 222347 - DNA, 103 bp, Artificial Sequence
  Synthetic Polynucleotide
taatacgactcactatagggagagcgatttgtccctggggagcaggctgcaacagaggagagcagccatgtccccagggaacctggcggcagcgcaaaagatg

SEQ ID NO: 222348 - DNA, 103 bp, Artificial Sequence
  Synthetic Polynucleotide
taatacgactcactatagggtaggtctggctggttgacaggagctctgggaacagaggagacccagaatgcctgtcaacaacctggcggcagcgcaaaagatg

SEQ ID NO: 222349 - DNA, 103 bp, Artificial Sequence
  Synthetic Polynucleotide
taatacgactcactatagggtaggtgaggtagagcgatttgtccctggggaacagaggagaccccagatgcaaatcgctaacctggcggcagcgcaaaagatg

SEQ ID NO: 222350 - DNA, 103 bp, Artificial Sequence
  Synthetic Polynucleotide
taatacgactcactatagggctggccgttgtaggtctggctggttgacagaacagaggagactgtcaatgagccagaccaacctggcggcagcgcaaaagatg

SEQ ID NO: 222351 - DNA, 103 bp, Artificial Sequence
  Synthetic Polynucleotide
taatacgactcactatagggtgttctcgctctggccgttgtaggtctggcaacagaggagagccagaatgacaacggccaacctggcggcagcgcaaaagatg

SEQ ID NO: 222352 - DNA, 103 bp, Artificial Sequence
  Synthetic Polynucleotide
taatacgactcactatagggtagtcttcgttgttctcgctctggccgttgaacagaggagacaacggatggagcgagaaaacctggcggcagcgcaaaagatg

SEQ ID NO: 222353 - DNA, 103 bp, Artificial Sequence
  Synthetic Polynucleotide
taatacgactcactatagggggggatctcatagtcttcgttgttctcgctaacagaggagaagcgagatgaacgaagacaacctggcggcagcgcaaaagatg

SEQ ID NO: 222354 - DNA, 103 bp, Artificial Sequence
  Synthetic Polynucleotide
taatacgactcactatagggcgcccaccgcgggcgccgaggggtacaggcaacagaggagagcctgtatgcctcggcgcaacctggcggcagcgcaaaagatg

SEQ ID NO: 222355 - DNA, 103 bp, Artificial Sequence
  Synthetic Polynucleotide
taatacgactcactataggggtgttatcggggggatctcatagtcttcgtaacagaggagaacgaagatgatgagatccaacctggcggcagcgcaaaagatg

SEQ ID NO: 222356 - DNA, 103 bp, Artificial Sequence
  Synthetic Polynucleotide
taatacgactcactatagggaggttgggaggtgttatcggggggatctcaaacagaggagatgagatatgcccgataacaacctggcggcagcgcaaaagatg

SEQ ID NO: 222357 - DNA, 103 bp, Artificial Sequence
  Synthetic Polynucleotide
taatacgactcactatagggtggctccgggaggttgggaggtgttatcggaacagaggagaccgataatgcctcccaacaacctggcggcagcgcaaaagatg

SEQ ID NO: 222358 - DNA, 103 bp, Artificial Sequence
  Synthetic Polynucleotide
taatacgactcactataggggcaggagggatggctccgggaggttgggagaacagaggagactcccaatgtcccggagcaacctggcggcagcgcaaaagatg

SEQ ID NO: 222359 - DNA, 103 bp, Artificial Sequence
  Synthetic Polynucleotide
taatacgactcactatagggtcccccaggtgcaggagggatggctccgggaacagaggagacccggaatgatccctcctaacctggcggcagcgcaaaagatg

SEQ ID NO: 222360 - DNA, 103 bp, Artificial Sequence
  Synthetic Polynucleotide
taatacgactcactatagggggcttcgtggtcccccaggtgcaggagggaaacagaggagatccctcatgcacctggggaacctggcggcagcgcaaaagatg

SEQ ID NO: 222361 - DNA, 103 bp, Artificial Sequence
  Synthetic Polynucleotide
taatacgactcactatagggagtggtagctggcttcgtggtcccccaggtaacagaggagaacctggatgaccacgaagaacctggcggcagcgcaaaagatg

SEQ ID NO: 222362 - DNA, 103 bp, Artificial Sequence
  Synthetic Polynucleotide
taatacgactcactatagggtggcacagcgagtggtagctggcttcgtggaacagaggagaccacgaatgcagctaccaaacctggcggcagcgcaaaagatg

SEQ ID NO: 222363 - DNA, 103 bp, Artificial Sequence
  Synthetic Polynucleotide
taatacgactcactatagggggtgaggccgtggcacagcgagtggtagctaacagaggagaagctacatgtcgctgtgcaacctggcggcagcgcaaaagatg

SEQ ID NO: 222364 - DNA, 103 bp, Artificial Sequence
  Synthetic Polynucleotide
taatacgactcactataggggaccgttgggggtgaggccgtggcacagcgaacagaggagacgctgtatgacggcctcaaacctggcggcagcgcaaaagatg

SEQ ID NO: 222365 - DNA, 103 bp, Artificial Sequence
  Synthetic Polynucleotide
taatacgactcactatagggccgggccgcgcgcccaccgcgggcgccgagaacagaggagactcggcatgcgcggtgggaacctggcggcagcgcaaaagatg

SEQ ID NO: 222366 - DNA, 103 bp, Artificial Sequence
  Synthetic Polynucleotide
taatacgactcactataggggcagggagcagaccgttgggggtgaggccgaacagaggagacggcctatgccccaacggaacctggcggcagcgcaaaagatg

SEQ ID NO: 222367 - DNA, 103 bp, Artificial Sequence
  Synthetic Polynucleotide
taatacgactcactatagggataggagtaggcagggagcagaccgttgggaacagaggagacccaacatgctgctccctaacctggcggcagcgcaaaagatg

SEQ ID NO: 222368 - DNA, 103 bp, Artificial Sequence
  Synthetic Polynucleotide
taatacgactcactatagggccatggcctgataggagtaggcagggagcaaacagaggagatgctccatgcctactcctaacctggcggcagcgcaaaagatg

SEQ ID NO: 222369 - DNA, 103 bp, Artificial Sequence
  Synthetic Polynucleotide
taatacgactcactataggggctgggaggtccatggcctgataggagtagaacagaggagactactcatgtcaggccataacctggcggcagcgcaaaagatg

SEQ ID NO: 222370 - DNA, 103 bp, Artificial Sequence
  Synthetic Polynucleotide
taatacgactcactatagggcaccatgatggctgggaggtccatggcctgaacagaggagacaggccatggacctcccaaacctggcggcagcgcaaaagatg

SEQ ID NO: 222371 - DNA, 103 bp, Artificial Sequence
  Synthetic Polynucleotide
taatacgactcactataggggcatgttggacaccatgatggctgggaggtaacagaggagaacctccatgccatcatggaacctggcggcagcgcaaaagatg

SEQ ID NO: 222372 - DNA, 103 bp, Artificial Sequence
  Synthetic Polynucleotide
taatacgactcactatagggtcctgtgctagcatgttggacaccatgatgaacagaggagacatcatatggtccaacataacctggcggcagcgcaaaagatg

SEQ ID NO: 222373 - DNA, 103 bp, Artificial Sequence
  Synthetic Polynucleotide
taatacgactcactatagggcaggtggctgtcctgtgctagcatgttggaaacagaggagatccaacatgctagcacagaacctggcggcagcgcaaaagatg

SEQ ID NO: 222374 - DNA, 103 bp, Artificial Sequence
  Synthetic Polynucleotide
taatacgactcactatagggggcccgacagcaggtggctgtcctgtgctaaacagaggagatagcacatgacagccaccaacctggcggcagcgcaaaagatg

SEQ ID NO: 222375 - DNA, 103 bp, Artificial Sequence
  Synthetic Polynucleotide
taatacgactcactataggggtgggcagctggcccgacagcaggtggctgaacagaggagacagccaatggctgtcgggaacctggcggcagcgcaaaagatg

SEQ ID NO: 222376 - DNA, 103 bp, Artificial Sequence
  Synthetic Polynucleotide
taatacgactcactatagggcggctcggccccgggccgcgcgcccaccgcaacagaggagagcggtgatggcgcggcccaacctggcggcagcgcaaaagatg

SEQ ID NO: 222377 - DNA, 103 bp, Artificial Sequence
  Synthetic Polynucleotide
taatacgactcactatagggctcctggatcgtgggcagctggcccgacagaacagaggagactgtcgatgcagctgcccaacctggcggcagcgcaaaagatg

SEQ ID NO: 222378 - DNA, 103 bp, Artificial Sequence
  Synthetic Polynucleotide
taatacgactcactatagggagtggaccatctcctggatcgtgggcagctaacagaggagaagctgcatgcgatccaggaacctggcggcagcgcaaaagatg

SEQ ID NO: 222379 - DNA, 103 bp, Artificial Sequence
  Synthetic Polynucleotide
taatacgactcactataggggccacttccgagtggaccatctcctggatcaacagaggagagatccaatggatggtccaaacctggcggcagcgcaaaagatg

SEQ ID NO: 222380 - DNA, 103 bp, Artificial Sequence
  Synthetic Polynucleotide
taatacgactcactataggggtcataggcagccacttccgagtggaccataacagaggagaatggtcatgtcggaagtgaacctggcggcagcgcaaaagatg

SEQ ID NO: 222381 - DNA, 103 bp, Artificial Sequence
  Synthetic Polynucleotide
taatacgactcactataggggccggcccgagtcataggcagccacttccgaacagaggagacggaagatgctgcctatgaacctggcggcagcgcaaaagatg

SEQ ID NO: 222382 - DNA, 103 bp, Artificial Sequence
  Synthetic Polynucleotide
taatacgactcactatagggaggggcccgggccggcccgagtcataggcaaacagaggagatgcctaatgctcgggccgaacctggcggcagcgcaaaagatg

SEQ ID NO: 222383 - DNA, 103 bp, Artificial Sequence
  Synthetic Polynucleotide
taatacgactcactataggggcgacccagcaggggcccgggccggcccgaaacagaggagatcgggcatgcccgggcccaacctggcggcagcgcaaaagatg

SEQ ID NO: 222384 - DNA, 103 bp, Artificial Sequence
  Synthetic Polynucleotide
taatacgactcactataggggcattgccgggcgacccagcaggggcccggaacagaggagaccgggcatgtgctgggtcaacctggcggcagcgcaaaagatg

SEQ ID NO: 222385 - DNA, 103 bp, Artificial Sequence
  Synthetic Polynucleotide
taatacgactcactatagggtggctggccagcattgccgggcgacccagcaacagaggagagctgggatgcccggcaataacctggcggcagcgcaaaagatg

SEQ ID NO: 222386 - DNA, 103 bp, Artificial Sequence
  Synthetic Polynucleotide
taatacgactcactatagggggcactcatgtggctggccagcattgccggaacagaggagaccggcaatgctggccagcaacctggcggcagcgcaaaagatg

SEQ ID NO: 222387 - DNA, 103 bp, Artificial Sequence
  Synthetic Polynucleotide
taatacgactcactatagggccaggccggccggctcggccccgggccgcgaacagaggagacgcggcatggggccgagcaacctggcggcagcgcaaaagatg

SEQ ID NO: 222388 - DNA, 103 bp, Artificial Sequence
  Synthetic Polynucleotide
taatacgactcactatagggactggctgagggcactcatgtggctggccaaacagaggagatggccaatgacatgagtgaacctggcggcagcgcaaaagatg

SEQ ID NO: 222389 - DNA, 103 bp, Artificial Sequence
  Synthetic Polynucleotide
taatacgactcactatagggatgagctgggactggctgagggcactcatgaacagaggagacatgagatgcctcagccaaacctggcggcagcgcaaaagatg

SEQ ID NO: 222390 - DNA, 103 bp, Artificial Sequence
  Synthetic Polynucleotide
taatacgactcactatagggcatctgcgagatgagctgggactggctgagaacagaggagactcagcatgtcccagctcaacctggcggcagcgcaaaagatg

SEQ ID NO: 222391 - DNA, 103 bp, Artificial Sequence
  Synthetic Polynucleotide
taatacgactcactatagggtccggatgcccatctgcgagatgagctgggaacagaggagacccagcatgtctcgcagaaacctggcggcagcgcaaaagatg

SEQ ID NO: 222392 - DNA, 103 bp, Artificial Sequence
  Synthetic Polynucleotide
taatacgactcactataggggcgatgctgctccggatgcccatctgcgagaacagaggagactcgcaatggggcatccgaacctggcggcagcgcaaaagatg

SEQ ID NO: 222393 - DNA, 103 bp, Artificial Sequence
  Synthetic Polynucleotide
taatacgactcactatagggggagctgtgggcgatgctgctccggatgccaacagaggagaggcatcatgagcagcatcaacctggcggcagcgcaaaagatg

SEQ ID NO: 222394 - DNA, 103 bp, Artificial Sequence
  Synthetic Polynucleotide
taatacgactcactataggggcggtgatggggagctgtgggcgatgctgcaacagaggagagcagcaatgcccacagctaacctggcggcagcgcaaaagatg

SEQ ID NO: 222395 - DNA, 103 bp, Artificial Sequence
  Synthetic Polynucleotide
taatacgactcactatagggttgctccccggcggtgatggggagctgtggaacagaggagaccacagatgcccatcaccaacctggcggcagcgcaaaagatg

SEQ ID NO: 222396 - DNA, 103 bp, Artificial Sequence
  Synthetic Polynucleotide
taatacgactcactatagggggtcgctgacttgctccccggcggtgatggaacagaggagaccatcaatgccggggagcaacctggcggcagcgcaaaagatg

SEQ ID NO: 222397 - DNA, 103 bp, Artificial Sequence
  Synthetic Polynucleotide
taatacgactcactatagggagggagagggggtcgctgacttgctccccgaacagaggagacggggaatgagtcagcgaaacctggcggcagcgcaaaagatg

SEQ ID NO: 222398 - DNA, 103 bp, Artificial Sequence
  Synthetic Polynucleotide
taatacgactcactatagggtccaggtgcgccaggccggccggctcggccaacagaggagaggccgaatgggccggcctaacctggcggcagcgcaaaagatg

SEQ ID NO: 222399 - DNA, 103 bp, Artificial Sequence
  Synthetic Polynucleotide
taatacgactcactataggggtggagctggagggagagggggtcgctgacaacagaggagagtcagcatgcccctctccaacctggcggcagcgcaaaagatg

SEQ ID NO: 222400 - DNA, 103 bp, Artificial Sequence
  Synthetic Polynucleotide
taatacgactcactatagggctcttcctgagtggagctggagggagagggaacagaggagaccctctatgtccagctccaacctggcggcagcgcaaaagatg

SEQ ID NO: 222401 - DNA, 103 bp, Artificial Sequence
  Synthetic Polynucleotide
taatacgactcactatagggcttccgactcctcttcctgagtggagctggaacagaggagaccagctatgctcaggaagaacctggcggcagcgcaaaagatg

SEQ ID NO: 222402 - DNA, 103 bp, Artificial Sequence
  Synthetic Polynucleotide
taatacgactcactatagggttgaaatgcacttccgactcctcttcctgaaacagaggagatcaggaatgggagtcggaaacctggcggcagcgcaaaagatg

SEQ ID NO: 222403 - DNA, 103 bp, Artificial Sequence
  Synthetic Polynucleotide
taatacgactcactatagggtcccgagatcttgaaatgcacttccgactcaacagaggagagagtcgatggtgcatttcaacctggcggcagcgcaaaagatg

SEQ ID NO: 222404 - DNA, 103 bp, Artificial Sequence
  Synthetic Polynucleotide
taatacgactcactataggggtctcttttctcccgagatcttgaaatgcaaacagaggagatgcattatgagatctcggaacctggcggcagcgcaaaagatg

SEQ ID NO: 222405 - DNA, 103 bp, Artificial Sequence
  Synthetic Polynucleotide
taatacgactcactatagggtcggctgaaggtctcttttctcccgagatcaacagaggagagatctcatgagaaaagagaacctggcggcagcgcaaaagatg

SEQ ID NO: 222406 - DNA, 103 bp, Artificial Sequence
  Synthetic Polynucleotide
taatacgactcactatagggttttcctgggtcggctgaaggtctcttttcaacagaggagagaaaagatgccttcagccaacctggcggcagcgcaaaagatg

SEQ ID NO: 222407 - DNA, 103 bp, Artificial Sequence
  Synthetic Polynucleotide
taatacgactcactatagggtcttggccttttttcctgggtcggctgaagaacagaggagacttcagatgacccaggaaaacctggcggcagcgcaaaagatg

SEQ ID NO: 222408 - DNA, 103 bp, Artificial Sequence
  Synthetic Polynucleotide
taatacgactcactatagggttcttcgggttcttggccttttttcctgggaacagaggagacccaggatgaaaggccaaaacctggcggcagcgcaaaagatg

SEQ ID NO: 222409 - DNA, 103 bp, Artificial Sequence
  Synthetic Polynucleotide
taatacgactcactataggggtggtaatagtccaggtgcgccaggccggcaacagaggagagccggcatggcgcacctgaacctggcggcagcgcaaaagatg

SEQ ID NO: 222410 - DNA, 103 bp, Artificial Sequence
  Synthetic Polynucleotide
taatacgactcactatagggctttttcttcttcttcgggttcttggccttaacagaggagaaaggccatgaacccgaagaacctggcggcagcgcaaaagatg

SEQ ID NO: 222411 - DNA, 103 bp, Artificial Sequence
  Synthetic Polynucleotide
taatacgactcactatagggtggggtccttctttttcttcttcttcgggtaacagaggagaacccgaatgagaagaaaaaacctggcggcagcgcaaaagatg

SEQ ID NO: 222412 - DNA, 103 bp, Artificial Sequence
  Synthetic Polynucleotide
taatacgactcactatagggtgcggctcattggggtccttctttttcttcaacagaggagagaagaaatggaaggacccaacctggcggcagcgcaaaagatg

SEQ ID NO: 222413 - DNA, 103 bp, Artificial Sequence
  Synthetic Polynucleotide
taatacgactcactatagggcacaggcttctgcggctcattggggtccttaacagaggagaaaggacatgaatgagccgaacctggcggcagcgcaaaagatg

SEQ ID NO: 222414 - DNA, 103 bp, Artificial Sequence
  Synthetic Polynucleotide
taatacgactcactatagggcgtaggccgacacaggcttctgcggctcataacagaggagaatgagcatgagaagcctgaacctggcggcagcgcaaaagatg

SEQ ID NO: 222415 - DNA, 103 bp, Artificial Sequence
  Synthetic Polynucleotide
taatacgactcactatagggaagaagagtgcgtaggccgacacaggcttcaacagaggagagaagccatggtcggcctaaacctggcggcagcgcaaaagatg

SEQ ID NO: 222416 - DNA, 103 bp, Artificial Sequence
  Synthetic Polynucleotide
taatacgactcactatagggagtgtctctgaagaagagtgcgtaggccgaaacagaggagatcggccatggcactcttcaacctggcggcagcgcaaaagatg

SEQ ID NO: 222417 - DNA, 103 bp, Artificial Sequence
  Synthetic Polynucleotide
taatacgactcactatagggtggcggcctgagtgtctctgaagaagagtgaacagaggagacactctatgtcagagacaaacctggcggcagcgcaaaagatg

SEQ ID NO: 222418 - DNA, 103 bp, Artificial Sequence
  Synthetic Polynucleotide
taatacgactcactatagggtgacccttgatggcggcctgagtgtctctgaacagaggagacagagaatgtcaggccgcaacctggcggcagcgcaaaagatg

SEQ ID NO: 222419 - DNA, 103 bp, Artificial Sequence
  Synthetic Polynucleotide
taatacgactcactatagggactggggttctgacccttgatggcggcctgaacagaggagacaggccatgatcaagggtaacctggcggcagcgcaaaagatg

SEQ ID NO: 222420 - DNA, 103 bp, Artificial Sequence
  Synthetic Polynucleotide
taatacgactcactatagggacttgccgccgtggtaatagtccaggtgcgaacagaggagacgcaccatgactattaccaacctggcggcagcgcaaaagatg

SEQ ID NO: 222421 - DNA, 103 bp, Artificial Sequence
  Synthetic Polynucleotide
taatacgactcactatagggcgaaagtggcactggggttctgacccttgaaacagaggagatcaaggatgagaaccccaaacctggcggcagcgcaaaagatg

SEQ ID NO: 222422 - DNA, 103 bp, Artificial Sequence
  Synthetic Polynucleotide
taatacgactcactataggggacacgtcaccgaaagtggcactggggttcaacagaggagagaacccatgtgccactttaacctggcggcagcgcaaaagatg

SEQ ID NO: 222423 - DNA, 103 bp, Artificial Sequence
  Synthetic Polynucleotide
taatacgactcactatagggcacgattttggacacgtcaccgaaagtggcaacagaggagagccactatgggtgacgtgaacctggcggcagcgcaaaagatg

SEQ ID NO: 222424 - DNA, 103 bp, Artificial Sequence
  Synthetic Polynucleotide
taatacgactcactatagggacatggaggccacgattttggacacgtcacaacagaggagagtgacgatgccaaaatcgaacctggcggcagcgcaaaagatg

SEQ ID NO: 222425 - DNA, 103 bp, Artificial Sequence
  Synthetic Polynucleotide
taatacgactcactatagggaggctgtcccacatggaggccacgattttgaacagaggagacaaaatatgggcctccataacctggcggcagcgcaaaagatg

SEQ ID NO: 222426 - DNA, 103 bp, Artificial Sequence
  Synthetic Polynucleotide
taatacgactcactatagggttcctctcccaggctgtcccacatggaggcaacagaggagagcctccatgtgggacagcaacctggcggcagcgcaaaagatg

SEQ ID NO: 222427 - DNA, 103 bp, Artificial Sequence
  Synthetic Polynucleotide
taatacgactcactatagggcctgcttctgttcctctcccaggctgtcccaacagaggagagggacaatgtgggagaggaacctggcggcagcgcaaaagatg

SEQ ID NO: 222428 - DNA, 103 bp, Artificial Sequence
  Synthetic Polynucleotide
taatacgactcactatagggctcttgtaggcctgcttctgttcctctcccaacagaggagagggagaatgacagaagcaaacctggcggcagcgcaaaagatg

SEQ ID NO: 222429 - DNA, 103 bp, Artificial Sequence
  Synthetic Polynucleotide
taatacgactcactatagggttctgtcttcctcttgtaggcctgcttctgaacagaggagacagaagatggcctacaagaacctggcggcagcgcaaaagatg

SEQ ID NO: 222430 - DNA, 103 bp, Artificial Sequence
  Synthetic Polynucleotide
taatacgactcactatagggtctttgctgcttctgtcttcctcttgtaggaacagaggagacctacaatgggaagacagaacctggcggcagcgcaaaagatg

SEQ ID NO: 222431 - DNA, 103 bp, Artificial Sequence
  Synthetic Polynucleotide
taatacgactcactatagggtcaccatcaaacttgccgccgtggtaatagaacagaggagactattaatgcggcggcaaaacctggcggcagcgcaaaagatg

SEQ ID NO: 222432 - DNA, 103 bp, Artificial Sequence
  Synthetic Polynucleotide
taatacgactcactatagggagatattccttctttgctgcttctgtcttcaacagaggagagaagacatgagcagcaaaaacctggcggcagcgcaaaagatg

SEQ ID NO: 222433 - DNA, 103 bp, Artificial Sequence
  Synthetic Polynucleotide
taatacgactcactatagggcagggccttcagatattccttctttgctgcaacagaggagagcagcaatgaaggaatataacctggcggcagcgcaaaagatg

SEQ ID NO: 222434 - DNA, 103 bp, Artificial Sequence
  Synthetic Polynucleotide
taatacgactcactatagggggtaggctgccagggccttcagatattcctaacagaggagaaggaatatgtgaaggcccaacctggcggcagcgcaaaagatg

SEQ ID NO: 222435 - DNA, 103 bp, Artificial Sequence
  Synthetic Polynucleotide
taatacgactcactatagggaggctagcccggtaggctgccagggccttcaacagaggagagaaggcatgggcagcctaaacctggcggcagcgcaaaagatg

SEQ ID NO: 222436 - DNA, 103 bp, Artificial Sequence
  Synthetic Polynucleotide
taatacgactcactatagggcttggagacgaggctagcccggtaggctgcaacagaggagagcagccatgcgggctagcaacctggcggcagcgcaaaagatg

SEQ ID NO: 222437 - DNA, 103 bp, Artificial Sequence
  Synthetic Polynucleotide
taatacgactcactatagggctggggagctcttggagacgaggctagcccaacagaggagagggctaatgtcgtctccaaacctggcggcagcgcaaaagatg

SEQ ID NO: 222438 - DNA, 103 bp, Artificial Sequence
  Synthetic Polynucleotide
taatacgactcactatagggtcaccttgatctggggagctcttggagacgaacagaggagacgtctcatggagctccccaacctggcggcagcgcaaaagatg

SEQ ID NO: 222439 - DNA, 103 bp, Artificial Sequence
  Synthetic Polynucleotide
taatacgactcactataggggctcttggtctcaccttgatctggggagctaacagaggagaagctccatggatcaaggtaacctggcggcagcgcaaaagatg

SEQ ID NO: 222440 - DNA, 103 bp, Artificial Sequence
  Synthetic Polynucleotide
taatacgactcactatagggttgcctgagtgctcttggtctcaccttgataacagaggagaatcaagatgagaccaagaaacctggcggcagcgcaaaagatg

SEQ ID NO: 222441 - DNA, 103 bp, Artificial Sequence
  Synthetic Polynucleotide
taatacgactcactataggggctggtgggtttgcctgagtgctcttggtcaacagaggagagaccaaatgcactcaggcaacctggcggcagcgcaaaagatg

SEQ ID NO: 222442 - DNA, 103 bp, Artificial Sequence
  Synthetic Polynucleotide
taatacgactcactatagggggccgccgcggggtagaacctcacatccataacagaggagaatggatatgaggttctacaacctggcggcagcgcaaaagatg

SEQ ID NO: 222443 - DNA, 103 bp, Artificial Sequence
  Synthetic Polynucleotide
taatacgactcactatagggagccatattcatatagttattattatttccaacagaggagaggaaatatgaataactataacctggcggcagcgcaaaagatg

SEQ ID NO: 222444 - DNA, 103 bp, Artificial Sequence
  Synthetic Polynucleotide
taatacgactcactataggggatggtctgggcttctgctgactcagcagcaacagaggagagctgctatgtcagcagaaaacctggcggcagcgcaaaagatg

SEQ ID NO: 222445 - DNA, 103 bp, Artificial Sequence
  Synthetic Polynucleotide
taatacgactcactataggggaacagaacggatggtctgggcttctgctgaacagaggagacagcagatgcccagaccaaacctggcggcagcgcaaaagatg

SEQ ID NO: 222446 - DNA, 103 bp, Artificial Sequence
  Synthetic Polynucleotide
taatacgactcactatagggagggtctgctgaacagaacggatggtctggaacagaggagaccagacatgccgttctgtaacctggcggcagcgcaaaagatg

SEQ ID NO: 222447 - DNA, 103 bp, Artificial Sequence
  Synthetic Polynucleotide
taatacgactcactatagggggtcgacgccagggtctgctgaacagaacgaacagaggagacgttctatgcagcagaccaacctggcggcagcgcaaaagatg

SEQ ID NO: 222448 - DNA, 103 bp, Artificial Sequence
  Synthetic Polynucleotide
taatacgactcactatagggatgttagattggtcgacgccagggtctgctaacagaggagaagcagaatgtggcgtcgaaacctggcggcagcgcaaaagatg

SEQ ID NO: 222449 - DNA, 103 bp, Artificial Sequence
  Synthetic Polynucleotide
taatacgactcactatagggaggagagaggatgttagattggtcgacgccaacagaggagaggcgtcatgcaatctaacaacctggcggcagcgcaaaagatg

SEQ ID NO: 222450 - DNA, 103 bp, Artificial Sequence
  Synthetic Polynucleotide
taatacgactcactatagggagtgttgagaaggagagaggatgttagattaacagaggagaaatctaatgtcctctctcaacctggcggcagcgcaaaagatg

SEQ ID NO: 222451 - DNA, 103 bp, Artificial Sequence
  Synthetic Polynucleotide
taatacgactcactataggggagacagtggagtgttgagaaggagagaggaacagaggagacctctcatgttctcaacaaacctggcggcagcgcaaaagatg

SEQ ID NO: 222452 - DNA, 103 bp, Artificial Sequence
  Synthetic Polynucleotide
taatacgactcactataggggttccatgttgagacagtggagtgttgagaaacagaggagatctcaaatgtccactgtcaacctggcggcagcgcaaaagatg

SEQ ID NO: 222453 - DNA, 103 bp, Artificial Sequence
  Synthetic Polynucleotide
taatacgactcactatagggtgctgacactgttccatgttgagacagtggaacagaggagaccactgatgcaacatggaaacctggcggcagcgcaaaagatg

SEQ ID NO: 222454 - DNA, 103 bp, Artificial Sequence
  Synthetic Polynucleotide
taatacgactcactatagggtgttcgcctcagccatattcatatagttataacagaggagaataactatgtgaatatggaacctggcggcagcgcaaaagatg

SEQ ID NO: 222455 - DNA, 103 bp, Artificial Sequence
  Synthetic Polynucleotide
taatacgactcactatagggtctgaggtgatgctgacactgttccatgttaacagaggagaaacatgatgcagtgtcagaacctggcggcagcgcaaaagatg

SEQ ID NO: 222456 - DNA, 103 bp, Artificial Sequence
  Synthetic Polynucleotide
taatacgactcactatagggtgctggagagtctgaggtgatgctgacactaacagaggagaagtgtcatgatcacctcaaacctggcggcagcgcaaaagatg

SEQ ID NO: 222457 - DNA, 103 bp, Artificial Sequence
  Synthetic Polynucleotide
taatacgactcactatagggagggagggattgctggagagtctgaggtgaaacagaggagatcacctatgactctccagaacctggcggcagcgcaaaagatg

SEQ ID NO: 222458 - DNA, 103 bp, Artificial Sequence
  Synthetic Polynucleotide
taatacgactcactatagggcgattgacctagggagggattgctggagagaacagaggagactctccatgaatccctccaacctggcggcagcgcaaaagatg

SEQ ID NO: 222459 - DNA, 103 bp, Artificial Sequence
  Synthetic Polynucleotide
taatacgactcactatagggggtttgggagcgattgacctagggagggataacagaggagaatccctatgtaggtcaataacctggcggcagcgcaaaagatg

SEQ ID NO: 222460 - DNA, 103 bp, Artificial Sequence
  Synthetic Polynucleotide
taatacgactcactatagggcatggttaagggtttgggagcgattgacctaacagaggagaaggtcaatggctcccaaaaacctggcggcagcgcaaaagatg

SEQ ID NO: 222461 - DNA, 103 bp, Artificial Sequence
  Synthetic Polynucleotide
taatacgactcactatagggtggggagtctcatggttaagggtttgggagaacagaggagactcccaatgccttaaccaaacctggcggcagcgcaaaagatg

SEQ ID NO: 222462 - DNA, 103 bp, Artificial Sequence
  Synthetic Polynucleotide
taatacgactcactatagggatctggttcatggggagtctcatggttaagaacagaggagacttaacatggagactcccaacctggcggcagcgcaaaagatg

SEQ ID NO: 222463 - DNA, 103 bp, Artificial Sequence
  Synthetic Polynucleotide
taatacgactcactatagggtgatgtgacaatctggttcatggggagtctaacagaggagaagactcatgatgaaccagaacctggcggcagcgcaaaagatg

SEQ ID NO: 222464 - DNA, 103 bp, Artificial Sequence
  Synthetic Polynucleotide
taatacgactcactatagggcaatggtgactgatgtgacaatctggttcaaacagaggagatgaaccatgttgtcacataacctggcggcagcgcaaaagatg

SEQ ID NO: 222465 - DNA, 103 bp, Artificial Sequence
  Synthetic Polynucleotide
taatacgactcactatagggaagaacgcattgttcgcctcagccatattcaacagaggagagaatatatgtgaggcgaaaacctggcggcagcgcaaaagatg

SEQ ID NO: 222466 - DNA, 103 bp, Artificial Sequence
  Synthetic Polynucleotide
taatacgactcactatagggatgttggctgcaatggtgactgatgtgacaaacagaggagatgtcacatgagtcaccataacctggcggcagcgcaaaagatg

SEQ ID NO: 222467 - DNA, 103 bp, Artificial Sequence
  Synthetic Polynucleotide
taatacgactcactataggggttcgagggcatgttggctgcaatggtgacaacagaggagagtcaccatggcagccaacaacctggcggcagcgcaaaagatg

SEQ ID NO: 222468 - DNA, 103 bp, Artificial Sequence
  Synthetic Polynucleotide
taatacgactcactataggggagccccaatgttcgagggcatgttggctgaacagaggagacagccaatgtgccctcgaaacctggcggcagcgcaaaagatg

SEQ ID NO: 222469 - DNA, 103 bp, Artificial Sequence
  Synthetic Polynucleotide
taatacgactcactatagggcttatcagtggagccccaatgttcgagggcaacagaggagagccctcatgcattggggcaacctggcggcagcgcaaaagatg

SEQ ID NO: 222470 - DNA, 103 bp, Artificial Sequence
  Synthetic Polynucleotide
taatacgactcactatagggtcccatggagcttatcagtggagccccaataacagaggagaattgggatgccactgataaacctggcggcagcgcaaaagatg

SEQ ID NO: 222471 - DNA, 103 bp, Artificial Sequence
  Synthetic Polynucleotide
taatacgactcactatagggccatggtcgttcccatggagcttatcagtgaacagaggagacactgaatggctccatggaacctggcggcagcgcaaaagatg

SEQ ID NO: 222472 - DNA, 103 bp, Artificial Sequence
  Synthetic Polynucleotide
taatacgactcactataggggctgagccaaccatggtcgttcccatggagaacagaggagactccatatgaacgaccataacctggcggcagcgcaaaagatg

SEQ ID NO: 222473 - DNA, 103 bp, Artificial Sequence
  Synthetic Polynucleotide
taatacgactcactatagggggtggagggtgctgagccaaccatggtcgtaacagaggagaacgaccatggttggctcaaacctggcggcagcgcaaaagatg

SEQ ID NO: 222474 - DNA, 103 bp, Artificial Sequence
  Synthetic Polynucleotide
taatacgactcactataggggactcacttgggtggagggtgctgagccaaaacagaggagattggctatgcaccctccaaacctggcggcagcgcaaaagatg

SEQ ID NO: 222475 - DNA, 103 bp, Artificial Sequence
  Synthetic Polynucleotide
taatacgactcactatagggtgcaccgaaggactcacttgggtggagggtaacagaggagaaccctcatgccaagtgagaacctggcggcagcgcaaaagatg

SEQ ID NO: 222476 - DNA, 103 bp, Artificial Sequence
  Synthetic Polynucleotide
taatacgactcactatagggactggcagcgaagaacgcattgttcgcctcaacagaggagagaggcgatgaatgcgttcaacctggcggcagcgcaaaagatg

SEQ ID NO: 222477 - DNA, 103 bp, Artificial Sequence
  Synthetic Polynucleotide
taatacgactcactatagggctgctgggtttgcaccgaaggactcacttgaacagaggagacaagtgatgccttcggtgaacctggcggcagcgcaaaagatg

SEQ ID NO: 222478 - DNA, 103 bp, Artificial Sequence
  Synthetic Polynucleotide
taatacgactcactataggggcatctgatgctgctgggtttgcaccgaagaacagaggagacttcggatgaaacccagcaacctggcggcagcgcaaaagatg

SEQ ID NO: 222479 - DNA, 103 bp, Artificial Sequence
  Synthetic Polynucleotide
taatacgactcactatagggtgctgcaattgcatctgatgctgctgggttaacagaggagaaacccaatggcatcagataacctggcggcagcgcaaaagatg

SEQ ID NO: 222480 - DNA, 103 bp, Artificial Sequence
  Synthetic Polynucleotide
taatacgactcactatagggctgctgctgctgctgcaattgcatctgatgaacagaggagacatcagatgcaattgcagaacctggcggcagcgcaaaagatg

SEQ ID NO: 222481 - DNA, 103 bp, Artificial Sequence
  Synthetic Polynucleotide
taatacgactcactataggggttgttgctgctgctgctgctgctgcaattaacagaggagaaattgcatgagcagcagcaacctggcggcagcgcaaaagatg

SEQ ID NO: 222482 - DNA, 103 bp, Artificial Sequence
  Synthetic Polynucleotide
taatacgactcactatagggtgcatctgttgttgttgctgctgctgctgcaacagaggagagcagcaatggcagcaacaaacctggcggcagcgcaaaagatg

SEQ ID NO: 222483 - DNA, 103 bp, Artificial Sequence
  Synthetic Polynucleotide
taatacgactcactatagggctgcatctgttgcatctgttgttgttgctgaacagaggagacagcaaatgcaacagatgaacctggcggcagcgcaaaagatg

SEQ ID NO: 222484 - DNA, 103 bp, Artificial Sequence
  Synthetic Polynucleotide
taatacgactcactataggggttgctgctgctgcatctgttgcatctgttaacagaggagaaacagaatgaacagatgcaacctggcggcagcgcaaaagatg

SEQ ID NO: 222485 - DNA, 103 bp, Artificial Sequence
  Synthetic Polynucleotide
taatacgactcactatagggtgctgctggagttgctgctgctgcatctgtaacagaggagaacagatatggcagcagcaaacctggcggcagcgcaaaagatg

SEQ ID NO: 222486 - DNA, 103 bp, Artificial Sequence
  Synthetic Polynucleotide
taatacgactcactatagggatgcatttggtgctgctggagttgctgctgaacagaggagacagcagatgctccagcagaacctggcggcagcgcaaaagatg

SEQ ID NO: 222487 - DNA, 103 bp, Artificial Sequence
  Synthetic Polynucleotide
taatacgactcactatagggatgtctgctcactggcagcgaagaacgcataacagaggagaatgcgtatgtcgctgccaaacctggcggcagcgcaaaagatg

SEQ ID NO: 222488 - DNA, 103 bp, Artificial Sequence
  Synthetic Polynucleotide
taatacgactcactatagggggatttgctgatgcatttggtgctgctggaaacagaggagatccagcatgaccaaatgcaacctggcggcagcgcaaaagatg

SEQ ID NO: 222489 - DNA, 103 bp, Artificial Sequence
  Synthetic Polynucleotide
taatacgactcactatagggatctgctgctggatttgctgatgcatttggaacagaggagaccaaatatgtcagcaaataacctggcggcagcgcaaaagatg

SEQ ID NO: 222490 - DNA, 103 bp, Artificial Sequence
  Synthetic Polynucleotide
taatacgactcactatagggctgctgctgcatctgctgctggatttgctgaacagaggagacagcaaatgcagcagcagaacctggcggcagcgcaaaagatg

SEQ ID NO: 222491 - DNA, 103 bp, Artificial Sequence
  Synthetic Polynucleotide
taatacgactcactataggggctggaaatgctgctgctgcatctgctgctaacagaggagaagcagcatgtgcagcagcaacctggcggcagcgcaaaagatg

SEQ ID NO: 222492 - DNA, 103 bp, Artificial Sequence
  Synthetic Polynucleotide
taatacgactcactatagggtgcatgtggtgctggaaatgctgctgctgcaacagaggagagcagcaatggcatttccaaacctggcggcagcgcaaaagatg

SEQ ID NO: 222493 - DNA, 103 bp, Artificial Sequence
  Synthetic Polynucleotide
taatacgactcactatagggcaggtgctgctgcatgtggtgctggaaatgaacagaggagacatttcatgcaccacatgaacctggcggcagcgcaaaagatg

SEQ ID NO: 222494 - DNA, 103 bp, Artificial Sequence
  Synthetic Polynucleotide
taatacgactcactataggggctgctgctgcaggtgctgctgcatgtggtaacagaggagaaccacaatgagcagcaccaacctggcggcagcgcaaaagatg

SEQ ID NO: 222495 - DNA, 103 bp, Artificial Sequence
  Synthetic Polynucleotide
taatacgactcactatagggagatgctgctgctgctgctgcaggtgctgcaacagaggagagcagcaatggcagcagcaaacctggcggcagcgcaaaagatg

SEQ ID NO: 222496 - DNA, 103 bp, Artificial Sequence
  Synthetic Polynucleotide
taatacgactcactatagggttgctgctggagatgctgctgctgctgctgaacagaggagacagcagatgcagcagcataacctggcggcagcgcaaaagatg

SEQ ID NO: 222497 - DNA, 103 bp, Artificial Sequence
  Synthetic Polynucleotide
taatacgactcactataggggttgattaatttgctgctggagatgctgctaacagaggagaagcagcatgtccagcagcaacctggcggcagcgcaaaagatg

SEQ ID NO: 222498 - DNA, 103 bp, Artificial Sequence
  Synthetic Polynucleotide
taatacgactcactatagggggtgtgtggaatgtctgctcactggcagcgaacagaggagacgctgcatgtgagcagacaacctggcggcagcgcaaaagatg

SEQ ID NO: 222499 - DNA, 103 bp, Artificial Sequence
  Synthetic Polynucleotide
taatacgactcactatagggtgcagctgctgttgattaatttgctgctggaacagaggagaccagcaatgaattaatcaaacctggcggcagcgcaaaagatg

SEQ ID NO: 222500 - DNA, 103 bp, Artificial Sequence
  Synthetic Polynucleotide
taatacgactcactatagggcagctgctgctgcagctgctgttgattaataacagaggagaattaatatgcagcagctgaacctggcggcagcgcaaaagatg

SEQ ID NO: 222501 - DNA, 103 bp, Artificial Sequence
  Synthetic Polynucleotide
taatacgactcactatagggggcgctgctgcagctgctgctgcagctgctaacagaggagaagcagcatgagcagcagcaacctggcggcagcgcaaaagatg

SEQ ID NO: 222502 - DNA, 103 bp, Artificial Sequence
  Synthetic Polynucleotide
taatacgactcactatagggtgcagctggaggcgctgctgcagctgctgcaacagaggagagcagcaatggcagcagcgaacctggcggcagcgcaaaagatg

SEQ ID NO: 222503 - DNA, 103 bp, Artificial Sequence
  Synthetic Polynucleotide
taatacgactcactatagggttgcagctgctgcagctggaggcgctgctgaacagaggagacagcagatgctccagctgaacctggcggcagcgcaaaagatg

SEQ ID NO: 222504 - DNA, 103 bp, Artificial Sequence
  Synthetic Polynucleotide
taatacgactcactataggggctgcatgtgttgcagctgctgcagctggaaacagaggagatccagcatgagcagctgcaacctggcggcagcgcaaaagatg

SEQ ID NO: 222505 - DNA, 103 bp, Artificial Sequence
  Synthetic Polynucleotide
taatacgactcactatagggtgagactggtgctgcatgtgttgcagctgcaacagaggagagcagctatgacacatgcaaacctggcggcagcgcaaaagatg

SEQ ID NO: 222506 - DNA, 103 bp, Artificial Sequence
  Synthetic Polynucleotide
taatacgactcactatagggaggagaaggctgagactggtgctgcatgtgaacagaggagacacatgatgcaccagtctaacctggcggcagcgcaaaagatg

SEQ ID NO: 222507 - DNA, 103 bp, Artificial Sequence
  Synthetic Polynucleotide
taatacgactcactatagggagtgctgccgaggagaaggctgagactggtaacagaggagaaccagtatgagccttctcaacctggcggcagcgcaaaagatg

SEQ ID NO: 222508 - DNA, 103 bp, Artificial Sequence
  Synthetic Polynucleotide
taatacgactcactataggggcgacaggggagtgctgccgaggagaaggcaacagaggagagccttcatgtcggcagcaaacctggcggcagcgcaaaagatg

SEQ ID NO: 222509 - DNA, 103 bp, Artificial Sequence
  Synthetic Polynucleotide
taatacgactcactatagggcccaaggcttggtgtgtggaatgtctgctcaacagaggagagagcagatgttccacacaaacctggcggcagcgcaaaagatg

SEQ ID NO: 222510 - DNA, 103 bp, Artificial Sequence
  Synthetic Polynucleotide
taatacgactcactatagggtatctgagaggcgacaggggagtgctgccgaacagaggagacggcagatgtcccctgtcaacctggcggcagcgcaaaagatg

SEQ ID NO: 222511 - DNA, 103 bp, Artificial Sequence
  Synthetic Polynucleotide
taatacgactcactatagggtgggggatgttatctgagaggcgacaggggaacagaggagacccctgatgcctctcagaaacctggcggcagcgcaaaagatg

SEQ ID NO: 222512 - DNA, 103 bp, Artificial Sequence
  Synthetic Polynucleotide
taatacgactcactatagggatggcagggatgggggatgttatctgagagaacagaggagactctcaatgaacatccccaacctggcggcagcgcaaaagatg

SEQ ID NO: 222513 - DNA, 103 bp, Artificial Sequence
  Synthetic Polynucleotide
taatacgactcactatagggggggctcccgatggcagggatgggggatgtaacagaggagaacatccatgatccctgccaacctggcggcagcgcaaaagatg

SEQ ID NO: 222514 - DNA, 103 bp, Artificial Sequence
  Synthetic Polynucleotide
taatacgactcactatagggaggctggctgggggctcccgatggcagggaaacagaggagatccctgatgtcgggagccaacctggcggcagcgcaaaagatg

SEQ ID NO: 222515 - DNA, 103 bp, Artificial Sequence
  Synthetic Polynucleotide
taatacgactcactatagggtgctgctgagaggctggctgggggctcccgaacagaggagacgggagatgccagccagcaacctggcggcagcgcaaaagatg

SEQ ID NO: 222516 - DNA, 103 bp, Artificial Sequence
  Synthetic Polynucleotide
taatacgactcactatagggttgcgactggtgctgctgagaggctggctgaacagaggagacagccaatgtctcagcagaacctggcggcagcgcaaaagatg

SEQ ID NO: 222517 - DNA, 103 bp, Artificial Sequence
  Synthetic Polynucleotide
taatacgactcactataggggagactgtatttgcgactggtgctgctgagaacagaggagactcagcatgaccagtcgcaacctggcggcagcgcaaaagatg

SEQ ID NO: 222518 - DNA, 103 bp, Artificial Sequence
  Synthetic Polynucleotide
taatacgactcactataggggtctgtgtctgagactgtatttgcgactggaacagaggagaccagtcatgaatacagtcaacctggcggcagcgcaaaagatg

SEQ ID NO: 222519 - DNA, 103 bp, Artificial Sequence
  Synthetic Polynucleotide
taatacgactcactatagggtaatacttgagtctgtgtctgagactgtataacagaggagaatacagatgcagacacagaacctggcggcagcgcaaaagatg

SEQ ID NO: 222520 - DNA, 103 bp, Artificial Sequence
  Synthetic Polynucleotide
taatacgactcactatagggattcctcgtccccaaggcttggtgtgtggaaacagaggagatccacaatgcaagccttgaacctggcggcagcgcaaaagatg

SEQ ID NO: 222521 - DNA, 103 bp, Artificial Sequence
  Synthetic Polynucleotide
taatacgactcactatagggtgacctgcgataatacttgagtctgtgtctaacagaggagaagacacatgctcaagtataacctggcggcagcgcaaaagatg

SEQ ID NO: 222522 - DNA, 103 bp, Artificial Sequence
  Synthetic Polynucleotide
taatacgactcactatagggcagaaaatactgacctgcgataatacttgaaacagaggagatcaagtatgatcgcaggtaacctggcggcagcgcaaaagatg

SEQ ID NO: 222523 - DNA, 103 bp, Artificial Sequence
  Synthetic Polynucleotide
taatacgactcactatagggggaatttcgaattcctcgtccccaaggcttaacagaggagaaagcctatgggacgaggaaacctggcggcagcgcaaaagatg

SEQ ID NO: 222524 - DNA, 103 bp, Artificial Sequence
  Synthetic Polynucleotide
taatacgactcactatagggcgtgattggtggaatttcgaattcctcgtcaacagaggagagacgagatgttcgaaattaacctggcggcagcgcaaaagatg

SEQ ID NO: 222525 - DNA, 103 bp, Artificial Sequence
  Synthetic Polynucleotide
taatacgactcactatagggcagggtccccggccgccgcggggtagaaccaacagaggagaggttctatgccgcggcggaacctggcggcagcgcaaaagatg

SEQ ID NO: 222526 - DNA, 103 bp, Artificial Sequence
  Synthetic Polynucleotide
taatacgactcactatagggctggaggaggcgtgattggtggaatttcgaaacagaggagatcgaaaatgcaccaatcaaacctggcggcagcgcaaaagatg

SEQ ID NO: 222527 - DNA, 103 bp, Artificial Sequence
  Synthetic Polynucleotide
taatacgactcactataggggggtctgactctggaggaggcgtgattggtaacagaggagaaccaatatggcctcctccaacctggcggcagcgcaaaagatg

SEQ ID NO: 222528 - DNA, 103 bp, Artificial Sequence
  Synthetic Polynucleotide
taatacgactcactataggggcctagggcagggtctgactctggaggaggaacagaggagacctcctatggagtcagacaacctggcggcagcgcaaaagatg

SEQ ID NO: 222529 - DNA, 103 bp, Artificial Sequence
  Synthetic Polynucleotide
taatacgactcactatagggcatccggcatgcctagggcagggtctgactaacagaggagaagtcagatgctgccctagaacctggcggcagcgcaaaagatg

SEQ ID NO: 222530 - DNA, 103 bp, Artificial Sequence
  Synthetic Polynucleotide
taatacgactcactatagggggtagcagtacatccggcatgcctagggcaaacagaggagatgccctatgcatgccggaaacctggcggcagcgcaaaagatg

SEQ ID NO: 222531 - DNA, 103 bp, Artificial Sequence
  Synthetic Polynucleotide
taatacgactcactatagggggcttgaaagggtagcagtacatccggcataacagaggagaatgccgatggtactgctaaacctggcggcagcgcaaaagatg

SEQ ID NO: 222532 - DNA, 103 bp, Artificial Sequence
  Synthetic Polynucleotide
taatacgactcactataggggatcgctgagggcttgaaagggtagcagtaaacagaggagatactgcatgcctttcaagaacctggcggcagcgcaaaagatg

SEQ ID NO: 222533 - DNA, 103 bp, Artificial Sequence
  Synthetic Polynucleotide
taatacgactcactataggggaaggcaatggatcgctgagggcttgaaagaacagaggagactttcaatgcctcagcgaaacctggcggcagcgcaaaagatg

SEQ ID NO: 222534 - DNA, 103 bp, Artificial Sequence
  Synthetic Polynucleotide
taatacgactcactatagggacttccctgggaaggcaatggatcgctgagaacagaggagactcagcatgccattgcctaacctggcggcagcgcaaaagatg

SEQ ID NO: 222535 - DNA, 103 bp, Artificial Sequence
  Synthetic Polynucleotide
taatacgactcactataggggtgtgaattcacttccctgggaaggcaatgaacagaggagacattgcatgcccagggaaaacctggcggcagcgcaaaagatg

SEQ ID NO: 222536 - DNA, 103 bp, Artificial Sequence
  Synthetic Polynucleotide
taatacgactcactatagggtccaggctggcagggtccccggccgccgcgaacagaggagacgcggcatgcggggacccaacctggcggcagcgcaaaagatg

SEQ ID NO: 222537 - DNA, 103 bp, Artificial Sequence
  Synthetic Polynucleotide
taatacgactcactatagggggaaactggggtgtgaattcacttccctggaacagaggagaccagggatgtgaattcacaacctggcggcagcgcaaaagatg

SEQ ID NO: 222538 - DNA, 103 bp, Artificial Sequence
  Synthetic Polynucleotide
taatacgactcactataggggctttgagggggaaactggggtgtgaattcaacagaggagagaattcatgccccagtttaacctggcggcagcgcaaaagatg

SEQ ID NO: 222539 - DNA, 103 bp, Artificial Sequence
  Synthetic Polynucleotide
taatacgactcactatagggggaggtccaggctttgagggggaaactgggaacagaggagacccagtatgcccctcaaaaacctggcggcagcgcaaaagatg

SEQ ID NO: 222540 - DNA, 103 bp, Artificial Sequence
  Synthetic Polynucleotide
taatacgactcactataggggtaatggaagggaggtccaggctttgagggaacagaggagaccctcaatgcctggacctaacctggcggcagcgcaaaagatg

SEQ ID NO: 222541 - DNA, 103 bp, Artificial Sequence
  Synthetic Polynucleotide
taatacgactcactatagggtcttgagattgtaatggaagggaggtccagaacagaggagactggacatgccttccattaacctggcggcagcgcaaaagatg

SEQ ID NO: 222542 - DNA, 103 bp, Artificial Sequence
  Synthetic Polynucleotide
taatacgactcactatagggccacgagatttcttgagattgtaatggaagaacagaggagacttccaatgcaatctcaaaacctggcggcagcgcaaaagatg

SEQ ID NO: 222543 - DNA, 103 bp, Artificial Sequence
  Synthetic Polynucleotide
taatacgactcactatagggccatcttgttccacgagatttcttgagattaacagaggagaaatctcatgaaatctcgtaacctggcggcagcgcaaaagatg

SEQ ID NO: 222544 - DNA, 103 bp, Artificial Sequence
  Synthetic Polynucleotide
taatacgactcactatagggatgaagcacgccatcttgttccacgagattaacagaggagaaatctcatggaacaagataacctggcggcagcgcaaaagatg

SEQ ID NO: 222545 - DNA, 103 bp, Artificial Sequence
  Synthetic Polynucleotide
taatacgactcactatagggacccactgctatgaagcacgccatcttgttaacagaggagaaacaagatggcgtgcttcaacctggcggcagcgcaaaagatg

SEQ ID NO: 222546 - DNA, 103 bp, Artificial Sequence
  Synthetic Polynucleotide
taatacgactcactatagggtccatatgcaacccactgctatgaagcacgaacagaggagacgtgctatgtagcagtggaacctggcggcagcgcaaaagatg

SEQ ID NO: 222547 - DNA, 103 bp, Artificial Sequence
  Synthetic Polynucleotide
taatacgactcactatagggctgcgcgaagtccaggctggcagggtccccaacagaggagaggggacatggccagcctgaacctggcggcagcgcaaaagatg

SEQ ID NO: 222548 - DNA, 103 bp, Artificial Sequence
  Synthetic Polynucleotide
taatacgactcactataggggtggctctgatccatatgcaacccactgctaacagaggagaagcagtatgttgcatatgaacctggcggcagcgcaaaagatg

SEQ ID NO: 222549 - DNA, 103 bp, Artificial Sequence
  Synthetic Polynucleotide
taatacgactcactatagggacacttgtgtgtggctctgatccatatgcaaacagaggagatgcataatgatcagagccaacctggcggcagcgcaaaagatg

SEQ ID NO: 222550 - DNA, 103 bp, Artificial Sequence
  Synthetic Polynucleotide
taatacgactcactatagggcggtactgggacacttgtgtgtggctctgaaacagaggagatcagagatgcacacaagtaacctggcggcagcgcaaaagatg

SEQ ID NO: 222551 - DNA, 103 bp, Artificial Sequence
  Synthetic Polynucleotide
taatacgactcactataggggggatcctgccggtactgggacacttgtgtaacagaggagaacacaaatgtcccagtacaacctggcggcagcgcaaaagatg

SEQ ID NO: 222552 - DNA, 103 bp, Artificial Sequence
  Synthetic Polynucleotide
taatacgactcactatagggtgatcagggagggatcctgccggtactgggaacagaggagacccagtatgggcaggatcaacctggcggcagcgcaaaagatg

SEQ ID NO: 222553 - DNA, 103 bp, Artificial Sequence
  Synthetic Polynucleotide
taatacgactcactatagggatggaccgcatgatcagggagggatcctgcaacagaggagagcaggaatgctccctgataacctggcggcagcgcaaaagatg

SEQ ID NO: 222554 - DNA, 103 bp, Artificial Sequence
  Synthetic Polynucleotide
taatacgactcactatagggcatgtggacgatggaccgcatgatcagggaaacagaggagatccctgatgatgcggtccaacctggcggcagcgcaaaagatg

SEQ ID NO: 222555 - DNA, 103 bp, Artificial Sequence
  Synthetic Polynucleotide
taatacgactcactatagggcagcatcggtcatgtggacgatggaccgcaaacagaggagatgcggtatgtcgtccacaaacctggcggcagcgcaaaagatg

SEQ ID NO: 222556 - DNA, 103 bp, Artificial Sequence
  Synthetic Polynucleotide
taatacgactcactatagggccagaacgcgcagcatcggtcatgtggacgaacagaggagacgtccaatggaccgatgcaacctggcggcagcgcaaaagatg

SEQ ID NO: 222557 - DNA, 103 bp, Artificial Sequence
  Synthetic Polynucleotide
taatacgactcactatagggaggcatgaccccagaacgcgcagcatcggtaacagaggagaaccgatatggcgcgttctaacctggcggcagcgcaaaagatg

SEQ ID NO: 222558 - DNA, 103 bp, Artificial Sequence
  Synthetic Polynucleotide
taatacgactcactatagggaccccaggcactgcgcgaagtccaggctggaacagaggagaccagccatgacttcgcgcaacctggcggcagcgcaaaagatg

SEQ ID NO: 222559 - DNA, 103 bp, Artificial Sequence
  Synthetic Polynucleotide
taatacgactcactataggggctgggcaggaggcatgaccccagaacgcgaacagaggagacgcgttatggggtcatgcaacctggcggcagcgcaaaagatg

SEQ ID NO: 222560 - DNA, 103 bp, Artificial Sequence
  Synthetic Polynucleotide
taatacgactcactatagggatggtggtgagctgggcaggaggcatgaccaacagaggagaggtcatatgtcctgcccaaacctggcggcagcgcaaaagatg

SEQ ID NO: 222561 - DNA, 103 bp, Artificial Sequence
  Synthetic Polynucleotide
taatacgactcactatagggagactggttgatggtggtgagctgggcaggaacagaggagacctgccatgctcaccaccaacctggcggcagcgcaaaagatg

SEQ ID NO: 222562 - DNA, 103 bp, Artificial Sequence
  Synthetic Polynucleotide
taatacgactcactatagggcgctgagctgagactggttgatggtggtgaaacagaggagatcaccaatgtcaaccagtaacctggcggcagcgcaaaagatg

SEQ ID NO: 222563 - DNA, 103 bp, Artificial Sequence
  Synthetic Polynucleotide
taatacgactcactatagggcccaactgggcgctgagctgagactggttgaacagaggagacaaccaatgtcagctcagaacctggcggcagcgcaaaagatg

SEQ ID NO: 222564 - DNA, 103 bp, Artificial Sequence
  Synthetic Polynucleotide
taatacgactcactatagggcaaattcaaccccaactgggcgctgagctgaacagaggagacagctcatggcccagttgaacctggcggcagcgcaaaagatg

SEQ ID NO: 222565 - DNA, 103 bp, Artificial Sequence
  Synthetic Polynucleotide
taatacgactcactatagggtggcacctcccaaattcaaccccaactgggaacagaggagacccagtatgggttgaattaacctggcggcagcgcaaaagatg

SEQ ID NO: 222566 - DNA, 103 bp, Artificial Sequence
  Synthetic Polynucleotide
taatacgactcactatagggtgaggcatactggcacctcccaaattcaacaacagaggagagttgaaatggggaggtgcaacctggcggcagcgcaaaagatg

SEQ ID NO: 222567 - DNA, 103 bp, Artificial Sequence
  Synthetic Polynucleotide
taatacgactcactatagggaggagatgtgtgaggcatactggcacctccaacagaggagaggaggtatgagtatgcctaacctggcggcagcgcaaaagatg

SEQ ID NO: 222568 - DNA, 103 bp, Artificial Sequence
  Synthetic Polynucleotide
taatacgactcactatagggctggaggtgaaggagatgtgtgaggcatacaacagaggagagtatgcatgacacatctcaacctggcggcagcgcaaaagatg

SEQ ID NO: 222569 - DNA, 103 bp, Artificial Sequence
  Synthetic Polynucleotide
taatacgactcactatagggtagccgtagtaccccaggcactgcgcgaagaacagaggagacttcgcatggtgcctgggaacctggcggcagcgcaaaagatg

SEQ ID NO: 222570 - DNA, 103 bp, Artificial Sequence
  Synthetic Polynucleotide
taatacgactcactataggggatttgcttgctggaggtgaaggagatgtgaacagaggagacacatcatgttcacctccaacctggcggcagcgcaaaagatg

SEQ ID NO: 222571 - DNA, 103 bp, Artificial Sequence
  Synthetic Polynucleotide
taatacgactcactataggggggagtggctgatttgcttgctggaggtgaaacagaggagatcacctatggcaagcaaaaacctggcggcagcgcaaaagatg

SEQ ID NO: 222572 - DNA, 103 bp, Artificial Sequence
  Synthetic Polynucleotide
taatacgactcactatagggtggaaggggagggagtggctgatttgcttgaacagaggagacaagcaatgcagccactcaacctggcggcagcgcaaaagatg

SEQ ID NO: 222573 - DNA, 103 bp, Artificial Sequence
  Synthetic Polynucleotide
taatacgactcactatagggttgatggagctggaaggggagggagtggctaacagaggagaagccacatgctccccttcaacctggcggcagcgcaaaagatg

SEQ ID NO: 222574 - DNA, 103 bp, Artificial Sequence
  Synthetic Polynucleotide
taatacgactcactatagggatcctcttcattgatggagctggaaggggaaacagaggagatcccctatgagctccatcaacctggcggcagcgcaaaagatg

SEQ ID NO: 222575 - DNA, 103 bp, Artificial Sequence
  Synthetic Polynucleotide
taatacgactcactatagggcttcatcagcatcctcttcattgatggagcaacagaggagagctccaatgatgaagaggaacctggcggcagcgcaaaagatg

SEQ ID NO: 222576 - DNA, 103 bp, Artificial Sequence
  Synthetic Polynucleotide
taatacgactcactataggggctctgttggcttcatcagcatcctcttcaaacagaggagatgaagaatgtgctgatgaaacctggcggcagcgcaaaagatg

SEQ ID NO: 222577 - DNA, 103 bp, Artificial Sequence
  Synthetic Polynucleotide
taatacgactcactatagggctctccaatggctctgttggcttcatcagcaacagaggagagctgatatggccaacagaaacctggcggcagcgcaaaagatg

SEQ ID NO: 222578 - DNA, 103 bp, Artificial Sequence
  Synthetic Polynucleotide
taatacgactcactatagggcagctcttttctctccaatggctctgttggaacagaggagaccaacaatgccattggagaacctggcggcagcgcaaaagatg

SEQ ID NO: 222579 - DNA, 103 bp, Artificial Sequence
  Synthetic Polynucleotide
taatacgactcactataggggagtctggagcagctcttttctctccaatgaacagaggagacattggatggaaaagagcaacctggcggcagcgcaaaagatg

SEQ ID NO: 222580 - DNA, 103 bp, Artificial Sequence
  Synthetic Polynucleotide
taatacgactcactatagggaaacttgctgtagccgtagtaccccaggcaaacagaggagatgcctgatgtactacggcaacctggcggcagcgcaaaagatg

SEQ ID NO: 222581 - DNA, 103 bp, Artificial Sequence
  Synthetic Polynucleotide
taatacgactcactatagggcttcttgccagagtctggagcagctcttttaacagaggagaaaaagaatggctccagacaacctggcggcagcgcaaaagatg

SEQ ID NO: 222582 - DNA, 103 bp, Artificial Sequence
  Synthetic Polynucleotide
taatacgactcactataggggagtcttgggcttcttgccagagtctggagaacagaggagactccagatgctggcaagaaacctggcggcagcgcaaaagatg

SEQ ID NO: 222583 - DNA, 103 bp, Artificial Sequence
  Synthetic Polynucleotide
taatacgactcactatagggtttttctttggagtcttgggcttcttgccaaacagaggagatggcaaatggcccaagacaacctggcggcagcgcaaaagatg

SEQ ID NO: 222584 - DNA, 103 bp, Artificial Sequence
  Synthetic Polynucleotide
taatacgactcactatagggtttctttttctttttctttggagtcttgggaacagaggagacccaagatgccaaagaaaaacctggcggcagcgcaaaagatg

SEQ ID NO: 222585 - DNA, 103 bp, Artificial Sequence
  Synthetic Polynucleotide
taatacgactcactatagggcattgggatctttctttttctttttctttgaacagaggagacaaagaatgagaaaaagaaacctggcggcagcgcaaaagatg

SEQ ID NO: 222586 - DNA, 103 bp, Artificial Sequence
  Synthetic Polynucleotide
taatacgactcactatagggttctgtggctcattgggatctttctttttcaacagaggagagaaaaaatgagatcccaaaacctggcggcagcgcaaaagatg

SEQ ID NO: 222587 - DNA, 103 bp, Artificial Sequence
  Synthetic Polynucleotide
taatacgactcactatagggtgacactggcttctgtggctcattgggatcaacagaggagagatcccatggagccacagaacctggcggcagcgcaaaagatg

SEQ ID NO: 222588 - DNA, 103 bp, Artificial Sequence
  Synthetic Polynucleotide
taatacgactcactataggggggcatatgctgacactggcttctgtggctaacagaggagaagccacatgagccagtgtaacctggcggcagcgcaaaagatg

SEQ ID NO: 222589 - DNA, 103 bp, Artificial Sequence
  Synthetic Polynucleotide
taatacgactcactatagggctgaaaaacagggcatatgctgacactggcaacagaggagagccagtatgagcatatgcaacctggcggcagcgcaaaagatg

SEQ ID NO: 222590 - DNA, 103 bp, Artificial Sequence
  Synthetic Polynucleotide
taatacgactcactatagggctgtgtgtctctgaaaaacagggcatatgcaacagaggagagcatatatgctgtttttcaacctggcggcagcgcaaaagatg

SEQ ID NO: 222591 - DNA, 103 bp, Artificial Sequence
  Synthetic Polynucleotide
taatacgactcactatagggtattatttccaaacttgctgtagccgtagtaacagaggagaactacgatgacagcaagtaacctggcggcagcgcaaaagatg

SEQ ID NO: 222592 - DNA, 103 bp, Artificial Sequence
  Synthetic Polynucleotide
taatacgactcactatagggtaattgcagcctgtgtgtctctgaaaaacaaacagaggagatgttttatggagacacacaacctggcggcagcgcaaaagatg

SEQ ID NO: 222593 - DNA, 103 bp, Artificial Sequence
  Synthetic Polynucleotide
taatacgactcactatagggttttgacctttaattgcagcctgtgtgtctaacagaggagaagacacatgggctgcaataacctggcggcagcgcaaaagatg

SEQ ID NO: 222594 - DNA, 103 bp, Artificial Sequence
  Synthetic Polynucleotide
taatacgactcactatagggtgcattggggttttgacctttaattgcagcaacagaggagagctgcaatgaaaggtcaaaacctggcggcagcgcaaaagatg

SEQ ID NO: 222595 - DNA, 103 bp, Artificial Sequence
  Synthetic Polynucleotide
taatacgactcactatagggctccaaaggttgcattggggttttgaccttaacagaggagaaaggtcatgaccccaatgaacctggcggcagcgcaaaagatg

SEQ ID NO: 222596 - DNA, 103 bp, Artificial Sequence
  Synthetic Polynucleotide
taatacgactcactatagggtttgagacctctccaaaggttgcattggggaacagaggagaccccaaatgaacctttggaacctggcggcagcgcaaaagatg

SEQ ID NO: 222597 - DNA, 103 bp, Artificial Sequence
  Synthetic Polynucleotide
taatacgactcactatagggtgctacaatttttgagacctctccaaaggtaacagaggagaacctttatggaggtctcaaacctggcggcagcgcaaaagatg

SEQ ID NO: 222598 - DNA, 103 bp, Artificial Sequence
  Synthetic Polynucleotide
taatacgactcactatagggcccacatagatgctacaatttttgagacctaacagaggagaaggtctatgaaattgtagaacctggcggcagcgcaaaagatg

SEQ ID NO: 222599 - DNA, 103 bp, Artificial Sequence
  Synthetic Polynucleotide
taatacgactcactatagggccaaggctgtcccacatagatgctacaattaacagaggagaaattgtatgatctatgtgaacctggcggcagcgcaaaagatg

SEQ ID NO: 222600 - DNA, 103 bp, Artificial Sequence
  Synthetic Polynucleotide
taatacgactcactatagggttgttcttctccaaggctgtcccacatagaaacagaggagatctatgatggacagccttaacctggcggcagcgcaaaagatg

SEQ ID NO: 222601 - DNA, 103 bp, Artificial Sequence
  Synthetic Polynucleotide
taatacgactcactatagggatacctgcttttgttcttctccaaggctgtaacagaggagaacagccatggagaagaacaacctggcggcagcgcaaaagatg

SEQ ID NO: 222602 - DNA, 103 bp, Artificial Sequence
  Synthetic Polynucleotide
taatacgactcactatagggatatagttattattatttccaaacttgctgaacagaggagacagcaaatgtggaaataaaacctggcggcagcgcaaaagatg

SEQ ID NO: 222603 - DNA, 103 bp, Artificial Sequence
  Synthetic Polynucleotide
taatacgactcactatagggttccttttatatacctgcttttgttcttctaacagaggagaagaagaatgaaagcaggtaacctggcggcagcgcaaaagatg

SEQ ID NO: 222604 - DNA, 103 bp, Artificial Sequence
  Synthetic Polynucleotide
taatacgactcactatagggagcttctgttttccttttatatacctgcttaacagaggagaaagcagatgtataaaaggaacctggcggcagcgcaaaagatg

SEQ ID NO: 222605 - DNA, 103 bp, Artificial Sequence
  Synthetic Polynucleotide
taatacgactcactatagggcttttttggcagcttctgttttccttttataacagaggagaataaaaatgaaacagaagaacctggcggcagcgcaaaagatg

SEQ ID NO: 222606 - DNA, 103 bp, Artificial Sequence
  Synthetic Polynucleotide
taatacgactcactatagggttcaggtattcttttttggcagcttctgttaacagaggagaaacagaatgtgccaaaaaaacctggcggcagcgcaaaagatg

SEQ ID NO: 222607 - DNA, 103 bp, Artificial Sequence
  Synthetic Polynucleotide
taatacgactcactatagggcgccagggccttcaggtattcttttttggcaacagaggagagccaaaatggaatacctgaacctggcggcagcgcaaaagatg

SEQ ID NO: 222608 - DNA, 103 bp, Artificial Sequence
  Synthetic Polynucleotide
taatacgactcactatagggccctgtatgccgccagggccttcaggtattaacagaggagaaataccatgaggccctggaacctggcggcagcgcaaaagatg

SEQ ID NO: 222609 - DNA, 103 bp, Artificial Sequence
  Synthetic Polynucleotide
taatacgactcactatagggacgaggctggccctgtatgccgccagggccaacagaggagaggccctatgggcatacagaacctggcggcagcgcaaaagatg

SEQ ID NO: 222610 - DNA, 103 bp, Artificial Sequence
  Synthetic Polynucleotide
taatacgactcactatagggagccttagaaacgaggctggccctgtatgcaacagaggagagcatacatggccagcctcaacctggcggcagcgcaaaagatg

SEQ ID NO: 222611 - DNA, 103 bp, Artificial Sequence
  Synthetic Polynucleotide
taatacgactcactatagggactcagcagcagccttagaaacgaggctggaacagaggagaccagccatgtttctaaggaacctggcggcagcgcaaaagatg

SEQ ID NO: 222612 - DNA, 103 bp, Artificial Sequence
  Synthetic Polynucleotide
taatacgactcactataggggcttctgctgactcagcagcagccttagaaaacagaggagattctaaatgtgctgctgaaacctggcggcagcgcaaaagatg

SEQ ID NO: 222613 - DNA, 103 bp, Artificial Sequence
  Synthetic Polynucleotide
taatacgactcactataggggacgctaggatctgactgcggctcctccataacagaggagaatggagatgccgcagtcaaacctggcggcagcgcaaaagatg

SEQ ID NO: 222614 - DNA, 103 bp, Artificial Sequence
  Synthetic Polynucleotide
taatacgactcactatagggcattgcttgggacggcaagggggacagaacaacagaggagagttctgatgcccttgccgaacctggcggcagcgcaaaagatg

SEQ ID NO: 222615 - DNA, 103 bp, Artificial Sequence
  Synthetic Polynucleotide
taatacgactcactatagggcatctcgaagcgctcacgcccacggatctgaacagaggagacagatcatggggcgtgagaacctggcggcagcgcaaaagatg

SEQ ID NO: 222616 - DNA, 103 bp, Artificial Sequence
  Synthetic Polynucleotide
taatacgactcactataggggctctcggaacatctcgaagcgctcacgccaacagaggagaggcgtgatggcttcgagaaacctggcggcagcgcaaaagatg

SEQ ID NO: 222617 - DNA, 103 bp, Artificial Sequence
  Synthetic Polynucleotide
taatacgactcactataggggcctcattcagctctcggaacatctcgaagaacagaggagacttcgaatggttccgagaaacctggcggcagcgcaaaagatg

SEQ ID NO: 222618 - DNA, 103 bp, Artificial Sequence
  Synthetic Polynucleotide
taatacgactcactataggggagttccaaggcctcattcagctctcggaaaacagaggagattccgaatgctgaatgagaacctggcggcagcgcaaaagatg

SEQ ID NO: 222619 - DNA, 103 bp, Artificial Sequence
  Synthetic Polynucleotide
taatacgactcactataggggggcatccttgagttccaaggcctcattcaaacagaggagatgaatgatgccttggaacaacctggcggcagcgcaaaagatg

SEQ ID NO: 222620 - DNA, 103 bp, Artificial Sequence
  Synthetic Polynucleotide
taatacgactcactatagggttcccagcctgggcatccttgagttccaagaacagaggagacttggaatgcaaggatgcaacctggcggcagcgcaaaagatg

SEQ ID NO: 222621 - DNA, 103 bp, Artificial Sequence
  Synthetic Polynucleotide
taatacgactcactatagggccctggctccttcccagcctgggcatccttaacagaggagaaaggatatgcaggctgggaacctggcggcagcgcaaaagatg
